United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 35

SEQ ID NO: 1553306 - RNA, 19 nt, Human adenovirus C
ucacgcucgcuugguccug

SEQ ID NO: 1553307 - RNA, 17 nt, Human adenovirus C
gaagccucagaagaaac

SEQ ID NO: 1553308 - RNA, 12 nt, Human adenovirus C
ugcagagccagc

SEQ ID NO: 1553309 - RNA, 20 nt, Human adenovirus C
agcucggcggugaccugcac

SEQ ID NO: 1553310 - RNA, 13 nt, Human adenovirus C
gugcagcagagcg

SEQ ID NO: 1553311 - RNA, 18 nt, Human adenovirus C
cgccuuuuagcugcaaac

SEQ ID NO: 1553312 - RNA, 18 nt, Human adenovirus C
ccacaccuacagccugag

SEQ ID NO: 1553313 - RNA, 16 nt, Human adenovirus C
ccgcgccugcugggcg

SEQ ID NO: 1553314 - RNA, 17 nt, Human adenovirus C
gauggcacccaaaaaga

SEQ ID NO: 1553315 - RNA, 21 nt, Human adenovirus C
gcgcacacguggcggccgccg

SEQ ID NO: 1553316 - RNA, 15 nt, Human adenovirus C
aacauucccagcugc

SEQ ID NO: 1553317 - RNA, 14 nt, Human adenovirus C
cgccugcugggcga

SEQ ID NO: 1553318 - RNA, 23 nt, Human adenovirus C
cuccagagcgcccuccaccuuca

SEQ ID NO: 1553319 - RNA, 20 nt, Human adenovirus C
accaaccuggaccggcuggu

SEQ ID NO: 1553320 - RNA, 15 nt, Human adenovirus C
gguucugcagagcuc

SEQ ID NO: 1553321 - RNA, 22 nt, Human adenovirus C
cggauagcaagacucugacaaa

SEQ ID NO: 1553322 - RNA, 12 nt, Human adenovirus C
gccgugaacccc

SEQ ID NO: 1553323 - RNA, 13 nt, Human adenovirus C
agugcugggccag

SEQ ID NO: 1553324 - RNA, 19 nt, Human adenovirus C
caaccuaaaggagcugcag

SEQ ID NO: 1553325 - RNA, 22 nt, Human adenovirus C
gcaccaccggcggcggcgcgcg

SEQ ID NO: 1553326 - RNA, 14 nt, Human adenovirus C
uuugacucuucugu

SEQ ID NO: 1553327 - RNA, 17 nt, Human adenovirus C
gccccguccugcccgca

SEQ ID NO: 1553328 - RNA, 15 nt, Human adenovirus C
gucagcguagucugg

SEQ ID NO: 1553329 - RNA, 14 nt, Human adenovirus C
cauaaaaaaaucca

SEQ ID NO: 1553330 - RNA, 17 nt, Human adenovirus C
gcucugcaacaagaaaa

SEQ ID NO: 1553331 - RNA, 19 nt, Human adenovirus C
cacuaccgcgcgcccuggg

SEQ ID NO: 1553332 - RNA, 14 nt, Human adenovirus C
uuugcuuuccugag

SEQ ID NO: 1553333 - RNA, 18 nt, Human adenovirus C
cuucucccacccccacug

SEQ ID NO: 1553334 - RNA, 14 nt, Human adenovirus C
ccgccucagcuaca

SEQ ID NO: 1553335 - RNA, 13 nt, Human adenovirus C
cauuacccagggc

SEQ ID NO: 1553336 - RNA, 18 nt, Human adenovirus C
ggaggauaggguggccuu

SEQ ID NO: 1553337 - RNA, 14 nt, Human adenovirus C
ccaucugagcgggg

SEQ ID NO: 1553338 - RNA, 12 nt, Human adenovirus C
cagccgcagcgc

SEQ ID NO: 1553339 - RNA, 15 nt, Human adenovirus C
cuccacgccuuugcc

SEQ ID NO: 1553340 - RNA, 15 nt, Human adenovirus C
ucgugcgcaccaccg

SEQ ID NO: 1553341 - RNA, 22 nt, Human adenovirus C
agcggcaacccuuccaggaggg

SEQ ID NO: 1553342 - RNA, 16 nt, Human adenovirus C
acccggcacugccgcc

SEQ ID NO: 1553343 - RNA, 20 nt, Human adenovirus C
acggccgccagagcuuccac

SEQ ID NO: 1553344 - RNA, 11 nt, Human adenovirus C
aacccuucagg

SEQ ID NO: 1553345 - RNA, 20 nt, Human adenovirus C
ugaaaugugcgauauuacca

SEQ ID NO: 1553346 - RNA, 20 nt, Human adenovirus C
gcccuggaggcagcuggggc

SEQ ID NO: 1553347 - RNA, 13 nt, Human adenovirus C
cagcuguuggggu

SEQ ID NO: 1553348 - RNA, 20 nt, Human adenovirus C
uacaagcuacccacccagcg

SEQ ID NO: 1553349 - RNA, 20 nt, Human adenovirus C
uuguccuccgggcacagcag

SEQ ID NO: 1553350 - RNA, 13 nt, Human adenovirus C
cagaggacagcaa

SEQ ID NO: 1553351 - RNA, 16 nt, Human adenovirus C
guuggacgcuggaaga

SEQ ID NO: 1553352 - RNA, 20 nt, Human adenovirus C
gccgcaccgugcgcuuaccu

SEQ ID NO: 1553353 - RNA, 16 nt, Human adenovirus C
uuuaccccccacccuu

SEQ ID NO: 1553354 - RNA, 17 nt, Human adenovirus C
ggcgcaggcggcggcaa

SEQ ID NO: 1553355 - RNA, 21 nt, Human adenovirus C
gugcuuguagguuaccucugc

SEQ ID NO: 1553356 - RNA, 13 nt, Human adenovirus C
gccgaaaacaggg

SEQ ID NO: 1553357 - RNA, 20 nt, Human adenovirus C
cacagaacaugaaaagcuua

SEQ ID NO: 1553358 - RNA, 17 nt, Human adenovirus C
caacccuuccaggaggg

SEQ ID NO: 1553359 - RNA, 15 nt, Human adenovirus C
ugcaaucccugaagc

SEQ ID NO: 1553360 - RNA, 12 nt, Human adenovirus C
ggccuacccgca

SEQ ID NO: 1553361 - RNA, 12 nt, Human adenovirus C
ccguucccagca

SEQ ID NO: 1553362 - RNA, 14 nt, Human adenovirus C
cggucaccagaggc

SEQ ID NO: 1553363 - RNA, 15 nt, Human adenovirus C
gcuggaagccaugcu

SEQ ID NO: 1553364 - RNA, 17 nt, Human adenovirus C
uucagccugaauaacaa

SEQ ID NO: 1553365 - RNA, 23 nt, Human adenovirus C
gaccacuuacuggcugcagccag

SEQ ID NO: 1553366 - RNA, 18 nt, Human adenovirus C
gagcagcggcagacaugc

SEQ ID NO: 1553367 - RNA, 13 nt, Human adenovirus C
cccgugggcucgu

SEQ ID NO: 1553368 - RNA, 21 nt, Human adenovirus C
caucaugucgcugacugcgcg

SEQ ID NO: 1553369 - RNA, 14 nt, Human adenovirus C
ccagacacacaucu

SEQ ID NO: 1553370 - RNA, 15 nt, Human adenovirus C
ggcggggaccacaga

SEQ ID NO: 1553371 - RNA, 13 nt, Human adenovirus C
cuugccuaccacu

SEQ ID NO: 1553372 - RNA, 14 nt, Human adenovirus C
aauuaccugggcgg

SEQ ID NO: 1553373 - RNA, 17 nt, Human adenovirus C
ggaacgaagcugaugcu

SEQ ID NO: 1553374 - RNA, 14 nt, Human adenovirus C
cauaaaagaagcaa

SEQ ID NO: 1553375 - RNA, 15 nt, Human adenovirus C
gccagaaggcgcucg

SEQ ID NO: 1553376 - RNA, 22 nt, Human adenovirus C
cagacuauuuuuuccagaccag

SEQ ID NO: 1553377 - RNA, 21 nt, Human adenovirus C
cacgggcuguacauccugcac

SEQ ID NO: 1553378 - RNA, 15 nt, Human adenovirus C
caggucaucgcgccg

SEQ ID NO: 1553379 - RNA, 18 nt, Human adenovirus C
ggccagcacgaaggaggc

SEQ ID NO: 1553380 - RNA, 17 nt, Human adenovirus C
cgcauagccgggucagg

SEQ ID NO: 1553381 - RNA, 15 nt, Human adenovirus C
cagggcaaccugggc

SEQ ID NO: 1553382 - RNA, 15 nt, Human adenovirus C
ggaauacaacauggc

SEQ ID NO: 1553383 - RNA, 23 nt, Human adenovirus C
auccugccgugccaaccgcagcc

SEQ ID NO: 1553384 - RNA, 16 nt, Human adenovirus C
auacuuuccaggagau

SEQ ID NO: 1553385 - RNA, 18 nt, Human adenovirus C
uguccuaucaacucuugc

SEQ ID NO: 1553386 - RNA, 12 nt, Human adenovirus C
cuggaccucccg

SEQ ID NO: 1553387 - RNA, 17 nt, Human adenovirus C
gccauuuuuucuggggu

SEQ ID NO: 1553388 - RNA, 13 nt, Human adenovirus C
ccugcugcacgca

SEQ ID NO: 1553389 - RNA, 22 nt, Human adenovirus C
cagagcaaaaaguccgugcgcu

SEQ ID NO: 1553390 - RNA, 21 nt, Human adenovirus C
cauaaacacgcuggacauaaa

SEQ ID NO: 1553391 - RNA, 18 nt, Human adenovirus C
gcuggugggggaugugcg

SEQ ID NO: 1553392 - RNA, 16 nt, Human adenovirus C
gacccuggugcugcca

SEQ ID NO: 1553393 - RNA, 15 nt, Human adenovirus C
uucugcccgccaccu

SEQ ID NO: 1553394 - RNA, 19 nt, Human adenovirus C
ggugggccgcggggguguc

SEQ ID NO: 1553395 - RNA, 13 nt, Human adenovirus C
aguacgagccaga

SEQ ID NO: 1553396 - RNA, 21 nt, Human adenovirus C
cagugcaacaugaccaaggac

SEQ ID NO: 1553397 - RNA, 17 nt, Human adenovirus C
cucgcucccaccaugcg

SEQ ID NO: 1553398 - RNA, 15 nt, Human adenovirus C
ccuucagcuggggcu

SEQ ID NO: 1553399 - RNA, 24 nt, Human adenovirus C
uccaugcccuucucccacgcagac

SEQ ID NO: 1553400 - RNA, 17 nt, Human adenovirus C
cuuagauuugaccaaaa

SEQ ID NO: 1553401 - RNA, 15 nt, Human adenovirus C
gcgcccacaccuaca

SEQ ID NO: 1553402 - RNA, 22 nt, Human adenovirus C
agauuauccaaaaccucaaaau

SEQ ID NO: 1553403 - RNA, 17 nt, Human adenovirus C
accgucaagaaaaacac

SEQ ID NO: 1553404 - RNA, 13 nt, Human adenovirus C
accgucacccagc

SEQ ID NO: 1553405 - RNA, 15 nt, Human adenovirus C
augucgcccucuucg

SEQ ID NO: 1553406 - RNA, 18 nt, Human adenovirus C
ccgccgccacccacggac

SEQ ID NO: 1553407 - RNA, 16 nt, Human adenovirus C
auuuccaggggcuggu

SEQ ID NO: 1553408 - RNA, 14 nt, Human adenovirus C
aagcgcgcuggagc

SEQ ID NO: 1553409 - RNA, 16 nt, Human adenovirus C
uuugccacacaaccuu

SEQ ID NO: 1553410 - RNA, 14 nt, Human adenovirus C
ccagaacgaccaca

SEQ ID NO: 1553411 - RNA, 16 nt, Human adenovirus C
gucuugucaugccugg

SEQ ID NO: 1553412 - RNA, 15 nt, Human adenovirus C
gcugggaugggugca

SEQ ID NO: 1553413 - RNA, 16 nt, Human adenovirus C
cugccgccgccgccac

SEQ ID NO: 1553414 - RNA, 22 nt, Human adenovirus C
cgacgcggcgguugaucuccug

SEQ ID NO: 1553415 - RNA, 19 nt, Human adenovirus C
caagaacaagagcugaaaa

SEQ ID NO: 1553416 - RNA, 14 nt, Human adenovirus C
cugcagcacagcac

SEQ ID NO: 1553417 - RNA, 22 nt, Human adenovirus C
aauuccuccggaaacagggacg

SEQ ID NO: 1553418 - RNA, 14 nt, Human adenovirus C
ccuugccgugcuug

SEQ ID NO: 1553419 - RNA, 21 nt, Human adenovirus C
ccaccgcagaauaagccacac

SEQ ID NO: 1553420 - RNA, 18 nt, Human adenovirus C
acgggcggcaugcgucgu

SEQ ID NO: 1553421 - RNA, 21 nt, Human adenovirus C
gccuucccccguaacauccug

SEQ ID NO: 1553422 - RNA, 16 nt, Human adenovirus C
cugggaguugcgcgcc

SEQ ID NO: 1553423 - RNA, 14 nt, Human adenovirus C
uggacaccucccac

SEQ ID NO: 1553424 - RNA, 18 nt, Human adenovirus C
cggcugacgcggcggcag

SEQ ID NO: 1553425 - RNA, 21 nt, Human adenovirus C
agcuaaagcgggucaaaaaga

SEQ ID NO: 1553426 - RNA, 15 nt, Human adenovirus C
cuggccccgcgacac

SEQ ID NO: 1553427 - RNA, 13 nt, Human adenovirus C
cccggcgccagca

SEQ ID NO: 1553428 - RNA, 14 nt, Human adenovirus C
gcucgccugcgcca

SEQ ID NO: 1553429 - RNA, 13 nt, Human adenovirus C
cuugaucugcugg

SEQ ID NO: 1553430 - RNA, 12 nt, Human adenovirus C
gaccccauggca

SEQ ID NO: 1553431 - RNA, 22 nt, Human adenovirus C
gcaugaagggcacgagcugcuu

SEQ ID NO: 1553432 - RNA, 20 nt, Human adenovirus C
gcuggaagccaugcucagaa

SEQ ID NO: 1553433 - RNA, 13 nt, Human adenovirus C
ccgaacagggcgg

SEQ ID NO: 1553434 - RNA, 22 nt, Human adenovirus C
uccgcgcgcggcggucggagcu

SEQ ID NO: 1553435 - RNA, 15 nt, Human adenovirus C
ccgcagccacagugc

SEQ ID NO: 1553436 - RNA, 17 nt, Human adenovirus C
cuccugaaucuggcgcc

SEQ ID NO: 1553437 - RNA, 21 nt, Human adenovirus C
gcaccccuauucgacaccacc

SEQ ID NO: 1553438 - RNA, 15 nt, Human adenovirus C
ucucaaaagcgggca

SEQ ID NO: 1553439 - RNA, 21 nt, Human adenovirus C
cauaaaguugcgugugaugcg

SEQ ID NO: 1553440 - RNA, 15 nt, Human adenovirus C
ucuuauuaaaaccau

SEQ ID NO: 1553441 - RNA, 22 nt, Human adenovirus C
acuacauggacaaaagaugaaa

SEQ ID NO: 1553442 - RNA, 18 nt, Human adenovirus C
cgagagccggccuggacc

SEQ ID NO: 1553443 - RNA, 20 nt, Human adenovirus C
ccgugcugaaacgcagcauc

SEQ ID NO: 1553444 - RNA, 21 nt, Human adenovirus C
gccaaaaaucuuugagggucu

SEQ ID NO: 1553445 - RNA, 14 nt, Human adenovirus C
gggccggaccuggg

SEQ ID NO: 1553446 - RNA, 19 nt, Human adenovirus C
acgcugcccgagggcaacu

SEQ ID NO: 1553447 - RNA, 15 nt, Human adenovirus C
cuuaaugaccagaca

SEQ ID NO: 1553448 - RNA, 20 nt, Human adenovirus C
gaggccauaggucaggcgca

SEQ ID NO: 1553449 - RNA, 13 nt, Human adenovirus C
gacuggaagaugu

SEQ ID NO: 1553450 - RNA, 23 nt, Human adenovirus C
uugacaugaccaugaagaucugg

SEQ ID NO: 1553451 - RNA, 16 nt, Human adenovirus C
uacacaggguugcagc

SEQ ID NO: 1553452 - RNA, 17 nt, Human adenovirus C
ccgcggcgacaggucag

SEQ ID NO: 1553453 - RNA, 23 nt, Human adenovirus C
gcacggcguccggcucaccaccc

SEQ ID NO: 1553454 - RNA, 17 nt, Human adenovirus C
ggugaaggucagcugca

SEQ ID NO: 1553455 - RNA, 20 nt, Human adenovirus C
agacucuguuuggauuuuga

SEQ ID NO: 1553456 - RNA, 19 nt, Human adenovirus C
ccgacggaggagcaacagc

SEQ ID NO: 1553457 - RNA, 20 nt, Human adenovirus C
acuaaaccuaugauacuuac

SEQ ID NO: 1553458 - RNA, 20 nt, Human adenovirus C
gcuccugucgccauccugug

SEQ ID NO: 1553459 - RNA, 19 nt, Human adenovirus C
uacuggucguugccagaca

SEQ ID NO: 1553460 - RNA, 17 nt, Human adenovirus C
cuugggcgcgagaaaua

SEQ ID NO: 1553461 - RNA, 19 nt, Human adenovirus C
ugcaagucuagcgccugcu

SEQ ID NO: 1553462 - RNA, 14 nt, Human adenovirus C
cagcgccaaggcua

SEQ ID NO: 1553463 - RNA, 23 nt, Human adenovirus C
cugaacuguuuccagaacugaga

SEQ ID NO: 1553464 - RNA, 23 nt, Human adenovirus C
cuacagcccgggggaggcaagca

SEQ ID NO: 1553465 - RNA, 19 nt, Human adenovirus C
ugcugcccacgcuugcacc

SEQ ID NO: 1553466 - RNA, 17 nt, Human adenovirus C
cgcguccaucuggucag

SEQ ID NO: 1553467 - RNA, 19 nt, Human adenovirus C
cagcaauaugagcgguggc

SEQ ID NO: 1553468 - RNA, 18 nt, Human adenovirus C
gcgccaaaaacuggugcu

SEQ ID NO: 1553469 - RNA, 20 nt, Human adenovirus C
ccuccgggcacagcagcgca

SEQ ID NO: 1553470 - RNA, 20 nt, Human adenovirus C
ugcauguuucuccacgccuu

SEQ ID NO: 1553471 - RNA, 19 nt, Human adenovirus C
cgcuggacaugaccgcgcg

SEQ ID NO: 1553472 - RNA, 18 nt, Human adenovirus C
auggcagcaaggccugga

SEQ ID NO: 1553473 - RNA, 12 nt, Human adenovirus C
acugaggaugaa

SEQ ID NO: 1553474 - RNA, 12 nt, Human adenovirus C
ccgcguacgagc

SEQ ID NO: 1553475 - RNA, 13 nt, Human adenovirus C
gcgcgggcaggag

SEQ ID NO: 1553476 - RNA, 11 nt, Human adenovirus C
agagggcaugg

SEQ ID NO: 1553477 - RNA, 16 nt, Human adenovirus C
cgucuagggcgcagua

SEQ ID NO: 1553478 - RNA, 23 nt, Human adenovirus C
ucagcgaccgcgagcugaugcac

SEQ ID NO: 1553479 - RNA, 22 nt, Human adenovirus C
ccugaacuaccagaacgaccac

SEQ ID NO: 1553480 - RNA, 22 nt, Human adenovirus C
augugaccgaggagcugaggcc

SEQ ID NO: 1553481 - RNA, 18 nt, Human adenovirus C
cccuccgcacccacuauc

SEQ ID NO: 1553482 - RNA, 17 nt, Human adenovirus C
cuguccauggucuggag

SEQ ID NO: 1553483 - RNA, 16 nt, Human adenovirus C
gacgagucggugagcu

SEQ ID NO: 1553484 - RNA, 15 nt, Human adenovirus C
ucaacgcugguggcu

SEQ ID NO: 1553485 - RNA, 21 nt, Human adenovirus C
ccgcggcugacgcggcggcag

SEQ ID NO: 1553486 - RNA, 22 nt, Human adenovirus C
ccagggugcgcuugaggcuggu

SEQ ID NO: 1553487 - RNA, 14 nt, Human adenovirus C
aaaagaaccugccu

SEQ ID NO: 1553488 - RNA, 17 nt, Human adenovirus C
cuugaagucgcaguugg

SEQ ID NO: 1553489 - RNA, 22 nt, Human adenovirus C
uccagacaucauuuugcugcca

SEQ ID NO: 1553490 - RNA, 21 nt, Human adenovirus C
cacgcaaccgcgcccaggcgg

SEQ ID NO: 1553491 - RNA, 18 nt, Human adenovirus C
aaugaaaacggugccaug

SEQ ID NO: 1553492 - RNA, 21 nt, Human adenovirus C
aggaucaccuacgaugaccug

SEQ ID NO: 1553493 - RNA, 15 nt, Human adenovirus C
cuucacggacagugg

SEQ ID NO: 1553494 - RNA, 21 nt, Human adenovirus C
aacggacuaucgcaacaccac

SEQ ID NO: 1553495 - RNA, 22 nt, Human adenovirus C
gacgagcauacuuuccaggaga

SEQ ID NO: 1553496 - RNA, 13 nt, Human adenovirus C
acgcgcgcgcagc

SEQ ID NO: 1553497 - RNA, 14 nt, Human adenovirus C
aggcugcuguccaa

SEQ ID NO: 1553498 - RNA, 18 nt, Human adenovirus C
aaggccggaaaccucacc

SEQ ID NO: 1553499 - RNA, 14 nt, Human adenovirus C
cgguagaggggcca

SEQ ID NO: 1553500 - RNA, 19 nt, Human adenovirus C
aacuuugauaauacugcca

SEQ ID NO: 1553501 - RNA, 15 nt, Human adenovirus C
gccgcgcgcuggggc

SEQ ID NO: 1553502 - RNA, 23 nt, Human adenovirus C
ccaggcgcggcggcugcugcgcu

SEQ ID NO: 1553503 - RNA, 23 nt, Human adenovirus C
cgcugaggccgaggcagcggcag

SEQ ID NO: 1553504 - RNA, 17 nt, Human adenovirus C
auaaacacgcuggacau

SEQ ID NO: 1553505 - RNA, 19 nt, Human adenovirus C
cggcccguagccaguggca

SEQ ID NO: 1553506 - RNA, 18 nt, Human adenovirus C
caguagucggugcucguc

SEQ ID NO: 1553507 - RNA, 15 nt, Human adenovirus C
aggaugcggggugga

SEQ ID NO: 1553508 - RNA, 15 nt, Human adenovirus C
gcgcgucccugcgcc

SEQ ID NO: 1553509 - RNA, 16 nt, Human adenovirus C
cacuguaccgcgaggc

SEQ ID NO: 1553510 - RNA, 17 nt, Human adenovirus C
cagacaaugcagaaaca

SEQ ID NO: 1553511 - RNA, 13 nt, Human adenovirus C
ccgccgcagcagc

SEQ ID NO: 1553512 - RNA, 20 nt, Human adenovirus C
cuaucaggguccagaggacc

SEQ ID NO: 1553513 - RNA, 21 nt, Human adenovirus C
uaccuguguggaagccuggac

SEQ ID NO: 1553514 - RNA, 21 nt, Human adenovirus C
caagccccacugaccgugcaa

SEQ ID NO: 1553515 - RNA, 16 nt, Human adenovirus C
acuccucacuuaaaaa

SEQ ID NO: 1553516 - RNA, 22 nt, Human adenovirus C
gcaacaucaacaacagcugccg

SEQ ID NO: 1553517 - RNA, 18 nt, Human adenovirus C
cacgaccccuggagaggg

SEQ ID NO: 1553518 - RNA, 14 nt, Human adenovirus C
accuuaaucaaacu

SEQ ID NO: 1553519 - RNA, 18 nt, Human adenovirus C
gggugguggaccuggcca

SEQ ID NO: 1553520 - RNA, 21 nt, Human adenovirus C
guagacaaggccugcagaccg

SEQ ID NO: 1553521 - RNA, 15 nt, Human adenovirus C
agacagugucuccag

SEQ ID NO: 1553522 - RNA, 20 nt, Human adenovirus C
guccaggcgacgagcggccg

SEQ ID NO: 1553523 - RNA, 20 nt, Human adenovirus C
ccuggcgcggcuaggagcgc

SEQ ID NO: 1553524 - RNA, 23 nt, Human adenovirus C
gcccguucaugggaaacuggcaa

SEQ ID NO: 1553525 - RNA, 20 nt, Human adenovirus C
ugacaagcgcuuuccaggcu

SEQ ID NO: 1553526 - RNA, 14 nt, Human adenovirus C
cagcucggcgguga

SEQ ID NO: 1553527 - RNA, 14 nt, Human adenovirus C
cccagaagacgagc

SEQ ID NO: 1553528 - RNA, 17 nt, Human adenovirus C
cacgaucggcaggcuca

SEQ ID NO: 1553529 - RNA, 21 nt, Human adenovirus C
aaagcgcgguucacccuggcu

SEQ ID NO: 1553530 - RNA, 21 nt, Human adenovirus C
ugguaguuaagagagcugcag

SEQ ID NO: 1553531 - RNA, 18 nt, Human adenovirus C
cuccucaggggagcugag

SEQ ID NO: 1553532 - RNA, 16 nt, Human adenovirus C
agccgcgcgcuggggc

SEQ ID NO: 1553533 - RNA, 19 nt, Human adenovirus C
cuagcgccugcugccaugc

SEQ ID NO: 1553534 - RNA, 17 nt, Human adenovirus C
uggccuugcaggcgcag

SEQ ID NO: 1553535 - RNA, 21 nt, Human adenovirus C
gccaaucaagcagguggcacc

SEQ ID NO: 1553536 - RNA, 17 nt, Human adenovirus C
gaggccggccuggucua

SEQ ID NO: 1553537 - RNA, 14 nt, Human adenovirus C
cgcccccuuugagu

SEQ ID NO: 1553538 - RNA, 21 nt, Human adenovirus C
guccuccgcguugcucagggc

SEQ ID NO: 1553539 - RNA, 17 nt, Human adenovirus C
gcagguacgccugcagg

SEQ ID NO: 1553540 - RNA, 16 nt, Human adenovirus C
cgccuaccaggcaagc

SEQ ID NO: 1553541 - RNA, 19 nt, Human adenovirus C
auuuccauuuuaugaaaug

SEQ ID NO: 1553542 - RNA, 13 nt, Human adenovirus C
ggguuugccuccc

SEQ ID NO: 1553543 - RNA, 18 nt, Human adenovirus C
gcacgacguaaccacaga

SEQ ID NO: 1553544 - RNA, 21 nt, Human adenovirus C
acacccagcagaaaccugugc

SEQ ID NO: 1553545 - RNA, 19 nt, Human adenovirus C
gguggcacuuaggccagau

SEQ ID NO: 1553546 - RNA, 21 nt, Human adenovirus C
uggcgguguguucugccacga

SEQ ID NO: 1553547 - RNA, 15 nt, Human adenovirus C
ggcagaagcugccgc

SEQ ID NO: 1553548 - RNA, 15 nt, Human adenovirus C
aaggcuaauggcaau

SEQ ID NO: 1553549 - RNA, 15 nt, Human adenovirus C
auuucaacaaagcag

SEQ ID NO: 1553550 - RNA, 16 nt, Human adenovirus C
cuggaacagcagcaca

SEQ ID NO: 1553551 - RNA, 20 nt, Human adenovirus C
cccaaaauguaaccacuguu

SEQ ID NO: 1553552 - RNA, 22 nt, Human adenovirus C
uaacaggagggggguguuccua

SEQ ID NO: 1553553 - RNA, 12 nt, Human adenovirus C
acaacucagggg

SEQ ID NO: 1553554 - RNA, 20 nt, Human adenovirus C
uuuuacccacccaaagcaga

SEQ ID NO: 1553555 - RNA, 16 nt, Human adenovirus C
uucccaggauggcacc

SEQ ID NO: 1553556 - RNA, 22 nt, Human adenovirus C
ugaauguuguacagguggcuga

SEQ ID NO: 1553557 - RNA, 16 nt, Human adenovirus C
cugcgcgcuggccagg

SEQ ID NO: 1553558 - RNA, 16 nt, Human adenovirus C
cgaggcauucagggau

SEQ ID NO: 1553559 - RNA, 17 nt, Human adenovirus C
ggccggaccugggcugg

SEQ ID NO: 1553560 - RNA, 20 nt, Human adenovirus C
cguggcuacaccuaccgccc

SEQ ID NO: 1553561 - RNA, 15 nt, Human adenovirus C
gagcgacgaccuggg

SEQ ID NO: 1553562 - RNA, 15 nt, Human adenovirus C
gcagcggcagacaug

SEQ ID NO: 1553563 - RNA, 19 nt, Human adenovirus C
uauacagacuugagaggcc

SEQ ID NO: 1553564 - RNA, 20 nt, Human adenovirus C
gaaucaggcuguagacagcu

SEQ ID NO: 1553565 - RNA, 21 nt, Human adenovirus C
cgcauugcguaccucaggcac

SEQ ID NO: 1553566 - RNA, 15 nt, Human adenovirus C
gcgcugaccugcgcu

SEQ ID NO: 1553567 - RNA, 12 nt, Human adenovirus C
uaccgcgcggcg

SEQ ID NO: 1553568 - RNA, 21 nt, Human adenovirus C
gaaacacaagcuaaaccugua

SEQ ID NO: 1553569 - RNA, 15 nt, Human adenovirus C
ccauucagaccgugg

SEQ ID NO: 1553570 - RNA, 14 nt, Human adenovirus C
uuugaagagcuuuu

SEQ ID NO: 1553571 - RNA, 15 nt, Human adenovirus C
gcaccgcccgcagca

SEQ ID NO: 1553572 - RNA, 20 nt, Human adenovirus C
cgccgccguuagcccaagag

SEQ ID NO: 1553573 - RNA, 18 nt, Human adenovirus C
ccuccaccuucagccuca

SEQ ID NO: 1553574 - RNA, 22 nt, Human adenovirus C
uuaaguucaugucgcuguccag

SEQ ID NO: 1553575 - RNA, 14 nt, Human adenovirus C
agcuggugcugcgc

SEQ ID NO: 1553576 - RNA, 14 nt, Human adenovirus C
aaccuauggagaaa

SEQ ID NO: 1553577 - RNA, 16 nt, Human adenovirus C
acgggcagccuggagg

SEQ ID NO: 1553578 - RNA, 17 nt, Human adenovirus C
caaacaauacuaaaaaa

SEQ ID NO: 1553579 - RNA, 16 nt, Human adenovirus C
gagccgguguccacgc

SEQ ID NO: 1553580 - RNA, 21 nt, Human adenovirus C
ugacaagcgcuuuccaggcuu

SEQ ID NO: 1553581 - RNA, 12 nt, Human adenovirus C
gcaaggccuggc

SEQ ID NO: 1553582 - RNA, 19 nt, Human adenovirus C
cgcgggcggagggugccag

SEQ ID NO: 1553583 - RNA, 14 nt, Human adenovirus C
ccccguccugcccg

SEQ ID NO: 1553584 - RNA, 21 nt, Human adenovirus C
cauucagauaaugacugcaaa

SEQ ID NO: 1553585 - RNA, 21 nt, Human adenovirus C
gugugaugcggaagggucccg

SEQ ID NO: 1553586 - RNA, 21 nt, Human adenovirus C
uccggcagcagccgcaggcca

SEQ ID NO: 1553587 - RNA, 16 nt, Human adenovirus C
ugcgcuaugugcagca

SEQ ID NO: 1553588 - RNA, 15 nt, Human adenovirus C
agcaggagcgcuggg

SEQ ID NO: 1553589 - RNA, 20 nt, Human adenovirus C
caccggggcgcgcugcggcu

SEQ ID NO: 1553590 - RNA, 15 nt, Human adenovirus C
cucgcguccaggcca

SEQ ID NO: 1553591 - RNA, 16 nt, Human adenovirus C
ggcccauuacaguguc

SEQ ID NO: 1553592 - RNA, 15 nt, Human adenovirus C
gcacccuccccuucu

SEQ ID NO: 1553593 - RNA, 15 nt, Human adenovirus C
uggcaccgggacugg

SEQ ID NO: 1553594 - RNA, 21 nt, Human adenovirus C
ccaugauuacuaaacuuggag

SEQ ID NO: 1553595 - RNA, 20 nt, Human adenovirus C
cgcuggccgaaaacagggcc

SEQ ID NO: 1553596 - RNA, 18 nt, Human adenovirus C
gaagccccucaucggcug

SEQ ID NO: 1553597 - RNA, 22 nt, Human adenovirus C
cuucacgaucuuggccuugcua

SEQ ID NO: 1553598 - RNA, 19 nt, Human adenovirus C
acucagggucgcaggggca

SEQ ID NO: 1553599 - RNA, 13 nt, Human adenovirus C
guaccugccagac

SEQ ID NO: 1553600 - RNA, 16 nt, Human adenovirus C
caaauagaugagccuc

SEQ ID NO: 1553601 - RNA, 14 nt, Human adenovirus C
caaauacaaaagca

SEQ ID NO: 1553602 - RNA, 16 nt, Human adenovirus C
gcacuuaaccuacccc

SEQ ID NO: 1553603 - RNA, 23 nt, Human adenovirus C
ucauuuuuguuuugcugauuuuu

SEQ ID NO: 1553604 - RNA, 16 nt, Human adenovirus C
aucuggcgccucugcg

SEQ ID NO: 1553605 - RNA, 19 nt, Human adenovirus C
ccgcguccaucuggucaga

SEQ ID NO: 1553606 - RNA, 17 nt, Human adenovirus C
aguaacucuacaagcuu

SEQ ID NO: 1553607 - RNA, 23 nt, Human adenovirus C
ggcaggaggacacgggcagccug

SEQ ID NO: 1553608 - RNA, 14 nt, Human adenovirus C
ugcagcacagcacc

SEQ ID NO: 1553609 - RNA, 16 nt, Human adenovirus C
cuacuuccgcagccac

SEQ ID NO: 1553610 - RNA, 16 nt, Human adenovirus C
cccaaaaagaagcugc

SEQ ID NO: 1553611 - RNA, 15 nt, Human adenovirus C
agagcaagagcagcg

SEQ ID NO: 1553612 - RNA, 19 nt, Human adenovirus C
gugguagauggccuggccu

SEQ ID NO: 1553613 - RNA, 21 nt, Human adenovirus C
ucugcagcgccagugcgccau

SEQ ID NO: 1553614 - RNA, 12 nt, Human adenovirus C
agcggccgccgc

SEQ ID NO: 1553615 - RNA, 20 nt, Human adenovirus C
gggacuugcggcuggagcug

SEQ ID NO: 1553616 - RNA, 17 nt, Human adenovirus C
ugucguuucucagcagc

SEQ ID NO: 1553617 - RNA, 13 nt, Human adenovirus C
gucgucagcgcca

SEQ ID NO: 1553618 - RNA, 20 nt, Human adenovirus C
gauccuaacucugcagaccu

SEQ ID NO: 1553619 - RNA, 15 nt, Human adenovirus C
cgccuacccccggcu

SEQ ID NO: 1553620 - RNA, 14 nt, Human adenovirus C
ccuaaaggagcugc

SEQ ID NO: 1553621 - RNA, 22 nt, Human adenovirus C
cuuagaaccaaaguugcaggag

SEQ ID NO: 1553622 - RNA, 21 nt, Human adenovirus C
ggccgcgauguuuagcugcac

SEQ ID NO: 1553623 - RNA, 18 nt, Human adenovirus C
gacugcgcguaacccuga

SEQ ID NO: 1553624 - RNA, 12 nt, Human adenovirus C
gcaacgccacaa

SEQ ID NO: 1553625 - RNA, 20 nt, Human adenovirus C
gccgcacugggcgcaccacc

SEQ ID NO: 1553626 - RNA, 13 nt, Human adenovirus C
cgcuggccagcac

SEQ ID NO: 1553627 - RNA, 14 nt, Human adenovirus C
agugcagacuuuua

SEQ ID NO: 1553628 - RNA, 16 nt, Human adenovirus C
agugcuuaaaaaaaca

SEQ ID NO: 1553629 - RNA, 22 nt, Human adenovirus C
ugacauccgcggcgugcuggac

SEQ ID NO: 1553630 - RNA, 21 nt, Human adenovirus C
ugggagacgacgugcuguuga

SEQ ID NO: 1553631 - RNA, 18 nt, Human adenovirus C
auuuggguaacaggaggg

SEQ ID NO: 1553632 - RNA, 16 nt, Human adenovirus C
gccgcaggccccgcag

SEQ ID NO: 1553633 - RNA, 18 nt, Human adenovirus C
aaccgcgguugugcaggg

SEQ ID NO: 1553634 - RNA, 14 nt, Human adenovirus C
cacgcuggccagca

SEQ ID NO: 1553635 - RNA, 14 nt, Human adenovirus C
uggaggaggcgcgc

SEQ ID NO: 1553636 - RNA, 19 nt, Human adenovirus C
cgauggauuccucugggac

SEQ ID NO: 1553637 - RNA, 17 nt, Human adenovirus C
acucuaugucuuuuaca

SEQ ID NO: 1553638 - RNA, 16 nt, Human adenovirus C
uccauccggcccaggg

SEQ ID NO: 1553639 - RNA, 21 nt, Human adenovirus C
aggcuacuaagaaaacacaug

SEQ ID NO: 1553640 - RNA, 24 nt, Human adenovirus C
gcggccguucucgcgggggcgcag

SEQ ID NO: 1553641 - RNA, 22 nt, Human adenovirus C
ugauaggcgauuucggccauga

SEQ ID NO: 1553642 - RNA, 19 nt, Human adenovirus C
uggaagacugggacagccu

SEQ ID NO: 1553643 - RNA, 18 nt, Human adenovirus C
uguaugcuauauuucaac

SEQ ID NO: 1553644 - RNA, 16 nt, Human adenovirus C
cucccggccacuaccc

SEQ ID NO: 1553645 - RNA, 21 nt, Human adenovirus C
ugcgccgugccgccagcgguc

SEQ ID NO: 1553646 - RNA, 21 nt, Human adenovirus C
ccgcacuggcuaccgcccccu

SEQ ID NO: 1553647 - RNA, 23 nt, Human adenovirus C
cgcccguucaugggaaacuggca

SEQ ID NO: 1553648 - RNA, 16 nt, Human adenovirus C
caaucuccucuuccau

SEQ ID NO: 1553649 - RNA, 17 nt, Human adenovirus C
acggaggauaggguggc

SEQ ID NO: 1553650 - RNA, 13 nt, Human adenovirus C
gugcagcugaugg

SEQ ID NO: 1553651 - RNA, 23 nt, Human adenovirus C
gauuucugccagcgccugcacug

SEQ ID NO: 1553652 - RNA, 14 nt, Human adenovirus C
aagggugcagcuga

SEQ ID NO: 1553653 - RNA, 21 nt, Human adenovirus C
gcagaaaccugugcugccagg

SEQ ID NO: 1553654 - RNA, 17 nt, Human adenovirus C
acaagcgagugguggcu

SEQ ID NO: 1553655 - RNA, 14 nt, Human adenovirus C
augaagaagaggaa

SEQ ID NO: 1553656 - RNA, 15 nt, Human adenovirus C
gcugaagcagggcca

SEQ ID NO: 1553657 - RNA, 12 nt, Human adenovirus C
aaccuguugcau

SEQ ID NO: 1553658 - RNA, 12 nt, Human adenovirus C
ggccugcagacc

SEQ ID NO: 1553659 - RNA, 21 nt, Human adenovirus C
uuaucucaaauacaaaagcag

SEQ ID NO: 1553660 - RNA, 21 nt, Human adenovirus C
uuuagagaacacuggcaccuu

SEQ ID NO: 1553661 - RNA, 21 nt, Human adenovirus C
gccugcgcggccuuccggagc

SEQ ID NO: 1553662 - RNA, 15 nt, Human adenovirus C
aacgggguguuugac

SEQ ID NO: 1553663 - RNA, 21 nt, Human adenovirus C
aaugucguuucucagcagcug

SEQ ID NO: 1553664 - RNA, 14 nt, Human adenovirus C
cauucccagcugcu

SEQ ID NO: 1553665 - RNA, 14 nt, Human adenovirus C
cacuccugcgccgu

SEQ ID NO: 1553666 - RNA, 13 nt, Human adenovirus C
ugccgcggcagaa

SEQ ID NO: 1553667 - RNA, 23 nt, Human adenovirus C
ggagcgcaaccuaaaggagcugc

SEQ ID NO: 1553668 - RNA, 23 nt, Human adenovirus C
gucuagggcgcaguaguccaggg

SEQ ID NO: 1553669 - RNA, 16 nt, Human adenovirus C
aaaguuuuuugccauu

SEQ ID NO: 1553670 - RNA, 17 nt, Human adenovirus C
ccggccggacugcggcg

SEQ ID NO: 1553671 - RNA, 12 nt, Human adenovirus C
caaauccuuuug

SEQ ID NO: 1553672 - RNA, 14 nt, Human adenovirus C
ugcaaacggacccg

SEQ ID NO: 1553673 - RNA, 17 nt, Human adenovirus C
gcuccguccugcaggaa

SEQ ID NO: 1553674 - RNA, 21 nt, Human adenovirus C
cugcgcgugcccgugcgcacc

SEQ ID NO: 1553675 - RNA, 13 nt, Human adenovirus C
ugcaugcccaggc

SEQ ID NO: 1553676 - RNA, 19 nt, Human adenovirus C
aggcacuaaagcaaggccu

SEQ ID NO: 1553677 - RNA, 16 nt, Human adenovirus C
cccuaucagcagccgc

SEQ ID NO: 1553678 - RNA, 18 nt, Human adenovirus C
ugccgccugcugcacgca

SEQ ID NO: 1553679 - RNA, 13 nt, Human adenovirus C
cugaagcagggcc

SEQ ID NO: 1553680 - RNA, 21 nt, Human adenovirus C
gaauaugcccuacauccuucc

SEQ ID NO: 1553681 - RNA, 20 nt, Human adenovirus C
gccggagaucuauggccccc

SEQ ID NO: 1553682 - RNA, 22 nt, Human adenovirus C
gcacugccgcccaacgcgcggc

SEQ ID NO: 1553683 - RNA, 22 nt, Human adenovirus C
gguguguucugccacgaagaag

SEQ ID NO: 1553684 - RNA, 11 nt, Human adenovirus C
ccaaguacaga

SEQ ID NO: 1553685 - RNA, 16 nt, Human adenovirus C
cugauugccaggggca

SEQ ID NO: 1553686 - RNA, 12 nt, Human adenovirus C
ugcuugcuugca

SEQ ID NO: 1553687 - RNA, 19 nt, Human adenovirus C
accaccauccuaaaccagc

SEQ ID NO: 1553688 - RNA, 18 nt, Human adenovirus C
ccgcguccggcucgcucc

SEQ ID NO: 1553689 - RNA, 13 nt, Human adenovirus C
acaggccgcguca

SEQ ID NO: 1553690 - RNA, 21 nt, Human adenovirus C
aacuggccccaaacucccaug

SEQ ID NO: 1553691 - RNA, 20 nt, Human adenovirus C
uugcccaggaauaaagaauc

SEQ ID NO: 1553692 - RNA, 22 nt, Human adenovirus C
agaugccgcggugcaggcggcc

SEQ ID NO: 1553693 - RNA, 16 nt, Human adenovirus C
gcagaggcggcgcugc

SEQ ID NO: 1553694 - RNA, 20 nt, Human adenovirus C
acgagcauacuuuccaggag

SEQ ID NO: 1553695 - RNA, 22 nt, Human adenovirus C
cgacgggccgaacacucgugcu

SEQ ID NO: 1553696 - RNA, 23 nt, Human adenovirus C
cuccagauaucaacccaauaaaa

SEQ ID NO: 1553697 - RNA, 17 nt, Human adenovirus C
uagcgacuuugugccca

SEQ ID NO: 1553698 - RNA, 13 nt, Human adenovirus C
cugccaccucccu

SEQ ID NO: 1553699 - RNA, 17 nt, Human adenovirus C
caaauccauacacaaau

SEQ ID NO: 1553700 - RNA, 17 nt, Human adenovirus C
gcccuucucggccggca

SEQ ID NO: 1553701 - RNA, 16 nt, Human adenovirus C
ccuggcuggcacgggc

SEQ ID NO: 1553702 - RNA, 22 nt, Human adenovirus C
cugaccacuuacuggcugcagc

SEQ ID NO: 1553703 - RNA, 22 nt, Human adenovirus C
ugacgaccgcgcacaaggaagc

SEQ ID NO: 1553704 - RNA, 17 nt, Human adenovirus C
gccguagcgccauugcu

SEQ ID NO: 1553705 - RNA, 15 nt, Human adenovirus C
cgcggcugacgcggc

SEQ ID NO: 1553706 - RNA, 14 nt, Human adenovirus C
cauguugugcagaa

SEQ ID NO: 1553707 - RNA, 16 nt, Human adenovirus C
cuucauucagccgccg

SEQ ID NO: 1553708 - RNA, 12 nt, Human adenovirus C
cgaccacagcaa

SEQ ID NO: 1553709 - RNA, 15 nt, Human adenovirus C
ucugcccgccaccug

SEQ ID NO: 1553710 - RNA, 16 nt, Human adenovirus C
acuggggcagggaccc

SEQ ID NO: 1553711 - RNA, 17 nt, Human adenovirus C
cuaccgcgucaggaggg

SEQ ID NO: 1553712 - RNA, 22 nt, Human adenovirus C
ccauuacaauaggaaacaaaaa

SEQ ID NO: 1553713 - RNA, 21 nt, Human adenovirus C
cgguucaucccuguggaccgc

SEQ ID NO: 1553714 - RNA, 14 nt, Human adenovirus C
agggcacgagcugc

SEQ ID NO: 1553715 - RNA, 16 nt, Human adenovirus C
gcggcgacaggucagg

SEQ ID NO: 1553716 - RNA, 23 nt, Human adenovirus C
gggaauuugagccccucgccugg

SEQ ID NO: 1553717 - RNA, 12 nt, Human adenovirus C
agcccacccugc

SEQ ID NO: 1553718 - RNA, 18 nt, Human adenovirus C
ugccaccucccucccaac

SEQ ID NO: 1553719 - RNA, 17 nt, Human adenovirus C
gcagacgcgccagaccc

SEQ ID NO: 1553720 - RNA, 21 nt, Human adenovirus C
gcacuucuucuucuccuuccu

SEQ ID NO: 1553721 - RNA, 18 nt, Human adenovirus C
agcagguuccugagcagc

SEQ ID NO: 1553722 - RNA, 19 nt, Human adenovirus C
cucgcauuccacgagccag

SEQ ID NO: 1553723 - RNA, 19 nt, Human adenovirus C
aacagcgaaaaugaaaguc

SEQ ID NO: 1553724 - RNA, 20 nt, Human adenovirus C
gcgacgggguaacgcccagc

SEQ ID NO: 1553725 - RNA, 15 nt, Human adenovirus C
ccuccuccugccagg

SEQ ID NO: 1553726 - RNA, 22 nt, Human adenovirus C
ucugugccuuaggguugccgcc

SEQ ID NO: 1553727 - RNA, 15 nt, Human adenovirus C
uguauuuuuuccagg

SEQ ID NO: 1553728 - RNA, 16 nt, Human adenovirus C
auaucgcccagcaaua

SEQ ID NO: 1553729 - RNA, 16 nt, Human adenovirus C
ugucgcccucuucggc

SEQ ID NO: 1553730 - RNA, 12 nt, Human adenovirus C
cccccuccucag

SEQ ID NO: 1553731 - RNA, 16 nt, Human adenovirus C
cguccgcauaccccgc

SEQ ID NO: 1553732 - RNA, 23 nt, Human adenovirus C
gccgcggugcaggcggccgcugc

SEQ ID NO: 1553733 - RNA, 18 nt, Human adenovirus C
agccagaggacggcgagu

SEQ ID NO: 1553734 - RNA, 20 nt, Human adenovirus C
gcccgagggccgcuggcugc

SEQ ID NO: 1553735 - RNA, 17 nt, Human adenovirus C
gccccaggcuggggaga

SEQ ID NO: 1553736 - RNA, 19 nt, Human adenovirus C
ugccgcggggacaggagga

SEQ ID NO: 1553737 - RNA, 23 nt, Human adenovirus C
auagauacggaggauaggguggc

SEQ ID NO: 1553738 - RNA, 19 nt, Human adenovirus C
ggccagcuguuggggugag

SEQ ID NO: 1553739 - RNA, 19 nt, Human adenovirus C
accgggacugggcgugcag

SEQ ID NO: 1553740 - RNA, 12 nt, Human adenovirus C
cggcgccagugg

SEQ ID NO: 1553741 - RNA, 22 nt, Human adenovirus C
cgcuggaagacguugaagcugg

SEQ ID NO: 1553742 - RNA, 17 nt, Human adenovirus C
uggcgccuucagcuggg

SEQ ID NO: 1553743 - RNA, 13 nt, Human adenovirus C
ggccuccccuucu

SEQ ID NO: 1553744 - RNA, 22 nt, Human adenovirus C
cggcguaagcgguuaggcugga

SEQ ID NO: 1553745 - RNA, 12 nt, Human adenovirus C
uuccagaacuga

SEQ ID NO: 1553746 - RNA, 14 nt, Human adenovirus C
cugcugccaugcgc

SEQ ID NO: 1553747 - RNA, 11 nt, Human adenovirus C
ccgggcagcag

SEQ ID NO: 1553748 - RNA, 16 nt, Human adenovirus C
cuuuccuuccucccaa

SEQ ID NO: 1553749 - RNA, 15 nt, Human adenovirus C
cccggcggugcgggc

SEQ ID NO: 1553750 - RNA, 19 nt, Human adenovirus C
gcgcuggccgcucuucauu

SEQ ID NO: 1553751 - RNA, 13 nt, Human adenovirus C
accguaggagggg

SEQ ID NO: 1553752 - RNA, 23 nt, Human adenovirus C
cacugugccccccagguccaggc

SEQ ID NO: 1553753 - RNA, 14 nt, Human adenovirus C
caggcgaccgcgcg

SEQ ID NO: 1553754 - RNA, 16 nt, Human adenovirus C
uugcccgugcacucca

SEQ ID NO: 1553755 - RNA, 17 nt, Human adenovirus C
aauacuaaaaaacugga

SEQ ID NO: 1553756 - RNA, 13 nt, Human adenovirus C
uaucgacccgcga

SEQ ID NO: 1553757 - RNA, 21 nt, Human adenovirus C
agguggcuauaggacugaugc

SEQ ID NO: 1553758 - RNA, 17 nt, Human adenovirus C
gaacgaccggcaaggca

SEQ ID NO: 1553759 - RNA, 13 nt, Human adenovirus C
ucauuccacgcuc

SEQ ID NO: 1553760 - RNA, 15 nt, Human adenovirus C
cugcugcagccgcag

SEQ ID NO: 1553761 - RNA, 15 nt, Human adenovirus C
caggaauuguugcua

SEQ ID NO: 1553762 - RNA, 20 nt, Human adenovirus C
gcaauaacacaggcuggggc

SEQ ID NO: 1553763 - RNA, 23 nt, Human adenovirus C
gccguugauguuguggcccacga

SEQ ID NO: 1553764 - RNA, 20 nt, Human adenovirus C
gcgccacaauguggccuccg

SEQ ID NO: 1553765 - RNA, 21 nt, Human adenovirus C
ugauggaagcauugugagcuc

SEQ ID NO: 1553766 - RNA, 17 nt, Human adenovirus C
cagacacacaucugucu

SEQ ID NO: 1553767 - RNA, 16 nt, Human adenovirus C
cggcgguggcagaugc

SEQ ID NO: 1553768 - RNA, 19 nt, Human adenovirus C
acgcguugcaagagcgcag

SEQ ID NO: 1553769 - RNA, 14 nt, Human adenovirus C
cauucugcagagca

SEQ ID NO: 1553770 - RNA, 23 nt, Human adenovirus C
gggacauuucagaucggcggcgc

SEQ ID NO: 1553771 - RNA, 16 nt, Human adenovirus C
gacgagaaacgcgcgg

SEQ ID NO: 1553772 - RNA, 17 nt, Human adenovirus C
guccauggucuggagcu

SEQ ID NO: 1553773 - RNA, 19 nt, Human adenovirus C
guuccuggugcagauguug

SEQ ID NO: 1553774 - RNA, 20 nt, Human adenovirus C
cgagagcguggugagcgcgg

SEQ ID NO: 1553775 - RNA, 17 nt, Human adenovirus C
cauuuggguaacaggag

SEQ ID NO: 1553776 - RNA, 15 nt, Human adenovirus C
ugguuccuggugcag

SEQ ID NO: 1553777 - RNA, 21 nt, Human adenovirus C
cucgcaaggccuggccagugu

SEQ ID NO: 1553778 - RNA, 16 nt, Human adenovirus C
cgugcucuacauuggc

SEQ ID NO: 1553779 - RNA, 14 nt, Human adenovirus C
aaaccugagccagg

SEQ ID NO: 1553780 - RNA, 15 nt, Human adenovirus C
gcgagauugagcucc

SEQ ID NO: 1553781 - RNA, 22 nt, Human adenovirus C
acgccaccguuuuuacccaccc

SEQ ID NO: 1553782 - RNA, 17 nt, Human adenovirus C
ccgcccuagccgcgcgu

SEQ ID NO: 1553783 - RNA, 16 nt, Human adenovirus C
aaauagaugagccucc

SEQ ID NO: 1553784 - RNA, 14 nt, Human adenovirus C
gcccgggaccagcg

SEQ ID NO: 1553785 - RNA, 17 nt, Human adenovirus C
cagcugccgccgccgcc

SEQ ID NO: 1553786 - RNA, 21 nt, Human adenovirus C
gcuccuucagcgcgcgcugcc

SEQ ID NO: 1553787 - RNA, 14 nt, Human adenovirus C
aaguuugccacaca

SEQ ID NO: 1553788 - RNA, 20 nt, Human adenovirus C
uggcagcggugcacgggcug

SEQ ID NO: 1553789 - RNA, 15 nt, Human adenovirus C
gcuaccucuccgcgu

SEQ ID NO: 1553790 - RNA, 17 nt, Human adenovirus C
caaccaggcagugcaaa

SEQ ID NO: 1553791 - RNA, 13 nt, Human adenovirus C
ugcacgaccccug

SEQ ID NO: 1553792 - RNA, 16 nt, Human adenovirus C
gguggacgucgcgccg

SEQ ID NO: 1553793 - RNA, 16 nt, Human adenovirus C
cacaguaacugcagca

SEQ ID NO: 1553794 - RNA, 19 nt, Human adenovirus C
gccgcgauguuuagcugca

SEQ ID NO: 1553795 - RNA, 14 nt, Human adenovirus C
cggcgcgcuccuug

SEQ ID NO: 1553796 - RNA, 16 nt, Human adenovirus C
caacggaauccgcgcc

SEQ ID NO: 1553797 - RNA, 22 nt, Human adenovirus C
uauggaucuuaugccaggccua

SEQ ID NO: 1553798 - RNA, 21 nt, Human adenovirus C
caaaaacaugcuaccucuuug

SEQ ID NO: 1553799 - RNA, 13 nt, Human adenovirus C
cacugaacagcau

SEQ ID NO: 1553800 - RNA, 20 nt, Human adenovirus C
cgcagcuuguugaccagcuc

SEQ ID NO: 1553801 - RNA, 14 nt, Human adenovirus C
gucuuacaaaccug

SEQ ID NO: 1553802 - RNA, 16 nt, Human adenovirus C
auaaacauuaccucuu

SEQ ID NO: 1553803 - RNA, 18 nt, Human adenovirus C
ucgcguuucagccccccg

SEQ ID NO: 1553804 - RNA, 21 nt, Human adenovirus C
aacaacauggaaauuaaaacg

SEQ ID NO: 1553805 - RNA, 20 nt, Human adenovirus C
uccucggagccgcgcuccgg

SEQ ID NO: 1553806 - RNA, 22 nt, Human adenovirus C
agcuguccauggucuggagcuc

SEQ ID NO: 1553807 - RNA, 13 nt, Human adenovirus C
gugcaugcccagg

SEQ ID NO: 1553808 - RNA, 20 nt, Human adenovirus C
cgaugaggccggccuggucu

SEQ ID NO: 1553809 - RNA, 18 nt, Human adenovirus C
gcagggcgaaggugacau

SEQ ID NO: 1553810 - RNA, 17 nt, Human adenovirus C
cagcggcaacgugcaga

SEQ ID NO: 1553811 - RNA, 16 nt, Human adenovirus C
aggucacuugcugaca

SEQ ID NO: 1553812 - RNA, 16 nt, Human adenovirus C
uugcgauacacagggu

SEQ ID NO: 1553813 - RNA, 22 nt, Human adenovirus C
cgcccaggcggcggguacagug

SEQ ID NO: 1553814 - RNA, 21 nt, Human adenovirus C
gguggcaccgggacugggcgu

SEQ ID NO: 1553815 - RNA, 14 nt, Human adenovirus C
gcgggcggcgcugc

SEQ ID NO: 1553816 - RNA, 14 nt, Human adenovirus C
cccuccucaccugc

SEQ ID NO: 1553817 - RNA, 21 nt, Human adenovirus C
ccgagcggacaagcagcuggc

SEQ ID NO: 1553818 - RNA, 13 nt, Human adenovirus C
uacaacaguuucc

SEQ ID NO: 1553819 - RNA, 21 nt, Human adenovirus C
auccgcggcgugcuggacagg

SEQ ID NO: 1553820 - RNA, 18 nt, Human adenovirus C
gcagaugcgccccccucc

SEQ ID NO: 1553821 - RNA, 14 nt, Human adenovirus C
ggaguuaccagcca

SEQ ID NO: 1553822 - RNA, 19 nt, Human adenovirus C
cuggagaaacaauuacaaa

SEQ ID NO: 1553823 - RNA, 20 nt, Human adenovirus C
cgccgcgcgcgggcaggagc

SEQ ID NO: 1553824 - RNA, 14 nt, Human adenovirus C
agcgguugcugcgc

SEQ ID NO: 1553825 - RNA, 20 nt, Human adenovirus C
accgugucuagcuugcugac

SEQ ID NO: 1553826 - RNA, 19 nt, Human adenovirus C
cgggcggcgcugcagagcc

SEQ ID NO: 1553827 - RNA, 23 nt, Human adenovirus C
ggcacaaccauccgcggcagcuc

SEQ ID NO: 1553828 - RNA, 19 nt, Human adenovirus C
uauguggaaucaggcugua

SEQ ID NO: 1553829 - RNA, 13 nt, Human adenovirus C
acuucugugccuu

SEQ ID NO: 1553830 - RNA, 18 nt, Human adenovirus C
ggugcugcgcgcggaggu

SEQ ID NO: 1553831 - RNA, 17 nt, Human adenovirus C
ccacacccagccaaccu

SEQ ID NO: 1553832 - RNA, 18 nt, Human adenovirus C
gugcgcccgcuuuccaag

SEQ ID NO: 1553833 - RNA, 15 nt, Human adenovirus C
ccacacugcagggaa

SEQ ID NO: 1553834 - RNA, 19 nt, Human adenovirus C
gauuugucacccuuauccu

SEQ ID NO: 1553835 - RNA, 17 nt, Human adenovirus C
gaugcgggccaugagcu

SEQ ID NO: 1553836 - RNA, 17 nt, Human adenovirus C
aggccagcacgaaggag

SEQ ID NO: 1553837 - RNA, 20 nt, Human adenovirus C
uacauugcccaggaauaaag

SEQ ID NO: 1553838 - RNA, 20 nt, Human adenovirus C
gcccgagggcaacuacuccg

SEQ ID NO: 1553839 - RNA, 20 nt, Human adenovirus C
gccguuggagacugcagccu

SEQ ID NO: 1553840 - RNA, 12 nt, Human adenovirus C
guaccugcugga

SEQ ID NO: 1553841 - RNA, 13 nt, Human adenovirus C
gcagaaacacaag

SEQ ID NO: 1553842 - RNA, 13 nt, Human adenovirus C
acuugcuggaaca

SEQ ID NO: 1553843 - RNA, 23 nt, Human adenovirus C
agugguuuuguacagugaagaug

SEQ ID NO: 1553844 - RNA, 15 nt, Human adenovirus C
gcacgaaggaggcgu

SEQ ID NO: 1553845 - RNA, 16 nt, Human adenovirus C
cgugcauacacuuccu

SEQ ID NO: 1553846 - RNA, 13 nt, Human adenovirus C
cuauuaccaccac

SEQ ID NO: 1553847 - RNA, 17 nt, Human adenovirus C
ccaaucaaucagccucg

SEQ ID NO: 1553848 - RNA, 22 nt, Human adenovirus C
gccauagaugccaugaaccacc

SEQ ID NO: 1553849 - RNA, 17 nt, Human adenovirus C
cuuccuuuuccucuugc

SEQ ID NO: 1553850 - RNA, 13 nt, Human adenovirus C
cacgcugcccgag

SEQ ID NO: 1553851 - RNA, 13 nt, Human adenovirus C
aggaagagcagga

SEQ ID NO: 1553852 - RNA, 13 nt, Human adenovirus C
cucccgccaccag

SEQ ID NO: 1553853 - RNA, 13 nt, Human adenovirus C
caccugagccuuu

SEQ ID NO: 1553854 - RNA, 16 nt, Human adenovirus C
gccaaccuacacauuc

SEQ ID NO: 1553855 - RNA, 18 nt, Human adenovirus C
cagagggcugccugcacu

SEQ ID NO: 1553856 - RNA, 15 nt, Human adenovirus C
gccauuuccuucucc

SEQ ID NO: 1553857 - RNA, 18 nt, Human adenovirus C
acuggaacccgccgccgc

SEQ ID NO: 1553858 - RNA, 20 nt, Human adenovirus C
caccaccgccuccaccgaug

SEQ ID NO: 1553859 - RNA, 16 nt, Human adenovirus C
ugaggacuaccacgcc

SEQ ID NO: 1553860 - RNA, 14 nt, Human adenovirus C
cggggugguggacc

SEQ ID NO: 1553861 - RNA, 18 nt, Human adenovirus C
gaucuggaaggugcugag

SEQ ID NO: 1553862 - RNA, 13 nt, Human adenovirus C
gccaaaaccugcc

SEQ ID NO: 1553863 - RNA, 16 nt, Human adenovirus C
caccucgaccacugcc

SEQ ID NO: 1553864 - RNA, 19 nt, Human adenovirus C
ggcuugagacgcgcgagcc

SEQ ID NO: 1553865 - RNA, 20 nt, Human adenovirus C
cuaaaggggguaaagaggga

SEQ ID NO: 1553866 - RNA, 18 nt, Human adenovirus C
cuggagcugcccaagacu

SEQ ID NO: 1553867 - RNA, 23 nt, Human adenovirus C
ccacuaggggguccacucgcucc

SEQ ID NO: 1553868 - RNA, 22 nt, Human adenovirus C
ucagcuggggcucgcuguggag

SEQ ID NO: 1553869 - RNA, 14 nt, Human adenovirus C
ccgacccggcacug

SEQ ID NO: 1553870 - RNA, 14 nt, Human adenovirus C
gaucauggagucag

SEQ ID NO: 1553871 - RNA, 14 nt, Human adenovirus C
caggcugcgcacca

SEQ ID NO: 1553872 - RNA, 17 nt, Human adenovirus C
ugucuuuacgccaccuu

SEQ ID NO: 1553873 - RNA, 17 nt, Human adenovirus C
ccggcuaugcacugcag

SEQ ID NO: 1553874 - RNA, 21 nt, Human adenovirus C
ucugccagcgccugcacugca

SEQ ID NO: 1553875 - RNA, 18 nt, Human adenovirus C
acaccuagccuaaagccc

SEQ ID NO: 1553876 - RNA, 15 nt, Human adenovirus C
cugagcagcugcgac

SEQ ID NO: 1553877 - RNA, 19 nt, Human adenovirus C
gcuguacauccugcacgag

SEQ ID NO: 1553878 - RNA, 19 nt, Human adenovirus C
gcgcuuaccucccuugccg

SEQ ID NO: 1553879 - RNA, 17 nt, Human adenovirus C
gcagcuuguugaccagc

SEQ ID NO: 1553880 - RNA, 15 nt, Human adenovirus C
cagacuugagaggcc

SEQ ID NO: 1553881 - RNA, 14 nt, Human adenovirus C
aggaugaagaagag

SEQ ID NO: 1553882 - RNA, 12 nt, Human adenovirus C
uggacaccuccc

SEQ ID NO: 1553883 - RNA, 13 nt, Human adenovirus C
gauaaauggagcg

SEQ ID NO: 1553884 - RNA, 16 nt, Human adenovirus C
acaaggccugcagacc

SEQ ID NO: 1553885 - RNA, 19 nt, Human adenovirus C
cagcucggcggugaccugc

SEQ ID NO: 1553886 - RNA, 18 nt, Human adenovirus C
gcucgccuucgaucucag

SEQ ID NO: 1553887 - RNA, 18 nt, Human adenovirus C
ccagcugcugagccacag

SEQ ID NO: 1553888 - RNA, 14 nt, Human adenovirus C
acgcuggaagacgu

SEQ ID NO: 1553889 - RNA, 14 nt, Human adenovirus C
gggcuaaagggggu

SEQ ID NO: 1553890 - RNA, 14 nt, Human adenovirus C
ccgccugcugcacg

SEQ ID NO: 1553891 - RNA, 21 nt, Human adenovirus C
acauggguguucuugcugguc

SEQ ID NO: 1553892 - RNA, 18 nt, Human adenovirus C
cguaguuucgcaggcgcu

SEQ ID NO: 1553893 - RNA, 14 nt, Human adenovirus C
ccaugggcuccagu

SEQ ID NO: 1553894 - RNA, 17 nt, Human adenovirus C
guugccucggcgguggc

SEQ ID NO: 1553895 - RNA, 22 nt, Human adenovirus C
acaaacuccacccccucauuau

SEQ ID NO: 1553896 - RNA, 14 nt, Human adenovirus C
ccaacgcgcggcgg

SEQ ID NO: 1553897 - RNA, 14 nt, Human adenovirus C
caggagcagagccc

SEQ ID NO: 1553898 - RNA, 19 nt, Human adenovirus C
ucagauacaugggcauaag

SEQ ID NO: 1553899 - RNA, 23 nt, Human adenovirus C
gccuccccccgcugacacccagc

SEQ ID NO: 1553900 - RNA, 16 nt, Human adenovirus C
ucuaugcccaggcucc

SEQ ID NO: 1553901 - RNA, 19 nt, Human adenovirus C
cguggcccuuggcgcgcag

SEQ ID NO: 1553902 - RNA, 15 nt, Human adenovirus C
gcucgcguccaggcc

SEQ ID NO: 1553903 - RNA, 21 nt, Human adenovirus C
aaaccuauuaaaaaacaccac

SEQ ID NO: 1553904 - RNA, 11 nt, Human adenovirus C
aaucaaaauaa

SEQ ID NO: 1553905 - RNA, 21 nt, Human adenovirus C
gcagcggcagcaacagcagcg

SEQ ID NO: 1553906 - RNA, 12 nt, Human adenovirus C
agguugcuggcg

SEQ ID NO: 1553907 - RNA, 14 nt, Human adenovirus C
ggggugggugagcg

SEQ ID NO: 1553908 - RNA, 15 nt, Human adenovirus C
cacuuucaauaaagg

SEQ ID NO: 1553909 - RNA, 15 nt, Human adenovirus C
gccacauccuuggcc

SEQ ID NO: 1553910 - RNA, 23 nt, Human adenovirus C
cgccaccguuuuuacccacccaa

SEQ ID NO: 1553911 - RNA, 14 nt, Human adenovirus C
caaaagcagggcuu

SEQ ID NO: 1553912 - RNA, 11 nt, Human adenovirus C
cuuuccaggcu

SEQ ID NO: 1553913 - RNA, 16 nt, Human adenovirus C
ccauaugacacagaaa

SEQ ID NO: 1553914 - RNA, 13 nt, Human adenovirus C
uccuacauugccc

SEQ ID NO: 1553915 - RNA, 17 nt, Human adenovirus C
cugacgaccgcgcacaa

SEQ ID NO: 1553916 - RNA, 23 nt, Human adenovirus C
cacacaaccuucucggcuucaac

SEQ ID NO: 1553917 - RNA, 12 nt, Human adenovirus C
ucgaccacugcc

SEQ ID NO: 1553918 - RNA, 14 nt, Human adenovirus C
agguuccugagcag

SEQ ID NO: 1553919 - RNA, 17 nt, Human adenovirus C
cacaagcucgccugcgc

SEQ ID NO: 1553920 - RNA, 19 nt, Human adenovirus C
augcgcggcgguauccugc

SEQ ID NO: 1553921 - RNA, 22 nt, Human adenovirus C
cgggucagggcgcgggcuaggu

SEQ ID NO: 1553922 - RNA, 22 nt, Human adenovirus C
agcacuaguauugccacugcca

SEQ ID NO: 1553923 - RNA, 18 nt, Human adenovirus C
cccagcguggcgcuggac

SEQ ID NO: 1553924 - RNA, 21 nt, Human adenovirus C
agggacaaguugaaagagcaa

SEQ ID NO: 1553925 - RNA, 13 nt, Human adenovirus C
gggccaagaacaa

SEQ ID NO: 1553926 - RNA, 22 nt, Human adenovirus C
uccagcuuauucagcaucaccu

SEQ ID NO: 1553927 - RNA, 13 nt, Human adenovirus C
ccucccggccacu

SEQ ID NO: 1553928 - RNA, 17 nt, Human adenovirus C
caagaaaaacaccacca

SEQ ID NO: 1553929 - RNA, 21 nt, Human adenovirus C
gcugcuaaacauaguagagcc

SEQ ID NO: 1553930 - RNA, 21 nt, Human adenovirus C
ggccaugggcguguggcagca

SEQ ID NO: 1553931 - RNA, 17 nt, Human adenovirus C
auggaucacaaccccac

SEQ ID NO: 1553932 - RNA, 18 nt, Human adenovirus C
guggccuugcaggcgcag

SEQ ID NO: 1553933 - RNA, 14 nt, Human adenovirus C
cccacucuguaugc

SEQ ID NO: 1553934 - RNA, 14 nt, Human adenovirus C
gaccucugcacucu

SEQ ID NO: 1553935 - RNA, 15 nt, Human adenovirus C
aggaggacacgggca

SEQ ID NO: 1553936 - RNA, 13 nt, Human adenovirus C
aauacaacauggc

SEQ ID NO: 1553937 - RNA, 23 nt, Human adenovirus C
uugcaagaacaaaccgaggaggg

SEQ ID NO: 1553938 - RNA, 12 nt, Human adenovirus C
gcagccuggagg

SEQ ID NO: 1553939 - RNA, 20 nt, Human adenovirus C
ccuguaacgcuggaccugcc

SEQ ID NO: 1553940 - RNA, 16 nt, Human adenovirus C
accacccuccucaccu

SEQ ID NO: 1553941 - RNA, 16 nt, Human adenovirus C
cgggcggaggagaagc

SEQ ID NO: 1553942 - RNA, 14 nt, Human adenovirus C
cccuccgcggcgug

SEQ ID NO: 1553943 - RNA, 19 nt, Human adenovirus C
cuaccggagugcugggcca

SEQ ID NO: 1553944 - RNA, 22 nt, Human adenovirus C
gcccugcuuaaccgcgcacguc

SEQ ID NO: 1553945 - RNA, 16 nt, Human adenovirus C
caaggccauggcaccg

SEQ ID NO: 1553946 - RNA, 15 nt, Human adenovirus C
cggcaaccgccucag

SEQ ID NO: 1553947 - RNA, 22 nt, Human adenovirus C
cugcucgaucucuuccuccugg

SEQ ID NO: 1553948 - RNA, 17 nt, Human adenovirus C
guggaccuggccaacca

SEQ ID NO: 1553949 - RNA, 13 nt, Human adenovirus C
uacucuggcucca

SEQ ID NO: 1553950 - RNA, 15 nt, Human adenovirus C
cgaucgaugcggccc

SEQ ID NO: 1553951 - RNA, 21 nt, Human adenovirus C
ccacuggcagggacacguugc

SEQ ID NO: 1553952 - RNA, 19 nt, Human adenovirus C
cggccgccgcagcagccgc

SEQ ID NO: 1553953 - RNA, 22 nt, Human adenovirus C
cugcuccucuucccgacuggcc

SEQ ID NO: 1553954 - RNA, 13 nt, Human adenovirus C
ccagcgacuggaa

SEQ ID NO: 1553955 - RNA, 16 nt, Human adenovirus C
ggccagaugcugaggg

SEQ ID NO: 1553956 - RNA, 14 nt, Human adenovirus C
caggaacugaaagc

SEQ ID NO: 1553957 - RNA, 17 nt, Human adenovirus C
ggcaagauaucggcacc

SEQ ID NO: 1553958 - RNA, 14 nt, Human adenovirus C
ggaggugagcucaa

SEQ ID NO: 1553959 - RNA, 13 nt, Human adenovirus C
ggcggcggcgcgc

SEQ ID NO: 1553960 - RNA, 14 nt, Human adenovirus C
gcccuaacaguggc

SEQ ID NO: 1553961 - RNA, 21 nt, Human adenovirus C
ugagcaaggaaauucccacgc

SEQ ID NO: 1553962 - RNA, 15 nt, Human adenovirus C
cggcuggagcugccc

SEQ ID NO: 1553963 - RNA, 15 nt, Human adenovirus C
cagagggcauggaga

SEQ ID NO: 1553964 - RNA, 19 nt, Human adenovirus C
aaccauuaacgaggauggg

SEQ ID NO: 1553965 - RNA, 16 nt, Human adenovirus C
gugcaugcccaggcuu

SEQ ID NO: 1553966 - RNA, 17 nt, Human adenovirus C
ccgcgccgcaggccccg

SEQ ID NO: 1553967 - RNA, 18 nt, Human adenovirus C
ccagcgcggccacuuccc

SEQ ID NO: 1553968 - RNA, 18 nt, Human adenovirus C
ccaggacgacgcagaggc

SEQ ID NO: 1553969 - RNA, 15 nt, Human adenovirus C
caccccgcaccgcuc

SEQ ID NO: 1553970 - RNA, 18 nt, Human adenovirus C
agcgugcaggggcccaac

SEQ ID NO: 1553971 - RNA, 17 nt, Human adenovirus C
cccucgccggcgcccca

SEQ ID NO: 1553972 - RNA, 20 nt, Human adenovirus C
uucuucacgaucuuggccuu

SEQ ID NO: 1553973 - RNA, 17 nt, Human adenovirus C
cgcaugcccccaugggc

SEQ ID NO: 1553974 - RNA, 10 nt, Human adenovirus C
ggcuggggcc

SEQ ID NO: 1553975 - RNA, 17 nt, Human adenovirus C
aaccuggaccggcuggu

SEQ ID NO: 1553976 - RNA, 16 nt, Human adenovirus C
cccuggaggcagcugg

SEQ ID NO: 1553977 - RNA, 16 nt, Human adenovirus C
aaagggcccuggcugg

SEQ ID NO: 1553978 - RNA, 17 nt, Human adenovirus C
aaaccuauuaaaaaaca

SEQ ID NO: 1553979 - RNA, 18 nt, Human adenovirus C
aguggagagcccaggacu

SEQ ID NO: 1553980 - RNA, 22 nt, Human adenovirus C
aagcuuccgaggccgaagaggu

SEQ ID NO: 1553981 - RNA, 15 nt, Human adenovirus C
cgcuguacggcagua

SEQ ID NO: 1553982 - RNA, 19 nt, Human adenovirus C
cagcucggucacgugcucu

SEQ ID NO: 1553983 - RNA, 21 nt, Human adenovirus C
ccaggguuuccuugaugaugu

SEQ ID NO: 1553984 - RNA, 14 nt, Human adenovirus C
ccagcggccacacc

SEQ ID NO: 1553985 - RNA, 13 nt, Human adenovirus C
aagggcccuggcu

SEQ ID NO: 1553986 - RNA, 17 nt, Human adenovirus C
cgcauugcguaccucag

SEQ ID NO: 1553987 - RNA, 12 nt, Human adenovirus C
gcuucaauccaa

SEQ ID NO: 1553988 - RNA, 17 nt, Human adenovirus C
uguucugacagggccca

SEQ ID NO: 1553989 - RNA, 21 nt, Human adenovirus C
ugacaguggagagcccaggac

SEQ ID NO: 1553990 - RNA, 18 nt, Human adenovirus C
aggccgaggcagcggcag

SEQ ID NO: 1553991 - RNA, 11 nt, Human adenovirus C
uacgccaccuu

SEQ ID NO: 1553992 - RNA, 23 nt, Human adenovirus C
ucaacuuugcgucucuggccccg

SEQ ID NO: 1553993 - RNA, 13 nt, Human adenovirus C
cgcaacugggcag

SEQ ID NO: 1553994 - RNA, 16 nt, Human adenovirus C
cccgggcuggugcagu

SEQ ID NO: 1553995 - RNA, 14 nt, Human adenovirus C
acgcucuggccggu

SEQ ID NO: 1553996 - RNA, 16 nt, Human adenovirus C
gaucuugguugugggc

SEQ ID NO: 1553997 - RNA, 11 nt, Human adenovirus C
caacuggcaaa

SEQ ID NO: 1553998 - RNA, 22 nt, Human adenovirus C
gccuucacacgcuugaagacaa

SEQ ID NO: 1553999 - RNA, 19 nt, Human adenovirus C
accaacaugccaaauguga

SEQ ID NO: 1554000 - RNA, 17 nt, Human adenovirus C
accuagaugugggagac

SEQ ID NO: 1554001 - RNA, 14 nt, Human adenovirus C
auaccacugcaaca

SEQ ID NO: 1554002 - RNA, 19 nt, Human adenovirus C
ucaagaaaaacaccaccac

SEQ ID NO: 1554003 - RNA, 15 nt, Human adenovirus C
gucugggucacggug

SEQ ID NO: 1554004 - RNA, 18 nt, Human adenovirus C
ugcauacacuuccucagg

SEQ ID NO: 1554005 - RNA, 16 nt, Human adenovirus C
acaccuaccgccccag

SEQ ID NO: 1554006 - RNA, 18 nt, Human adenovirus C
uacagcccgggggaggca

SEQ ID NO: 1554007 - RNA, 15 nt, Human adenovirus C
gcuggggcaggagga

SEQ ID NO: 1554008 - RNA, 17 nt, Human adenovirus C
ggugagcgcggaggcgu

SEQ ID NO: 1554009 - RNA, 14 nt, Human adenovirus C
agcaacaacagcgc

SEQ ID NO: 1554010 - RNA, 19 nt, Human adenovirus C
aggagcaacagcaggagga

SEQ ID NO: 1554011 - RNA, 14 nt, Human adenovirus C
ccagcgccugcacu

SEQ ID NO: 1554012 - RNA, 20 nt, Human adenovirus C
ggcggcuuucgucacagggu

SEQ ID NO: 1554013 - RNA, 17 nt, Human adenovirus C
aguucuugcaaggaagc

SEQ ID NO: 1554014 - RNA, 22 nt, Human adenovirus C
ggaucaccuacgaugaccugga

SEQ ID NO: 1554015 - RNA, 12 nt, Human adenovirus C
ugagguacauga

SEQ ID NO: 1554016 - RNA, 23 nt, Human adenovirus C
cgacgcggcgguugaucuccuga

SEQ ID NO: 1554017 - RNA, 20 nt, Human adenovirus C
gugugaccccgaagccccuc

SEQ ID NO: 1554018 - RNA, 18 nt, Human adenovirus C
gccgccguuagcccaaga

SEQ ID NO: 1554019 - RNA, 22 nt, Human adenovirus C
ccacagcucggucacgugcucu

SEQ ID NO: 1554020 - RNA, 21 nt, Human adenovirus C
gccuggcgcaaaaucuccugc

SEQ ID NO: 1554021 - RNA, 21 nt, Human adenovirus C
acuaccuuuccgccgccaaca

SEQ ID NO: 1554022 - RNA, 23 nt, Human adenovirus C
gccgccguuagcccaagagcaac

SEQ ID NO: 1554023 - RNA, 19 nt, Human adenovirus C
uuacaagugggaauuugaa

SEQ ID NO: 1554024 - RNA, 17 nt, Human adenovirus C
ugcaggagcgcagcuug

SEQ ID NO: 1554025 - RNA, 17 nt, Human adenovirus C
ggcagcagcaggaggag

SEQ ID NO: 1554026 - RNA, 12 nt, Human adenovirus C
ggcggaggcgcg

SEQ ID NO: 1554027 - RNA, 20 nt, Human adenovirus C
gccuagacgaagcuuccgag

SEQ ID NO: 1554028 - RNA, 17 nt, Human adenovirus C
gcccaucuccaucccau

SEQ ID NO: 1554029 - RNA, 14 nt, Human adenovirus C
auccggugcugcgg

SEQ ID NO: 1554030 - RNA, 17 nt, Human adenovirus C
ugagccccucgccuggc

SEQ ID NO: 1554031 - RNA, 13 nt, Human adenovirus C
cauuccagcaccu

SEQ ID NO: 1554032 - RNA, 17 nt, Human adenovirus C
cagcaauaacacaggcu

SEQ ID NO: 1554033 - RNA, 18 nt, Human adenovirus C
cuggcggaggugcugcug

SEQ ID NO: 1554034 - RNA, 16 nt, Human adenovirus C
uaacuuuauguccaug

SEQ ID NO: 1554035 - RNA, 19 nt, Human adenovirus C
accaaagcaaaccucaccu

SEQ ID NO: 1554036 - RNA, 15 nt, Human adenovirus C
acucagggucgcagg

SEQ ID NO: 1554037 - RNA, 14 nt, Human adenovirus C
gcagacaugcaggg

SEQ ID NO: 1554038 - RNA, 16 nt, Human adenovirus C
ugcuugcuugcaagac

SEQ ID NO: 1554039 - RNA, 16 nt, Human adenovirus C
uggggauaugagaugc

SEQ ID NO: 1554040 - RNA, 18 nt, Human adenovirus C
cuccgggcugcgcgcugg

SEQ ID NO: 1554041 - RNA, 20 nt, Human adenovirus C
gggcucccacaggcgaccgc

SEQ ID NO: 1554042 - RNA, 23 nt, Human adenovirus C
cucccucacccgcagcugccugu

SEQ ID NO: 1554043 - RNA, 24 nt, Human adenovirus C
ccagcccaugagccggcaaguggu

SEQ ID NO: 1554044 - RNA, 15 nt, Human adenovirus C
accguggcgggcggc

SEQ ID NO: 1554045 - RNA, 16 nt, Human adenovirus C
ggaccugcuugagcag

SEQ ID NO: 1554046 - RNA, 20 nt, Human adenovirus C
cccauggcauggggugggug

SEQ ID NO: 1554047 - RNA, 22 nt, Human adenovirus C
agucuagcgccugcugccaugc

SEQ ID NO: 1554048 - RNA, 18 nt, Human adenovirus C
gguaccuuugagcugcag

SEQ ID NO: 1554049 - RNA, 22 nt, Human adenovirus C
cgugaccuuccgcuccacgagc

SEQ ID NO: 1554050 - RNA, 12 nt, Human adenovirus C
gggcggcaagcg

SEQ ID NO: 1554051 - RNA, 16 nt, Human adenovirus C
auuucaacaaagcagg

SEQ ID NO: 1554052 - RNA, 12 nt, Human adenovirus C
auuaccugggcg

SEQ ID NO: 1554053 - RNA, 22 nt, Human adenovirus C
acaguaacugcagcacagcacc

SEQ ID NO: 1554054 - RNA, 20 nt, Human adenovirus C
uaggcuggaaagcgaaagca

SEQ ID NO: 1554055 - RNA, 16 nt, Human adenovirus C
gcaugaaagccuugau

SEQ ID NO: 1554056 - RNA, 21 nt, Human adenovirus C
cggcacugccgcccaacgcgc

SEQ ID NO: 1554057 - RNA, 20 nt, Human adenovirus C
caucuccuucgcccgccgcu

SEQ ID NO: 1554058 - RNA, 18 nt, Human adenovirus C
gcgugucccgggacacau

SEQ ID NO: 1554059 - RNA, 17 nt, Human adenovirus C
accuccuccuccugcca

SEQ ID NO: 1554060 - RNA, 18 nt, Human adenovirus C
uccgggguugaaacucac

SEQ ID NO: 1554061 - RNA, 18 nt, Human adenovirus C
agucacaagccccacuga

SEQ ID NO: 1554062 - RNA, 14 nt, Human adenovirus C
uacuaagaaaacac

SEQ ID NO: 1554063 - RNA, 16 nt, Human adenovirus C
cagucguagcaggagc

SEQ ID NO: 1554064 - RNA, 18 nt, Human adenovirus C
cgggacgcucuggccggu

SEQ ID NO: 1554065 - RNA, 21 nt, Human adenovirus C
ccuaauaagcaaugacagcac

SEQ ID NO: 1554066 - RNA, 21 nt, Human adenovirus C
uaaaacauaaauaaaaaccag

SEQ ID NO: 1554067 - RNA, 13 nt, Human adenovirus C
guagcgccacauc

SEQ ID NO: 1554068 - RNA, 12 nt, Human adenovirus C
gucacacagaag

SEQ ID NO: 1554069 - RNA, 22 nt, Human adenovirus C
gcacgaaggaggcguaggaguc

SEQ ID NO: 1554070 - RNA, 18 nt, Human adenovirus C
gcauguuuucccugacca

SEQ ID NO: 1554071 - RNA, 13 nt, Human adenovirus C
agccuggcugaca

SEQ ID NO: 1554072 - RNA, 20 nt, Human adenovirus C
gacugggguuugacccaguc

SEQ ID NO: 1554073 - RNA, 19 nt, Human adenovirus C
acgggcggcggccugggcg

SEQ ID NO: 1554074 - RNA, 15 nt, Human adenovirus C
ccgccggcacugccu

SEQ ID NO: 1554075 - RNA, 13 nt, Human adenovirus C
ccgugcuggcccc

SEQ ID NO: 1554076 - RNA, 14 nt, Human adenovirus C
aggacuaaaaaaug

SEQ ID NO: 1554077 - RNA, 22 nt, Human adenovirus C
aaugcacuacucuuauaaaaug

SEQ ID NO: 1554078 - RNA, 21 nt, Human adenovirus C
gcguagcacgucgccaccgcc

SEQ ID NO: 1554079 - RNA, 19 nt, Human adenovirus C
ccaggacgacgcagaggca

SEQ ID NO: 1554080 - RNA, 16 nt, Human adenovirus C
ucccguucauccgccc

SEQ ID NO: 1554081 - RNA, 17 nt, Human adenovirus C
ccgcugcgcaacagcau

SEQ ID NO: 1554082 - RNA, 23 nt, Human adenovirus C
uccaggcgcggcggcugcugcgc

SEQ ID NO: 1554083 - RNA, 15 nt, Human adenovirus C
aaaugggaugucaaa

SEQ ID NO: 1554084 - RNA, 15 nt, Human adenovirus C
gguucacccuggcug

SEQ ID NO: 1554085 - RNA, 22 nt, Human adenovirus C
cgcggggacaggaggacuacac

SEQ ID NO: 1554086 - RNA, 19 nt, Human adenovirus C
guggccuugcaggcgcaga

SEQ ID NO: 1554087 - RNA, 18 nt, Human adenovirus C
gcaguggucuccucagcg

SEQ ID NO: 1554088 - RNA, 16 nt, Human adenovirus C
gcaaccaggaacagcu

SEQ ID NO: 1554089 - RNA, 23 nt, Human adenovirus C
ggccuggcgcaaaaucuccugca

SEQ ID NO: 1554090 - RNA, 14 nt, Human adenovirus C
ugaugggcuccagc

SEQ ID NO: 1554091 - RNA, 20 nt, Human adenovirus C
gcagcuggccuugcggcagg

SEQ ID NO: 1554092 - RNA, 18 nt, Human adenovirus C
caagcagugcagcuuccc

SEQ ID NO: 1554093 - RNA, 14 nt, Human adenovirus C
cagggaugcgcugc

SEQ ID NO: 1554094 - RNA, 17 nt, Human adenovirus C
gcgcaacuagauugcaa

SEQ ID NO: 1554095 - RNA, 20 nt, Human adenovirus C
ucuacuggggcuccugucgc

SEQ ID NO: 1554096 - RNA, 15 nt, Human adenovirus C
agcaccuucaaccau

SEQ ID NO: 1554097 - RNA, 19 nt, Human adenovirus C
gcccuaccugugcuuugcu

SEQ ID NO: 1554098 - RNA, 18 nt, Human adenovirus C
ucuccuucgcccgccgcu

SEQ ID NO: 1554099 - RNA, 16 nt, Human adenovirus C
ggcgccgcgcgcgggc

SEQ ID NO: 1554100 - RNA, 17 nt, Human adenovirus C
gccuguuugaaaggugu

SEQ ID NO: 1554101 - RNA, 18 nt, Human adenovirus C
ugauucgggaguuuacca

SEQ ID NO: 1554102 - RNA, 18 nt, Human adenovirus C
cuuccuggagcgccacuc

SEQ ID NO: 1554103 - RNA, 12 nt, Human adenovirus C
cagcggcagcaa

SEQ ID NO: 1554104 - RNA, 21 nt, Human adenovirus C
cgugacacugcagcaggugcu

SEQ ID NO: 1554105 - RNA, 14 nt, Human adenovirus C
gcgcugcagagcca

SEQ ID NO: 1554106 - RNA, 14 nt, Human adenovirus C
uccaagauggcuac

SEQ ID NO: 1554107 - RNA, 15 nt, Human adenovirus C
ggcggcaggagcaga

SEQ ID NO: 1554108 - RNA, 20 nt, Human adenovirus C
ucacggugaaggggugcgcu

SEQ ID NO: 1554109 - RNA, 22 nt, Human adenovirus C
cuugcuuguauuccccuggaca

SEQ ID NO: 1554110 - RNA, 19 nt, Human adenovirus C
gcaagacucugacaaagcc

SEQ ID NO: 1554111 - RNA, 14 nt, Human adenovirus C
aaagcaaggccugc

SEQ ID NO: 1554112 - RNA, 20 nt, Human adenovirus C
cccaguccggcgaggagcuc

SEQ ID NO: 1554113 - RNA, 23 nt, Human adenovirus C
cuguugaagcaucugcagcgcca

SEQ ID NO: 1554114 - RNA, 18 nt, Human adenovirus C
ggagcugcugagccgccg

SEQ ID NO: 1554115 - RNA, 16 nt, Human adenovirus C
aucucccgccaccagu

SEQ ID NO: 1554116 - RNA, 14 nt, Human adenovirus C
agcaggggggccac

SEQ ID NO: 1554117 - RNA, 17 nt, Human adenovirus C
aucgcaacaccacugcu

SEQ ID NO: 1554118 - RNA, 14 nt, Human adenovirus C
gggcaaagaagcgc

SEQ ID NO: 1554119 - RNA, 23 nt, Human adenovirus C
caagcugauugccaggggcaggc

SEQ ID NO: 1554120 - RNA, 22 nt, Human adenovirus C
ccaaacuuaccuacgaaaaaac

SEQ ID NO: 1554121 - RNA, 20 nt, Human adenovirus C
cagcuguuggaucugcgcca

SEQ ID NO: 1554122 - RNA, 20 nt, Human adenovirus C
acccaaaaagaagcugcagc

SEQ ID NO: 1554123 - RNA, 19 nt, Human adenovirus C
aaugggcccacgggcggcg

SEQ ID NO: 1554124 - RNA, 19 nt, Human adenovirus C
ccucggcgguggcagaugc

SEQ ID NO: 1554125 - RNA, 19 nt, Human adenovirus C
gggcgggcccccggaggua

SEQ ID NO: 1554126 - RNA, 14 nt, Human adenovirus C
aggcccuuggugua

SEQ ID NO: 1554127 - RNA, 15 nt, Human adenovirus C
agggcauggagacac

SEQ ID NO: 1554128 - RNA, 20 nt, Human adenovirus C
cggagaugcagcgcaagcua

SEQ ID NO: 1554129 - RNA, 14 nt, Human adenovirus C
gcgcaggguggcuc

SEQ ID NO: 1554130 - RNA, 18 nt, Human adenovirus C
ggcgucaucgagaccgug

SEQ ID NO: 1554131 - RNA, 20 nt, Human adenovirus C
acaaauaggaucagacaaug

SEQ ID NO: 1554132 - RNA, 15 nt, Human adenovirus C
agggccgcuggcugc

SEQ ID NO: 1554133 - RNA, 20 nt, Human adenovirus C
ccaggugaugccggcggcgg

SEQ ID NO: 1554134 - RNA, 18 nt, Human adenovirus C
cugcccaagacuacucaa

SEQ ID NO: 1554135 - RNA, 18 nt, Human adenovirus C
cgcuucagccgcugcagc

SEQ ID NO: 1554136 - RNA, 17 nt, Human adenovirus C
cgucgccaccgccgccg

SEQ ID NO: 1554137 - RNA, 17 nt, Human adenovirus C
agcggggugguggaccu

SEQ ID NO: 1554138 - RNA, 16 nt, Human adenovirus C
cuggcgguagaggggc

SEQ ID NO: 1554139 - RNA, 16 nt, Human adenovirus C
gcagggauacggcgcu

SEQ ID NO: 1554140 - RNA, 18 nt, Human adenovirus C
accacuguuacucagcca

SEQ ID NO: 1554141 - RNA, 15 nt, Human adenovirus C
ccgugcuggccccga

SEQ ID NO: 1554142 - RNA, 16 nt, Human adenovirus C
gcugcgcgcuggccag

SEQ ID NO: 1554143 - RNA, 12 nt, Human adenovirus C
ggacgcuggaag

SEQ ID NO: 1554144 - RNA, 12 nt, Human adenovirus C
aacaacucccau

SEQ ID NO: 1554145 - RNA, 22 nt, Human adenovirus C
aacgcucaucagugauauuaau

SEQ ID NO: 1554146 - RNA, 14 nt, Human adenovirus C
caaacgccaagaaa

SEQ ID NO: 1554147 - RNA, 22 nt, Human adenovirus C
cgcagcugccuguaucacaaaa

SEQ ID NO: 1554148 - RNA, 19 nt, Human adenovirus C
cguuccugcucucacagau

SEQ ID NO: 1554149 - RNA, 13 nt, Human adenovirus C
aucccagggaaca

SEQ ID NO: 1554150 - RNA, 19 nt, Human adenovirus C
guuccagacgcggcuguag

SEQ ID NO: 1554151 - RNA, 21 nt, Human adenovirus C
ggcuaccgcucguggcgcggg

SEQ ID NO: 1554152 - RNA, 16 nt, Human adenovirus C
cauguucucuucuuuu

SEQ ID NO: 1554153 - RNA, 16 nt, Human adenovirus C
gggcuguggggggugc

SEQ ID NO: 1554154 - RNA, 21 nt, Human adenovirus C
ugcaccguaggaggggcaugg

SEQ ID NO: 1554155 - RNA, 22 nt, Human adenovirus C
agacucggcggacggcuacgac

SEQ ID NO: 1554156 - RNA, 17 nt, Human adenovirus C
guggauuacccauuuga

SEQ ID NO: 1554157 - RNA, 17 nt, Human adenovirus C
agcuugaucugcuggcg

SEQ ID NO: 1554158 - RNA, 19 nt, Human adenovirus C
cacgcuggaagccaugcuc

SEQ ID NO: 1554159 - RNA, 22 nt, Human adenovirus C
cuugagcaggccaacgagcgcc

SEQ ID NO: 1554160 - RNA, 15 nt, Human adenovirus C
aguaacugcagcaca

SEQ ID NO: 1554161 - RNA, 18 nt, Human adenovirus C
agggccuccccuucuucu

SEQ ID NO: 1554162 - RNA, 15 nt, Human adenovirus C
caucucgggccagga

SEQ ID NO: 1554163 - RNA, 18 nt, Human adenovirus C
auugcgcuguaccugcca

SEQ ID NO: 1554164 - RNA, 14 nt, Human adenovirus C
agcgcacugcggcu

SEQ ID NO: 1554165 - RNA, 14 nt, Human adenovirus C
cugcugcuggaagg

SEQ ID NO: 1554166 - RNA, 12 nt, Human adenovirus C
ccgccgccgcag

SEQ ID NO: 1554167 - RNA, 21 nt, Human adenovirus C
gcucguccagacgggccaggg

SEQ ID NO: 1554168 - RNA, 18 nt, Human adenovirus C
agguggucgcgaaagguc

SEQ ID NO: 1554169 - RNA, 14 nt, Human adenovirus C
uacuuacuuaaaau

SEQ ID NO: 1554170 - RNA, 11 nt, Human adenovirus C
ggcggcagcgg

SEQ ID NO: 1554171 - RNA, 15 nt, Human adenovirus C
acgugguccgugugc

SEQ ID NO: 1554172 - RNA, 22 nt, Human adenovirus C
cuuaaaagccaccugagccuuu

SEQ ID NO: 1554173 - RNA, 11 nt, Human adenovirus C
cugcagcagcg

SEQ ID NO: 1554174 - RNA, 22 nt, Human adenovirus C
cuaccccguauuugccgugcca

SEQ ID NO: 1554175 - RNA, 23 nt, Human adenovirus C
cgcgaggccauaggucaggcgca

SEQ ID NO: 1554176 - RNA, 16 nt, Human adenovirus C
acuaccuugccuacca

SEQ ID NO: 1554177 - RNA, 22 nt, Human adenovirus C
accguggcgggcggcagcgggu

SEQ ID NO: 1554178 - RNA, 22 nt, Human adenovirus C
agaccguaaaccugagccaggc

SEQ ID NO: 1554179 - RNA, 22 nt, Human adenovirus C
gcccugcucccagagcaaaaag

SEQ ID NO: 1554180 - RNA, 14 nt, Human adenovirus C
caaagcccaagaaa

SEQ ID NO: 1554181 - RNA, 14 nt, Human adenovirus C
gcggcaggagcaga

SEQ ID NO: 1554182 - RNA, 21 nt, Human adenovirus C
caaaauguaaccacuguuacu

SEQ ID NO: 1554183 - RNA, 14 nt, Human adenovirus C
cagcuggggccgga

SEQ ID NO: 1554184 - RNA, 14 nt, Human adenovirus C
gcgggcacucuucc

SEQ ID NO: 1554185 - RNA, 19 nt, Human adenovirus C
guccuccgcguugcucagg

SEQ ID NO: 1554186 - RNA, 23 nt, Human adenovirus C
cuugagacgcgcgagccugccga

SEQ ID NO: 1554187 - RNA, 16 nt, Human adenovirus C
uuucgcguuucagccc

SEQ ID NO: 1554188 - RNA, 17 nt, Human adenovirus C
cguucagauacccacca

SEQ ID NO: 1554189 - RNA, 13 nt, Human adenovirus C
gaaacacagagcu

SEQ ID NO: 1554190 - RNA, 12 nt, Human adenovirus C
aggugcagaccc

SEQ ID NO: 1554191 - RNA, 18 nt, Human adenovirus C
ucuuuccaguacucuugg

SEQ ID NO: 1554192 - RNA, 22 nt, Human adenovirus C
aaguauuccauagagcagcuga

SEQ ID NO: 1554193 - RNA, 15 nt, Human adenovirus C
gaaagcuuccgcagg

SEQ ID NO: 1554194 - RNA, 23 nt, Human adenovirus C
aucuuccaccgcggaugcuggcg

SEQ ID NO: 1554195 - RNA, 15 nt, Human adenovirus C
cucaaauacuaccuc

SEQ ID NO: 1554196 - RNA, 21 nt, Human adenovirus C
uaauacugccauagcuauaaa

SEQ ID NO: 1554197 - RNA, 15 nt, Human adenovirus C
ccaacuaccuugccu

SEQ ID NO: 1554198 - RNA, 18 nt, Human adenovirus C
uugccagacaugaugcaa

SEQ ID NO: 1554199 - RNA, 15 nt, Human adenovirus C
agcccgagagcaugu

SEQ ID NO: 1554200 - RNA, 14 nt, Human adenovirus C
cgacuuaccgcagc

SEQ ID NO: 1554201 - RNA, 15 nt, Human adenovirus C
ucacggugaaggggu

SEQ ID NO: 1554202 - RNA, 20 nt, Human adenovirus C
cgcggcaaacgcucugcaac

SEQ ID NO: 1554203 - RNA, 15 nt, Human adenovirus C
cgaccgcgagcugau

SEQ ID NO: 1554204 - RNA, 21 nt, Human adenovirus C
cguaggcgcucguugguccag

SEQ ID NO: 1554205 - RNA, 13 nt, Human adenovirus C
accgcccccuggu

SEQ ID NO: 1554206 - RNA, 11 nt, Human adenovirus C
augagcagcug

SEQ ID NO: 1554207 - RNA, 15 nt, Human adenovirus C
ccgcgcgcgggcagg

SEQ ID NO: 1554208 - RNA, 14 nt, Human adenovirus C
gacuuggaggagcg

SEQ ID NO: 1554209 - RNA, 21 nt, Human adenovirus C
aacaugguguguggcaacugc

SEQ ID NO: 1554210 - RNA, 18 nt, Human adenovirus C
auucaaccugccaccucc

SEQ ID NO: 1554211 - RNA, 13 nt, Human adenovirus C
cuagcuugcugac

SEQ ID NO: 1554212 - RNA, 15 nt, Human adenovirus C
gaguauaauaaauac

SEQ ID NO: 1554213 - RNA, 18 nt, Human adenovirus C
aucaugauugcaaaaauu

SEQ ID NO: 1554214 - RNA, 18 nt, Human adenovirus C
gaucuccgcguccggcuc

SEQ ID NO: 1554215 - RNA, 14 nt, Human adenovirus C
gcaagcacacagac

SEQ ID NO: 1554216 - RNA, 20 nt, Human adenovirus C
agccgcggcaaugcagccgg

SEQ ID NO: 1554217 - RNA, 14 nt, Human adenovirus C
ugaccaaggacugg

SEQ ID NO: 1554218 - RNA, 22 nt, Human adenovirus C
ccucggacucgagacgccgccu

SEQ ID NO: 1554219 - RNA, 18 nt, Human adenovirus C
gagcacagucaugagcga

SEQ ID NO: 1554220 - RNA, 16 nt, Human adenovirus C
ggcugcgcaccaucac

SEQ ID NO: 1554221 - RNA, 17 nt, Human adenovirus C
cucacuuaaaucagcac

SEQ ID NO: 1554222 - RNA, 13 nt, Human adenovirus C
caaacgacugcag

SEQ ID NO: 1554223 - RNA, 20 nt, Human adenovirus C
augcguccaugucgccgcca

SEQ ID NO: 1554224 - RNA, 14 nt, Human adenovirus C
cgggcgcagggucc

SEQ ID NO: 1554225 - RNA, 16 nt, Human adenovirus C
cgccgcacgaggggca

SEQ ID NO: 1554226 - RNA, 12 nt, Human adenovirus C
ccgggcugcgcg

SEQ ID NO: 1554227 - RNA, 22 nt, Human adenovirus C
gucuagcugcgucucguccggg

SEQ ID NO: 1554228 - RNA, 14 nt, Human adenovirus C
acuuccagcccaug

SEQ ID NO: 1554229 - RNA, 16 nt, Human adenovirus C
agauccgcguccaggu

SEQ ID NO: 1554230 - RNA, 16 nt, Human adenovirus C
gcuccucaggcgccgc

SEQ ID NO: 1554231 - RNA, 21 nt, Human adenovirus C
gaccuggccaaccaggcagug

SEQ ID NO: 1554232 - RNA, 14 nt, Human adenovirus C
ggcagcggcagcaa

SEQ ID NO: 1554233 - RNA, 16 nt, Human adenovirus C
agcaacagcaggagga

SEQ ID NO: 1554234 - RNA, 13 nt, Human adenovirus C
cuggcgcagaagu

SEQ ID NO: 1554235 - RNA, 16 nt, Human adenovirus C
gcgcugcuccucuucc

SEQ ID NO: 1554236 - RNA, 20 nt, Human adenovirus C
ggcacucuuccguggucugg

SEQ ID NO: 1554237 - RNA, 14 nt, Human adenovirus C
ugaugccuuugagg

SEQ ID NO: 1554238 - RNA, 12 nt, Human adenovirus C
cuucauucaguu

SEQ ID NO: 1554239 - RNA, 19 nt, Human adenovirus C
cucccauggaucacaaccc

SEQ ID NO: 1554240 - RNA, 17 nt, Human adenovirus C
ccagcaucguuuaaaag

SEQ ID NO: 1554241 - RNA, 16 nt, Human adenovirus C
cugcggcucggagcag

SEQ ID NO: 1554242 - RNA, 23 nt, Human adenovirus C
agcgcaaccuaaaggagcugcag

SEQ ID NO: 1554243 - RNA, 21 nt, Human adenovirus C
cauggcgccauccaccaccau

SEQ ID NO: 1554244 - RNA, 16 nt, Human adenovirus C
aguuggcccgcugccc

SEQ ID NO: 1554245 - RNA, 15 nt, Human adenovirus C
agacguugaagcugg

SEQ ID NO: 1554246 - RNA, 16 nt, Human adenovirus C
cagagacgcccaggcc

SEQ ID NO: 1554247 - RNA, 15 nt, Human adenovirus C
uagugaauccacaga

SEQ ID NO: 1554248 - RNA, 14 nt, Human adenovirus C
cgaggccgaagagg

SEQ ID NO: 1554249 - RNA, 22 nt, Human adenovirus C
gcccaacucggccgccugugga

SEQ ID NO: 1554250 - RNA, 19 nt, Human adenovirus C
ccgagcggacaagcagcug

SEQ ID NO: 1554251 - RNA, 20 nt, Human adenovirus C
aacuuugauaauacugccau

SEQ ID NO: 1554252 - RNA, 13 nt, Human adenovirus C
cagcggcggcagc

SEQ ID NO: 1554253 - RNA, 17 nt, Human adenovirus C
gguagugggucuagcug

SEQ ID NO: 1554254 - RNA, 18 nt, Human adenovirus C
ccaacgcggcagccgcgg

SEQ ID NO: 1554255 - RNA, 14 nt, Human adenovirus C
agauguugcacaau

SEQ ID NO: 1554256 - RNA, 15 nt, Human adenovirus C
gagcucagcgaccgc

SEQ ID NO: 1554257 - RNA, 21 nt, Human adenovirus C
aaggccuggccaguguuugag

SEQ ID NO: 1554258 - RNA, 19 nt, Human adenovirus C
gggagcggggggcuucuga

SEQ ID NO: 1554259 - RNA, 17 nt, Human adenovirus C
cuacgccaacuccgccc

SEQ ID NO: 1554260 - RNA, 17 nt, Human adenovirus C
ccauggucuggagcucc

SEQ ID NO: 1554261 - RNA, 10 nt, Human adenovirus C
cuggccaggg

SEQ ID NO: 1554262 - RNA, 16 nt, Human adenovirus C
uuaggccagauugcaa

SEQ ID NO: 1554263 - RNA, 14 nt, Human adenovirus C
gcgcgaggcguacg

SEQ ID NO: 1554264 - RNA, 18 nt, Human adenovirus C
cagaagacggaugagcuc

SEQ ID NO: 1554265 - RNA, 15 nt, Human adenovirus C
gcccucaccugccgc

SEQ ID NO: 1554266 - RNA, 21 nt, Human adenovirus C
caugcgagcccaacccgcgcc

SEQ ID NO: 1554267 - RNA, 18 nt, Human adenovirus C
ccgagggccgcuggcugc

SEQ ID NO: 1554268 - RNA, 20 nt, Human adenovirus C
cacggcggcgacgacggcgc

SEQ ID NO: 1554269 - RNA, 12 nt, Human adenovirus C
aggagcugaggc

SEQ ID NO: 1554270 - RNA, 22 nt, Human adenovirus C
cgccuguggacuauucugcugc

SEQ ID NO: 1554271 - RNA, 20 nt, Human adenovirus C
ccgcggugcaggcggccgcu

SEQ ID NO: 1554272 - RNA, 17 nt, Human adenovirus C
agucugcagcgcugcca

SEQ ID NO: 1554273 - RNA, 15 nt, Human adenovirus C
aacgccuuccugagu

SEQ ID NO: 1554274 - RNA, 21 nt, Human adenovirus C
agaugccgcggugcaggcggc

SEQ ID NO: 1554275 - RNA, 19 nt, Human adenovirus C
cagagggcgagguauucag

SEQ ID NO: 1554276 - RNA, 15 nt, Human adenovirus C
ccaacucggccgccu

SEQ ID NO: 1554277 - RNA, 21 nt, Human adenovirus C
ucccauccaagguccacggcu

SEQ ID NO: 1554278 - RNA, 21 nt, Human adenovirus C
cuucagaaacuuccagcccau

SEQ ID NO: 1554279 - RNA, 16 nt, Human adenovirus C
cugccaggaugcgggg

SEQ ID NO: 1554280 - RNA, 14 nt, Human adenovirus C
cugaaacccaccau

SEQ ID NO: 1554281 - RNA, 15 nt, Human adenovirus C
cagcggcggcagcag

SEQ ID NO: 1554282 - RNA, 22 nt, Human adenovirus C
ccauggcccacaacacggccuc

SEQ ID NO: 1554283 - RNA, 21 nt, Human adenovirus C
cacgggacgcuaccgcugcgc

SEQ ID NO: 1554284 - RNA, 14 nt, Human adenovirus C
ggaggggcaacauc

SEQ ID NO: 1554285 - RNA, 14 nt, Human adenovirus C
agagcugcagcugc

SEQ ID NO: 1554286 - RNA, 15 nt, Human adenovirus C
aagcaaaccucaccu

SEQ ID NO: 1554287 - RNA, 23 nt, Human adenovirus C
gcaacagcaggaggaagccaggc

SEQ ID NO: 1554288 - RNA, 22 nt, Human adenovirus C
uggugacgcaaauagaugagcc

SEQ ID NO: 1554289 - RNA, 18 nt, Human adenovirus C
caugcagggcacccuccc

SEQ ID NO: 1554290 - RNA, 14 nt, Human adenovirus C
cuggugugggagga

SEQ ID NO: 1554291 - RNA, 19 nt, Human adenovirus C
cggccacuuccccgccagg

SEQ ID NO: 1554292 - RNA, 17 nt, Human adenovirus C
guugagucgcaggaccc

SEQ ID NO: 1554293 - RNA, 17 nt, Human adenovirus C
uuccaaaacugcaagau

SEQ ID NO: 1554294 - RNA, 17 nt, Human adenovirus C
agcggcgcggaagagaa

SEQ ID NO: 1554295 - RNA, 13 nt, Human adenovirus C
auucaucaaacaa

SEQ ID NO: 1554296 - RNA, 12 nt, Human adenovirus C
cugaggccgagg

SEQ ID NO: 1554297 - RNA, 20 nt, Human adenovirus C
cuuggguauccugucugagg

SEQ ID NO: 1554298 - RNA, 14 nt, Human adenovirus C
aggccuggaacagc

SEQ ID NO: 1554299 - RNA, 19 nt, Human adenovirus C
cgcacggcguccggcucac

SEQ ID NO: 1554300 - RNA, 14 nt, Human adenovirus C
cucccggccacuac

SEQ ID NO: 1554301 - RNA, 21 nt, Human adenovirus C
gguggcugaacuguuuccaga

SEQ ID NO: 1554302 - RNA, 23 nt, Human adenovirus C
caccuccuuuccuuccucccaac

SEQ ID NO: 1554303 - RNA, 17 nt, Human adenovirus C
gcgcaccaccggcggcg

SEQ ID NO: 1554304 - RNA, 12 nt, Human adenovirus C
ccugucccuuuu

SEQ ID NO: 1554305 - RNA, 16 nt, Human adenovirus C
acguggcggccgccga

SEQ ID NO: 1554306 - RNA, 19 nt, Human adenovirus C
cacuuaauggcacuaguga

SEQ ID NO: 1554307 - RNA, 21 nt, Human adenovirus C
uuguagguuaccucugcaaac

SEQ ID NO: 1554308 - RNA, 16 nt, Human adenovirus C
aaaccugugcugccag

SEQ ID NO: 1554309 - RNA, 15 nt, Human adenovirus C
cggaggugcugcuga

SEQ ID NO: 1554310 - RNA, 20 nt, Human adenovirus C
aagggugcaugcccaggcuu

SEQ ID NO: 1554311 - RNA, 23 nt, Human adenovirus C
accugggcuggcgguggcacccg

SEQ ID NO: 1554312 - RNA, 18 nt, Human adenovirus C
ccagaggaccucugcacu

SEQ ID NO: 1554313 - RNA, 18 nt, Human adenovirus C
ccucuucccgacuggcca

SEQ ID NO: 1554314 - RNA, 19 nt, Human adenovirus C
ggcggcuauuaccaccaca

SEQ ID NO: 1554315 - RNA, 22 nt, Human adenovirus C
cugcaccacauuucggccccac

SEQ ID NO: 1554316 - RNA, 17 nt, Human adenovirus C
cuacauugcccaggaau

SEQ ID NO: 1554317 - RNA, 14 nt, Human adenovirus C
ucacuuuccgcuuc

SEQ ID NO: 1554318 - RNA, 13 nt, Human adenovirus C
cacugccgccgcc

SEQ ID NO: 1554319 - RNA, 18 nt, Human adenovirus C
uuacaauaggaaacaaaa

SEQ ID NO: 1554320 - RNA, 19 nt, Human adenovirus C
cgcuugcuuguauuccccu

SEQ ID NO: 1554321 - RNA, 17 nt, Human adenovirus C
cagaaacuuccagccca

SEQ ID NO: 1554322 - RNA, 19 nt, Human adenovirus C
acagagggcauggagacac

SEQ ID NO: 1554323 - RNA, 14 nt, Human adenovirus C
cggcagacgacagc

SEQ ID NO: 1554324 - RNA, 17 nt, Human adenovirus C
ugcugcgcgaggaggac

SEQ ID NO: 1554325 - RNA, 13 nt, Human adenovirus C
gcggcggcaggag

SEQ ID NO: 1554326 - RNA, 17 nt, Human adenovirus C
auuauucgccacaaaga

SEQ ID NO: 1554327 - RNA, 14 nt, Human adenovirus C
acaucauggaagac

SEQ ID NO: 1554328 - RNA, 18 nt, Human adenovirus C
cauuuuaaaaaaacuaca

SEQ ID NO: 1554329 - RNA, 17 nt, Human adenovirus C
cgcuaugcgccacuggc

SEQ ID NO: 1554330 - RNA, 18 nt, Human adenovirus C
cgcgcaaaccccacgcac

SEQ ID NO: 1554331 - RNA, 16 nt, Human adenovirus C
ucccagggaacaaccc

SEQ ID NO: 1554332 - RNA, 17 nt, Human adenovirus C
uaccuuuuuaaugcauc

SEQ ID NO: 1554333 - RNA, 16 nt, Human adenovirus C
cucgcguccaggccag

SEQ ID NO: 1554334 - RNA, 16 nt, Human adenovirus C
cggccauucagaccgu

SEQ ID NO: 1554335 - RNA, 22 nt, Human adenovirus C
agccuuucuaccggcacuucuu

SEQ ID NO: 1554336 - RNA, 15 nt, Human adenovirus C
ugagauuagcuacuu

SEQ ID NO: 1554337 - RNA, 16 nt, Human adenovirus C
cggcgcgcaacgaagc

SEQ ID NO: 1554338 - RNA, 19 nt, Human adenovirus C
guuuuggacgaggaggagg

SEQ ID NO: 1554339 - RNA, 16 nt, Human adenovirus C
gagcuugaucugcugg

SEQ ID NO: 1554340 - RNA, 22 nt, Human adenovirus C
cagaggggcguggcgaaaagcg

SEQ ID NO: 1554341 - RNA, 14 nt, Human adenovirus C
cugaguauuccaag

SEQ ID NO: 1554342 - RNA, 20 nt, Human adenovirus C
agaccaguagacaaggccug

SEQ ID NO: 1554343 - RNA, 14 nt, Human adenovirus C
gaugcacagccugc

SEQ ID NO: 1554344 - RNA, 18 nt, Human adenovirus C
cacaacacggccuccacg

SEQ ID NO: 1554345 - RNA, 18 nt, Human adenovirus C
ggagccugggcuggagcc

SEQ ID NO: 1554346 - RNA, 13 nt, Human adenovirus C
gcgggggcgcagu

SEQ ID NO: 1554347 - RNA, 21 nt, Human adenovirus C
uacauggacaaaagaugaaac

SEQ ID NO: 1554348 - RNA, 22 nt, Human adenovirus C
auuaagaaaugccuguuugaaa

SEQ ID NO: 1554349 - RNA, 13 nt, Human adenovirus C
gggcguguggcag

SEQ ID NO: 1554350 - RNA, 21 nt, Human adenovirus C
ucagcgcagcggugcagccac

SEQ ID NO: 1554351 - RNA, 12 nt, Human adenovirus C
aagauggcuacc

SEQ ID NO: 1554352 - RNA, 21 nt, Human adenovirus C
ggaucacaaccccaccaugaa

SEQ ID NO: 1554353 - RNA, 16 nt, Human adenovirus C
auccauaugacacaga

SEQ ID NO: 1554354 - RNA, 15 nt, Human adenovirus C
ucucuuccuccugga

SEQ ID NO: 1554355 - RNA, 15 nt, Human adenovirus C
acuuacccuguggac

SEQ ID NO: 1554356 - RNA, 22 nt, Human adenovirus C
ccccuacugcaccggcggcagc

SEQ ID NO: 1554357 - RNA, 17 nt, Human adenovirus C
guccaggguuuccuuga

SEQ ID NO: 1554358 - RNA, 14 nt, Human adenovirus C
ggacaaaagaugaa

SEQ ID NO: 1554359 - RNA, 14 nt, Human adenovirus C
acccccacugagau

SEQ ID NO: 1554360 - RNA, 15 nt, Human adenovirus C
gcgccuucagcuggg

SEQ ID NO: 1554361 - RNA, 20 nt, Human adenovirus C
guccgaagaaaagcgcggcc

SEQ ID NO: 1554362 - RNA, 17 nt, Human adenovirus C
cuaagcagccgccgccg

SEQ ID NO: 1554363 - RNA, 15 nt, Human adenovirus C
gccuguugcugcugc

SEQ ID NO: 1554364 - RNA, 14 nt, Human adenovirus C
cagacgacagcagc

SEQ ID NO: 1554365 - RNA, 18 nt, Human adenovirus C
gccgacgcgcccuggagg

SEQ ID NO: 1554366 - RNA, 22 nt, Human adenovirus C
cuggccgcggguauugucacug

SEQ ID NO: 1554367 - RNA, 15 nt, Human adenovirus C
cgcugcggcugcugu

SEQ ID NO: 1554368 - RNA, 16 nt, Human adenovirus C
cggcacuaccuggacu

SEQ ID NO: 1554369 - RNA, 14 nt, Human adenovirus C
ccacuuaaaaaaac

SEQ ID NO: 1554370 - RNA, 13 nt, Human adenovirus C
ugcuauauuucaa

SEQ ID NO: 1554371 - RNA, 17 nt, Human adenovirus C
accauuacugacgccag

SEQ ID NO: 1554372 - RNA, 15 nt, Human adenovirus C
ccuaucauugugcuc

SEQ ID NO: 1554373 - RNA, 21 nt, Human adenovirus C
cgggucaacggaauccgcgcc

SEQ ID NO: 1554374 - RNA, 20 nt, Human adenovirus C
caagugcuuugcccgcggcu

SEQ ID NO: 1554375 - RNA, 16 nt, Human adenovirus C
gccuaccggggggaga

SEQ ID NO: 1554376 - RNA, 22 nt, Human adenovirus C
ugcaagacagaaacacagagcu

SEQ ID NO: 1554377 - RNA, 20 nt, Human adenovirus C
cgcgcagcagcagggcaacc

SEQ ID NO: 1554378 - RNA, 18 nt, Human adenovirus C
agcgcuccacccgcaccu

SEQ ID NO: 1554379 - RNA, 14 nt, Human adenovirus C
gaccguggagccug

SEQ ID NO: 1554380 - RNA, 24 nt, Human adenovirus C
ggcagccaggugacacuaacgacu

SEQ ID NO: 1554381 - RNA, 21 nt, Human adenovirus C
ugcaagaccccgugaccuucc

SEQ ID NO: 1554382 - RNA, 16 nt, Human adenovirus C
ggugaaggggugcgcu

SEQ ID NO: 1554383 - RNA, 19 nt, Human adenovirus C
ggcggaggcgcguagcacg

SEQ ID NO: 1554384 - RNA, 18 nt, Human adenovirus C
ucagauaaugacugcaaa

SEQ ID NO: 1554385 - RNA, 14 nt, Human adenovirus C
gcgcgucgcaccgu

SEQ ID NO: 1554386 - RNA, 12 nt, Human adenovirus C
aagcuaaaccug

SEQ ID NO: 1554387 - RNA, 23 nt, Human adenovirus C
cuaagcauugcuacuaaagggcc

SEQ ID NO: 1554388 - RNA, 18 nt, Human adenovirus C
cugcagagcucucuggga

SEQ ID NO: 1554389 - RNA, 14 nt, Human adenovirus C
gcagggcacccucc

SEQ ID NO: 1554390 - RNA, 14 nt, Human adenovirus C
gucuuuccacgggc

SEQ ID NO: 1554391 - RNA, 18 nt, Human adenovirus C
ucgccccaucaucgucac

SEQ ID NO: 1554392 - RNA, 15 nt, Human adenovirus C
uugaugaaaagaaaa

SEQ ID NO: 1554393 - RNA, 21 nt, Human adenovirus C
cugguaggcgcagcaucccuu

SEQ ID NO: 1554394 - RNA, 19 nt, Human adenovirus C
caaagcaggggccaagaac

SEQ ID NO: 1554395 - RNA, 15 nt, Human adenovirus C
cgaaugagcuccaca

SEQ ID NO: 1554396 - RNA, 23 nt, Human adenovirus C
ugcuuguagguuaccucugcaaa

SEQ ID NO: 1554397 - RNA, 21 nt, Human adenovirus C
aaaauucagguuccucacaga

SEQ ID NO: 1554398 - RNA, 14 nt, Human adenovirus C
cacgagcugcuucc

SEQ ID NO: 1554399 - RNA, 13 nt, Human adenovirus C
accuucacccagu

SEQ ID NO: 1554400 - RNA, 15 nt, Human adenovirus C
aguggacaagaugag

SEQ ID NO: 1554401 - RNA, 16 nt, Human adenovirus C
cccagcuucagcuugc

SEQ ID NO: 1554402 - RNA, 18 nt, Human adenovirus C
aagggugcaugcccaggc

SEQ ID NO: 1554403 - RNA, 19 nt, Human adenovirus C
acacaugucuaugcccagg

SEQ ID NO: 1554404 - RNA, 15 nt, Human adenovirus C
cacgcagcaccuugc

SEQ ID NO: 1554405 - RNA, 19 nt, Human adenovirus C
ccacagcucgcgguugagg

SEQ ID NO: 1554406 - RNA, 14 nt, Human adenovirus C
acccgcagcugccu

SEQ ID NO: 1554407 - RNA, 21 nt, Human adenovirus C
ugaggacuaccacgcccacga

SEQ ID NO: 1554408 - RNA, 19 nt, Human adenovirus C
auguacuaggagacacuuu

SEQ ID NO: 1554409 - RNA, 20 nt, Human adenovirus C
agagugcuuaaaaaaacaac

SEQ ID NO: 1554410 - RNA, 21 nt, Human adenovirus C
accggcggcggcgcgcgucgc

SEQ ID NO: 1554411 - RNA, 14 nt, Human adenovirus C
ucgcuaugcgccac

SEQ ID NO: 1554412 - RNA, 12 nt, Human adenovirus C
cuuguugaccag

SEQ ID NO: 1554413 - RNA, 15 nt, Human adenovirus C
uaauuaccugggcgg

SEQ ID NO: 1554414 - RNA, 22 nt, Human adenovirus C
uauaacucaccugaaaaucaga

SEQ ID NO: 1554415 - RNA, 19 nt, Human adenovirus C
gcgcgaggccguggcgcag

SEQ ID NO: 1554416 - RNA, 11 nt, Human adenovirus C
uaccagccaca

SEQ ID NO: 1554417 - RNA, 19 nt, Human adenovirus C
gugcguaacuugcuggaac

SEQ ID NO: 1554418 - RNA, 23 nt, Human adenovirus C
caccggccgacgggcggccaugc

SEQ ID NO: 1554419 - RNA, 23 nt, Human adenovirus C
aucccauggacgagcccacccuu

SEQ ID NO: 1554420 - RNA, 15 nt, Human adenovirus C
uggaucugcgccagc

SEQ ID NO: 1554421 - RNA, 18 nt, Human adenovirus C
gcaaaccucaccuccggu

SEQ ID NO: 1554422 - RNA, 16 nt, Human adenovirus C
cucgggcuugggagag

SEQ ID NO: 1554423 - RNA, 16 nt, Human adenovirus C
gcgcaacugggcagca

SEQ ID NO: 1554424 - RNA, 19 nt, Human adenovirus C
aaucagcguaaaucccaca

SEQ ID NO: 1554425 - RNA, 16 nt, Human adenovirus C
gcauguagaacugguu

SEQ ID NO: 1554426 - RNA, 14 nt, Human adenovirus C
ucucuacagccccu

SEQ ID NO: 1554427 - RNA, 18 nt, Human adenovirus C
cgaaucaugauugcaaaa

SEQ ID NO: 1554428 - RNA, 20 nt, Human adenovirus C
auuaagaaaugccuguuuga

SEQ ID NO: 1554429 - RNA, 22 nt, Human adenovirus C
accacccuacuuucccagugcc

SEQ ID NO: 1554430 - RNA, 13 nt, Human adenovirus C
cggcuggagcugc

SEQ ID NO: 1554431 - RNA, 21 nt, Human adenovirus C
ggcugcgcgcuggccagggug

SEQ ID NO: 1554432 - RNA, 20 nt, Human adenovirus C
ccuguguggaagccuggacc

SEQ ID NO: 1554433 - RNA, 15 nt, Human adenovirus C
accgcgucaggaggg

SEQ ID NO: 1554434 - RNA, 12 nt, Human adenovirus C
ccugcacuuccc

SEQ ID NO: 1554435 - RNA, 23 nt, Human adenovirus C
gcuccuucagcgcgcgcugcccg

SEQ ID NO: 1554436 - RNA, 15 nt, Human adenovirus C
uggagccugggcugg

SEQ ID NO: 1554437 - RNA, 16 nt, Human adenovirus C
cugcagaauuaaggag

SEQ ID NO: 1554438 - RNA, 19 nt, Human adenovirus C
acuggggcuccugucgcca

SEQ ID NO: 1554439 - RNA, 12 nt, Human adenovirus C
cgcgccagaccc

SEQ ID NO: 1554440 - RNA, 15 nt, Human adenovirus C
aacguguacugggug

SEQ ID NO: 1554441 - RNA, 14 nt, Human adenovirus C
acacaggcuggggc

SEQ ID NO: 1554442 - RNA, 20 nt, Human adenovirus C
gccucggaguaccugagccc

SEQ ID NO: 1554443 - RNA, 18 nt, Human adenovirus C
agcugcaaacuuucucca

SEQ ID NO: 1554444 - RNA, 19 nt, Human adenovirus C
accuggccaaccaggcagu

SEQ ID NO: 1554445 - RNA, 14 nt, Human adenovirus C
gcgggccaugagcu

SEQ ID NO: 1554446 - RNA, 23 nt, Human adenovirus C
agcgcagcgaugugccccucgcc

SEQ ID NO: 1554447 - RNA, 15 nt, Human adenovirus C
aucaaacaauacuaa

SEQ ID NO: 1554448 - RNA, 17 nt, Human adenovirus C
accgcgcgcccuggggc

SEQ ID NO: 1554449 - RNA, 21 nt, Human adenovirus C
cgcugcgguucaucccugugg

SEQ ID NO: 1554450 - RNA, 23 nt, Human adenovirus C
gaguacuaagcggugauguuucu

SEQ ID NO: 1554451 - RNA, 12 nt, Human adenovirus C
aagcaugaugca

SEQ ID NO: 1554452 - RNA, 20 nt, Human adenovirus C
acucccauuuuuccaaaaca

SEQ ID NO: 1554453 - RNA, 14 nt, Human adenovirus C
gcucagggcgaacg

SEQ ID NO: 1554454 - RNA, 18 nt, Human adenovirus C
ccaguggcaacuggcaaa

SEQ ID NO: 1554455 - RNA, 14 nt, Human adenovirus C
aguccgggccagac

SEQ ID NO: 1554456 - RNA, 23 nt, Human adenovirus C
gcgucccugcgccgugccgccag

SEQ ID NO: 1554457 - RNA, 16 nt, Human adenovirus C
gagggagaggagcccg

SEQ ID NO: 1554458 - RNA, 16 nt, Human adenovirus C
gcggagggugccagac

SEQ ID NO: 1554459 - RNA, 16 nt, Human adenovirus C
gcgcaacgcaccgcca

SEQ ID NO: 1554460 - RNA, 16 nt, Human adenovirus C
gcucccaaaccucagc

SEQ ID NO: 1554461 - RNA, 19 nt, Human adenovirus C
ccagguccuccgcguugcu

SEQ ID NO: 1554462 - RNA, 13 nt, Human adenovirus C
gagcucaacuccc

SEQ ID NO: 1554463 - RNA, 22 nt, Human adenovirus C
ucagcagguuggaauucuucac

SEQ ID NO: 1554464 - RNA, 19 nt, Human adenovirus C
cacaagaaucgccugcuac

SEQ ID NO: 1554465 - RNA, 15 nt, Human adenovirus C
gcacuggcaacaugg

SEQ ID NO: 1554466 - RNA, 14 nt, Human adenovirus C
gccgccaacaugcu

SEQ ID NO: 1554467 - RNA, 14 nt, Human adenovirus C
gagcaacaacagcg

SEQ ID NO: 1554468 - RNA, 15 nt, Human adenovirus C
cucaccacccaggua

SEQ ID NO: 1554469 - RNA, 20 nt, Human adenovirus C
gcucggaagacuaucugccu

SEQ ID NO: 1554470 - RNA, 19 nt, Human adenovirus C
uggcacccgcgcgcgcugg

SEQ ID NO: 1554471 - RNA, 16 nt, Human adenovirus C
cuuggagacgcccuug

SEQ ID NO: 1554472 - RNA, 13 nt, Human adenovirus C
aagcaagcaacau

SEQ ID NO: 1554473 - RNA, 22 nt, Human adenovirus C
uggcacccgcgcgcgcuggcaa

SEQ ID NO: 1554474 - RNA, 18 nt, Human adenovirus C
caagaaaaacaccaccac

SEQ ID NO: 1554475 - RNA, 22 nt, Human adenovirus C
cauucccagcugcuacaacaaa

SEQ ID NO: 1554476 - RNA, 18 nt, Human adenovirus C
cggaaaccucaccuccca

SEQ ID NO: 1554477 - RNA, 15 nt, Human adenovirus C
cuagcgagguaagca

SEQ ID NO: 1554478 - RNA, 13 nt, Human adenovirus C
gcaaccguuccca

SEQ ID NO: 1554479 - RNA, 18 nt, Human adenovirus C
aggcuaccucgcucccac

SEQ ID NO: 1554480 - RNA, 20 nt, Human adenovirus C
gcagguggucgcgaaagguc

SEQ ID NO: 1554481 - RNA, 16 nt, Human adenovirus C
ucgcagggccagcuga

SEQ ID NO: 1554482 - RNA, 15 nt, Human adenovirus C
cgcccuggaggcagc

SEQ ID NO: 1554483 - RNA, 14 nt, Human adenovirus C
cuugcaaggaagca

SEQ ID NO: 1554484 - RNA, 13 nt, Human adenovirus C
cuuccgcaggcca

SEQ ID NO: 1554485 - RNA, 17 nt, Human adenovirus C
ccugagcguaaccagac

SEQ ID NO: 1554486 - RNA, 21 nt, Human adenovirus C
cuucuccuacauugcccagga

SEQ ID NO: 1554487 - RNA, 11 nt, Human adenovirus C
aacgccaagaa

SEQ ID NO: 1554488 - RNA, 15 nt, Human adenovirus C
cccagggccacaucc

SEQ ID NO: 1554489 - RNA, 22 nt, Human adenovirus C
gccacccacggacgaggaggaa

SEQ ID NO: 1554490 - RNA, 20 nt, Human adenovirus C
aggggccagcguaggguggc

SEQ ID NO: 1554491 - RNA, 13 nt, Human adenovirus C
cgugcuggccccg

SEQ ID NO: 1554492 - RNA, 14 nt, Human adenovirus C
agagggggcagggg

SEQ ID NO: 1554493 - RNA, 21 nt, Human adenovirus C
cucuaugugggauaugcucca

SEQ ID NO: 1554494 - RNA, 22 nt, Human adenovirus C
acaauacuaaaaaacuggaagu

SEQ ID NO: 1554495 - RNA, 21 nt, Human adenovirus C
cgcguagcacgucgccaccgc

SEQ ID NO: 1554496 - RNA, 21 nt, Human adenovirus C
ugccauuaaaaaccuccuccu

SEQ ID NO: 1554497 - RNA, 17 nt, Human adenovirus C
uuaaaucagcacaguaa

SEQ ID NO: 1554498 - RNA, 13 nt, Human adenovirus C
cuacaauucccaa

SEQ ID NO: 1554499 - RNA, 13 nt, Human adenovirus C
ucuucagaaacuu

SEQ ID NO: 1554500 - RNA, 13 nt, Human adenovirus C
caggccaacgagc

SEQ ID NO: 1554501 - RNA, 23 nt, Human adenovirus C
cacagagggcauggagacacaaa

SEQ ID NO: 1554502 - RNA, 19 nt, Human adenovirus C
aacugcuuagcgaaaguca

SEQ ID NO: 1554503 - RNA, 20 nt, Human adenovirus C
ccaagaaauccacagcggcg

SEQ ID NO: 1554504 - RNA, 15 nt, Human adenovirus C
gagcacuacuugaaa

SEQ ID NO: 1554505 - RNA, 12 nt, Human adenovirus C
ucgagaucaggc

SEQ ID NO: 1554506 - RNA, 20 nt, Human adenovirus C
acaguguauccggugcacuu

SEQ ID NO: 1554507 - RNA, 11 nt, Human adenovirus C
cuccucaccug

SEQ ID NO: 1554508 - RNA, 13 nt, Human adenovirus C
agcgcacuacugc

SEQ ID NO: 1554509 - RNA, 23 nt, Human adenovirus C
gguccacucgcuccaggguguga

SEQ ID NO: 1554510 - RNA, 15 nt, Human adenovirus C
aggucacuugcugac

SEQ ID NO: 1554511 - RNA, 13 nt, Human adenovirus C
gcagcggcagaca

SEQ ID NO: 1554512 - RNA, 14 nt, Human adenovirus C
gcuagacugcuccu

SEQ ID NO: 1554513 - RNA, 13 nt, Human adenovirus C
ugcuggcgcgcac

SEQ ID NO: 1554514 - RNA, 22 nt, Human adenovirus C
guggcaccgggacugggcgugc

SEQ ID NO: 1554515 - RNA, 16 nt, Human adenovirus C
cgcggcggcugcugcg

SEQ ID NO: 1554516 - RNA, 18 nt, Human adenovirus C
gugucguugacggcggcc

SEQ ID NO: 1554517 - RNA, 21 nt, Human adenovirus C
ccucagcgccucccaaaagac

SEQ ID NO: 1554518 - RNA, 19 nt, Human adenovirus C
ggcgccuucagcuggggcu

SEQ ID NO: 1554519 - RNA, 17 nt, Human adenovirus C
aucucaaauacaaaagc

SEQ ID NO: 1554520 - RNA, 15 nt, Human adenovirus C
cagcggcagcggcag

SEQ ID NO: 1554521 - RNA, 17 nt, Human adenovirus C
agcugccgccgccgcca

SEQ ID NO: 1554522 - RNA, 15 nt, Human adenovirus C
ccguggucuggugga

SEQ ID NO: 1554523 - RNA, 14 nt, Human adenovirus C
caucuuccaccgcg

SEQ ID NO: 1554524 - RNA, 16 nt, Human adenovirus C
cucggucgcauucccc

SEQ ID NO: 1554525 - RNA, 22 nt, Human adenovirus C
gcgguacgguuuuccuggccaa

SEQ ID NO: 1554526 - RNA, 17 nt, Human adenovirus C
gccccaaucaaucagcc

SEQ ID NO: 1554527 - RNA, 13 nt, Human adenovirus C
ggacccuggugcu

SEQ ID NO: 1554528 - RNA, 15 nt, Human adenovirus C
ucguugguccagcag

SEQ ID NO: 1554529 - RNA, 16 nt, Human adenovirus C
ggccggugaggcgugc

SEQ ID NO: 1554530 - RNA, 23 nt, Human adenovirus C
gacgaggaccugcuugagcaggc

SEQ ID NO: 1554531 - RNA, 14 nt, Human adenovirus C
acggacaguggcag

SEQ ID NO: 1554532 - RNA, 13 nt, Human adenovirus C
ccuccugccaggc

SEQ ID NO: 1554533 - RNA, 17 nt, Human adenovirus C
gccuccaacugugcccu

SEQ ID NO: 1554534 - RNA, 13 nt, Human adenovirus C
ccaaaaccuucuc

SEQ ID NO: 1554535 - RNA, 18 nt, Human adenovirus C
gaugccaugaaccacccu

SEQ ID NO: 1554536 - RNA, 23 nt, Human adenovirus C
aaacuaagcauugcuacuaaagg

SEQ ID NO: 1554537 - RNA, 18 nt, Human adenovirus C
acuuacuggcugcagcca

SEQ ID NO: 1554538 - RNA, 13 nt, Human adenovirus C
acaauaaauuacu

SEQ ID NO: 1554539 - RNA, 14 nt, Human adenovirus C
gcgcagaugggagc

SEQ ID NO: 1554540 - RNA, 21 nt, Human adenovirus C
cggugaaguuuucacuccaca

SEQ ID NO: 1554541 - RNA, 19 nt, Human adenovirus C
uguugcgcuuuucugugcg

SEQ ID NO: 1554542 - RNA, 21 nt, Human adenovirus C
ccagacaucauuuugcugcca

SEQ ID NO: 1554543 - RNA, 14 nt, Human adenovirus C
cagcagccgcggcc

SEQ ID NO: 1554544 - RNA, 15 nt, Human adenovirus C
gagccuccaccggcc

SEQ ID NO: 1554545 - RNA, 14 nt, Human adenovirus C
gcacugggcgcacc

SEQ ID NO: 1554546 - RNA, 21 nt, Human adenovirus C
accuguguggaagccuggacc

SEQ ID NO: 1554547 - RNA, 16 nt, Human adenovirus C
ccacgcuggaagccau

SEQ ID NO: 1554548 - RNA, 18 nt, Human adenovirus C
ggccacuacccggaccag

SEQ ID NO: 1554549 - RNA, 23 nt, Human adenovirus C
agugucagccgcgcgcuggggca

SEQ ID NO: 1554550 - RNA, 22 nt, Human adenovirus C
acguggcggccgccgaccuggu

SEQ ID NO: 1554551 - RNA, 20 nt, Human adenovirus C
gcacagggaugugcccggcc

SEQ ID NO: 1554552 - RNA, 22 nt, Human adenovirus C
ccacuaccggcaaccgccucag

SEQ ID NO: 1554553 - RNA, 17 nt, Human adenovirus C
uuuguccagcuuauuca

SEQ ID NO: 1554554 - RNA, 19 nt, Human adenovirus C
uacugggacagucaggcag

SEQ ID NO: 1554555 - RNA, 13 nt, Human adenovirus C
gauaucaacccaa

SEQ ID NO: 1554556 - RNA, 16 nt, Human adenovirus C
caggcagaggcggcgc

SEQ ID NO: 1554557 - RNA, 22 nt, Human adenovirus C
gcaucuaucgcuacggcggcgg

SEQ ID NO: 1554558 - RNA, 22 nt, Human adenovirus C
gcaaaaucaaagaagagaugcu

SEQ ID NO: 1554559 - RNA, 15 nt, Human adenovirus C
aaccugccaccuccc

SEQ ID NO: 1554560 - RNA, 16 nt, Human adenovirus C
acugccacagagggca

SEQ ID NO: 1554561 - RNA, 16 nt, Human adenovirus C
uacuaccgucaucucu

SEQ ID NO: 1554562 - RNA, 19 nt, Human adenovirus C
gcaggaggacacgggcagc

SEQ ID NO: 1554563 - RNA, 22 nt, Human adenovirus C
gcuguccauggucuggagcucc

SEQ ID NO: 1554564 - RNA, 20 nt, Human adenovirus C
gcagacccugcgaguguggc

SEQ ID NO: 1554565 - RNA, 18 nt, Human adenovirus C
gggguccacucgcuccag

SEQ ID NO: 1554566 - RNA, 20 nt, Human adenovirus C
ugcucgaucucuuccuccug

SEQ ID NO: 1554567 - RNA, 15 nt, Human adenovirus C
ggagcagagcccaug

SEQ ID NO: 1554568 - RNA, 21 nt, Human adenovirus C
gacugcagguacgccugcagg

SEQ ID NO: 1554569 - RNA, 15 nt, Human adenovirus C
agaaagaugaugaug

SEQ ID NO: 1554570 - RNA, 20 nt, Human adenovirus C
ccguaguuggcccgcugccc

SEQ ID NO: 1554571 - RNA, 22 nt, Human adenovirus C
cacucgcccuacuuccgcagcc

SEQ ID NO: 1554572 - RNA, 20 nt, Human adenovirus C
cguaggagucgcgcagcuug

SEQ ID NO: 1554573 - RNA, 20 nt, Human adenovirus C
ugcaaacaucagccccccuc

SEQ ID NO: 1554574 - RNA, 22 nt, Human adenovirus C
ccgaucacuuggugcuggccug

SEQ ID NO: 1554575 - RNA, 22 nt, Human adenovirus C
cagggugcgcuugaggcugguc

SEQ ID NO: 1554576 - RNA, 13 nt, Human adenovirus C
acugcagcaggug

SEQ ID NO: 1554577 - RNA, 22 nt, Human adenovirus C
aucgaaguagauugcaucccac

SEQ ID NO: 1554578 - RNA, 23 nt, Human adenovirus C
uguuuggaagauuuuucugcugu

SEQ ID NO: 1554579 - RNA, 14 nt, Human adenovirus C
uggcgaugagcagc

SEQ ID NO: 1554580 - RNA, 17 nt, Human adenovirus C
aaagcuacaaggaccgc

SEQ ID NO: 1554581 - RNA, 20 nt, Human adenovirus C
aucaacuuugcgucucuggc

SEQ ID NO: 1554582 - RNA, 17 nt, Human adenovirus C
ggcuguugaugugguga

SEQ ID NO: 1554583 - RNA, 12 nt, Human adenovirus C
ucuggacuacau

SEQ ID NO: 1554584 - RNA, 15 nt, Human adenovirus C
gagcccguguucuga

SEQ ID NO: 1554585 - RNA, 20 nt, Human adenovirus C
ggcgaccccucauaaacacg

SEQ ID NO: 1554586 - RNA, 20 nt, Human adenovirus C
accagccugugaugcuggau

SEQ ID NO: 1554587 - RNA, 21 nt, Human adenovirus C
cuagggcgcaguaguccaggg

SEQ ID NO: 1554588 - RNA, 21 nt, Human adenovirus C
uaaaugggaugucaaauuccu

SEQ ID NO: 1554589 - RNA, 19 nt, Human adenovirus C
ccugaacgggguguuugac

SEQ ID NO: 1554590 - RNA, 19 nt, Human adenovirus C
gcucccgggcuuguagacu

SEQ ID NO: 1554591 - RNA, 19 nt, Human adenovirus C
aggagcugcagaagcugcu

SEQ ID NO: 1554592 - RNA, 16 nt, Human adenovirus C
cuggcugcagccaggg

SEQ ID NO: 1554593 - RNA, 23 nt, Human adenovirus C
ggugcagauguuggccaacuaca

SEQ ID NO: 1554594 - RNA, 17 nt, Human adenovirus C
cccaagggugcagcuga

SEQ ID NO: 1554595 - RNA, 16 nt, Human adenovirus C
uagcccugcaaacauc

SEQ ID NO: 1554596 - RNA, 18 nt, Human adenovirus C
accaguuaacggucuggu

SEQ ID NO: 1554597 - RNA, 20 nt, Human adenovirus C
cggcguaguuucgcaggcgc

SEQ ID NO: 1554598 - RNA, 21 nt, Human adenovirus C
gggaagagcuggaagaaccau

SEQ ID NO: 1554599 - RNA, 12 nt, Human adenovirus C
gcggcugcuguu

SEQ ID NO: 1554600 - RNA, 14 nt, Human adenovirus C
guacauccugcacg

SEQ ID NO: 1554601 - RNA, 13 nt, Human adenovirus C
cccugcgacgggc

SEQ ID NO: 1554602 - RNA, 18 nt, Human adenovirus C
aacacaggcuggggccug

SEQ ID NO: 1554603 - RNA, 16 nt, Human adenovirus C
uaacagcacuggcaac

SEQ ID NO: 1554604 - RNA, 17 nt, Human adenovirus C
ggcccguagccaguggc

SEQ ID NO: 1554605 - RNA, 22 nt, Human adenovirus C
caucaccuccuuuccuuccucc

SEQ ID NO: 1554606 - RNA, 12 nt, Human adenovirus C
aaaguccagaug

SEQ ID NO: 1554607 - RNA, 14 nt, Human adenovirus C
gcaucuuggacugu

SEQ ID NO: 1554608 - RNA, 12 nt, Human adenovirus C
ccaggcgggcaa

SEQ ID NO: 1554609 - RNA, 21 nt, Human adenovirus C
aagacguguuuugcgacccgg

SEQ ID NO: 1554610 - RNA, 11 nt, Human adenovirus C
acaagcagcug

SEQ ID NO: 1554611 - RNA, 15 nt, Human adenovirus C
ucucgcaaggccugg

SEQ ID NO: 1554612 - RNA, 11 nt, Human adenovirus C
ggggcugugcc

SEQ ID NO: 1554613 - RNA, 18 nt, Human adenovirus C
gaaaccccacgguggcac

SEQ ID NO: 1554614 - RNA, 17 nt, Human adenovirus C
ggaucacaaccccacca

SEQ ID NO: 1554615 - RNA, 16 nt, Human adenovirus C
caacccuuccaggagg

SEQ ID NO: 1554616 - RNA, 15 nt, Human adenovirus C
gcccgcgccugcugg

SEQ ID NO: 1554617 - RNA, 21 nt, Human adenovirus C
cucgcauuccacgagccaggu

SEQ ID NO: 1554618 - RNA, 13 nt, Human adenovirus C
cugcagccagggg

SEQ ID NO: 1554619 - RNA, 20 nt, Human adenovirus C
gaacagcaucgugggucugg

SEQ ID NO: 1554620 - RNA, 13 nt, Human adenovirus C
cagcggugcagcc

SEQ ID NO: 1554621 - RNA, 22 nt, Human adenovirus C
guccacaaaaaacacccagaaa

SEQ ID NO: 1554622 - RNA, 24 nt, Human adenovirus C
augcccaggcuccuuugucuggag

SEQ ID NO: 1554623 - RNA, 13 nt, Human adenovirus C
ccagcggucucgg

SEQ ID NO: 1554624 - RNA, 15 nt, Human adenovirus C
guucuugcuggucag

SEQ ID NO: 1554625 - RNA, 16 nt, Human adenovirus C
auacagagacaggacu

SEQ ID NO: 1554626 - RNA, 15 nt, Human adenovirus C
cugaguuggcacccc

SEQ ID NO: 1554627 - RNA, 10 nt, Human adenovirus C
ccccuucccu

SEQ ID NO: 1554628 - RNA, 17 nt, Human adenovirus C
caugggaaacuggcaag

SEQ ID NO: 1554629 - RNA, 15 nt, Human adenovirus C
uacacucucggguga

SEQ ID NO: 1554630 - RNA, 13 nt, Human adenovirus C
uacaacgcucuag

SEQ ID NO: 1554631 - RNA, 14 nt, Human adenovirus C
ugcaugaaagccuu

SEQ ID NO: 1554632 - RNA, 18 nt, Human adenovirus C
cgcgcaacgaagcuaugu

SEQ ID NO: 1554633 - RNA, 15 nt, Human adenovirus C
acccgucggccuccg

SEQ ID NO: 1554634 - RNA, 15 nt, Human adenovirus C
ugcggaagggucccg

SEQ ID NO: 1554635 - RNA, 15 nt, Human adenovirus C
acucugacaaagccc

SEQ ID NO: 1554636 - RNA, 18 nt, Human adenovirus C
aucaccgucacccagcac

SEQ ID NO: 1554637 - RNA, 13 nt, Human adenovirus C
gcggcggcuggcg

SEQ ID NO: 1554638 - RNA, 16 nt, Human adenovirus C
gacgcgggcgggcccc

SEQ ID NO: 1554639 - RNA, 20 nt, Human adenovirus C
uggcaccgggacugggcgug

SEQ ID NO: 1554640 - RNA, 12 nt, Human adenovirus C
cgcccagcaaua

SEQ ID NO: 1554641 - RNA, 15 nt, Human adenovirus C
acuuugguucuuaca

SEQ ID NO: 1554642 - RNA, 23 nt, Human adenovirus C
uagcaccgguggguugcugaaac

SEQ ID NO: 1554643 - RNA, 23 nt, Human adenovirus C
augcaguagaagguaagcggguc

SEQ ID NO: 1554644 - RNA, 18 nt, Human adenovirus C
agguccgcgugcggccaa

SEQ ID NO: 1554645 - RNA, 18 nt, Human adenovirus C
cgugcaagacuccaaacu

SEQ ID NO: 1554646 - RNA, 22 nt, Human adenovirus C
gguccagaggaccucugcacuc

SEQ ID NO: 1554647 - RNA, 16 nt, Human adenovirus C
uaaguuugccacacaa

SEQ ID NO: 1554648 - RNA, 15 nt, Human adenovirus C
caccuuucgccaggg

SEQ ID NO: 1554649 - RNA, 22 nt, Human adenovirus C
agucgagaaggaggacagccua

SEQ ID NO: 1554650 - RNA, 15 nt, Human adenovirus C
agccugaauaacaag

SEQ ID NO: 1554651 - RNA, 14 nt, Human adenovirus C
ugacucggcagacg

SEQ ID NO: 1554652 - RNA, 16 nt, Human adenovirus C
accaaggacugguucc

SEQ ID NO: 1554653 - RNA, 16 nt, Human adenovirus C
acaagugcuuugcccg

SEQ ID NO: 1554654 - RNA, 18 nt, Human adenovirus C
cugaacauaaucgugcag

SEQ ID NO: 1554655 - RNA, 18 nt, Human adenovirus C
ggccugguaggcgcagca

SEQ ID NO: 1554656 - RNA, 21 nt, Human adenovirus C
ccucgcgcaaaaaagcaagca

SEQ ID NO: 1554657 - RNA, 18 nt, Human adenovirus C
gugacccggcugcgagag

SEQ ID NO: 1554658 - RNA, 12 nt, Human adenovirus C
cgugacacugca

SEQ ID NO: 1554659 - RNA, 17 nt, Human adenovirus C
gagaacgccuaaaacaa

SEQ ID NO: 1554660 - RNA, 14 nt, Human adenovirus C
gguggaggaggcgc

SEQ ID NO: 1554661 - RNA, 13 nt, Human adenovirus C
agaucggcggcgc

SEQ ID NO: 1554662 - RNA, 11 nt, Human adenovirus C
gcaaccaggaa

SEQ ID NO: 1554663 - RNA, 18 nt, Human adenovirus C
cucgcguccaggccagca

SEQ ID NO: 1554664 - RNA, 21 nt, Human adenovirus C
ugauuauuuaccccccacccu

SEQ ID NO: 1554665 - RNA, 18 nt, Human adenovirus C
acugccuguucgccgacc

SEQ ID NO: 1554666 - RNA, 17 nt, Human adenovirus C
gacccuggugcugccaa

SEQ ID NO: 1554667 - RNA, 21 nt, Human adenovirus C
agccacuuaaaaaaacaaagu

SEQ ID NO: 1554668 - RNA, 22 nt, Human adenovirus C
ccucgcucgacgaagugccaaa

SEQ ID NO: 1554669 - RNA, 23 nt, Human adenovirus C
ugacgaggacgaugaguacgagc

SEQ ID NO: 1554670 - RNA, 15 nt, Human adenovirus C
agauuuuucugcugu

SEQ ID NO: 1554671 - RNA, 20 nt, Human adenovirus C
uccauagagcagcugaccac

SEQ ID NO: 1554672 - RNA, 15 nt, Human adenovirus C
ggcuacuaagaaaac

SEQ ID NO: 1554673 - RNA, 16 nt, Human adenovirus C
agggaagaaacucugg

SEQ ID NO: 1554674 - RNA, 18 nt, Human adenovirus C
ggaggaauacugggacag

SEQ ID NO: 1554675 - RNA, 15 nt, Human adenovirus C
cugcagaccucgucc

SEQ ID NO: 1554676 - RNA, 21 nt, Human adenovirus C
gccucggcgguggcagaugcc

SEQ ID NO: 1554677 - RNA, 22 nt, Human adenovirus C
ccuggcugacaagguggccgcc

SEQ ID NO: 1554678 - RNA, 14 nt, Human adenovirus C
agcacgaaggaggc

SEQ ID NO: 1554679 - RNA, 23 nt, Human adenovirus C
guugcuggugaaggucagcugca

SEQ ID NO: 1554680 - RNA, 23 nt, Human adenovirus C
gccacaacgcgcagcccgugggc

SEQ ID NO: 1554681 - RNA, 14 nt, Human adenovirus C
agacgacagcagcg

SEQ ID NO: 1554682 - RNA, 13 nt, Human adenovirus C
gcagcggcgcgga

SEQ ID NO: 1554683 - RNA, 16 nt, Human adenovirus C
gucaggcgggagcucc

SEQ ID NO: 1554684 - RNA, 12 nt, Human adenovirus C
gcugcagagcca

SEQ ID NO: 1554685 - RNA, 17 nt, Human adenovirus C
cagacgggccaggguca

SEQ ID NO: 1554686 - RNA, 13 nt, Human adenovirus C
guaccuuaaucaa

SEQ ID NO: 1554687 - RNA, 17 nt, Human adenovirus C
cgcagccggugggcccg

SEQ ID NO: 1554688 - RNA, 22 nt, Human adenovirus C
caacagcaggaggaagccaggc

SEQ ID NO: 1554689 - RNA, 15 nt, Human adenovirus C
cgcagcuugagccug

SEQ ID NO: 1554690 - RNA, 20 nt, Human adenovirus C
acccaccgugcagcugaugg

SEQ ID NO: 1554691 - RNA, 15 nt, Human adenovirus C
gcuaccuucugcagc

SEQ ID NO: 1554692 - RNA, 20 nt, Human adenovirus C
ccguggagccugggcuggag

SEQ ID NO: 1554693 - RNA, 17 nt, Human adenovirus C
gcccucaccugccgccu

SEQ ID NO: 1554694 - RNA, 17 nt, Human adenovirus C
ccugcgcgugcccgugc

SEQ ID NO: 1554695 - RNA, 20 nt, Human adenovirus C
gcuugcuuugguauguaccu

SEQ ID NO: 1554696 - RNA, 15 nt, Human adenovirus C
gccugugaugcugga

SEQ ID NO: 1554697 - RNA, 16 nt, Human adenovirus C
uccugagcagcugcga

SEQ ID NO: 1554698 - RNA, 15 nt, Human adenovirus C
ccacugccacagagg

SEQ ID NO: 1554699 - RNA, 23 nt, Human adenovirus C
gccuuaggguugccgccugcugc

SEQ ID NO: 1554700 - RNA, 16 nt, Human adenovirus C
cguggcuacaccuacc

SEQ ID NO: 1554701 - RNA, 17 nt, Human adenovirus C
ugggauaugcuccaggc

SEQ ID NO: 1554702 - RNA, 22 nt, Human adenovirus C
gggugcuuggcauggacggggu

SEQ ID NO: 1554703 - RNA, 22 nt, Human adenovirus C
aaagcagguuccugagcagcug

SEQ ID NO: 1554704 - RNA, 22 nt, Human adenovirus C
gaagcaucugcagcgccagugc

SEQ ID NO: 1554705 - RNA, 18 nt, Human adenovirus C
aucggcugaagcagggcc

SEQ ID NO: 1554706 - RNA, 13 nt, Human adenovirus C
cgaacccccgcgg

SEQ ID NO: 1554707 - RNA, 22 nt, Human adenovirus C
gccuggcgcaaaaucuccugca

SEQ ID NO: 1554708 - RNA, 18 nt, Human adenovirus C
guagacaaggccugcaga

SEQ ID NO: 1554709 - RNA, 15 nt, Human adenovirus C
caagaccaggacgac

SEQ ID NO: 1554710 - RNA, 16 nt, Human adenovirus C
auccgcaauacagaga

SEQ ID NO: 1554711 - RNA, 20 nt, Human adenovirus C
guucugguuccggaugaaaa

SEQ ID NO: 1554712 - RNA, 12 nt, Human adenovirus C
agcacaggccag

SEQ ID NO: 1554713 - RNA, 18 nt, Human adenovirus C
cuccaacgcggcagccgc

SEQ ID NO: 1554714 - RNA, 23 nt, Human adenovirus C
cggcguaguuucgcaggcgcuga

SEQ ID NO: 1554715 - RNA, 21 nt, Human adenovirus C
aagcgaaagcauuaaguggcu

SEQ ID NO: 1554716 - RNA, 18 nt, Human adenovirus C
uccuacuuugacgcgggc

SEQ ID NO: 1554717 - RNA, 21 nt, Human adenovirus C
gacuggaagaugucuuggaaa

SEQ ID NO: 1554718 - RNA, 14 nt, Human adenovirus C
ggagcgaggagguc

SEQ ID NO: 1554719 - RNA, 17 nt, Human adenovirus C
cugcgcccacaccuaca

SEQ ID NO: 1554720 - RNA, 13 nt, Human adenovirus C
ugucuaccugcgg

SEQ ID NO: 1554721 - RNA, 16 nt, Human adenovirus C
ugagccccgggcuggu

SEQ ID NO: 1554722 - RNA, 21 nt, Human adenovirus C
uguccuuggguccggccugcu

SEQ ID NO: 1554723 - RNA, 20 nt, Human adenovirus C
uaccuguguggaagccugga

SEQ ID NO: 1554724 - RNA, 21 nt, Human adenovirus C
uaucagcgccggguggugcac

SEQ ID NO: 1554725 - RNA, 16 nt, Human adenovirus C
acgcugcccgagggca

SEQ ID NO: 1554726 - RNA, 14 nt, Human adenovirus C
cugcugggcgagga

SEQ ID NO: 1554727 - RNA, 14 nt, Human adenovirus C
gcacagcagggaca

SEQ ID NO: 1554728 - RNA, 23 nt, Human adenovirus C
ggggaggggggacacggcggcga

SEQ ID NO: 1554729 - RNA, 23 nt, Human adenovirus C
agcaccguggcgggcggcagcgg

SEQ ID NO: 1554730 - RNA, 18 nt, Human adenovirus C
ccaggccgucuacuccca

SEQ ID NO: 1554731 - RNA, 16 nt, Human adenovirus C
cagugcccgcugucau

SEQ ID NO: 1554732 - RNA, 22 nt, Human adenovirus C
ugcaaggcgcuguauccaaagc

SEQ ID NO: 1554733 - RNA, 15 nt, Human adenovirus C
ugcgcgucggccagg

SEQ ID NO: 1554734 - RNA, 13 nt, Human adenovirus C
uguaccgcgaggc

SEQ ID NO: 1554735 - RNA, 18 nt, Human adenovirus C
ccacggacgacuggcgcc

SEQ ID NO: 1554736 - RNA, 15 nt, Human adenovirus C
gggcugcgcgcuggc

SEQ ID NO: 1554737 - RNA, 16 nt, Human adenovirus C
ugacuuugagguacug

SEQ ID NO: 1554738 - RNA, 17 nt, Human adenovirus C
cgcagcuugagccuggc

SEQ ID NO: 1554739 - RNA, 19 nt, Human adenovirus C
cauguggaguuaccagcca

SEQ ID NO: 1554740 - RNA, 14 nt, Human adenovirus C
gccuuugccuggaa

SEQ ID NO: 1554741 - RNA, 15 nt, Human adenovirus C
ccuauccugccgugc

SEQ ID NO: 1554742 - RNA, 23 nt, Human adenovirus C
gaggcacuaaagcaaggccugcc

SEQ ID NO: 1554743 - RNA, 11 nt, Human adenovirus C
caccaaggcca

SEQ ID NO: 1554744 - RNA, 14 nt, Human adenovirus C
ugguggaggcgcgc

SEQ ID NO: 1554745 - RNA, 22 nt, Human adenovirus C
gcggcaugcgucgugcgcacca

SEQ ID NO: 1554746 - RNA, 17 nt, Human adenovirus C
gcccgccagcccccacc

SEQ ID NO: 1554747 - RNA, 18 nt, Human adenovirus C
gcacgcuuguggcgcgcg

SEQ ID NO: 1554748 - RNA, 19 nt, Human adenovirus C
guacgguuuuccuggccaa

SEQ ID NO: 1554749 - RNA, 23 nt, Human adenovirus C
aauccuguggugagcuguuugau

SEQ ID NO: 1554750 - RNA, 17 nt, Human adenovirus C
cgacagggaagaaacuc

SEQ ID NO: 1554751 - RNA, 15 nt, Human adenovirus C
ggagagcggugguga

SEQ ID NO: 1554752 - RNA, 21 nt, Human adenovirus C
cuguuggaucugcgccagcag

SEQ ID NO: 1554753 - RNA, 23 nt, Human adenovirus C
ccgcgcacaaggaagcagagugg

SEQ ID NO: 1554754 - RNA, 21 nt, Human adenovirus C
cuggcgcaaaaucuccugcac

SEQ ID NO: 1554755 - RNA, 14 nt, Human adenovirus C
uuucuuaccucugg

SEQ ID NO: 1554756 - RNA, 12 nt, Human adenovirus C
aaaaccuucucu

SEQ ID NO: 1554757 - RNA, 17 nt, Human adenovirus C
gccauagcggaugucag

SEQ ID NO: 1554758 - RNA, 19 nt, Human adenovirus C
uggccauuaccuuugacuc

SEQ ID NO: 1554759 - RNA, 16 nt, Human adenovirus C
cgcucugcuuauuaca

SEQ ID NO: 1554760 - RNA, 14 nt, Human adenovirus C
ucuuaaucacaccu

SEQ ID NO: 1554761 - RNA, 15 nt, Human adenovirus C
gcaaccgccucagcu

SEQ ID NO: 1554762 - RNA, 13 nt, Human adenovirus C
ccuucagcugggg

SEQ ID NO: 1554763 - RNA, 15 nt, Human adenovirus C
ucguugaggguccug

SEQ ID NO: 1554764 - RNA, 23 nt, Human adenovirus C
cugcagggaaccgggacuggaac

SEQ ID NO: 1554765 - RNA, 15 nt, Human adenovirus C
gccucuggcauuagc

SEQ ID NO: 1554766 - RNA, 15 nt, Human adenovirus C
uggccagggugcgcu

SEQ ID NO: 1554767 - RNA, 17 nt, Human adenovirus C
guauacagacuugagag

SEQ ID NO: 1554768 - RNA, 16 nt, Human adenovirus C
cgucugaagacaccuu

SEQ ID NO: 1554769 - RNA, 13 nt, Human adenovirus C
gggagcugagccc

SEQ ID NO: 1554770 - RNA, 15 nt, Human adenovirus C
ucccugggaucaggc

SEQ ID NO: 1554771 - RNA, 13 nt, Human adenovirus C
cuuauuuguugcc

SEQ ID NO: 1554772 - RNA, 21 nt, Human adenovirus C
caacuggccccaaacucccau

SEQ ID NO: 1554773 - RNA, 14 nt, Human adenovirus C
cucuuguccugcau

SEQ ID NO: 1554774 - RNA, 19 nt, Human adenovirus C
caaagcaaaccucaccucc

SEQ ID NO: 1554775 - RNA, 23 nt, Human adenovirus C
accguggcgggcggcagcgggug

SEQ ID NO: 1554776 - RNA, 18 nt, Human adenovirus C
uaacgcuggaccugccuc

SEQ ID NO: 1554777 - RNA, 22 nt, Human adenovirus C
acccggcggugcgggcggcgcu

SEQ ID NO: 1554778 - RNA, 11 nt, Human adenovirus C
aggugcugccc

SEQ ID NO: 1554779 - RNA, 21 nt, Human adenovirus C
gcgccugcugggcgaggagga

SEQ ID NO: 1554780 - RNA, 18 nt, Human adenovirus C
aacucuuacaccuucucc

SEQ ID NO: 1554781 - RNA, 21 nt, Human adenovirus C
ggcuuuguuucuccacacaag

SEQ ID NO: 1554782 - RNA, 17 nt, Human adenovirus C
gucuaugcccaggcucc

SEQ ID NO: 1554783 - RNA, 12 nt, Human adenovirus C
gcugcagcugcc

SEQ ID NO: 1554784 - RNA, 16 nt, Human adenovirus C
ugaucagaugaugcaa

SEQ ID NO: 1554785 - RNA, 14 nt, Human adenovirus C
cgggaagaacugga

SEQ ID NO: 1554786 - RNA, 17 nt, Human adenovirus C
guguccacgcucgguga

SEQ ID NO: 1554787 - RNA, 18 nt, Human adenovirus C
gggcuguacauccugcac

SEQ ID NO: 1554788 - RNA, 15 nt, Human adenovirus C
cguuccggcagcagc

SEQ ID NO: 1554789 - RNA, 21 nt, Human adenovirus C
ccaggugcgggcgugacaaac

SEQ ID NO: 1554790 - RNA, 22 nt, Human adenovirus C
uaccgcgucaggaggggcaaca

SEQ ID NO: 1554791 - RNA, 15 nt, Human adenovirus C
cgccagcgacuggaa

SEQ ID NO: 1554792 - RNA, 14 nt, Human adenovirus C
cuagcacuucugug

SEQ ID NO: 1554793 - RNA, 15 nt, Human adenovirus C
caagcuugguggcaa

SEQ ID NO: 1554794 - RNA, 19 nt, Human adenovirus C
guuagcgccugauuucugc

SEQ ID NO: 1554795 - RNA, 18 nt, Human adenovirus C
agaacgggguucuggaaa

SEQ ID NO: 1554796 - RNA, 16 nt, Human adenovirus C
ugauaugguuggacgc

SEQ ID NO: 1554797 - RNA, 16 nt, Human adenovirus C
cgcggcgccgggcccg

SEQ ID NO: 1554798 - RNA, 23 nt, Human adenovirus C
cgcucgaucaucuccccgcggcg

SEQ ID NO: 1554799 - RNA, 12 nt, Human adenovirus C
gcggcaggagca

SEQ ID NO: 1554800 - RNA, 12 nt, Human adenovirus C
agcccgaggaga

SEQ ID NO: 1554801 - RNA, 18 nt, Human adenovirus C
aaccagccugugaugcug

SEQ ID NO: 1554802 - RNA, 15 nt, Human adenovirus C
accacuguuacucag

SEQ ID NO: 1554803 - RNA, 15 nt, Human adenovirus C
aacacaggcuggggc

SEQ ID NO: 1554804 - RNA, 14 nt, Human adenovirus C
uaggcgcagcaucc

SEQ ID NO: 1554805 - RNA, 14 nt, Human adenovirus C
cagggucugccaga

SEQ ID NO: 1554806 - RNA, 20 nt, Human adenovirus C
gcccuuggaggaggcgccgc

SEQ ID NO: 1554807 - RNA, 23 nt, Human adenovirus C
gccgaagaggugucagacgaaac

SEQ ID NO: 1554808 - RNA, 20 nt, Human adenovirus C
uucaaguaacucuacaagcu

SEQ ID NO: 1554809 - RNA, 21 nt, Human adenovirus C
ccaggccagcacgaaggaggc

SEQ ID NO: 1554810 - RNA, 16 nt, Human adenovirus C
ugccacagagggcaug

SEQ ID NO: 1554811 - RNA, 22 nt, Human adenovirus C
gagcacaacauacugacccgcu

SEQ ID NO: 1554812 - RNA, 20 nt, Human adenovirus C
acgccccgcgccacgucaca

SEQ ID NO: 1554813 - RNA, 20 nt, Human adenovirus C
agcauuaaguggcucgcucc

SEQ ID NO: 1554814 - RNA, 22 nt, Human adenovirus C
gggguccacucgcuccagggug

SEQ ID NO: 1554815 - RNA, 16 nt, Human adenovirus C
gcauggccggccacgg

SEQ ID NO: 1554816 - RNA, 16 nt, Human adenovirus C
ugcccuaaauuuaccc

SEQ ID NO: 1554817 - RNA, 20 nt, Human adenovirus C
cucauaacuuggacauaaac

SEQ ID NO: 1554818 - RNA, 13 nt, Human adenovirus C
caaccggcggcag

SEQ ID NO: 1554819 - RNA, 17 nt, Human adenovirus C
ggggcuccgggggcgag

SEQ ID NO: 1554820 - RNA, 17 nt, Human adenovirus C
uaccggcacuucuucuu

SEQ ID NO: 1554821 - RNA, 15 nt, Human adenovirus C
gcccgucucuggggu

SEQ ID NO: 1554822 - RNA, 18 nt, Human adenovirus C
caaggucaacgcuggugg

SEQ ID NO: 1554823 - RNA, 16 nt, Human adenovirus C
ucuggaaggugcugag

SEQ ID NO: 1554824 - RNA, 12 nt, Human adenovirus C
ccgcuacgugcc

SEQ ID NO: 1554825 - RNA, 21 nt, Human adenovirus C
cgguugacaguauuacccaga

SEQ ID NO: 1554826 - RNA, 20 nt, Human adenovirus C
caagccgcucauggcgcagc

SEQ ID NO: 1554827 - RNA, 23 nt, Human adenovirus C
ucaacgcgcgcgcagccuccaug

SEQ ID NO: 1554828 - RNA, 18 nt, Human adenovirus C
uuauacgccaucaucucu

SEQ ID NO: 1554829 - RNA, 15 nt, Human adenovirus C
ggugcgcuugaggcu

SEQ ID NO: 1554830 - RNA, 21 nt, Human adenovirus C
cuaccuggacuuggaggaggg

SEQ ID NO: 1554831 - RNA, 15 nt, Human adenovirus C
cguggcuuaagggug

SEQ ID NO: 1554832 - RNA, 14 nt, Human adenovirus C
caucugcagccucg

SEQ ID NO: 1554833 - RNA, 12 nt, Human adenovirus C
cagcggcggcag

SEQ ID NO: 1554834 - RNA, 19 nt, Human adenovirus C
cacuuggugcuggccugca

SEQ ID NO: 1554835 - RNA, 15 nt, Human adenovirus C
cauucugcagagcau

SEQ ID NO: 1554836 - RNA, 13 nt, Human adenovirus C
aagcaucugcagc

SEQ ID NO: 1554837 - RNA, 20 nt, Human adenovirus C
ggccuugcaggcgcagagac

SEQ ID NO: 1554838 - RNA, 18 nt, Human adenovirus C
gucgcauuccccucgccg

SEQ ID NO: 1554839 - RNA, 22 nt, Human adenovirus C
gccgcgauguuuagcugcacgu

SEQ ID NO: 1554840 - RNA, 18 nt, Human adenovirus C
aacagcgcgagcaggcag

SEQ ID NO: 1554841 - RNA, 12 nt, Human adenovirus C
ggacaguggcag

SEQ ID NO: 1554842 - RNA, 22 nt, Human adenovirus C
aaacucccuuagaaccaaaguu

SEQ ID NO: 1554843 - RNA, 23 nt, Human adenovirus C
aaacuaaaauuggcucuggcauu

SEQ ID NO: 1554844 - RNA, 15 nt, Human adenovirus C
cucaucugcagccuc

SEQ ID NO: 1554845 - RNA, 13 nt, Human adenovirus C
cauccgcccugcu

SEQ ID NO: 1554846 - RNA, 11 nt, Human adenovirus C
caacagcagcg

SEQ ID NO: 1554847 - RNA, 21 nt, Human adenovirus C
aacauuaccucuuuuggcaug

SEQ ID NO: 1554848 - RNA, 21 nt, Human adenovirus C
ccggaccugggcuggcggugg

SEQ ID NO: 1554849 - RNA, 18 nt, Human adenovirus C
gcuaccaccccagcaucg

SEQ ID NO: 1554850 - RNA, 18 nt, Human adenovirus C
ugcaaacuuucuccaaag

SEQ ID NO: 1554851 - RNA, 20 nt, Human adenovirus C
gcuaauggcaauggcucagg

SEQ ID NO: 1554852 - RNA, 20 nt, Human adenovirus C
guucaugggaaacuggcaag

SEQ ID NO: 1554853 - RNA, 20 nt, Human adenovirus C
cccaggcggcggguacagug

SEQ ID NO: 1554854 - RNA, 19 nt, Human adenovirus C
gaggcagagcgacugcgcc

SEQ ID NO: 1554855 - RNA, 16 nt, Human adenovirus C
cauuaccuuugacucu

SEQ ID NO: 1554856 - RNA, 15 nt, Human adenovirus C
ggaggcaggacccug

SEQ ID NO: 1554857 - RNA, 21 nt, Human adenovirus C
gaaggcucgcguccaggccag

SEQ ID NO: 1554858 - RNA, 12 nt, Human adenovirus C
gacgacgaggug

SEQ ID NO: 1554859 - RNA, 15 nt, Human adenovirus C
ccggcaaggcaaugc

SEQ ID NO: 1554860 - RNA, 14 nt, Human adenovirus C
cuguaacugcauca

SEQ ID NO: 1554861 - RNA, 14 nt, Human adenovirus C
uuuagcugcacgua

SEQ ID NO: 1554862 - RNA, 22 nt, Human adenovirus C
ggcgauuucggccaugaacugc

SEQ ID NO: 1554863 - RNA, 13 nt, Human adenovirus C
cacuuaggccaga

SEQ ID NO: 1554864 - RNA, 20 nt, Human adenovirus C
uuugacgcggugaaagacuc

SEQ ID NO: 1554865 - RNA, 14 nt, Human adenovirus C
ugagcuccucaggg

SEQ ID NO: 1554866 - RNA, 20 nt, Human adenovirus C
gccuugcaggcgcagagaca

SEQ ID NO: 1554867 - RNA, 20 nt, Human adenovirus C
cgccaccuguucucaccgcg

SEQ ID NO: 1554868 - RNA, 15 nt, Human adenovirus C
cagcggugcagccac

SEQ ID NO: 1554869 - RNA, 17 nt, Human adenovirus C
cucaucggcugaagcag

SEQ ID NO: 1554870 - RNA, 14 nt, Human adenovirus C
cgagcgguugcugc

SEQ ID NO: 1554871 - RNA, 20 nt, Human adenovirus C
gucgcaaccaggaacagcuc

SEQ ID NO: 1554872 - RNA, 16 nt, Human adenovirus C
ggcgggcggugggccg

SEQ ID NO: 1554873 - RNA, 22 nt, Human adenovirus C
cugcagcagcgcgcgaauaaac

SEQ ID NO: 1554874 - RNA, 21 nt, Human adenovirus C
ugcgggcggcgcugcagagcc

SEQ ID NO: 1554875 - RNA, 19 nt, Human adenovirus C
gcuuauuuguugccuaaag

SEQ ID NO: 1554876 - RNA, 17 nt, Human adenovirus C
cuccacaggcugcgcac

SEQ ID NO: 1554877 - RNA, 20 nt, Human adenovirus C
caguaacugcagcacagcac

SEQ ID NO: 1554878 - RNA, 19 nt, Human adenovirus C
ugcgccguuuaaaaaucaa

SEQ ID NO: 1554879 - RNA, 17 nt, Human adenovirus C
aggggccucuucuucuu

SEQ ID NO: 1554880 - RNA, 16 nt, Human adenovirus C
cggcuggagcugccca

SEQ ID NO: 1554881 - RNA, 14 nt, Human adenovirus C
gcgcggcggcugcu

SEQ ID NO: 1554882 - RNA, 17 nt, Human adenovirus C
gcacaucucgggccagg

SEQ ID NO: 1554883 - RNA, 22 nt, Human adenovirus C
ugacgcaaauagaugagccucc

SEQ ID NO: 1554884 - RNA, 21 nt, Human adenovirus C
cauagcuauaaaugcaggaaa

SEQ ID NO: 1554885 - RNA, 13 nt, Human adenovirus C
agaacaagagcug

SEQ ID NO: 1554886 - RNA, 13 nt, Human adenovirus C
cacucgugcuggc

SEQ ID NO: 1554887 - RNA, 21 nt, Human adenovirus C
cucccaaaauguaaccacugu

SEQ ID NO: 1554888 - RNA, 23 nt, Human adenovirus C
ccaacgcgccuaccaccuucccc

SEQ ID NO: 1554889 - RNA, 20 nt, Human adenovirus C
ugcaacccgcggugcuccuc

SEQ ID NO: 1554890 - RNA, 20 nt, Human adenovirus C
acacaccucgaccacugccg

SEQ ID NO: 1554891 - RNA, 23 nt, Human adenovirus C
aaaggcuacaggggccucuucuu

SEQ ID NO: 1554892 - RNA, 15 nt, Human adenovirus C
gcggcagucugcagc

SEQ ID NO: 1554893 - RNA, 13 nt, Human adenovirus C
gugcggucgcccg

SEQ ID NO: 1554894 - RNA, 21 nt, Human adenovirus C
gaacugaggaugaauugccaa

SEQ ID NO: 1554895 - RNA, 15 nt, Human adenovirus C
accacucgacacggc

SEQ ID NO: 1554896 - RNA, 18 nt, Human adenovirus C
cggggggcuucugaggcu

SEQ ID NO: 1554897 - RNA, 20 nt, Human adenovirus C
gcgcuggggcaggaggacac

SEQ ID NO: 1554898 - RNA, 23 nt, Human adenovirus C
cgccaugggcuccagugagcagg

SEQ ID NO: 1554899 - RNA, 18 nt, Human adenovirus C
ugcuacgaaagggacggg

SEQ ID NO: 1554900 - RNA, 17 nt, Human adenovirus C
acaccuacucuggcucc

SEQ ID NO: 1554901 - RNA, 22 nt, Human adenovirus C
auguagcaugauaaauaugugg

SEQ ID NO: 1554902 - RNA, 22 nt, Human adenovirus C
ggcguugccgcuggacgagggc

SEQ ID NO: 1554903 - RNA, 13 nt, Human adenovirus C
gguucccccuucg

SEQ ID NO: 1554904 - RNA, 21 nt, Human adenovirus C
ccgggucagggcgcgggcuag

SEQ ID NO: 1554905 - RNA, 22 nt, Human adenovirus C
acgcgcgaggcguacgugccgc

SEQ ID NO: 1554906 - RNA, 18 nt, Human adenovirus C
cagcggcggcagcagcag

SEQ ID NO: 1554907 - RNA, 12 nt, Human adenovirus C
caauugcagaaa

SEQ ID NO: 1554908 - RNA, 21 nt, Human adenovirus C
agcgcguaugccugcgcggcc

SEQ ID NO: 1554909 - RNA, 15 nt, Human adenovirus C
ccuugcggcagggcg

SEQ ID NO: 1554910 - RNA, 17 nt, Human adenovirus C
ucccuguagccggaggg

SEQ ID NO: 1554911 - RNA, 16 nt, Human adenovirus C
cccagacacacaucug

SEQ ID NO: 1554912 - RNA, 10 nt, Human adenovirus C
cuggaccccc

SEQ ID NO: 1554913 - RNA, 18 nt, Human adenovirus C
agaauggcgguagugggu

SEQ ID NO: 1554914 - RNA, 13 nt, Human adenovirus C
agguggaacugcu

SEQ ID NO: 1554915 - RNA, 15 nt, Human adenovirus C
gguuauccuuacucu

SEQ ID NO: 1554916 - RNA, 19 nt, Human adenovirus C
agcacaacauacugacccg

SEQ ID NO: 1554917 - RNA, 15 nt, Human adenovirus C
ugggggcgcgcgggg

SEQ ID NO: 1554918 - RNA, 21 nt, Human adenovirus C
cagguggagaugacugaaucu

SEQ ID NO: 1554919 - RNA, 20 nt, Human adenovirus C
cgccaucaucucugucaugg

SEQ ID NO: 1554920 - RNA, 16 nt, Human adenovirus C
acgguuuuccuggcca

SEQ ID NO: 1554921 - RNA, 22 nt, Human adenovirus C
cacgcagacacgaucggcaggc

SEQ ID NO: 1554922 - RNA, 18 nt, Human adenovirus C
gcgacgaaugagcuccac

SEQ ID NO: 1554923 - RNA, 15 nt, Human adenovirus C
gucuaagcagccgcc

SEQ ID NO: 1554924 - RNA, 16 nt, Human adenovirus C
cggcagcggcagcggc

SEQ ID NO: 1554925 - RNA, 21 nt, Human adenovirus C
ucaggcgcauguggacgagca

SEQ ID NO: 1554926 - RNA, 16 nt, Human adenovirus C
cgccgacccggcacug

SEQ ID NO: 1554927 - RNA, 18 nt, Human adenovirus C
ccuccgggcacagcagcg

SEQ ID NO: 1554928 - RNA, 16 nt, Human adenovirus C
gaugcgggccaugagc

SEQ ID NO: 1554929 - RNA, 19 nt, Human adenovirus C
ugcacgaccccuggagagg

SEQ ID NO: 1554930 - RNA, 21 nt, Human adenovirus C
cugauuggccggacaggccgc

SEQ ID NO: 1554931 - RNA, 16 nt, Human adenovirus C
cccuauccugccgugc

SEQ ID NO: 1554932 - RNA, 14 nt, Human adenovirus C
ggaacauucccagc

SEQ ID NO: 1554933 - RNA, 13 nt, Human adenovirus C
gggucgcaggggc

SEQ ID NO: 1554934 - RNA, 15 nt, Human adenovirus C
ccacacaagcucgcc

SEQ ID NO: 1554935 - RNA, 12 nt, Human adenovirus C
gcaggacccagg

SEQ ID NO: 1554936 - RNA, 15 nt, Human adenovirus C
ccccaggcuggggag

SEQ ID NO: 1554937 - RNA, 16 nt, Human adenovirus C
cagagcauaguggugc

SEQ ID NO: 1554938 - RNA, 14 nt, Human adenovirus C
agcgcugccggucu

SEQ ID NO: 1554939 - RNA, 13 nt, Human adenovirus C
uugccaggggcag

SEQ ID NO: 1554940 - RNA, 13 nt, Human adenovirus C
gcggcugcuguug

SEQ ID NO: 1554941 - RNA, 13 nt, Human adenovirus C
cuggaggcaaccc

SEQ ID NO: 1554942 - RNA, 20 nt, Human adenovirus C
gcuggcaacgucggcggcgu

SEQ ID NO: 1554943 - RNA, 15 nt, Human adenovirus C
caguggucuccucag

SEQ ID NO: 1554944 - RNA, 23 nt, Human adenovirus C
cacaguccuuucuccccggcugg

SEQ ID NO: 1554945 - RNA, 23 nt, Human adenovirus C
acgccaccuguucucaccgcgcg

SEQ ID NO: 1554946 - RNA, 22 nt, Human adenovirus C
uguaguauauccacucucucaa

SEQ ID NO: 1554947 - RNA, 12 nt, Human adenovirus C
aucucuuccucc

SEQ ID NO: 1554948 - RNA, 18 nt, Human adenovirus C
caaagcagaccaaagcaa

SEQ ID NO: 1554949 - RNA, 20 nt, Human adenovirus C
aaugugaugggcuccagcau

SEQ ID NO: 1554950 - RNA, 17 nt, Human adenovirus C
ggcggcgacgacggcgc

SEQ ID NO: 1554951 - RNA, 18 nt, Human adenovirus C
caccuacucuggcuccau

SEQ ID NO: 1554952 - RNA, 17 nt, Human adenovirus C
caucuccuaacugcaga

SEQ ID NO: 1554953 - RNA, 13 nt, Human adenovirus C
guugcauguggaa

SEQ ID NO: 1554954 - RNA, 15 nt, Human adenovirus C
uaacucuacaagcuu

SEQ ID NO: 1554955 - RNA, 21 nt, Human adenovirus C
ggugucauaguccagccccuc

SEQ ID NO: 1554956 - RNA, 19 nt, Human adenovirus C
ugugguacuucccagagac

SEQ ID NO: 1554957 - RNA, 16 nt, Human adenovirus C
aacucaggcacaacca

SEQ ID NO: 1554958 - RNA, 14 nt, Human adenovirus C
gguacccaacucca

SEQ ID NO: 1554959 - RNA, 18 nt, Human adenovirus C
gcagaauaagccacaccc

SEQ ID NO: 1554960 - RNA, 15 nt, Human adenovirus C
gggcguagagcuugg

SEQ ID NO: 1554961 - RNA, 22 nt, Human adenovirus C
cccugcgccgugccgccagcgg

SEQ ID NO: 1554962 - RNA, 21 nt, Human adenovirus C
agggcgagguauucagcucaa

SEQ ID NO: 1554963 - RNA, 14 nt, Human adenovirus C
gcccggcgcacggc

SEQ ID NO: 1554964 - RNA, 13 nt, Human adenovirus C
aacgaccacagca

SEQ ID NO: 1554965 - RNA, 19 nt, Human adenovirus C
cuggcaaagcacacugaac

SEQ ID NO: 1554966 - RNA, 19 nt, Human adenovirus C
ugagguacgaugagacccg

SEQ ID NO: 1554967 - RNA, 18 nt, Human adenovirus C
acucacagaccugggcca

SEQ ID NO: 1554968 - RNA, 22 nt, Human adenovirus C
ccgcacgaggggcagugcagac

SEQ ID NO: 1554969 - RNA, 18 nt, Human adenovirus C
gguacgaugagacccgca

SEQ ID NO: 1554970 - RNA, 22 nt, Human adenovirus C
ugagcaaggaaauucccacgcc

SEQ ID NO: 1554971 - RNA, 21 nt, Human adenovirus C
gaucugcuuaaaagccaccug

SEQ ID NO: 1554972 - RNA, 18 nt, Human adenovirus C
uggaucugcgccagcagg

SEQ ID NO: 1554973 - RNA, 12 nt, Human adenovirus C
gcuggccgggca

SEQ ID NO: 1554974 - RNA, 17 nt, Human adenovirus C
gcucccaaaccucagcg

SEQ ID NO: 1554975 - RNA, 12 nt, Human adenovirus C
gcagcggcagca

SEQ ID NO: 1554976 - RNA, 14 nt, Human adenovirus C
uguaauuuacaaca

SEQ ID NO: 1554977 - RNA, 16 nt, Human adenovirus C
gcaggcgcagagacac

SEQ ID NO: 1554978 - RNA, 20 nt, Human adenovirus C
ccaucaacgcgcgcgcagcc

SEQ ID NO: 1554979 - RNA, 19 nt, Human adenovirus C
ggcugacaagguggccgcc

SEQ ID NO: 1554980 - RNA, 19 nt, Human adenovirus C
cugaggccgaggcagcggc

SEQ ID NO: 1554981 - RNA, 18 nt, Human adenovirus C
gacccuccuuugcacucc

SEQ ID NO: 1554982 - RNA, 14 nt, Human adenovirus C
cagucacagucgca

SEQ ID NO: 1554983 - RNA, 23 nt, Human adenovirus C
cagccugcaaagggcccuggcug

SEQ ID NO: 1554984 - RNA, 13 nt, Human adenovirus C
cugucugagggua

SEQ ID NO: 1554985 - RNA, 14 nt, Human adenovirus C
cagcagccgcgggc

SEQ ID NO: 1554986 - RNA, 17 nt, Human adenovirus C
gucgggguuguuucugg

SEQ ID NO: 1554987 - RNA, 15 nt, Human adenovirus C
cggcggcuggcggua

SEQ ID NO: 1554988 - RNA, 21 nt, Human adenovirus C
gcuaacgugucguauguguca

SEQ ID NO: 1554989 - RNA, 14 nt, Human adenovirus C
ucaguaccaacaga

SEQ ID NO: 1554990 - RNA, 20 nt, Human adenovirus C
gcuacaacguagcucagugc

SEQ ID NO: 1554991 - RNA, 21 nt, Human adenovirus C
uugcgcgcgcgguaggcccgg

SEQ ID NO: 1554992 - RNA, 20 nt, Human adenovirus C
aaugggcccacgggcggcgg

SEQ ID NO: 1554993 - RNA, 19 nt, Human adenovirus C
gacacuuucaauaaaggca

SEQ ID NO: 1554994 - RNA, 15 nt, Human adenovirus C
agaugaagaagagga

SEQ ID NO: 1554995 - RNA, 15 nt, Human adenovirus C
guaggaggggcaugg

SEQ ID NO: 1554996 - RNA, 14 nt, Human adenovirus C
acaccuacucuggc

SEQ ID NO: 1554997 - RNA, 18 nt, Human adenovirus C
ccaggcuuugaguugcac

SEQ ID NO: 1554998 - RNA, 19 nt, Human adenovirus C
ggcucgcguccaggccagc

SEQ ID NO: 1554999 - RNA, 13 nt, Human adenovirus C
cacuccacaggcu

SEQ ID NO: 1555000 - RNA, 22 nt, Human adenovirus C
aggggccaagaacaagagcuga

SEQ ID NO: 1555001 - RNA, 18 nt, Human adenovirus C
gcaccguccgaagaaaag

SEQ ID NO: 1555002 - RNA, 17 nt, Human adenovirus C
ccuuuuguuccaccgcu

SEQ ID NO: 1555003 - RNA, 19 nt, Human adenovirus C
cgcgagggagaggagcccg

SEQ ID NO: 1555004 - RNA, 15 nt, Human adenovirus C
ucuuguugcugguga

SEQ ID NO: 1555005 - RNA, 15 nt, Human adenovirus C
gcgcagaugggagcu

SEQ ID NO: 1555006 - RNA, 17 nt, Human adenovirus C
cagcuugagccuggcug

SEQ ID NO: 1555007 - RNA, 17 nt, Human adenovirus C
cacugccgccgccacaa

SEQ ID NO: 1555008 - RNA, 19 nt, Human adenovirus C
gacguaugcgcaggagcac

SEQ ID NO: 1555009 - RNA, 19 nt, Human adenovirus C
caugcagggcacccucccc

SEQ ID NO: 1555010 - RNA, 15 nt, Human adenovirus C
gccaugccccaggcu

SEQ ID NO: 1555011 - RNA, 15 nt, Human adenovirus C
acaugcgagcccaac

SEQ ID NO: 1555012 - RNA, 23 nt, Human adenovirus C
gacuaccuuuccgccgccaacau

SEQ ID NO: 1555013 - RNA, 18 nt, Human adenovirus C
ggccgcggucgcucacau

SEQ ID NO: 1555014 - RNA, 15 nt, Human adenovirus C
ccagacgggccaggg

SEQ ID NO: 1555015 - RNA, 21 nt, Human adenovirus C
agaaauuuccuuuacuccaau

SEQ ID NO: 1555016 - RNA, 13 nt, Human adenovirus C
ccaccggccgugg

SEQ ID NO: 1555017 - RNA, 17 nt, Human adenovirus C
ucagcuugccugcucca

SEQ ID NO: 1555018 - RNA, 16 nt, Human adenovirus C
caccggcggcggcgcg

SEQ ID NO: 1555019 - RNA, 22 nt, Human adenovirus C
ccaccugagccuuugcgccuuc

SEQ ID NO: 1555020 - RNA, 19 nt, Human adenovirus C
ugagggacaaguugaaaga

SEQ ID NO: 1555021 - RNA, 19 nt, Human adenovirus C
caccgugcuuucacuuucc

SEQ ID NO: 1555022 - RNA, 22 nt, Human adenovirus C
gcgugucgaacccaggugugcg

SEQ ID NO: 1555023 - RNA, 11 nt, Human adenovirus C
gcaucccaccu

SEQ ID NO: 1555024 - RNA, 18 nt, Human adenovirus C
cucguacgaggaggcacu

SEQ ID NO: 1555025 - RNA, 19 nt, Human adenovirus C
ggcgaguacuaagcgguga

SEQ ID NO: 1555026 - RNA, 14 nt, Human adenovirus C
gcgccgccggcacu

SEQ ID NO: 1555027 - RNA, 23 nt, Human adenovirus C
gcuuauuacagcgcuugcuuugg

SEQ ID NO: 1555028 - RNA, 21 nt, Human adenovirus C
gccgccgcuucagccgcugca

SEQ ID NO: 1555029 - RNA, 19 nt, Human adenovirus C
uggaucggaccaccacgcc

SEQ ID NO: 1555030 - RNA, 23 nt, Human adenovirus C
gcacuccugacguaaccugcggc

SEQ ID NO: 1555031 - RNA, 21 nt, Human adenovirus C
caccaugcgcgagggacaggc

SEQ ID NO: 1555032 - RNA, 18 nt, Human adenovirus C
acauguggugguuuucca

SEQ ID NO: 1555033 - RNA, 22 nt, Human adenovirus C
cugaaagagguaguugagggug

SEQ ID NO: 1555034 - RNA, 14 nt, Human adenovirus C
cccguagccagugg

SEQ ID NO: 1555035 - RNA, 23 nt, Human adenovirus C
cuggucuugucaugccuggggua

SEQ ID NO: 1555036 - RNA, 18 nt, Human adenovirus C
gccacacgggcggaggag

SEQ ID NO: 1555037 - RNA, 22 nt, Human adenovirus C
cagaccaguagacaaggccugc

SEQ ID NO: 1555038 - RNA, 16 nt, Human adenovirus C
caaaaggcaaacugcc

SEQ ID NO: 1555039 - RNA, 17 nt, Human adenovirus C
caacuaacauaaacaca

SEQ ID NO: 1555040 - RNA, 14 nt, Human adenovirus C
guuugccuuauuau

SEQ ID NO: 1555041 - RNA, 16 nt, Human adenovirus C
cagcaaugccuggagg

SEQ ID NO: 1555042 - RNA, 17 nt, Human adenovirus C
gcaacagcgcgagcagg

SEQ ID NO: 1555043 - RNA, 16 nt, Human adenovirus C
ggugugggaggacgau

SEQ ID NO: 1555044 - RNA, 20 nt, Human adenovirus C
cggcgacaccuuugccacac

SEQ ID NO: 1555045 - RNA, 17 nt, Human adenovirus C
gcggcagacaugcaggg

SEQ ID NO: 1555046 - RNA, 18 nt, Human adenovirus C
cuucggcaucgcgggcgc

SEQ ID NO: 1555047 - RNA, 17 nt, Human adenovirus C
ugccccucgccauagcg

SEQ ID NO: 1555048 - RNA, 12 nt, Human adenovirus C
ccaggacgccuc

SEQ ID NO: 1555049 - RNA, 18 nt, Human adenovirus C
gaagcugcuaaagcaaaa

SEQ ID NO: 1555050 - RNA, 23 nt, Human adenovirus C
ucaguaguauagccccaccacca

SEQ ID NO: 1555051 - RNA, 13 nt, Human adenovirus C
ccagcacacaccu

SEQ ID NO: 1555052 - RNA, 14 nt, Human adenovirus C
gcaaugcuacuaaa

SEQ ID NO: 1555053 - RNA, 13 nt, Human adenovirus C
aggccagaugcug

SEQ ID NO: 1555054 - RNA, 15 nt, Human adenovirus C
cgcacgcccuucucg

SEQ ID NO: 1555055 - RNA, 21 nt, Human adenovirus C
aagugauuaucgagcaggacc

SEQ ID NO: 1555056 - RNA, 12 nt, Human adenovirus C
caguuccaggcg

SEQ ID NO: 1555057 - RNA, 14 nt, Human adenovirus C
cgcgcccuggaggc

SEQ ID NO: 1555058 - RNA, 15 nt, Human adenovirus C
ccccgcugacaccca

SEQ ID NO: 1555059 - RNA, 23 nt, Human adenovirus C
cgccguuggagacugcagccucc

SEQ ID NO: 1555060 - RNA, 21 nt, Human adenovirus C
gcagaggagguuuuggacgag

SEQ ID NO: 1555061 - RNA, 14 nt, Human adenovirus C
gcccgcgccaccga

SEQ ID NO: 1555062 - RNA, 15 nt, Human adenovirus C
caacacggccuccac

SEQ ID NO: 1555063 - RNA, 14 nt, Human adenovirus C
gcaucugcagcgcc

SEQ ID NO: 1555064 - RNA, 13 nt, Human adenovirus C
gcugccagggccg

SEQ ID NO: 1555065 - RNA, 23 nt, Human adenovirus C
cugcagaccguaaaccugagcca

SEQ ID NO: 1555066 - RNA, 21 nt, Human adenovirus C
gaccaaagcaaaccucaccuc

SEQ ID NO: 1555067 - RNA, 14 nt, Human adenovirus C
aagcgggucaaaaa

SEQ ID NO: 1555068 - RNA, 20 nt, Human adenovirus C
cagccgagcggacaagcagc

SEQ ID NO: 1555069 - RNA, 18 nt, Human adenovirus C
ggccguggagacaguguc

SEQ ID NO: 1555070 - RNA, 22 nt, Human adenovirus C
aucgcugucugcgagggccagc

SEQ ID NO: 1555071 - RNA, 18 nt, Human adenovirus C
acaagcuaaaauacaacc

SEQ ID NO: 1555072 - RNA, 20 nt, Human adenovirus C
gaccgagguugcuacgggcg

SEQ ID NO: 1555073 - RNA, 16 nt, Human adenovirus C
gauuucugccagcgcc

SEQ ID NO: 1555074 - RNA, 19 nt, Human adenovirus C
caggacccuggugcugcca

SEQ ID NO: 1555075 - RNA, 16 nt, Human adenovirus C
ucgcuguccagcugcu

SEQ ID NO: 1555076 - RNA, 16 nt, Human adenovirus C
gugguggaccuggcca

SEQ ID NO: 1555077 - RNA, 12 nt, Human adenovirus C
uccugcaucucu

SEQ ID NO: 1555078 - RNA, 21 nt, Human adenovirus C
gccuguccucgagcgguguuc

SEQ ID NO: 1555079 - RNA, 13 nt, Human adenovirus C
gccacacccagcc

SEQ ID NO: 1555080 - RNA, 15 nt, Human adenovirus C
gggagcgaggagguc

SEQ ID NO: 1555081 - RNA, 16 nt, Human adenovirus C
gaggccguggcgcagc

SEQ ID NO: 1555082 - RNA, 15 nt, Human adenovirus C
agccaguggcaacug

SEQ ID NO: 1555083 - RNA, 16 nt, Human adenovirus C
agucacuggucuuguc

SEQ ID NO: 1555084 - RNA, 21 nt, Human adenovirus C
uuaaaucagcacaguaacugc

SEQ ID NO: 1555085 - RNA, 14 nt, Human adenovirus C
aggugcugcucaaa

SEQ ID NO: 1555086 - RNA, 14 nt, Human adenovirus C
cuccgggcugcgcg

SEQ ID NO: 1555087 - RNA, 21 nt, Human adenovirus C
ucccaucgcgcccauggcuac

SEQ ID NO: 1555088 - RNA, 20 nt, Human adenovirus C
cuggagcugcccaagacuac

SEQ ID NO: 1555089 - RNA, 13 nt, Human adenovirus C
accaggcagugca

SEQ ID NO: 1555090 - RNA, 16 nt, Human adenovirus C
cggaacauuaacaaaa

SEQ ID NO: 1555091 - RNA, 15 nt, Human adenovirus C
gcagggucccucgcc

SEQ ID NO: 1555092 - RNA, 18 nt, Human adenovirus C
cuucccccguaacauccu

SEQ ID NO: 1555093 - RNA, 23 nt, Human adenovirus C
auuaugagcaaggaaauucccac

SEQ ID NO: 1555094 - RNA, 22 nt, Human adenovirus C
acaauguggccuccgacugugg

SEQ ID NO: 1555095 - RNA, 23 nt, Human adenovirus C
gucuuuguaguagucuugcauga

SEQ ID NO: 1555096 - RNA, 21 nt, Human adenovirus C
uaucagcagccgcgggcccuu

SEQ ID NO: 1555097 - RNA, 19 nt, Human adenovirus C
ccuucgcagggccagcuga

SEQ ID NO: 1555098 - RNA, 18 nt, Human adenovirus C
ccaacucugguaucucag

SEQ ID NO: 1555099 - RNA, 12 nt, Human adenovirus C
ccuccgcaccca

SEQ ID NO: 1555100 - RNA, 15 nt, Human adenovirus C
cucuuccuccuggag

SEQ ID NO: 1555101 - RNA, 17 nt, Human adenovirus C
cucccguguagacacuu

SEQ ID NO: 1555102 - RNA, 16 nt, Human adenovirus C
ggccauuuccuucucc

SEQ ID NO: 1555103 - RNA, 17 nt, Human adenovirus C
agcuugagugcaugcag

SEQ ID NO: 1555104 - RNA, 21 nt, Human adenovirus C
aagcaagauguuuggcggggc

SEQ ID NO: 1555105 - RNA, 17 nt, Human adenovirus C
uacuaaaaaacuggaag

SEQ ID NO: 1555106 - RNA, 20 nt, Human adenovirus C
aaagaacagauaauggcauu

SEQ ID NO: 1555107 - RNA, 16 nt, Human adenovirus C
cggccugguaggcgca

SEQ ID NO: 1555108 - RNA, 23 nt, Human adenovirus C
cacaccggggcgcgcugcggcug

SEQ ID NO: 1555109 - RNA, 20 nt, Human adenovirus C
acuuuccgcuucacuggacu

SEQ ID NO: 1555110 - RNA, 15 nt, Human adenovirus C
cucgcgccuguugcu

SEQ ID NO: 1555111 - RNA, 18 nt, Human adenovirus C
acaagugggaauuugaag

SEQ ID NO: 1555112 - RNA, 17 nt, Human adenovirus C
ccgccgcuuucuucucu

SEQ ID NO: 1555113 - RNA, 15 nt, Human adenovirus C
caaagcccgccaaga

SEQ ID NO: 1555114 - RNA, 17 nt, Human adenovirus C
acuggcugcagccaggg

SEQ ID NO: 1555115 - RNA, 14 nt, Human adenovirus C
accuggucuccuac

SEQ ID NO: 1555116 - RNA, 19 nt, Human adenovirus C
ccagguacagcccacccug

SEQ ID NO: 1555117 - RNA, 17 nt, Human adenovirus C
gucuucauucagccgcc

SEQ ID NO: 1555118 - RNA, 23 nt, Human adenovirus C
gcccuagccgcgcgucccugcgc

SEQ ID NO: 1555119 - RNA, 16 nt, Human adenovirus C
cggcagaagauccccu

SEQ ID NO: 1555120 - RNA, 16 nt, Human adenovirus C
uucaaaucaaacuuuc

SEQ ID NO: 1555121 - RNA, 19 nt, Human adenovirus C
ccgucaagaaaaacaccac

SEQ ID NO: 1555122 - RNA, 21 nt, Human adenovirus C
ugaacgggguguuugacauga

SEQ ID NO: 1555123 - RNA, 16 nt, Human adenovirus C
ccugugcugccagggc

SEQ ID NO: 1555124 - RNA, 21 nt, Human adenovirus C
uaguuaagagagcugcagcug

SEQ ID NO: 1555125 - RNA, 14 nt, Human adenovirus C
auggcacccaaaaa

SEQ ID NO: 1555126 - RNA, 22 nt, Human adenovirus C
aaaaggcuguccguguccccgu

SEQ ID NO: 1555127 - RNA, 14 nt, Human adenovirus C
agccgcugcagcca

SEQ ID NO: 1555128 - RNA, 11 nt, Human adenovirus C
gucacaaacuc

SEQ ID NO: 1555129 - RNA, 23 nt, Human adenovirus C
cugguacuuuaacggcucuucau

SEQ ID NO: 1555130 - RNA, 14 nt, Human adenovirus C
gaagcugcagcugc

SEQ ID NO: 1555131 - RNA, 13 nt, Human adenovirus C
auggaaaccccag

SEQ ID NO: 1555132 - RNA, 14 nt, Human adenovirus C
ggacgagcccaccc

SEQ ID NO: 1555133 - RNA, 22 nt, Human adenovirus C
cagcgccggguggugcacgcug

SEQ ID NO: 1555134 - RNA, 16 nt, Human adenovirus C
cacgggcagccuggag

SEQ ID NO: 1555135 - RNA, 13 nt, Human adenovirus C
cggucccacagcu

SEQ ID NO: 1555136 - RNA, 12 nt, Human adenovirus C
caaauccauaca

SEQ ID NO: 1555137 - RNA, 13 nt, Human adenovirus C
gcgccugcugcca

SEQ ID NO: 1555138 - RNA, 14 nt, Human adenovirus C
ccgcucccaccacu

SEQ ID NO: 1555139 - RNA, 17 nt, Human adenovirus C
gcagguuccugagcagc

SEQ ID NO: 1555140 - RNA, 18 nt, Human adenovirus C
ugaccgucuggcugcucg

SEQ ID NO: 1555141 - RNA, 21 nt, Human adenovirus C
accuaaacaacucgcugcugc

SEQ ID NO: 1555142 - RNA, 19 nt, Human adenovirus C
uguacucguucuucagaaa

SEQ ID NO: 1555143 - RNA, 22 nt, Human adenovirus C
acgccugcuuaaaacccugcaa

SEQ ID NO: 1555144 - RNA, 14 nt, Human adenovirus C
ggcaagcgcgcgcu

SEQ ID NO: 1555145 - RNA, 13 nt, Human adenovirus C
ucccacccccacu

SEQ ID NO: 1555146 - RNA, 19 nt, Human adenovirus C
ugaccaagcaguuccaggc

SEQ ID NO: 1555147 - RNA, 17 nt, Human adenovirus C
acucacagaccugggcc

SEQ ID NO: 1555148 - RNA, 21 nt, Human adenovirus C
cuacgucaucuccagcggcca

SEQ ID NO: 1555149 - RNA, 13 nt, Human adenovirus C
cgccagugcgcca

SEQ ID NO: 1555150 - RNA, 15 nt, Human adenovirus C
auaagggccuccccu

SEQ ID NO: 1555151 - RNA, 17 nt, Human adenovirus C
cuugaacccgcacuggc

SEQ ID NO: 1555152 - RNA, 15 nt, Human adenovirus C
gcguaacuugcugga

SEQ ID NO: 1555153 - RNA, 20 nt, Human adenovirus C
gguggcguggucaaacucua

SEQ ID NO: 1555154 - RNA, 19 nt, Human adenovirus C
acgucaucuccagcggcca

SEQ ID NO: 1555155 - RNA, 17 nt, Human adenovirus C
cuggaaggugcugaggu

SEQ ID NO: 1555156 - RNA, 22 nt, Human adenovirus C
agcccuacuccggcacugccua

SEQ ID NO: 1555157 - RNA, 17 nt, Human adenovirus C
ugcuacgggcgggcugc

SEQ ID NO: 1555158 - RNA, 18 nt, Human adenovirus C
cugccaccucccucccaa

SEQ ID NO: 1555159 - RNA, 23 nt, Human adenovirus C
uaccuuuccgccgccaacaugcu

SEQ ID NO: 1555160 - RNA, 18 nt, Human adenovirus C
cacagggaugugcccggc

SEQ ID NO: 1555161 - RNA, 11 nt, Human adenovirus C
acgggcgcagg

SEQ ID NO: 1555162 - RNA, 20 nt, Human adenovirus C
gaaccuuuggacaccuccca

SEQ ID NO: 1555163 - RNA, 17 nt, Human adenovirus C
ccaacaccuagccuaaa

SEQ ID NO: 1555164 - RNA, 12 nt, Human adenovirus C
accgccucagcu

SEQ ID NO: 1555165 - RNA, 13 nt, Human adenovirus C
aggggcagugcag

SEQ ID NO: 1555166 - RNA, 18 nt, Human adenovirus C
gaacugguugacggccug

SEQ ID NO: 1555167 - RNA, 21 nt, Human adenovirus C
gccgcgcgcgggcaggagcug

SEQ ID NO: 1555168 - RNA, 14 nt, Human adenovirus C
aaccucaccuccca

SEQ ID NO: 1555169 - RNA, 19 nt, Human adenovirus C
gcccgugcacuccaagagc

SEQ ID NO: 1555170 - RNA, 16 nt, Human adenovirus C
gcagggugacaagguc

SEQ ID NO: 1555171 - RNA, 14 nt, Human adenovirus C
ggaagccaugcuca

SEQ ID NO: 1555172 - RNA, 12 nt, Human adenovirus C
acggacaguggc

SEQ ID NO: 1555173 - RNA, 22 nt, Human adenovirus C
uugcauuucccacgcuuugagu

SEQ ID NO: 1555174 - RNA, 21 nt, Human adenovirus C
aggcagugcaaaauaagauua

SEQ ID NO: 1555175 - RNA, 19 nt, Human adenovirus C
agacgccgcaccugccccu

SEQ ID NO: 1555176 - RNA, 21 nt, Human adenovirus C
aucaaaauaaaaagucuggag

SEQ ID NO: 1555177 - RNA, 14 nt, Human adenovirus C
gcggucggccaugc

SEQ ID NO: 1555178 - RNA, 11 nt, Human adenovirus C
caaccccacca

SEQ ID NO: 1555179 - RNA, 23 nt, Human adenovirus C
guaccugagccccgggcuggugc

SEQ ID NO: 1555180 - RNA, 20 nt, Human adenovirus C
gcggaugucagccuugccua

SEQ ID NO: 1555181 - RNA, 19 nt, Human adenovirus C
ugagcaggaacugaaagcc

SEQ ID NO: 1555182 - RNA, 18 nt, Human adenovirus C
agugcagcacagcaggga

SEQ ID NO: 1555183 - RNA, 14 nt, Human adenovirus C
uguguggucaagca

SEQ ID NO: 1555184 - RNA, 14 nt, Human adenovirus C
agcccuacuccggc

SEQ ID NO: 1555185 - RNA, 22 nt, Human adenovirus C
gcacaacauacugacccgcugu

SEQ ID NO: 1555186 - RNA, 18 nt, Human adenovirus C
cggcgacgacggcgcacc

SEQ ID NO: 1555187 - RNA, 18 nt, Human adenovirus C
cuugauccccgcccuccc

SEQ ID NO: 1555188 - RNA, 18 nt, Human adenovirus C
gccagcgccugcacugca

SEQ ID NO: 1555189 - RNA, 13 nt, Human adenovirus C
cagguacagccca

SEQ ID NO: 1555190 - RNA, 22 nt, Human adenovirus C
cgcuccacgguggcggcgaggu

SEQ ID NO: 1555191 - RNA, 14 nt, Human adenovirus C
acuuggcgauggag

SEQ ID NO: 1555192 - RNA, 14 nt, Human adenovirus C
gaucggcaggcuca

SEQ ID NO: 1555193 - RNA, 17 nt, Human adenovirus C
agagagcugcagcugcc

SEQ ID NO: 1555194 - RNA, 18 nt, Human adenovirus C
aaacaauacuaaaaaacu

SEQ ID NO: 1555195 - RNA, 20 nt, Human adenovirus C
caaacgacccguagagggcg

SEQ ID NO: 1555196 - RNA, 16 nt, Human adenovirus C
ccgcccuagccgcgcg

SEQ ID NO: 1555197 - RNA, 19 nt, Human adenovirus C
aaaauacaaccccaccaau

SEQ ID NO: 1555198 - RNA, 18 nt, Human adenovirus C
caggcuacuaagaaaaca

SEQ ID NO: 1555199 - RNA, 17 nt, Human adenovirus C
cuuauucagcaucaccu

SEQ ID NO: 1555200 - RNA, 16 nt, Human adenovirus C
gcggugcgggcggcgc

SEQ ID NO: 1555201 - RNA, 12 nt, Human adenovirus C
ggcccacgggcg

SEQ ID NO: 1555202 - RNA, 21 nt, Human adenovirus C
auguggccuccgacugugguu

SEQ ID NO: 1555203 - RNA, 17 nt, Human adenovirus C
acucaggucaaaaaagc

SEQ ID NO: 1555204 - RNA, 16 nt, Human adenovirus C
ccccgggcuggugcag

SEQ ID NO: 1555205 - RNA, 20 nt, Human adenovirus C
ugcuaaccagcguagccccu

SEQ ID NO: 1555206 - RNA, 13 nt, Human adenovirus C
agggcccuggcug

SEQ ID NO: 1555207 - RNA, 20 nt, Human adenovirus C
ucccagcugcuacaacaaac

SEQ ID NO: 1555208 - RNA, 19 nt, Human adenovirus C
cgcaccuacaagcgcgugu

SEQ ID NO: 1555209 - RNA, 18 nt, Human adenovirus C
ccaauauugcgcuguacc

SEQ ID NO: 1555210 - RNA, 20 nt, Human adenovirus C
cagcggcaacgugcagacca

SEQ ID NO: 1555211 - RNA, 16 nt, Human adenovirus C
uccgccguaggcaugc

SEQ ID NO: 1555212 - RNA, 17 nt, Human adenovirus C
aggcguugaggccuccc

SEQ ID NO: 1555213 - RNA, 18 nt, Human adenovirus C
caaggguaucauggcgga

SEQ ID NO: 1555214 - RNA, 13 nt, Human adenovirus C
caaugacuacagc

SEQ ID NO: 1555215 - RNA, 14 nt, Human adenovirus C
agcgcgcugaggcc

SEQ ID NO: 1555216 - RNA, 18 nt, Human adenovirus C
gcuaugugcagcagagcg

SEQ ID NO: 1555217 - RNA, 13 nt, Human adenovirus C
ucaaguacuagcu

SEQ ID NO: 1555218 - RNA, 18 nt, Human adenovirus C
cguggagccugggcugga

SEQ ID NO: 1555219 - RNA, 22 nt, Human adenovirus C
uugcaagacagaaacacagagc

SEQ ID NO: 1555220 - RNA, 22 nt, Human adenovirus C
uucacccacagccgccugagca

SEQ ID NO: 1555221 - RNA, 14 nt, Human adenovirus C
agugggcaggcaga

SEQ ID NO: 1555222 - RNA, 15 nt, Human adenovirus C
cccuucucccacccc

SEQ ID NO: 1555223 - RNA, 15 nt, Human adenovirus C
cgguagaggggccag

SEQ ID NO: 1555224 - RNA, 21 nt, Human adenovirus C
ggccauuagugcuaugacuca

SEQ ID NO: 1555225 - RNA, 16 nt, Human adenovirus C
cgcgccuaccaccuuc

SEQ ID NO: 1555226 - RNA, 22 nt, Human adenovirus C
caccacugugguacuucccaga

SEQ ID NO: 1555227 - RNA, 15 nt, Human adenovirus C
auuaccauguacaug

SEQ ID NO: 1555228 - RNA, 15 nt, Human adenovirus C
cgcggcgacagguca

SEQ ID NO: 1555229 - RNA, 16 nt, Human adenovirus C
ugcuccagagcgcccu

SEQ ID NO: 1555230 - RNA, 15 nt, Human adenovirus C
agccgccgugcgccc

SEQ ID NO: 1555231 - RNA, 23 nt, Human adenovirus C
gcccacaacacggccuccacgcu

SEQ ID NO: 1555232 - RNA, 18 nt, Human adenovirus C
gugggugagcgcggaggc

SEQ ID NO: 1555233 - RNA, 15 nt, Human adenovirus C
agauuauacccacaa

SEQ ID NO: 1555234 - RNA, 23 nt, Human adenovirus C
agcucagugcaacaugaccaagg

SEQ ID NO: 1555235 - RNA, 19 nt, Human adenovirus C
aggcgcuguauccaaagcu

SEQ ID NO: 1555236 - RNA, 23 nt, Human adenovirus C
accugugcuuugcucccaaaccu

SEQ ID NO: 1555237 - RNA, 18 nt, Human adenovirus C
gccccaaucaaucagccu

SEQ ID NO: 1555238 - RNA, 17 nt, Human adenovirus C
gaggugcuugccaccua

SEQ ID NO: 1555239 - RNA, 19 nt, Human adenovirus C
aacucugguaucucagccg

SEQ ID NO: 1555240 - RNA, 13 nt, Human adenovirus C
ccggccgacgggc

SEQ ID NO: 1555241 - RNA, 17 nt, Human adenovirus C
gccuccccuucuucuuc

SEQ ID NO: 1555242 - RNA, 14 nt, Human adenovirus C
cccgccaggaacca

SEQ ID NO: 1555243 - RNA, 13 nt, Human adenovirus C
cgcuggccagggu

SEQ ID NO: 1555244 - RNA, 20 nt, Human adenovirus C
augcgccacuggcagggaca

SEQ ID NO: 1555245 - RNA, 16 nt, Human adenovirus C
caccaacgaccagucc

SEQ ID NO: 1555246 - RNA, 23 nt, Human adenovirus C
ugcaagucuagcgccugcugcca

SEQ ID NO: 1555247 - RNA, 17 nt, Human adenovirus C
caguggcaacuggcaaa

SEQ ID NO: 1555248 - RNA, 19 nt, Human adenovirus C
gcuaauggcaauggcucag

SEQ ID NO: 1555249 - RNA, 11 nt, Human adenovirus C
gaccugcacgu

SEQ ID NO: 1555250 - RNA, 11 nt, Human adenovirus C
uguggaagccu

SEQ ID NO: 1555251 - RNA, 23 nt, Human adenovirus C
cugacccggagaugcagcgcaag

SEQ ID NO: 1555252 - RNA, 21 nt, Human adenovirus C
cuucgcaaauuuguaccugag

SEQ ID NO: 1555253 - RNA, 19 nt, Human adenovirus C
aggcguugaggccucccuc

SEQ ID NO: 1555254 - RNA, 20 nt, Human adenovirus C
gcuacaccuaccgccccaga

SEQ ID NO: 1555255 - RNA, 20 nt, Human adenovirus C
uuuaauuaaguauaugagca

SEQ ID NO: 1555256 - RNA, 14 nt, Human adenovirus C
acugacaccuauca

SEQ ID NO: 1555257 - RNA, 18 nt, Human adenovirus C
uacaauauuggcuaccag

SEQ ID NO: 1555258 - RNA, 18 nt, Human adenovirus C
gcuggaagccaugcucag

SEQ ID NO: 1555259 - RNA, 14 nt, Human adenovirus C
cgacgaaugagcuc

SEQ ID NO: 1555260 - RNA, 12 nt, Human adenovirus C
gggauggcgggc

SEQ ID NO: 1555261 - RNA, 17 nt, Human adenovirus C
cguaaaccugagccagg

SEQ ID NO: 1555262 - RNA, 20 nt, Human adenovirus C
cgcucgggcuugggagaggg

SEQ ID NO: 1555263 - RNA, 16 nt, Human adenovirus C
gcuuucagggacaauu

SEQ ID NO: 1555264 - RNA, 17 nt, Human adenovirus C
gccgggagagggggcag

SEQ ID NO: 1555265 - RNA, 14 nt, Human adenovirus C
gcucaucuccgccg

SEQ ID NO: 1555266 - RNA, 16 nt, Human adenovirus C
ccguggcgggcggcag

SEQ ID NO: 1555267 - RNA, 20 nt, Human adenovirus C
cgccgcuucagccgcugcag

SEQ ID NO: 1555268 - RNA, 18 nt, Human adenovirus C
uuaagagagcugcagcug

SEQ ID NO: 1555269 - RNA, 20 nt, Human adenovirus C
cuccaggcgggcaagauuau

SEQ ID NO: 1555270 - RNA, 20 nt, Human adenovirus C
cagcagaaaccugugcugcc

SEQ ID NO: 1555271 - RNA, 17 nt, Human adenovirus C
cuggaacagcagcacag

SEQ ID NO: 1555272 - RNA, 14 nt, Human adenovirus C
ggcagaagcugccg

SEQ ID NO: 1555273 - RNA, 22 nt, Human adenovirus C
uuguaaauaucaggaauuguug

SEQ ID NO: 1555274 - RNA, 12 nt, Human adenovirus C
ucaccaaggcca

SEQ ID NO: 1555275 - RNA, 20 nt, Human adenovirus C
agcuguugcccgugcacucc

SEQ ID NO: 1555276 - RNA, 19 nt, Human adenovirus C
ccuccaccggccguggaga

SEQ ID NO: 1555277 - RNA, 21 nt, Human adenovirus C
cugcccuaaauuuaccccaag

SEQ ID NO: 1555278 - RNA, 18 nt, Human adenovirus C
aagaacuauggcagcaag

SEQ ID NO: 1555279 - RNA, 15 nt, Human adenovirus C
uggugcaggagcgca

SEQ ID NO: 1555280 - RNA, 15 nt, Human adenovirus C
cuggcaaagcacacu

SEQ ID NO: 1555281 - RNA, 18 nt, Human adenovirus C
uacucagccacuuaaaaa

SEQ ID NO: 1555282 - RNA, 16 nt, Human adenovirus C
gugguggaggaggcgc

SEQ ID NO: 1555283 - RNA, 18 nt, Human adenovirus C
cuccauguuguugggaaa

SEQ ID NO: 1555284 - RNA, 20 nt, Human adenovirus C
gcggccuaccggggggagaa

SEQ ID NO: 1555285 - RNA, 15 nt, Human adenovirus C
ugagcgacgaccugg

SEQ ID NO: 1555286 - RNA, 17 nt, Human adenovirus C
gacaaguugaaagagca

SEQ ID NO: 1555287 - RNA, 19 nt, Human adenovirus C
agaugacuaacucaggggc

SEQ ID NO: 1555288 - RNA, 16 nt, Human adenovirus C
aacaugcuaccucuuu

SEQ ID NO: 1555289 - RNA, 18 nt, Human adenovirus C
acaccucgaccacugccg

SEQ ID NO: 1555290 - RNA, 20 nt, Human adenovirus C
ccaucgcgcccauggcuacc

SEQ ID NO: 1555291 - RNA, 20 nt, Human adenovirus C
caagcuaaugauggccgcag

SEQ ID NO: 1555292 - RNA, 19 nt, Human adenovirus C
augccugcgcggccuuccg

SEQ ID NO: 1555293 - RNA, 17 nt, Human adenovirus C
cccaggacucguaacca

SEQ ID NO: 1555294 - RNA, 19 nt, Human adenovirus C
gcacgaccgucagcggggu

SEQ ID NO: 1555295 - RNA, 22 nt, Human adenovirus C
ccauuugaugcucaaacaaaac

SEQ ID NO: 1555296 - RNA, 15 nt, Human adenovirus C
ugccucaaaccggcc

SEQ ID NO: 1555297 - RNA, 14 nt, Human adenovirus C
acugccgccgccac

SEQ ID NO: 1555298 - RNA, 15 nt, Human adenovirus C
cuacgggcgggcugc

SEQ ID NO: 1555299 - RNA, 15 nt, Human adenovirus C
ccucacucucuuccg

SEQ ID NO: 1555300 - RNA, 22 nt, Human adenovirus C
cuggcgaacgcgacgacgcggc

SEQ ID NO: 1555301 - RNA, 13 nt, Human adenovirus C
accucaggcacca

SEQ ID NO: 1555302 - RNA, 13 nt, Human adenovirus C
ucccgcggcgaca

SEQ ID NO: 1555303 - RNA, 16 nt, Human adenovirus C
cgugguaaaggugacu

SEQ ID NO: 1555304 - RNA, 20 nt, Human adenovirus C
agcugaucgugcgccgugca

SEQ ID NO: 1555305 - RNA, 16 nt, Human adenovirus C
cgcgcgcuggggcagg

SEQ ID NO: 1555306 - RNA, 13 nt, Human adenovirus C
gggacaccacugg

SEQ ID NO: 1555307 - RNA, 14 nt, Human adenovirus C
gcuggucucuggac

SEQ ID NO: 1555308 - RNA, 18 nt, Human adenovirus C
ggccacacccggcgccag

SEQ ID NO: 1555309 - RNA, 19 nt, Human adenovirus C
cguccuaucgagccgcacu

SEQ ID NO: 1555310 - RNA, 16 nt, Human adenovirus C
aggcaguagcuugaag

SEQ ID NO: 1555311 - RNA, 20 nt, Human adenovirus C
ugcagauauggcccucaccu

SEQ ID NO: 1555312 - RNA, 17 nt, Human adenovirus C
ucgccagcccgugcugg

SEQ ID NO: 1555313 - RNA, 17 nt, Human adenovirus C
uugaaauccugugguga

SEQ ID NO: 1555314 - RNA, 12 nt, Human adenovirus C
uagaggagccuc

SEQ ID NO: 1555315 - RNA, 22 nt, Human adenovirus C
acaacaguuuccagcgagacga

SEQ ID NO: 1555316 - RNA, 14 nt, Human adenovirus C
auauccauaccuug

SEQ ID NO: 1555317 - RNA, 16 nt, Human adenovirus C
gcgaugagcagcuggc

SEQ ID NO: 1555318 - RNA, 18 nt, Human adenovirus C
agcauugauggucgcccc

SEQ ID NO: 1555319 - RNA, 15 nt, Human adenovirus C
cggucuucgcccugc

SEQ ID NO: 1555320 - RNA, 14 nt, Human adenovirus C
ugacagggcccagu

SEQ ID NO: 1555321 - RNA, 17 nt, Human adenovirus C
ggcaggacccuggugcu

SEQ ID NO: 1555322 - RNA, 19 nt, Human adenovirus C
ggucacggugaaggggugc

SEQ ID NO: 1555323 - RNA, 15 nt, Human adenovirus C
ggcaggagcuggugc

SEQ ID NO: 1555324 - RNA, 13 nt, Human adenovirus C
ggccucuucuucu

SEQ ID NO: 1555325 - RNA, 14 nt, Human adenovirus C
gcccuggaggcagc

SEQ ID NO: 1555326 - RNA, 20 nt, Human adenovirus C
cguucaugggaaacuggcaa

SEQ ID NO: 1555327 - RNA, 12 nt, Human adenovirus C
aagggugggaaa

SEQ ID NO: 1555328 - RNA, 23 nt, Human adenovirus C
gacgaagcuuccgaggccgaaga

SEQ ID NO: 1555329 - RNA, 14 nt, Human adenovirus C
uccgaggccgaaga

SEQ ID NO: 1555330 - RNA, 14 nt, Human adenovirus C
acucaccaaggcca

SEQ ID NO: 1555331 - RNA, 22 nt, Human adenovirus C
uagaaucauugaaaaccaugga

SEQ ID NO: 1555332 - RNA, 15 nt, Human adenovirus C
gugcuuaccuugagc

SEQ ID NO: 1555333 - RNA, 18 nt, Human adenovirus C
cgacuacgguaccgcgcg

SEQ ID NO: 1555334 - RNA, 13 nt, Human adenovirus C
cuuuccacgggcg

SEQ ID NO: 1555335 - RNA, 18 nt, Human adenovirus C
uaaugucguuucucagca

SEQ ID NO: 1555336 - RNA, 21 nt, Human adenovirus C
acguagaggggcucucugagu

SEQ ID NO: 1555337 - RNA, 15 nt, Human adenovirus C
gcccuggaggcagcu

SEQ ID NO: 1555338 - RNA, 17 nt, Human adenovirus C
gcauugcguaccucagg

SEQ ID NO: 1555339 - RNA, 12 nt, Human adenovirus C
ccggcaccaccg

SEQ ID NO: 1555340 - RNA, 16 nt, Human adenovirus C
gggcaggagcuggugc

SEQ ID NO: 1555341 - RNA, 15 nt, Human adenovirus C
gcuacuaagaaaaca

SEQ ID NO: 1555342 - RNA, 19 nt, Human adenovirus C
aguucgccaccaccgccuc

SEQ ID NO: 1555343 - RNA, 23 nt, Human adenovirus C
ggcgcacucacagaccugggcca

SEQ ID NO: 1555344 - RNA, 15 nt, Human adenovirus C
cacucugagacgaag

SEQ ID NO: 1555345 - RNA, 21 nt, Human adenovirus C
cgcagcccuaucagcagccgc

SEQ ID NO: 1555346 - RNA, 18 nt, Human adenovirus C
cauccgcccugcucccag

SEQ ID NO: 1555347 - RNA, 13 nt, Human adenovirus C
cgcggcggcggcc

SEQ ID NO: 1555348 - RNA, 18 nt, Human adenovirus C
caccuacgacuacaugaa

SEQ ID NO: 1555349 - RNA, 16 nt, Human adenovirus C
cuuuggcgcaucccau

SEQ ID NO: 1555350 - RNA, 24 nt, Human adenovirus C
gcccuugcggcagucugcagcgcu

SEQ ID NO: 1555351 - RNA, 15 nt, Human adenovirus C
cgcggugcaggcggc

SEQ ID NO: 1555352 - RNA, 18 nt, Human adenovirus C
ugauccagucguagcagg

SEQ ID NO: 1555353 - RNA, 20 nt, Human adenovirus C
ccaaagcaaaccucaccucc

SEQ ID NO: 1555354 - RNA, 11 nt, Human adenovirus C
uuuucugcugu

SEQ ID NO: 1555355 - RNA, 16 nt, Human adenovirus C
agcgguuaagcuggga

SEQ ID NO: 1555356 - RNA, 13 nt, Human adenovirus C
aucugcgucuccg

SEQ ID NO: 1555357 - RNA, 15 nt, Human adenovirus C
cugaucuucucagaa

SEQ ID NO: 1555358 - RNA, 16 nt, Human adenovirus C
agccugggcuggagcc

SEQ ID NO: 1555359 - RNA, 18 nt, Human adenovirus C
agacguugaagcuggcgu

SEQ ID NO: 1555360 - RNA, 20 nt, Human adenovirus C
cguacgugccgcggcagaac

SEQ ID NO: 1555361 - RNA, 21 nt, Human adenovirus C
gcaaggguaucauggcggacg

SEQ ID NO: 1555362 - RNA, 19 nt, Human adenovirus C
aaaccgggccuccaacugu

SEQ ID NO: 1555363 - RNA, 14 nt, Human adenovirus C
cagcuuauucagca

SEQ ID NO: 1555364 - RNA, 23 nt, Human adenovirus C
guaacaggagggggguguuccua

SEQ ID NO: 1555365 - RNA, 15 nt, Human adenovirus C
augcaccacagaaca

SEQ ID NO: 1555366 - RNA, 19 nt, Human adenovirus C
agcucugcaaccuggucuc

SEQ ID NO: 1555367 - RNA, 17 nt, Human adenovirus C
aggcguacgugccgcgg

SEQ ID NO: 1555368 - RNA, 14 nt, Human adenovirus C
gugcugcggcagau

SEQ ID NO: 1555369 - RNA, 20 nt, Human adenovirus C
accuaucaccgucacccagc

SEQ ID NO: 1555370 - RNA, 21 nt, Human adenovirus C
cuuggaaaaaaugaccgugga

SEQ ID NO: 1555371 - RNA, 16 nt, Human adenovirus C
agccgcugcagccacc

SEQ ID NO: 1555372 - RNA, 17 nt, Human adenovirus C
gguuggcggggggcugc

SEQ ID NO: 1555373 - RNA, 15 nt, Human adenovirus C
guuuacuucaacccc

SEQ ID NO: 1555374 - RNA, 20 nt, Human adenovirus C
cggagaucuauggccccccg

SEQ ID NO: 1555375 - RNA, 15 nt, Human adenovirus C
gcgccauccaccacc

SEQ ID NO: 1555376 - RNA, 15 nt, Human adenovirus C
cgcaacuucagacug

SEQ ID NO: 1555377 - RNA, 17 nt, Human adenovirus C
gcacaugcgagcccaac

SEQ ID NO: 1555378 - RNA, 14 nt, Human adenovirus C
cagcagccgcaggc

SEQ ID NO: 1555379 - RNA, 13 nt, Human adenovirus C
caggcgcagagac

SEQ ID NO: 1555380 - RNA, 22 nt, Human adenovirus C
ggccgcgauguuuagcugcacg

SEQ ID NO: 1555381 - RNA, 18 nt, Human adenovirus C
ugugcgacgucagacaac

SEQ ID NO: 1555382 - RNA, 12 nt, Human adenovirus C
gacgacagcagc

SEQ ID NO: 1555383 - RNA, 12 nt, Human adenovirus C
uguuccaccgcu

SEQ ID NO: 1555384 - RNA, 19 nt, Human adenovirus C
agacaucauuuugcugcca

SEQ ID NO: 1555385 - RNA, 20 nt, Human adenovirus C
cuagcauuaaguuugacagc

SEQ ID NO: 1555386 - RNA, 14 nt, Human adenovirus C
acacuggauggccu

SEQ ID NO: 1555387 - RNA, 16 nt, Human adenovirus C
cugggguuugacccag

SEQ ID NO: 1555388 - RNA, 16 nt, Human adenovirus C
cgggcagccuggaggc

SEQ ID NO: 1555389 - RNA, 16 nt, Human adenovirus C
gcacgcuggccagcac

SEQ ID NO: 1555390 - RNA, 16 nt, Human adenovirus C
auuuucuggccaugca

SEQ ID NO: 1555391 - RNA, 14 nt, Human adenovirus C
accuacucuggcuc

SEQ ID NO: 1555392 - RNA, 23 nt, Human adenovirus C
acauccaggugaugccggcggcg

SEQ ID NO: 1555393 - RNA, 17 nt, Human adenovirus C
cggugagcgcuccaccc

SEQ ID NO: 1555394 - RNA, 19 nt, Human adenovirus C
uccuuccuaucaaccagaa

SEQ ID NO: 1555395 - RNA, 14 nt, Human adenovirus C
cggcggcugcugcg

SEQ ID NO: 1555396 - RNA, 19 nt, Human adenovirus C
uaccuggacuuggaggagg

SEQ ID NO: 1555397 - RNA, 14 nt, Human adenovirus C
ccgggucagggcgc

SEQ ID NO: 1555398 - RNA, 21 nt, Human adenovirus C
cacgggcggcggccugggcga

SEQ ID NO: 1555399 - RNA, 13 nt, Human adenovirus C
gugcugcagcagc

SEQ ID NO: 1555400 - RNA, 18 nt, Human adenovirus C
ccacgcuggaagccaugc

SEQ ID NO: 1555401 - RNA, 14 nt, Human adenovirus C
agggugacaagguc

SEQ ID NO: 1555402 - RNA, 13 nt, Human adenovirus C
gaagacgcggagg

SEQ ID NO: 1555403 - RNA, 20 nt, Human adenovirus C
ucaggcgggagcuccugcag

SEQ ID NO: 1555404 - RNA, 13 nt, Human adenovirus C
cgcgguaggcccg

SEQ ID NO: 1555405 - RNA, 19 nt, Human adenovirus C
acuggccccaaacucccau

SEQ ID NO: 1555406 - RNA, 14 nt, Human adenovirus C
caugcccaggcuuu

SEQ ID NO: 1555407 - RNA, 21 nt, Human adenovirus C
auucguccauaaugauggcaa

SEQ ID NO: 1555408 - RNA, 15 nt, Human adenovirus C
gcucaaaaacaugcu

SEQ ID NO: 1555409 - RNA, 15 nt, Human adenovirus C
cauccccgcggcgcg

SEQ ID NO: 1555410 - RNA, 14 nt, Human adenovirus C
ggcgguggcagaug

SEQ ID NO: 1555411 - RNA, 18 nt, Human adenovirus C
ccagcgcacuacugcccg

SEQ ID NO: 1555412 - RNA, 12 nt, Human adenovirus C
caagacuguggg

SEQ ID NO: 1555413 - RNA, 11 nt, Human adenovirus C
ccacuucuuuu

SEQ ID NO: 1555414 - RNA, 21 nt, Human adenovirus C
acgcgggcgcugaccugcgcu

SEQ ID NO: 1555415 - RNA, 13 nt, Human adenovirus C
cauaccacugcaa

SEQ ID NO: 1555416 - RNA, 23 nt, Human adenovirus C
cugcucggacggcaacugucacu

SEQ ID NO: 1555417 - RNA, 19 nt, Human adenovirus C
gggcccggcacuaccugga

SEQ ID NO: 1555418 - RNA, 14 nt, Human adenovirus C
caaacacaucugag

SEQ ID NO: 1555419 - RNA, 23 nt, Human adenovirus C
gagcaacagcaggaggaagccag

SEQ ID NO: 1555420 - RNA, 16 nt, Human adenovirus C
caggggagcugagccc

SEQ ID NO: 1555421 - RNA, 16 nt, Human adenovirus C
ugccaugcgcgggcgg

SEQ ID NO: 1555422 - RNA, 17 nt, Human adenovirus C
ugagcgcgcgcagcagc

SEQ ID NO: 1555423 - RNA, 17 nt, Human adenovirus C
gcaccaggugcagaccc

SEQ ID NO: 1555424 - RNA, 20 nt, Human adenovirus C
guucugcagagcucucuggg

SEQ ID NO: 1555425 - RNA, 16 nt, Human adenovirus C
ccccuucgaugcuccc

SEQ ID NO: 1555426 - RNA, 13 nt, Human adenovirus C
agcugcagcugcc

SEQ ID NO: 1555427 - RNA, 23 nt, Human adenovirus C
guauucgcgcgcaacgcaccgcc

SEQ ID NO: 1555428 - RNA, 15 nt, Human adenovirus C
caguccgggccagac

SEQ ID NO: 1555429 - RNA, 13 nt, Human adenovirus C
gcgcgagggacag

SEQ ID NO: 1555430 - RNA, 13 nt, Human adenovirus C
ccgccgccgcagc

SEQ ID NO: 1555431 - RNA, 23 nt, Human adenovirus C
agacggcguaguuucgcaggcgc

SEQ ID NO: 1555432 - RNA, 17 nt, Human adenovirus C
uugcccuuggaggaggc

SEQ ID NO: 1555433 - RNA, 15 nt, Human adenovirus C
cagcagcaggaggag

SEQ ID NO: 1555434 - RNA, 23 nt, Human adenovirus C
cugaccaaaugcgccagaaggcg

SEQ ID NO: 1555435 - RNA, 15 nt, Human adenovirus C
gcugcgggguggugu

SEQ ID NO: 1555436 - RNA, 23 nt, Human adenovirus C
uucuccccggcuggccuuaaaaa

SEQ ID NO: 1555437 - RNA, 14 nt, Human adenovirus C
gguccugcuggugc

SEQ ID NO: 1555438 - RNA, 21 nt, Human adenovirus C
gaggcgccgcacgaggggcag

SEQ ID NO: 1555439 - RNA, 15 nt, Human adenovirus C
ggaggcaagcacaca

SEQ ID NO: 1555440 - RNA, 15 nt, Human adenovirus C
gagaaggucaucaag

SEQ ID NO: 1555441 - RNA, 18 nt, Human adenovirus C
aggcgcagagacacugau

SEQ ID NO: 1555442 - RNA, 14 nt, Human adenovirus C
ccucuuccucccau

SEQ ID NO: 1555443 - RNA, 14 nt, Human adenovirus C
accaccacaccucg

SEQ ID NO: 1555444 - RNA, 19 nt, Human adenovirus C
gcuggccagggugcgcuug

SEQ ID NO: 1555445 - RNA, 15 nt, Human adenovirus C
uaaauaaaaaccaga

SEQ ID NO: 1555446 - RNA, 19 nt, Human adenovirus C
ccgagggccgcuggcugcu

SEQ ID NO: 1555447 - RNA, 18 nt, Human adenovirus C
aaagcgguuaagcuggga

SEQ ID NO: 1555448 - RNA, 15 nt, Human adenovirus C
ccuccgggcacagca

SEQ ID NO: 1555449 - RNA, 23 nt, Human adenovirus C
gaggaugaagaagaggaagauga

SEQ ID NO: 1555450 - RNA, 12 nt, Human adenovirus C
ucaaacccagcu

SEQ ID NO: 1555451 - RNA, 21 nt, Human adenovirus C
gagcucuaacaguaccucuug

SEQ ID NO: 1555452 - RNA, 19 nt, Human adenovirus C
cuggccaaccaggcagugc

SEQ ID NO: 1555453 - RNA, 15 nt, Human adenovirus C
gccggccacggccug

SEQ ID NO: 1555454 - RNA, 22 nt, Human adenovirus C
agguguaccaguccgggccaga

SEQ ID NO: 1555455 - RNA, 18 nt, Human adenovirus C
gaacgggguguuugacau

SEQ ID NO: 1555456 - RNA, 12 nt, Human adenovirus C
acggcaccgcca

SEQ ID NO: 1555457 - RNA, 13 nt, Human adenovirus C
gcggcuggagcug

SEQ ID NO: 1555458 - RNA, 18 nt, Human adenovirus C
ugcccuacauccuuccau

SEQ ID NO: 1555459 - RNA, 14 nt, Human adenovirus C
ggcgaggcgcgccg

SEQ ID NO: 1555460 - RNA, 16 nt, Human adenovirus C
cgcauccacaaggccg

SEQ ID NO: 1555461 - RNA, 21 nt, Human adenovirus C
accugagccuuugcgccuuca

SEQ ID NO: 1555462 - RNA, 16 nt, Human adenovirus C
cgcgcuggggcaggag

SEQ ID NO: 1555463 - RNA, 18 nt, Human adenovirus C
cagacggugaaccaggag

SEQ ID NO: 1555464 - RNA, 17 nt, Human adenovirus C
auugcaucccaccuuuc

SEQ ID NO: 1555465 - RNA, 15 nt, Human adenovirus C
caagcacacagacca

SEQ ID NO: 1555466 - RNA, 21 nt, Human adenovirus C
gguccgugugcaccagccgca

SEQ ID NO: 1555467 - RNA, 11 nt, Human adenovirus C
gacgaccuggg

SEQ ID NO: 1555468 - RNA, 13 nt, Human adenovirus C
uacgccaacuccg

SEQ ID NO: 1555469 - RNA, 17 nt, Human adenovirus C
gcuguaccugccagaca

SEQ ID NO: 1555470 - RNA, 20 nt, Human adenovirus C
cugucuuacaaaccuggaaa

SEQ ID NO: 1555471 - RNA, 17 nt, Human adenovirus C
auguggaaucaggcugu

SEQ ID NO: 1555472 - RNA, 14 nt, Human adenovirus C
acagagacaggacu

SEQ ID NO: 1555473 - RNA, 17 nt, Human adenovirus C
uacuaagaaaacacaug

SEQ ID NO: 1555474 - RNA, 16 nt, Human adenovirus C
ugcugagccacaggcu

SEQ ID NO: 1555475 - RNA, 13 nt, Human adenovirus C
ugccuuuuacugc

SEQ ID NO: 1555476 - RNA, 15 nt, Human adenovirus C
cggagugcugggcca

SEQ ID NO: 1555477 - RNA, 21 nt, Human adenovirus C
augcuaaugcggcaggaggga

SEQ ID NO: 1555478 - RNA, 21 nt, Human adenovirus C
ugaggccgaggcagcggcaga

SEQ ID NO: 1555479 - RNA, 16 nt, Human adenovirus C
uggcgaugagcagcug

SEQ ID NO: 1555480 - RNA, 19 nt, Human adenovirus C
ucaacggaauccgcgccca

SEQ ID NO: 1555481 - RNA, 16 nt, Human adenovirus C
cggguuuggcuggugg

SEQ ID NO: 1555482 - RNA, 23 nt, Human adenovirus C
ugcgggcucccacaggcgaccgc

SEQ ID NO: 1555483 - RNA, 12 nt, Human adenovirus C
cacucgcuccag

SEQ ID NO: 1555484 - RNA, 18 nt, Human adenovirus C
gccccccuucucccaccc

SEQ ID NO: 1555485 - RNA, 21 nt, Human adenovirus C
aauaagccacacccagccaac

SEQ ID NO: 1555486 - RNA, 22 nt, Human adenovirus C
caucaacgcgcgcgcagccucc

SEQ ID NO: 1555487 - RNA, 22 nt, Human adenovirus C
agauguuagaaucauugaaaac

SEQ ID NO: 1555488 - RNA, 13 nt, Human adenovirus C
cgggcagcggcga

SEQ ID NO: 1555489 - RNA, 19 nt, Human adenovirus C
uacaacaguuuccagcgag

SEQ ID NO: 1555490 - RNA, 14 nt, Human adenovirus C
gucaggcgggagcu

SEQ ID NO: 1555491 - RNA, 17 nt, Human adenovirus C
auguuuuguuugaaguc

SEQ ID NO: 1555492 - RNA, 21 nt, Human adenovirus C
acguuuacaaggcccugggca

SEQ ID NO: 1555493 - RNA, 22 nt, Human adenovirus C
acuaccuuuccgccgccaacau

SEQ ID NO: 1555494 - RNA, 13 nt, Human adenovirus C
gaugaggccggcc

SEQ ID NO: 1555495 - RNA, 19 nt, Human adenovirus C
uaccucugcaaacgacugc

SEQ ID NO: 1555496 - RNA, 13 nt, Human adenovirus C
ccaccauccuaaa

SEQ ID NO: 1555497 - RNA, 13 nt, Human adenovirus C
agggccuccccuu

SEQ ID NO: 1555498 - RNA, 24 nt, Human adenovirus C
ccccgccaacgugcccuacccacu

SEQ ID NO: 1555499 - RNA, 12 nt, Human adenovirus C
accugcggccua

SEQ ID NO: 1555500 - RNA, 14 nt, Human adenovirus C
cggugaaggggugc

SEQ ID NO: 1555501 - RNA, 13 nt, Human adenovirus C
cacgucuccugag

SEQ ID NO: 1555502 - RNA, 20 nt, Human adenovirus C
cagagugggaauuugagccc

SEQ ID NO: 1555503 - RNA, 16 nt, Human adenovirus C
agccgcggcaaugcag

SEQ ID NO: 1555504 - RNA, 19 nt, Human adenovirus C
acaccggggcgcgcugcgg

SEQ ID NO: 1555505 - RNA, 17 nt, Human adenovirus C
cacgcuggaagacgcgg

SEQ ID NO: 1555506 - RNA, 12 nt, Human adenovirus C
agucacuccugc

SEQ ID NO: 1555507 - RNA, 17 nt, Human adenovirus C
agcuaugcuaaccagcg

SEQ ID NO: 1555508 - RNA, 14 nt, Human adenovirus C
acagguggagauga

SEQ ID NO: 1555509 - RNA, 18 nt, Human adenovirus C
cacuaguauugccacugc

SEQ ID NO: 1555510 - RNA, 16 nt, Human adenovirus C
cugaguuggcaccccu

SEQ ID NO: 1555511 - RNA, 17 nt, Human adenovirus C
gcugaggcccgaucacu

SEQ ID NO: 1555512 - RNA, 18 nt, Human adenovirus C
guggacuauucugcugca

SEQ ID NO: 1555513 - RNA, 17 nt, Human adenovirus C
ucaaaucuucacuuccg

SEQ ID NO: 1555514 - RNA, 17 nt, Human adenovirus C
cugacagaggacagcaa

SEQ ID NO: 1555515 - RNA, 17 nt, Human adenovirus C
uuccggcagcagccgca

SEQ ID NO: 1555516 - RNA, 18 nt, Human adenovirus C
agucagcaaaucuuuguc

SEQ ID NO: 1555517 - RNA, 17 nt, Human adenovirus C
augccaucuugaacccg

SEQ ID NO: 1555518 - RNA, 19 nt, Human adenovirus C
cgaagccuuccauccagac

SEQ ID NO: 1555519 - RNA, 20 nt, Human adenovirus C
auccaaaaccucaaaaugaa

SEQ ID NO: 1555520 - RNA, 16 nt, Human adenovirus C
gcgucucuggccccgc

SEQ ID NO: 1555521 - RNA, 22 nt, Human adenovirus C
cugggaacggggccgaggugga

SEQ ID NO: 1555522 - RNA, 13 nt, Human adenovirus C
ccaggcgcggcgg

SEQ ID NO: 1555523 - RNA, 17 nt, Human adenovirus C
uaaccuaaaugccaacc

SEQ ID NO: 1555524 - RNA, 21 nt, Human adenovirus C
cuccuucagcgcgcgcugccc

SEQ ID NO: 1555525 - RNA, 19 nt, Human adenovirus C
cccggugagcgcuccaccc

SEQ ID NO: 1555526 - RNA, 15 nt, Human adenovirus C
gaucacaaccccacc

SEQ ID NO: 1555527 - RNA, 22 nt, Human adenovirus C
gcgauccuaacucugcagaccu

SEQ ID NO: 1555528 - RNA, 20 nt, Human adenovirus C
cagcggcagaagcugccgcc

SEQ ID NO: 1555529 - RNA, 18 nt, Human adenovirus C
gcgcuccuuggccgcgau

SEQ ID NO: 1555530 - RNA, 13 nt, Human adenovirus C
gcagcagccgcag

SEQ ID NO: 1555531 - RNA, 15 nt, Human adenovirus C
cgcguccaggccagc

SEQ ID NO: 1555532 - RNA, 15 nt, Human adenovirus C
agaggaccucugcac

SEQ ID NO: 1555533 - RNA, 12 nt, Human adenovirus C
ccagcggccaca

SEQ ID NO: 1555534 - RNA, 19 nt, Human adenovirus C
cuaucaccgucacccagca

SEQ ID NO: 1555535 - RNA, 18 nt, Human adenovirus C
agcuuccgcaggccaagc

SEQ ID NO: 1555536 - RNA, 21 nt, Human adenovirus C
aguuuuauaaaggauaaaugg

SEQ ID NO: 1555537 - RNA, 19 nt, Human adenovirus C
cucugguaucucagccgcc

SEQ ID NO: 1555538 - RNA, 17 nt, Human adenovirus C
gugucccuaaccaugac

SEQ ID NO: 1555539 - RNA, 19 nt, Human adenovirus C
guccagcugcugagccaca

SEQ ID NO: 1555540 - RNA, 14 nt, Human adenovirus C
cugccacagagggc

SEQ ID NO: 1555541 - RNA, 13 nt, Human adenovirus C
cgcgcuggccagg

SEQ ID NO: 1555542 - RNA, 23 nt, Human adenovirus C
acgccauugacgcggugguggag

SEQ ID NO: 1555543 - RNA, 16 nt, Human adenovirus C
uguggccgggggugcu

SEQ ID NO: 1555544 - RNA, 20 nt, Human adenovirus C
cccaaaagcagggcuucaau

SEQ ID NO: 1555545 - RNA, 22 nt, Human adenovirus C
augcuuuugagcguuugaccaa

SEQ ID NO: 1555546 - RNA, 15 nt, Human adenovirus C
ggacaggcuuacccc

SEQ ID NO: 1555547 - RNA, 12 nt, Human adenovirus C
cagcgccagugc

SEQ ID NO: 1555548 - RNA, 15 nt, Human adenovirus C
aguuggcccgcugcc

SEQ ID NO: 1555549 - RNA, 13 nt, Human adenovirus C
caggcagaggagg

SEQ ID NO: 1555550 - RNA, 22 nt, Human adenovirus C
caagcggcaacccuuccaggag

SEQ ID NO: 1555551 - RNA, 16 nt, Human adenovirus C
ccaaucaaucagccuc

SEQ ID NO: 1555552 - RNA, 20 nt, Human adenovirus C
cagacgcgccagacccccca

SEQ ID NO: 1555553 - RNA, 21 nt, Human adenovirus C
gucaggcgauccuaacucugc

SEQ ID NO: 1555554 - RNA, 13 nt, Human adenovirus C
gcggcggcggcug

SEQ ID NO: 1555555 - RNA, 12 nt, Human adenovirus C
cccagggccaca

SEQ ID NO: 1555556 - RNA, 23 nt, Human adenovirus C
gguggccgcguccaucuggucag

SEQ ID NO: 1555557 - RNA, 19 nt, Human adenovirus C
aaacuacgucuuaaacugg

SEQ ID NO: 1555558 - RNA, 16 nt, Human adenovirus C
acgaucggcaggcuca

SEQ ID NO: 1555559 - RNA, 19 nt, Human adenovirus C
aagaucuggaaggugcuga

SEQ ID NO: 1555560 - RNA, 15 nt, Human adenovirus C
agcuguccuaucaac

SEQ ID NO: 1555561 - RNA, 16 nt, Human adenovirus C
aaacuuuugcuaccaa

SEQ ID NO: 1555562 - RNA, 23 nt, Human adenovirus C
ggaucagacaaugcagaaacaca

SEQ ID NO: 1555563 - RNA, 14 nt, Human adenovirus C
gcuggaacagagcu

SEQ ID NO: 1555564 - RNA, 23 nt, Human adenovirus C
ugucccuaaccaugacuuugagg

SEQ ID NO: 1555565 - RNA, 19 nt, Human adenovirus C
cuguguauuuuuuccagga

SEQ ID NO: 1555566 - RNA, 15 nt, Human adenovirus C
caucguaggugacaa

SEQ ID NO: 1555567 - RNA, 14 nt, Human adenovirus C
agguuaccucugca

SEQ ID NO: 1555568 - RNA, 23 nt, Human adenovirus C
guccccagguacagcccacccug

SEQ ID NO: 1555569 - RNA, 21 nt, Human adenovirus C
gagucuccagauaucaaccca

SEQ ID NO: 1555570 - RNA, 18 nt, Human adenovirus C
ccgugacacugcagcagg

SEQ ID NO: 1555571 - RNA, 22 nt, Human adenovirus C
ccuuaguaugcagcgcgcggcg

SEQ ID NO: 1555572 - RNA, 22 nt, Human adenovirus C
gaacagggcggggauggcgcag

SEQ ID NO: 1555573 - RNA, 16 nt, Human adenovirus C
agcgccagcgacugga

SEQ ID NO: 1555574 - RNA, 13 nt, Human adenovirus C
cguggugagcgcg

SEQ ID NO: 1555575 - RNA, 17 nt, Human adenovirus C
gcucccucacccgcagc

SEQ ID NO: 1555576 - RNA, 21 nt, Human adenovirus C
cgccaacuccgcccacgcgcu

SEQ ID NO: 1555577 - RNA, 18 nt, Human adenovirus C
gcgugacacgcgcgaggc

SEQ ID NO: 1555578 - RNA, 13 nt, Human adenovirus C
caucugcagccuc

SEQ ID NO: 1555579 - RNA, 17 nt, Human adenovirus C
ucccuuagaaccaaagu

SEQ ID NO: 1555580 - RNA, 16 nt, Human adenovirus C
gccacugccacagagg

SEQ ID NO: 1555581 - RNA, 21 nt, Human adenovirus C
ccaagagcaacaacagcgcca

SEQ ID NO: 1555582 - RNA, 23 nt, Human adenovirus C
cagcaugaagggcacgagcugcu

SEQ ID NO: 1555583 - RNA, 20 nt, Human adenovirus C
acugcagcaggugcugccca

SEQ ID NO: 1555584 - RNA, 17 nt, Human adenovirus C
cgaggccguggcgcagc

SEQ ID NO: 1555585 - RNA, 12 nt, Human adenovirus C
uaaugcaucaaa

SEQ ID NO: 1555586 - RNA, 24 nt, Human adenovirus C
ccaagccgacgcgcccuggaggca

SEQ ID NO: 1555587 - RNA, 23 nt, Human adenovirus C
ugacuaccuuuccgccgccaaca

SEQ ID NO: 1555588 - RNA, 20 nt, Human adenovirus C
cccauggcccacaacacggc

SEQ ID NO: 1555589 - RNA, 19 nt, Human adenovirus C
ugacgaccguucgcacugg

SEQ ID NO: 1555590 - RNA, 21 nt, Human adenovirus C
cccgaugaggccggccugguc

SEQ ID NO: 1555591 - RNA, 15 nt, Human adenovirus C
uccgcgguccuccuc

SEQ ID NO: 1555592 - RNA, 16 nt, Human adenovirus C
gcagucugcagcgcug

SEQ ID NO: 1555593 - RNA, 14 nt, Human adenovirus C
cgcagccuccaugc

SEQ ID NO: 1555594 - RNA, 22 nt, Human adenovirus C
guccuguguauuuuuuccagga

SEQ ID NO: 1555595 - RNA, 18 nt, Human adenovirus C
agcgcgcgcagcagcagg

SEQ ID NO: 1555596 - RNA, 17 nt, Human adenovirus C
cgcucaguugacgggga

SEQ ID NO: 1555597 - RNA, 16 nt, Human adenovirus C
acuuugcgucucuggc

SEQ ID NO: 1555598 - RNA, 13 nt, Human adenovirus C
acccgcaccuaca

SEQ ID NO: 1555599 - RNA, 16 nt, Human adenovirus C
agcagcuggccuugcg

SEQ ID NO: 1555600 - RNA, 15 nt, Human adenovirus C
gacgcucggugcgag

SEQ ID NO: 1555601 - RNA, 21 nt, Human adenovirus C
gguggaucccauggacgagcc

SEQ ID NO: 1555602 - RNA, 14 nt, Human adenovirus C
uacucuuauaaaau

SEQ ID NO: 1555603 - RNA, 13 nt, Human adenovirus C
cgccugcugggcg

SEQ ID NO: 1555604 - RNA, 20 nt, Human adenovirus C
ggcgauggagcgcaggguuu

SEQ ID NO: 1555605 - RNA, 19 nt, Human adenovirus C
cggugaggcgugcgcaguc

SEQ ID NO: 1555606 - RNA, 19 nt, Human adenovirus C
ccuugagcgacgaccuggg

SEQ ID NO: 1555607 - RNA, 20 nt, Human adenovirus C
gacuuugcuuuccugagccc

SEQ ID NO: 1555608 - RNA, 12 nt, Human adenovirus C
gcgcggcggcug

SEQ ID NO: 1555609 - RNA, 13 nt, Human adenovirus C
ugccgcagugguc

SEQ ID NO: 1555610 - RNA, 13 nt, Human adenovirus C
gaggaugaagaag

SEQ ID NO: 1555611 - RNA, 19 nt, Human adenovirus C
cuuugcgucucuggccccg

SEQ ID NO: 1555612 - RNA, 19 nt, Human adenovirus C
gccugccgacuuggaggag

SEQ ID NO: 1555613 - RNA, 15 nt, Human adenovirus C
ggcggcguggaggaa

SEQ ID NO: 1555614 - RNA, 13 nt, Human adenovirus C
cccaccacugugg

SEQ ID NO: 1555615 - RNA, 13 nt, Human adenovirus C
ccugagccuuugc

SEQ ID NO: 1555616 - RNA, 17 nt, Human adenovirus C
ccuuuccuuccucccaa

SEQ ID NO: 1555617 - RNA, 17 nt, Human adenovirus C
aucagccccccucucug

SEQ ID NO: 1555618 - RNA, 18 nt, Human adenovirus C
cggcagcggcagcaacag

SEQ ID NO: 1555619 - RNA, 13 nt, Human adenovirus C
gcccaacccgcgc

SEQ ID NO: 1555620 - RNA, 15 nt, Human adenovirus C
gggagaucagcuggg

SEQ ID NO: 1555621 - RNA, 16 nt, Human adenovirus C
agcuugaucugcuggc

SEQ ID NO: 1555622 - RNA, 18 nt, Human adenovirus C
agugucuugcugucuuua

SEQ ID NO: 1555623 - RNA, 17 nt, Human adenovirus C
ugccacagagggcaugg

SEQ ID NO: 1555624 - RNA, 14 nt, Human adenovirus C
agugcugggccagc

SEQ ID NO: 1555625 - RNA, 21 nt, Human adenovirus C
cugaccgugcaagacuccaaa

SEQ ID NO: 1555626 - RNA, 16 nt, Human adenovirus C
cauucgggcagcagcg

SEQ ID NO: 1555627 - RNA, 14 nt, Human adenovirus C
cgagggccagcugu

SEQ ID NO: 1555628 - RNA, 15 nt, Human adenovirus C
aaaaacaaagucaaa

SEQ ID NO: 1555629 - RNA, 15 nt, Human adenovirus C
cuccuccuccugcca

SEQ ID NO: 1555630 - RNA, 15 nt, Human adenovirus C
gccuggaggagcgca

SEQ ID NO: 1555631 - RNA, 14 nt, Human adenovirus C
ggacagggccucuc

SEQ ID NO: 1555632 - RNA, 11 nt, Human adenovirus C
cggugccauga

SEQ ID NO: 1555633 - RNA, 21 nt, Human adenovirus C
acgaacccguaucgacccgcg

SEQ ID NO: 1555634 - RNA, 12 nt, Human adenovirus C
caugcacaucuc

SEQ ID NO: 1555635 - RNA, 14 nt, Human adenovirus C
gcagggcaaccugg

SEQ ID NO: 1555636 - RNA, 22 nt, Human adenovirus C
cccgaguauuucaccaaugcca

SEQ ID NO: 1555637 - RNA, 16 nt, Human adenovirus C
accguaaaccugagcc

SEQ ID NO: 1555638 - RNA, 15 nt, Human adenovirus C
uguagguuaccucug

SEQ ID NO: 1555639 - RNA, 14 nt, Human adenovirus C
acgggcagccugga

SEQ ID NO: 1555640 - RNA, 20 nt, Human adenovirus C
cgcuggacgagggcaaccca

SEQ ID NO: 1555641 - RNA, 15 nt, Human adenovirus C
cgggacugggcgugc

SEQ ID NO: 1555642 - RNA, 15 nt, Human adenovirus C
gcaagacuccaaacu

SEQ ID NO: 1555643 - RNA, 21 nt, Human adenovirus C
guacuuuaacggcucuucauu

SEQ ID NO: 1555644 - RNA, 19 nt, Human adenovirus C
ggcagcaaugccuggagga

SEQ ID NO: 1555645 - RNA, 17 nt, Human adenovirus C
aucaaucagccucgccc

SEQ ID NO: 1555646 - RNA, 20 nt, Human adenovirus C
cacucacagaccugggccaa

SEQ ID NO: 1555647 - RNA, 18 nt, Human adenovirus C
ccugauuucugccagcgc

SEQ ID NO: 1555648 - RNA, 16 nt, Human adenovirus C
gcgcaccaccggcggc

SEQ ID NO: 1555649 - RNA, 18 nt, Human adenovirus C
gagcuaugcuaaccagcg

SEQ ID NO: 1555650 - RNA, 19 nt, Human adenovirus C
uucacacgcuugaagacaa

SEQ ID NO: 1555651 - RNA, 17 nt, Human adenovirus C
agagccggccuggaccc

SEQ ID NO: 1555652 - RNA, 23 nt, Human adenovirus C
cuagccuaaagcccgugacacug

SEQ ID NO: 1555653 - RNA, 15 nt, Human adenovirus C
cucggcgguggcaga

SEQ ID NO: 1555654 - RNA, 15 nt, Human adenovirus C
ucgccccccuucucc

SEQ ID NO: 1555655 - RNA, 16 nt, Human adenovirus C
cccguauuugccgugc

SEQ ID NO: 1555656 - RNA, 13 nt, Human adenovirus C
caugucccugacu

SEQ ID NO: 1555657 - RNA, 19 nt, Human adenovirus C
aucaggguccagaggaccu

SEQ ID NO: 1555658 - RNA, 20 nt, Human adenovirus C
aacugcgaggacagggccuc

SEQ ID NO: 1555659 - RNA, 21 nt, Human adenovirus C
cuugacgaccguucgcacugg

SEQ ID NO: 1555660 - RNA, 13 nt, Human adenovirus C
cccgcgccacugg

SEQ ID NO: 1555661 - RNA, 21 nt, Human adenovirus C
ccaggaacagcucuacagcuu

SEQ ID NO: 1555662 - RNA, 16 nt, Human adenovirus C
ccgggacugggcgugc

SEQ ID NO: 1555663 - RNA, 15 nt, Human adenovirus C
gugaauccacagaaa

SEQ ID NO: 1555664 - RNA, 24 nt, Human adenovirus C
ugaugguacccaagcgccagcgac

SEQ ID NO: 1555665 - RNA, 21 nt, Human adenovirus C
agcgcccuucacggacagugg

SEQ ID NO: 1555666 - RNA, 21 nt, Human adenovirus C
cccgcuugcaagcagugcagc

SEQ ID NO: 1555667 - RNA, 17 nt, Human adenovirus C
ugugcguaacuugcugg

SEQ ID NO: 1555668 - RNA, 20 nt, Human adenovirus C
ccacagagggcauggagaca

SEQ ID NO: 1555669 - RNA, 16 nt, Human adenovirus C
cucacagaccugggcc

SEQ ID NO: 1555670 - RNA, 18 nt, Human adenovirus C
gaggacacgggcagccug

SEQ ID NO: 1555671 - RNA, 16 nt, Human adenovirus C
ccuuacuuuaucucaa

SEQ ID NO: 1555672 - RNA, 23 nt, Human adenovirus C
agcauaaaaaaauccaguggacu

SEQ ID NO: 1555673 - RNA, 14 nt, Human adenovirus C
cugagacgaaggcu

SEQ ID NO: 1555674 - RNA, 14 nt, Human adenovirus C
cccauuugaugcuc

SEQ ID NO: 1555675 - RNA, 22 nt, Human adenovirus C
uacccaccaccaguagcacuag

SEQ ID NO: 1555676 - RNA, 19 nt, Human adenovirus C
gcauuaaguggcucgcucc

SEQ ID NO: 1555677 - RNA, 20 nt, Human adenovirus C
cgggccgcucgaaggcuggc

SEQ ID NO: 1555678 - RNA, 14 nt, Human adenovirus C
ugcccgccaccugc

SEQ ID NO: 1555679 - RNA, 14 nt, Human adenovirus C
gccagcgccugcac

SEQ ID NO: 1555680 - RNA, 12 nt, Human adenovirus C
cuagguccaggu

SEQ ID NO: 1555681 - RNA, 12 nt, Human adenovirus C
cgagggccagcu

SEQ ID NO: 1555682 - RNA, 21 nt, Human adenovirus C
caucguuuaaaagccggucuu

SEQ ID NO: 1555683 - RNA, 20 nt, Human adenovirus C
guacacagcccgccaacgug

SEQ ID NO: 1555684 - RNA, 17 nt, Human adenovirus C
guaagcgcgcuggagca

SEQ ID NO: 1555685 - RNA, 20 nt, Human adenovirus C
agcgcagcggugcagccaca

SEQ ID NO: 1555686 - RNA, 16 nt, Human adenovirus C
cgccaacuccgcccac

SEQ ID NO: 1555687 - RNA, 16 nt, Human adenovirus C
ugccugcuccagagau

SEQ ID NO: 1555688 - RNA, 18 nt, Human adenovirus C
gaugaccggcucaaccau

SEQ ID NO: 1555689 - RNA, 14 nt, Human adenovirus C
augucagccuugcc

SEQ ID NO: 1555690 - RNA, 12 nt, Human adenovirus C
gaucugcgccag

SEQ ID NO: 1555691 - RNA, 17 nt, Human adenovirus C
ucgaagccguugauguu

SEQ ID NO: 1555692 - RNA, 14 nt, Human adenovirus C
cgaccacagcaacu

SEQ ID NO: 1555693 - RNA, 17 nt, Human adenovirus C
ugcgcgagauugagcuc

SEQ ID NO: 1555694 - RNA, 13 nt, Human adenovirus C
ucaggaauucugc

SEQ ID NO: 1555695 - RNA, 21 nt, Human adenovirus C
uauaacucaccugaaaaucag

SEQ ID NO: 1555696 - RNA, 21 nt, Human adenovirus C
cccaggcggcggguacagugg

SEQ ID NO: 1555697 - RNA, 13 nt, Human adenovirus C
cgccagcccccac

SEQ ID NO: 1555698 - RNA, 23 nt, Human adenovirus C
gcaacuuggcgauggagcgcagg

SEQ ID NO: 1555699 - RNA, 14 nt, Human adenovirus C
ugccaaccuaugga

SEQ ID NO: 1555700 - RNA, 15 nt, Human adenovirus C
gcucgcgaaggaggc

SEQ ID NO: 1555701 - RNA, 17 nt, Human adenovirus C
ggcgcaccgggaggcgg

SEQ ID NO: 1555702 - RNA, 22 nt, Human adenovirus C
ggccuugcaggcgcagagacac

SEQ ID NO: 1555703 - RNA, 15 nt, Human adenovirus C
cugcccgccaccugc

SEQ ID NO: 1555704 - RNA, 23 nt, Human adenovirus C
acaacagcugccgccaugggcuc

SEQ ID NO: 1555705 - RNA, 19 nt, Human adenovirus C
cgaggaucgcucaguacca

SEQ ID NO: 1555706 - RNA, 19 nt, Human adenovirus C
acuggcaccuuuuguucca

SEQ ID NO: 1555707 - RNA, 18 nt, Human adenovirus C
aguacgagucacuccugc

SEQ ID NO: 1555708 - RNA, 14 nt, Human adenovirus C
cgaucguggagcac

SEQ ID NO: 1555709 - RNA, 19 nt, Human adenovirus C
uaccccuucgaugaugccg

SEQ ID NO: 1555710 - RNA, 21 nt, Human adenovirus C
ucucgcauuccacgagccagg

SEQ ID NO: 1555711 - RNA, 22 nt, Human adenovirus C
uggugcaguuugcccgcgccac

SEQ ID NO: 1555712 - RNA, 15 nt, Human adenovirus C
aguuaagagagcugc

SEQ ID NO: 1555713 - RNA, 19 nt, Human adenovirus C
cacgguuaacuccuccucc

SEQ ID NO: 1555714 - RNA, 17 nt, Human adenovirus C
accccgccaacgugccc

SEQ ID NO: 1555715 - RNA, 16 nt, Human adenovirus C
augagcuccacagguc

SEQ ID NO: 1555716 - RNA, 17 nt, Human adenovirus C
ggcgccauccaccacca

SEQ ID NO: 1555717 - RNA, 22 nt, Human adenovirus C
auguauuauaacagcacuggca

SEQ ID NO: 1555718 - RNA, 15 nt, Human adenovirus C
ugucuaugcccaggc

SEQ ID NO: 1555719 - RNA, 14 nt, Human adenovirus C
gggcuggcgguggc

SEQ ID NO: 1555720 - RNA, 20 nt, Human adenovirus C
ccggcccgaugaggccggcc

SEQ ID NO: 1555721 - RNA, 18 nt, Human adenovirus C
cagaccaaagcaaaccuc

SEQ ID NO: 1555722 - RNA, 18 nt, Human adenovirus C
acgcucgagaucaggcua

SEQ ID NO: 1555723 - RNA, 22 nt, Human adenovirus C
acgauguaaaguuccaagaagc

SEQ ID NO: 1555724 - RNA, 14 nt, Human adenovirus C
caugucgcugucca

SEQ ID NO: 1555725 - RNA, 16 nt, Human adenovirus C
gggcccauuacagugu

SEQ ID NO: 1555726 - RNA, 20 nt, Human adenovirus C
augcacaucucgggccagga

SEQ ID NO: 1555727 - RNA, 19 nt, Human adenovirus C
guuccugcucucacagauc

SEQ ID NO: 1555728 - RNA, 17 nt, Human adenovirus C
ucacugcuaccuucugc

SEQ ID NO: 1555729 - RNA, 21 nt, Human adenovirus C
gcucgaucucuuccuccugga

SEQ ID NO: 1555730 - RNA, 14 nt, Human adenovirus C
ucacuuggugcugg

SEQ ID NO: 1555731 - RNA, 12 nt, Human adenovirus C
ccuacugcaccg

SEQ ID NO: 1555732 - RNA, 17 nt, Human adenovirus C
acuggauggccuuugcc

SEQ ID NO: 1555733 - RNA, 12 nt, Human adenovirus C
ucuuuuuccaaa

SEQ ID NO: 1555734 - RNA, 12 nt, Human adenovirus C
cagcuugccugc

SEQ ID NO: 1555735 - RNA, 12 nt, Human adenovirus C
acaagugggaau

SEQ ID NO: 1555736 - RNA, 22 nt, Human adenovirus C
cgacugcgccugacacaccucg

SEQ ID NO: 1555737 - RNA, 15 nt, Human adenovirus C
guuuagagaacacug

SEQ ID NO: 1555738 - RNA, 13 nt, Human adenovirus C
cugagccccgggc

SEQ ID NO: 1555739 - RNA, 15 nt, Human adenovirus C
ugcagaccaaccugg

SEQ ID NO: 1555740 - RNA, 13 nt, Human adenovirus C
gcgcaggguggcu

SEQ ID NO: 1555741 - RNA, 18 nt, Human adenovirus C
acugacccgcuguuccuu

SEQ ID NO: 1555742 - RNA, 17 nt, Human adenovirus C
agaccgggauccgcuca

SEQ ID NO: 1555743 - RNA, 17 nt, Human adenovirus C
cgucaugcacgcagcac

SEQ ID NO: 1555744 - RNA, 16 nt, Human adenovirus C
ugguggcuaccucucc

SEQ ID NO: 1555745 - RNA, 17 nt, Human adenovirus C
ccuccuuauuccacuga

SEQ ID NO: 1555746 - RNA, 15 nt, Human adenovirus C
agcuugccugcucca

SEQ ID NO: 1555747 - RNA, 15 nt, Human adenovirus C
gguuaacuccuccuc

SEQ ID NO: 1555748 - RNA, 14 nt, Human adenovirus C
cuacgaagaccaau

SEQ ID NO: 1555749 - RNA, 14 nt, Human adenovirus C
cuggcccgcgguga

SEQ ID NO: 1555750 - RNA, 12 nt, Human adenovirus C
ggaagcgguggu

SEQ ID NO: 1555751 - RNA, 12 nt, Human adenovirus C
ggccggacaggc

SEQ ID NO: 1555752 - RNA, 19 nt, Human adenovirus C
acggcgacgaggaccugcu

SEQ ID NO: 1555753 - RNA, 15 nt, Human adenovirus C
uaggaggggcauggc

SEQ ID NO: 1555754 - RNA, 18 nt, Human adenovirus C
cuggcuggcacgggcagc

SEQ ID NO: 1555755 - RNA, 13 nt, Human adenovirus C
gcucuacagcuuc

SEQ ID NO: 1555756 - RNA, 17 nt, Human adenovirus C
cgugagcgcgcgcagca

SEQ ID NO: 1555757 - RNA, 23 nt, Human adenovirus C
gcggcgucgaugacuugcaagag

SEQ ID NO: 1555758 - RNA, 12 nt, Human adenovirus C
gugcagcacagc

SEQ ID NO: 1555759 - RNA, 18 nt, Human adenovirus C
cacgcucaagggcgaggc

SEQ ID NO: 1555760 - RNA, 12 nt, Human adenovirus C
ugauacaaacac

SEQ ID NO: 1555761 - RNA, 16 nt, Human adenovirus C
gcgcccuaccugugcu

SEQ ID NO: 1555762 - RNA, 16 nt, Human adenovirus C
uaggcccgggaccagc

SEQ ID NO: 1555763 - RNA, 18 nt, Human adenovirus C
uaaacaacucgcugcugc

SEQ ID NO: 1555764 - RNA, 22 nt, Human adenovirus C
gaaaaucagagggcgagguauu

SEQ ID NO: 1555765 - RNA, 21 nt, Human adenovirus C
guuuaaacagcgaggaggagc

SEQ ID NO: 1555766 - RNA, 13 nt, Human adenovirus C
agacggcggaggc

SEQ ID NO: 1555767 - RNA, 17 nt, Human adenovirus C
agggugcaugcccaggc

SEQ ID NO: 1555768 - RNA, 19 nt, Human adenovirus C
ugggcaccuaugacaagcg

SEQ ID NO: 1555769 - RNA, 21 nt, Human adenovirus C
cgccugauuucugccagcgcc

SEQ ID NO: 1555770 - RNA, 21 nt, Human adenovirus C
aauauugcgcuguaccugcca

SEQ ID NO: 1555771 - RNA, 18 nt, Human adenovirus C
gagacguacuucagccug

SEQ ID NO: 1555772 - RNA, 20 nt, Human adenovirus C
agcaaggaaauucccacgcc

SEQ ID NO: 1555773 - RNA, 12 nt, Human adenovirus C
gccggcggcggu

SEQ ID NO: 1555774 - RNA, 23 nt, Human adenovirus C
caaaaccuucucuacgccaacuc

SEQ ID NO: 1555775 - RNA, 17 nt, Human adenovirus C
cagcacucggcagaaac

SEQ ID NO: 1555776 - RNA, 17 nt, Human adenovirus C
ccgacgggcggccaugc

SEQ ID NO: 1555777 - RNA, 15 nt, Human adenovirus C
gcgcuggggcaggag

SEQ ID NO: 1555778 - RNA, 11 nt, Human adenovirus C
aacguggagcu

SEQ ID NO: 1555779 - RNA, 18 nt, Human adenovirus C
ugggacaccacuggaacc

SEQ ID NO: 1555780 - RNA, 21 nt, Human adenovirus C
ugcaauucuucucaaauacua

SEQ ID NO: 1555781 - RNA, 19 nt, Human adenovirus C
guacagugaagauguaaau

SEQ ID NO: 1555782 - RNA, 20 nt, Human adenovirus C
gcagcugaugguacccaagc

SEQ ID NO: 1555783 - RNA, 14 nt, Human adenovirus C
gugacgaaaaggcu

SEQ ID NO: 1555784 - RNA, 15 nt, Human adenovirus C
acauuggcuggaaug

SEQ ID NO: 1555785 - RNA, 19 nt, Human adenovirus C
cgcaacuagauugcaagaa

SEQ ID NO: 1555786 - RNA, 16 nt, Human adenovirus C
gaagacgacgggcccg

SEQ ID NO: 1555787 - RNA, 24 nt, Human adenovirus C
cacaccucguaauaaccuuaaucc

SEQ ID NO: 1555788 - RNA, 15 nt, Human adenovirus C
caaggccugcagacc

SEQ ID NO: 1555789 - RNA, 19 nt, Human adenovirus C
caagacagaaacacagagc

SEQ ID NO: 1555790 - RNA, 14 nt, Human adenovirus C
ccuggaggcagcug

SEQ ID NO: 1555791 - RNA, 18 nt, Human adenovirus C
gacgaaguaaguuugcca

SEQ ID NO: 1555792 - RNA, 15 nt, Human adenovirus C
cgcccucuccugagc

SEQ ID NO: 1555793 - RNA, 11 nt, Human adenovirus C
agugucacugu

SEQ ID NO: 1555794 - RNA, 12 nt, Human adenovirus C
uaacuugcaugg

SEQ ID NO: 1555795 - RNA, 14 nt, Human adenovirus C
cagaaccaccagca

SEQ ID NO: 1555796 - RNA, 17 nt, Human adenovirus C
ucaucucuacagccccu

SEQ ID NO: 1555797 - RNA, 16 nt, Human adenovirus C
cgcgggcuagguccag

SEQ ID NO: 1555798 - RNA, 22 nt, Human adenovirus C
ccgugugcuugauauggcuucc

SEQ ID NO: 1555799 - RNA, 14 nt, Human adenovirus C
gcuucacuggacuc

SEQ ID NO: 1555800 - RNA, 21 nt, Human adenovirus C
acgugcagaccaaccuggacc

SEQ ID NO: 1555801 - RNA, 17 nt, Human adenovirus C
cgcuggccgcucuucau

SEQ ID NO: 1555802 - RNA, 17 nt, Human adenovirus C
gguucggggcugugccu

SEQ ID NO: 1555803 - RNA, 23 nt, Human adenovirus C
cauguuguaauucaccaccuccc

SEQ ID NO: 1555804 - RNA, 16 nt, Human adenovirus C
acaccuacgacuacau

SEQ ID NO: 1555805 - RNA, 19 nt, Human adenovirus C
gcagcaaugccuggaggag

SEQ ID NO: 1555806 - RNA, 18 nt, Human adenovirus C
cagcauaacaacucagga

SEQ ID NO: 1555807 - RNA, 16 nt, Human adenovirus C
gaaucuacuggggcuc

SEQ ID NO: 1555808 - RNA, 21 nt, Human adenovirus C
aggagggagagugcuuaaaaa

SEQ ID NO: 1555809 - RNA, 17 nt, Human adenovirus C
gcagccggugggcccgu

SEQ ID NO: 1555810 - RNA, 15 nt, Human adenovirus C
ccacgguggcaccua

SEQ ID NO: 1555811 - RNA, 20 nt, Human adenovirus C
gccgugcugaaacgcagcau

SEQ ID NO: 1555812 - RNA, 23 nt, Human adenovirus C
uucuugucccuccgcacccacua

SEQ ID NO: 1555813 - RNA, 16 nt, Human adenovirus C
cauccaggugaugccg

SEQ ID NO: 1555814 - RNA, 18 nt, Human adenovirus C
acaucaacuuugcgucuc

SEQ ID NO: 1555815 - RNA, 19 nt, Human adenovirus C
cccucucaaaagcgggcau

SEQ ID NO: 1555816 - RNA, 14 nt, Human adenovirus C
gguugaucuccuga

SEQ ID NO: 1555817 - RNA, 15 nt, Human adenovirus C
gaggcagcuggggcc

SEQ ID NO: 1555818 - RNA, 14 nt, Human adenovirus C
cuucagcuggggcu

SEQ ID NO: 1555819 - RNA, 19 nt, Human adenovirus C
aauucuguuuauucuuaua

SEQ ID NO: 1555820 - RNA, 16 nt, Human adenovirus C
cacaggguugcagcac

SEQ ID NO: 1555821 - RNA, 19 nt, Human adenovirus C
cgccaguggcggcggcgcu

SEQ ID NO: 1555822 - RNA, 17 nt, Human adenovirus C
gcacgucuagggcgcag

SEQ ID NO: 1555823 - RNA, 13 nt, Human adenovirus C
ggcgugcuggaca

SEQ ID NO: 1555824 - RNA, 21 nt, Human adenovirus C
agaaacgaaagccaaaaaacc

SEQ ID NO: 1555825 - RNA, 15 nt, Human adenovirus C
ggaggcagcuggggc

SEQ ID NO: 1555826 - RNA, 14 nt, Human adenovirus C
cugcagcgcugcca

SEQ ID NO: 1555827 - RNA, 14 nt, Human adenovirus C
aagcugcagcugcc

SEQ ID NO: 1555828 - RNA, 21 nt, Human adenovirus C
ccucgaccacugccgccgcca

SEQ ID NO: 1555829 - RNA, 21 nt, Human adenovirus C
gcaagcugauugccaggggca

SEQ ID NO: 1555830 - RNA, 11 nt, Human adenovirus C
agcaucugcag

SEQ ID NO: 1555831 - RNA, 18 nt, Human adenovirus C
agcccgccaagaguuucu

SEQ ID NO: 1555832 - RNA, 23 nt, Human adenovirus C
acggccugguaggcgcagcaucc

SEQ ID NO: 1555833 - RNA, 16 nt, Human adenovirus C
caaacuuuccuggacg

SEQ ID NO: 1555834 - RNA, 17 nt, Human adenovirus C
cagcuaaaugccguggu

SEQ ID NO: 1555835 - RNA, 16 nt, Human adenovirus C
cacagcggcggcagca

SEQ ID NO: 1555836 - RNA, 19 nt, Human adenovirus C
caccuaugacaagcgcuuu

SEQ ID NO: 1555837 - RNA, 21 nt, Human adenovirus C
uacgaacccccgcggcgccgg

SEQ ID NO: 1555838 - RNA, 15 nt, Human adenovirus C
ucagaugcugaccug

SEQ ID NO: 1555839 - RNA, 20 nt, Human adenovirus C
agcuggcgcgcuggcuugag

SEQ ID NO: 1555840 - RNA, 20 nt, Human adenovirus C
agcggggggcuucugaggcu

SEQ ID NO: 1555841 - RNA, 13 nt, Human adenovirus C
ucccauucuccag

SEQ ID NO: 1555842 - RNA, 22 nt, Human adenovirus C
agcgcauccacaaggccgugag

SEQ ID NO: 1555843 - RNA, 20 nt, Human adenovirus C
gcagcgaugugccccucgcc

SEQ ID NO: 1555844 - RNA, 16 nt, Human adenovirus C
cgcgguaccugcggcc

SEQ ID NO: 1555845 - RNA, 17 nt, Human adenovirus C
cagccuccgccgccgcu

SEQ ID NO: 1555846 - RNA, 22 nt, Human adenovirus C
cagacccaucuccuaacugcag

SEQ ID NO: 1555847 - RNA, 18 nt, Human adenovirus C
gcagguuccugagcagcu

SEQ ID NO: 1555848 - RNA, 17 nt, Human adenovirus C
cccaacccgcgccucaa

SEQ ID NO: 1555849 - RNA, 22 nt, Human adenovirus C
aucagccucgccccccuucucc

SEQ ID NO: 1555850 - RNA, 19 nt, Human adenovirus C
ggccaaccaggcagugcaa

SEQ ID NO: 1555851 - RNA, 21 nt, Human adenovirus C
caguacaaguuguggccccca

SEQ ID NO: 1555852 - RNA, 17 nt, Human adenovirus C
ccaaaaagaagcugcag

SEQ ID NO: 1555853 - RNA, 16 nt, Human adenovirus C
gcugcuccucuucccg

SEQ ID NO: 1555854 - RNA, 13 nt, Human adenovirus C
cgccgccaccagu

SEQ ID NO: 1555855 - RNA, 21 nt, Human adenovirus C
uucuaccccguauuugccgug

SEQ ID NO: 1555856 - RNA, 13 nt, Human adenovirus C
uggacuucaccca

SEQ ID NO: 1555857 - RNA, 12 nt, Human adenovirus C
uuugagccccuc

SEQ ID NO: 1555858 - RNA, 17 nt, Human adenovirus C
gaagacgugagcgguga

SEQ ID NO: 1555859 - RNA, 12 nt, Human adenovirus C
cgcaccucgcgc

SEQ ID NO: 1555860 - RNA, 20 nt, Human adenovirus C
augcgggccaugagcugcga

SEQ ID NO: 1555861 - RNA, 13 nt, Human adenovirus C
gcaacugggcagc

SEQ ID NO: 1555862 - RNA, 22 nt, Human adenovirus C
aauaccuguguggaagccugga

SEQ ID NO: 1555863 - RNA, 21 nt, Human adenovirus C
ucggccccaccgguucuucac

SEQ ID NO: 1555864 - RNA, 21 nt, Human adenovirus C
cucagcgcagcggugcagcca

SEQ ID NO: 1555865 - RNA, 21 nt, Human adenovirus C
cacccuugccgucugcgccgu

SEQ ID NO: 1555866 - RNA, 18 nt, Human adenovirus C
gucccuaaccaugacuuu

SEQ ID NO: 1555867 - RNA, 23 nt, Human adenovirus C
guaucuuuuguguggucaagcag

SEQ ID NO: 1555868 - RNA, 15 nt, Human adenovirus C
ccucagcuacaagcu

SEQ ID NO: 1555869 - RNA, 13 nt, Human adenovirus C
ugcagccagggga

SEQ ID NO: 1555870 - RNA, 19 nt, Human adenovirus C
agggccucucagaugcuga

SEQ ID NO: 1555871 - RNA, 18 nt, Human adenovirus C
ugcaacagguuauugccc

SEQ ID NO: 1555872 - RNA, 22 nt, Human adenovirus C
gaaguauuccauagagcagcug

SEQ ID NO: 1555873 - RNA, 14 nt, Human adenovirus C
gaaaccccuucccu

SEQ ID NO: 1555874 - RNA, 16 nt, Human adenovirus C
gccgcgcgcuggggca

SEQ ID NO: 1555875 - RNA, 13 nt, Human adenovirus C
ccgucacccagca

SEQ ID NO: 1555876 - RNA, 16 nt, Human adenovirus C
gcugcagcugccgccg

SEQ ID NO: 1555877 - RNA, 14 nt, Human adenovirus C
agcggcauuaaaaa

SEQ ID NO: 1555878 - RNA, 16 nt, Human adenovirus C
guuagucugcagaauu

SEQ ID NO: 1555879 - RNA, 15 nt, Human adenovirus C
cucuagcgaugaaga

SEQ ID NO: 1555880 - RNA, 14 nt, Human adenovirus C
agcccgugcuggcc

SEQ ID NO: 1555881 - RNA, 22 nt, Human adenovirus C
gauauccguagauguaccugga

SEQ ID NO: 1555882 - RNA, 14 nt, Human adenovirus C
acgcgcggcggcgg

SEQ ID NO: 1555883 - RNA, 18 nt, Human adenovirus C
auauuaaugcaucucaua

SEQ ID NO: 1555884 - RNA, 12 nt, Human adenovirus C
auuuccugcaga

SEQ ID NO: 1555885 - RNA, 13 nt, Human adenovirus C
agugcggcggcgg

SEQ ID NO: 1555886 - RNA, 21 nt, Human adenovirus C
auuacugacgccagacgccgc

SEQ ID NO: 1555887 - RNA, 19 nt, Human adenovirus C
aaaagaagcugcagcugcc

SEQ ID NO: 1555888 - RNA, 23 nt, Human adenovirus C
aaucuaacuuuuagcuuaaugac

SEQ ID NO: 1555889 - RNA, 16 nt, Human adenovirus C
ccaaguucaugccuuu

SEQ ID NO: 1555890 - RNA, 17 nt, Human adenovirus C
cgagggagaggagcccg

SEQ ID NO: 1555891 - RNA, 16 nt, Human adenovirus C
ccgccgccgcuccguc

SEQ ID NO: 1555892 - RNA, 15 nt, Human adenovirus C
acccggagaugcagc

SEQ ID NO: 1555893 - RNA, 16 nt, Human adenovirus C
cccaggcuggggagaa

SEQ ID NO: 1555894 - RNA, 18 nt, Human adenovirus C
cugcccacgcuugcaccg

SEQ ID NO: 1555895 - RNA, 15 nt, Human adenovirus C
cgcugaggccgaggc

SEQ ID NO: 1555896 - RNA, 13 nt, Human adenovirus C
cacuaucagcgcc

SEQ ID NO: 1555897 - RNA, 23 nt, Human adenovirus C
cagugucgucgcauccgcccugc

SEQ ID NO: 1555898 - RNA, 19 nt, Human adenovirus C
aguuuucacuccacaggcu

SEQ ID NO: 1555899 - RNA, 14 nt, Human adenovirus C
gggcuucugaggcu

SEQ ID NO: 1555900 - RNA, 23 nt, Human adenovirus C
cuuucacuuuccgcuucacugga

SEQ ID NO: 1555901 - RNA, 21 nt, Human adenovirus C
cuuaaaaaacauuacuggaac

SEQ ID NO: 1555902 - RNA, 13 nt, Human adenovirus C
cgaugagcagcug

SEQ ID NO: 1555903 - RNA, 17 nt, Human adenovirus C
uaagaacuauggcagca

SEQ ID NO: 1555904 - RNA, 18 nt, Human adenovirus C
gcggucccauccaagguc

SEQ ID NO: 1555905 - RNA, 19 nt, Human adenovirus C
cccuagacaaggccggaaa

SEQ ID NO: 1555906 - RNA, 17 nt, Human adenovirus C
cgagucucgggccggcc

SEQ ID NO: 1555907 - RNA, 13 nt, Human adenovirus C
gaauucauucaga

SEQ ID NO: 1555908 - RNA, 13 nt, Human adenovirus C
aucugcuccagag

SEQ ID NO: 1555909 - RNA, 23 nt, Human adenovirus C
ggcuguacauccugcacgagguu

SEQ ID NO: 1555910 - RNA, 20 nt, Human adenovirus C
acuaucgcaacaccacugcu

SEQ ID NO: 1555911 - RNA, 19 nt, Human adenovirus C
cgaagagcauaucgagggc

SEQ ID NO: 1555912 - RNA, 22 nt, Human adenovirus C
aggauuacaagugggaauuuga

SEQ ID NO: 1555913 - RNA, 23 nt, Human adenovirus C
ccuugcuagacugcuccuucagc

SEQ ID NO: 1555914 - RNA, 19 nt, Human adenovirus C
cgccacaauguggccuccg

SEQ ID NO: 1555915 - RNA, 17 nt, Human adenovirus C
gcugccgccaugggcuc

SEQ ID NO: 1555916 - RNA, 15 nt, Human adenovirus C
aguaccuuaccuggu

SEQ ID NO: 1555917 - RNA, 17 nt, Human adenovirus C
gcagccacaacgcgcag

SEQ ID NO: 1555918 - RNA, 16 nt, Human adenovirus C
gguaccauauaaaccu

SEQ ID NO: 1555919 - RNA, 15 nt, Human adenovirus C
guaguuucgcaggcg

SEQ ID NO: 1555920 - RNA, 19 nt, Human adenovirus C
ggaacggggccgaggugga

SEQ ID NO: 1555921 - RNA, 22 nt, Human adenovirus C
gagauacuacauggacaaaaga

SEQ ID NO: 1555922 - RNA, 19 nt, Human adenovirus C
ggcgagggccuggcgcggc

SEQ ID NO: 1555923 - RNA, 13 nt, Human adenovirus C
gccaccugagccu

SEQ ID NO: 1555924 - RNA, 23 nt, Human adenovirus C
cuccgccgcuuuggggucacugc

SEQ ID NO: 1555925 - RNA, 16 nt, Human adenovirus C
cgcgcacgucgcaccg

SEQ ID NO: 1555926 - RNA, 16 nt, Human adenovirus C
cuaccggagugcuggg

SEQ ID NO: 1555927 - RNA, 21 nt, Human adenovirus C
augagcaaacaguacaaguug

SEQ ID NO: 1555928 - RNA, 19 nt, Human adenovirus C
ucuucggcaucaaggaagg

SEQ ID NO: 1555929 - RNA, 14 nt, Human adenovirus C
ucaguagcaagcug

SEQ ID NO: 1555930 - RNA, 16 nt, Human adenovirus C
aggaugggcaggggcu

SEQ ID NO: 1555931 - RNA, 13 nt, Human adenovirus C
ggaggaagccagg

SEQ ID NO: 1555932 - RNA, 14 nt, Human adenovirus C
aaacaggucucugc

SEQ ID NO: 1555933 - RNA, 16 nt, Human adenovirus C
cacaagccccacugac

SEQ ID NO: 1555934 - RNA, 14 nt, Human adenovirus C
auugacgcgguggu

SEQ ID NO: 1555935 - RNA, 21 nt, Human adenovirus C
gagccugggcuggagcccgag

SEQ ID NO: 1555936 - RNA, 17 nt, Human adenovirus C
uuccgcgguccuccucg

SEQ ID NO: 1555937 - RNA, 13 nt, Human adenovirus C
ccgggucagggcg

SEQ ID NO: 1555938 - RNA, 19 nt, Human adenovirus C
acgccuuugccaacuggcc

SEQ ID NO: 1555939 - RNA, 19 nt, Human adenovirus C
gacacccaagggugcagcu

SEQ ID NO: 1555940 - RNA, 18 nt, Human adenovirus C
caggacgacgcagaggca

SEQ ID NO: 1555941 - RNA, 20 nt, Human adenovirus C
cggcgacagugucgcgcacc

SEQ ID NO: 1555942 - RNA, 19 nt, Human adenovirus C
acaggcggcuauuaccacc

SEQ ID NO: 1555943 - RNA, 22 nt, Human adenovirus C
ggaggcaagcacacagaccauc

SEQ ID NO: 1555944 - RNA, 18 nt, Human adenovirus C
ucuucauucagccgccgc

SEQ ID NO: 1555945 - RNA, 17 nt, Human adenovirus C
cagcgccauuaugagca

SEQ ID NO: 1555946 - RNA, 18 nt, Human adenovirus C
ccgcggcgacaggucagg

SEQ ID NO: 1555947 - RNA, 13 nt, Human adenovirus C
ucauuuugcugcc

SEQ ID NO: 1555948 - RNA, 20 nt, Human adenovirus C
gaagcgugacacgcgcgagg

SEQ ID NO: 1555949 - RNA, 22 nt, Human adenovirus C
agugcccgcugucauaccacug

SEQ ID NO: 1555950 - RNA, 12 nt, Human adenovirus C
ccuaucagcagc

SEQ ID NO: 1555951 - RNA, 20 nt, Human adenovirus C
ucaauguuggcacaacacag

SEQ ID NO: 1555952 - RNA, 11 nt, Human adenovirus C
aaccugaaaga

SEQ ID NO: 1555953 - RNA, 14 nt, Human adenovirus C
acugggacagccua

SEQ ID NO: 1555954 - RNA, 13 nt, Human adenovirus C
agcagcacaggcc

SEQ ID NO: 1555955 - RNA, 15 nt, Human adenovirus C
cauaacauggugugu

SEQ ID NO: 1555956 - RNA, 16 nt, Human adenovirus C
aacuauuuuguagaau

SEQ ID NO: 1555957 - RNA, 15 nt, Human adenovirus C
agcuuaaaagaugac

SEQ ID NO: 1555958 - RNA, 21 nt, Human adenovirus C
cagccugcaaagggcccuggc

SEQ ID NO: 1555959 - RNA, 18 nt, Human adenovirus C
aacgaagcuauguccaag

SEQ ID NO: 1555960 - RNA, 19 nt, Human adenovirus C
cuuggguccggccugcuga

SEQ ID NO: 1555961 - RNA, 19 nt, Human adenovirus C
gaccucguccucggagccg

SEQ ID NO: 1555962 - RNA, 23 nt, Human adenovirus C
uuccagaccaguagacaaggccu

SEQ ID NO: 1555963 - RNA, 21 nt, Human adenovirus C
gacgcgcccuggaggcagcug

SEQ ID NO: 1555964 - RNA, 23 nt, Human adenovirus C
cuggcaagauaucggcaccagca

SEQ ID NO: 1555965 - RNA, 21 nt, Human adenovirus C
gcugauugccaggggcaggcc

SEQ ID NO: 1555966 - RNA, 14 nt, Human adenovirus C
acugcaccggcggc

SEQ ID NO: 1555967 - RNA, 23 nt, Human adenovirus C
acgcuuguggcgcgcgaggaggu

SEQ ID NO: 1555968 - RNA, 21 nt, Human adenovirus C
uaauguacuaggagacacuuu

SEQ ID NO: 1555969 - RNA, 22 nt, Human adenovirus C
cgaaccuuuggacaccucccac

SEQ ID NO: 1555970 - RNA, 15 nt, Human adenovirus C
gggaacaacccauuc

SEQ ID NO: 1555971 - RNA, 15 nt, Human adenovirus C
acgcuggaccugccu

SEQ ID NO: 1555972 - RNA, 21 nt, Human adenovirus C
cugcuuaaaagccaccugagc

SEQ ID NO: 1555973 - RNA, 20 nt, Human adenovirus C
cgagacguacuucagccuga

SEQ ID NO: 1555974 - RNA, 17 nt, Human adenovirus C
augcgcgagggacaggc

SEQ ID NO: 1555975 - RNA, 16 nt, Human adenovirus C
gcucgaucucuuccuc

SEQ ID NO: 1555976 - RNA, 22 nt, Human adenovirus C
cacaguaacugcagcacagcac

SEQ ID NO: 1555977 - RNA, 19 nt, Human adenovirus C
cccgagagccggccuggac

SEQ ID NO: 1555978 - RNA, 16 nt, Human adenovirus C
gauguaaauauggaaa

SEQ ID NO: 1555979 - RNA, 16 nt, Human adenovirus C
gccaaaaccuucucua

SEQ ID NO: 1555980 - RNA, 23 nt, Human adenovirus C
caaggccuggaacagcagcacag

SEQ ID NO: 1555981 - RNA, 18 nt, Human adenovirus C
accacagaccggucccag

SEQ ID NO: 1555982 - RNA, 21 nt, Human adenovirus C
aagauaucggcaccagcaaua

SEQ ID NO: 1555983 - RNA, 19 nt, Human adenovirus C
agccacaggcugcugucca

SEQ ID NO: 1555984 - RNA, 21 nt, Human adenovirus C
gcauaguggugcaggagcgca

SEQ ID NO: 1555985 - RNA, 13 nt, Human adenovirus C
aagcuaaaauaca

SEQ ID NO: 1555986 - RNA, 13 nt, Human adenovirus C
ggguccagaggac

SEQ ID NO: 1555987 - RNA, 15 nt, Human adenovirus C
cagagacgcccaggc

SEQ ID NO: 1555988 - RNA, 19 nt, Human adenovirus C
cgcucgucgggcaccaggu

SEQ ID NO: 1555989 - RNA, 13 nt, Human adenovirus C
cccaggcugggga

SEQ ID NO: 1555990 - RNA, 23 nt, Human adenovirus C
aaagcuagcccugcaaacaucag

SEQ ID NO: 1555991 - RNA, 12 nt, Human adenovirus C
ccugccaccucc

SEQ ID NO: 1555992 - RNA, 16 nt, Human adenovirus C
cagccccuccgcggcg

SEQ ID NO: 1555993 - RNA, 12 nt, Human adenovirus C
gcuccucucuug

SEQ ID NO: 1555994 - RNA, 14 nt, Human adenovirus C
cccgcggugcuccu

SEQ ID NO: 1555995 - RNA, 14 nt, Human adenovirus C
cagacgggccaggg

SEQ ID NO: 1555996 - RNA, 14 nt, Human adenovirus C
cgucaucuccagcg

SEQ ID NO: 1555997 - RNA, 17 nt, Human adenovirus C
uuuuggacgaggaggag

SEQ ID NO: 1555998 - RNA, 12 nt, Human adenovirus C
ggucccuguguu

SEQ ID NO: 1555999 - RNA, 18 nt, Human adenovirus C
ggcugcucugcucggaag

SEQ ID NO: 1556000 - RNA, 18 nt, Human adenovirus C
ggcaacccuuccaggagg

SEQ ID NO: 1556001 - RNA, 14 nt, Human adenovirus C
cugcgucuggcgcc

SEQ ID NO: 1556002 - RNA, 23 nt, Human adenovirus C
gccgugccagaggugcuugccac

SEQ ID NO: 1556003 - RNA, 21 nt, Human adenovirus C
auugagcuccacgugccgggc

SEQ ID NO: 1556004 - RNA, 15 nt, Human adenovirus C
cagcgcacuacugcc

SEQ ID NO: 1556005 - RNA, 21 nt, Human adenovirus C
ugcgagccgaucgggaagaac

SEQ ID NO: 1556006 - RNA, 13 nt, Human adenovirus C
uccauaagggccu

SEQ ID NO: 1556007 - RNA, 16 nt, Human adenovirus C
aguggucuuacaugca

SEQ ID NO: 1556008 - RNA, 18 nt, Human adenovirus C
uggagcucugcaaccugg

SEQ ID NO: 1556009 - RNA, 24 nt, Human adenovirus C
agauaccccuauccugccgugcca

SEQ ID NO: 1556010 - RNA, 20 nt, Human adenovirus C
cugguuauacgccaucaucu

SEQ ID NO: 1556011 - RNA, 16 nt, Human adenovirus C
cagucacaagccccac

SEQ ID NO: 1556012 - RNA, 13 nt, Human adenovirus C
auugcuugagccc

SEQ ID NO: 1556013 - RNA, 18 nt, Human adenovirus C
gacgaugacucggcagac

SEQ ID NO: 1556014 - RNA, 13 nt, Human adenovirus C
ccaggaacagcuc

SEQ ID NO: 1556015 - RNA, 19 nt, Human adenovirus C
ggcaugcgucgugcgcacc

SEQ ID NO: 1556016 - RNA, 15 nt, Human adenovirus C
acgggcggaggagaa

SEQ ID NO: 1556017 - RNA, 17 nt, Human adenovirus C
aaggggugcgcuccggg

SEQ ID NO: 1556018 - RNA, 21 nt, Human adenovirus C
uuauacuagcacuucugugcc

SEQ ID NO: 1556019 - RNA, 17 nt, Human adenovirus C
gcagaaaccugugcugc

SEQ ID NO: 1556020 - RNA, 14 nt, Human adenovirus C
uugcauuuggguaa

SEQ ID NO: 1556021 - RNA, 18 nt, Human adenovirus C
gcggcuguagaccacgcc

SEQ ID NO: 1556022 - RNA, 16 nt, Human adenovirus C
ugcaggaauacaacau

SEQ ID NO: 1556023 - RNA, 18 nt, Human adenovirus C
ccacuguuacucagccac

SEQ ID NO: 1556024 - RNA, 22 nt, Human adenovirus C
aguugcuugcuugcaagacugu

SEQ ID NO: 1556025 - RNA, 21 nt, Human adenovirus C
cuugucccuccgcacccacua

SEQ ID NO: 1556026 - RNA, 21 nt, Human adenovirus C
gcucaaaggcuacaggggccu

SEQ ID NO: 1556027 - RNA, 23 nt, Human adenovirus C
gcgcgagcucagcgaccgcgagc

SEQ ID NO: 1556028 - RNA, 22 nt, Human adenovirus C
gaacuauggcagcaaggccugg

SEQ ID NO: 1556029 - RNA, 13 nt, Human adenovirus C
cugcagagccagc

SEQ ID NO: 1556030 - RNA, 16 nt, Human adenovirus C
gccgccgccgucgccg

SEQ ID NO: 1556031 - RNA, 17 nt, Human adenovirus C
aagaucuggaaggugcu

SEQ ID NO: 1556032 - RNA, 16 nt, Human adenovirus C
cgcgcccuggaggcag

SEQ ID NO: 1556033 - RNA, 12 nt, Human adenovirus C
gaccugcgcugg

SEQ ID NO: 1556034 - RNA, 16 nt, Human adenovirus C
aaugcgccgugggcua

SEQ ID NO: 1556035 - RNA, 15 nt, Human adenovirus C
ccggugcugcggcag

SEQ ID NO: 1556036 - RNA, 20 nt, Human adenovirus C
cuuccauaagggccuccccu

SEQ ID NO: 1556037 - RNA, 22 nt, Human adenovirus C
ucgccagggcuacgugcgccag

SEQ ID NO: 1556038 - RNA, 18 nt, Human adenovirus C
aucagcguaaaucccaca

SEQ ID NO: 1556039 - RNA, 10 nt, Human adenovirus C
uuccucccaa

SEQ ID NO: 1556040 - RNA, 16 nt, Human adenovirus C
aacccuuccaggaggg

SEQ ID NO: 1556041 - RNA, 13 nt, Human adenovirus C
ugucucuaagcaa

SEQ ID NO: 1556042 - RNA, 15 nt, Human adenovirus C
gauggcgcaggcggc

SEQ ID NO: 1556043 - RNA, 21 nt, Human adenovirus C
cggggauucauguugugcaga

SEQ ID NO: 1556044 - RNA, 20 nt, Human adenovirus C
caagggcgaggcgcgccgcg

SEQ ID NO: 1556045 - RNA, 23 nt, Human adenovirus C
gugguuuuguacagugaagaugu

SEQ ID NO: 1556046 - RNA, 18 nt, Human adenovirus C
caggcgggagcuccugca

SEQ ID NO: 1556047 - RNA, 18 nt, Human adenovirus C
gucucgcauuccacgagc

SEQ ID NO: 1556048 - RNA, 13 nt, Human adenovirus C
accuacucuggcu

SEQ ID NO: 1556049 - RNA, 15 nt, Human adenovirus C
uggagacugcagccu

SEQ ID NO: 1556050 - RNA, 13 nt, Human adenovirus C
uaggguagcaucu

SEQ ID NO: 1556051 - RNA, 13 nt, Human adenovirus C
cacgcccccuucg

SEQ ID NO: 1556052 - RNA, 18 nt, Human adenovirus C
cggcagaugcgccccccu

SEQ ID NO: 1556053 - RNA, 12 nt, Human adenovirus C
gccgcggugcag

SEQ ID NO: 1556054 - RNA, 19 nt, Human adenovirus C
aaccuuuggacaccuccca

SEQ ID NO: 1556055 - RNA, 18 nt, Human adenovirus C
gcuacaaccuccgcuccu

SEQ ID NO: 1556056 - RNA, 21 nt, Human adenovirus C
cuggagucucacgcucgcuug

SEQ ID NO: 1556057 - RNA, 19 nt, Human adenovirus C
ccacuguuacucagccacu

SEQ ID NO: 1556058 - RNA, 22 nt, Human adenovirus C
uagcaagcugauugccaggggc

SEQ ID NO: 1556059 - RNA, 14 nt, Human adenovirus C
cugcagcuagccaa

SEQ ID NO: 1556060 - RNA, 13 nt, Human adenovirus C
acgcgacgagaaa

SEQ ID NO: 1556061 - RNA, 12 nt, Human adenovirus C
cgucaggagggg

SEQ ID NO: 1556062 - RNA, 12 nt, Human adenovirus C
uagacugcuccu

SEQ ID NO: 1556063 - RNA, 13 nt, Human adenovirus C
ggcgcugcagagc

SEQ ID NO: 1556064 - RNA, 22 nt, Human adenovirus C
aggcacccccgcuugaggagga

SEQ ID NO: 1556065 - RNA, 14 nt, Human adenovirus C
ccggcggcagcggc

SEQ ID NO: 1556066 - RNA, 15 nt, Human adenovirus C
aggagcgcugggcgu

SEQ ID NO: 1556067 - RNA, 15 nt, Human adenovirus C
ggagaucugcaccac

SEQ ID NO: 1556068 - RNA, 18 nt, Human adenovirus C
gauggccgcgggcugggu

SEQ ID NO: 1556069 - RNA, 21 nt, Human adenovirus C
cgcugcccugguguaccagga

SEQ ID NO: 1556070 - RNA, 15 nt, Human adenovirus C
aaggggguggugugu

SEQ ID NO: 1556071 - RNA, 14 nt, Human adenovirus C
cggcagcggcagca

SEQ ID NO: 1556072 - RNA, 21 nt, Human adenovirus C
agauauggcccucaccugccg

SEQ ID NO: 1556073 - RNA, 12 nt, Human adenovirus C
ccggcggcagaa

SEQ ID NO: 1556074 - RNA, 14 nt, Human adenovirus C
aaaccucaccuccc

SEQ ID NO: 1556075 - RNA, 17 nt, Human adenovirus C
cgcucauggcgcagcug

SEQ ID NO: 1556076 - RNA, 17 nt, Human adenovirus C
ucuucagcaaauacugc

SEQ ID NO: 1556077 - RNA, 20 nt, Human adenovirus C
cagccauaucccuccgggga

SEQ ID NO: 1556078 - RNA, 19 nt, Human adenovirus C
ugcuggauuuucuggccau

SEQ ID NO: 1556079 - RNA, 16 nt, Human adenovirus C
aaacauuacuggaacu

SEQ ID NO: 1556080 - RNA, 23 nt, Human adenovirus C
aggcggcggcggcggcaggagca

SEQ ID NO: 1556081 - RNA, 11 nt, Human adenovirus C
ucugcagagca

SEQ ID NO: 1556082 - RNA, 21 nt, Human adenovirus C
gcggcaacaacaguggcagcg

SEQ ID NO: 1556083 - RNA, 19 nt, Human adenovirus C
caagcgagugguggcuccc

SEQ ID NO: 1556084 - RNA, 15 nt, Human adenovirus C
agguguaggccacgu

SEQ ID NO: 1556085 - RNA, 17 nt, Human adenovirus C
cguaugccugcgcggcc

SEQ ID NO: 1556086 - RNA, 16 nt, Human adenovirus C
accuggaccggcuggu

SEQ ID NO: 1556087 - RNA, 12 nt, Human adenovirus C
ugaaccaggaga

SEQ ID NO: 1556088 - RNA, 22 nt, Human adenovirus C
auggcacccaaaaagaagcugc

SEQ ID NO: 1556089 - RNA, 21 nt, Human adenovirus C
agguaggcgaucccuacugua

SEQ ID NO: 1556090 - RNA, 17 nt, Human adenovirus C
cugcuuaaaagccaccu

SEQ ID NO: 1556091 - RNA, 18 nt, Human adenovirus C
cucacuuaaaucagcaca

SEQ ID NO: 1556092 - RNA, 20 nt, Human adenovirus C
ccgcagcccuaucagcagcc

SEQ ID NO: 1556093 - RNA, 23 nt, Human adenovirus C
ccgcacgcgaaccuacgcccaga

SEQ ID NO: 1556094 - RNA, 17 nt, Human adenovirus C
gcuacaaauaggaucag

SEQ ID NO: 1556095 - RNA, 23 nt, Human adenovirus C
auggguguucuugcuggucaggc

SEQ ID NO: 1556096 - RNA, 21 nt, Human adenovirus C
cccgcaacuucagacuggggu

SEQ ID NO: 1556097 - RNA, 20 nt, Human adenovirus C
accucgaccacugccgccgc

SEQ ID NO: 1556098 - RNA, 18 nt, Human adenovirus C
gcguccaugucgccgcca

SEQ ID NO: 1556099 - RNA, 15 nt, Human adenovirus C
guggaccuggccaac

SEQ ID NO: 1556100 - RNA, 14 nt, Human adenovirus C
aagaaaaacaccac

SEQ ID NO: 1556101 - RNA, 22 nt, Human adenovirus C
cugggugugcgcggcaccagcg

SEQ ID NO: 1556102 - RNA, 22 nt, Human adenovirus C
cugaccaaaugcgccagaaggc

SEQ ID NO: 1556103 - RNA, 16 nt, Human adenovirus C
accugccagacaagcu

SEQ ID NO: 1556104 - RNA, 16 nt, Human adenovirus C
ggaccacagaacccac

SEQ ID NO: 1556105 - RNA, 19 nt, Human adenovirus C
gcucuagaccgugcaaaag

SEQ ID NO: 1556106 - RNA, 15 nt, Human adenovirus C
gggucaaaaaccagg

SEQ ID NO: 1556107 - RNA, 13 nt, Human adenovirus C
acuggggcggcga

SEQ ID NO: 1556108 - RNA, 15 nt, Human adenovirus C
caguacuggcagcgg

SEQ ID NO: 1556109 - RNA, 12 nt, Human adenovirus C
ggaggggcaugg

SEQ ID NO: 1556110 - RNA, 13 nt, Human adenovirus C
gccgcgcaccugg

SEQ ID NO: 1556111 - RNA, 23 nt, Human adenovirus C
caaauauggaacauucccagcug

SEQ ID NO: 1556112 - RNA, 18 nt, Human adenovirus C
acggcgacgaggaccugc

SEQ ID NO: 1556113 - RNA, 22 nt, Human adenovirus C
ggggaggcaagcacacagacca

SEQ ID NO: 1556114 - RNA, 14 nt, Human adenovirus C
cuagcccugcaaac

SEQ ID NO: 1556115 - RNA, 12 nt, Human adenovirus C
ccgcgcgcggcg

SEQ ID NO: 1556116 - RNA, 22 nt, Human adenovirus C
uccgaaccuuuggacaccuccc

SEQ ID NO: 1556117 - RNA, 18 nt, Human adenovirus C
gaugacuugcaagaggcc

SEQ ID NO: 1556118 - RNA, 22 nt, Human adenovirus C
gaccgugucuagcuugcugacg

SEQ ID NO: 1556119 - RNA, 18 nt, Human adenovirus C
gaacaaaacucccuuaga

SEQ ID NO: 1556120 - RNA, 21 nt, Human adenovirus C
gcuuugcucccaaaccucagc

SEQ ID NO: 1556121 - RNA, 23 nt, Human adenovirus C
ggugguagauggccuggccucug

SEQ ID NO: 1556122 - RNA, 16 nt, Human adenovirus C
cguuucagccccccgg

SEQ ID NO: 1556123 - RNA, 22 nt, Human adenovirus C
acgugccgcggggacaggagga

SEQ ID NO: 1556124 - RNA, 15 nt, Human adenovirus C
cagcccgugcuggcc

SEQ ID NO: 1556125 - RNA, 13 nt, Human adenovirus C
gcccgacagggaa

SEQ ID NO: 1556126 - RNA, 14 nt, Human adenovirus C
aacucgcugcugca

SEQ ID NO: 1556127 - RNA, 20 nt, Human adenovirus C
cgguucuuugcugacccgga

SEQ ID NO: 1556128 - RNA, 21 nt, Human adenovirus C
caaguacuagcuacuguagcu

SEQ ID NO: 1556129 - RNA, 19 nt, Human adenovirus C
uuuguacagugaagaugua

SEQ ID NO: 1556130 - RNA, 21 nt, Human adenovirus C
cgaugcuccccuggacccgcc

SEQ ID NO: 1556131 - RNA, 21 nt, Human adenovirus C
cucccaaaagacauauuuccu

SEQ ID NO: 1556132 - RNA, 13 nt, Human adenovirus C
ccgcggggacagg

SEQ ID NO: 1556133 - RNA, 19 nt, Human adenovirus C
aggacccuggugcugccaa

SEQ ID NO: 1556134 - RNA, 18 nt, Human adenovirus C
ccccgggcagcaggcgcg

SEQ ID NO: 1556135 - RNA, 21 nt, Human adenovirus C
gcccgccggcuaugcacugca

SEQ ID NO: 1556136 - RNA, 20 nt, Human adenovirus C
cuacccgacgccgaaccacc

SEQ ID NO: 1556137 - RNA, 15 nt, Human adenovirus C
gcugaaacgcagcau

SEQ ID NO: 1556138 - RNA, 15 nt, Human adenovirus C
cgugcagaccgugga

SEQ ID NO: 1556139 - RNA, 13 nt, Human adenovirus C
caguccgggccag

SEQ ID NO: 1556140 - RNA, 19 nt, Human adenovirus C
auuugaagagcuuuugaaa

SEQ ID NO: 1556141 - RNA, 18 nt, Human adenovirus C
aucaggcuacuaagaaaa

SEQ ID NO: 1556142 - RNA, 17 nt, Human adenovirus C
cccugggaucaggcuac

SEQ ID NO: 1556143 - RNA, 23 nt, Human adenovirus C
gcggucucggucguugagggucc

SEQ ID NO: 1556144 - RNA, 13 nt, Human adenovirus C
ccauagcggaugu

SEQ ID NO: 1556145 - RNA, 15 nt, Human adenovirus C
caccacccuccucac

SEQ ID NO: 1556146 - RNA, 13 nt, Human adenovirus C
agcagcaggagga

SEQ ID NO: 1556147 - RNA, 18 nt, Human adenovirus C
ucauaguuguguuccagg

SEQ ID NO: 1556148 - RNA, 18 nt, Human adenovirus C
uguggccuccgacugugg

SEQ ID NO: 1556149 - RNA, 22 nt, Human adenovirus C
ggacgcuaccgcugcgcaacag

SEQ ID NO: 1556150 - RNA, 11 nt, Human adenovirus C
aauguggccuc

SEQ ID NO: 1556151 - RNA, 17 nt, Human adenovirus C
gccagaggagcugcuga

SEQ ID NO: 1556152 - RNA, 13 nt, Human adenovirus C
cugcagcagcgcg

SEQ ID NO: 1556153 - RNA, 21 nt, Human adenovirus C
uuccaugcucagucugggcaa

SEQ ID NO: 1556154 - RNA, 16 nt, Human adenovirus C
caacgugccgcgggga

SEQ ID NO: 1556155 - RNA, 14 nt, Human adenovirus C
auuaacaaaaauac

SEQ ID NO: 1556156 - RNA, 13 nt, Human adenovirus C
ccgggcacagcag

SEQ ID NO: 1556157 - RNA, 13 nt, Human adenovirus C
aggguucggggcu

SEQ ID NO: 1556158 - RNA, 17 nt, Human adenovirus C
cgcaaccgcgcccaggc

SEQ ID NO: 1556159 - RNA, 15 nt, Human adenovirus C
gcagcuggccuugcg

SEQ ID NO: 1556160 - RNA, 13 nt, Human adenovirus C
caguggacuaaac

SEQ ID NO: 1556161 - RNA, 18 nt, Human adenovirus C
ccuuacuacaccuacucu

SEQ ID NO: 1556162 - RNA, 16 nt, Human adenovirus C
gacgacuggcgccagg

SEQ ID NO: 1556163 - RNA, 22 nt, Human adenovirus C
gccgcuucagccgcugcagcca

SEQ ID NO: 1556164 - RNA, 19 nt, Human adenovirus C
uuuguagcgccacaucuuc

SEQ ID NO: 1556165 - RNA, 19 nt, Human adenovirus C
acgcggugguggaggaggc

SEQ ID NO: 1556166 - RNA, 18 nt, Human adenovirus C
gucaucucuacagccccu

SEQ ID NO: 1556167 - RNA, 21 nt, Human adenovirus C
aacgacgagucggugagcucc

SEQ ID NO: 1556168 - RNA, 22 nt, Human adenovirus C
aggcgcuuuuccaagagaaggu

SEQ ID NO: 1556169 - RNA, 16 nt, Human adenovirus C
gaacuaccugcugacc

SEQ ID NO: 1556170 - RNA, 19 nt, Human adenovirus C
uccugucgagccaaacgcu

SEQ ID NO: 1556171 - RNA, 16 nt, Human adenovirus C
cugcagagcucucugg

SEQ ID NO: 1556172 - RNA, 16 nt, Human adenovirus C
aaagcagaccaaagca

SEQ ID NO: 1556173 - RNA, 21 nt, Human adenovirus C
gugcaguuugcccgcgccacc

SEQ ID NO: 1556174 - RNA, 22 nt, Human adenovirus C
cgguaaagaccccgggcagcag

SEQ ID NO: 1556175 - RNA, 16 nt, Human adenovirus C
gccgcuggacgagggc

SEQ ID NO: 1556176 - RNA, 14 nt, Human adenovirus C
cggccgcugcggcc

SEQ ID NO: 1556177 - RNA, 14 nt, Human adenovirus C
gaauuguugcuaca

SEQ ID NO: 1556178 - RNA, 13 nt, Human adenovirus C
cacuggcagggac

SEQ ID NO: 1556179 - RNA, 15 nt, Human adenovirus C
cagucguagcaggag

SEQ ID NO: 1556180 - RNA, 15 nt, Human adenovirus C
accugcuugagcagg

SEQ ID NO: 1556181 - RNA, 20 nt, Human adenovirus C
uaaacauuccagcaccuuca

SEQ ID NO: 1556182 - RNA, 16 nt, Human adenovirus C
gugaugccggcggcgg

SEQ ID NO: 1556183 - RNA, 20 nt, Human adenovirus C
gacacccaagggugcagcug

SEQ ID NO: 1556184 - RNA, 16 nt, Human adenovirus C
gccacagagggcaugg

SEQ ID NO: 1556185 - RNA, 15 nt, Human adenovirus C
agcuacccacccagc

SEQ ID NO: 1556186 - RNA, 12 nt, Human adenovirus C
cugccaggcuca

SEQ ID NO: 1556187 - RNA, 15 nt, Human adenovirus C
gaucaggcuacuaag

SEQ ID NO: 1556188 - RNA, 17 nt, Human adenovirus C
gccgcacgaggggcagu

SEQ ID NO: 1556189 - RNA, 14 nt, Human adenovirus C
gacgaaugagcucc

SEQ ID NO: 1556190 - RNA, 20 nt, Human adenovirus C
gcucuggccguucgggguca

SEQ ID NO: 1556191 - RNA, 22 nt, Human adenovirus C
ggcagcuggggccggaccuggg

SEQ ID NO: 1556192 - RNA, 15 nt, Human adenovirus C
gcgggagcuccugca

SEQ ID NO: 1556193 - RNA, 22 nt, Human adenovirus C
aagagcuucuacaacgaccagg

SEQ ID NO: 1556194 - RNA, 22 nt, Human adenovirus C
uuaaaucagcacaguaacugca

SEQ ID NO: 1556195 - RNA, 13 nt, Human adenovirus C
ggcguuggacagc

SEQ ID NO: 1556196 - RNA, 19 nt, Human adenovirus C
augaggaagguccuccucc

SEQ ID NO: 1556197 - RNA, 15 nt, Human adenovirus C
cacagaagcaaaggc

SEQ ID NO: 1556198 - RNA, 16 nt, Human adenovirus C
agggccgcuggcugcu

SEQ ID NO: 1556199 - RNA, 14 nt, Human adenovirus C
uucgcacuggggcg

SEQ ID NO: 1556200 - RNA, 21 nt, Human adenovirus C
gcaacagcgcgagcaggcaga

SEQ ID NO: 1556201 - RNA, 22 nt, Human adenovirus C
uauuuccugaagcaaaaccagg

SEQ ID NO: 1556202 - RNA, 18 nt, Human adenovirus C
cagccauaucccuccggg

SEQ ID NO: 1556203 - RNA, 22 nt, Human adenovirus C
auacacaggguugcagcacugg

SEQ ID NO: 1556204 - RNA, 16 nt, Human adenovirus C
aacuccaacgcggcag

SEQ ID NO: 1556205 - RNA, 22 nt, Human adenovirus C
gcagguuggaauucuucaccag

SEQ ID NO: 1556206 - RNA, 20 nt, Human adenovirus C
uggagucagucgagaaggag

SEQ ID NO: 1556207 - RNA, 14 nt, Human adenovirus C
augaugacaaacuu

SEQ ID NO: 1556208 - RNA, 18 nt, Human adenovirus C
ccugccagacaagcuaaa

SEQ ID NO: 1556209 - RNA, 23 nt, Human adenovirus C
cccagcagaaaccugugcugcca

SEQ ID NO: 1556210 - RNA, 18 nt, Human adenovirus C
ggcugguccugcuggugc

SEQ ID NO: 1556211 - RNA, 19 nt, Human adenovirus C
ugcugcaccugcgugaggg

SEQ ID NO: 1556212 - RNA, 14 nt, Human adenovirus C
acagugaagaugua

SEQ ID NO: 1556213 - RNA, 14 nt, Human adenovirus C
cacaguaacugcag

SEQ ID NO: 1556214 - RNA, 13 nt, Human adenovirus C
acugcugcuggaa

SEQ ID NO: 1556215 - RNA, 18 nt, Human adenovirus C
uacgacccuuacuacacc

SEQ ID NO: 1556216 - RNA, 13 nt, Human adenovirus C
accugggcggcga

SEQ ID NO: 1556217 - RNA, 21 nt, Human adenovirus C
uagauugcaucccaccuuuca

SEQ ID NO: 1556218 - RNA, 21 nt, Human adenovirus C
ggcgcaccgggaggcggucga

SEQ ID NO: 1556219 - RNA, 19 nt, Human adenovirus C
gcagaggcggccgcccuug

SEQ ID NO: 1556220 - RNA, 17 nt, Human adenovirus C
cgugcgcaggguggcuc

SEQ ID NO: 1556221 - RNA, 14 nt, Human adenovirus C
ggcgaugagcagcu

SEQ ID NO: 1556222 - RNA, 18 nt, Human adenovirus C
uggaauucuucaccagca

SEQ ID NO: 1556223 - RNA, 16 nt, Human adenovirus C
augaagaucuggaagg

SEQ ID NO: 1556224 - RNA, 13 nt, Human adenovirus C
gaggcuugggagu

SEQ ID NO: 1556225 - RNA, 17 nt, Human adenovirus C
cucuacaagcuugucua

SEQ ID NO: 1556226 - RNA, 17 nt, Human adenovirus C
gguauugggguaacuga

SEQ ID NO: 1556227 - RNA, 16 nt, Human adenovirus C
gguugccgccugcugc

SEQ ID NO: 1556228 - RNA, 16 nt, Human adenovirus C
guccacuagggggucc

SEQ ID NO: 1556229 - RNA, 19 nt, Human adenovirus C
uauacgccaucaucucugu

SEQ ID NO: 1556230 - RNA, 20 nt, Human adenovirus C
gccgggagagggggcagggg

SEQ ID NO: 1556231 - RNA, 12 nt, Human adenovirus C
guacuuugacau

SEQ ID NO: 1556232 - RNA, 14 nt, Human adenovirus C
ucuucuucuucugg

SEQ ID NO: 1556233 - RNA, 18 nt, Human adenovirus C
uaagagagcugcagcugc

SEQ ID NO: 1556234 - RNA, 14 nt, Human adenovirus C
agaagcugcagcug

SEQ ID NO: 1556235 - RNA, 19 nt, Human adenovirus C
gcugugcgcuuccuagcga

SEQ ID NO: 1556236 - RNA, 13 nt, Human adenovirus C
cggcuaggucucg

SEQ ID NO: 1556237 - RNA, 19 nt, Human adenovirus C
ccgaggcagcggcagaagc

SEQ ID NO: 1556238 - RNA, 23 nt, Human adenovirus C
acaucgaaguagauugcauccca

SEQ ID NO: 1556239 - RNA, 15 nt, Human adenovirus C
cgccgugccgccagc

SEQ ID NO: 1556240 - RNA, 14 nt, Human adenovirus C
cggagggugccaga

SEQ ID NO: 1556241 - RNA, 14 nt, Human adenovirus C
ggcggcgcuggccg

SEQ ID NO: 1556242 - RNA, 21 nt, Human adenovirus C
cucgcuuacuaaggacaaaca

SEQ ID NO: 1556243 - RNA, 15 nt, Human adenovirus C
gaggacuaccacgcc

SEQ ID NO: 1556244 - RNA, 17 nt, Human adenovirus C
auccuaacucugcagac

SEQ ID NO: 1556245 - RNA, 19 nt, Human adenovirus C
cgucaucucuacagccccu

SEQ ID NO: 1556246 - RNA, 15 nt, Human adenovirus C
gcggcaccagcgcau

SEQ ID NO: 1556247 - RNA, 20 nt, Human adenovirus C
cggccaaucaagcagguggc

SEQ ID NO: 1556248 - RNA, 19 nt, Human adenovirus C
ccaggcggcggguacagug

SEQ ID NO: 1556249 - RNA, 15 nt, Human adenovirus C
ccgcgcgcuggggca

SEQ ID NO: 1556250 - RNA, 18 nt, Human adenovirus C
gcagacacgaucggcagg

SEQ ID NO: 1556251 - RNA, 22 nt, Human adenovirus C
ccugugcuuugcucccaaaccu

SEQ ID NO: 1556252 - RNA, 23 nt, Human adenovirus C
gcucccaccaugcgcgagggaca

SEQ ID NO: 1556253 - RNA, 19 nt, Human adenovirus C
cuccuuuccuuccucccaa

SEQ ID NO: 1556254 - RNA, 18 nt, Human adenovirus C
ggcagacaugcagggcac

SEQ ID NO: 1556255 - RNA, 17 nt, Human adenovirus C
acccaaaaagaagcugc

SEQ ID NO: 1556256 - RNA, 15 nt, Human adenovirus C
agcuugagccuggcu

SEQ ID NO: 1556257 - RNA, 15 nt, Human adenovirus C
ggcgcaguuggaaga

SEQ ID NO: 1556258 - RNA, 12 nt, Human adenovirus C
cgccgcagcagc

SEQ ID NO: 1556259 - RNA, 23 nt, Human adenovirus C
uacaaccccaccaauguggaaau

SEQ ID NO: 1556260 - RNA, 17 nt, Human adenovirus C
ccggaaaccucaccucc

SEQ ID NO: 1556261 - RNA, 16 nt, Human adenovirus C
cggccaugcgggccgc

SEQ ID NO: 1556262 - RNA, 21 nt, Human adenovirus C
gcgccugauuucugccagcgc

SEQ ID NO: 1556263 - RNA, 17 nt, Human adenovirus C
ggcguugccgcuggacg

SEQ ID NO: 1556264 - RNA, 21 nt, Human adenovirus C
cugccccuacguuuacaaggc

SEQ ID NO: 1556265 - RNA, 14 nt, Human adenovirus C
gcagcaggugcugc

SEQ ID NO: 1556266 - RNA, 17 nt, Human adenovirus C
aucuugguuacaucuga

SEQ ID NO: 1556267 - RNA, 22 nt, Human adenovirus C
cugcgaggacagggccucucag

SEQ ID NO: 1556268 - RNA, 20 nt, Human adenovirus C
caaccuggaccggcuggugg

SEQ ID NO: 1556269 - RNA, 16 nt, Human adenovirus C
ugauuccauaggugau

SEQ ID NO: 1556270 - RNA, 18 nt, Human adenovirus C
agcgcccucuccugagcg

SEQ ID NO: 1556271 - RNA, 11 nt, Human adenovirus C
cuuugccaacu

SEQ ID NO: 1556272 - RNA, 19 nt, Human adenovirus C
ccuccuccugccaggcuca

SEQ ID NO: 1556273 - RNA, 16 nt, Human adenovirus C
aaaccuauuaaaaaac

SEQ ID NO: 1556274 - RNA, 16 nt, Human adenovirus C
gaguuuaaggaaccag

SEQ ID NO: 1556275 - RNA, 22 nt, Human adenovirus C
aacacggccuccacgcuggaag

SEQ ID NO: 1556276 - RNA, 22 nt, Human adenovirus C
cgagagcguggugagcgcggcg

SEQ ID NO: 1556277 - RNA, 13 nt, Human adenovirus C
ucccauagacaag

SEQ ID NO: 1556278 - RNA, 18 nt, Human adenovirus C
ggauucauguugugcaga

SEQ ID NO: 1556279 - RNA, 15 nt, Human adenovirus C
ccuuuggacaccucc

SEQ ID NO: 1556280 - RNA, 22 nt, Human adenovirus C
cucaggcgccgccggcacugcc

SEQ ID NO: 1556281 - RNA, 14 nt, Human adenovirus C
gacuacucaacccg

SEQ ID NO: 1556282 - RNA, 14 nt, Human adenovirus C
cuaaacccuucagg

SEQ ID NO: 1556283 - RNA, 15 nt, Human adenovirus C
cuggagcucccgcgg

SEQ ID NO: 1556284 - RNA, 11 nt, Human adenovirus C
ccgcaccugcc

SEQ ID NO: 1556285 - RNA, 21 nt, Human adenovirus C
gccgcuuuggggucacugcua

SEQ ID NO: 1556286 - RNA, 14 nt, Human adenovirus C
gaaggugauugguu

SEQ ID NO: 1556287 - RNA, 20 nt, Human adenovirus C
ccaucuccuaacugcagaau

SEQ ID NO: 1556288 - RNA, 22 nt, Human adenovirus C
ugcccgcugucauaccacugca

SEQ ID NO: 1556289 - RNA, 19 nt, Human adenovirus C
aaugaaaaaauucauagau

SEQ ID NO: 1556290 - RNA, 19 nt, Human adenovirus C
cacccgucccaucgcgccc

SEQ ID NO: 1556291 - RNA, 21 nt, Human adenovirus C
ugcgguucaucccuguggacc

SEQ ID NO: 1556292 - RNA, 15 nt, Human adenovirus C
cugccgucaucccug

SEQ ID NO: 1556293 - RNA, 21 nt, Human adenovirus C
agagcccgagggccgcuggcu

SEQ ID NO: 1556294 - RNA, 12 nt, Human adenovirus C
uacgucacuucc

SEQ ID NO: 1556295 - RNA, 21 nt, Human adenovirus C
guacuccgccaccgagggacc

SEQ ID NO: 1556296 - RNA, 22 nt, Human adenovirus C
ggagcgaagaaacccaucugag

SEQ ID NO: 1556297 - RNA, 15 nt, Human adenovirus C
gcagagcccauggaa

SEQ ID NO: 1556298 - RNA, 15 nt, Human adenovirus C
cggcucaccacccag

SEQ ID NO: 1556299 - RNA, 14 nt, Human adenovirus C
ugaggguuggaagc

SEQ ID NO: 1556300 - RNA, 15 nt, Human adenovirus C
accucgaccacugcc

SEQ ID NO: 1556301 - RNA, 22 nt, Human adenovirus C
uccaggcggucccacagcucgg

SEQ ID NO: 1556302 - RNA, 14 nt, Human adenovirus C
cccucgccuggcgg

SEQ ID NO: 1556303 - RNA, 18 nt, Human adenovirus C
gacucggcagacgacagc

SEQ ID NO: 1556304 - RNA, 16 nt, Human adenovirus C
gcgagcaggcagaggc

SEQ ID NO: 1556305 - RNA, 23 nt, Human adenovirus C
aggaggagaugauggaagacugg

SEQ ID NO: 1556306 - RNA, 23 nt, Human adenovirus C
cuuuuguaaaaacgugcgcagua

SEQ ID NO: 1556307 - RNA, 13 nt, Human adenovirus C
cugagucuccaga

SEQ ID NO: 1556308 - RNA, 17 nt, Human adenovirus C
cccggagaugcagcgca

SEQ ID NO: 1556309 - RNA, 16 nt, Human adenovirus C
ccagcaucgcuacaac

SEQ ID NO: 1556310 - RNA, 19 nt, Human adenovirus C
ucauuccacgcucaagggc

SEQ ID NO: 1556311 - RNA, 15 nt, Human adenovirus C
uaugacacagaaacc

SEQ ID NO: 1556312 - RNA, 14 nt, Human adenovirus C
ugccaugcgcgggc

SEQ ID NO: 1556313 - RNA, 14 nt, Human adenovirus C
cagaccugggccaa

SEQ ID NO: 1556314 - RNA, 19 nt, Human adenovirus C
auccagcggcggcggcgcg

SEQ ID NO: 1556315 - RNA, 14 nt, Human adenovirus C
agaucuccgcgucc

SEQ ID NO: 1556316 - RNA, 15 nt, Human adenovirus C
gcccagucugcaaga

SEQ ID NO: 1556317 - RNA, 21 nt, Human adenovirus C
ggaagacguaugcgcaggagc

SEQ ID NO: 1556318 - RNA, 20 nt, Human adenovirus C
ccacgccccgcgccacguca

SEQ ID NO: 1556319 - RNA, 16 nt, Human adenovirus C
gagucucgggccggcc

SEQ ID NO: 1556320 - RNA, 17 nt, Human adenovirus C
cacugucgcugcaaccu

SEQ ID NO: 1556321 - RNA, 11 nt, Human adenovirus C
gccacgucaca

SEQ ID NO: 1556322 - RNA, 17 nt, Human adenovirus C
cggcuaugcacugcagg

SEQ ID NO: 1556323 - RNA, 17 nt, Human adenovirus C
cuucaaucuccucuucc

SEQ ID NO: 1556324 - RNA, 14 nt, Human adenovirus C
agcaaggccugccc

SEQ ID NO: 1556325 - RNA, 20 nt, Human adenovirus C
cgggcggccaugcgggccgc

SEQ ID NO: 1556326 - RNA, 13 nt, Human adenovirus C
gcggcggcagcag

SEQ ID NO: 1556327 - RNA, 19 nt, Human adenovirus C
ucccaaaaagggugcaugc

SEQ ID NO: 1556328 - RNA, 22 nt, Human adenovirus C
ucguggcuacaccuaccgcccc

SEQ ID NO: 1556329 - RNA, 22 nt, Human adenovirus C
gugcuuauggugggagaaaaac

SEQ ID NO: 1556330 - RNA, 14 nt, Human adenovirus C
cgcgcugcggcugc

SEQ ID NO: 1556331 - RNA, 21 nt, Human adenovirus C
cacgcacgaaggaggcguagg

SEQ ID NO: 1556332 - RNA, 14 nt, Human adenovirus C
guuccugagcagcu

SEQ ID NO: 1556333 - RNA, 14 nt, Human adenovirus C
acgaagccuuccau

SEQ ID NO: 1556334 - RNA, 18 nt, Human adenovirus C
agauccgcguccaggucc

SEQ ID NO: 1556335 - RNA, 20 nt, Human adenovirus C
ugacaguggagagcccagga

SEQ ID NO: 1556336 - RNA, 15 nt, Human adenovirus C
aucccugaacuacca

SEQ ID NO: 1556337 - RNA, 21 nt, Human adenovirus C
cagccacucucgcaaggccug

SEQ ID NO: 1556338 - RNA, 13 nt, Human adenovirus C
agaucagcuggga

SEQ ID NO: 1556339 - RNA, 22 nt, Human adenovirus C
aauucuuuaauuaugaaacgga

SEQ ID NO: 1556340 - RNA, 19 nt, Human adenovirus C
ccaucgcgcccauggcuac

SEQ ID NO: 1556341 - RNA, 15 nt, Human adenovirus C
guuggaggaguggcu

SEQ ID NO: 1556342 - RNA, 21 nt, Human adenovirus C
caugucgcuguccagcugcug

SEQ ID NO: 1556343 - RNA, 19 nt, Human adenovirus C
cgaggaugaagaagaggaa

SEQ ID NO: 1556344 - RNA, 17 nt, Human adenovirus C
gcaagaccaggacgacg

SEQ ID NO: 1556345 - RNA, 22 nt, Human adenovirus C
ugacaaaagaacccacacugau

SEQ ID NO: 1556346 - RNA, 13 nt, Human adenovirus C
gaggugcuugcca

SEQ ID NO: 1556347 - RNA, 14 nt, Human adenovirus C
gcugcaacccgcgg

SEQ ID NO: 1556348 - RNA, 18 nt, Human adenovirus C
ccucggucgcauuccccu

SEQ ID NO: 1556349 - RNA, 23 nt, Human adenovirus C
ccgcaguuggcgaugagcagcug

SEQ ID NO: 1556350 - RNA, 18 nt, Human adenovirus C
gauuagcaaacuuguaaa

SEQ ID NO: 1556351 - RNA, 16 nt, Human adenovirus C
gagggccgcuggcugc

SEQ ID NO: 1556352 - RNA, 17 nt, Human adenovirus C
gaggagccuccaccggc

SEQ ID NO: 1556353 - RNA, 13 nt, Human adenovirus C
augcaucaaacaa

SEQ ID NO: 1556354 - RNA, 14 nt, Human adenovirus C
ggcugcagccaggg

SEQ ID NO: 1556355 - RNA, 14 nt, Human adenovirus C
guugaggguggugg

SEQ ID NO: 1556356 - RNA, 13 nt, Human adenovirus C
accgugcagcuga

SEQ ID NO: 1556357 - RNA, 16 nt, Human adenovirus C
cgagcaggacccaggu

SEQ ID NO: 1556358 - RNA, 16 nt, Human adenovirus C
augcgccagaaggcgc

SEQ ID NO: 1556359 - RNA, 17 nt, Human adenovirus C
gguccagcagaggcggc

SEQ ID NO: 1556360 - RNA, 17 nt, Human adenovirus C
gcauccggugcugcggc

SEQ ID NO: 1556361 - RNA, 16 nt, Human adenovirus C
cauccgcggcagcucg

SEQ ID NO: 1556362 - RNA, 14 nt, Human adenovirus C
ggaggaagccaggc

SEQ ID NO: 1556363 - RNA, 22 nt, Human adenovirus C
acuggcaaagcacacugaacag

SEQ ID NO: 1556364 - RNA, 23 nt, Human adenovirus C
ugcgugugaccccgaagccccuc

SEQ ID NO: 1556365 - RNA, 15 nt, Human adenovirus C
cgcggcggucaccag

SEQ ID NO: 1556366 - RNA, 20 nt, Human adenovirus C
ccuucacccaguaccgcagc

SEQ ID NO: 1556367 - RNA, 13 nt, Human adenovirus C
accugggcuggcg

SEQ ID NO: 1556368 - RNA, 22 nt, Human adenovirus C
ugugcuugauauggcuuccacg

SEQ ID NO: 1556369 - RNA, 16 nt, Human adenovirus C
gcugcuggaagggggu

SEQ ID NO: 1556370 - RNA, 12 nt, Human adenovirus C
uugguccagcag

SEQ ID NO: 1556371 - RNA, 14 nt, Human adenovirus C
gccuggaacagcag

SEQ ID NO: 1556372 - RNA, 12 nt, Human adenovirus C
agaggccgcauc

SEQ ID NO: 1556373 - RNA, 21 nt, Human adenovirus C
cucuuccauaagggccucccc

SEQ ID NO: 1556374 - RNA, 18 nt, Human adenovirus C
gacaaagcccaagaaauc

SEQ ID NO: 1556375 - RNA, 19 nt, Human adenovirus C
ccugagcaacuuguugggc

SEQ ID NO: 1556376 - RNA, 20 nt, Human adenovirus C
gcugugccuuuuacugcugc

SEQ ID NO: 1556377 - RNA, 22 nt, Human adenovirus C
ucagugcaacaugaccaaggac

SEQ ID NO: 1556378 - RNA, 17 nt, Human adenovirus C
aggcucucuucagcaaa

SEQ ID NO: 1556379 - RNA, 19 nt, Human adenovirus C
uccacaaaaaacacccaga

SEQ ID NO: 1556380 - RNA, 14 nt, Human adenovirus C
ccaacccgcgccuc

SEQ ID NO: 1556381 - RNA, 14 nt, Human adenovirus C
cacaagccccacug

SEQ ID NO: 1556382 - RNA, 23 nt, Human adenovirus C
uacaaguuguggcccccacaaaa

SEQ ID NO: 1556383 - RNA, 18 nt, Human adenovirus C
ugaccagcucggcgguga

SEQ ID NO: 1556384 - RNA, 20 nt, Human adenovirus C
cgaagaaggaagagcaggau

SEQ ID NO: 1556385 - RNA, 21 nt, Human adenovirus C
uuugacgcugcgguucauccc

SEQ ID NO: 1556386 - RNA, 20 nt, Human adenovirus C
accacuuacaauuaccucag

SEQ ID NO: 1556387 - RNA, 18 nt, Human adenovirus C
gaaccccggauccggccg

SEQ ID NO: 1556388 - RNA, 21 nt, Human adenovirus C
caguggaacgaagcugaugcu

SEQ ID NO: 1556389 - RNA, 17 nt, Human adenovirus C
agccgcgcgcuggggca

SEQ ID NO: 1556390 - RNA, 19 nt, Human adenovirus C
gaccgcgagcugaugcaca

SEQ ID NO: 1556391 - RNA, 16 nt, Human adenovirus C
cuggccaguguuugag

SEQ ID NO: 1556392 - RNA, 21 nt, Human adenovirus C
gggguccacucgcuccagggu

SEQ ID NO: 1556393 - RNA, 15 nt, Human adenovirus C
cuguaacgcuggacc

SEQ ID NO: 1556394 - RNA, 19 nt, Human adenovirus C
agguggcacuuaggccaga

SEQ ID NO: 1556395 - RNA, 17 nt, Human adenovirus C
ccacagccgccugagca

SEQ ID NO: 1556396 - RNA, 22 nt, Human adenovirus C
ggaagacguaugcgcaggagca

SEQ ID NO: 1556397 - RNA, 23 nt, Human adenovirus C
cagagcgugagccuuaaccugau

SEQ ID NO: 1556398 - RNA, 13 nt, Human adenovirus C
ggugcagacccug

SEQ ID NO: 1556399 - RNA, 15 nt, Human adenovirus C
cucccuugccgugcu

SEQ ID NO: 1556400 - RNA, 22 nt, Human adenovirus C
uuucuggcggaggugcugcuga

SEQ ID NO: 1556401 - RNA, 20 nt, Human adenovirus C
auugcguaccucaggcacca

SEQ ID NO: 1556402 - RNA, 18 nt, Human adenovirus C
accauuaacgaggauggg

SEQ ID NO: 1556403 - RNA, 12 nt, Human adenovirus C
cgcuggccaggg

SEQ ID NO: 1556404 - RNA, 23 nt, Human adenovirus C
cuccacgcuggaagccaugcuca

SEQ ID NO: 1556405 - RNA, 17 nt, Human adenovirus C
ggaauccgcgcccaccg

SEQ ID NO: 1556406 - RNA, 20 nt, Human adenovirus C
cacccaaugguuuccaagaa

SEQ ID NO: 1556407 - RNA, 13 nt, Human adenovirus C
ccuaucacaucuu

SEQ ID NO: 1556408 - RNA, 18 nt, Human adenovirus C
acugccacggguagcuug

SEQ ID NO: 1556409 - RNA, 16 nt, Human adenovirus C
ucaaaucuucacuucc

SEQ ID NO: 1556410 - RNA, 20 nt, Human adenovirus C
gcgcccacaccuacagccug

SEQ ID NO: 1556411 - RNA, 18 nt, Human adenovirus C
ugcccaucuccaucccau

SEQ ID NO: 1556412 - RNA, 18 nt, Human adenovirus C
agugcuuguuaccgugga

SEQ ID NO: 1556413 - RNA, 13 nt, Human adenovirus C
ucaaaaacaugcu

SEQ ID NO: 1556414 - RNA, 13 nt, Human adenovirus C
cccuguggaccgc

SEQ ID NO: 1556415 - RNA, 12 nt, Human adenovirus C
ggcgcaggcggc

SEQ ID NO: 1556416 - RNA, 23 nt, Human adenovirus C
caaccuucaaaucaaacuuuccu

SEQ ID NO: 1556417 - RNA, 20 nt, Human adenovirus C
uggcgcaucccauucuccag

SEQ ID NO: 1556418 - RNA, 23 nt, Human adenovirus C
aaacucuucgcggucuuuccagu

SEQ ID NO: 1556419 - RNA, 14 nt, Human adenovirus C
ggcggcggcaggag

SEQ ID NO: 1556420 - RNA, 17 nt, Human adenovirus C
ugucuuacaaaccugga

SEQ ID NO: 1556421 - RNA, 22 nt, Human adenovirus C
acacaccucgaccacugccgcc

SEQ ID NO: 1556422 - RNA, 21 nt, Human adenovirus C
ugauuaaaugagacaugauuc

SEQ ID NO: 1556423 - RNA, 14 nt, Human adenovirus C
cagcacuggcaaca

SEQ ID NO: 1556424 - RNA, 18 nt, Human adenovirus C
ggcagagcgacugcgccu

SEQ ID NO: 1556425 - RNA, 22 nt, Human adenovirus C
gcguccaugucgccgccagagg

SEQ ID NO: 1556426 - RNA, 17 nt, Human adenovirus C
gcgcuguaccugccaga

SEQ ID NO: 1556427 - RNA, 12 nt, Human adenovirus C
gcgcggccgccg

SEQ ID NO: 1556428 - RNA, 15 nt, Human adenovirus C
uacuuuucagcagau

SEQ ID NO: 1556429 - RNA, 19 nt, Human adenovirus C
agcggugacgcgggcgggc

SEQ ID NO: 1556430 - RNA, 19 nt, Human adenovirus C
gaaaccccacgguggcacc

SEQ ID NO: 1556431 - RNA, 19 nt, Human adenovirus C
guagauggccuggccucug

SEQ ID NO: 1556432 - RNA, 20 nt, Human adenovirus C
gcauuagcggggugguggac

SEQ ID NO: 1556433 - RNA, 16 nt, Human adenovirus C
ccgggagagggggcag

SEQ ID NO: 1556434 - RNA, 17 nt, Human adenovirus C
ggccgaaaacagggcca

SEQ ID NO: 1556435 - RNA, 20 nt, Human adenovirus C
gggggcaacauccaagauga

SEQ ID NO: 1556436 - RNA, 14 nt, Human adenovirus C
uaaugacugcaaau

SEQ ID NO: 1556437 - RNA, 12 nt, Human adenovirus C
cgcagccggugg

SEQ ID NO: 1556438 - RNA, 16 nt, Human adenovirus C
cagcugcuacaacaaa

SEQ ID NO: 1556439 - RNA, 14 nt, Human adenovirus C
ccagcgacuggaag

SEQ ID NO: 1556440 - RNA, 22 nt, Human adenovirus C
ccgaaccuuuggacaccuccca

SEQ ID NO: 1556441 - RNA, 15 nt, Human adenovirus C
accgucuggcugcuc

SEQ ID NO: 1556442 - RNA, 13 nt, Human adenovirus C
cccauacccgcca

SEQ ID NO: 1556443 - RNA, 13 nt, Human adenovirus C
cagcggcagaagc

SEQ ID NO: 1556444 - RNA, 16 nt, Human adenovirus C
agggcacccuccccuu

SEQ ID NO: 1556445 - RNA, 13 nt, Human adenovirus C
agacaagcuaaaa

SEQ ID NO: 1556446 - RNA, 12 nt, Human adenovirus C
ugcuucuucccc

SEQ ID NO: 1556447 - RNA, 13 nt, Human adenovirus C
cugcccgccaccu

SEQ ID NO: 1556448 - RNA, 16 nt, Human adenovirus C
caaccuauggagaaau

SEQ ID NO: 1556449 - RNA, 20 nt, Human adenovirus C
uccgcacccacuaucuucau

SEQ ID NO: 1556450 - RNA, 17 nt, Human adenovirus C
ugcgucgcaaccaggaa

SEQ ID NO: 1556451 - RNA, 12 nt, Human adenovirus C
ccaccaccgccu

SEQ ID NO: 1556452 - RNA, 14 nt, Human adenovirus C
ccuuugccuggaac

SEQ ID NO: 1556453 - RNA, 13 nt, Human adenovirus C
ugcccgccaccug

SEQ ID NO: 1556454 - RNA, 13 nt, Human adenovirus C
cccgcgccacguc

SEQ ID NO: 1556455 - RNA, 20 nt, Human adenovirus C
cgaggaggacuuugagcccg

SEQ ID NO: 1556456 - RNA, 14 nt, Human adenovirus C
ucgggaagaacugg

SEQ ID NO: 1556457 - RNA, 16 nt, Human adenovirus C
cccggcggugcgggcg

SEQ ID NO: 1556458 - RNA, 19 nt, Human adenovirus C
ugcagcgcaagcuagagga

SEQ ID NO: 1556459 - RNA, 18 nt, Human adenovirus C
uacaaguuguggccccca

SEQ ID NO: 1556460 - RNA, 21 nt, Human adenovirus C
ggaaacagggacgagccccuu

SEQ ID NO: 1556461 - RNA, 15 nt, Human adenovirus C
ccugcgacgggccga

SEQ ID NO: 1556462 - RNA, 17 nt, Human adenovirus C
gaccgucuggcugcucg

SEQ ID NO: 1556463 - RNA, 15 nt, Human adenovirus C
aaggccucaaggcgc

SEQ ID NO: 1556464 - RNA, 16 nt, Human adenovirus C
cguagcucagugcaac

SEQ ID NO: 1556465 - RNA, 21 nt, Human adenovirus C
cugcgugaagacgacgggccc

SEQ ID NO: 1556466 - RNA, 14 nt, Human adenovirus C
acucgcugcugcag

SEQ ID NO: 1556467 - RNA, 23 nt, Human adenovirus C
cuggggcaggaggacacgggcag

SEQ ID NO: 1556468 - RNA, 19 nt, Human adenovirus C
auagcuaacgugucguaug

SEQ ID NO: 1556469 - RNA, 17 nt, Human adenovirus C
uccaugggcgcacucac

SEQ ID NO: 1556470 - RNA, 23 nt, Human adenovirus C
ccugcaaagggcccuggcuggca

SEQ ID NO: 1556471 - RNA, 15 nt, Human adenovirus C
ugggauaugcuccag

SEQ ID NO: 1556472 - RNA, 17 nt, Human adenovirus C
ggcgcagcaucccuuuu

SEQ ID NO: 1556473 - RNA, 15 nt, Human adenovirus C
cugagccccgggcug

SEQ ID NO: 1556474 - RNA, 21 nt, Human adenovirus C
gcgcuccgaccaacacccagu

SEQ ID NO: 1556475 - RNA, 18 nt, Human adenovirus C
gauaugcuccaggcgggc

SEQ ID NO: 1556476 - RNA, 15 nt, Human adenovirus C
ucuggcgcccaacga

SEQ ID NO: 1556477 - RNA, 14 nt, Human adenovirus C
gggugguggaccug

SEQ ID NO: 1556478 - RNA, 18 nt, Human adenovirus C
gaaaugccuguuugaaag

SEQ ID NO: 1556479 - RNA, 19 nt, Human adenovirus C
cggcgacaccuuugccaca

SEQ ID NO: 1556480 - RNA, 21 nt, Human adenovirus C
ggcagccuggaggcaacccug

SEQ ID NO: 1556481 - RNA, 23 nt, Human adenovirus C
cugccagcgccugcacugcaaau

SEQ ID NO: 1556482 - RNA, 13 nt, Human adenovirus C
cuccccccgcuga

SEQ ID NO: 1556483 - RNA, 16 nt, Human adenovirus C
uggacuaaacuuugau

SEQ ID NO: 1556484 - RNA, 16 nt, Human adenovirus C
gcaguagucggugcuc

SEQ ID NO: 1556485 - RNA, 20 nt, Human adenovirus C
aaaaugaaagucacugugga

SEQ ID NO: 1556486 - RNA, 22 nt, Human adenovirus C
gugccaaaaaucuuugaggguc

SEQ ID NO: 1556487 - RNA, 19 nt, Human adenovirus C
guacauccugcacgagguu

SEQ ID NO: 1556488 - RNA, 18 nt, Human adenovirus C
ucgggcggggggaccaaa

SEQ ID NO: 1556489 - RNA, 17 nt, Human adenovirus C
acccagcacucggcaga

SEQ ID NO: 1556490 - RNA, 22 nt, Human adenovirus C
ucacaucgaaguagauugcauc

SEQ ID NO: 1556491 - RNA, 14 nt, Human adenovirus C
guggcgcccucuuc

SEQ ID NO: 1556492 - RNA, 15 nt, Human adenovirus C
cuagcucccaagggc

SEQ ID NO: 1556493 - RNA, 23 nt, Human adenovirus C
agcagaaaccugugcugccaggg

SEQ ID NO: 1556494 - RNA, 23 nt, Human adenovirus C
auggcuaccggagugcugggcca

SEQ ID NO: 1556495 - RNA, 19 nt, Human adenovirus C
agaagguaagcgggucuug

SEQ ID NO: 1556496 - RNA, 18 nt, Human adenovirus C
cuggccccaaacucccau

SEQ ID NO: 1556497 - RNA, 16 nt, Human adenovirus C
acaacuuugccaugga

SEQ ID NO: 1556498 - RNA, 16 nt, Human adenovirus C
guucugacagggccca

SEQ ID NO: 1556499 - RNA, 15 nt, Human adenovirus C
caucugcagcgccag

SEQ ID NO: 1556500 - RNA, 13 nt, Human adenovirus C
caacacguaauga

SEQ ID NO: 1556501 - RNA, 15 nt, Human adenovirus C
ccgaggucgagaagc

SEQ ID NO: 1556502 - RNA, 21 nt, Human adenovirus C
cggcagaugcgccccccuccu

SEQ ID NO: 1556503 - RNA, 15 nt, Human adenovirus C
ccucuuguccugcau

SEQ ID NO: 1556504 - RNA, 19 nt, Human adenovirus C
auuagagaucuuauuccau

SEQ ID NO: 1556505 - RNA, 18 nt, Human adenovirus C
ggccaguguuugagcaca

SEQ ID NO: 1556506 - RNA, 20 nt, Human adenovirus C
gccgcacgaggggcagugca

SEQ ID NO: 1556507 - RNA, 19 nt, Human adenovirus C
auacuacauggacaaaaga

SEQ ID NO: 1556508 - RNA, 15 nt, Human adenovirus C
auaggacugaugcau

SEQ ID NO: 1556509 - RNA, 14 nt, Human adenovirus C
ccggggcuguggac

SEQ ID NO: 1556510 - RNA, 15 nt, Human adenovirus C
gcaacgccacaacau

SEQ ID NO: 1556511 - RNA, 16 nt, Human adenovirus C
caccaguguaaaagag

SEQ ID NO: 1556512 - RNA, 16 nt, Human adenovirus C
cggccgccgcagcagc

SEQ ID NO: 1556513 - RNA, 13 nt, Human adenovirus C
ucacuccacaggc

SEQ ID NO: 1556514 - RNA, 20 nt, Human adenovirus C
cauuaaguuugacagcauuu

SEQ ID NO: 1556515 - RNA, 13 nt, Human adenovirus C
aggccuggaacag

SEQ ID NO: 1556516 - RNA, 19 nt, Human adenovirus C
uggacaccuccgcaccacu

SEQ ID NO: 1556517 - RNA, 16 nt, Human adenovirus C
ucagccucgccccccu

SEQ ID NO: 1556518 - RNA, 17 nt, Human adenovirus C
gagcuccacgugccggg

SEQ ID NO: 1556519 - RNA, 12 nt, Human adenovirus C
caccaccucccg

SEQ ID NO: 1556520 - RNA, 22 nt, Human adenovirus C
gcagaggagguuuuggacgagg

SEQ ID NO: 1556521 - RNA, 15 nt, Human adenovirus C
gcugcagagccagcc

SEQ ID NO: 1556522 - RNA, 13 nt, Human adenovirus C
cagcccuaucagc

SEQ ID NO: 1556523 - RNA, 21 nt, Human adenovirus C
caucgcuaugcgccacuggca

SEQ ID NO: 1556524 - RNA, 12 nt, Human adenovirus C
accucccuugcc

SEQ ID NO: 1556525 - RNA, 15 nt, Human adenovirus C
acccuuccaggaggg

SEQ ID NO: 1556526 - RNA, 17 nt, Human adenovirus C
guccgugugcaccagcc

SEQ ID NO: 1556527 - RNA, 15 nt, Human adenovirus C
aggcuaauggcaaug

SEQ ID NO: 1556528 - RNA, 12 nt, Human adenovirus C
agacgacagcgu

SEQ ID NO: 1556529 - RNA, 21 nt, Human adenovirus C
cggagcuaugcuaaccagcgu

SEQ ID NO: 1556530 - RNA, 22 nt, Human adenovirus C
ggccgcgucaugcacgcagcac

SEQ ID NO: 1556531 - RNA, 12 nt, Human adenovirus C
cgagguggagau

SEQ ID NO: 1556532 - RNA, 12 nt, Human adenovirus C
gcuaccagggcu

SEQ ID NO: 1556533 - RNA, 19 nt, Human adenovirus C
cuauuaccggcugcaacug

SEQ ID NO: 1556534 - RNA, 14 nt, Human adenovirus C
caguggacgcggcc

SEQ ID NO: 1556535 - RNA, 17 nt, Human adenovirus C
acgguuuuccuggccaa

SEQ ID NO: 1556536 - RNA, 17 nt, Human adenovirus C
cgccgagcuguugcccg

SEQ ID NO: 1556537 - RNA, 22 nt, Human adenovirus C
cagagcauaguggugcaggagc

SEQ ID NO: 1556538 - RNA, 13 nt, Human adenovirus C
gcccgccaccugc

SEQ ID NO: 1556539 - RNA, 24 nt, Human adenovirus C
cccacgauguaaaguuccaagaag

SEQ ID NO: 1556540 - RNA, 14 nt, Human adenovirus C
ccuuugagcugcag

SEQ ID NO: 1556541 - RNA, 11 nt, Human adenovirus C
agaaaccccac

SEQ ID NO: 1556542 - RNA, 13 nt, Human adenovirus C
cagacgacagcag

SEQ ID NO: 1556543 - RNA, 20 nt, Human adenovirus C
cccuugcggcagucugcagc

SEQ ID NO: 1556544 - RNA, 17 nt, Human adenovirus C
uuugauauucaccuggc

SEQ ID NO: 1556545 - RNA, 14 nt, Human adenovirus C
gaagacugggacag

SEQ ID NO: 1556546 - RNA, 18 nt, Human adenovirus C
aagccaugcucagaaaug

SEQ ID NO: 1556547 - RNA, 15 nt, Human adenovirus C
cccgccaccaguugg

SEQ ID NO: 1556548 - RNA, 15 nt, Human adenovirus C
ggcauccgcgccgca

SEQ ID NO: 1556549 - RNA, 22 nt, Human adenovirus C
gcaucgcugucugcgagggcca

SEQ ID NO: 1556550 - RNA, 17 nt, Human adenovirus C
gcgguauccugccccuc

SEQ ID NO: 1556551 - RNA, 20 nt, Human adenovirus C
ccuuggccaauugcaagcca

SEQ ID NO: 1556552 - RNA, 15 nt, Human adenovirus C
aucgcuacggcggcg

SEQ ID NO: 1556553 - RNA, 11 nt, Human adenovirus C
ggaggugagcu

SEQ ID NO: 1556554 - RNA, 15 nt, Human adenovirus C
ggugaaggggugcgc

SEQ ID NO: 1556555 - RNA, 14 nt, Human adenovirus C
gcaaaacgcucgag

SEQ ID NO: 1556556 - RNA, 12 nt, Human adenovirus C
gcggcggcagca

SEQ ID NO: 1556557 - RNA, 20 nt, Human adenovirus C
caaaggcacgaccgucagcg

SEQ ID NO: 1556558 - RNA, 22 nt, Human adenovirus C
ggacagggccucucagaugcug

SEQ ID NO: 1556559 - RNA, 19 nt, Human adenovirus C
cagugucagauggaaagcu

SEQ ID NO: 1556560 - RNA, 19 nt, Human adenovirus C
ucagccgcgcgcuggggca

SEQ ID NO: 1556561 - RNA, 18 nt, Human adenovirus C
cacggcguggccuucccc

SEQ ID NO: 1556562 - RNA, 15 nt, Human adenovirus C
acuaguauugccacu

SEQ ID NO: 1556563 - RNA, 22 nt, Human adenovirus C
ugagcgggggguaccugcugga

SEQ ID NO: 1556564 - RNA, 20 nt, Human adenovirus C
cugccgccgccgccacccac

SEQ ID NO: 1556565 - RNA, 21 nt, Human adenovirus C
gggacgggggguuuaccugga

SEQ ID NO: 1556566 - RNA, 18 nt, Human adenovirus C
ccauuuuugcccuagcca

SEQ ID NO: 1556567 - RNA, 21 nt, Human adenovirus C
cagggcggggauggcgcaggc

SEQ ID NO: 1556568 - RNA, 19 nt, Human adenovirus C
ccacacgggcggaggagaa

SEQ ID NO: 1556569 - RNA, 12 nt, Human adenovirus C
gagcccacccuu

SEQ ID NO: 1556570 - RNA, 19 nt, Human adenovirus C
uccuccgggcacagcagcg

SEQ ID NO: 1556571 - RNA, 20 nt, Human adenovirus C
ggaagcagagugggaauuug

SEQ ID NO: 1556572 - RNA, 20 nt, Human adenovirus C
caaacagguggagcugaaau

SEQ ID NO: 1556573 - RNA, 11 nt, Human adenovirus C
agaacugagac

SEQ ID NO: 1556574 - RNA, 21 nt, Human adenovirus C
ggagcgcagcuugagccuggc

SEQ ID NO: 1556575 - RNA, 19 nt, Human adenovirus C
gagcauacuuuccaggaga

SEQ ID NO: 1556576 - RNA, 23 nt, Human adenovirus C
cgggcugggugugcgcggcacca

SEQ ID NO: 1556577 - RNA, 18 nt, Human adenovirus C
augcgccacuggcaggga

SEQ ID NO: 1556578 - RNA, 16 nt, Human adenovirus C
ccagacauuacuccca

SEQ ID NO: 1556579 - RNA, 14 nt, Human adenovirus C
guauccggugcacu

SEQ ID NO: 1556580 - RNA, 16 nt, Human adenovirus C
cuggagcugcccaaga

SEQ ID NO: 1556581 - RNA, 15 nt, Human adenovirus C
cugcagcgcugccaa

SEQ ID NO: 1556582 - RNA, 14 nt, Human adenovirus C
ccgcgguccuccuc

SEQ ID NO: 1556583 - RNA, 19 nt, Human adenovirus C
ucgcgccuguugcugcugc

SEQ ID NO: 1556584 - RNA, 13 nt, Human adenovirus C
aguagcacaaaac

SEQ ID NO: 1556585 - RNA, 17 nt, Human adenovirus C
gcgggcugcucugcucg

SEQ ID NO: 1556586 - RNA, 18 nt, Human adenovirus C
aggaagaugaagaugaag

SEQ ID NO: 1556587 - RNA, 17 nt, Human adenovirus C
gcgcugcggccccgcgg

SEQ ID NO: 1556588 - RNA, 15 nt, Human adenovirus C
uaacauccaccaccg

SEQ ID NO: 1556589 - RNA, 21 nt, Human adenovirus C
gacauuucagaucggcggcgc

SEQ ID NO: 1556590 - RNA, 13 nt, Human adenovirus C
gcguucaggaauu

SEQ ID NO: 1556591 - RNA, 18 nt, Human adenovirus C
gcacaucucgggccagga

SEQ ID NO: 1556592 - RNA, 22 nt, Human adenovirus C
uagaaccaaaguugcaggagcu

SEQ ID NO: 1556593 - RNA, 17 nt, Human adenovirus C
cuacaucguaggugaca

SEQ ID NO: 1556594 - RNA, 12 nt, Human adenovirus C
uccacagcucgc

SEQ ID NO: 1556595 - RNA, 12 nt, Human adenovirus C
cggcggcagcag

SEQ ID NO: 1556596 - RNA, 21 nt, Human adenovirus C
uggcagcaaugccuggaggag

SEQ ID NO: 1556597 - RNA, 18 nt, Human adenovirus C
accguggagccugggcug

SEQ ID NO: 1556598 - RNA, 19 nt, Human adenovirus C
gccgcgcaccuggcggaca

SEQ ID NO: 1556599 - RNA, 17 nt, Human adenovirus C
gcuggaagccaugcuca

SEQ ID NO: 1556600 - RNA, 22 nt, Human adenovirus C
uaccuuggguauccugucugag

SEQ ID NO: 1556601 - RNA, 18 nt, Human adenovirus C
gcugcgcgcuggccaggg

SEQ ID NO: 1556602 - RNA, 22 nt, Human adenovirus C
cugcgcuagcuuuuuuggccac

SEQ ID NO: 1556603 - RNA, 14 nt, Human adenovirus C
ccagacgggccagg

SEQ ID NO: 1556604 - RNA, 12 nt, Human adenovirus C
cuuaugccaggc

SEQ ID NO: 1556605 - RNA, 23 nt, Human adenovirus C
acaugcgagcccaacccgcgccu

SEQ ID NO: 1556606 - RNA, 16 nt, Human adenovirus C
cugcagcuagccaacu

SEQ ID NO: 1556607 - RNA, 13 nt, Human adenovirus C
gucgcaggggcaa

SEQ ID NO: 1556608 - RNA, 14 nt, Human adenovirus C
caccccgcaccgcu

SEQ ID NO: 1556609 - RNA, 14 nt, Human adenovirus C
uaauggacuacuug

SEQ ID NO: 1556610 - RNA, 17 nt, Human adenovirus C
cuacgucaucuccagcg

SEQ ID NO: 1556611 - RNA, 13 nt, Human adenovirus C
gccagcacgcucu

SEQ ID NO: 1556612 - RNA, 20 nt, Human adenovirus C
guguggaagccuggaccgau

SEQ ID NO: 1556613 - RNA, 23 nt, Human adenovirus C
caaauuccucauguucuuguccc

SEQ ID NO: 1556614 - RNA, 16 nt, Human adenovirus C
ucuggagcucccgcgg

SEQ ID NO: 1556615 - RNA, 23 nt, Human adenovirus C
ccguaucgacccgcgagcuuaga

SEQ ID NO: 1556616 - RNA, 22 nt, Human adenovirus C
caccuuuuguuccaccgcucug

SEQ ID NO: 1556617 - RNA, 22 nt, Human adenovirus C
uugcgcuaugugcagcagagcg

SEQ ID NO: 1556618 - RNA, 23 nt, Human adenovirus C
gugcugguggaacuugaggguga

SEQ ID NO: 1556619 - RNA, 21 nt, Human adenovirus C
cugucccuuuuuuuuccacag

SEQ ID NO: 1556620 - RNA, 15 nt, Human adenovirus C
acccuggcugugggu

SEQ ID NO: 1556621 - RNA, 17 nt, Human adenovirus C
gcuaggagcgcccucuc

SEQ ID NO: 1556622 - RNA, 20 nt, Human adenovirus C
cugacccggagaugcagcgc

SEQ ID NO: 1556623 - RNA, 22 nt, Human adenovirus C
cuacaugagcgcgggaccccac

SEQ ID NO: 1556624 - RNA, 15 nt, Human adenovirus C
cugcuugagcaggcc

SEQ ID NO: 1556625 - RNA, 14 nt, Human adenovirus C
ugccugaagauggc

SEQ ID NO: 1556626 - RNA, 16 nt, Human adenovirus C
cgcguuccggcagcag

SEQ ID NO: 1556627 - RNA, 23 nt, Human adenovirus C
gcccugcgcgucggccagguagc

SEQ ID NO: 1556628 - RNA, 21 nt, Human adenovirus C
cacgccuuugccaacuggccc

SEQ ID NO: 1556629 - RNA, 17 nt, Human adenovirus C
ugcaagcagugcagcuu

SEQ ID NO: 1556630 - RNA, 23 nt, Human adenovirus C
ugcaagaggccgcauccccgcgg

SEQ ID NO: 1556631 - RNA, 18 nt, Human adenovirus C
ggggauucauguugugca

SEQ ID NO: 1556632 - RNA, 15 nt, Human adenovirus C
gcgcacgcuuguggc

SEQ ID NO: 1556633 - RNA, 13 nt, Human adenovirus C
ccgagguggagau

SEQ ID NO: 1556634 - RNA, 19 nt, Human adenovirus C
ucgaggucacccacuuugc

SEQ ID NO: 1556635 - RNA, 19 nt, Human adenovirus C
gcgcuguaccugccagaca

SEQ ID NO: 1556636 - RNA, 20 nt, Human adenovirus C
ucuacagccccuacugcacc

SEQ ID NO: 1556637 - RNA, 20 nt, Human adenovirus C
uccacggacgacuggcgcca

SEQ ID NO: 1556638 - RNA, 14 nt, Human adenovirus C
gaagggcacgagcu

SEQ ID NO: 1556639 - RNA, 19 nt, Human adenovirus C
gcaccgggacugggcgugc

SEQ ID NO: 1556640 - RNA, 20 nt, Human adenovirus C
cgcagcuugagccuggcuga

SEQ ID NO: 1556641 - RNA, 16 nt, Human adenovirus C
acgggccagggucaug

SEQ ID NO: 1556642 - RNA, 20 nt, Human adenovirus C
agggcgcugucauaccugau

SEQ ID NO: 1556643 - RNA, 15 nt, Human adenovirus C
gaucugcgccagcag

SEQ ID NO: 1556644 - RNA, 20 nt, Human adenovirus C
acucuguaugcuauauuuca

SEQ ID NO: 1556645 - RNA, 15 nt, Human adenovirus C
ggugccucuuccaaa

SEQ ID NO: 1556646 - RNA, 12 nt, Human adenovirus C
auacuaaauaca

SEQ ID NO: 1556647 - RNA, 21 nt, Human adenovirus C
acgccuuccugaguacacagc

SEQ ID NO: 1556648 - RNA, 20 nt, Human adenovirus C
ccugcugaaugcgcaggcgg

SEQ ID NO: 1556649 - RNA, 15 nt, Human adenovirus C
gguggaggaggcgcg

SEQ ID NO: 1556650 - RNA, 12 nt, Human adenovirus C
gguccagcagag

SEQ ID NO: 1556651 - RNA, 17 nt, Human adenovirus C
acggcaccgccagcgca

SEQ ID NO: 1556652 - RNA, 21 nt, Human adenovirus C
ugaagcgcugccggucuucgc

SEQ ID NO: 1556653 - RNA, 19 nt, Human adenovirus C
cugacgccagacgccgcac

SEQ ID NO: 1556654 - RNA, 21 nt, Human adenovirus C
acaugcagggcacccuccccu

SEQ ID NO: 1556655 - RNA, 23 nt, Human adenovirus C
ccagcugcuacaacaaacagagc

SEQ ID NO: 1556656 - RNA, 17 nt, Human adenovirus C
gacgggcccggugagcu

SEQ ID NO: 1556657 - RNA, 17 nt, Human adenovirus C
guaccugagccccgggc

SEQ ID NO: 1556658 - RNA, 21 nt, Human adenovirus C
gccagacaugaugcaagaccc

SEQ ID NO: 1556659 - RNA, 17 nt, Human adenovirus C
caugcaucuguggagag

SEQ ID NO: 1556660 - RNA, 18 nt, Human adenovirus C
cguguucugacagggccc

SEQ ID NO: 1556661 - RNA, 21 nt, Human adenovirus C
guuucuggcggaggugcugcu

SEQ ID NO: 1556662 - RNA, 19 nt, Human adenovirus C
uacagccccuacugcaccg

SEQ ID NO: 1556663 - RNA, 21 nt, Human adenovirus C
caugcgcgggcggcaagcgcg

SEQ ID NO: 1556664 - RNA, 16 nt, Human adenovirus C
auugagguacugaaau

SEQ ID NO: 1556665 - RNA, 17 nt, Human adenovirus C
agccacuuaaaaaaaca

SEQ ID NO: 1556666 - RNA, 16 nt, Human adenovirus C
uagaggggcucucuga

SEQ ID NO: 1556667 - RNA, 15 nt, Human adenovirus C
uacaagcuccucccg

SEQ ID NO: 1556668 - RNA, 20 nt, Human adenovirus C
ucucagcgcagcggugcagc

SEQ ID NO: 1556669 - RNA, 22 nt, Human adenovirus C
aguagaagucccugcgacgggc

SEQ ID NO: 1556670 - RNA, 17 nt, Human adenovirus C
acgcgcgcgcagccucc

SEQ ID NO: 1556671 - RNA, 10 nt, Human adenovirus C
uucugcugug

SEQ ID NO: 1556672 - RNA, 22 nt, Human adenovirus C
cagguuuuguaagcgaagacga

SEQ ID NO: 1556673 - RNA, 22 nt, Human adenovirus C
ugaucugcuuaaaagccaccug

SEQ ID NO: 1556674 - RNA, 23 nt, Human adenovirus C
uccacgcuggaagccaugcucag

SEQ ID NO: 1556675 - RNA, 20 nt, Human adenovirus C
agggcuacaacguagcucag

SEQ ID NO: 1556676 - RNA, 14 nt, Human adenovirus C
caggaaccaugaca

SEQ ID NO: 1556677 - RNA, 19 nt, Human adenovirus C
cguccagacgggccagggu

SEQ ID NO: 1556678 - RNA, 14 nt, Human adenovirus C
ccauccgcggcagc

SEQ ID NO: 1556679 - RNA, 22 nt, Human adenovirus C
cuggcgaucguaaacgcgcugg

SEQ ID NO: 1556680 - RNA, 18 nt, Human adenovirus C
cuccagcggccacacccg

SEQ ID NO: 1556681 - RNA, 19 nt, Human adenovirus C
cuacaucguaggugacaaa

SEQ ID NO: 1556682 - RNA, 19 nt, Human adenovirus C
acgugcagaccaaccugga

SEQ ID NO: 1556683 - RNA, 15 nt, Human adenovirus C
agaccuaccgcguca

SEQ ID NO: 1556684 - RNA, 19 nt, Human adenovirus C
cucuggggauggcgggcgc

SEQ ID NO: 1556685 - RNA, 21 nt, Human adenovirus C
gcuaccuucugcagcuagcca

SEQ ID NO: 1556686 - RNA, 14 nt, Human adenovirus C
guccagcagaggcg

SEQ ID NO: 1556687 - RNA, 23 nt, Human adenovirus C
cgcgagcugaugcacagccugca

SEQ ID NO: 1556688 - RNA, 19 nt, Human adenovirus C
cuucagagaagaacaugcc

SEQ ID NO: 1556689 - RNA, 23 nt, Human adenovirus C
gagguugaccugacgaccgcgca

SEQ ID NO: 1556690 - RNA, 18 nt, Human adenovirus C
ccccuuaguaugcagcgc

SEQ ID NO: 1556691 - RNA, 14 nt, Human adenovirus C
ugaagaugaagaag

SEQ ID NO: 1556692 - RNA, 15 nt, Human adenovirus C
gcgcaggagcacagg

SEQ ID NO: 1556693 - RNA, 16 nt, Human adenovirus C
guggucgcgaaagguc

SEQ ID NO: 1556694 - RNA, 20 nt, Human adenovirus C
ccuaaacaacucgcugcugc

SEQ ID NO: 1556695 - RNA, 17 nt, Human adenovirus C
ugcucaacccacacaau

SEQ ID NO: 1556696 - RNA, 18 nt, Human adenovirus C
augcagaaacacaagcua

SEQ ID NO: 1556697 - RNA, 15 nt, Human adenovirus C
cuacuucggcugcuu

SEQ ID NO: 1556698 - RNA, 23 nt, Human adenovirus C
aaagcggaacauuaacaaaaaua

SEQ ID NO: 1556699 - RNA, 18 nt, Human adenovirus C
acgcgcagcccgugggcu

SEQ ID NO: 1556700 - RNA, 20 nt, Human adenovirus C
ugcggccuaccggggggaga

SEQ ID NO: 1556701 - RNA, 14 nt, Human adenovirus C
cagacgcgccagac

SEQ ID NO: 1556702 - RNA, 16 nt, Human adenovirus C
aaugcagaaacacaag

SEQ ID NO: 1556703 - RNA, 13 nt, Human adenovirus C
cgcgggcgggccc

SEQ ID NO: 1556704 - RNA, 15 nt, Human adenovirus C
caaguagcacaaaac

SEQ ID NO: 1556705 - RNA, 13 nt, Human adenovirus C
aggucagcugcaa

SEQ ID NO: 1556706 - RNA, 22 nt, Human adenovirus C
cgggagagggggcaggggcacg

SEQ ID NO: 1556707 - RNA, 18 nt, Human adenovirus C
cuggcgcaaaaucuccug

SEQ ID NO: 1556708 - RNA, 16 nt, Human adenovirus C
ccuccccuucuccuac

SEQ ID NO: 1556709 - RNA, 15 nt, Human adenovirus C
gguggcggcgagguc

SEQ ID NO: 1556710 - RNA, 13 nt, Human adenovirus C
cgugcggcaggga

SEQ ID NO: 1556711 - RNA, 20 nt, Human adenovirus C
cgagcggccgccgcagcagc

SEQ ID NO: 1556712 - RNA, 11 nt, Human adenovirus C
cagcacagcag

SEQ ID NO: 1556713 - RNA, 23 nt, Human adenovirus C
ucacccuuauccucaucugcagc

SEQ ID NO: 1556714 - RNA, 14 nt, Human adenovirus C
auaguggugcagga

SEQ ID NO: 1556715 - RNA, 19 nt, Human adenovirus C
ggaagcgacgaaugagcuc

SEQ ID NO: 1556716 - RNA, 13 nt, Human adenovirus C
auucaccaccucc

SEQ ID NO: 1556717 - RNA, 12 nt, Human adenovirus C
uaaccaccaccg

SEQ ID NO: 1556718 - RNA, 19 nt, Human adenovirus C
uacaaacgaagccuuccau

SEQ ID NO: 1556719 - RNA, 22 nt, Human adenovirus C
ugcgccccccuccucagcagcg

SEQ ID NO: 1556720 - RNA, 14 nt, Human adenovirus C
gucauaccacugca

SEQ ID NO: 1556721 - RNA, 18 nt, Human adenovirus C
agcuugccugcuccagag

SEQ ID NO: 1556722 - RNA, 11 nt, Human adenovirus C
cggugagcgcu

SEQ ID NO: 1556723 - RNA, 20 nt, Human adenovirus C
uaucaccgucacccagcacu

SEQ ID NO: 1556724 - RNA, 17 nt, Human adenovirus C
gcggcaacgugcagacc

SEQ ID NO: 1556725 - RNA, 15 nt, Human adenovirus C
aauaagauuaacagu

SEQ ID NO: 1556726 - RNA, 18 nt, Human adenovirus C
uccagagcgcccuccacc

SEQ ID NO: 1556727 - RNA, 12 nt, Human adenovirus C
agaagcgcgggg

SEQ ID NO: 1556728 - RNA, 16 nt, Human adenovirus C
agggcugccugcacuu

SEQ ID NO: 1556729 - RNA, 21 nt, Human adenovirus C
acccaaaaagaagcugcagcu

SEQ ID NO: 1556730 - RNA, 22 nt, Human adenovirus C
uggugcgcucgucgggcaccag

SEQ ID NO: 1556731 - RNA, 18 nt, Human adenovirus C
auaguggugcaggagcgc

SEQ ID NO: 1556732 - RNA, 14 nt, Human adenovirus C
cugcagccagggga

SEQ ID NO: 1556733 - RNA, 14 nt, Human adenovirus C
aaggcuacaggggc

SEQ ID NO: 1556734 - RNA, 19 nt, Human adenovirus C
uggaacagcagcacaggcc

SEQ ID NO: 1556735 - RNA, 15 nt, Human adenovirus C
gucgccaccgccgcc

SEQ ID NO: 1556736 - RNA, 18 nt, Human adenovirus C
cgucauuacccagggcca

SEQ ID NO: 1556737 - RNA, 12 nt, Human adenovirus C
cccuccccuucu

SEQ ID NO: 1556738 - RNA, 13 nt, Human adenovirus C
gcacucgcaccgu

SEQ ID NO: 1556739 - RNA, 15 nt, Human adenovirus C
uuaggguauaugcaa

SEQ ID NO: 1556740 - RNA, 17 nt, Human adenovirus C
cucacccgcagcugccu

SEQ ID NO: 1556741 - RNA, 14 nt, Human adenovirus C
uuacugcugcugga

SEQ ID NO: 1556742 - RNA, 17 nt, Human adenovirus C
uggcguugccgcuggac

SEQ ID NO: 1556743 - RNA, 19 nt, Human adenovirus C
agcggaugucagccuugcc

SEQ ID NO: 1556744 - RNA, 15 nt, Human adenovirus C
uggccugaaccgcga

SEQ ID NO: 1556745 - RNA, 21 nt, Human adenovirus C
gcgcaaaggugucccuaacca

SEQ ID NO: 1556746 - RNA, 19 nt, Human adenovirus C
aacucaggggcgcagcuug

SEQ ID NO: 1556747 - RNA, 22 nt, Human adenovirus C
ggacgggggguuuaccuggacc

SEQ ID NO: 1556748 - RNA, 14 nt, Human adenovirus C
gcggggugcccuug

SEQ ID NO: 1556749 - RNA, 15 nt, Human adenovirus C
uccauccggcccagg

SEQ ID NO: 1556750 - RNA, 14 nt, Human adenovirus C
ggccaugcaucugu

SEQ ID NO: 1556751 - RNA, 21 nt, Human adenovirus C
auaccuugacggaaccuucua

SEQ ID NO: 1556752 - RNA, 18 nt, Human adenovirus C
ccuugacggaaccuucua

SEQ ID NO: 1556753 - RNA, 23 nt, Human adenovirus C
ugcugacccggagaugcagcgca

SEQ ID NO: 1556754 - RNA, 22 nt, Human adenovirus C
uguuuggaagauuuuucugcug

SEQ ID NO: 1556755 - RNA, 17 nt, Human adenovirus C
gacugggcgugcagacc

SEQ ID NO: 1556756 - RNA, 19 nt, Human adenovirus C
gagcgcuccuuuuggcuuc

SEQ ID NO: 1556757 - RNA, 14 nt, Human adenovirus C
cgagugguggcucc

SEQ ID NO: 1556758 - RNA, 21 nt, Human adenovirus C
cucuauaaacauuccagcacc

SEQ ID NO: 1556759 - RNA, 22 nt, Human adenovirus C
guuccuuauagugcagcacagc

SEQ ID NO: 1556760 - RNA, 17 nt, Human adenovirus C
gcccagcguggcgcugg

SEQ ID NO: 1556761 - RNA, 22 nt, Human adenovirus C
cugcuuuacggauuugucaccc

SEQ ID NO: 1556762 - RNA, 14 nt, Human adenovirus C
gcgcgcgggcagga

SEQ ID NO: 1556763 - RNA, 13 nt, Human adenovirus C
ccaaaagcagggc

SEQ ID NO: 1556764 - RNA, 16 nt, Human adenovirus C
cucaacccgaauaaac

SEQ ID NO: 1556765 - RNA, 14 nt, Human adenovirus C
caacgcgcagcccg

SEQ ID NO: 1556766 - RNA, 12 nt, Human adenovirus C
caguuuccaaaa

SEQ ID NO: 1556767 - RNA, 20 nt, Human adenovirus C
ugcagagcuucaugcugcgg

SEQ ID NO: 1556768 - RNA, 20 nt, Human adenovirus C
ccuggccaaccaggcagugc

SEQ ID NO: 1556769 - RNA, 20 nt, Human adenovirus C
agcgggggguaccugcugga

SEQ ID NO: 1556770 - RNA, 13 nt, Human adenovirus C
ugcugcagccgca

SEQ ID NO: 1556771 - RNA, 18 nt, Human adenovirus C
cgcuggaaaaguccaccc

SEQ ID NO: 1556772 - RNA, 14 nt, Human adenovirus C
gcuugagcaggcca

SEQ ID NO: 1556773 - RNA, 19 nt, Human adenovirus C
ugcagaccguaaaccugag

SEQ ID NO: 1556774 - RNA, 20 nt, Human adenovirus C
caaggacugguuccuggugc

SEQ ID NO: 1556775 - RNA, 17 nt, Human adenovirus C
cugggccagcacacacc

SEQ ID NO: 1556776 - RNA, 20 nt, Human adenovirus C
gcacccaaaaagaagcugca

SEQ ID NO: 1556777 - RNA, 22 nt, Human adenovirus C
guuccauccggcccaggggcgu

SEQ ID NO: 1556778 - RNA, 23 nt, Human adenovirus C
auuucugccagcgccugcacugc

SEQ ID NO: 1556779 - RNA, 17 nt, Human adenovirus C
ccacaggcugcugucca

SEQ ID NO: 1556780 - RNA, 15 nt, Human adenovirus C
caacagggucugcca

SEQ ID NO: 1556781 - RNA, 22 nt, Human adenovirus C
ucugcacucuuauuaaaaccau

SEQ ID NO: 1556782 - RNA, 24 nt, Human adenovirus C
aggcggcggcaacaacaguggcag

SEQ ID NO: 1556783 - RNA, 12 nt, Human adenovirus C
cgcaacugggca

SEQ ID NO: 1556784 - RNA, 15 nt, Human adenovirus C
ugaaauccuguggug

SEQ ID NO: 1556785 - RNA, 19 nt, Human adenovirus C
uauaaugucacagucuucc

SEQ ID NO: 1556786 - RNA, 15 nt, Human adenovirus C
acgcgcuccccuccg

SEQ ID NO: 1556787 - RNA, 23 nt, Human adenovirus C
ccgcgggcugggugugcgcggca

SEQ ID NO: 1556788 - RNA, 16 nt, Human adenovirus C
aagagacgcucggugc

SEQ ID NO: 1556789 - RNA, 18 nt, Human adenovirus C
cacgguguaagcuucuau

SEQ ID NO: 1556790 - RNA, 15 nt, Human adenovirus C
cuaccggagugcugg

SEQ ID NO: 1556791 - RNA, 13 nt, Human adenovirus C
cugcagcacagca

SEQ ID NO: 1556792 - RNA, 17 nt, Human adenovirus C
ggcggcuauuaccacca

SEQ ID NO: 1556793 - RNA, 13 nt, Human adenovirus C
gacaacgcgcaug

SEQ ID NO: 1556794 - RNA, 23 nt, Human adenovirus C
caaguuguggcccccacaaaagu

SEQ ID NO: 1556795 - RNA, 13 nt, Human adenovirus C
gagcaggacccag

SEQ ID NO: 1556796 - RNA, 18 nt, Human adenovirus C
ugcgcgagauugagcucc

SEQ ID NO: 1556797 - RNA, 13 nt, Human adenovirus C
ggggcagugcaga

SEQ ID NO: 1556798 - RNA, 16 nt, Human adenovirus C
uuuaaugacuaccuuu

SEQ ID NO: 1556799 - RNA, 23 nt, Human adenovirus C
cacguggcggccgccgaccuggu

SEQ ID NO: 1556800 - RNA, 15 nt, Human adenovirus C
acccaagggugcagc

SEQ ID NO: 1556801 - RNA, 16 nt, Human adenovirus C
uaggauuuuucccacu

SEQ ID NO: 1556802 - RNA, 23 nt, Human adenovirus C
ucaggaauucugcccgccaccug

SEQ ID NO: 1556803 - RNA, 14 nt, Human adenovirus C
cuuacucccaauga

SEQ ID NO: 1556804 - RNA, 18 nt, Human adenovirus C
cgcagcgaugugccccuc

SEQ ID NO: 1556805 - RNA, 19 nt, Human adenovirus C
ugcagcagccgccgccaug

SEQ ID NO: 1556806 - RNA, 20 nt, Human adenovirus C
aggggugcgcuccgggcugc

SEQ ID NO: 1556807 - RNA, 13 nt, Human adenovirus C
acgcggcggcaga

SEQ ID NO: 1556808 - RNA, 21 nt, Human adenovirus C
cggggaguaggcauccgcgcc

SEQ ID NO: 1556809 - RNA, 13 nt, Human adenovirus C
cagccgcugcagc

SEQ ID NO: 1556810 - RNA, 15 nt, Human adenovirus C
aacccacacaaugaa

SEQ ID NO: 1556811 - RNA, 18 nt, Human adenovirus C
uguggcgcgcgaggaggu

SEQ ID NO: 1556812 - RNA, 13 nt, Human adenovirus C
gcagcacagcacc

SEQ ID NO: 1556813 - RNA, 20 nt, Human adenovirus C
acauuacucccauuuuucca

SEQ ID NO: 1556814 - RNA, 12 nt, Human adenovirus C
cuacaggggccu

SEQ ID NO: 1556815 - RNA, 20 nt, Human adenovirus C
ggcgcucguugguccagcag

SEQ ID NO: 1556816 - RNA, 19 nt, Human adenovirus C
guauccggugcacuuggga

SEQ ID NO: 1556817 - RNA, 21 nt, Human adenovirus C
ggcggucggccaugccccagg

SEQ ID NO: 1556818 - RNA, 14 nt, Human adenovirus C
ugcacgucuccuga

SEQ ID NO: 1556819 - RNA, 23 nt, Human adenovirus C
guaggggagaucagcugggaaga

SEQ ID NO: 1556820 - RNA, 16 nt, Human adenovirus C
agccaacuaccuugcc

SEQ ID NO: 1556821 - RNA, 21 nt, Human adenovirus C
cgagggacaggcuuaccccgc

SEQ ID NO: 1556822 - RNA, 17 nt, Human adenovirus C
uccaagcgcaaaaucaa

SEQ ID NO: 1556823 - RNA, 12 nt, Human adenovirus C
caguaacugcag

SEQ ID NO: 1556824 - RNA, 13 nt, Human adenovirus C
gcggccaugcggg

SEQ ID NO: 1556825 - RNA, 13 nt, Human adenovirus C
uagauggccuggc

SEQ ID NO: 1556826 - RNA, 14 nt, Human adenovirus C
cagccuggaggcaa

SEQ ID NO: 1556827 - RNA, 16 nt, Human adenovirus C
cagauccuuccuauca

SEQ ID NO: 1556828 - RNA, 15 nt, Human adenovirus C
gcccgaggguaacga

SEQ ID NO: 1556829 - RNA, 14 nt, Human adenovirus C
ccugugcugccagg

SEQ ID NO: 1556830 - RNA, 19 nt, Human adenovirus C
ucuuauauuauugacccuu

SEQ ID NO: 1556831 - RNA, 15 nt, Human adenovirus C
ccugugaugcuggau

SEQ ID NO: 1556832 - RNA, 17 nt, Human adenovirus C
ggcugacgcggcggcag

SEQ ID NO: 1556833 - RNA, 16 nt, Human adenovirus C
acgaaagccaaaaaac

SEQ ID NO: 1556834 - RNA, 20 nt, Human adenovirus C
cucaacucccggaacucagg

SEQ ID NO: 1556835 - RNA, 17 nt, Human adenovirus C
ggcagaggcggcgcugc

SEQ ID NO: 1556836 - RNA, 22 nt, Human adenovirus C
uggcaccuuuuguuccaccgcu

SEQ ID NO: 1556837 - RNA, 19 nt, Human adenovirus C
cuauccaaaaacccaaagu

SEQ ID NO: 1556838 - RNA, 22 nt, Human adenovirus C
cgaggacgaugaguacgagcca

SEQ ID NO: 1556839 - RNA, 20 nt, Human adenovirus C
guggcccuuggcgcgcagcu

SEQ ID NO: 1556840 - RNA, 12 nt, Human adenovirus C
cgcgcccauggc

SEQ ID NO: 1556841 - RNA, 23 nt, Human adenovirus C
ucuacagcuuccuggagcgccac

SEQ ID NO: 1556842 - RNA, 14 nt, Human adenovirus C
ggccggcaacgcca

SEQ ID NO: 1556843 - RNA, 21 nt, Human adenovirus C
ugcaggaauacaacauggcag

SEQ ID NO: 1556844 - RNA, 19 nt, Human adenovirus C
gcaauaugagcgguggcgc

SEQ ID NO: 1556845 - RNA, 19 nt, Human adenovirus C
ccaucgcgcaacugggcag

SEQ ID NO: 1556846 - RNA, 17 nt, Human adenovirus C
augaauggaacuucagg

SEQ ID NO: 1556847 - RNA, 16 nt, Human adenovirus C
gcaacgaccgccugcu

SEQ ID NO: 1556848 - RNA, 19 nt, Human adenovirus C
cgaccgggguucgaacccc

SEQ ID NO: 1556849 - RNA, 14 nt, Human adenovirus C
ggcggaggugcugc

SEQ ID NO: 1556850 - RNA, 17 nt, Human adenovirus C
gacacuguaccgcgagg

SEQ ID NO: 1556851 - RNA, 20 nt, Human adenovirus C
uccucugauaguuacuagcg

SEQ ID NO: 1556852 - RNA, 22 nt, Human adenovirus C
aaggaggacagccuaaccgccc

SEQ ID NO: 1556853 - RNA, 11 nt, Human adenovirus C
accacuguggu

SEQ ID NO: 1556854 - RNA, 14 nt, Human adenovirus C
ugcgacgucagaca

SEQ ID NO: 1556855 - RNA, 15 nt, Human adenovirus C
uaccugagccccggg

SEQ ID NO: 1556856 - RNA, 23 nt, Human adenovirus C
ccauaaugauggcaaugggccca

SEQ ID NO: 1556857 - RNA, 15 nt, Human adenovirus C
uggagagcgguggug

SEQ ID NO: 1556858 - RNA, 18 nt, Human adenovirus C
acaucauuuugcugccag

SEQ ID NO: 1556859 - RNA, 22 nt, Human adenovirus C
cccaaccguagaugggacacca

SEQ ID NO: 1556860 - RNA, 14 nt, Human adenovirus C
guauauuccuuaga

SEQ ID NO: 1556861 - RNA, 20 nt, Human adenovirus C
cugcaaagggcccuggcugg

SEQ ID NO: 1556862 - RNA, 15 nt, Human adenovirus C
ccaccacgccgcgcg

SEQ ID NO: 1556863 - RNA, 22 nt, Human adenovirus C
agaacuccucacuuaaaaaaca

SEQ ID NO: 1556864 - RNA, 16 nt, Human adenovirus C
cgccgccacccacgga

SEQ ID NO: 1556865 - RNA, 18 nt, Human adenovirus C
ccugcaggaaucgcccca

SEQ ID NO: 1556866 - RNA, 20 nt, Human adenovirus C
gcagacaugcagggcacccu

SEQ ID NO: 1556867 - RNA, 21 nt, Human adenovirus C
cagauggugauuacgaacccc

SEQ ID NO: 1556868 - RNA, 16 nt, Human adenovirus C
uggacuuggaggaggg

SEQ ID NO: 1556869 - RNA, 12 nt, Human adenovirus C
uccauacacaaa

SEQ ID NO: 1556870 - RNA, 12 nt, Human adenovirus C
ugcuaccucuuu

SEQ ID NO: 1556871 - RNA, 18 nt, Human adenovirus C
agauugcaagaaaaaacu

SEQ ID NO: 1556872 - RNA, 22 nt, Human adenovirus C
cgggcggcagcggguggcgguc

SEQ ID NO: 1556873 - RNA, 18 nt, Human adenovirus C
agagcaacaacagcgcca

SEQ ID NO: 1556874 - RNA, 12 nt, Human adenovirus C
aaugacugggcg

SEQ ID NO: 1556875 - RNA, 16 nt, Human adenovirus C
gcggcgcugcagagcc

SEQ ID NO: 1556876 - RNA, 11 nt, Human adenovirus C
caccaugcgcg

SEQ ID NO: 1556877 - RNA, 10 nt, Human adenovirus C
gcagccacag

SEQ ID NO: 1556878 - RNA, 11 nt, Human adenovirus C
ccaagcaguuc

SEQ ID NO: 1556879 - RNA, 19 nt, Human adenovirus C
ccauuaaguaccgugaaug

SEQ ID NO: 1556880 - RNA, 14 nt, Human adenovirus C
caguguccacagug

SEQ ID NO: 1556881 - RNA, 17 nt, Human adenovirus C
gaccguaaaccugagcc

SEQ ID NO: 1556882 - RNA, 13 nt, Human adenovirus C
agucgcaggaccc

SEQ ID NO: 1556883 - RNA, 14 nt, Human adenovirus C
gggguuugacccag

SEQ ID NO: 1556884 - RNA, 23 nt, Human adenovirus C
gcuggggcaggaggacacgggca

SEQ ID NO: 1556885 - RNA, 17 nt, Human adenovirus C
aggcuguccgugucccc

SEQ ID NO: 1556886 - RNA, 15 nt, Human adenovirus C
gcccuaccugugcuu

SEQ ID NO: 1556887 - RNA, 11 nt, Human adenovirus C
ucaaaaaccag

SEQ ID NO: 1556888 - RNA, 21 nt, Human adenovirus C
accugcucggacggcaacugu

SEQ ID NO: 1556889 - RNA, 21 nt, Human adenovirus C
ccgccgucgccgucgccagcc

SEQ ID NO: 1556890 - RNA, 20 nt, Human adenovirus C
uuggcgcgcccgccagcccc

SEQ ID NO: 1556891 - RNA, 21 nt, Human adenovirus C
uggcuccauaccauaccuuga

SEQ ID NO: 1556892 - RNA, 22 nt, Human adenovirus C
aaaugaccguggagccugggcu

SEQ ID NO: 1556893 - RNA, 18 nt, Human adenovirus C
gggauuccgaggaagaau

SEQ ID NO: 1556894 - RNA, 15 nt, Human adenovirus C
caaagucaaacugcu

SEQ ID NO: 1556895 - RNA, 12 nt, Human adenovirus C
agggaguggcaa

SEQ ID NO: 1556896 - RNA, 11 nt, Human adenovirus C
ggccagaugcu

SEQ ID NO: 1556897 - RNA, 12 nt, Human adenovirus C
gagccggcggcg

SEQ ID NO: 1556898 - RNA, 17 nt, Human adenovirus C
agagcaacaacagcgcc

SEQ ID NO: 1556899 - RNA, 20 nt, Human adenovirus C
ccaaagcgugcaggggccca

SEQ ID NO: 1556900 - RNA, 23 nt, Human adenovirus C
gccuaaagcgcgagucuggugac

SEQ ID NO: 1556901 - RNA, 16 nt, Human adenovirus C
cgucgccagcccgugc

SEQ ID NO: 1556902 - RNA, 15 nt, Human adenovirus C
uacgaaaaaaccacu

SEQ ID NO: 1556903 - RNA, 14 nt, Human adenovirus C
cuugcccuuggagg

SEQ ID NO: 1556904 - RNA, 13 nt, Human adenovirus C
ccacccuccucac

SEQ ID NO: 1556905 - RNA, 22 nt, Human adenovirus C
gagcccgacgcgcggaccggga

SEQ ID NO: 1556906 - RNA, 22 nt, Human adenovirus C
caguacaaguuguggcccccac

SEQ ID NO: 1556907 - RNA, 16 nt, Human adenovirus C
ggccaaccaggcagug

SEQ ID NO: 1556908 - RNA, 18 nt, Human adenovirus C
acggccgcuacgugcccu

SEQ ID NO: 1556909 - RNA, 22 nt, Human adenovirus C
cguuucgcggguuggggcggcu

SEQ ID NO: 1556910 - RNA, 20 nt, Human adenovirus C
cuccagaggggcguggcgaa

SEQ ID NO: 1556911 - RNA, 19 nt, Human adenovirus C
gacccgccguuugugccuc

SEQ ID NO: 1556912 - RNA, 15 nt, Human adenovirus C
cggugguaugcgccc

SEQ ID NO: 1556913 - RNA, 17 nt, Human adenovirus C
ccacgcucggugacgaa

SEQ ID NO: 1556914 - RNA, 15 nt, Human adenovirus C
gcgaucguggagcac

SEQ ID NO: 1556915 - RNA, 17 nt, Human adenovirus C
cgugggucugggggugc

SEQ ID NO: 1556916 - RNA, 11 nt, Human adenovirus C
gaaaccccaga

SEQ ID NO: 1556917 - RNA, 18 nt, Human adenovirus C
ugauggaagacugggaca

SEQ ID NO: 1556918 - RNA, 12 nt, Human adenovirus C
cuuccgcagcca

SEQ ID NO: 1556919 - RNA, 22 nt, Human adenovirus C
uuaaccuacaccaguguaaaag

SEQ ID NO: 1556920 - RNA, 14 nt, Human adenovirus C
agucauccaugucc

SEQ ID NO: 1556921 - RNA, 21 nt, Human adenovirus C
cagucaaguuuacuugcaugg

SEQ ID NO: 1556922 - RNA, 14 nt, Human adenovirus C
augugccccucgcc

SEQ ID NO: 1556923 - RNA, 12 nt, Human adenovirus C
aguaguccaggg

SEQ ID NO: 1556924 - RNA, 14 nt, Human adenovirus C
uagguguaggccac

SEQ ID NO: 1556925 - RNA, 16 nt, Human adenovirus C
uccuggauuugggagg

SEQ ID NO: 1556926 - RNA, 17 nt, Human adenovirus C
gccccgggcuggugcag

SEQ ID NO: 1556927 - RNA, 15 nt, Human adenovirus C
gaaccugaacggggu

SEQ ID NO: 1556928 - RNA, 12 nt, Human adenovirus C
uccuggugcaga

SEQ ID NO: 1556929 - RNA, 16 nt, Human adenovirus C
ugaccugcgcugggcc

SEQ ID NO: 1556930 - RNA, 15 nt, Human adenovirus C
gcagaagcugccgcc

SEQ ID NO: 1556931 - RNA, 23 nt, Human adenovirus C
ucaucggcugaagcagggccagg

SEQ ID NO: 1556932 - RNA, 16 nt, Human adenovirus C
gaccuggccaaccagg

SEQ ID NO: 1556933 - RNA, 13 nt, Human adenovirus C
augagcuccacag

SEQ ID NO: 1556934 - RNA, 14 nt, Human adenovirus C
cgcgcuggccaggg

SEQ ID NO: 1556935 - RNA, 11 nt, Human adenovirus C
ugcaaaggugg

SEQ ID NO: 1556936 - RNA, 17 nt, Human adenovirus C
uauaccuuuuuaaugca

SEQ ID NO: 1556937 - RNA, 14 nt, Human adenovirus C
aaugccuguuugaa

SEQ ID NO: 1556938 - RNA, 15 nt, Human adenovirus C
aagggcgaggcgcgc

SEQ ID NO: 1556939 - RNA, 22 nt, Human adenovirus C
cgggcccuugcuucccaggaug

SEQ ID NO: 1556940 - RNA, 20 nt, Human adenovirus C
ugaccagacaccguccugag

SEQ ID NO: 1556941 - RNA, 15 nt, Human adenovirus C
ccagcucggcgguga

SEQ ID NO: 1556942 - RNA, 23 nt, Human adenovirus C
agagcauguccaaggugaaccug

SEQ ID NO: 1556943 - RNA, 12 nt, Human adenovirus C
gcugccagggcc

SEQ ID NO: 1556944 - RNA, 19 nt, Human adenovirus C
guguuccgcgguccuccuc

SEQ ID NO: 1556945 - RNA, 15 nt, Human adenovirus C
gauuccucugggacg

SEQ ID NO: 1556946 - RNA, 18 nt, Human adenovirus C
ugcaaacaucagcccccc

SEQ ID NO: 1556947 - RNA, 14 nt, Human adenovirus C
gcgucuggcgccca

SEQ ID NO: 1556948 - RNA, 21 nt, Human adenovirus C
gggucuuuuaccagcacucgc

SEQ ID NO: 1556949 - RNA, 20 nt, Human adenovirus C
gugguccgugugcaccagcc

SEQ ID NO: 1556950 - RNA, 16 nt, Human adenovirus C
caaggccugcccacca

SEQ ID NO: 1556951 - RNA, 15 nt, Human adenovirus C
ucuccuucgcccgcc

SEQ ID NO: 1556952 - RNA, 23 nt, Human adenovirus C
caccgucaagaaaaacaccacca

SEQ ID NO: 1556953 - RNA, 20 nt, Human adenovirus C
ccuggcaaacggccaugggc

SEQ ID NO: 1556954 - RNA, 16 nt, Human adenovirus C
uaacaguccccaggua

SEQ ID NO: 1556955 - RNA, 14 nt, Human adenovirus C
uacaacaaacagag

SEQ ID NO: 1556956 - RNA, 17 nt, Human adenovirus C
gauggcaaugggcccac

SEQ ID NO: 1556957 - RNA, 23 nt, Human adenovirus C
ccugggcauagucucgccgcgcg

SEQ ID NO: 1556958 - RNA, 13 nt, Human adenovirus C
gacuuggaggagg

SEQ ID NO: 1556959 - RNA, 16 nt, Human adenovirus C
cgagcugaugcacagc

SEQ ID NO: 1556960 - RNA, 17 nt, Human adenovirus C
ccccggcgcccgcgccg

SEQ ID NO: 1556961 - RNA, 21 nt, Human adenovirus C
ugcaguagaagguaagcgggu

SEQ ID NO: 1556962 - RNA, 20 nt, Human adenovirus C
agcggucacacagaagcaaa

SEQ ID NO: 1556963 - RNA, 16 nt, Human adenovirus C
gacaacgcgcaugccc

SEQ ID NO: 1556964 - RNA, 16 nt, Human adenovirus C
cugaggcuacagagga

SEQ ID NO: 1556965 - RNA, 23 nt, Human adenovirus C
uuuccaacguggagcucugcaac

SEQ ID NO: 1556966 - RNA, 22 nt, Human adenovirus C
gugugggcguggcuuaagggug

SEQ ID NO: 1556967 - RNA, 16 nt, Human adenovirus C
ugcagaaacacaagcu

SEQ ID NO: 1556968 - RNA, 16 nt, Human adenovirus C
cuuccuuccaggcgcg

SEQ ID NO: 1556969 - RNA, 20 nt, Human adenovirus C
gcgcucccucacccgcagcu

SEQ ID NO: 1556970 - RNA, 22 nt, Human adenovirus C
cgccaccaccgccuccaccgau

SEQ ID NO: 1556971 - RNA, 14 nt, Human adenovirus C
cagauucacucaaa

SEQ ID NO: 1556972 - RNA, 16 nt, Human adenovirus C
gcggggcuuaaagggu

SEQ ID NO: 1556973 - RNA, 22 nt, Human adenovirus C
auacggaggauaggguggccuu

SEQ ID NO: 1556974 - RNA, 19 nt, Human adenovirus C
cuuggccaauugcaagcca

SEQ ID NO: 1556975 - RNA, 17 nt, Human adenovirus C
ggugcaugcccaggcuu

SEQ ID NO: 1556976 - RNA, 14 nt, Human adenovirus C
gcgaucguggagca

SEQ ID NO: 1556977 - RNA, 22 nt, Human adenovirus C
ccaccuucuuccccauggccca

SEQ ID NO: 1556978 - RNA, 23 nt, Human adenovirus C
cuccgaacgguaagagccuagca

SEQ ID NO: 1556979 - RNA, 13 nt, Human adenovirus C
gcccucuuccucc

SEQ ID NO: 1556980 - RNA, 17 nt, Human adenovirus C
caagaacuugcaggggc

SEQ ID NO: 1556981 - RNA, 20 nt, Human adenovirus C
aggguggcucgcgaaggagg

SEQ ID NO: 1556982 - RNA, 21 nt, Human adenovirus C
agcuggggccggaccugggcu

SEQ ID NO: 1556983 - RNA, 19 nt, Human adenovirus C
ccugggcauagucucgccg

SEQ ID NO: 1556984 - RNA, 23 nt, Human adenovirus C
cgcaguuggcgaugagcagcugg

SEQ ID NO: 1556985 - RNA, 14 nt, Human adenovirus C
caagcagugcagcu

SEQ ID NO: 1556986 - RNA, 17 nt, Human adenovirus C
gagccaggugagcucug

SEQ ID NO: 1556987 - RNA, 13 nt, Human adenovirus C
agacgggccaggg

SEQ ID NO: 1556988 - RNA, 16 nt, Human adenovirus C
caaacaacauggaaau

SEQ ID NO: 1556989 - RNA, 23 nt, Human adenovirus C
ucaacggaauccgcgcccaccga

SEQ ID NO: 1556990 - RNA, 21 nt, Human adenovirus C
ugacucuucuguuagcuggcc

SEQ ID NO: 1556991 - RNA, 20 nt, Human adenovirus C
cgugcccaucuccaucccau

SEQ ID NO: 1556992 - RNA, 14 nt, Human adenovirus C
cugcgacgggccga

SEQ ID NO: 1556993 - RNA, 15 nt, Human adenovirus C
ggcacgagcugcuuc

SEQ ID NO: 1556994 - RNA, 19 nt, Human adenovirus C
ccgcacugggcgcaccacc

SEQ ID NO: 1556995 - RNA, 22 nt, Human adenovirus C
caguaacuuuauguccaugggc

SEQ ID NO: 1556996 - RNA, 21 nt, Human adenovirus C
gccugcgucauuacccagggc

SEQ ID NO: 1556997 - RNA, 18 nt, Human adenovirus C
ugcguaacuugcuggaac

SEQ ID NO: 1556998 - RNA, 17 nt, Human adenovirus C
cgccagacgccgcaccu

SEQ ID NO: 1556999 - RNA, 19 nt, Human adenovirus C
ugcuguugaagcaucugca

SEQ ID NO: 1557000 - RNA, 19 nt, Human adenovirus C
auucaguaguauagcccca

SEQ ID NO: 1557001 - RNA, 14 nt, Human adenovirus C
agcaagagcagcgg

SEQ ID NO: 1557002 - RNA, 11 nt, Human adenovirus C
ucaccaggcgc

SEQ ID NO: 1557003 - RNA, 14 nt, Human adenovirus C
ucuuguucccagcg

SEQ ID NO: 1557004 - RNA, 21 nt, Human adenovirus C
gaggaagguccuccucccucc

SEQ ID NO: 1557005 - RNA, 17 nt, Human adenovirus C
cauucaacuaacauaaa

SEQ ID NO: 1557006 - RNA, 21 nt, Human adenovirus C
aggaggauuacaagugggaau

SEQ ID NO: 1557007 - RNA, 21 nt, Human adenovirus C
aggcugagcaccguggcgggc

SEQ ID NO: 1557008 - RNA, 18 nt, Human adenovirus C
gccuuuuacugcugcugg

SEQ ID NO: 1557009 - RNA, 22 nt, Human adenovirus C
ugaagacaaaggaaaccccuuc

SEQ ID NO: 1557010 - RNA, 17 nt, Human adenovirus C
gcuuccuuccaggcgcg

SEQ ID NO: 1557011 - RNA, 13 nt, Human adenovirus C
aaagcuagcccug

SEQ ID NO: 1557012 - RNA, 22 nt, Human adenovirus C
ggucacccacuuugccuacccg

SEQ ID NO: 1557013 - RNA, 20 nt, Human adenovirus C
cccaacucggccgccugugg

SEQ ID NO: 1557014 - RNA, 19 nt, Human adenovirus C
cugggacagucaggcagag

SEQ ID NO: 1557015 - RNA, 23 nt, Human adenovirus C
uacuaaggacaaacagguggagc

SEQ ID NO: 1557016 - RNA, 15 nt, Human adenovirus C
ugcgcgcuggccagg

SEQ ID NO: 1557017 - RNA, 22 nt, Human adenovirus C
cauuuuuucuggggugaugcag

SEQ ID NO: 1557018 - RNA, 16 nt, Human adenovirus C
gacaaggagguaaaga

SEQ ID NO: 1557019 - RNA, 21 nt, Human adenovirus C
agcgcagcuugagccuggcug

SEQ ID NO: 1557020 - RNA, 20 nt, Human adenovirus C
ggccguucucgcgggggcgc

SEQ ID NO: 1557021 - RNA, 18 nt, Human adenovirus C
cccgcuuuccaagauggc

SEQ ID NO: 1557022 - RNA, 15 nt, Human adenovirus C
uccuccagaagacgg

SEQ ID NO: 1557023 - RNA, 15 nt, Human adenovirus C
ccuccucagcagcgg

SEQ ID NO: 1557024 - RNA, 13 nt, Human adenovirus C
auucagccgccgc

SEQ ID NO: 1557025 - RNA, 12 nt, Human adenovirus C
cuacccccggcu

SEQ ID NO: 1557026 - RNA, 14 nt, Human adenovirus C
caggugagcucugg

SEQ ID NO: 1557027 - RNA, 20 nt, Human adenovirus C
ugaaggggugcgcuccgggc

SEQ ID NO: 1557028 - RNA, 21 nt, Human adenovirus C
cgacgagcggccgccgcagca

SEQ ID NO: 1557029 - RNA, 13 nt, Human adenovirus C
aagcugcagcugc

SEQ ID NO: 1557030 - RNA, 20 nt, Human adenovirus C
gagcauaguggugcaggagc

SEQ ID NO: 1557031 - RNA, 22 nt, Human adenovirus C
uaauagcgcccuucacggacag

SEQ ID NO: 1557032 - RNA, 15 nt, Human adenovirus C
acgcccacgccgcca

SEQ ID NO: 1557033 - RNA, 16 nt, Human adenovirus C
cauauuuccugcagau

SEQ ID NO: 1557034 - RNA, 16 nt, Human adenovirus C
uacagaggaggcuagg

SEQ ID NO: 1557035 - RNA, 14 nt, Human adenovirus C
aggaaaccccuucc

SEQ ID NO: 1557036 - RNA, 16 nt, Human adenovirus C
acuggaaccagggccg

SEQ ID NO: 1557037 - RNA, 12 nt, Human adenovirus C
acgagccagagg

SEQ ID NO: 1557038 - RNA, 18 nt, Human adenovirus C
accgucaucucuacagcc

SEQ ID NO: 1557039 - RNA, 22 nt, Human adenovirus C
guucuaauggagaacuccucac

SEQ ID NO: 1557040 - RNA, 18 nt, Human adenovirus C
ucccguagaggagccucc

SEQ ID NO: 1557041 - RNA, 19 nt, Human adenovirus C
gccacaacgcgcagcccgu

SEQ ID NO: 1557042 - RNA, 13 nt, Human adenovirus C
aguggagcgggag

SEQ ID NO: 1557043 - RNA, 22 nt, Human adenovirus C
guggaccuggccaaccaggcag

SEQ ID NO: 1557044 - RNA, 21 nt, Human adenovirus C
gcuggaugugaccgaggagcu

SEQ ID NO: 1557045 - RNA, 13 nt, Human adenovirus C
cuggaggcagcug

SEQ ID NO: 1557046 - RNA, 23 nt, Human adenovirus C
acuuggcacccaccgugcagcug

SEQ ID NO: 1557047 - RNA, 12 nt, Human adenovirus C
cgcggcagaacc

SEQ ID NO: 1557048 - RNA, 13 nt, Human adenovirus C
gugaugccuuuga

SEQ ID NO: 1557049 - RNA, 14 nt, Human adenovirus C
uggagugcuggugg

SEQ ID NO: 1557050 - RNA, 20 nt, Human adenovirus C
cgugacacugcagcaggugc

SEQ ID NO: 1557051 - RNA, 14 nt, Human adenovirus C
acccuggugcugcc

SEQ ID NO: 1557052 - RNA, 20 nt, Human adenovirus C
cacguggccaucauaccaca

SEQ ID NO: 1557053 - RNA, 18 nt, Human adenovirus C
caacggacccggcggugc

SEQ ID NO: 1557054 - RNA, 18 nt, Human adenovirus C
cuccaugcccuucuccca

SEQ ID NO: 1557055 - RNA, 13 nt, Human adenovirus C
cugacaccuauca

SEQ ID NO: 1557056 - RNA, 19 nt, Human adenovirus C
agggcggggauggcgcagg

SEQ ID NO: 1557057 - RNA, 19 nt, Human adenovirus C
cugagccccgggcuggugc

SEQ ID NO: 1557058 - RNA, 18 nt, Human adenovirus C
cuccccggcuggccuuaa

SEQ ID NO: 1557059 - RNA, 21 nt, Human adenovirus C
cagcggcaagagcaagagcag

SEQ ID NO: 1557060 - RNA, 13 nt, Human adenovirus C
cccuucccuggga

SEQ ID NO: 1557061 - RNA, 20 nt, Human adenovirus C
auauaggacuaaaaaaugac

SEQ ID NO: 1557062 - RNA, 15 nt, Human adenovirus C
acaacacggccucca

SEQ ID NO: 1557063 - RNA, 14 nt, Human adenovirus C
uaggcuaccucgcu

SEQ ID NO: 1557064 - RNA, 16 nt, Human adenovirus C
ggcgguggcagaugcc

SEQ ID NO: 1557065 - RNA, 17 nt, Human adenovirus C
cuccugacguaaccugc

SEQ ID NO: 1557066 - RNA, 14 nt, Human adenovirus C
uggaggcagcuggg

SEQ ID NO: 1557067 - RNA, 19 nt, Human adenovirus C
ggccauuuuuucuggggug

SEQ ID NO: 1557068 - RNA, 14 nt, Human adenovirus C
auccuacacggugu

SEQ ID NO: 1557069 - RNA, 18 nt, Human adenovirus C
cgcgcgcagcagcagggc

SEQ ID NO: 1557070 - RNA, 12 nt, Human adenovirus C
aaggccuggcca

SEQ ID NO: 1557071 - RNA, 13 nt, Human adenovirus C
gagcacagggaug

SEQ ID NO: 1557072 - RNA, 16 nt, Human adenovirus C
uucgcgguugggccuu

SEQ ID NO: 1557073 - RNA, 20 nt, Human adenovirus C
agauauuuuucuauguggaa

SEQ ID NO: 1557074 - RNA, 15 nt, Human adenovirus C
cuccgcgguaccugc

SEQ ID NO: 1557075 - RNA, 17 nt, Human adenovirus C
ccacagcggcggcagca

SEQ ID NO: 1557076 - RNA, 14 nt, Human adenovirus C
uacuagcuacugua

SEQ ID NO: 1557077 - RNA, 23 nt, Human adenovirus C
gcgcgcuggccagggugcgcuug

SEQ ID NO: 1557078 - RNA, 20 nt, Human adenovirus C
aaccccuuuucuggaccucc

SEQ ID NO: 1557079 - RNA, 13 nt, Human adenovirus C
cgcggcaccagcg

SEQ ID NO: 1557080 - RNA, 17 nt, Human adenovirus C
guggaggaggcgcgcaa

SEQ ID NO: 1557081 - RNA, 21 nt, Human adenovirus C
gccugcugggcgaggaggagu

SEQ ID NO: 1557082 - RNA, 20 nt, Human adenovirus C
agccgcugcagccaccgccc

SEQ ID NO: 1557083 - RNA, 21 nt, Human adenovirus C
cacaggccagaugcugaggga

SEQ ID NO: 1557084 - RNA, 19 nt, Human adenovirus C
cacaagcucgccugcgcca

SEQ ID NO: 1557085 - RNA, 16 nt, Human adenovirus C
ccacuguuacucagcc

SEQ ID NO: 1557086 - RNA, 21 nt, Human adenovirus C
cagaugcgccccccuccucag

SEQ ID NO: 1557087 - RNA, 15 nt, Human adenovirus C
gggugguggcggugu

SEQ ID NO: 1557088 - RNA, 19 nt, Human adenovirus C
uccaauauugcgcuguacc

SEQ ID NO: 1557089 - RNA, 13 nt, Human adenovirus C
agucacuggucuu

SEQ ID NO: 1557090 - RNA, 14 nt, Human adenovirus C
cgccggcacugccu

SEQ ID NO: 1557091 - RNA, 12 nt, Human adenovirus C
gaagguggccau

SEQ ID NO: 1557092 - RNA, 22 nt, Human adenovirus C
caucccugagcaggggggccac

SEQ ID NO: 1557093 - RNA, 14 nt, Human adenovirus C
ggcgggagcuccug

SEQ ID NO: 1557094 - RNA, 11 nt, Human adenovirus C
aggucagcugc

SEQ ID NO: 1557095 - RNA, 14 nt, Human adenovirus C
uucaaaaucccaca

SEQ ID NO: 1557096 - RNA, 23 nt, Human adenovirus C
uucgguuccaccauuaagaacua

SEQ ID NO: 1557097 - RNA, 14 nt, Human adenovirus C
gcugaugcacagcc

SEQ ID NO: 1557098 - RNA, 14 nt, Human adenovirus C
aagcgcgcugaggc

SEQ ID NO: 1557099 - RNA, 14 nt, Human adenovirus C
aggcccgggaccag

SEQ ID NO: 1557100 - RNA, 17 nt, Human adenovirus C
cuaacauaaacacacaa

SEQ ID NO: 1557101 - RNA, 16 nt, Human adenovirus C
gaugaagaugaagaag

SEQ ID NO: 1557102 - RNA, 19 nt, Human adenovirus C
gacggccugguaggcgcag

SEQ ID NO: 1557103 - RNA, 18 nt, Human adenovirus C
agguugcuacgggcgggc

SEQ ID NO: 1557104 - RNA, 20 nt, Human adenovirus C
gacauuucagaucggcggcg

SEQ ID NO: 1557105 - RNA, 16 nt, Human adenovirus C
acggacgacuggcgcc

SEQ ID NO: 1557106 - RNA, 21 nt, Human adenovirus C
caggagcacagggaugugccc

SEQ ID NO: 1557107 - RNA, 20 nt, Human adenovirus C
accaggacgacgcagaggca

SEQ ID NO: 1557108 - RNA, 20 nt, Human adenovirus C
gagggcguuggacagcaacu

SEQ ID NO: 1557109 - RNA, 19 nt, Human adenovirus C
gcgcagacgcgccagaccc

SEQ ID NO: 1557110 - RNA, 21 nt, Human adenovirus C
ucuagggcgcaguaguccagg

SEQ ID NO: 1557111 - RNA, 16 nt, Human adenovirus C
uuggguauccugucug

SEQ ID NO: 1557112 - RNA, 15 nt, Human adenovirus C
ccgccaaaugcggag

SEQ ID NO: 1557113 - RNA, 22 nt, Human adenovirus C
agacgaaggcucgcguccaggc

SEQ ID NO: 1557114 - RNA, 17 nt, Human adenovirus C
ggcggugguggaggcgc

SEQ ID NO: 1557115 - RNA, 21 nt, Human adenovirus C
gcccuaacaguggcaaccacc

SEQ ID NO: 1557116 - RNA, 12 nt, Human adenovirus C
acgcccuucucg

SEQ ID NO: 1557117 - RNA, 21 nt, Human adenovirus C
gucacuguagucaucgccuuc

SEQ ID NO: 1557118 - RNA, 19 nt, Human adenovirus C
gcacccugaucucacuuaa

SEQ ID NO: 1557119 - RNA, 21 nt, Human adenovirus C
agccgagcggacaagcagcug

SEQ ID NO: 1557120 - RNA, 22 nt, Human adenovirus C
ugaaccgcgagcgguugcugcg

SEQ ID NO: 1557121 - RNA, 23 nt, Human adenovirus C
ccacggcuaggucucgcgcggcg

SEQ ID NO: 1557122 - RNA, 20 nt, Human adenovirus C
gcuaccggagugcugggcca

SEQ ID NO: 1557123 - RNA, 16 nt, Human adenovirus C
caguauuacccagaaa

SEQ ID NO: 1557124 - RNA, 21 nt, Human adenovirus C
gcugcgguucaucccugugga

SEQ ID NO: 1557125 - RNA, 17 nt, Human adenovirus C
cuggugcaguuugcccg

SEQ ID NO: 1557126 - RNA, 23 nt, Human adenovirus C
caugagcgcgggaccccacauga

SEQ ID NO: 1557127 - RNA, 19 nt, Human adenovirus C
aagcaggggccaagaacaa

SEQ ID NO: 1557128 - RNA, 12 nt, Human adenovirus C
aacaacagcgcc

SEQ ID NO: 1557129 - RNA, 21 nt, Human adenovirus C
gcgcaccaccggcggcggcgc

SEQ ID NO: 1557130 - RNA, 13 nt, Human adenovirus C
gccgcauccccgc

SEQ ID NO: 1557131 - RNA, 23 nt, Human adenovirus C
uggauguggacgccuaccaggca

SEQ ID NO: 1557132 - RNA, 13 nt, Human adenovirus C
acauguggaguua

SEQ ID NO: 1557133 - RNA, 14 nt, Human adenovirus C
agaaagaugaugau

SEQ ID NO: 1557134 - RNA, 15 nt, Human adenovirus C
cauagaugccaugaa

SEQ ID NO: 1557135 - RNA, 19 nt, Human adenovirus C
gaacagcagcacaggccag

SEQ ID NO: 1557136 - RNA, 20 nt, Human adenovirus C
acgcuggaagacgcggaggc

SEQ ID NO: 1557137 - RNA, 18 nt, Human adenovirus C
guacggcaccgccagcgc

SEQ ID NO: 1557138 - RNA, 19 nt, Human adenovirus C
uggccgaaaacagggccau

SEQ ID NO: 1557139 - RNA, 17 nt, Human adenovirus C
uguggugagcuguuuga

SEQ ID NO: 1557140 - RNA, 13 nt, Human adenovirus C
cacaauguggccu

SEQ ID NO: 1557141 - RNA, 13 nt, Human adenovirus C
auuggcucuggca

SEQ ID NO: 1557142 - RNA, 21 nt, Human adenovirus C
ugugucauguaugcguccaug

SEQ ID NO: 1557143 - RNA, 12 nt, Human adenovirus C
ggccagcuguug

SEQ ID NO: 1557144 - RNA, 20 nt, Human adenovirus C
aaaaagaagcugcagcugcc

SEQ ID NO: 1557145 - RNA, 20 nt, Human adenovirus C
caaggccggaaaccucaccu

SEQ ID NO: 1557146 - RNA, 16 nt, Human adenovirus C
cggcgccagcaccugu

SEQ ID NO: 1557147 - RNA, 13 nt, Human adenovirus C
acgcuggaccugc

SEQ ID NO: 1557148 - RNA, 17 nt, Human adenovirus C
cgugccaaccgcagccg

SEQ ID NO: 1557149 - RNA, 13 nt, Human adenovirus C
gcggucuuuccag

SEQ ID NO: 1557150 - RNA, 19 nt, Human adenovirus C
agccugauucgggaguuua

SEQ ID NO: 1557151 - RNA, 15 nt, Human adenovirus C
guagcugccuuccca

SEQ ID NO: 1557152 - RNA, 17 nt, Human adenovirus C
ccaagcgccagcgacug

SEQ ID NO: 1557153 - RNA, 15 nt, Human adenovirus C
cggacaagcagcugg

SEQ ID NO: 1557154 - RNA, 21 nt, Human adenovirus C
cggccugguaggcgcagcauc

SEQ ID NO: 1557155 - RNA, 13 nt, Human adenovirus C
cagcagccgcggc

SEQ ID NO: 1557156 - RNA, 18 nt, Human adenovirus C
auauggcccucaccugcc

SEQ ID NO: 1557157 - RNA, 14 nt, Human adenovirus C
caugaaccacccua

SEQ ID NO: 1557158 - RNA, 13 nt, Human adenovirus C
uugacaugaccau

SEQ ID NO: 1557159 - RNA, 20 nt, Human adenovirus C
cagcuggggccggaccuggg

SEQ ID NO: 1557160 - RNA, 12 nt, Human adenovirus C
ccacgccuuugc

SEQ ID NO: 1557161 - RNA, 15 nt, Human adenovirus C
uaggcccgggaccag

SEQ ID NO: 1557162 - RNA, 20 nt, Human adenovirus C
ggcacuaaagcaaggccugc

SEQ ID NO: 1557163 - RNA, 16 nt, Human adenovirus C
guucaucccuguggac

SEQ ID NO: 1557164 - RNA, 19 nt, Human adenovirus C
ggacaaguugaaagagcaa

SEQ ID NO: 1557165 - RNA, 12 nt, Human adenovirus C
agauuuuucugc

SEQ ID NO: 1557166 - RNA, 17 nt, Human adenovirus C
accucuuugagcccuuu

SEQ ID NO: 1557167 - RNA, 17 nt, Human adenovirus C
ugagcuugaucugcugg

SEQ ID NO: 1557168 - RNA, 21 nt, Human adenovirus C
ugcagcugccgucaucccuga

SEQ ID NO: 1557169 - RNA, 23 nt, Human adenovirus C
acgcguuccggcagcagccgcag

SEQ ID NO: 1557170 - RNA, 22 nt, Human adenovirus C
ccaacgugccgcggggacagga

SEQ ID NO: 1557171 - RNA, 14 nt, Human adenovirus C
gccgcggcagaacc

SEQ ID NO: 1557172 - RNA, 19 nt, Human adenovirus C
ugcaaagggcccuggcugg

SEQ ID NO: 1557173 - RNA, 23 nt, Human adenovirus C
gcuggugcaguuugcccgcgcca

SEQ ID NO: 1557174 - RNA, 16 nt, Human adenovirus C
uggccggggcuccggg

SEQ ID NO: 1557175 - RNA, 14 nt, Human adenovirus C
gccaccgcccgcgg

SEQ ID NO: 1557176 - RNA, 19 nt, Human adenovirus C
cgugagcgugagccggcgg

SEQ ID NO: 1557177 - RNA, 15 nt, Human adenovirus C
gguuuacugguccca

SEQ ID NO: 1557178 - RNA, 20 nt, Human adenovirus C
uuagguucuacgaagaccaa

SEQ ID NO: 1557179 - RNA, 16 nt, Human adenovirus C
ucccuuagaaccaaag

SEQ ID NO: 1557180 - RNA, 13 nt, Human adenovirus C
cacucgcuccagg

SEQ ID NO: 1557181 - RNA, 22 nt, Human adenovirus C
gcuaccggagugcugggccagc

SEQ ID NO: 1557182 - RNA, 13 nt, Human adenovirus C
ccauauauccaua

SEQ ID NO: 1557183 - RNA, 20 nt, Human adenovirus C
cccgaucacuuggugcuggc

SEQ ID NO: 1557184 - RNA, 21 nt, Human adenovirus C
acugcuaaaaauaacauuguc

SEQ ID NO: 1557185 - RNA, 21 nt, Human adenovirus C
cugcugccaugcgcgggcggc

SEQ ID NO: 1557186 - RNA, 18 nt, Human adenovirus C
gcgcagcagcagggcaac

SEQ ID NO: 1557187 - RNA, 23 nt, Human adenovirus C
aggagcagagcccauggaacccg

SEQ ID NO: 1557188 - RNA, 21 nt, Human adenovirus C
agcugccgccgccgccaccca

SEQ ID NO: 1557189 - RNA, 14 nt, Human adenovirus C
gucacuugcugaca

SEQ ID NO: 1557190 - RNA, 11 nt, Human adenovirus C
uggcagugguc

SEQ ID NO: 1557191 - RNA, 21 nt, Human adenovirus C
agaggccgcauccccgcggcg

SEQ ID NO: 1557192 - RNA, 17 nt, Human adenovirus C
gguggaccuggccaacc

SEQ ID NO: 1557193 - RNA, 14 nt, Human adenovirus C
ugaugaaaauucua

SEQ ID NO: 1557194 - RNA, 19 nt, Human adenovirus C
gaaggaaaugcguggaaga

SEQ ID NO: 1557195 - RNA, 14 nt, Human adenovirus C
uuaaaaaacaccac

SEQ ID NO: 1557196 - RNA, 15 nt, Human adenovirus C
gcaaacaucagcccc

SEQ ID NO: 1557197 - RNA, 23 nt, Human adenovirus C
ccacccgcccgcgccugcugggc

SEQ ID NO: 1557198 - RNA, 16 nt, Human adenovirus C
cgugcacuccaagagc

SEQ ID NO: 1557199 - RNA, 17 nt, Human adenovirus C
cguuucucagcagcugu

SEQ ID NO: 1557200 - RNA, 18 nt, Human adenovirus C
cuggcggguuuggcuggu

SEQ ID NO: 1557201 - RNA, 17 nt, Human adenovirus C
cagcccgggggaggcaa

SEQ ID NO: 1557202 - RNA, 19 nt, Human adenovirus C
agaucuuucauccaugaca

SEQ ID NO: 1557203 - RNA, 21 nt, Human adenovirus C
ccgcgcgcgggcaggagcugg

SEQ ID NO: 1557204 - RNA, 18 nt, Human adenovirus C
caguugccgaggaugaag

SEQ ID NO: 1557205 - RNA, 16 nt, Human adenovirus C
cacuguuacucagcca

SEQ ID NO: 1557206 - RNA, 18 nt, Human adenovirus C
gcccgcgccugcugggcg

SEQ ID NO: 1557207 - RNA, 14 nt, Human adenovirus C
agagccggccugga

SEQ ID NO: 1557208 - RNA, 16 nt, Human adenovirus C
uaguuaagagagcugc

SEQ ID NO: 1557209 - RNA, 16 nt, Human adenovirus C
gcucguugguccagca

SEQ ID NO: 1557210 - RNA, 15 nt, Human adenovirus C
ugaucaaacccagcu

SEQ ID NO: 1557211 - RNA, 16 nt, Human adenovirus C
uacugcugcuggaagg

SEQ ID NO: 1557212 - RNA, 17 nt, Human adenovirus C
gccgugagcgugagccg

SEQ ID NO: 1557213 - RNA, 18 nt, Human adenovirus C
cuacugcaccggcggcag

SEQ ID NO: 1557214 - RNA, 16 nt, Human adenovirus C
uacucccauuuuucca

SEQ ID NO: 1557215 - RNA, 21 nt, Human adenovirus C
ccaacucugguaucucagccg

SEQ ID NO: 1557216 - RNA, 17 nt, Human adenovirus C
cacacagaccaucaauc

SEQ ID NO: 1557217 - RNA, 14 nt, Human adenovirus C
guuuggcggggcaa

SEQ ID NO: 1557218 - RNA, 14 nt, Human adenovirus C
ggagaggcagagcg

SEQ ID NO: 1557219 - RNA, 21 nt, Human adenovirus C
ucccacgauacgucacuuccc

SEQ ID NO: 1557220 - RNA, 16 nt, Human adenovirus C
aaaccucagcgccucc

SEQ ID NO: 1557221 - RNA, 17 nt, Human adenovirus C
agaaaccugugcugcca

SEQ ID NO: 1557222 - RNA, 18 nt, Human adenovirus C
cuguggggcuccucccag

SEQ ID NO: 1557223 - RNA, 19 nt, Human adenovirus C
cuuugcaaguagcacaaaa

SEQ ID NO: 1557224 - RNA, 22 nt, Human adenovirus C
agcaagccgcucauggcgcagc

SEQ ID NO: 1557225 - RNA, 17 nt, Human adenovirus C
ggaccccauggcauggg

SEQ ID NO: 1557226 - RNA, 13 nt, Human adenovirus C
cuggggugaugca

SEQ ID NO: 1557227 - RNA, 21 nt, Human adenovirus C
ccauuccugaaucagcguaaa

SEQ ID NO: 1557228 - RNA, 12 nt, Human adenovirus C
cugcccaagacu

SEQ ID NO: 1557229 - RNA, 14 nt, Human adenovirus C
acccacccagcgcc

SEQ ID NO: 1557230 - RNA, 22 nt, Human adenovirus C
ugagcuccacaggucacgggcc

SEQ ID NO: 1557231 - RNA, 18 nt, Human adenovirus C
gaaggcucgcguccaggc

SEQ ID NO: 1557232 - RNA, 15 nt, Human adenovirus C
guguuacuuuucagc

SEQ ID NO: 1557233 - RNA, 17 nt, Human adenovirus C
cgagcccaacccgcgcc

SEQ ID NO: 1557234 - RNA, 13 nt, Human adenovirus C
gcucgaggggagu

SEQ ID NO: 1557235 - RNA, 19 nt, Human adenovirus C
cucaacuaaugcaaaucca

SEQ ID NO: 1557236 - RNA, 14 nt, Human adenovirus C
agagcccgagggcc

SEQ ID NO: 1557237 - RNA, 17 nt, Human adenovirus C
ggcaacaacaguggcag

SEQ ID NO: 1557238 - RNA, 20 nt, Human adenovirus C
ccaggaaagucccgcuccca

SEQ ID NO: 1557239 - RNA, 17 nt, Human adenovirus C
gcaagauaccccuaucc

SEQ ID NO: 1557240 - RNA, 18 nt, Human adenovirus C
agcagggcaaccugggcu

SEQ ID NO: 1557241 - RNA, 19 nt, Human adenovirus C
ccggcucgcuccacggugg

SEQ ID NO: 1557242 - RNA, 18 nt, Human adenovirus C
ugguggacgucgcgccgc

SEQ ID NO: 1557243 - RNA, 16 nt, Human adenovirus C
cacucucgcaaggccu

SEQ ID NO: 1557244 - RNA, 12 nt, Human adenovirus C
cuaaagcggguc

SEQ ID NO: 1557245 - RNA, 20 nt, Human adenovirus C
ccauccgcaauacagagaca

SEQ ID NO: 1557246 - RNA, 16 nt, Human adenovirus C
cgcggcgauuggcgcc

SEQ ID NO: 1557247 - RNA, 12 nt, Human adenovirus C
gagacagugucu

SEQ ID NO: 1557248 - RNA, 18 nt, Human adenovirus C
gcgcugcuccucuucccg

SEQ ID NO: 1557249 - RNA, 11 nt, Human adenovirus C
gaccuggccaa

SEQ ID NO: 1557250 - RNA, 22 nt, Human adenovirus C
aggggcauggccggccacggcc

SEQ ID NO: 1557251 - RNA, 20 nt, Human adenovirus C
cuuauacuagcacuucugug

SEQ ID NO: 1557252 - RNA, 17 nt, Human adenovirus C
aaaaacccaaagucaaa

SEQ ID NO: 1557253 - RNA, 16 nt, Human adenovirus C
aguaugauuaaaugag

SEQ ID NO: 1557254 - RNA, 18 nt, Human adenovirus C
ccccagguacagcccacc

SEQ ID NO: 1557255 - RNA, 13 nt, Human adenovirus C
gcccuuggaggag

SEQ ID NO: 1557256 - RNA, 12 nt, Human adenovirus C
ucgacaccaccc

SEQ ID NO: 1557257 - RNA, 23 nt, Human adenovirus C
cugcugugcguaacuugcuggaa

SEQ ID NO: 1557258 - RNA, 24 nt, Human adenovirus C
cugcuuauuacagcgcuugcuuug

SEQ ID NO: 1557259 - RNA, 17 nt, Human adenovirus C
aguugagggugguggcg

SEQ ID NO: 1557260 - RNA, 16 nt, Human adenovirus C
cgcccucuuccuccca

SEQ ID NO: 1557261 - RNA, 21 nt, Human adenovirus C
cgggcugcgcgcuggccaggg

SEQ ID NO: 1557262 - RNA, 15 nt, Human adenovirus C
acgcacgaaggaggc

SEQ ID NO: 1557263 - RNA, 17 nt, Human adenovirus C
augacaaacuuacccug

SEQ ID NO: 1557264 - RNA, 20 nt, Human adenovirus C
cuugcuggaacagagcucua

SEQ ID NO: 1557265 - RNA, 22 nt, Human adenovirus C
ugacacaccucgaccacugccg

SEQ ID NO: 1557266 - RNA, 14 nt, Human adenovirus C
gacuacaugaacaa

SEQ ID NO: 1557267 - RNA, 12 nt, Human adenovirus C
ccugagcagcug

SEQ ID NO: 1557268 - RNA, 20 nt, Human adenovirus C
gcccugcgcgucggccaggu

SEQ ID NO: 1557269 - RNA, 18 nt, Human adenovirus C
acgcuuguggcgcgcgag

SEQ ID NO: 1557270 - RNA, 14 nt, Human adenovirus C
auucccacgcccua

SEQ ID NO: 1557271 - RNA, 13 nt, Human adenovirus C
cagcaucaccucc

SEQ ID NO: 1557272 - RNA, 16 nt, Human adenovirus C
uggggugggugagcgc

SEQ ID NO: 1557273 - RNA, 19 nt, Human adenovirus C
gcgaggccauaggucaggc

SEQ ID NO: 1557274 - RNA, 19 nt, Human adenovirus C
cgagucuggugacuuggca

SEQ ID NO: 1557275 - RNA, 22 nt, Human adenovirus C
ccggcagcagccgcaggccaac

SEQ ID NO: 1557276 - RNA, 17 nt, Human adenovirus C
ccuuggcgcgcagcuug

SEQ ID NO: 1557277 - RNA, 14 nt, Human adenovirus C
augaguacgagcca

SEQ ID NO: 1557278 - RNA, 17 nt, Human adenovirus C
ccagcauaacaacucag

SEQ ID NO: 1557279 - RNA, 13 nt, Human adenovirus C
caucucgggccag

SEQ ID NO: 1557280 - RNA, 19 nt, Human adenovirus C
uaucugacaaccccaacac

SEQ ID NO: 1557281 - RNA, 14 nt, Human adenovirus C
aacgcgcggcggcg

SEQ ID NO: 1557282 - RNA, 14 nt, Human adenovirus C
ccguugaacaaaac

SEQ ID NO: 1557283 - RNA, 14 nt, Human adenovirus C
caaacuugcaagaa

SEQ ID NO: 1557284 - RNA, 19 nt, Human adenovirus C
ccgaagauagcggccgggc

SEQ ID NO: 1557285 - RNA, 14 nt, Human adenovirus C
cagggccaggucgg

SEQ ID NO: 1557286 - RNA, 14 nt, Human adenovirus C
gcgguuaggcugga

SEQ ID NO: 1557287 - RNA, 20 nt, Human adenovirus C
gagcgcuccacccgcaccua

SEQ ID NO: 1557288 - RNA, 16 nt, Human adenovirus C
cagauacccaccacca

SEQ ID NO: 1557289 - RNA, 17 nt, Human adenovirus C
cgggcggaggagaagcg

SEQ ID NO: 1557290 - RNA, 21 nt, Human adenovirus C
uccgggcugcgcgcuggccag

SEQ ID NO: 1557291 - RNA, 12 nt, Human adenovirus C
gucaucucugug

SEQ ID NO: 1557292 - RNA, 17 nt, Human adenovirus C
gacauauuuccugcaga

SEQ ID NO: 1557293 - RNA, 14 nt, Human adenovirus C
gcguuccggcagca

SEQ ID NO: 1557294 - RNA, 13 nt, Human adenovirus C
uccugccaggcuc

SEQ ID NO: 1557295 - RNA, 15 nt, Human adenovirus C
cgggcagcaggcgcg

SEQ ID NO: 1557296 - RNA, 20 nt, Human adenovirus C
aggugucaccguugaacaaa

SEQ ID NO: 1557297 - RNA, 11 nt, Human adenovirus C
acuuccagccc

SEQ ID NO: 1557298 - RNA, 19 nt, Human adenovirus C
gcgcaucccauucuccagu

SEQ ID NO: 1557299 - RNA, 13 nt, Human adenovirus C
gaccaaaacggug

SEQ ID NO: 1557300 - RNA, 20 nt, Human adenovirus C
cgaaggcucgcguccaggcc

SEQ ID NO: 1557301 - RNA, 13 nt, Human adenovirus C
cagacaaugcaga

SEQ ID NO: 1557302 - RNA, 19 nt, Human adenovirus C
cccgagggccgcuggcugc

SEQ ID NO: 1557303 - RNA, 15 nt, Human adenovirus C
acagccgccugagca

SEQ ID NO: 1557304 - RNA, 20 nt, Human adenovirus C
cagcagggcaaccugggcuc

SEQ ID NO: 1557305 - RNA, 20 nt, Human adenovirus C
cuugcaagcagugcagcuuc

SEQ ID NO: 1557306 - RNA, 13 nt, Human adenovirus C
cuuugugagcgca

SEQ ID NO: 1557307 - RNA, 22 nt, Human adenovirus C
ccaggcgcggcggcugcugcgc

SEQ ID NO: 1557308 - RNA, 19 nt, Human adenovirus C
ccguggagccugggcugga

SEQ ID NO: 1557309 - RNA, 22 nt, Human adenovirus C
agauaaugacugcaaauuuacu

SEQ ID NO: 1557310 - RNA, 23 nt, Human adenovirus C
cccaacucugguaucucagccgc

SEQ ID NO: 1557311 - RNA, 21 nt, Human adenovirus C
gggugauggugucgcgcucgc

SEQ ID NO: 1557312 - RNA, 20 nt, Human adenovirus C
cgccagggcuacgugcgcca

SEQ ID NO: 1557313 - RNA, 12 nt, Human adenovirus C
cucgucacaucc

SEQ ID NO: 1557314 - RNA, 17 nt, Human adenovirus C
ccaccaauguggaaaua

SEQ ID NO: 1557315 - RNA, 22 nt, Human adenovirus C
gguggcaccgggacugggcgug

SEQ ID NO: 1557316 - RNA, 23 nt, Human adenovirus C
cagguuggaauucuucaccagca

SEQ ID NO: 1557317 - RNA, 18 nt, Human adenovirus C
cccaaaaagggugcaugc

SEQ ID NO: 1557318 - RNA, 18 nt, Human adenovirus C
acaagcuacccacccagc

SEQ ID NO: 1557319 - RNA, 16 nt, Human adenovirus C
ccuagccgcgcguccc

SEQ ID NO: 1557320 - RNA, 15 nt, Human adenovirus C
auccgcggcagcucg

SEQ ID NO: 1557321 - RNA, 24 nt, Human adenovirus C
cgggcaagauuauacccacaaccu

SEQ ID NO: 1557322 - RNA, 20 nt, Human adenovirus C
caacucggccgccuguggac

SEQ ID NO: 1557323 - RNA, 13 nt, Human adenovirus C
acuuucuccaaag

SEQ ID NO: 1557324 - RNA, 21 nt, Human adenovirus C
agucugcagcgcugccaaaaa

SEQ ID NO: 1557325 - RNA, 12 nt, Human adenovirus C
cagcugccgcca

SEQ ID NO: 1557326 - RNA, 12 nt, Human adenovirus C
acgcugguggcu

SEQ ID NO: 1557327 - RNA, 24 nt, Human adenovirus C
caugguguguggcaacugcgagga

SEQ ID NO: 1557328 - RNA, 15 nt, Human adenovirus C
uccgggcacagcagc

SEQ ID NO: 1557329 - RNA, 18 nt, Human adenovirus C
ggacugguuccuggugca

SEQ ID NO: 1557330 - RNA, 21 nt, Human adenovirus C
acucccauggaucacaacccc

SEQ ID NO: 1557331 - RNA, 14 nt, Human adenovirus C
cugcucucacagau

SEQ ID NO: 1557332 - RNA, 23 nt, Human adenovirus C
caaagaucuugguugugggccau

SEQ ID NO: 1557333 - RNA, 14 nt, Human adenovirus C
cccgcgccacuggg

SEQ ID NO: 1557334 - RNA, 18 nt, Human adenovirus C
auugggguaacugacacc

SEQ ID NO: 1557335 - RNA, 13 nt, Human adenovirus C
cucugcaaccugg

SEQ ID NO: 1557336 - RNA, 15 nt, Human adenovirus C
gcaccuucgccccag

SEQ ID NO: 1557337 - RNA, 14 nt, Human adenovirus C
augguucugcagag

SEQ ID NO: 1557338 - RNA, 15 nt, Human adenovirus C
cagaacgaccacagc

SEQ ID NO: 1557339 - RNA, 16 nt, Human adenovirus C
auggaagacugggaca

SEQ ID NO: 1557340 - RNA, 15 nt, Human adenovirus C
ccucacccgcagcug

SEQ ID NO: 1557341 - RNA, 14 nt, Human adenovirus C
guuggagaucugca

SEQ ID NO: 1557342 - RNA, 16 nt, Human adenovirus C
ggcagucugcagcgcu

SEQ ID NO: 1557343 - RNA, 21 nt, Human adenovirus C
gaaaagcuuauuauucgccac

SEQ ID NO: 1557344 - RNA, 17 nt, Human adenovirus C
ugccaccucccucccaa

SEQ ID NO: 1557345 - RNA, 14 nt, Human adenovirus C
caacaccuagccua

SEQ ID NO: 1557346 - RNA, 23 nt, Human adenovirus C
accuccgcuccucaggcgccgcc

SEQ ID NO: 1557347 - RNA, 21 nt, Human adenovirus C
acucgcgccuguugcugcugc

SEQ ID NO: 1557348 - RNA, 23 nt, Human adenovirus C
ccgaaccuuuggacaccucccac

SEQ ID NO: 1557349 - RNA, 19 nt, Human adenovirus C
ggagcgcugggcguggugc

SEQ ID NO: 1557350 - RNA, 15 nt, Human adenovirus C
gccgcggucgcucac

SEQ ID NO: 1557351 - RNA, 19 nt, Human adenovirus C
guagaggggcucucugagu

SEQ ID NO: 1557352 - RNA, 19 nt, Human adenovirus C
ugaagaaaaccguuuccgg

SEQ ID NO: 1557353 - RNA, 19 nt, Human adenovirus C
cgccagacgccgcaccugc

SEQ ID NO: 1557354 - RNA, 17 nt, Human adenovirus C
gaaagcuuccgcaggcc

SEQ ID NO: 1557355 - RNA, 16 nt, Human adenovirus C
ugccaugaaccacccu

SEQ ID NO: 1557356 - RNA, 20 nt, Human adenovirus C
cuagcgagguaagcacuuac

SEQ ID NO: 1557357 - RNA, 11 nt, Human adenovirus C
gcaugaugcaa

SEQ ID NO: 1557358 - RNA, 21 nt, Human adenovirus C
cggcaguagucggugcucguc

SEQ ID NO: 1557359 - RNA, 17 nt, Human adenovirus C
gcgcagacgcgccagac

SEQ ID NO: 1557360 - RNA, 20 nt, Human adenovirus C
ccagaggagcugcugagccg

SEQ ID NO: 1557361 - RNA, 15 nt, Human adenovirus C
gcauggcgacuaccu

SEQ ID NO: 1557362 - RNA, 18 nt, Human adenovirus C
gggcugcgcgcuggccag

SEQ ID NO: 1557363 - RNA, 15 nt, Human adenovirus C
gacagaggacagcaa

SEQ ID NO: 1557364 - RNA, 22 nt, Human adenovirus C
cuggaaaaguccacccaaagcg

SEQ ID NO: 1557365 - RNA, 22 nt, Human adenovirus C
accagggcuucuacauuccaga

SEQ ID NO: 1557366 - RNA, 21 nt, Human adenovirus C
cggcaugcgucgugcgcacca

SEQ ID NO: 1557367 - RNA, 16 nt, Human adenovirus C
gaggcauucagggaug

SEQ ID NO: 1557368 - RNA, 23 nt, Human adenovirus C
aauguauuauaacagcacuggca

SEQ ID NO: 1557369 - RNA, 14 nt, Human adenovirus C
agcagagcgugagc

SEQ ID NO: 1557370 - RNA, 15 nt, Human adenovirus C
ucgcguccaggccag

SEQ ID NO: 1557371 - RNA, 17 nt, Human adenovirus C
agaagcugcagcugccg

SEQ ID NO: 1557372 - RNA, 14 nt, Human adenovirus C
acgugccgcgggga

SEQ ID NO: 1557373 - RNA, 13 nt, Human adenovirus C
uggccgcgggcug

SEQ ID NO: 1557374 - RNA, 11 nt, Human adenovirus C
aggaaggugau

SEQ ID NO: 1557375 - RNA, 13 nt, Human adenovirus C
cagcgaggaggag

SEQ ID NO: 1557376 - RNA, 13 nt, Human adenovirus C
gagccccucgccu

SEQ ID NO: 1557377 - RNA, 18 nt, Human adenovirus C
gcagcggugcagccacaa

SEQ ID NO: 1557378 - RNA, 21 nt, Human adenovirus C
uacuucccagagacgcccagg

SEQ ID NO: 1557379 - RNA, 22 nt, Human adenovirus C
agccaacuaccuugccuaccac

SEQ ID NO: 1557380 - RNA, 19 nt, Human adenovirus C
cccugcaaacaucagcccc

SEQ ID NO: 1557381 - RNA, 21 nt, Human adenovirus C
agccgccgccguuagcccaag

SEQ ID NO: 1557382 - RNA, 14 nt, Human adenovirus C
uggaccuggccaac

SEQ ID NO: 1557383 - RNA, 14 nt, Human adenovirus C
augcagccggugga

SEQ ID NO: 1557384 - RNA, 23 nt, Human adenovirus C
cgaugccgccaacgcgccuacca

SEQ ID NO: 1557385 - RNA, 17 nt, Human adenovirus C
aauacugcgcgcugacu

SEQ ID NO: 1557386 - RNA, 16 nt, Human adenovirus C
gaaaccucaccuccca

SEQ ID NO: 1557387 - RNA, 14 nt, Human adenovirus C
cuuaaccugaugcg

SEQ ID NO: 1557388 - RNA, 21 nt, Human adenovirus C
gccgcgucaugcacgcagcac

SEQ ID NO: 1557389 - RNA, 17 nt, Human adenovirus C
cuuacaauuaccucagg

SEQ ID NO: 1557390 - RNA, 16 nt, Human adenovirus C
ccaaucccgcccgcca

SEQ ID NO: 1557391 - RNA, 23 nt, Human adenovirus C
guccucggagccgcgcuccggag

SEQ ID NO: 1557392 - RNA, 15 nt, Human adenovirus C
uaucccccaaggccu

SEQ ID NO: 1557393 - RNA, 21 nt, Human adenovirus C
gccccccuucucccaccccca

SEQ ID NO: 1557394 - RNA, 19 nt, Human adenovirus C
ccuugcggcagucugcagc

SEQ ID NO: 1557395 - RNA, 22 nt, Human adenovirus C
acaccggggcgcgcugcggcug

SEQ ID NO: 1557396 - RNA, 22 nt, Human adenovirus C
ggccauuuuuacaaagcgcggg

SEQ ID NO: 1557397 - RNA, 19 nt, Human adenovirus C
cgcuugcaagcagugcagc

SEQ ID NO: 1557398 - RNA, 18 nt, Human adenovirus C
cagaaacuuccagcccau

SEQ ID NO: 1557399 - RNA, 18 nt, Human adenovirus C
ugcggcuggagcugccca

SEQ ID NO: 1557400 - RNA, 22 nt, Human adenovirus C
acagagggcugccugcacuucc

SEQ ID NO: 1557401 - RNA, 20 nt, Human adenovirus C
ccagauguugcgcagcggca

SEQ ID NO: 1557402 - RNA, 19 nt, Human adenovirus C
ggugcugcgcgcggagguu

SEQ ID NO: 1557403 - RNA, 16 nt, Human adenovirus C
ccgcugcagccaccgc

SEQ ID NO: 1557404 - RNA, 17 nt, Human adenovirus C
ugagcuccacgugccgg

SEQ ID NO: 1557405 - RNA, 20 nt, Human adenovirus C
ucagcugggaagaaagcagg

SEQ ID NO: 1557406 - RNA, 21 nt, Human adenovirus C
cagaugaaacgcgccagaccg

SEQ ID NO: 1557407 - RNA, 13 nt, Human adenovirus C
cacagaccugggc

SEQ ID NO: 1557408 - RNA, 19 nt, Human adenovirus C
uccgcuccucaggcgccgc

SEQ ID NO: 1557409 - RNA, 16 nt, Human adenovirus C
cugucauaccacugca

SEQ ID NO: 1557410 - RNA, 18 nt, Human adenovirus C
agaggccgaguccuacuu

SEQ ID NO: 1557411 - RNA, 21 nt, Human adenovirus C
uccacgcuggaagccaugcuc

SEQ ID NO: 1557412 - RNA, 17 nt, Human adenovirus C
caggaaagucccgcucc

SEQ ID NO: 1557413 - RNA, 16 nt, Human adenovirus C
cuuacuacaccuacuc

SEQ ID NO: 1557414 - RNA, 18 nt, Human adenovirus C
uccuaacucugcagaccu

SEQ ID NO: 1557415 - RNA, 16 nt, Human adenovirus C
gcccgagggccgcugg

SEQ ID NO: 1557416 - RNA, 19 nt, Human adenovirus C
uaggcgauuucggccauga

SEQ ID NO: 1557417 - RNA, 20 nt, Human adenovirus C
uauuuguugccuaaagcgca

SEQ ID NO: 1557418 - RNA, 20 nt, Human adenovirus C
auaugaguggguggaguuca

SEQ ID NO: 1557419 - RNA, 15 nt, Human adenovirus C
ccaaagcagaccaaa

SEQ ID NO: 1557420 - RNA, 21 nt, Human adenovirus C
gcggcugacgcggcggcagau

SEQ ID NO: 1557421 - RNA, 21 nt, Human adenovirus C
auggaaaaauaggaauuaaaa

SEQ ID NO: 1557422 - RNA, 12 nt, Human adenovirus C
gcuagcauuaag

SEQ ID NO: 1557423 - RNA, 14 nt, Human adenovirus C
cauggcgcagcugu

SEQ ID NO: 1557424 - RNA, 19 nt, Human adenovirus C
gggcguggcuuaagggugg

SEQ ID NO: 1557425 - RNA, 22 nt, Human adenovirus C
caccgguugcugcgcccacacc

SEQ ID NO: 1557426 - RNA, 23 nt, Human adenovirus C
ggcgccgcgcgcgggcaggagcu

SEQ ID NO: 1557427 - RNA, 21 nt, Human adenovirus C
agcuguccauggucuggagcu

SEQ ID NO: 1557428 - RNA, 20 nt, Human adenovirus C
cggugccaugauuacuaaac

SEQ ID NO: 1557429 - RNA, 15 nt, Human adenovirus C
gccggguggugcacg

SEQ ID NO: 1557430 - RNA, 15 nt, Human adenovirus C
acgccaucaucucug

SEQ ID NO: 1557431 - RNA, 13 nt, Human adenovirus C
cacccgccccguu

SEQ ID NO: 1557432 - RNA, 22 nt, Human adenovirus C
cucagcgaccgcgagcugaugc

SEQ ID NO: 1557433 - RNA, 15 nt, Human adenovirus C
cggccacuacccgga

SEQ ID NO: 1557434 - RNA, 13 nt, Human adenovirus C
uccguccugcagg

SEQ ID NO: 1557435 - RNA, 17 nt, Human adenovirus C
cagccgguggaggacau

SEQ ID NO: 1557436 - RNA, 23 nt, Human adenovirus C
ugagcccguguucugacagggcc

SEQ ID NO: 1557437 - RNA, 22 nt, Human adenovirus C
cugagcccguguucugacaggg

SEQ ID NO: 1557438 - RNA, 23 nt, Human adenovirus C
cagcguaaaucccacacugcagg

SEQ ID NO: 1557439 - RNA, 16 nt, Human adenovirus C
agggcccuggcuggca

SEQ ID NO: 1557440 - RNA, 21 nt, Human adenovirus C
uaccugugcuuugcucccaaa

SEQ ID NO: 1557441 - RNA, 15 nt, Human adenovirus C
gaugaagaagaggaa

SEQ ID NO: 1557442 - RNA, 20 nt, Human adenovirus C
ccaaagcagaccaaagcaaa

SEQ ID NO: 1557443 - RNA, 13 nt, Human adenovirus C
caagcacacagac

SEQ ID NO: 1557444 - RNA, 15 nt, Human adenovirus C
cuggacguuagcgcc

SEQ ID NO: 1557445 - RNA, 15 nt, Human adenovirus C
uccucaggggagcug

SEQ ID NO: 1557446 - RNA, 22 nt, Human adenovirus C
gucugaggguaacuccagggug

SEQ ID NO: 1557447 - RNA, 10 nt, Human adenovirus C
gccugcuggg

SEQ ID NO: 1557448 - RNA, 13 nt, Human adenovirus C
auacccaccacca

SEQ ID NO: 1557449 - RNA, 16 nt, Human adenovirus C
ggccgccgcagcagcc

SEQ ID NO: 1557450 - RNA, 23 nt, Human adenovirus C
guucccagcaucgcuacaaccuc

SEQ ID NO: 1557451 - RNA, 15 nt, Human adenovirus C
gucaugucuuuccac

SEQ ID NO: 1557452 - RNA, 18 nt, Human adenovirus C
cggccaaucaagcaggug

SEQ ID NO: 1557453 - RNA, 23 nt, Human adenovirus C
cuuggcacccaccgugcagcuga

SEQ ID NO: 1557454 - RNA, 21 nt, Human adenovirus C
ggaggagcaacagcaggagga

SEQ ID NO: 1557455 - RNA, 15 nt, Human adenovirus C
gcucccaccaugcgc

SEQ ID NO: 1557456 - RNA, 18 nt, Human adenovirus C
cacgaucuuggccuugcu

SEQ ID NO: 1557457 - RNA, 15 nt, Human adenovirus C
gcaauaacacaggcu

SEQ ID NO: 1557458 - RNA, 15 nt, Human adenovirus C
ggcuauaggacugau

SEQ ID NO: 1557459 - RNA, 16 nt, Human adenovirus C
gaugcugaccugcucg

SEQ ID NO: 1557460 - RNA, 14 nt, Human adenovirus C
cugcagcugccgcc

SEQ ID NO: 1557461 - RNA, 21 nt, Human adenovirus C
acagguggagcugaaauauga

SEQ ID NO: 1557462 - RNA, 15 nt, Human adenovirus C
cgagcaggcagaggc

SEQ ID NO: 1557463 - RNA, 14 nt, Human adenovirus C
cuguuuugcagcag

SEQ ID NO: 1557464 - RNA, 18 nt, Human adenovirus C
cgcagcccuaucagcagc

SEQ ID NO: 1557465 - RNA, 15 nt, Human adenovirus C
uagugcagcacagca

SEQ ID NO: 1557466 - RNA, 22 nt, Human adenovirus C
caaacucuucgcggucuuucca

SEQ ID NO: 1557467 - RNA, 19 nt, Human adenovirus C
caacgagcgcuccguggcc

SEQ ID NO: 1557468 - RNA, 19 nt, Human adenovirus C
guuccucacagaccuguau

SEQ ID NO: 1557469 - RNA, 17 nt, Human adenovirus C
gccgugccaaccgcagc

SEQ ID NO: 1557470 - RNA, 17 nt, Human adenovirus C
gcuacaagcuacccacc

SEQ ID NO: 1557471 - RNA, 13 nt, Human adenovirus C
gcggcgaccugaa

SEQ ID NO: 1557472 - RNA, 19 nt, Human adenovirus C
gcuuauguuuguuugccuu

SEQ ID NO: 1557473 - RNA, 18 nt, Human adenovirus C
cgggcaggagcuggugcu

SEQ ID NO: 1557474 - RNA, 14 nt, Human adenovirus C
ucacuccacaggcu

SEQ ID NO: 1557475 - RNA, 16 nt, Human adenovirus C
ggugagcgcggcgcca

SEQ ID NO: 1557476 - RNA, 13 nt, Human adenovirus C
gagggacaggcuu

SEQ ID NO: 1557477 - RNA, 13 nt, Human adenovirus C
caagacuacucaa

SEQ ID NO: 1557478 - RNA, 20 nt, Human adenovirus C
uccccuccgguggcgugguc

SEQ ID NO: 1557479 - RNA, 16 nt, Human adenovirus C
accgcgucacgcacga

SEQ ID NO: 1557480 - RNA, 17 nt, Human adenovirus C
cuggaggcagcuggggc

SEQ ID NO: 1557481 - RNA, 17 nt, Human adenovirus C
caucgaggucacccacu

SEQ ID NO: 1557482 - RNA, 17 nt, Human adenovirus C
cucggaguaccugagcc

SEQ ID NO: 1557483 - RNA, 14 nt, Human adenovirus C
cacggcucgcgccc

SEQ ID NO: 1557484 - RNA, 22 nt, Human adenovirus C
agugcuuguuaccguggagcuu

SEQ ID NO: 1557485 - RNA, 16 nt, Human adenovirus C
cgaggccguggcgcag

SEQ ID NO: 1557486 - RNA, 17 nt, Human adenovirus C
uugcaagacagaaacac

SEQ ID NO: 1557487 - RNA, 18 nt, Human adenovirus C
uuaaucaaacucacagaa

SEQ ID NO: 1557488 - RNA, 16 nt, Human adenovirus C
ucccugggaucaggcu

SEQ ID NO: 1557489 - RNA, 17 nt, Human adenovirus C
agcagacggugaaccag

SEQ ID NO: 1557490 - RNA, 19 nt, Human adenovirus C
gaagggcacgagcugcuuc

SEQ ID NO: 1557491 - RNA, 18 nt, Human adenovirus C
gacugcgguauaaugguu

SEQ ID NO: 1557492 - RNA, 22 nt, Human adenovirus C
gucccagcguuugacgcugcgg

SEQ ID NO: 1557493 - RNA, 19 nt, Human adenovirus C
gagguugcuacgggcgggc

SEQ ID NO: 1557494 - RNA, 21 nt, Human adenovirus C
aaagcuagcccugcaaacauc

SEQ ID NO: 1557495 - RNA, 19 nt, Human adenovirus C
aggaggacuuugagcccga

SEQ ID NO: 1557496 - RNA, 13 nt, Human adenovirus C
agaucuuauucca

SEQ ID NO: 1557497 - RNA, 18 nt, Human adenovirus C
guucgagucucgggccgg

SEQ ID NO: 1557498 - RNA, 22 nt, Human adenovirus C
caugcuauaccccauacccgcc

SEQ ID NO: 1557499 - RNA, 24 nt, Human adenovirus C
gcguuucagccccccggcgcccgc

SEQ ID NO: 1557500 - RNA, 15 nt, Human adenovirus C
cuccagggugcgcca

SEQ ID NO: 1557501 - RNA, 19 nt, Human adenovirus C
uaaaugccaaccuauggag

SEQ ID NO: 1557502 - RNA, 17 nt, Human adenovirus C
gcagaugggagcugucc

SEQ ID NO: 1557503 - RNA, 18 nt, Human adenovirus C
gaagaucuggaaggugcu

SEQ ID NO: 1557504 - RNA, 23 nt, Human adenovirus C
gaaggcucgcguccaggccagca

SEQ ID NO: 1557505 - RNA, 15 nt, Human adenovirus C
cagcguagucugggu

SEQ ID NO: 1557506 - RNA, 19 nt, Human adenovirus C
agcauaguggugcaggagc

SEQ ID NO: 1557507 - RNA, 16 nt, Human adenovirus C
ccggcgccagcaccug

SEQ ID NO: 1557508 - RNA, 16 nt, Human adenovirus C
cugcgcgucggccagg

SEQ ID NO: 1557509 - RNA, 20 nt, Human adenovirus C
uuaagaaaugccuguuugaa

SEQ ID NO: 1557510 - RNA, 15 nt, Human adenovirus C
gcgcgggcaggagcu

SEQ ID NO: 1557511 - RNA, 15 nt, Human adenovirus C
agugcccgcugucau

SEQ ID NO: 1557512 - RNA, 21 nt, Human adenovirus C
cacuaguauugccacugccac

SEQ ID NO: 1557513 - RNA, 18 nt, Human adenovirus C
agcaaggccugcccacca

SEQ ID NO: 1557514 - RNA, 15 nt, Human adenovirus C
ccucaggggagcuga

SEQ ID NO: 1557515 - RNA, 15 nt, Human adenovirus C
ucaacuaacauaaac

SEQ ID NO: 1557516 - RNA, 15 nt, Human adenovirus C
cacugcagcaggugc

SEQ ID NO: 1557517 - RNA, 20 nt, Human adenovirus C
gucccuaaccaugacuuuga

SEQ ID NO: 1557518 - RNA, 16 nt, Human adenovirus C
gaggggcagugcagac

SEQ ID NO: 1557519 - RNA, 23 nt, Human adenovirus C
agcgguguuccgcgguccuccuc

SEQ ID NO: 1557520 - RNA, 19 nt, Human adenovirus C
gaccgugguuugcaacugu

SEQ ID NO: 1557521 - RNA, 23 nt, Human adenovirus C
acuggucuugucaugccuggggu

SEQ ID NO: 1557522 - RNA, 15 nt, Human adenovirus C
gcuguauccaaagcu

SEQ ID NO: 1557523 - RNA, 23 nt, Human adenovirus C
cccugcaaacaucagccccccuc

SEQ ID NO: 1557524 - RNA, 15 nt, Human adenovirus C
cugacaaagcccaag

SEQ ID NO: 1557525 - RNA, 20 nt, Human adenovirus C
caugucuaugcccaggcucc

SEQ ID NO: 1557526 - RNA, 17 nt, Human adenovirus C
cgaggaugaagaagagg

SEQ ID NO: 1557527 - RNA, 18 nt, Human adenovirus C
cagucugcagcgcugcca

SEQ ID NO: 1557528 - RNA, 22 nt, Human adenovirus C
gagaacuccaacgcggcagccg

SEQ ID NO: 1557529 - RNA, 12 nt, Human adenovirus C
agagagcugcag

SEQ ID NO: 1557530 - RNA, 23 nt, Human adenovirus C
gacgcguugcaagagcgcagcga

SEQ ID NO: 1557531 - RNA, 19 nt, Human adenovirus C
uaacgcuggaccugccucc

SEQ ID NO: 1557532 - RNA, 23 nt, Human adenovirus C
gccgcaggccaaccggcucuccg

SEQ ID NO: 1557533 - RNA, 16 nt, Human adenovirus C
cagagcuguccuauca

SEQ ID NO: 1557534 - RNA, 15 nt, Human adenovirus C
ccgcaacuucagacu

SEQ ID NO: 1557535 - RNA, 22 nt, Human adenovirus C
ccaaccgcagccgagcggacaa

SEQ ID NO: 1557536 - RNA, 13 nt, Human adenovirus C
ugcuuuccugagc

SEQ ID NO: 1557537 - RNA, 14 nt, Human adenovirus C
agugcuuugcccgc

SEQ ID NO: 1557538 - RNA, 18 nt, Human adenovirus C
gagggcgagggccuggcg

SEQ ID NO: 1557539 - RNA, 16 nt, Human adenovirus C
agcggggggcuucuga

SEQ ID NO: 1557540 - RNA, 20 nt, Human adenovirus C
uccacgggcgcaggguccuc

SEQ ID NO: 1557541 - RNA, 15 nt, Human adenovirus C
ccgcccgcgccugcu

SEQ ID NO: 1557542 - RNA, 19 nt, Human adenovirus C
uccgcauaccccgcgccac

SEQ ID NO: 1557543 - RNA, 11 nt, Human adenovirus C
uugaagacaug

SEQ ID NO: 1557544 - RNA, 12 nt, Human adenovirus C
uuguugcuacau

SEQ ID NO: 1557545 - RNA, 21 nt, Human adenovirus C
aacuggugcuuauggugggag

SEQ ID NO: 1557546 - RNA, 14 nt, Human adenovirus C
auggccugcugcac

SEQ ID NO: 1557547 - RNA, 19 nt, Human adenovirus C
caagagcaagagcagcggc

SEQ ID NO: 1557548 - RNA, 13 nt, Human adenovirus C
ggugcgcuugagg

SEQ ID NO: 1557549 - RNA, 18 nt, Human adenovirus C
aagccgcucauggcgcag

SEQ ID NO: 1557550 - RNA, 15 nt, Human adenovirus C
gccacaucuucucuu

SEQ ID NO: 1557551 - RNA, 21 nt, Human adenovirus C
acuuggugcuggccugcaccc

SEQ ID NO: 1557552 - RNA, 16 nt, Human adenovirus C
gaagaaggaagagcag

SEQ ID NO: 1557553 - RNA, 13 nt, Human adenovirus C
gacuuugugccca

SEQ ID NO: 1557554 - RNA, 16 nt, Human adenovirus C
gugacaaagagacgcu

SEQ ID NO: 1557555 - RNA, 22 nt, Human adenovirus C
ccuuuucuggaccucccggcca

SEQ ID NO: 1557556 - RNA, 16 nt, Human adenovirus C
cgaccggcaaggcaau

SEQ ID NO: 1557557 - RNA, 22 nt, Human adenovirus C
gcgcgaaaagaaccugccuccg

SEQ ID NO: 1557558 - RNA, 16 nt, Human adenovirus C
ggaacauucccagcug

SEQ ID NO: 1557559 - RNA, 14 nt, Human adenovirus C
cgaugagcagcugg

SEQ ID NO: 1557560 - RNA, 13 nt, Human adenovirus C
acucugcagaccu

SEQ ID NO: 1557561 - RNA, 20 nt, Human adenovirus C
gcuggcgguagaggggccag

SEQ ID NO: 1557562 - RNA, 16 nt, Human adenovirus C
gcggcggcggcaggag

SEQ ID NO: 1557563 - RNA, 14 nt, Human adenovirus C
caucaucucuguca

SEQ ID NO: 1557564 - RNA, 15 nt, Human adenovirus C
cgagccaggugagcu

SEQ ID NO: 1557565 - RNA, 14 nt, Human adenovirus C
gauguuaacauggu

SEQ ID NO: 1557566 - RNA, 19 nt, Human adenovirus C
caccuguucucaccgcgcg

SEQ ID NO: 1557567 - RNA, 19 nt, Human adenovirus C
gcaucccuuuucuacgggu

SEQ ID NO: 1557568 - RNA, 17 nt, Human adenovirus C
ccagcaauaacacaggc

SEQ ID NO: 1557569 - RNA, 22 nt, Human adenovirus C
agcgacacccaagggugcagcu

SEQ ID NO: 1557570 - RNA, 14 nt, Human adenovirus C
gcagaggcggcgcu

SEQ ID NO: 1557571 - RNA, 16 nt, Human adenovirus C
cuugaggaggaggaag

SEQ ID NO: 1557572 - RNA, 13 nt, Human adenovirus C
gcuagguccaggu

SEQ ID NO: 1557573 - RNA, 17 nt, Human adenovirus C
cguggcuuaaggguggg

SEQ ID NO: 1557574 - RNA, 16 nt, Human adenovirus C
cgcugaccugcgcugg

SEQ ID NO: 1557575 - RNA, 15 nt, Human adenovirus C
gcaccuacgcacgac

SEQ ID NO: 1557576 - RNA, 15 nt, Human adenovirus C
cuugacauuggcugg

SEQ ID NO: 1557577 - RNA, 21 nt, Human adenovirus C
cccguagaggagccuccaccg

SEQ ID NO: 1557578 - RNA, 17 nt, Human adenovirus C
cggccugguaggcgcag

SEQ ID NO: 1557579 - RNA, 19 nt, Human adenovirus C
auuaacgaggaugggcagg

SEQ ID NO: 1557580 - RNA, 21 nt, Human adenovirus C
ggguguucuugcuggucaggc

SEQ ID NO: 1557581 - RNA, 20 nt, Human adenovirus C
acuucggcugcuuguccuug

SEQ ID NO: 1557582 - RNA, 22 nt, Human adenovirus C
ccacgugaccggguguuccuga

SEQ ID NO: 1557583 - RNA, 18 nt, Human adenovirus C
gucuugcauacggccgcc

SEQ ID NO: 1557584 - RNA, 19 nt, Human adenovirus C
auguucagauacaugggca

SEQ ID NO: 1557585 - RNA, 21 nt, Human adenovirus C
auaugcccuacauccuuccau

SEQ ID NO: 1557586 - RNA, 24 nt, Human adenovirus C
cggggcaaagaagcgcuccgacca

SEQ ID NO: 1557587 - RNA, 17 nt, Human adenovirus C
gagucgcgcagcuuguu

SEQ ID NO: 1557588 - RNA, 17 nt, Human adenovirus C
gccccccggcgcccgcg

SEQ ID NO: 1557589 - RNA, 20 nt, Human adenovirus C
uggcgaccccucauaaacac

SEQ ID NO: 1557590 - RNA, 14 nt, Human adenovirus C
cacgggcggcggcc

SEQ ID NO: 1557591 - RNA, 17 nt, Human adenovirus C
uggcuugagacgcgcga

SEQ ID NO: 1557592 - RNA, 21 nt, Human adenovirus C
aacaucgcgcagaugggagcu

SEQ ID NO: 1557593 - RNA, 13 nt, Human adenovirus C
gcgcuccauggcc

SEQ ID NO: 1557594 - RNA, 22 nt, Human adenovirus C
cguagaggagccuccaccggcc

SEQ ID NO: 1557595 - RNA, 20 nt, Human adenovirus C
cugcuagaguugcaacagcg

SEQ ID NO: 1557596 - RNA, 15 nt, Human adenovirus C
aggagcugaggcccg

SEQ ID NO: 1557597 - RNA, 14 nt, Human adenovirus C
augagcagcuggcg

SEQ ID NO: 1557598 - RNA, 17 nt, Human adenovirus C
aacagcacuggcaacau

SEQ ID NO: 1557599 - RNA, 22 nt, Human adenovirus C
agucucacgcucgcuugguccu

SEQ ID NO: 1557600 - RNA, 12 nt, Human adenovirus C
gccuggaggagc

SEQ ID NO: 1557601 - RNA, 20 nt, Human adenovirus C
gcaagcuaaugauggccgca

SEQ ID NO: 1557602 - RNA, 16 nt, Human adenovirus C
cuuccagcccaugagc

SEQ ID NO: 1557603 - RNA, 21 nt, Human adenovirus C
guaucgacccgcgagcuuaga

SEQ ID NO: 1557604 - RNA, 16 nt, Human adenovirus C
cugugcuacaccuggc

SEQ ID NO: 1557605 - RNA, 20 nt, Human adenovirus C
aggagcgcagcuugagccug

SEQ ID NO: 1557606 - RNA, 17 nt, Human adenovirus C
ccgggagagggggcagg

SEQ ID NO: 1557607 - RNA, 17 nt, Human adenovirus C
cagcuuguugaccagcu

SEQ ID NO: 1557608 - RNA, 21 nt, Human adenovirus C
cggcgccgcgcgcgggcagga

SEQ ID NO: 1557609 - RNA, 12 nt, Human adenovirus C
cggaccugggcu

SEQ ID NO: 1557610 - RNA, 22 nt, Human adenovirus C
ugcugaguauaauaaauacaga

SEQ ID NO: 1557611 - RNA, 14 nt, Human adenovirus C
acauuacuggaacu

SEQ ID NO: 1557612 - RNA, 14 nt, Human adenovirus C
cgccugcaggaauc

SEQ ID NO: 1557613 - RNA, 20 nt, Human adenovirus C
aggugaaaaucguaaaacuu

SEQ ID NO: 1557614 - RNA, 15 nt, Human adenovirus C
cgcgcuggccagggu

SEQ ID NO: 1557615 - RNA, 16 nt, Human adenovirus C
gagacggcggaggcgc

SEQ ID NO: 1557616 - RNA, 23 nt, Human adenovirus C
cuacagccugagcguaaccagac

SEQ ID NO: 1557617 - RNA, 21 nt, Human adenovirus C
cgaggagcugaggcccgauca

SEQ ID NO: 1557618 - RNA, 20 nt, Human adenovirus C
acgcggguuuggcagggcga

SEQ ID NO: 1557619 - RNA, 12 nt, Human adenovirus C
acuaccacgccc

SEQ ID NO: 1557620 - RNA, 13 nt, Human adenovirus C
ccuauuaaaaaac

SEQ ID NO: 1557621 - RNA, 22 nt, Human adenovirus C
gccugcaaaauuuccaacgugg

SEQ ID NO: 1557622 - RNA, 12 nt, Human adenovirus C
ucccuugccgug

SEQ ID NO: 1557623 - RNA, 22 nt, Human adenovirus C
ggcggcaacaacaguggcagcg

SEQ ID NO: 1557624 - RNA, 16 nt, Human adenovirus C
accccccacccuugcc

SEQ ID NO: 1557625 - RNA, 15 nt, Human adenovirus C
uccugagcagcugcg

SEQ ID NO: 1557626 - RNA, 20 nt, Human adenovirus C
uugcauacggccgccagagc

SEQ ID NO: 1557627 - RNA, 22 nt, Human adenovirus C
cucagcgccucccaaaagacau

SEQ ID NO: 1557628 - RNA, 17 nt, Human adenovirus C
ggccaguguuugagcac

SEQ ID NO: 1557629 - RNA, 23 nt, Human adenovirus C
cuggggugaugcaguagaaggua

SEQ ID NO: 1557630 - RNA, 12 nt, Human adenovirus C
ccuccgcccugc

SEQ ID NO: 1557631 - RNA, 11 nt, Human adenovirus C
gguggcggcga

SEQ ID NO: 1557632 - RNA, 17 nt, Human adenovirus C
cugcucugcucggaaga

SEQ ID NO: 1557633 - RNA, 16 nt, Human adenovirus C
ugggcuaaucuugguu

SEQ ID NO: 1557634 - RNA, 16 nt, Human adenovirus C
ggaggacuuugagccc

SEQ ID NO: 1557635 - RNA, 22 nt, Human adenovirus C
ccacucucgcaaggccuggcca

SEQ ID NO: 1557636 - RNA, 13 nt, Human adenovirus C
cucgaccacugcc

SEQ ID NO: 1557637 - RNA, 21 nt, Human adenovirus C
guaagcgguuaggcuggaaag

SEQ ID NO: 1557638 - RNA, 15 nt, Human adenovirus C
gccgggucagggcgc

SEQ ID NO: 1557639 - RNA, 16 nt, Human adenovirus C
agcccaacccgcgccu

SEQ ID NO: 1557640 - RNA, 14 nt, Human adenovirus C
caaacgaggaacaa

SEQ ID NO: 1557641 - RNA, 14 nt, Human adenovirus C
cuaaaaaacuggaa

SEQ ID NO: 1557642 - RNA, 14 nt, Human adenovirus C
gaagaagaggaaga

SEQ ID NO: 1557643 - RNA, 14 nt, Human adenovirus C
aacgcgccuaccac

SEQ ID NO: 1557644 - RNA, 11 nt, Human adenovirus C
gggugcccuug

SEQ ID NO: 1557645 - RNA, 14 nt, Human adenovirus C
ucaucccuguggac

SEQ ID NO: 1557646 - RNA, 14 nt, Human adenovirus C
gccggcgccccaga

SEQ ID NO: 1557647 - RNA, 16 nt, Human adenovirus C
agcggcggcagcagca

SEQ ID NO: 1557648 - RNA, 17 nt, Human adenovirus C
gaucacuuggugcuggc

SEQ ID NO: 1557649 - RNA, 13 nt, Human adenovirus C
gaccggcuggugg

SEQ ID NO: 1557650 - RNA, 14 nt, Human adenovirus C
aaagcaugaugcaa

SEQ ID NO: 1557651 - RNA, 14 nt, Human adenovirus C
aguugcauguggaa

SEQ ID NO: 1557652 - RNA, 19 nt, Human adenovirus C
agcaacaucaacaacagcu

SEQ ID NO: 1557653 - RNA, 19 nt, Human adenovirus C
gggauggcgcaggcggcgg

SEQ ID NO: 1557654 - RNA, 19 nt, Human adenovirus C
cagcagguuucugcccuga

SEQ ID NO: 1557655 - RNA, 14 nt, Human adenovirus C
caugaaagccuuga

SEQ ID NO: 1557656 - RNA, 23 nt, Human adenovirus C
gcugcgcgcggagguugcuggcg

SEQ ID NO: 1557657 - RNA, 16 nt, Human adenovirus C
acgggcccggugagcu

SEQ ID NO: 1557658 - RNA, 18 nt, Human adenovirus C
ccaccaguagcacuagua

SEQ ID NO: 1557659 - RNA, 23 nt, Human adenovirus C
gcucaagggcgaggcgcgccgcg

SEQ ID NO: 1557660 - RNA, 16 nt, Human adenovirus C
gccucggcgguggcag

SEQ ID NO: 1557661 - RNA, 15 nt, Human adenovirus C
gccgacuuggaggag

SEQ ID NO: 1557662 - RNA, 14 nt, Human adenovirus C
ccuucccaaaaagg

SEQ ID NO: 1557663 - RNA, 16 nt, Human adenovirus C
agcaguuccaggcggu

SEQ ID NO: 1557664 - RNA, 23 nt, Human adenovirus C
cagaccgucugaagacaccuuca

SEQ ID NO: 1557665 - RNA, 21 nt, Human adenovirus C
cagggaagaaacucuggugac

SEQ ID NO: 1557666 - RNA, 14 nt, Human adenovirus C
cacuuacuggcugc

SEQ ID NO: 1557667 - RNA, 15 nt, Human adenovirus C
cgcacccgccccccg

SEQ ID NO: 1557668 - RNA, 14 nt, Human adenovirus C
uucaucccugugga

SEQ ID NO: 1557669 - RNA, 14 nt, Human adenovirus C
caucucuacagccc

SEQ ID NO: 1557670 - RNA, 14 nt, Human adenovirus C
cugcagagccagcc

SEQ ID NO: 1557671 - RNA, 19 nt, Human adenovirus C
cugaggcccgaucacuugg

SEQ ID NO: 1557672 - RNA, 14 nt, Human adenovirus C
gagcgagguguggg

SEQ ID NO: 1557673 - RNA, 15 nt, Human adenovirus C
cggcgcugcagagcc

SEQ ID NO: 1557674 - RNA, 11 nt, Human adenovirus C
gaaagcuaaag

SEQ ID NO: 1557675 - RNA, 14 nt, Human adenovirus C
cagacaaugcagaa

SEQ ID NO: 1557676 - RNA, 18 nt, Human adenovirus C
caccuacgaugaccugga

SEQ ID NO: 1557677 - RNA, 23 nt, Human adenovirus C
gguaguuaagagagcugcagcug

SEQ ID NO: 1557678 - RNA, 17 nt, Human adenovirus C
gcuacaacguagcucag

SEQ ID NO: 1557679 - RNA, 20 nt, Human adenovirus C
cugcagggaagaccucgcac

SEQ ID NO: 1557680 - RNA, 20 nt, Human adenovirus C
gcuccucaggcgccgccggc

SEQ ID NO: 1557681 - RNA, 14 nt, Human adenovirus C
cacgucgcaccggc

SEQ ID NO: 1557682 - RNA, 17 nt, Human adenovirus C
cuuauccucaucugcag

SEQ ID NO: 1557683 - RNA, 15 nt, Human adenovirus C
gacacaugucgcccu

SEQ ID NO: 1557684 - RNA, 18 nt, Human adenovirus C
gacgcggugguggaggag

SEQ ID NO: 1557685 - RNA, 18 nt, Human adenovirus C
gaaaccucaccucccaaa

SEQ ID NO: 1557686 - RNA, 14 nt, Human adenovirus C
gcgcgucggccagg

SEQ ID NO: 1557687 - RNA, 17 nt, Human adenovirus C
cauggccggccacggcc

SEQ ID NO: 1557688 - RNA, 17 nt, Human adenovirus C
ccucuuguccugcaucu

SEQ ID NO: 1557689 - RNA, 15 nt, Human adenovirus C
acugcuaaaaauaac

SEQ ID NO: 1557690 - RNA, 20 nt, Human adenovirus C
ugcgcaggagcacagggaug

SEQ ID NO: 1557691 - RNA, 22 nt, Human adenovirus C
auguucucuucuuuuacaguau

SEQ ID NO: 1557692 - RNA, 20 nt, Human adenovirus C
gagcugaugcacagccugca

SEQ ID NO: 1557693 - RNA, 21 nt, Human adenovirus C
ucgagacgccgccucagccgc

SEQ ID NO: 1557694 - RNA, 17 nt, Human adenovirus C
ggaucuuaugccaggcc

SEQ ID NO: 1557695 - RNA, 17 nt, Human adenovirus C
caggcggucggccaugc

SEQ ID NO: 1557696 - RNA, 12 nt, Human adenovirus C
cucccgguacca

SEQ ID NO: 1557697 - RNA, 16 nt, Human adenovirus C
ccgggcuggugcaguu

SEQ ID NO: 1557698 - RNA, 13 nt, Human adenovirus C
gaccaaagcaaac

SEQ ID NO: 1557699 - RNA, 20 nt, Human adenovirus C
uaccggcaaccgccucagcu

SEQ ID NO: 1557700 - RNA, 13 nt, Human adenovirus C
uauguucccagcc

SEQ ID NO: 1557701 - RNA, 13 nt, Human adenovirus C
ucauccaugacag

SEQ ID NO: 1557702 - RNA, 17 nt, Human adenovirus C
gcauuggaacucuacaa

SEQ ID NO: 1557703 - RNA, 22 nt, Human adenovirus C
uggcccacaacacggccuccac

SEQ ID NO: 1557704 - RNA, 23 nt, Human adenovirus C
ccuuccgcuccacgagccagauc

SEQ ID NO: 1557705 - RNA, 22 nt, Human adenovirus C
ccaccgcaaugcgggccuccgu

SEQ ID NO: 1557706 - RNA, 23 nt, Human adenovirus C
ggccggaccugggcuggcggugg

SEQ ID NO: 1557707 - RNA, 23 nt, Human adenovirus C
caauuucggugucguugacggcg

SEQ ID NO: 1557708 - RNA, 17 nt, Human adenovirus C
ugcgggccaugagcugc

SEQ ID NO: 1557709 - RNA, 18 nt, Human adenovirus C
gcaggacccuggugcugc

SEQ ID NO: 1557710 - RNA, 23 nt, Human adenovirus C
cgcaucuugcgcuaugugcagca

SEQ ID NO: 1557711 - RNA, 17 nt, Human adenovirus C
ccccaaacucccaugga

SEQ ID NO: 1557712 - RNA, 20 nt, Human adenovirus C
gcaacccgcggugcuccucg

SEQ ID NO: 1557713 - RNA, 19 nt, Human adenovirus C
gagagggggcaggggcacg

SEQ ID NO: 1557714 - RNA, 15 nt, Human adenovirus C
ucaaacccagcuuca

SEQ ID NO: 1557715 - RNA, 16 nt, Human adenovirus C
ccagcgccugcacugc

SEQ ID NO: 1557716 - RNA, 15 nt, Human adenovirus C
ugcacgucuccugag

SEQ ID NO: 1557717 - RNA, 15 nt, Human adenovirus C
cugcgacgcguugca

SEQ ID NO: 1557718 - RNA, 19 nt, Human adenovirus C
ugcccuacauccuuccauc

SEQ ID NO: 1557719 - RNA, 20 nt, Human adenovirus C
cgaagcuauguccaagcgca

SEQ ID NO: 1557720 - RNA, 23 nt, Human adenovirus C
uaccugcuggauuuucuggccau

SEQ ID NO: 1557721 - RNA, 19 nt, Human adenovirus C
acugcgccugacacaccuc

SEQ ID NO: 1557722 - RNA, 22 nt, Human adenovirus C
acaaagcgcgguucacccuggc

SEQ ID NO: 1557723 - RNA, 14 nt, Human adenovirus C
uacuuaaaaucagu

SEQ ID NO: 1557724 - RNA, 13 nt, Human adenovirus C
ggauggcgcaggc

SEQ ID NO: 1557725 - RNA, 17 nt, Human adenovirus C
uuacugcugcuggaagg

SEQ ID NO: 1557726 - RNA, 21 nt, Human adenovirus C
gucagccgcgcgcuggggcag

SEQ ID NO: 1557727 - RNA, 15 nt, Human adenovirus C
ccggcgccagcaccu

SEQ ID NO: 1557728 - RNA, 23 nt, Human adenovirus C
caccgugcagcugaugguaccca

SEQ ID NO: 1557729 - RNA, 19 nt, Human adenovirus C
cagagaagaacaugccgca

SEQ ID NO: 1557730 - RNA, 12 nt, Human adenovirus C
ugaccagcucgg

SEQ ID NO: 1557731 - RNA, 17 nt, Human adenovirus C
ugcgcgagggacaggcu

SEQ ID NO: 1557732 - RNA, 20 nt, Human adenovirus C
cuagccauauauccauaccu

SEQ ID NO: 1557733 - RNA, 18 nt, Human adenovirus C
aggaggacuuugagcccg

SEQ ID NO: 1557734 - RNA, 19 nt, Human adenovirus C
ugcuuaaaagccaccugag

SEQ ID NO: 1557735 - RNA, 13 nt, Human adenovirus C
ugacggcgcggcc

SEQ ID NO: 1557736 - RNA, 21 nt, Human adenovirus C
cagacuauuuuuuccagacca

SEQ ID NO: 1557737 - RNA, 12 nt, Human adenovirus C
gccuggaggcaa

SEQ ID NO: 1557738 - RNA, 21 nt, Human adenovirus C
ccugcgccguagcgccauugc

SEQ ID NO: 1557739 - RNA, 19 nt, Human adenovirus C
ucccccguaacauccugca

SEQ ID NO: 1557740 - RNA, 22 nt, Human adenovirus C
gccugcugaaugcgcaggcggu

SEQ ID NO: 1557741 - RNA, 13 nt, Human adenovirus C
uaauucaccaccu

SEQ ID NO: 1557742 - RNA, 15 nt, Human adenovirus C
acgcagcaccuugcg

SEQ ID NO: 1557743 - RNA, 15 nt, Human adenovirus C
cgccaugggcuccag

SEQ ID NO: 1557744 - RNA, 19 nt, Human adenovirus C
ggcgauccuaacucugcag

SEQ ID NO: 1557745 - RNA, 16 nt, Human adenovirus C
gucauaccacugcaac

SEQ ID NO: 1557746 - RNA, 22 nt, Human adenovirus C
uucugaucagaugaugcaagac

SEQ ID NO: 1557747 - RNA, 18 nt, Human adenovirus C
acucgagacgccgccuca

SEQ ID NO: 1557748 - RNA, 22 nt, Human adenovirus C
gccgucgccagcccgugcuggc

SEQ ID NO: 1557749 - RNA, 12 nt, Human adenovirus C
cguaggugagcu

SEQ ID NO: 1557750 - RNA, 20 nt, Human adenovirus C
aacagcgccaaggcuaccgc

SEQ ID NO: 1557751 - RNA, 13 nt, Human adenovirus C
ucuccugcacguc

SEQ ID NO: 1557752 - RNA, 13 nt, Human adenovirus C
gaggauagggugg

SEQ ID NO: 1557753 - RNA, 20 nt, Human adenovirus C
cuuuuauguauaaauuucca

SEQ ID NO: 1557754 - RNA, 22 nt, Human adenovirus C
gcgacaggucaggcgggagcuc

SEQ ID NO: 1557755 - RNA, 20 nt, Human adenovirus C
cggcgcaccgggaggcgguc

SEQ ID NO: 1557756 - RNA, 13 nt, Human adenovirus C
ggugcgcggagcc

SEQ ID NO: 1557757 - RNA, 19 nt, Human adenovirus C
aaaacuacgucuuaaacug

SEQ ID NO: 1557758 - RNA, 17 nt, Human adenovirus C
ugccgccgccgccaccc

SEQ ID NO: 1557759 - RNA, 18 nt, Human adenovirus C
gaggcaaacgaggaacaa

SEQ ID NO: 1557760 - RNA, 13 nt, Human adenovirus C
uggugggcgccga

SEQ ID NO: 1557761 - RNA, 20 nt, Human adenovirus C
ccguuggagacugcagccuc

SEQ ID NO: 1557762 - RNA, 20 nt, Human adenovirus C
aaagcgcgggcggagggugc

SEQ ID NO: 1557763 - RNA, 16 nt, Human adenovirus C
gcgcccuggaggcagc

SEQ ID NO: 1557764 - RNA, 14 nt, Human adenovirus C
cggcgccagcaccu

SEQ ID NO: 1557765 - RNA, 13 nt, Human adenovirus C
guacccaacucca

SEQ ID NO: 1557766 - RNA, 21 nt, Human adenovirus C
auggcagcaaggccuggaaca

SEQ ID NO: 1557767 - RNA, 12 nt, Human adenovirus C
ugcugggccagc

SEQ ID NO: 1557768 - RNA, 17 nt, Human adenovirus C
ucuuggccuugcuagac

SEQ ID NO: 1557769 - RNA, 23 nt, Human adenovirus C
ccgcgcgcgcacacguggcggcc

SEQ ID NO: 1557770 - RNA, 23 nt, Human adenovirus C
gcuacaacguagcucagugcaac

SEQ ID NO: 1557771 - RNA, 14 nt, Human adenovirus C
cgcaccugccccua

SEQ ID NO: 1557772 - RNA, 12 nt, Human adenovirus C
ugcgcuuuucug

SEQ ID NO: 1557773 - RNA, 13 nt, Human adenovirus C
aggagcugaggcc

SEQ ID NO: 1557774 - RNA, 13 nt, Human adenovirus C
ccggcccaggggc

SEQ ID NO: 1557775 - RNA, 17 nt, Human adenovirus C
agcuugcccuuggagga

SEQ ID NO: 1557776 - RNA, 16 nt, Human adenovirus C
ugcccgccaccugcug

SEQ ID NO: 1557777 - RNA, 16 nt, Human adenovirus C
ugaaaauaaaaaacag

SEQ ID NO: 1557778 - RNA, 17 nt, Human adenovirus C
cgacgcguugcaagagc

SEQ ID NO: 1557779 - RNA, 16 nt, Human adenovirus C
cugcgcucccucaccc

SEQ ID NO: 1557780 - RNA, 18 nt, Human adenovirus C
caggccgucuacucccag

SEQ ID NO: 1557781 - RNA, 18 nt, Human adenovirus C
cagaccguaaaccugagc

SEQ ID NO: 1557782 - RNA, 15 nt, Human adenovirus C
aauuuuucuggaauu

SEQ ID NO: 1557783 - RNA, 23 nt, Human adenovirus C
uccgcaagcggcaacccuuccag

SEQ ID NO: 1557784 - RNA, 15 nt, Human adenovirus C
aggaggcacuaaagc

SEQ ID NO: 1557785 - RNA, 16 nt, Human adenovirus C
ucgcucccaccaugcg

SEQ ID NO: 1557786 - RNA, 17 nt, Human adenovirus C
uucugccacgaagaagu

SEQ ID NO: 1557787 - RNA, 12 nt, Human adenovirus C
gcgcuccauggc

SEQ ID NO: 1557788 - RNA, 23 nt, Human adenovirus C
aacaugguucugcagagcucucu

SEQ ID NO: 1557789 - RNA, 20 nt, Human adenovirus C
caaaccgaagauagcggccg

SEQ ID NO: 1557790 - RNA, 18 nt, Human adenovirus C
ggacccuggugcugccaa

SEQ ID NO: 1557791 - RNA, 23 nt, Human adenovirus C
auacugggacagucaggcagagg

SEQ ID NO: 1557792 - RNA, 14 nt, Human adenovirus C
cgucuagggcgcag

SEQ ID NO: 1557793 - RNA, 19 nt, Human adenovirus C
accgcgcacgucgcaccgg

SEQ ID NO: 1557794 - RNA, 15 nt, Human adenovirus C
uggaggaggcgccgc

SEQ ID NO: 1557795 - RNA, 13 nt, Human adenovirus C
ugagccuggcuga

SEQ ID NO: 1557796 - RNA, 15 nt, Human adenovirus C
gcggaggagaagcgc

SEQ ID NO: 1557797 - RNA, 22 nt, Human adenovirus C
aaaaugggcagcggucuuaccc

SEQ ID NO: 1557798 - RNA, 19 nt, Human adenovirus C
cuccacuuaaacucaggca

SEQ ID NO: 1557799 - RNA, 23 nt, Human adenovirus C
ucaaauauggaacauucccagcu

SEQ ID NO: 1557800 - RNA, 15 nt, Human adenovirus C
auaaggugggggucu

SEQ ID NO: 1557801 - RNA, 14 nt, Human adenovirus C
cccgggaccagcgg

SEQ ID NO: 1557802 - RNA, 16 nt, Human adenovirus C
gggcguguggcagcaa

SEQ ID NO: 1557803 - RNA, 13 nt, Human adenovirus C
aaagucaaacaua

SEQ ID NO: 1557804 - RNA, 13 nt, Human adenovirus C
gcgggguggugga

SEQ ID NO: 1557805 - RNA, 14 nt, Human adenovirus C
cuccaugcccuucu

SEQ ID NO: 1557806 - RNA, 19 nt, Human adenovirus C
cacaccucgaccacugccg

SEQ ID NO: 1557807 - RNA, 17 nt, Human adenovirus C
ugccagacaugaugcaa

SEQ ID NO: 1557808 - RNA, 20 nt, Human adenovirus C
agcgcaaccuaaaggagcug

SEQ ID NO: 1557809 - RNA, 16 nt, Human adenovirus C
gcuccuaacuccugug

SEQ ID NO: 1557810 - RNA, 12 nt, Human adenovirus C
acgcgccagacc

SEQ ID NO: 1557811 - RNA, 14 nt, Human adenovirus C
cuauguaaacuccu

SEQ ID NO: 1557812 - RNA, 14 nt, Human adenovirus C
agcuugaucugcug

SEQ ID NO: 1557813 - RNA, 14 nt, Human adenovirus C
augagguacaugau

SEQ ID NO: 1557814 - RNA, 22 nt, Human adenovirus C
aagaccauucacguagccagcc

SEQ ID NO: 1557815 - RNA, 14 nt, Human adenovirus C
ucgucauaggccau

SEQ ID NO: 1557816 - RNA, 14 nt, Human adenovirus C
cgcgcgucgcaccg

SEQ ID NO: 1557817 - RNA, 13 nt, Human adenovirus C
aucuccuaacugc

SEQ ID NO: 1557818 - RNA, 14 nt, Human adenovirus C
cccuggugcugcca

SEQ ID NO: 1557819 - RNA, 19 nt, Human adenovirus C
cagacuauuuuuuccagac

SEQ ID NO: 1557820 - RNA, 17 nt, Human adenovirus C
gagggaccugagcgagu

SEQ ID NO: 1557821 - RNA, 16 nt, Human adenovirus C
guguggcaacugcgag

SEQ ID NO: 1557822 - RNA, 20 nt, Human adenovirus C
acgucaucuccagcggccac

SEQ ID NO: 1557823 - RNA, 18 nt, Human adenovirus C
cgguugccucggcggugg

SEQ ID NO: 1557824 - RNA, 21 nt, Human adenovirus C
cgguccuuugcaaguagcaca

SEQ ID NO: 1557825 - RNA, 15 nt, Human adenovirus C
gugaccuuccgcucc

SEQ ID NO: 1557826 - RNA, 17 nt, Human adenovirus C
aaagacaaucuuuuugu

SEQ ID NO: 1557827 - RNA, 16 nt, Human adenovirus C
ccgugcuuucacuuuc

SEQ ID NO: 1557828 - RNA, 21 nt, Human adenovirus C
ugacaaggucaacgcuggugg

SEQ ID NO: 1557829 - RNA, 15 nt, Human adenovirus C
caccgggacugggcg

SEQ ID NO: 1557830 - RNA, 22 nt, Human adenovirus C
uggcgguagugggucuagcugc

SEQ ID NO: 1557831 - RNA, 13 nt, Human adenovirus C
agccggcggcgcg

SEQ ID NO: 1557832 - RNA, 21 nt, Human adenovirus C
caaccuccgcuccucaggcgc

SEQ ID NO: 1557833 - RNA, 23 nt, Human adenovirus C
gcggccauucagaccguggugcg

SEQ ID NO: 1557834 - RNA, 17 nt, Human adenovirus C
acagcgaggaggagcgc

SEQ ID NO: 1557835 - RNA, 14 nt, Human adenovirus C
cgcaacaccacugc

SEQ ID NO: 1557836 - RNA, 13 nt, Human adenovirus C
cggcgggcggugg

SEQ ID NO: 1557837 - RNA, 16 nt, Human adenovirus C
augccauagaugccau

SEQ ID NO: 1557838 - RNA, 17 nt, Human adenovirus C
ugguacuucccagagac

SEQ ID NO: 1557839 - RNA, 22 nt, Human adenovirus C
cugacaaccccaacaccuacga

SEQ ID NO: 1557840 - RNA, 23 nt, Human adenovirus C
gagcccgagguccgcgugcggcc

SEQ ID NO: 1557841 - RNA, 15 nt, Human adenovirus C
agaccaguagacaag

SEQ ID NO: 1557842 - RNA, 21 nt, Human adenovirus C
uugcaacagcgcgagcaggca

SEQ ID NO: 1557843 - RNA, 23 nt, Human adenovirus C
agaccgucugaagacaccuucaa

SEQ ID NO: 1557844 - RNA, 22 nt, Human adenovirus C
ggaguucacgcugcccgagggc

SEQ ID NO: 1557845 - RNA, 14 nt, Human adenovirus C
gccuggcugacaag

SEQ ID NO: 1557846 - RNA, 23 nt, Human adenovirus C
uggcauuagcggggugguggacc

SEQ ID NO: 1557847 - RNA, 13 nt, Human adenovirus C
gcgccccccuccu

SEQ ID NO: 1557848 - RNA, 16 nt, Human adenovirus C
acauaaacuauaacag

SEQ ID NO: 1557849 - RNA, 18 nt, Human adenovirus C
gcagccacaacgcgcagc

SEQ ID NO: 1557850 - RNA, 18 nt, Human adenovirus C
cuccuuugucuggagaaa

SEQ ID NO: 1557851 - RNA, 16 nt, Human adenovirus C
cgaugauucgcaccgc

SEQ ID NO: 1557852 - RNA, 17 nt, Human adenovirus C
agcggcaacccuuccag

SEQ ID NO: 1557853 - RNA, 17 nt, Human adenovirus C
cagaaggugaccgugcc

SEQ ID NO: 1557854 - RNA, 17 nt, Human adenovirus C
gcgcucaaaaacaugcu

SEQ ID NO: 1557855 - RNA, 18 nt, Human adenovirus C
gagccccgggcuggugca

SEQ ID NO: 1557856 - RNA, 16 nt, Human adenovirus C
cugcgcacgcccuucu

SEQ ID NO: 1557857 - RNA, 13 nt, Human adenovirus C
caacgccacaaca

SEQ ID NO: 1557858 - RNA, 15 nt, Human adenovirus C
cuacauuucugggaa

SEQ ID NO: 1557859 - RNA, 17 nt, Human adenovirus C
ccgcgcgcccuggggcg

SEQ ID NO: 1557860 - RNA, 18 nt, Human adenovirus C
gucgccgucgccagcccg

SEQ ID NO: 1557861 - RNA, 17 nt, Human adenovirus C
ugcccuucucccacgca

SEQ ID NO: 1557862 - RNA, 14 nt, Human adenovirus C
cugcugcagccgca

SEQ ID NO: 1557863 - RNA, 22 nt, Human adenovirus C
gagcugcccaagacuacucaac

SEQ ID NO: 1557864 - RNA, 18 nt, Human adenovirus C
ugacgcguuccggcagca

SEQ ID NO: 1557865 - RNA, 12 nt, Human adenovirus C
cagcaggaggaa

SEQ ID NO: 1557866 - RNA, 15 nt, Human adenovirus C
gcgacgaaugagcuc

SEQ ID NO: 1557867 - RNA, 20 nt, Human adenovirus C
cauagcggaugucagccuug

SEQ ID NO: 1557868 - RNA, 19 nt, Human adenovirus C
agccuccaugcccuucucc

SEQ ID NO: 1557869 - RNA, 20 nt, Human adenovirus C
augucguuucucagcagcug

SEQ ID NO: 1557870 - RNA, 16 nt, Human adenovirus C
cuauguucccagccau

SEQ ID NO: 1557871 - RNA, 22 nt, Human adenovirus C
aacuauggcagcaaggccugga

SEQ ID NO: 1557872 - RNA, 22 nt, Human adenovirus C
cggcgccgcgcgcgggcaggag

SEQ ID NO: 1557873 - RNA, 19 nt, Human adenovirus C
cugcaacagguuauugccc

SEQ ID NO: 1557874 - RNA, 23 nt, Human adenovirus C
gcgcgucccugcgccgugccgcc

SEQ ID NO: 1557875 - RNA, 17 nt, Human adenovirus C
caggguauaacucaccu

SEQ ID NO: 1557876 - RNA, 12 nt, Human adenovirus C
ccaccacuggaa

SEQ ID NO: 1557877 - RNA, 22 nt, Human adenovirus C
uuaaaaacaaguugcaugugga

SEQ ID NO: 1557878 - RNA, 18 nt, Human adenovirus C
gcucuugucggagaucag

SEQ ID NO: 1557879 - RNA, 18 nt, Human adenovirus C
accauccuaaaccagcug

SEQ ID NO: 1557880 - RNA, 22 nt, Human adenovirus C
guaaaguuccaagaagcgcggg

SEQ ID NO: 1557881 - RNA, 15 nt, Human adenovirus C
auccgcaagcggcaa

SEQ ID NO: 1557882 - RNA, 14 nt, Human adenovirus C
ucagagaagaacau

SEQ ID NO: 1557883 - RNA, 13 nt, Human adenovirus C
ccaaagcaaaccu

SEQ ID NO: 1557884 - RNA, 14 nt, Human adenovirus C
aggcgcauguggac

SEQ ID NO: 1557885 - RNA, 23 nt, Human adenovirus C
cggcuuucgcuguacggcaguag

SEQ ID NO: 1557886 - RNA, 17 nt, Human adenovirus C
ucaugcugcgggguggu

SEQ ID NO: 1557887 - RNA, 13 nt, Human adenovirus C
cggucggccaugc

SEQ ID NO: 1557888 - RNA, 14 nt, Human adenovirus C
ccggagcgaggugu

SEQ ID NO: 1557889 - RNA, 17 nt, Human adenovirus C
acaaugaaaaaauucau

SEQ ID NO: 1557890 - RNA, 17 nt, Human adenovirus C
acgggcagccuggaggc

SEQ ID NO: 1557891 - RNA, 15 nt, Human adenovirus C
gacacgggcagccug

SEQ ID NO: 1557892 - RNA, 23 nt, Human adenovirus C
ccugguaaccgcguacgagcaga

SEQ ID NO: 1557893 - RNA, 14 nt, Human adenovirus C
cuacgacuacauga

SEQ ID NO: 1557894 - RNA, 16 nt, Human adenovirus C
caaaauaaaaagucug

SEQ ID NO: 1557895 - RNA, 12 nt, Human adenovirus C
uuguccagcuua

SEQ ID NO: 1557896 - RNA, 15 nt, Human adenovirus C
cagcgccaaaaacug

SEQ ID NO: 1557897 - RNA, 20 nt, Human adenovirus C
caagauuauacccacaaccu

SEQ ID NO: 1557898 - RNA, 17 nt, Human adenovirus C
gguuccugagcagcugc

SEQ ID NO: 1557899 - RNA, 15 nt, Human adenovirus C
cagacgggccagggu

SEQ ID NO: 1557900 - RNA, 18 nt, Human adenovirus C
gaccauucacguagccag

SEQ ID NO: 1557901 - RNA, 20 nt, Human adenovirus C
cuaucguggcuacaccuacc

SEQ ID NO: 1557902 - RNA, 13 nt, Human adenovirus C
cagagcgugagcc

SEQ ID NO: 1557903 - RNA, 19 nt, Human adenovirus C
gccugcgucauuacccagg

SEQ ID NO: 1557904 - RNA, 21 nt, Human adenovirus C
accagcucaaucagucacagu

SEQ ID NO: 1557905 - RNA, 15 nt, Human adenovirus C
ccaguccgggccaga

SEQ ID NO: 1557906 - RNA, 13 nt, Human adenovirus C
cgcgcgcuggggc

SEQ ID NO: 1557907 - RNA, 20 nt, Human adenovirus C
aagugauuaucgagcaggac

SEQ ID NO: 1557908 - RNA, 22 nt, Human adenovirus C
uggcaccccuauucgacaccac

SEQ ID NO: 1557909 - RNA, 17 nt, Human adenovirus C
guagcaccacugcagag

SEQ ID NO: 1557910 - RNA, 16 nt, Human adenovirus C
gcccuccaccuucagc

SEQ ID NO: 1557911 - RNA, 20 nt, Human adenovirus C
ggcuucuacauuccagaaag

SEQ ID NO: 1557912 - RNA, 21 nt, Human adenovirus C
accgggguacccaacuccaug

SEQ ID NO: 1557913 - RNA, 16 nt, Human adenovirus C
aaccaaaguugcagga

SEQ ID NO: 1557914 - RNA, 20 nt, Human adenovirus C
ggacaaccccagacccaucu

SEQ ID NO: 1557915 - RNA, 16 nt, Human adenovirus C
ucugcagcgcugccaa

SEQ ID NO: 1557916 - RNA, 21 nt, Human adenovirus C
gcacucacagaccugggccaa

SEQ ID NO: 1557917 - RNA, 23 nt, Human adenovirus C
acuugcggcuggagcugcccaag

SEQ ID NO: 1557918 - RNA, 13 nt, Human adenovirus C
uccacgagccagg

SEQ ID NO: 1557919 - RNA, 13 nt, Human adenovirus C
cacgcuggccagc

SEQ ID NO: 1557920 - RNA, 21 nt, Human adenovirus C
aggcaggacccuggugcugcc

SEQ ID NO: 1557921 - RNA, 18 nt, Human adenovirus C
aguccccagguacagccc

SEQ ID NO: 1557922 - RNA, 14 nt, Human adenovirus C
uccccagguacagc

SEQ ID NO: 1557923 - RNA, 12 nt, Human adenovirus C
acgccaagaaaa

SEQ ID NO: 1557924 - RNA, 13 nt, Human adenovirus C
aggaggggcaaca

SEQ ID NO: 1557925 - RNA, 16 nt, Human adenovirus C
gucaucucuacagccc

SEQ ID NO: 1557926 - RNA, 18 nt, Human adenovirus C
ggagcaacagcaggagga

SEQ ID NO: 1557927 - RNA, 21 nt, Human adenovirus C
cuccguggccgcgcaccuggc

SEQ ID NO: 1557928 - RNA, 17 nt, Human adenovirus C
cacaggguugcagcacu

SEQ ID NO: 1557929 - RNA, 14 nt, Human adenovirus C
agugucaugccaaa

SEQ ID NO: 1557930 - RNA, 18 nt, Human adenovirus C
ccggcucaccacccaggu

SEQ ID NO: 1557931 - RNA, 14 nt, Human adenovirus C
caccgccagcgcac

SEQ ID NO: 1557932 - RNA, 12 nt, Human adenovirus C
caggcgggagcu

SEQ ID NO: 1557933 - RNA, 14 nt, Human adenovirus C
gucgccgccagagg

SEQ ID NO: 1557934 - RNA, 14 nt, Human adenovirus C
ccaggugcagaccc

SEQ ID NO: 1557935 - RNA, 23 nt, Human adenovirus C
cagcuagccaacuaccuugccua

SEQ ID NO: 1557936 - RNA, 20 nt, Human adenovirus C
acaugucuaugcccaggcuc

SEQ ID NO: 1557937 - RNA, 17 nt, Human adenovirus C
cauuguaaaaaucugcu

SEQ ID NO: 1557938 - RNA, 18 nt, Human adenovirus C
cuggaccaggugucaccg

SEQ ID NO: 1557939 - RNA, 21 nt, Human adenovirus C
cggaggcucucuucagcaaau

SEQ ID NO: 1557940 - RNA, 19 nt, Human adenovirus C
guggaacgaagcugaugcu

SEQ ID NO: 1557941 - RNA, 19 nt, Human adenovirus C
caaggccugcccaccaccc

SEQ ID NO: 1557942 - RNA, 23 nt, Human adenovirus C
auuugcaagacagaaacacagag

SEQ ID NO: 1557943 - RNA, 18 nt, Human adenovirus C
uagguucuacgaagacca

SEQ ID NO: 1557944 - RNA, 13 nt, Human adenovirus C
gccuguugcugcu

SEQ ID NO: 1557945 - RNA, 20 nt, Human adenovirus C
gggcugguugguggcggcgu

SEQ ID NO: 1557946 - RNA, 20 nt, Human adenovirus C
aaacuuguaaauaucaggaa

SEQ ID NO: 1557947 - RNA, 12 nt, Human adenovirus C
ccgccgccgccg

SEQ ID NO: 1557948 - RNA, 13 nt, Human adenovirus C
acccuccucaccu

SEQ ID NO: 1557949 - RNA, 15 nt, Human adenovirus C
ggugcugcggcagau

SEQ ID NO: 1557950 - RNA, 18 nt, Human adenovirus C
gcugaggccgaggcagcg

SEQ ID NO: 1557951 - RNA, 15 nt, Human adenovirus C
cgcgggcggagggug

SEQ ID NO: 1557952 - RNA, 17 nt, Human adenovirus C
ucaacaaagcaggggcc

SEQ ID NO: 1557953 - RNA, 12 nt, Human adenovirus C
gcucccaagggc

SEQ ID NO: 1557954 - RNA, 16 nt, Human adenovirus C
caagaaguugaagaca

SEQ ID NO: 1557955 - RNA, 21 nt, Human adenovirus C
acucugacaaagcccaagaaa

SEQ ID NO: 1557956 - RNA, 17 nt, Human adenovirus C
cccagcgauagcaguuc

SEQ ID NO: 1557957 - RNA, 19 nt, Human adenovirus C
gagcgcccucuccugagcg

SEQ ID NO: 1557958 - RNA, 20 nt, Human adenovirus C
guagcaagcugauugccagg

SEQ ID NO: 1557959 - RNA, 15 nt, Human adenovirus C
ucgaaggcuggccgc

SEQ ID NO: 1557960 - RNA, 21 nt, Human adenovirus C
uuaaguauaugagcaauucaa

SEQ ID NO: 1557961 - RNA, 21 nt, Human adenovirus C
cacugugguacuucccagaga

SEQ ID NO: 1557962 - RNA, 14 nt, Human adenovirus C
uguuauauuccaca

SEQ ID NO: 1557963 - RNA, 14 nt, Human adenovirus C
agcgggguggugga

SEQ ID NO: 1557964 - RNA, 17 nt, Human adenovirus C
cgcgccuaccaccuucc

SEQ ID NO: 1557965 - RNA, 18 nt, Human adenovirus C
cgcugcgucuggcgccca

SEQ ID NO: 1557966 - RNA, 14 nt, Human adenovirus C
gcugauugccaggg

SEQ ID NO: 1557967 - RNA, 22 nt, Human adenovirus C
cuugccuacgaacgccaccugu

SEQ ID NO: 1557968 - RNA, 14 nt, Human adenovirus C
aacacaagcuaaac

SEQ ID NO: 1557969 - RNA, 12 nt, Human adenovirus C
agauccgcgucc

SEQ ID NO: 1557970 - RNA, 19 nt, Human adenovirus C
gcccagcaauaacacaggc

SEQ ID NO: 1557971 - RNA, 15 nt, Human adenovirus C
caggguccagaggac

SEQ ID NO: 1557972 - RNA, 12 nt, Human adenovirus C
ccaagcgccagc

SEQ ID NO: 1557973 - RNA, 18 nt, Human adenovirus C
ugcgucauuacccagggc

SEQ ID NO: 1557974 - RNA, 23 nt, Human adenovirus C
ucagaaacuuccagcccaugagc

SEQ ID NO: 1557975 - RNA, 13 nt, Human adenovirus C
acauuccagcacc

SEQ ID NO: 1557976 - RNA, 15 nt, Human adenovirus C
gcugggcguggugcc

SEQ ID NO: 1557977 - RNA, 17 nt, Human adenovirus C
acagagcgaguauauau

SEQ ID NO: 1557978 - RNA, 13 nt, Human adenovirus C
ccagcagaggcgg

SEQ ID NO: 1557979 - RNA, 14 nt, Human adenovirus C
ugcugagccgccgu

SEQ ID NO: 1557980 - RNA, 23 nt, Human adenovirus C
auuaaacauggcgccauccacca

SEQ ID NO: 1557981 - RNA, 22 nt, Human adenovirus C
accuugagcgacgaccugggcg

SEQ ID NO: 1557982 - RNA, 17 nt, Human adenovirus C
cuggcggaggugcugcu

SEQ ID NO: 1557983 - RNA, 19 nt, Human adenovirus C
ccgcaggccaagcagcuug

SEQ ID NO: 1557984 - RNA, 23 nt, Human adenovirus C
augcgccccccuccucagcagcg

SEQ ID NO: 1557985 - RNA, 19 nt, Human adenovirus C
cuucauuuguaauuuacaa

SEQ ID NO: 1557986 - RNA, 12 nt, Human adenovirus C
aagccuggaccg

SEQ ID NO: 1557987 - RNA, 16 nt, Human adenovirus C
ccaccuucagccucaa

SEQ ID NO: 1557988 - RNA, 23 nt, Human adenovirus C
uuccauaggugauagaaccagau

SEQ ID NO: 1557989 - RNA, 23 nt, Human adenovirus C
acgcgcggcaaacgcucugcaac

SEQ ID NO: 1557990 - RNA, 14 nt, Human adenovirus C
cgcgcgcgggcagg

SEQ ID NO: 1557991 - RNA, 17 nt, Human adenovirus C
cgccgcuuucuucucua

SEQ ID NO: 1557992 - RNA, 22 nt, Human adenovirus C
ugcagaccguaaaccugagcca

SEQ ID NO: 1557993 - RNA, 18 nt, Human adenovirus C
uaacaugguguguggcaa

SEQ ID NO: 1557994 - RNA, 20 nt, Human adenovirus C
gcugacacuguaccgcgagg

SEQ ID NO: 1557995 - RNA, 18 nt, Human adenovirus C
ugcgcuguaccugccaga

SEQ ID NO: 1557996 - RNA, 19 nt, Human adenovirus C
gaugagguguacggcgacg

SEQ ID NO: 1557997 - RNA, 18 nt, Human adenovirus C
agaagcaccauguccuug

SEQ ID NO: 1557998 - RNA, 20 nt, Human adenovirus C
ggcccgcggugaugccuuug

SEQ ID NO: 1557999 - RNA, 18 nt, Human adenovirus C
gcacucacagaccugggc

SEQ ID NO: 1558000 - RNA, 21 nt, Human adenovirus C
gcuggaaaaguccacccaaag

SEQ ID NO: 1558001 - RNA, 12 nt, Human adenovirus C
cgcucccucacc

SEQ ID NO: 1558002 - RNA, 13 nt, Human adenovirus C
aagcuacccaccc

SEQ ID NO: 1558003 - RNA, 22 nt, Human adenovirus C
cggagucaacuuugguagcugc

SEQ ID NO: 1558004 - RNA, 20 nt, Human adenovirus C
uccucaaaucuucacuuccg

SEQ ID NO: 1558005 - RNA, 18 nt, Human adenovirus C
augguacccaagcgccag

SEQ ID NO: 1558006 - RNA, 22 nt, Human adenovirus C
ccucaggcgccgccggcacugc

SEQ ID NO: 1558007 - RNA, 15 nt, Human adenovirus C
ggcggggggcugccg

SEQ ID NO: 1558008 - RNA, 15 nt, Human adenovirus C
agccacacccagcca

SEQ ID NO: 1558009 - RNA, 15 nt, Human adenovirus C
acagcugccgccaug

SEQ ID NO: 1558010 - RNA, 13 nt, Human adenovirus C
cgcggccgcacug

SEQ ID NO: 1558011 - RNA, 17 nt, Human adenovirus C
cgaaagcuaaagcgggu

SEQ ID NO: 1558012 - RNA, 17 nt, Human adenovirus C
gcagaccaaccuggacc

SEQ ID NO: 1558013 - RNA, 14 nt, Human adenovirus C
ugucagauggaaag

SEQ ID NO: 1558014 - RNA, 17 nt, Human adenovirus C
cagcauugauggucgcc

SEQ ID NO: 1558015 - RNA, 23 nt, Human adenovirus C
gcuucuaaauagcuaacgugucg

SEQ ID NO: 1558016 - RNA, 13 nt, Human adenovirus C
cagcagcagggca

SEQ ID NO: 1558017 - RNA, 19 nt, Human adenovirus C
cagcccgggggaggcaagc

SEQ ID NO: 1558018 - RNA, 19 nt, Human adenovirus C
ccaggcuccuuugucugga

SEQ ID NO: 1558019 - RNA, 16 nt, Human adenovirus C
acggcgaguacuaagc

SEQ ID NO: 1558020 - RNA, 18 nt, Human adenovirus C
ccgaccaacacccagugc

SEQ ID NO: 1558021 - RNA, 22 nt, Human adenovirus C
ucuguguaguaguuguaguaua

SEQ ID NO: 1558022 - RNA, 22 nt, Human adenovirus C
cucgccuucgaucucagcgcag

SEQ ID NO: 1558023 - RNA, 20 nt, Human adenovirus C
caaagacaaaauuggcaagu

SEQ ID NO: 1558024 - RNA, 13 nt, Human adenovirus C
uuacuguaacugc

SEQ ID NO: 1558025 - RNA, 17 nt, Human adenovirus C
guugacggggagggcua

SEQ ID NO: 1558026 - RNA, 21 nt, Human adenovirus C
cguagguggcgcccucuuccu

SEQ ID NO: 1558027 - RNA, 11 nt, Human adenovirus C
aaagcgcgggc

SEQ ID NO: 1558028 - RNA, 19 nt, Human adenovirus C
ggguggugcacgcuggcca

SEQ ID NO: 1558029 - RNA, 16 nt, Human adenovirus C
cacuuacuggcugcag

SEQ ID NO: 1558030 - RNA, 17 nt, Human adenovirus C
aacauucugcagagcau

SEQ ID NO: 1558031 - RNA, 15 nt, Human adenovirus C
ccacaccuacagccu

SEQ ID NO: 1558032 - RNA, 15 nt, Human adenovirus C
uacugacgccagacg

SEQ ID NO: 1558033 - RNA, 23 nt, Human adenovirus C
gcaccagcucaaucagucacagu

SEQ ID NO: 1558034 - RNA, 13 nt, Human adenovirus C
acgagcauacuuu

SEQ ID NO: 1558035 - RNA, 18 nt, Human adenovirus C
uaguuuuguaucuguuuu

SEQ ID NO: 1558036 - RNA, 14 nt, Human adenovirus C
cuacccacccagcg

SEQ ID NO: 1558037 - RNA, 15 nt, Human adenovirus C
ugcgcuccgggcugc

SEQ ID NO: 1558038 - RNA, 12 nt, Human adenovirus C
cuacaccuaccg

SEQ ID NO: 1558039 - RNA, 18 nt, Human adenovirus C
guuggcggggggcugccg

SEQ ID NO: 1558040 - RNA, 20 nt, Human adenovirus C
cccguucaugggaaacuggc

SEQ ID NO: 1558041 - RNA, 20 nt, Human adenovirus C
aagaucuugguugugggcca

SEQ ID NO: 1558042 - RNA, 18 nt, Human adenovirus C
ggcucuagcgaugaagau

SEQ ID NO: 1558043 - RNA, 19 nt, Human adenovirus C
aucugggucaccaggcgcu

SEQ ID NO: 1558044 - RNA, 23 nt, Human adenovirus C
uuuccaggggcugguugguggcg

SEQ ID NO: 1558045 - RNA, 17 nt, Human adenovirus C
aggccaagcagcuuguc

SEQ ID NO: 1558046 - RNA, 21 nt, Human adenovirus C
gcccuuggaggaggcgccgca

SEQ ID NO: 1558047 - RNA, 18 nt, Human adenovirus C
ggucagggcgcgggcuag

SEQ ID NO: 1558048 - RNA, 19 nt, Human adenovirus C
ccacuuaaacucaggcaca

SEQ ID NO: 1558049 - RNA, 15 nt, Human adenovirus C
cgcaaccgcagaccc

SEQ ID NO: 1558050 - RNA, 21 nt, Human adenovirus C
cacacgggcggaggagaagcg

SEQ ID NO: 1558051 - RNA, 12 nt, Human adenovirus C
gaggugagcuca

SEQ ID NO: 1558052 - RNA, 15 nt, Human adenovirus C
cgcgugucgaaccca

SEQ ID NO: 1558053 - RNA, 18 nt, Human adenovirus C
cguggccgcgcaccuggc

SEQ ID NO: 1558054 - RNA, 20 nt, Human adenovirus C
cggcagacaugcagggcacc

SEQ ID NO: 1558055 - RNA, 15 nt, Human adenovirus C
caacagcgccaaggc

SEQ ID NO: 1558056 - RNA, 15 nt, Human adenovirus C
augaccaccugcgcg

SEQ ID NO: 1558057 - RNA, 17 nt, Human adenovirus C
ccgggcgaagacggcgu

SEQ ID NO: 1558058 - RNA, 17 nt, Human adenovirus C
gccgucaucccugagca

SEQ ID NO: 1558059 - RNA, 20 nt, Human adenovirus C
aacagcgaaaaugaaaguca

SEQ ID NO: 1558060 - RNA, 15 nt, Human adenovirus C
accgcagacccugcu

SEQ ID NO: 1558061 - RNA, 20 nt, Human adenovirus C
gaacaagcgagugguggcuc

SEQ ID NO: 1558062 - RNA, 13 nt, Human adenovirus C
caaauauggaaca

SEQ ID NO: 1558063 - RNA, 13 nt, Human adenovirus C
acgcacgaaggag

SEQ ID NO: 1558064 - RNA, 13 nt, Human adenovirus C
aaaacuaaaauug

SEQ ID NO: 1558065 - RNA, 13 nt, Human adenovirus C
caccaccgccucc

SEQ ID NO: 1558066 - RNA, 17 nt, Human adenovirus C
cccgccgccgcagcccu

SEQ ID NO: 1558067 - RNA, 20 nt, Human adenovirus C
cgugaagacgacgggcccgg

SEQ ID NO: 1558068 - RNA, 21 nt, Human adenovirus C
gcucccucacccgcagcugcc

SEQ ID NO: 1558069 - RNA, 13 nt, Human adenovirus C
gcggcgugcugga

SEQ ID NO: 1558070 - RNA, 22 nt, Human adenovirus C
uggccaauugcaagccaucaac

SEQ ID NO: 1558071 - RNA, 18 nt, Human adenovirus C
augaagggcacgagcugc

SEQ ID NO: 1558072 - RNA, 19 nt, Human adenovirus C
cuacucuuauaaaaugcac

SEQ ID NO: 1558073 - RNA, 11 nt, Human adenovirus C
cugugcugcca

SEQ ID NO: 1558074 - RNA, 19 nt, Human adenovirus C
cagcggcaacgugcagacc

SEQ ID NO: 1558075 - RNA, 19 nt, Human adenovirus C
uuacaacagcggcaacgug

SEQ ID NO: 1558076 - RNA, 11 nt, Human adenovirus C
ggaggaggcgc

SEQ ID NO: 1558077 - RNA, 14 nt, Human adenovirus C
cccagcggucccau

SEQ ID NO: 1558078 - RNA, 22 nt, Human adenovirus C
cuagcgccugcugccaugcgcg

SEQ ID NO: 1558079 - RNA, 15 nt, Human adenovirus C
ggccuuugccuggaa

SEQ ID NO: 1558080 - RNA, 22 nt, Human adenovirus C
aggugaugccggcggcgguggu

SEQ ID NO: 1558081 - RNA, 14 nt, Human adenovirus C
auugcguaccucag

SEQ ID NO: 1558082 - RNA, 21 nt, Human adenovirus C
ccaguccuuuaaugacuaccu

SEQ ID NO: 1558083 - RNA, 21 nt, Human adenovirus C
agauugagguacugaaaugug

SEQ ID NO: 1558084 - RNA, 12 nt, Human adenovirus C
auacugggacag

SEQ ID NO: 1558085 - RNA, 18 nt, Human adenovirus C
aggcuacagaggaggcua

SEQ ID NO: 1558086 - RNA, 21 nt, Human adenovirus C
caugucuuuccacgggcgcag

SEQ ID NO: 1558087 - RNA, 20 nt, Human adenovirus C
gaggggggacacggcggcga

SEQ ID NO: 1558088 - RNA, 20 nt, Human adenovirus C
agcauaaaaaaauccagugg

SEQ ID NO: 1558089 - RNA, 20 nt, Human adenovirus C
aguuuaaaugggaugucaaa

SEQ ID NO: 1558090 - RNA, 19 nt, Human adenovirus C
cugaugguacccaagcgcc

SEQ ID NO: 1558091 - RNA, 17 nt, Human adenovirus C
uccauaugacacagaaa

SEQ ID NO: 1558092 - RNA, 15 nt, Human adenovirus C
acaccgucacccucg

SEQ ID NO: 1558093 - RNA, 20 nt, Human adenovirus C
gucauggaccgcaucauguc

SEQ ID NO: 1558094 - RNA, 19 nt, Human adenovirus C
caaccaggaacagcucuac

SEQ ID NO: 1558095 - RNA, 13 nt, Human adenovirus C
guuugccuccccg

SEQ ID NO: 1558096 - RNA, 17 nt, Human adenovirus C
gccagcgccugcacugc

SEQ ID NO: 1558097 - RNA, 14 nt, Human adenovirus C
gauaucuugaaguc

SEQ ID NO: 1558098 - RNA, 21 nt, Human adenovirus C
aaugugugggcguggcuuaag

SEQ ID NO: 1558099 - RNA, 17 nt, Human adenovirus C
aauuaaccuaaaugcca

SEQ ID NO: 1558100 - RNA, 14 nt, Human adenovirus C
cuuccagcccauga

SEQ ID NO: 1558101 - RNA, 18 nt, Human adenovirus C
augccaugaaccacccua

SEQ ID NO: 1558102 - RNA, 13 nt, Human adenovirus C
cuggcggcggugg

SEQ ID NO: 1558103 - RNA, 21 nt, Human adenovirus C
accccgugaccuuccgcucca

SEQ ID NO: 1558104 - RNA, 15 nt, Human adenovirus C
ccaugcucagucugg

SEQ ID NO: 1558105 - RNA, 18 nt, Human adenovirus C
acacugauuaaaaacaag

SEQ ID NO: 1558106 - RNA, 20 nt, Human adenovirus C
gccgccguuagcccaagagc

SEQ ID NO: 1558107 - RNA, 13 nt, Human adenovirus C
gguggcagaugcc

SEQ ID NO: 1558108 - RNA, 20 nt, Human adenovirus C
gccugcugaaugcgcaggcg

SEQ ID NO: 1558109 - RNA, 23 nt, Human adenovirus C
cucgcugcugcagccgcagcgcg

SEQ ID NO: 1558110 - RNA, 16 nt, Human adenovirus C
ccacacaagcucgccu

SEQ ID NO: 1558111 - RNA, 15 nt, Human adenovirus C
guggacuaaacuuug

SEQ ID NO: 1558112 - RNA, 20 nt, Human adenovirus C
ggcagaugccgcggugcagg

SEQ ID NO: 1558113 - RNA, 15 nt, Human adenovirus C
ggcagcuggggccgg

SEQ ID NO: 1558114 - RNA, 15 nt, Human adenovirus C
gcugcgcgaggagga

SEQ ID NO: 1558115 - RNA, 18 nt, Human adenovirus C
cuguagaccacgcccccu

SEQ ID NO: 1558116 - RNA, 12 nt, Human adenovirus C
agaaaugccugu

SEQ ID NO: 1558117 - RNA, 21 nt, Human adenovirus C
ccuucagccucaagcagcgaa

SEQ ID NO: 1558118 - RNA, 15 nt, Human adenovirus C
ugcagcacagcaggg

SEQ ID NO: 1558119 - RNA, 18 nt, Human adenovirus C
ucagaugcgaguagccca

SEQ ID NO: 1558120 - RNA, 12 nt, Human adenovirus C
uaaguuugacag

SEQ ID NO: 1558121 - RNA, 16 nt, Human adenovirus C
ccucgccggcgcccca

SEQ ID NO: 1558122 - RNA, 16 nt, Human adenovirus C
ccuguaacgcuggacc

SEQ ID NO: 1558123 - RNA, 20 nt, Human adenovirus C
gaagaacuggaucucccgcc

SEQ ID NO: 1558124 - RNA, 18 nt, Human adenovirus C
caaguugaaagagcaaaa

SEQ ID NO: 1558125 - RNA, 21 nt, Human adenovirus C
cggcuauuaccaccacaccuc

SEQ ID NO: 1558126 - RNA, 12 nt, Human adenovirus C
guggugcaggag

SEQ ID NO: 1558127 - RNA, 24 nt, Human adenovirus C
caccuucuuccccauggcccacaa

SEQ ID NO: 1558128 - RNA, 16 nt, Human adenovirus C
ugacccgcuguuccuu

SEQ ID NO: 1558129 - RNA, 18 nt, Human adenovirus C
gcagcagccgcaggccaa

SEQ ID NO: 1558130 - RNA, 23 nt, Human adenovirus C
ccggggaguaggcauccgcgccg

SEQ ID NO: 1558131 - RNA, 9 nt, Human adenovirus C
uggcggcgg

SEQ ID NO: 1558132 - RNA, 20 nt, Human adenovirus C
cccuuggaggaggcgccgca

SEQ ID NO: 1558133 - RNA, 23 nt, Human adenovirus C
ccgccuguggacuauucugcugc

SEQ ID NO: 1558134 - RNA, 20 nt, Human adenovirus C
gacgcguuccggcagcagcc

SEQ ID NO: 1558135 - RNA, 15 nt, Human adenovirus C
uaagucuaagcagcc

SEQ ID NO: 1558136 - RNA, 15 nt, Human adenovirus C
gcugaaaauaaaaaa

SEQ ID NO: 1558137 - RNA, 12 nt, Human adenovirus C
cagccacagugc

SEQ ID NO: 1558138 - RNA, 13 nt, Human adenovirus C
uaccaucacggcg

SEQ ID NO: 1558139 - RNA, 17 nt, Human adenovirus C
cauaccuugacauuggc

SEQ ID NO: 1558140 - RNA, 16 nt, Human adenovirus C
cggcgacaggucaggc

SEQ ID NO: 1558141 - RNA, 18 nt, Human adenovirus C
ccgcagccggugggcccg

SEQ ID NO: 1558142 - RNA, 13 nt, Human adenovirus C
guccaaggugaac

SEQ ID NO: 1558143 - RNA, 14 nt, Human adenovirus C
gcugaaacccacca

SEQ ID NO: 1558144 - RNA, 22 nt, Human adenovirus C
ccaaggacugguuccuggugca

SEQ ID NO: 1558145 - RNA, 12 nt, Human adenovirus C
agagacaggacu

SEQ ID NO: 1558146 - RNA, 11 nt, Human adenovirus C
gagaggagccc

SEQ ID NO: 1558147 - RNA, 12 nt, Human adenovirus C
ggcgggcugcuc

SEQ ID NO: 1558148 - RNA, 15 nt, Human adenovirus C
gcccgugcacuccaa

SEQ ID NO: 1558149 - RNA, 13 nt, Human adenovirus C
cccgcucccacca

SEQ ID NO: 1558150 - RNA, 12 nt, Human adenovirus C
gcggcagcagca

SEQ ID NO: 1558151 - RNA, 20 nt, Human adenovirus C
acugcagagcuucaugcugc

SEQ ID NO: 1558152 - RNA, 13 nt, Human adenovirus C
aaccgcgcccagg

SEQ ID NO: 1558153 - RNA, 20 nt, Human adenovirus C
acacugcagcaggugcugcc

SEQ ID NO: 1558154 - RNA, 15 nt, Human adenovirus C
gcaggucgggcgccg

SEQ ID NO: 1558155 - RNA, 18 nt, Human adenovirus C
gccucggaguaccugagc

SEQ ID NO: 1558156 - RNA, 14 nt, Human adenovirus C
gcuaugugcagcag

SEQ ID NO: 1558157 - RNA, 19 nt, Human adenovirus C
guccagcuuauucagcauc

SEQ ID NO: 1558158 - RNA, 14 nt, Human adenovirus C
caucuccagcggcc

SEQ ID NO: 1558159 - RNA, 15 nt, Human adenovirus C
cgcgggggcgcaguu

SEQ ID NO: 1558160 - RNA, 21 nt, Human adenovirus C
gcugccuguaucacaaaagcg

SEQ ID NO: 1558161 - RNA, 16 nt, Human adenovirus C
cagacacgaucggcag

SEQ ID NO: 1558162 - RNA, 21 nt, Human adenovirus C
ugagcgggggguaccugcugg

SEQ ID NO: 1558163 - RNA, 15 nt, Human adenovirus C
gucaucucugugcug

SEQ ID NO: 1558164 - RNA, 21 nt, Human adenovirus C
gguaccuuugagcugcagggu

SEQ ID NO: 1558165 - RNA, 20 nt, Human adenovirus C
gcgcccuggaggcagcuggg

SEQ ID NO: 1558166 - RNA, 23 nt, Human adenovirus C
aggaggucgggaccgagguugcu

SEQ ID NO: 1558167 - RNA, 17 nt, Human adenovirus C
cugccgucaucccugag

SEQ ID NO: 1558168 - RNA, 18 nt, Human adenovirus C
agcucugcaaccuggucu

SEQ ID NO: 1558169 - RNA, 11 nt, Human adenovirus C
ccgacuggcca

SEQ ID NO: 1558170 - RNA, 13 nt, Human adenovirus C
cgaggagcugagg

SEQ ID NO: 1558171 - RNA, 17 nt, Human adenovirus C
agcuugagccuggcuga

SEQ ID NO: 1558172 - RNA, 17 nt, Human adenovirus C
cuucaacuacaccguca

SEQ ID NO: 1558173 - RNA, 19 nt, Human adenovirus C
cgaggggaguuauggugga

SEQ ID NO: 1558174 - RNA, 16 nt, Human adenovirus C
ggccgacgggcggcca

SEQ ID NO: 1558175 - RNA, 13 nt, Human adenovirus C
cugcacugcaaau

SEQ ID NO: 1558176 - RNA, 18 nt, Human adenovirus C
cgggcggccaugcgggcc

SEQ ID NO: 1558177 - RNA, 13 nt, Human adenovirus C
aguaguuacugga

SEQ ID NO: 1558178 - RNA, 18 nt, Human adenovirus C
gcagagcucucugggaaa

SEQ ID NO: 1558179 - RNA, 14 nt, Human adenovirus C
accgguggguugcu

SEQ ID NO: 1558180 - RNA, 22 nt, Human adenovirus C
auguaugcguccaugucgccgc

SEQ ID NO: 1558181 - RNA, 18 nt, Human adenovirus C
cggcgggcggugggccgc

SEQ ID NO: 1558182 - RNA, 14 nt, Human adenovirus C
guuaauuaccuggg

SEQ ID NO: 1558183 - RNA, 20 nt, Human adenovirus C
ggcgcggaagagaacuccaa

SEQ ID NO: 1558184 - RNA, 13 nt, Human adenovirus C
uguugucaucucu

SEQ ID NO: 1558185 - RNA, 20 nt, Human adenovirus C
gaccaguggagaggcagagc

SEQ ID NO: 1558186 - RNA, 12 nt, Human adenovirus C
ccguagaggagc

SEQ ID NO: 1558187 - RNA, 15 nt, Human adenovirus C
ccgcgggcugggugu

SEQ ID NO: 1558188 - RNA, 17 nt, Human adenovirus C
cauaacuuggacauaaa

SEQ ID NO: 1558189 - RNA, 13 nt, Human adenovirus C
ggagaugcagcgc

SEQ ID NO: 1558190 - RNA, 15 nt, Human adenovirus C
caagagcaagagcag

SEQ ID NO: 1558191 - RNA, 16 nt, Human adenovirus C
acgaggggcagugcag

SEQ ID NO: 1558192 - RNA, 23 nt, Human adenovirus C
ucacaccuauuaccggcugcaac

SEQ ID NO: 1558193 - RNA, 21 nt, Human adenovirus C
cuggucuugucaugccugggg

SEQ ID NO: 1558194 - RNA, 12 nt, Human adenovirus C
ccucagcagcgg

SEQ ID NO: 1558195 - RNA, 20 nt, Human adenovirus C
cugcccgccaccugcugugc

SEQ ID NO: 1558196 - RNA, 13 nt, Human adenovirus C
gcagcaaggccug

SEQ ID NO: 1558197 - RNA, 13 nt, Human adenovirus C
cugccgcccccgc

SEQ ID NO: 1558198 - RNA, 15 nt, Human adenovirus C
ugcgcuuuucugugc

SEQ ID NO: 1558199 - RNA, 22 nt, Human adenovirus C
cgaagccuuccauccagacauc

SEQ ID NO: 1558200 - RNA, 15 nt, Human adenovirus C
gcgcuuuccaggcuu

SEQ ID NO: 1558201 - RNA, 23 nt, Human adenovirus C
gcgcggcggucaccagaggcuca

SEQ ID NO: 1558202 - RNA, 15 nt, Human adenovirus C
gcgcaggcggcggca

SEQ ID NO: 1558203 - RNA, 17 nt, Human adenovirus C
auucuucucaaauacua

SEQ ID NO: 1558204 - RNA, 16 nt, Human adenovirus C
guggaacuugagggug

SEQ ID NO: 1558205 - RNA, 18 nt, Human adenovirus C
cgcgggcccuugcuuccc

SEQ ID NO: 1558206 - RNA, 15 nt, Human adenovirus C
gucccuccgcaccca

SEQ ID NO: 1558207 - RNA, 16 nt, Human adenovirus C
cgaggacagggccucu

SEQ ID NO: 1558208 - RNA, 15 nt, Human adenovirus C
cagcaacagcagcgg

SEQ ID NO: 1558209 - RNA, 17 nt, Human adenovirus C
cugcgcgcuggccaggg

SEQ ID NO: 1558210 - RNA, 19 nt, Human adenovirus C
gacgaaguaaguuugccac

SEQ ID NO: 1558211 - RNA, 13 nt, Human adenovirus C
auugaggaguucg

SEQ ID NO: 1558212 - RNA, 22 nt, Human adenovirus C
caaaccuggaaaaggugaugaa

SEQ ID NO: 1558213 - RNA, 19 nt, Human adenovirus C
cacgcaaccgcgcccaggc

SEQ ID NO: 1558214 - RNA, 18 nt, Human adenovirus C
ccacaggcugcuguccaa

SEQ ID NO: 1558215 - RNA, 15 nt, Human adenovirus C
agaaggugcuggcga

SEQ ID NO: 1558216 - RNA, 20 nt, Human adenovirus C
gcaagcaacaucaacaacag

SEQ ID NO: 1558217 - RNA, 14 nt, Human adenovirus C
ggccaaccaggcag

SEQ ID NO: 1558218 - RNA, 14 nt, Human adenovirus C
uggcgccaggucau

SEQ ID NO: 1558219 - RNA, 14 nt, Human adenovirus C
accaccacccuccu

SEQ ID NO: 1558220 - RNA, 16 nt, Human adenovirus C
aggcucgcguccaggc

SEQ ID NO: 1558221 - RNA, 17 nt, Human adenovirus C
ccaucgcgcaacugggc

SEQ ID NO: 1558222 - RNA, 15 nt, Human adenovirus C
cccgcuugaggagga

SEQ ID NO: 1558223 - RNA, 18 nt, Human adenovirus C
uaagcauaacauggugug

SEQ ID NO: 1558224 - RNA, 13 nt, Human adenovirus C
acuuaaacucagg

SEQ ID NO: 1558225 - RNA, 21 nt, Human adenovirus C
cagcagcggaugauccuccag

SEQ ID NO: 1558226 - RNA, 22 nt, Human adenovirus C
cgucgccagcccgugcuggccc

SEQ ID NO: 1558227 - RNA, 14 nt, Human adenovirus C
ugcacgcagcaccu

SEQ ID NO: 1558228 - RNA, 19 nt, Human adenovirus C
caucuugcgcuaugugcag

SEQ ID NO: 1558229 - RNA, 20 nt, Human adenovirus C
uucaguaguauagccccacc

SEQ ID NO: 1558230 - RNA, 22 nt, Human adenovirus C
aaaguccacaaaaaacacccag

SEQ ID NO: 1558231 - RNA, 21 nt, Human adenovirus C
ugaccaugaagaucuggaagg

SEQ ID NO: 1558232 - RNA, 17 nt, Human adenovirus C
aacgcgaucguggagca

SEQ ID NO: 1558233 - RNA, 18 nt, Human adenovirus C
ccgcucauggacccuccu

SEQ ID NO: 1558234 - RNA, 14 nt, Human adenovirus C
gaugcgccccccuc

SEQ ID NO: 1558235 - RNA, 14 nt, Human adenovirus C
ggagcugcccaaga

SEQ ID NO: 1558236 - RNA, 20 nt, Human adenovirus C
cagcuuccuggagcgccacu

SEQ ID NO: 1558237 - RNA, 17 nt, Human adenovirus C
ugggcguguggcagcaa

SEQ ID NO: 1558238 - RNA, 18 nt, Human adenovirus C
aucagcuucggcgcacgc

SEQ ID NO: 1558239 - RNA, 19 nt, Human adenovirus C
ccgccagaggagcugcuga

SEQ ID NO: 1558240 - RNA, 14 nt, Human adenovirus C
ugaaagagguaguu

SEQ ID NO: 1558241 - RNA, 20 nt, Human adenovirus C
ccccuuugaguucgccacca

SEQ ID NO: 1558242 - RNA, 18 nt, Human adenovirus C
ugauggccgcagugcuug

SEQ ID NO: 1558243 - RNA, 21 nt, Human adenovirus C
gcuccucguuuagccaggucu

SEQ ID NO: 1558244 - RNA, 23 nt, Human adenovirus C
accugaacgggguguuugacaug

SEQ ID NO: 1558245 - RNA, 13 nt, Human adenovirus C
aucucagccgccu

SEQ ID NO: 1558246 - RNA, 21 nt, Human adenovirus C
aagugcuuugcccgcggcucc

SEQ ID NO: 1558247 - RNA, 15 nt, Human adenovirus C
ccccuauccugccgu

SEQ ID NO: 1558248 - RNA, 16 nt, Human adenovirus C
cgggcacuaccgcgcg

SEQ ID NO: 1558249 - RNA, 19 nt, Human adenovirus C
accauccuaaaccagcugg

SEQ ID NO: 1558250 - RNA, 16 nt, Human adenovirus C
ucggaccaccacgccg

SEQ ID NO: 1558251 - RNA, 20 nt, Human adenovirus C
cugaaucuggcgccucugcg

SEQ ID NO: 1558252 - RNA, 14 nt, Human adenovirus C
gacgggccaggguc

SEQ ID NO: 1558253 - RNA, 16 nt, Human adenovirus C
gcuaugcacugcaggg

SEQ ID NO: 1558254 - RNA, 14 nt, Human adenovirus C
agaaccagauauuu

SEQ ID NO: 1558255 - RNA, 14 nt, Human adenovirus C
cggcagcagccgca

SEQ ID NO: 1558256 - RNA, 14 nt, Human adenovirus C
cggcggcgcgcaac

SEQ ID NO: 1558257 - RNA, 17 nt, Human adenovirus C
gacagaaacacagagcu

SEQ ID NO: 1558258 - RNA, 15 nt, Human adenovirus C
cgcggcagccgcggc

SEQ ID NO: 1558259 - RNA, 21 nt, Human adenovirus C
ggaacgcggguuuggcagggc

SEQ ID NO: 1558260 - RNA, 18 nt, Human adenovirus C
cugaguacacagcccgcc

SEQ ID NO: 1558261 - RNA, 20 nt, Human adenovirus C
cccgagggccgcuggcugcu

SEQ ID NO: 1558262 - RNA, 19 nt, Human adenovirus C
cgagacguacuucagccug

SEQ ID NO: 1558263 - RNA, 13 nt, Human adenovirus C
gcggccgccgcag

SEQ ID NO: 1558264 - RNA, 23 nt, Human adenovirus C
ugcgccccccuccucagcagcgg

SEQ ID NO: 1558265 - RNA, 18 nt, Human adenovirus C
caacgugcccaucuccau

SEQ ID NO: 1558266 - RNA, 15 nt, Human adenovirus C
cgccagaccccccau

SEQ ID NO: 1558267 - RNA, 13 nt, Human adenovirus C
guacaugauuuua

SEQ ID NO: 1558268 - RNA, 20 nt, Human adenovirus C
guuggaauucuucaccagca

SEQ ID NO: 1558269 - RNA, 16 nt, Human adenovirus C
cagcccuaucagcagc

SEQ ID NO: 1558270 - RNA, 16 nt, Human adenovirus C
ugaaaaucagagggcg

SEQ ID NO: 1558271 - RNA, 19 nt, Human adenovirus C
acggggccgagguggagau

SEQ ID NO: 1558272 - RNA, 21 nt, Human adenovirus C
ugagguguaccaguccgggcc

SEQ ID NO: 1558273 - RNA, 18 nt, Human adenovirus C
cgggcccggugagcuuga

SEQ ID NO: 1558274 - RNA, 14 nt, Human adenovirus C
uggggauggcgggc

SEQ ID NO: 1558275 - RNA, 18 nt, Human adenovirus C
accucuuugagcccuuug

SEQ ID NO: 1558276 - RNA, 18 nt, Human adenovirus C
cggugcugcggcagaugc

SEQ ID NO: 1558277 - RNA, 23 nt, Human adenovirus C
gccagacuauuuuuuccagacca

SEQ ID NO: 1558278 - RNA, 19 nt, Human adenovirus C
ggcacccgcgcgcgcuggc

SEQ ID NO: 1558279 - RNA, 19 nt, Human adenovirus C
aagggcacgagcugcuucc

SEQ ID NO: 1558280 - RNA, 14 nt, Human adenovirus C
acuaggagacacuu

SEQ ID NO: 1558281 - RNA, 19 nt, Human adenovirus C
gcagacccugcgagugugg

SEQ ID NO: 1558282 - RNA, 21 nt, Human adenovirus C
cucaggauuacaagcuccucc

SEQ ID NO: 1558283 - RNA, 22 nt, Human adenovirus C
gcagcuguuggaucugcgccag

SEQ ID NO: 1558284 - RNA, 16 nt, Human adenovirus C
gaucaucuccccgcgg

SEQ ID NO: 1558285 - RNA, 16 nt, Human adenovirus C
gggagaucagcuggga

SEQ ID NO: 1558286 - RNA, 17 nt, Human adenovirus C
aaacccugcaacagggu

SEQ ID NO: 1558287 - RNA, 21 nt, Human adenovirus C
ccagcagaaaccugugcugcc

SEQ ID NO: 1558288 - RNA, 13 nt, Human adenovirus C
cucagaugcugac

SEQ ID NO: 1558289 - RNA, 23 nt, Human adenovirus C
gggaugcaaacuugcaagaacaa

SEQ ID NO: 1558290 - RNA, 23 nt, Human adenovirus C
ccagaggagcugcugagccgccg

SEQ ID NO: 1558291 - RNA, 18 nt, Human adenovirus C
acagcuaugauccagaug

SEQ ID NO: 1558292 - RNA, 17 nt, Human adenovirus C
cagccacaacgcgcagc

SEQ ID NO: 1558293 - RNA, 15 nt, Human adenovirus C
aucucgauccagcau

SEQ ID NO: 1558294 - RNA, 19 nt, Human adenovirus C
agccucgccccccuucucc

SEQ ID NO: 1558295 - RNA, 14 nt, Human adenovirus C
ggcugcuguugcuu

SEQ ID NO: 1558296 - RNA, 13 nt, Human adenovirus C
caccgggacuggg

SEQ ID NO: 1558297 - RNA, 19 nt, Human adenovirus C
cgccagaggagcugcugag

SEQ ID NO: 1558298 - RNA, 13 nt, Human adenovirus C
gacgggguaacgc

SEQ ID NO: 1558299 - RNA, 20 nt, Human adenovirus C
ccagagaugaccggcucaac

SEQ ID NO: 1558300 - RNA, 15 nt, Human adenovirus C
aggcgcgccgcgacu

SEQ ID NO: 1558301 - RNA, 15 nt, Human adenovirus C
cccaguaccgcagcu

SEQ ID NO: 1558302 - RNA, 13 nt, Human adenovirus C
ggcggcggcccug

SEQ ID NO: 1558303 - RNA, 21 nt, Human adenovirus C
cugacgcguuccggcagcagc

SEQ ID NO: 1558304 - RNA, 15 nt, Human adenovirus C
cacccggcgccagca

SEQ ID NO: 1558305 - RNA, 22 nt, Human adenovirus C
gguugugcagggugacaagguc

SEQ ID NO: 1558306 - RNA, 16 nt, Human adenovirus C
gaaucuaacuuuuagc

SEQ ID NO: 1558307 - RNA, 17 nt, Human adenovirus C
ugcagauguuggccaac

SEQ ID NO: 1558308 - RNA, 20 nt, Human adenovirus C
acaggucucugcgcucccuc

SEQ ID NO: 1558309 - RNA, 23 nt, Human adenovirus C
aguggaaaauacaccacugaaac

SEQ ID NO: 1558310 - RNA, 22 nt, Human adenovirus C
ccguguucugacagggcccagu

SEQ ID NO: 1558311 - RNA, 18 nt, Human adenovirus C
ggagcuugagugcaugca

SEQ ID NO: 1558312 - RNA, 15 nt, Human adenovirus C
guccaucuggucaga

SEQ ID NO: 1558313 - RNA, 23 nt, Human adenovirus C
cagaagcuaaugaaugcacuacu

SEQ ID NO: 1558314 - RNA, 18 nt, Human adenovirus C
gcacgagcugcuucccaa

SEQ ID NO: 1558315 - RNA, 21 nt, Human adenovirus C
cgugcgcaguacuggcagcgg

SEQ ID NO: 1558316 - RNA, 15 nt, Human adenovirus C
ccaaccaggcagugc

SEQ ID NO: 1558317 - RNA, 14 nt, Human adenovirus C
guuccacgcagggc

SEQ ID NO: 1558318 - RNA, 12 nt, Human adenovirus C
ugcuugccaccu

SEQ ID NO: 1558319 - RNA, 20 nt, Human adenovirus C
aguggaaaauacaccacuga

SEQ ID NO: 1558320 - RNA, 18 nt, Human adenovirus C
cccugcaaacaucagccc

SEQ ID NO: 1558321 - RNA, 12 nt, Human adenovirus C
aaucuccugcac

SEQ ID NO: 1558322 - RNA, 15 nt, Human adenovirus C
gcaaccaccgcuccu

SEQ ID NO: 1558323 - RNA, 14 nt, Human adenovirus C
cucgaucucuuccu

SEQ ID NO: 1558324 - RNA, 21 nt, Human adenovirus C
guuccauccggcccaggggcg

SEQ ID NO: 1558325 - RNA, 19 nt, Human adenovirus C
aaugagcuugaucugcugg

SEQ ID NO: 1558326 - RNA, 13 nt, Human adenovirus C
cggcgcugcagag

SEQ ID NO: 1558327 - RNA, 18 nt, Human adenovirus C
uccucaggauuacaagcu

SEQ ID NO: 1558328 - RNA, 20 nt, Human adenovirus C
cauggcggggaccacagaac

SEQ ID NO: 1558329 - RNA, 12 nt, Human adenovirus C
aucccuguggac

SEQ ID NO: 1558330 - RNA, 23 nt, Human adenovirus C
ugcagcugccgucaucccugagc

SEQ ID NO: 1558331 - RNA, 17 nt, Human adenovirus C
accuguaacgcuggacc

SEQ ID NO: 1558332 - RNA, 19 nt, Human adenovirus C
cucgccugcgccauaguca

SEQ ID NO: 1558333 - RNA, 20 nt, Human adenovirus C
ccauccaaguauaggucucu

SEQ ID NO: 1558334 - RNA, 20 nt, Human adenovirus C
agccgacgcgcccuggaggc

SEQ ID NO: 1558335 - RNA, 15 nt, Human adenovirus C
ccaagaaauccacag

SEQ ID NO: 1558336 - RNA, 19 nt, Human adenovirus C
agcaaaucccgaauauuaa

SEQ ID NO: 1558337 - RNA, 12 nt, Human adenovirus C
gggggcgagguc

SEQ ID NO: 1558338 - RNA, 19 nt, Human adenovirus C
ccuaucagcagccgcgggc

SEQ ID NO: 1558339 - RNA, 16 nt, Human adenovirus C
aaugcaauuugaguca

SEQ ID NO: 1558340 - RNA, 21 nt, Human adenovirus C
acgugccgcggggacaggagg

SEQ ID NO: 1558341 - RNA, 13 nt, Human adenovirus C
agaaacacaagcu

SEQ ID NO: 1558342 - RNA, 23 nt, Human adenovirus C
cgcgcgagcccaaaguccagaug

SEQ ID NO: 1558343 - RNA, 16 nt, Human adenovirus C
ggucgcccgggcaggg

SEQ ID NO: 1558344 - RNA, 19 nt, Human adenovirus C
ccugcgcggccuuccggag

SEQ ID NO: 1558345 - RNA, 19 nt, Human adenovirus C
gucacugcuaccuucugca

SEQ ID NO: 1558346 - RNA, 14 nt, Human adenovirus C
cuggccaaccaggc

SEQ ID NO: 1558347 - RNA, 21 nt, Human adenovirus C
cuccacuuaaacucaggcaca

SEQ ID NO: 1558348 - RNA, 15 nt, Human adenovirus C
cggaguaccugagcc

SEQ ID NO: 1558349 - RNA, 14 nt, Human adenovirus C
gcgcgcgcaaaccc

SEQ ID NO: 1558350 - RNA, 22 nt, Human adenovirus C
gggaggcaagcacacagaccau

SEQ ID NO: 1558351 - RNA, 15 nt, Human adenovirus C
ccgcaggccaaccgg

SEQ ID NO: 1558352 - RNA, 16 nt, Human adenovirus C
ugcaaacuugcaagaa

SEQ ID NO: 1558353 - RNA, 19 nt, Human adenovirus C
agggcacccuccccuucuc

SEQ ID NO: 1558354 - RNA, 15 nt, Human adenovirus C
ccugccgugccaacc

SEQ ID NO: 1558355 - RNA, 10 nt, Human adenovirus C
ugaaacuuuu

SEQ ID NO: 1558356 - RNA, 14 nt, Human adenovirus C
uuagcguacaguca

SEQ ID NO: 1558357 - RNA, 14 nt, Human adenovirus C
gcggugcaggcggc

SEQ ID NO: 1558358 - RNA, 16 nt, Human adenovirus C
uaugauccagauguua

SEQ ID NO: 1558359 - RNA, 19 nt, Human adenovirus C
ucuggugacuuggcaccca

SEQ ID NO: 1558360 - RNA, 23 nt, Human adenovirus C
gcuccgggcugcgcgcuggccag

SEQ ID NO: 1558361 - RNA, 20 nt, Human adenovirus C
cgcguccuaucgagccgcac

SEQ ID NO: 1558362 - RNA, 13 nt, Human adenovirus C
ccaccuucagccu

SEQ ID NO: 1558363 - RNA, 13 nt, Human adenovirus C
cucgcuguggagc

SEQ ID NO: 1558364 - RNA, 19 nt, Human adenovirus C
cugcaaacaucagcccccc

SEQ ID NO: 1558365 - RNA, 19 nt, Human adenovirus C
gcucggcggugaccugcac

SEQ ID NO: 1558366 - RNA, 12 nt, Human adenovirus C
ccuggugcugcc

SEQ ID NO: 1558367 - RNA, 18 nt, Human adenovirus C
cguuggagacugcagccu

SEQ ID NO: 1558368 - RNA, 13 nt, Human adenovirus C
gugccagaggugc

SEQ ID NO: 1558369 - RNA, 15 nt, Human adenovirus C
agagacgcccaggcc

SEQ ID NO: 1558370 - RNA, 14 nt, Human adenovirus C
cgcugcccuggugu

SEQ ID NO: 1558371 - RNA, 17 nt, Human adenovirus C
cuggagcucccgcggcg

SEQ ID NO: 1558372 - RNA, 17 nt, Human adenovirus C
ugucugcgagggccagc

SEQ ID NO: 1558373 - RNA, 14 nt, Human adenovirus C
gaugaagaagagga

SEQ ID NO: 1558374 - RNA, 14 nt, Human adenovirus C
ccaagacuacucaa

SEQ ID NO: 1558375 - RNA, 14 nt, Human adenovirus C
gacgacagcagcgu

SEQ ID NO: 1558376 - RNA, 17 nt, Human adenovirus C
cugguuuccaugagccg

SEQ ID NO: 1558377 - RNA, 20 nt, Human adenovirus C
ugcacgcuggccagcacgcu

SEQ ID NO: 1558378 - RNA, 15 nt, Human adenovirus C
ccucaggcaccaucc

SEQ ID NO: 1558379 - RNA, 16 nt, Human adenovirus C
ucaccgucacccagca

SEQ ID NO: 1558380 - RNA, 17 nt, Human adenovirus C
guauugccacugccaca

SEQ ID NO: 1558381 - RNA, 14 nt, Human adenovirus C
ugccacacgggcgg

SEQ ID NO: 1558382 - RNA, 21 nt, Human adenovirus C
cuugaccgucuggcugcucga

SEQ ID NO: 1558383 - RNA, 13 nt, Human adenovirus C
cuacagccccuac

SEQ ID NO: 1558384 - RNA, 15 nt, Human adenovirus C
gcgcccguguugaug

SEQ ID NO: 1558385 - RNA, 14 nt, Human adenovirus C
gcuggugcugcgcg

SEQ ID NO: 1558386 - RNA, 12 nt, Human adenovirus C
cgggcggcaugc

SEQ ID NO: 1558387 - RNA, 14 nt, Human adenovirus C
ucgggaaugaaugu

SEQ ID NO: 1558388 - RNA, 18 nt, Human adenovirus C
gcccuaccugugcuuugc

SEQ ID NO: 1558389 - RNA, 14 nt, Human adenovirus C
gagccccgggcugg

SEQ ID NO: 1558390 - RNA, 14 nt, Human adenovirus C
aagcccgccaagag

SEQ ID NO: 1558391 - RNA, 14 nt, Human adenovirus C
ucggcgguggcaga

SEQ ID NO: 1558392 - RNA, 23 nt, Human adenovirus C
gccuccgaacgguaagagccuag

SEQ ID NO: 1558393 - RNA, 16 nt, Human adenovirus C
auggccuuugccugga

SEQ ID NO: 1558394 - RNA, 13 nt, Human adenovirus C
aucugacaacccc

SEQ ID NO: 1558395 - RNA, 15 nt, Human adenovirus C
gcccuggcuggcacg

SEQ ID NO: 1558396 - RNA, 14 nt, Human adenovirus C
ggcacaugcgagcc

SEQ ID NO: 1558397 - RNA, 23 nt, Human adenovirus C
gcuacaccuaccgccccagaaga

SEQ ID NO: 1558398 - RNA, 15 nt, Human adenovirus C
cuccugccaggcuca

SEQ ID NO: 1558399 - RNA, 23 nt, Human adenovirus C
gcuaccggagugcugggccagca

SEQ ID NO: 1558400 - RNA, 13 nt, Human adenovirus C
cguggcgggcggc

SEQ ID NO: 1558401 - RNA, 17 nt, Human adenovirus C
cgccugcuuacucccaa

SEQ ID NO: 1558402 - RNA, 17 nt, Human adenovirus C
cggccuuccggagcgag

SEQ ID NO: 1558403 - RNA, 18 nt, Human adenovirus C
uggcuccauaccauaccu

SEQ ID NO: 1558404 - RNA, 17 nt, Human adenovirus C
cacgguuuccugucgag

SEQ ID NO: 1558405 - RNA, 17 nt, Human adenovirus C
uaguauagccccaccac

SEQ ID NO: 1558406 - RNA, 15 nt, Human adenovirus C
gccaggacgccucgg

SEQ ID NO: 1558407 - RNA, 14 nt, Human adenovirus C
uugcucgcccuugc

SEQ ID NO: 1558408 - RNA, 19 nt, Human adenovirus C
cucggagcuaugcuaacca

SEQ ID NO: 1558409 - RNA, 22 nt, Human adenovirus C
auguaccuuacuuuaucucaaa

SEQ ID NO: 1558410 - RNA, 19 nt, Human adenovirus C
ccgcgguugugcaggguga

SEQ ID NO: 1558411 - RNA, 13 nt, Human adenovirus C
gcaaggccuggaa

SEQ ID NO: 1558412 - RNA, 16 nt, Human adenovirus C
ggcuacaggggccucu

SEQ ID NO: 1558413 - RNA, 13 nt, Human adenovirus C
guugacggccugg

SEQ ID NO: 1558414 - RNA, 14 nt, Human adenovirus C
ggugguggcggugu

SEQ ID NO: 1558415 - RNA, 17 nt, Human adenovirus C
ccccuucgaugcucccc

SEQ ID NO: 1558416 - RNA, 17 nt, Human adenovirus C
ccaggggcugguuggug

SEQ ID NO: 1558417 - RNA, 15 nt, Human adenovirus C
agcagggcaaccugg

SEQ ID NO: 1558418 - RNA, 13 nt, Human adenovirus C
ucuuaugccaggc

SEQ ID NO: 1558419 - RNA, 21 nt, Human adenovirus C
gaggcacuaaagcaaggccug

SEQ ID NO: 1558420 - RNA, 12 nt, Human adenovirus C
acgccaccuucu

SEQ ID NO: 1558421 - RNA, 15 nt, Human adenovirus C
gagagccggccugga

SEQ ID NO: 1558422 - RNA, 13 nt, Human adenovirus C
uugcccgcgccac

SEQ ID NO: 1558423 - RNA, 20 nt, Human adenovirus C
ucaccaacgcguuuagcagg

SEQ ID NO: 1558424 - RNA, 19 nt, Human adenovirus C
gccgcggcgauuggcgccg

SEQ ID NO: 1558425 - RNA, 16 nt, Human adenovirus C
agcgacgaccugggcg

SEQ ID NO: 1558426 - RNA, 20 nt, Human adenovirus C
ccuggaacagcagcacaggc

SEQ ID NO: 1558427 - RNA, 18 nt, Human adenovirus C
gucuaagcagccgccgcc

SEQ ID NO: 1558428 - RNA, 14 nt, Human adenovirus C
gcgcaguuggaaga

SEQ ID NO: 1558429 - RNA, 17 nt, Human adenovirus C
cugcccgccaccugcug

SEQ ID NO: 1558430 - RNA, 22 nt, Human adenovirus C
cauaucccagggaacaacccau

SEQ ID NO: 1558431 - RNA, 23 nt, Human adenovirus C
ccgccagcccccaccaucaccac

SEQ ID NO: 1558432 - RNA, 19 nt, Human adenovirus C
ggugcucguccagacgggc

SEQ ID NO: 1558433 - RNA, 17 nt, Human adenovirus C
gaccccuguauauuaau

SEQ ID NO: 1558434 - RNA, 14 nt, Human adenovirus C
aggagccuccaccg

SEQ ID NO: 1558435 - RNA, 21 nt, Human adenovirus C
gcgcccuucacggacaguggc

SEQ ID NO: 1558436 - RNA, 20 nt, Human adenovirus C
gccgugccaaccgcagccga

SEQ ID NO: 1558437 - RNA, 18 nt, Human adenovirus C
gcccuugauggagggcaa

SEQ ID NO: 1558438 - RNA, 15 nt, Human adenovirus C
cgcgagucuggugac

SEQ ID NO: 1558439 - RNA, 17 nt, Human adenovirus C
ucauggguaacagacau

SEQ ID NO: 1558440 - RNA, 16 nt, Human adenovirus C
gcucggucacgugcuc

SEQ ID NO: 1558441 - RNA, 21 nt, Human adenovirus C
ucgccagcccgugcuggcccc

SEQ ID NO: 1558442 - RNA, 21 nt, Human adenovirus C
acccgcccgcgccugcugggc

SEQ ID NO: 1558443 - RNA, 19 nt, Human adenovirus C
cccaaaaagaagcugcagc

SEQ ID NO: 1558444 - RNA, 15 nt, Human adenovirus C
ggcauagucucgccg

SEQ ID NO: 1558445 - RNA, 19 nt, Human adenovirus C
ggcagaaacagagggcugc

SEQ ID NO: 1558446 - RNA, 12 nt, Human adenovirus C
gcgccagcaccu

SEQ ID NO: 1558447 - RNA, 20 nt, Human adenovirus C
ggcacacgugcauacacuuc

SEQ ID NO: 1558448 - RNA, 19 nt, Human adenovirus C
uuauaacagcacuggcaac

SEQ ID NO: 1558449 - RNA, 22 nt, Human adenovirus C
cggcccugcuuaaccgcgcacg

SEQ ID NO: 1558450 - RNA, 23 nt, Human adenovirus C
acgugccgcggggacaggaggac

SEQ ID NO: 1558451 - RNA, 17 nt, Human adenovirus C
ucugcccgccaccugcu

SEQ ID NO: 1558452 - RNA, 16 nt, Human adenovirus C
ggccauucagaccgug

SEQ ID NO: 1558453 - RNA, 18 nt, Human adenovirus C
guagagcuugggcgcgag

SEQ ID NO: 1558454 - RNA, 17 nt, Human adenovirus C
cacuuggugcuggccug

SEQ ID NO: 1558455 - RNA, 23 nt, Human adenovirus C
uagcaagccgcucauggcgcagc

SEQ ID NO: 1558456 - RNA, 15 nt, Human adenovirus C
agugaagauguaaau

SEQ ID NO: 1558457 - RNA, 13 nt, Human adenovirus C
ucaucucugugcu

SEQ ID NO: 1558458 - RNA, 14 nt, Human adenovirus C
gcgguauccugccc

SEQ ID NO: 1558459 - RNA, 14 nt, Human adenovirus C
uggaacaaugacag

SEQ ID NO: 1558460 - RNA, 14 nt, Human adenovirus C
cgcuggccagcacg

SEQ ID NO: 1558461 - RNA, 20 nt, Human adenovirus C
uggaggagcgacgcaagcua

SEQ ID NO: 1558462 - RNA, 21 nt, Human adenovirus C
ugacgcgggcgcugaccugcg

SEQ ID NO: 1558463 - RNA, 22 nt, Human adenovirus C
uacuccggcacugccuacaacg

SEQ ID NO: 1558464 - RNA, 15 nt, Human adenovirus C
caugucgcccucuuc

SEQ ID NO: 1558465 - RNA, 15 nt, Human adenovirus C
cuucuaaauagcuaa

SEQ ID NO: 1558466 - RNA, 16 nt, Human adenovirus C
auguuguacagguggc

SEQ ID NO: 1558467 - RNA, 17 nt, Human adenovirus C
gcggugcgggcggcgcu

SEQ ID NO: 1558468 - RNA, 19 nt, Human adenovirus C
ggccugcaaaauuuccaac

SEQ ID NO: 1558469 - RNA, 17 nt, Human adenovirus C
ugucgucgcauccgccc

SEQ ID NO: 1558470 - RNA, 16 nt, Human adenovirus C
cagcucuacagcuucc

SEQ ID NO: 1558471 - RNA, 20 nt, Human adenovirus C
cuggcgcggcuaggagcgcc

SEQ ID NO: 1558472 - RNA, 19 nt, Human adenovirus C
gcggaugucagccuugccu

SEQ ID NO: 1558473 - RNA, 13 nt, Human adenovirus C
agcuggccgggca

SEQ ID NO: 1558474 - RNA, 18 nt, Human adenovirus C
accagccugugaugcugg

SEQ ID NO: 1558475 - RNA, 20 nt, Human adenovirus C
uguaagcgaagacgacgagg

SEQ ID NO: 1558476 - RNA, 15 nt, Human adenovirus C
cgggcacuaccgcgc

SEQ ID NO: 1558477 - RNA, 14 nt, Human adenovirus C
gacaaguugaaaga

SEQ ID NO: 1558478 - RNA, 15 nt, Human adenovirus C
acagaggaggcuagg

SEQ ID NO: 1558479 - RNA, 14 nt, Human adenovirus C
cgcgucggccaggu

SEQ ID NO: 1558480 - RNA, 22 nt, Human adenovirus C
agcaggccaacgagcgccucgg

SEQ ID NO: 1558481 - RNA, 23 nt, Human adenovirus C
uacacaguccuuucuccccggcu

SEQ ID NO: 1558482 - RNA, 15 nt, Human adenovirus C
ugagguacaugauuu

SEQ ID NO: 1558483 - RNA, 23 nt, Human adenovirus C
gaguugcaacagcgcgagcaggc

SEQ ID NO: 1558484 - RNA, 13 nt, Human adenovirus C
cccuucuucuucu

SEQ ID NO: 1558485 - RNA, 23 nt, Human adenovirus C
aggcuaccgcucguggcgcgggc

SEQ ID NO: 1558486 - RNA, 15 nt, Human adenovirus C
cuugccugcuccaga

SEQ ID NO: 1558487 - RNA, 20 nt, Human adenovirus C
agggcgcuccuaacuccugu

SEQ ID NO: 1558488 - RNA, 21 nt, Human adenovirus C
cgcagcuuguugaccagcucg

SEQ ID NO: 1558489 - RNA, 19 nt, Human adenovirus C
gguguaggccacgugaccg

SEQ ID NO: 1558490 - RNA, 15 nt, Human adenovirus C
caagcuacccaccca

SEQ ID NO: 1558491 - RNA, 14 nt, Human adenovirus C
agccaggucuugca

SEQ ID NO: 1558492 - RNA, 21 nt, Human adenovirus C
ggcacugccuacaacgcucua

SEQ ID NO: 1558493 - RNA, 15 nt, Human adenovirus C
agcgguuaggcugga

SEQ ID NO: 1558494 - RNA, 16 nt, Human adenovirus C
cguaggugagcuccuc

SEQ ID NO: 1558495 - RNA, 12 nt, Human adenovirus C
ggacauaaacau

SEQ ID NO: 1558496 - RNA, 20 nt, Human adenovirus C
ugauucuuugaaucuggguc

SEQ ID NO: 1558497 - RNA, 16 nt, Human adenovirus C
uuacauuuaaaucaga

SEQ ID NO: 1558498 - RNA, 12 nt, Human adenovirus C
ucuuccuccugg

SEQ ID NO: 1558499 - RNA, 12 nt, Human adenovirus C
gcagggugacaa

SEQ ID NO: 1558500 - RNA, 21 nt, Human adenovirus C
cgcaaccuaaaggagcugcag

SEQ ID NO: 1558501 - RNA, 23 nt, Human adenovirus C
uggcaccuuuuguuccaccgcuc

SEQ ID NO: 1558502 - RNA, 13 nt, Human adenovirus C
uggcccgcgguga

SEQ ID NO: 1558503 - RNA, 15 nt, Human adenovirus C
uggacgcuggaagac

SEQ ID NO: 1558504 - RNA, 17 nt, Human adenovirus C
uggaggaggcgcgcaac

SEQ ID NO: 1558505 - RNA, 23 nt, Human adenovirus C
auugauggucgccccguccugcc

SEQ ID NO: 1558506 - RNA, 22 nt, Human adenovirus C
auuguuguguagguacuccgcc

SEQ ID NO: 1558507 - RNA, 17 nt, Human adenovirus C
aguuggaagacgccgcc

SEQ ID NO: 1558508 - RNA, 20 nt, Human adenovirus C
aguuccaagaagcgcggggu

SEQ ID NO: 1558509 - RNA, 18 nt, Human adenovirus C
agugucgucgcauccgcc

SEQ ID NO: 1558510 - RNA, 16 nt, Human adenovirus C
aguuggggccuccgcc

SEQ ID NO: 1558511 - RNA, 14 nt, Human adenovirus C
aggcaaacgaggaa

SEQ ID NO: 1558512 - RNA, 13 nt, Human adenovirus C
agcgccucgggga

SEQ ID NO: 1558513 - RNA, 20 nt, Human adenovirus C
agauugagcuccacgugccg

SEQ ID NO: 1558514 - RNA, 20 nt, Human adenovirus C
agauuagguucuacgaagac

SEQ ID NO: 1558515 - RNA, 22 nt, Human adenovirus C
agaugugggagacgacgugcug

SEQ ID NO: 1558516 - RNA, 15 nt, Human adenovirus C
acacaagcuaaaccu

SEQ ID NO: 1558517 - RNA, 15 nt, Human adenovirus C
acccagcagaaaccu

SEQ ID NO: 1558518 - RNA, 20 nt, Human adenovirus C
aacccacacugauuaugaca

SEQ ID NO: 1558519 - RNA, 18 nt, Human adenovirus C
aacggccgcuacgugccc

SEQ ID NO: 1558520 - RNA, 18 nt, Human adenovirus C
aacgccaccaacgugccc

SEQ ID NO: 1558521 - RNA, 11 nt, Human adenovirus C
gagacaugauu

SEQ ID NO: 1558522 - RNA, 19 nt, Human adenovirus C
gcagggcgcugucauaccu

SEQ ID NO: 1558523 - RNA, 14 nt, Human adenovirus C
gaaaacagcgaaaa

SEQ ID NO: 1558524 - RNA, 15 nt, Human adenovirus C
gaaacgcgcggcaaa

SEQ ID NO: 1558525 - RNA, 16 nt, Human adenovirus C
gaacaagagcugaaaa

SEQ ID NO: 1558526 - RNA, 21 nt, Human adenovirus C
gaagugauuaucgagcaggac

SEQ ID NO: 1558527 - RNA, 17 nt, Human adenovirus C
gacagcaacuuggcgau

SEQ ID NO: 1558528 - RNA, 12 nt, Human adenovirus C
cggccguccgcc

SEQ ID NO: 1558529 - RNA, 15 nt, Human adenovirus C
cggcggcagcagcag

SEQ ID NO: 1558530 - RNA, 15 nt, Human adenovirus C
cggcggcggcaggag

SEQ ID NO: 1558531 - RNA, 18 nt, Human adenovirus C
guuuugcgacccggcacc

SEQ ID NO: 1558532 - RNA, 19 nt, Human adenovirus C
guuucagccccccggcgcc

SEQ ID NO: 1558533 - RNA, 20 nt, Human adenovirus C
uggacaugaccgcgcgcaac

SEQ ID NO: 1558534 - RNA, 13 nt, Human adenovirus C
ugcguggaagaac

SEQ ID NO: 1558535 - RNA, 22 nt, Human adenovirus C
ugacuaccuuuccgccgccaac

SEQ ID NO: 1558536 - RNA, 14 nt, Human adenovirus C
ugacugcgcguaac

SEQ ID NO: 1558537 - RNA, 13 nt, Human adenovirus C
ugacacccgcaac

SEQ ID NO: 1558538 - RNA, 21 nt, Human adenovirus C
gcuuaccccgccaacgugccc

SEQ ID NO: 1558539 - RNA, 15 nt, Human adenovirus C
ggaggagaagcgcgc

SEQ ID NO: 1558540 - RNA, 22 nt, Human adenovirus C
ggagcuggugcugcgcgcggag

SEQ ID NO: 1558541 - RNA, 20 nt, Human adenovirus C
ggugacggccuacuggagug

SEQ ID NO: 1558542 - RNA, 19 nt, Human adenovirus C
ggugcagacccugcgagug

SEQ ID NO: 1558543 - RNA, 19 nt, Human adenovirus C
ggugcaguuugcccgcgcc

SEQ ID NO: 1558544 - RNA, 23 nt, Human adenovirus C
gugcgcgggcacuaccgcgcgcc

SEQ ID NO: 1558545 - RNA, 19 nt, Human adenovirus C
ggguaucauggcggacgac

SEQ ID NO: 1558546 - RNA, 16 nt, Human adenovirus C
ggucaucgcgccggag

SEQ ID NO: 1558547 - RNA, 14 nt, Human adenovirus C
gcgcgcccgccagc

SEQ ID NO: 1558548 - RNA, 17 nt, Human adenovirus C
ggccguucucgcggggg

SEQ ID NO: 1558549 - RNA, 21 nt, Human adenovirus C
gcaccguccgaagaaaagcgc

SEQ ID NO: 1558550 - RNA, 13 nt, Human adenovirus C
gagggcccggcgc

SEQ ID NO: 1558551 - RNA, 13 nt, Human adenovirus C
gauagcggccggg

SEQ ID NO: 1558552 - RNA, 18 nt, Human adenovirus C
cgcggcaaacgcucugca

SEQ ID NO: 1558553 - RNA, 20 nt, Human adenovirus C
cguggcgaaaagcguccgcg

SEQ ID NO: 1558554 - RNA, 19 nt, Human adenovirus C
cucgcucgacgaagugcca

SEQ ID NO: 1558555 - RNA, 12 nt, Human adenovirus C
ugugcccggccc

SEQ ID NO: 1558556 - RNA, 22 nt, Human adenovirus C
uguccaucaacgcgcgcgcagc

SEQ ID NO: 1558557 - RNA, 19 nt, Human adenovirus C
uggucccggcgcgcgcaaa

SEQ ID NO: 1558558 - RNA, 21 nt, Human adenovirus C
ugggcauccgcaagcggcaac

SEQ ID NO: 1558559 - RNA, 13 nt, Human adenovirus C
ugggccgcggggg

SEQ ID NO: 1558560 - RNA, 16 nt, Human adenovirus C
ugcgcgugcgcgggca

SEQ ID NO: 1558561 - RNA, 18 nt, Human adenovirus C
ugcggccuaccgggggga

SEQ ID NO: 1558562 - RNA, 20 nt, Human adenovirus C
uucacggacaguggcagcgu

SEQ ID NO: 1558563 - RNA, 19 nt, Human adenovirus C
uucccgcacuguuggaugu

SEQ ID NO: 1558564 - RNA, 20 nt, Human adenovirus C
uugcugacacuguaccgcga

SEQ ID NO: 1558565 - RNA, 22 nt, Human adenovirus C
ugcgacgucagacaacggggga

SEQ ID NO: 1558566 - RNA, 23 nt, Human adenovirus C
ugcgcacccgccccccgcgcaac

SEQ ID NO: 1558567 - RNA, 19 nt, Human adenovirus C
guggggcuccucccaggca

SEQ ID NO: 1558568 - RNA, 13 nt, Human adenovirus C
guggucccggcgc

SEQ ID NO: 1558569 - RNA, 17 nt, Human adenovirus C
guguaccaguccgggcc

SEQ ID NO: 1558570 - RNA, 15 nt, Human adenovirus C
uacugcaccggcggc

SEQ ID NO: 1558571 - RNA, 20 nt, Human adenovirus C
cuggaacagagcucuaacag

SEQ ID NO: 1558572 - RNA, 21 nt, Human adenovirus C
gaagcugcagcugccgccgcc

SEQ ID NO: 1558573 - RNA, 18 nt, Human adenovirus C
gacggcggccuggcgcaa

SEQ ID NO: 1558574 - RNA, 12 nt, Human adenovirus C
cggggacaggag

SEQ ID NO: 1558575 - RNA, 14 nt, Human adenovirus C
cggugaaccaggag

SEQ ID NO: 1558576 - RNA, 14 nt, Human adenovirus C
cggugacgcgggcg

SEQ ID NO: 1558577 - RNA, 13 nt, Human adenovirus C
cucuugcguccgc

SEQ ID NO: 1558578 - RNA, 17 nt, Human adenovirus C
cugaggcuacagaggag

SEQ ID NO: 1558579 - RNA, 14 nt, Human adenovirus C
gugagcgcggcgcc

SEQ ID NO: 1558580 - RNA, 19 nt, Human adenovirus C
gugagcgugagccggcggc

SEQ ID NO: 1558581 - RNA, 13 nt, Human adenovirus C
gugaugcuggaug

SEQ ID NO: 1558582 - RNA, 14 nt, Human adenovirus C
gugcaguuggccau

SEQ ID NO: 1558583 - RNA, 20 nt, Human adenovirus C
ggaaccgggacuggaacaau

SEQ ID NO: 1558584 - RNA, 20 nt, Human adenovirus C
ggaagacguaugcgcaggag

SEQ ID NO: 1558585 - RNA, 21 nt, Human adenovirus C
ggacaggcuuaccccgccaac

SEQ ID NO: 1558586 - RNA, 17 nt, Human adenovirus C
guacucguacaaagcgc

SEQ ID NO: 1558587 - RNA, 22 nt, Human adenovirus C
guagcacgucgccaccgccgcc

SEQ ID NO: 1558588 - RNA, 15 nt, Human adenovirus C
gucaauacggccggu

SEQ ID NO: 1558589 - RNA, 21 nt, Human adenovirus C
gucgugcgcaccaccggcggc

SEQ ID NO: 1558590 - RNA, 14 nt, Human adenovirus C
gcucgccgcccagc

SEQ ID NO: 1558591 - RNA, 21 nt, Human adenovirus C
gcguggcccuuggcgcgcagc

SEQ ID NO: 1558592 - RNA, 21 nt, Human adenovirus C
gcccuucacggacaguggcag

SEQ ID NO: 1558593 - RNA, 20 nt, Human adenovirus C
gccgcuggacgagggcaacc

SEQ ID NO: 1558594 - RNA, 15 nt, Human adenovirus C
gccuaccaggcaagc

SEQ ID NO: 1558595 - RNA, 19 nt, Human adenovirus C
caacguguuuauuuuucaa

SEQ ID NO: 1558596 - RNA, 23 nt, Human adenovirus C
auauuggcuaccagggcuucuac

SEQ ID NO: 1558597 - RNA, 13 nt, Human adenovirus C
aucccuccgggga

SEQ ID NO: 1558598 - RNA, 14 nt, Human adenovirus C
aggcguacgugccg

SEQ ID NO: 1558599 - RNA, 22 nt, Human adenovirus C
auacggccgccagagcuuccac

SEQ ID NO: 1558600 - RNA, 13 nt, Human adenovirus C
acacggccuccac

SEQ ID NO: 1558601 - RNA, 14 nt, Human adenovirus C
aauaggcaaaaccg

SEQ ID NO: 1558602 - RNA, 13 nt, Human adenovirus C
accgcccgcggga

SEQ ID NO: 1558603 - RNA, 19 nt, Human adenovirus C
accgugaaugcccuccgcc

SEQ ID NO: 1558604 - RNA, 19 nt, Human adenovirus C
ccaucuauaggccuaucau

SEQ ID NO: 1558605 - RNA, 22 nt, Human adenovirus C
ccauuuuuacaaagcgcgggcg

SEQ ID NO: 1558606 - RNA, 20 nt, Human adenovirus C
cccaauuacauugcuuucag

SEQ ID NO: 1558607 - RNA, 13 nt, Human adenovirus C
ccccuccgcggcg

SEQ ID NO: 1558608 - RNA, 13 nt, Human adenovirus C
ccccucgccggcg

SEQ ID NO: 1558609 - RNA, 20 nt, Human adenovirus C
ccccuucggcaucgcgggcg

SEQ ID NO: 1558610 - RNA, 20 nt, Human adenovirus C
cccgaauaaacuacaugagc

SEQ ID NO: 1558611 - RNA, 21 nt, Human adenovirus C
cccuaucagcagccgcgggcc

SEQ ID NO: 1558612 - RNA, 16 nt, Human adenovirus C
ccuuccaggcgcggcg

SEQ ID NO: 1558613 - RNA, 16 nt, Human adenovirus C
ccuuauaucgcccagc

SEQ ID NO: 1558614 - RNA, 13 nt, Human adenovirus C
cgaggaggaggag

SEQ ID NO: 1558615 - RNA, 15 nt, Human adenovirus C
cgccgcgcgcgggca

SEQ ID NO: 1558616 - RNA, 15 nt, Human adenovirus C
gagcccacccuucuu

SEQ ID NO: 1558617 - RNA, 20 nt, Human adenovirus C
gaucgcacccuuuggcgcau

SEQ ID NO: 1558618 - RNA, 21 nt, Human adenovirus C
gaucuccugaaucuggcgccu

SEQ ID NO: 1558619 - RNA, 19 nt, Human adenovirus C
gagcgcugcgucuggcgcc

SEQ ID NO: 1558620 - RNA, 23 nt, Human adenovirus C
ccgcgcaccuggcggacauuauc

SEQ ID NO: 1558621 - RNA, 22 nt, Human adenovirus C
cgccugcugccaugcgcgggcg

SEQ ID NO: 1558622 - RNA, 20 nt, Human adenovirus C
uccuaccuuggaauuuugca

SEQ ID NO: 1558623 - RNA, 16 nt, Human adenovirus C
ggcgccgugcccggaa

SEQ ID NO: 1558624 - RNA, 17 nt, Human adenovirus C
ggcgcgcacaaacgcgg

SEQ ID NO: 1558625 - RNA, 21 nt, Human adenovirus C
ggcggcccugcuuaaccgcgc

SEQ ID NO: 1558626 - RNA, 13 nt, Human adenovirus C
ggcggcgcgcaac

SEQ ID NO: 1558627 - RNA, 16 nt, Human adenovirus C
gcgccgcgcgcgggca

SEQ ID NO: 1558628 - RNA, 20 nt, Human adenovirus C
gcgccguagcgccauugcuu

SEQ ID NO: 1558629 - RNA, 16 nt, Human adenovirus C
gcgccgugccgccagc

SEQ ID NO: 1558630 - RNA, 20 nt, Human adenovirus C
gcgcgcaacuacacgcccac

SEQ ID NO: 1558631 - RNA, 14 nt, Human adenovirus C
ucccaucgcgcaac

SEQ ID NO: 1558632 - RNA, 20 nt, Human adenovirus C
cuaugcaccccgcaccgcuc

SEQ ID NO: 1558633 - RNA, 23 nt, Human adenovirus C
gagcugcugagccgccgugcgcc

SEQ ID NO: 1558634 - RNA, 20 nt, Human adenovirus C
gauuugggagggaguggcaa

SEQ ID NO: 1558635 - RNA, 15 nt, Human adenovirus C
gcaaccgcgcccagg

SEQ ID NO: 1558636 - RNA, 20 nt, Human adenovirus C
cuacgaaaaaaccacuaccg

SEQ ID NO: 1558637 - RNA, 19 nt, Human adenovirus C
ccgggucagggcgcgggcu

SEQ ID NO: 1558638 - RNA, 20 nt, Human adenovirus C
ccguccgccgugauccaugc

SEQ ID NO: 1558639 - RNA, 17 nt, Human adenovirus C
cacccacggacgaggag

SEQ ID NO: 1558640 - RNA, 15 nt, Human adenovirus C
acugcagccuccgcc

SEQ ID NO: 1558641 - RNA, 16 nt, Human adenovirus C
acuggaacccgccgcc

SEQ ID NO: 1558642 - RNA, 20 nt, Human adenovirus C
acugguguuuagugcuccac

SEQ ID NO: 1558643 - RNA, 19 nt, Human adenovirus C
acuguugucuuccguccgc

SEQ ID NO: 1558644 - RNA, 12 nt, Human adenovirus C
acuacguccgcg

SEQ ID NO: 1558645 - RNA, 21 nt, Human adenovirus C
cagagcauaguggugcaggag

SEQ ID NO: 1558646 - RNA, 23 nt, Human adenovirus C
cagaggagguuuuggacgaggag

SEQ ID NO: 1558647 - RNA, 11 nt, Human adenovirus C
aagcaaaacca

SEQ ID NO: 1558648 - RNA, 13 nt, Human adenovirus C
cgagggagaggag

SEQ ID NO: 1558649 - RNA, 21 nt, Human adenovirus C
cgaggucgauggccgcgggcu

SEQ ID NO: 1558650 - RNA, 14 nt, Human adenovirus C
cgccggcacugccu

SEQ ID NO: 1558651 - RNA, 20 nt, Human adenovirus C
cgccgggcccggcacuaccu

SEQ ID NO: 1558652 - RNA, 14 nt, Human adenovirus C
cgccugacacaccu

SEQ ID NO: 1558653 - RNA, 20 nt, Human adenovirus C
cggaggagcaacagcaggag

SEQ ID NO: 1558654 - RNA, 16 nt, Human adenovirus C
augcagcgcgcggcga

SEQ ID NO: 1558655 - RNA, 20 nt, Human adenovirus C
augccaggccuacaaauccu

SEQ ID NO: 1558656 - RNA, 16 nt, Human adenovirus C
augccauucgcggcga

SEQ ID NO: 1558657 - RNA, 15 nt, Human adenovirus C
aucuccccgcggcga

SEQ ID NO: 1558658 - RNA, 22 nt, Human adenovirus C
augacaccgaacagggcgggga

SEQ ID NO: 1558659 - RNA, 22 nt, Human adenovirus C
cagcggguuuaucaccgugcuu

SEQ ID NO: 1558660 - RNA, 17 nt, Human adenovirus C
cagucgagaaggaggac

SEQ ID NO: 1558661 - RNA, 15 nt, Human adenovirus C
agcccgacgcgcgga

SEQ ID NO: 1558662 - RNA, 17 nt, Human adenovirus C
agcccgccaacgugccg

SEQ ID NO: 1558663 - RNA, 23 nt, Human adenovirus C
agcccgccaacgugccgcgggga

SEQ ID NO: 1558664 - RNA, 13 nt, Human adenovirus C
aucgccgcggcga

SEQ ID NO: 1558665 - RNA, 14 nt, Human adenovirus C
agcucccgcggcga

SEQ ID NO: 1558666 - RNA, 22 nt, Human adenovirus C
cugugcugccagggccguccgc

SEQ ID NO: 1558667 - RNA, 12 nt, Human adenovirus C
gaccgccugcuu

SEQ ID NO: 1558668 - RNA, 14 nt, Human adenovirus C
gcacgcaaccgcgc

SEQ ID NO: 1558669 - RNA, 20 nt, Human adenovirus C
gcacgcccuucucggccggc

SEQ ID NO: 1558670 - RNA, 15 nt, Human adenovirus C
gcacugccgcccaac

SEQ ID NO: 1558671 - RNA, 14 nt, Human adenovirus C
gcagcaccuugcgu

SEQ ID NO: 1558672 - RNA, 19 nt, Human adenovirus C
gcagccgcgggcccuugcu

SEQ ID NO: 1558673 - RNA, 22 nt, Human adenovirus C
cugggacagucaggcagaggag

SEQ ID NO: 1558674 - RNA, 20 nt, Human adenovirus C
cugcugagccgccgugcgcc

SEQ ID NO: 1558675 - RNA, 20 nt, Human adenovirus C
gcauuccccucgccggcgcc

SEQ ID NO: 1558676 - RNA, 19 nt, Human adenovirus C
gcauccgcaagcggcaacc

SEQ ID NO: 1558677 - RNA, 22 nt, Human adenovirus C
guaagucuaagcagccgccgcc

SEQ ID NO: 1558678 - RNA, 22 nt, Human adenovirus C
ggagccugggcuggagcccgag

SEQ ID NO: 1558679 - RNA, 16 nt, Human adenovirus C
guacggcaccgccagc

SEQ ID NO: 1558680 - RNA, 18 nt, Human adenovirus C
gcguaggagucgcgcagc

SEQ ID NO: 1558681 - RNA, 20 nt, Human adenovirus C
gcuagccaacuaccuugccu

SEQ ID NO: 1558682 - RNA, 20 nt, Human adenovirus C
ggacgcgacgagaaacgcgc

SEQ ID NO: 1558683 - RNA, 17 nt, Human adenovirus C
gcccgggggaggcaagc

SEQ ID NO: 1558684 - RNA, 17 nt, Human adenovirus C
gccggucuucgcccugc

SEQ ID NO: 1558685 - RNA, 21 nt, Human adenovirus C
gcgacgagcggccgccgcagc

SEQ ID NO: 1558686 - RNA, 20 nt, Human adenovirus C
gcgacgggguaacgcccagc

SEQ ID NO: 1558687 - RNA, 18 nt, Human adenovirus C
gcggccacacccggcgcc

SEQ ID NO: 1558688 - RNA, 18 nt, Human adenovirus C
gcgcgcuaccaccccagc

SEQ ID NO: 1558689 - RNA, 18 nt, Human adenovirus C
ggccaggacgccucggag

SEQ ID NO: 1558690 - RNA, 15 nt, Human adenovirus C
ggcgggcccccggag

SEQ ID NO: 1558691 - RNA, 22 nt, Human adenovirus C
ggcucgcucccuguagccggag

SEQ ID NO: 1558692 - RNA, 17 nt, Human adenovirus C
gggcgcaguuggaagac

SEQ ID NO: 1558693 - RNA, 21 nt, Human adenovirus C
gggcugcucugcucggaagac

SEQ ID NO: 1558694 - RNA, 21 nt, Human adenovirus C
caccucuggggauggcgggcg

SEQ ID NO: 1558695 - RNA, 19 nt, Human adenovirus C
cacgaucuuggccuugcua

SEQ ID NO: 1558696 - RNA, 17 nt, Human adenovirus C
acgucgccaccgccgcc

SEQ ID NO: 1558697 - RNA, 14 nt, Human adenovirus C
agaagaacaugccg

SEQ ID NO: 1558698 - RNA, 13 nt, Human adenovirus C
agacgacgaggau

SEQ ID NO: 1558699 - RNA, 18 nt, Human adenovirus C
agaccugggccaaaaccu

SEQ ID NO: 1558700 - RNA, 20 nt, Human adenovirus C
caccgaacagggcggggaug

SEQ ID NO: 1558701 - RNA, 19 nt, Human adenovirus C
acgguuugaggccguccgc

SEQ ID NO: 1558702 - RNA, 14 nt, Human adenovirus C
ccguucucgcgggg

SEQ ID NO: 1558703 - RNA, 22 nt, Human adenovirus C
cuaacaguggcaaccaccgcuc

SEQ ID NO: 1558704 - RNA, 20 nt, Human adenovirus C
cuaaccagcguagccccuau

SEQ ID NO: 1558705 - RNA, 15 nt, Human adenovirus C
ccgcguccaaaaccu

SEQ ID NO: 1558706 - RNA, 16 nt, Human adenovirus C
ccgcauccccgcggcg

SEQ ID NO: 1558707 - RNA, 22 nt, Human adenovirus C
ccgcaccgcucccuggucugca

SEQ ID NO: 1558708 - RNA, 17 nt, Human adenovirus C
cagaaagcuacaaggac

SEQ ID NO: 1558709 - RNA, 20 nt, Human adenovirus C
ccaagaugagguacaugauu

SEQ ID NO: 1558710 - RNA, 18 nt, Human adenovirus C
ccaacguggagcucugca

SEQ ID NO: 1558711 - RNA, 15 nt, Human adenovirus C
caagucauuuuucau

SEQ ID NO: 1558712 - RNA, 18 nt, Human adenovirus C
caaaauuuccaacgugga

SEQ ID NO: 1558713 - RNA, 21 nt, Human adenovirus C
augguugguggacgucgcgcc

SEQ ID NO: 1558714 - RNA, 20 nt, Human adenovirus C
auguccaugggcgcacucac

SEQ ID NO: 1558715 - RNA, 12 nt, Human adenovirus C
ccccacaugaua

SEQ ID NO: 1558716 - RNA, 14 nt, Human adenovirus C
cccggccacuaccc

SEQ ID NO: 1558717 - RNA, 16 nt, Human adenovirus C
aaaucaggcaaagccu

SEQ ID NO: 1558718 - RNA, 15 nt, Human adenovirus C
aaagcuauguugggu

SEQ ID NO: 1558719 - RNA, 20 nt, Human adenovirus C
aaaccagcuggccaaaaccu

SEQ ID NO: 1558720 - RNA, 20 nt, Human adenovirus C
aaaagaagcugcagcugccg

SEQ ID NO: 1558721 - RNA, 19 nt, Human adenovirus C
aaaagauuauccaaaaccu

SEQ ID NO: 1558722 - RNA, 21 nt, Human
cucgugccaccccgagggcug

SEQ ID NO: 1558723 - RNA, 13 nt, Human
ccuuccccagcau

SEQ ID NO: 1558724 - RNA, 12 nt, Human
ccuuccccagca

SEQ ID NO: 1558725 - RNA, 14 nt, Human
cuaagucauucaua

SEQ ID NO: 1558726 - RNA, 16 nt, Human
cccugacagggccagu

SEQ ID NO: 1558727 - RNA, 13 nt, Human
cccugacagggcc

SEQ ID NO: 1558728 - RNA, 16 nt, Human
cccuggaugcccagga

SEQ ID NO: 1558729 - RNA, 15 nt, Human
cccuggaugcccagg

SEQ ID NO: 1558730 - RNA, 19 nt, Human
cccagcaugcaccacgggc

SEQ ID NO: 1558731 - RNA, 23 nt, Human
cccagcaugcaccacgggcccgg

SEQ ID NO: 1558732 - RNA, 15 nt, Human
ccagacggggcugga

SEQ ID NO: 1558733 - RNA, 15 nt, Human
ccagaucaaggaugu

SEQ ID NO: 1558734 - RNA, 18 nt, Human
ccagacuugggaggaugu

SEQ ID NO: 1558735 - RNA, 15 nt, Human
caggaccccagcucu

SEQ ID NO: 1558736 - RNA, 14 nt, Human
caggaccccagcuc

SEQ ID NO: 1558737 - RNA, 13 nt, Human
caggaccccagcu

SEQ ID NO: 1558738 - RNA, 12 nt, Human
caggaccccagc

SEQ ID NO: 1558739 - RNA, 17 nt, Human
caggaccucgugccacc

SEQ ID NO: 1558740 - RNA, 14 nt, Human
cauuuguuguuuga

SEQ ID NO: 1558741 - RNA, 17 nt, Human
gccggccaguggccuuc

SEQ ID NO: 1558742 - RNA, 15 nt, Human
gccuccucaggagcc

SEQ ID NO: 1558743 - RNA, 17 nt, Human
gccaccccgagggcuga

SEQ ID NO: 1558744 - RNA, 23 nt, Human
gccaccccgagggcugagccugg

SEQ ID NO: 1558745 - RNA, 16 nt, Human
gccaccccgagggcug

SEQ ID NO: 1558746 - RNA, 13 nt, Human
ggaccccagcucu

SEQ ID NO: 1558747 - RNA, 15 nt, Human
ggaccccagcucugc

SEQ ID NO: 1558748 - RNA, 12 nt, Human
ggaccccagcuc

SEQ ID NO: 1558749 - RNA, 17 nt, Human
aaaagcuggauuuucuu

SEQ ID NO: 1558750 - RNA, 18 nt, Human
gaccucgugccaccccga

SEQ ID NO: 1558751 - RNA, 20 nt, Human
gagggcugagccugguccca

SEQ ID NO: 1558752 - RNA, 20 nt, Human
cuuauuagaaaaauauuaua

SEQ ID NO: 1558753 - RNA, 15 nt, Human
cuggaugcccaggaa

SEQ ID NO: 1558754 - RNA, 14 nt, Human
cuggaugcccagga

SEQ ID NO: 1558755 - RNA, 13 nt, Human
cuggaugcccagg

SEQ ID NO: 1558756 - RNA, 16 nt, Human
cuggaugcccaggaau

SEQ ID NO: 1558757 - RNA, 14 nt, Human
cuggaugauauuuu

SEQ ID NO: 1558758 - RNA, 11 nt, Human
cuggugcccug

SEQ ID NO: 1558759 - RNA, 15 nt, Human
cugcagccugcagga

SEQ ID NO: 1558760 - RNA, 19 nt, Human
cugcagccugcaggaccuc

SEQ ID NO: 1558761 - RNA, 14 nt, Human
cugcagccugcagg

SEQ ID NO: 1558762 - RNA, 12 nt, Human
cugcagccugca

SEQ ID NO: 1558763 - RNA, 16 nt, Human
aacauuugcugucagc

SEQ ID NO: 1558764 - RNA, 23 nt, Human
gugccguguccccugacagggcc

SEQ ID NO: 1558765 - RNA, 22 nt, Human
gugccguguccccugacagggc

SEQ ID NO: 1558766 - RNA, 18 nt, Human
uaguuuugugaaggugau

SEQ ID NO: 1558767 - RNA, 12 nt, Human
accauuauuuuu

SEQ ID NO: 1558768 - RNA, 16 nt, Human
accagacggggcugga

SEQ ID NO: 1558769 - RNA, 21 nt, Human
accagacggggcuggagugug

SEQ ID NO: 1558770 - RNA, 15 nt, Human
accagacggggcugg

SEQ ID NO: 1558771 - RNA, 14 nt, Human
accagacggggcug

SEQ ID NO: 1558772 - RNA, 18 nt, Human
acaguugcuguuguguga

SEQ ID NO: 1558773 - RNA, 23 nt, Human
accucgugccaccccgagggcug

SEQ ID NO: 1558774 - RNA, 19 nt, Human
accucgugccaccccgagg

SEQ ID NO: 1558775 - RNA, 17 nt, Human
acgggcccggguugggu

SEQ ID NO: 1558776 - RNA, 16 nt, Human
acgggcccggguuggg

SEQ ID NO: 1558777 - RNA, 21 nt, Human
acgggcccggguugggucacc

SEQ ID NO: 1558778 - RNA, 20 nt, Human
acgggcccggguugggucac

SEQ ID NO: 1558779 - RNA, 16 nt, Human
ucgguccuggugcccu

SEQ ID NO: 1558780 - RNA, 13 nt, Human
ucgguccuggugc

SEQ ID NO: 1558781 - RNA, 15 nt, Human
acuuauagauugaaa

SEQ ID NO: 1558782 - RNA, 19 nt, Human
acuugaauaaccaucugaa

SEQ ID NO: 1558783 - RNA, 20 nt, Human
acuugaauaaccaucugaaa

SEQ ID NO: 1558784 - RNA, 15 nt, Human
agagucuccauuuaa

SEQ ID NO: 1558785 - RNA, 18 nt, Human
aggagccgaagcccaggg

SEQ ID NO: 1558786 - RNA, 16 nt, Human
aggagccgaagcccag

SEQ ID NO: 1558787 - RNA, 21 nt, Human
uggagugugaggguccugcag

SEQ ID NO: 1558788 - RNA, 13 nt, Human
agggaggcagggg

SEQ ID NO: 1558789 - RNA, 20 nt, Human
uggggccaugccuccucagg

SEQ ID NO: 1558790 - RNA, 21 nt, Human
uggggccaugccuccucagga

SEQ ID NO: 1558791 - RNA, 19 nt, Human
uggggccaugccuccucag

SEQ ID NO: 1558792 - RNA, 14 nt, Human
uggggccaugccuc

SEQ ID NO: 1558793 - RNA, 23 nt, Human
aggggugcggcggucccagcucc

SEQ ID NO: 1558794 - RNA, 21 nt, Human
aggggugcggcggucccagcu

SEQ ID NO: 1558795 - RNA, 20 nt, Human
aggggugcggcggucccagc

SEQ ID NO: 1558796 - RNA, 22 nt, Human
aggggugcggcggucccagcuc

SEQ ID NO: 1558797 - RNA, 18 nt, Human
aggugauauuuuucuuau

SEQ ID NO: 1558798 - RNA, 19 nt, Human
uggugcccuggaugcccag

SEQ ID NO: 1558799 - RNA, 14 nt, Human
uguaguaucucaua

SEQ ID NO: 1558800 - RNA, 21 nt, Human
agucucaugccuugagaucug

SEQ ID NO: 1558801 - RNA, 19 nt, Human
agucucaugccuugagauc

SEQ ID NO: 1558802 - RNA, 16 nt, Human
ugugccacaggcuuag

SEQ ID NO: 1558803 - RNA, 12 nt, Human
ugugccacaggc

SEQ ID NO: 1558804 - RNA, 20 nt, Human
uuuacuucuaagucauucau

SEQ ID NO: 1558805 - RNA, 23 nt, Human
uuuaggauguguauuucauuuau

SEQ ID NO: 1558806 - RNA, 12 nt, Human
uuuuugauauau

SEQ ID NO: 1558807 - RNA, 16 nt, Human
auuauaaaguuuucua

SEQ ID NO: 1558808 - RNA, 13 nt, Human
auuauaaaguuuu

SEQ ID NO: 1558809 - RNA, 16 nt, Human
auuauaacucauuugu

SEQ ID NO: 1558810 - RNA, 21 nt, Human
uuugacacuuauagauugaaa

SEQ ID NO: 1558811 - RNA, 18 nt, Human
uuuuccaaucauuugacu

SEQ ID NO: 1558812 - RNA, 22 nt, Human
aagagucgcugugccacaggcu

SEQ ID NO: 1558813 - RNA, 15 nt, Human
aagagucgcugugcc

SEQ ID NO: 1558814 - RNA, 19 nt, Human
accacgggcccggguuggg

SEQ ID NO: 1558815 - RNA, 13 nt, Human
agcaucuaucaga

SEQ ID NO: 1558816 - RNA, 21 nt, Human
agggacaggaccccagcucug

SEQ ID NO: 1558817 - RNA, 16 nt, Human
caccagacggggcugg

SEQ ID NO: 1558818 - RNA, 17 nt, Human
caccagacggggcugga

SEQ ID NO: 1558819 - RNA, 21 nt, Human
ccacaggcuuagggacaggac

SEQ ID NO: 1558820 - RNA, 19 nt, Human
ccacaggcuuagggacagg

SEQ ID NO: 1558821 - RNA, 18 nt, Human
ccacaggcuuagggacag

SEQ ID NO: 1558822 - RNA, 15 nt, Human
ccacaggcuuaggga

SEQ ID NO: 1558823 - RNA, 12 nt, Human
cccaggggccgg

SEQ ID NO: 1558824 - RNA, 16 nt, Human
cccaggugauauuuuu

SEQ ID NO: 1558825 - RNA, 9 nt, Human
cccagcucc

SEQ ID NO: 1558826 - RNA, 19 nt, Human
ccccaggagggaggcaggg

SEQ ID NO: 1558827 - RNA, 18 nt, Human
ccccaggagggaggcagg

SEQ ID NO: 1558828 - RNA, 22 nt, Human
ccgagggcugagccugguccca

SEQ ID NO: 1558829 - RNA, 16 nt, Human
ccgagggcugagccug

SEQ ID NO: 1558830 - RNA, 13 nt, Human
ccgagggcugagc

SEQ ID NO: 1558831 - RNA, 16 nt, Human
ccugaagaacuauuuu

SEQ ID NO: 1558832 - RNA, 21 nt, Human
cgggcaggguguggggccaug

SEQ ID NO: 1558833 - RNA, 15 nt, Human
cgucgguccuggugc

SEQ ID NO: 1558834 - RNA, 24 nt, Human
cuuacuugcauaccaaguugauac

SEQ ID NO: 1558835 - RNA, 18 nt, Human
gacagggccagugcaguu

SEQ ID NO: 1558836 - RNA, 16 nt, Human
gaaggugauuuauucu

SEQ ID NO: 1558837 - RNA, 19 nt, Human
gaauaaucaaauacauuuu

SEQ ID NO: 1558838 - RNA, 16 nt, Human
gaagcccaggggccgg

SEQ ID NO: 1558839 - RNA, 19 nt, Human
gcaagcucuuuuauaugcu

SEQ ID NO: 1558840 - RNA, 15 nt, Human
gcaugcaccacgggc

SEQ ID NO: 1558841 - RNA, 14 nt, Human
gcaugcaccacggg

SEQ ID NO: 1558842 - RNA, 15 nt, Human
gcaccacgggcccgg

SEQ ID NO: 1558843 - RNA, 13 nt, Human
gcagccugcagga

SEQ ID NO: 1558844 - RNA, 16 nt, Human
gcagccugcaggaccu

SEQ ID NO: 1558845 - RNA, 15 nt, Human
gcaggaccucgugcc

SEQ ID NO: 1558846 - RNA, 22 nt, Human
gcggucccagcucccuggcucc

SEQ ID NO: 1558847 - RNA, 18 nt, Human
gcggucccagcucccugg

SEQ ID NO: 1558848 - RNA, 14 nt, Human
gcggucccagcucc

SEQ ID NO: 1558849 - RNA, 13 nt, Human
gcggucccagcuc

SEQ ID NO: 1558850 - RNA, 23 nt, Human
gccugcaggaccucgugccaccc

SEQ ID NO: 1558851 - RNA, 18 nt, Human
gccugcaggaccucgugc

SEQ ID NO: 1558852 - RNA, 17 nt, Human
gccugcaggaccucgug

SEQ ID NO: 1558853 - RNA, 13 nt, Human
gccugcaggaccu

SEQ ID NO: 1558854 - RNA, 17 nt, Human
gccgggcaggguguggg

SEQ ID NO: 1558855 - RNA, 19 nt, Human
ggagccgaagcccaggggc

SEQ ID NO: 1558856 - RNA, 17 nt, Human
ggagccgaagcccaggg

SEQ ID NO: 1558857 - RNA, 15 nt, Human
ggagccgaagcccag

SEQ ID NO: 1558858 - RNA, 22 nt, Human
ggagccgaagcccaggggccgg

SEQ ID NO: 1558859 - RNA, 11 nt, Human
ggcugagccug

SEQ ID NO: 1558860 - RNA, 19 nt, Human
ggucaccagacggggcugg

SEQ ID NO: 1558861 - RNA, 21 nt, Human
gggugcggcggucccagcucc

SEQ ID NO: 1558862 - RNA, 20 nt, Human
ggggugcggcggucccagcu

SEQ ID NO: 1558863 - RNA, 22 nt, Human
ggggugcggcggucccagcucc

SEQ ID NO: 1558864 - RNA, 20 nt, Human
uacuugaauaaccaucugaa

SEQ ID NO: 1558865 - RNA, 18 nt, Human
uacuugaauaaccaucug

SEQ ID NO: 1558866 - RNA, 16 nt, Human
uacagaaauauccaug

SEQ ID NO: 1558867 - RNA, 16 nt, Human
uaagagguugauuaua

SEQ ID NO: 1558868 - RNA, 14 nt, Human
guuuucuaaauuua

SEQ ID NO: 1558869 - RNA, 22 nt, Human
uccuggugcccuggaugcccag

SEQ ID NO: 1558870 - RNA, 13 nt, Human
uccuggugcccug

SEQ ID NO: 1558871 - RNA, 12 nt, Human
uccuggugcccu

SEQ ID NO: 1558872 - RNA, 18 nt, Human
ugccaccccgagggcuga

SEQ ID NO: 1558873 - RNA, 17 nt, Human
ugccaccccgagggcug

SEQ ID NO: 1558874 - RNA, 13 nt, Human
uggaugcccagga

SEQ ID NO: 1558875 - RNA, 14 nt, Human
uggaugcccaggaa

SEQ ID NO: 1558876 - RNA, 19 nt, Human
uggaugauauuuuuuauca

SEQ ID NO: 1558877 - RNA, 14 nt, Human
uguguaguuccagc

SEQ ID NO: 1558878 - RNA, 15 nt, Human
uguuguuuuuggaug

SEQ ID NO: 1558879 - RNA, 23 nt, Human
uguggggccaugccuccucagga

SEQ ID NO: 1558880 - RNA, 17 nt, Human
ugugaggguccugcagc

SEQ ID NO: 1558881 - RNA, 22 nt, Human
uuccccagcaugcaccacgggc

SEQ ID NO: 1558882 - RNA, 14 nt, Human
uuugauauaugaaa

SEQ ID NO: 1558883 - RNA, 22 nt, Human
cucugcgucgguccuggugccc

SEQ ID NO: 1558884 - RNA, 21 nt, Human
cucugcgucgguccuggugcc

SEQ ID NO: 1558885 - RNA, 20 nt, Human
cucugcgucgguccuggugc

SEQ ID NO: 1558886 - RNA, 19 nt, Human
cucugcgucgguccuggug

SEQ ID NO: 1558887 - RNA, 17 nt, Human
cuccgccuuaccaggag

SEQ ID NO: 1558888 - RNA, 19 nt, Human
cggcggucccagcucccug

SEQ ID NO: 1558889 - RNA, 16 nt, Human
cggcggucccagcucc

SEQ ID NO: 1558890 - RNA, 15 nt, Human
cggcggucccagcuc

SEQ ID NO: 1558891 - RNA, 18 nt, Human
ccugcaggaccucgugcc

SEQ ID NO: 1558892 - RNA, 17 nt, Human
ccugcaggaccucgugc

SEQ ID NO: 1558893 - RNA, 19 nt, Human
ccugcagccugcaggaccu

SEQ ID NO: 1558894 - RNA, 22 nt, Human
ccaugucaagagucgcugugcc

SEQ ID NO: 1558895 - RNA, 21 nt, Human
cagccugcaggaccucgugcc

SEQ ID NO: 1558896 - RNA, 12 nt, Human
cagccugcagga

SEQ ID NO: 1558897 - RNA, 21 nt, Human
ggccaugccuccucaggagcc

SEQ ID NO: 1558898 - RNA, 18 nt, Human
ggccaugccuccucagga

SEQ ID NO: 1558899 - RNA, 17 nt, Human
ggccaugccuccucagg

SEQ ID NO: 1558900 - RNA, 22 nt, Human
ggccaguggccuuccccagcau

SEQ ID NO: 1558901 - RNA, 19 nt, Human
ggccaguggccuuccccag

SEQ ID NO: 1558902 - RNA, 22 nt, Human
ggccagugcaguuugguguguc

SEQ ID NO: 1558903 - RNA, 22 nt, Human
gggacaggaccccagcucugcg

SEQ ID NO: 1558904 - RNA, 21 nt, Human
gggacaggaccccagcucugc

SEQ ID NO: 1558905 - RNA, 19 nt, Human
gggacaggaccccagcucu

SEQ ID NO: 1558906 - RNA, 17 nt, Human
gggacaggaccccagcu

SEQ ID NO: 1558907 - RNA, 15 nt, Human
gggacaggaccccag

SEQ ID NO: 1558908 - RNA, 22 nt, Human
gggccaugccuccucaggagcc

SEQ ID NO: 1558909 - RNA, 23 nt, Human
gggccaugccuccucaggagccg

SEQ ID NO: 1558910 - RNA, 13 nt, Human
gggccaugccucc

SEQ ID NO: 1558911 - RNA, 13 nt, Human
gguccuggugccc

SEQ ID NO: 1558912 - RNA, 12 nt, Human
gguccuggugcc

SEQ ID NO: 1558913 - RNA, 24 nt, Human
gguccuggugcccuggaugcccag

SEQ ID NO: 1558914 - RNA, 14 nt, Human
gguccuggugcccu

SEQ ID NO: 1558915 - RNA, 21 nt, Human
gcuggagugugaggguccugc

SEQ ID NO: 1558916 - RNA, 15 nt, Human
gcuggagugugaggg

SEQ ID NO: 1558917 - RNA, 13 nt, Human
gcugugccacagg

SEQ ID NO: 1558918 - RNA, 19 nt, Human
gcugugccacaggcuuagg

SEQ ID NO: 1558919 - RNA, 20 nt, Human
gcugugccacaggcuuaggg

SEQ ID NO: 1558920 - RNA, 15 nt, Human
gcugugccacaggcu

SEQ ID NO: 1558921 - RNA, 14 nt, Human
gcugugccacaggc

SEQ ID NO: 1558922 - RNA, 21 nt, Human
gccaguggccuuccccagcau

SEQ ID NO: 1558923 - RNA, 17 nt, Human
cuucuaagucauucaua

SEQ ID NO: 1558924 - RNA, 18 nt, Human
gugccaccccgagggcug

SEQ ID NO: 1558925 - RNA, 15 nt, Human
gugaggguccugcag

SEQ ID NO: 1558926 - RNA, 14 nt, Human
gugaggguccugca

SEQ ID NO: 1558927 - RNA, 23 nt, Human
gugaggguccugcagccugcagg

SEQ ID NO: 1558928 - RNA, 24 nt, Human
gugaggguccugcagccugcagga

SEQ ID NO: 1558929 - RNA, 11 nt, Human
aaauuguguua

SEQ ID NO: 1558930 - RNA, 23 nt, Human
guguggggccaugccuccucagg

SEQ ID NO: 1558931 - RNA, 21 nt, Human
guguggggccaugccuccuca

SEQ ID NO: 1558932 - RNA, 14 nt, Human
guguauuucauuua

SEQ ID NO: 1558933 - RNA, 19 nt, Human
guggccuuccccagcaugc

SEQ ID NO: 1558934 - RNA, 21 nt, Human
guggccuuccccagcaugcac

SEQ ID NO: 1558935 - RNA, 18 nt, Human
guggccuuccccagcaug

SEQ ID NO: 1558936 - RNA, 17 nt, Human
guggccuuccccagcau

SEQ ID NO: 1558937 - RNA, 21 nt, Human
guggggccaugccuccucagg

SEQ ID NO: 1558938 - RNA, 22 nt, Human
guggggccaugccuccucagga

SEQ ID NO: 1558939 - RNA, 15 nt, Human
aagcccaggggccgg

SEQ ID NO: 1558940 - RNA, 18 nt, Human
uaccauuauuuuuaggau

SEQ ID NO: 1558941 - RNA, 20 nt, Human
aauuacuuacguauguuugu

SEQ ID NO: 1558942 - RNA, 15 nt, Human
uauaacucauuuguu

SEQ ID NO: 1558943 - RNA, 17 nt, Human
uagaaacauguaauccu

SEQ ID NO: 1558944 - RNA, 14 nt, Human
acgagggugccgug

SEQ ID NO: 1558945 - RNA, 15 nt, Human
uccccugacagggcc

SEQ ID NO: 1558946 - RNA, 12 nt, Human
uccccugacagg

SEQ ID NO: 1558947 - RNA, 11 nt, Human
accccagcucu

SEQ ID NO: 1558948 - RNA, 16 nt, Human
ucgcugugccacaggc

SEQ ID NO: 1558949 - RNA, 20 nt, Human
agaaauuacuaauuuuacuu

SEQ ID NO: 1558950 - RNA, 17 nt, Human
agaauaaucaaauacau

SEQ ID NO: 1558951 - RNA, 20 nt, Human
ugaaaaagcuggauuuucuu

SEQ ID NO: 1558952 - RNA, 12 nt, Human
agauuuuguugg

SEQ ID NO: 1558953 - RNA, 22 nt, Human
ugaccccaggagggaggcaggg

SEQ ID NO: 1558954 - RNA, 20 nt, Human
ugaccccaggagggaggcag

SEQ ID NO: 1558955 - RNA, 17 nt, Human
agccacauauugagaug

SEQ ID NO: 1558956 - RNA, 17 nt, Human
ugaucaaacaugucucu

SEQ ID NO: 1558957 - RNA, 19 nt, Human
ugauauuuuuuaucauaaa

SEQ ID NO: 1558958 - RNA, 17 nt, Human
ugauauuuuuuaucaua

SEQ ID NO: 1558959 - RNA, 14 nt, Human
ugaguagucucaug

SEQ ID NO: 1558960 - RNA, 17 nt, Human
ugcagccugcaggaccu

SEQ ID NO: 1558961 - RNA, 18 nt, Human
ugcagccugcaggaccuc

SEQ ID NO: 1558962 - RNA, 22 nt, Human
agccuggucccacgagggugcc

SEQ ID NO: 1558963 - RNA, 17 nt, Human
ugcggcggucccagcuc

SEQ ID NO: 1558964 - RNA, 14 nt, Human
ugcggcggucccag

SEQ ID NO: 1558965 - RNA, 13 nt, Human
ugcggcgguccca

SEQ ID NO: 1558966 - RNA, 18 nt, Human
ugcggcggucccagcucc

SEQ ID NO: 1558967 - RNA, 15 nt, Human
uggccuuccccagca

SEQ ID NO: 1558968 - RNA, 23 nt, Human
uggccuuccccagcaugcaccac

SEQ ID NO: 1558969 - RNA, 13 nt, Human
uggccuuccccag

SEQ ID NO: 1558970 - RNA, 23 nt, Human
aggguguggggccaugccuccuc

SEQ ID NO: 1558971 - RNA, 22 nt, Human
aggguguggggccaugccuccu

SEQ ID NO: 1558972 - RNA, 19 nt, Human
ugucaagagucgcugugcc

SEQ ID NO: 1558973 - RNA, 17 nt, Human
ugucaagagucgcugug

SEQ ID NO: 1558974 - RNA, 15 nt, Human
aguuagaacauuugc

SEQ ID NO: 1558975 - RNA, 16 nt, Human
uuacaggcacuaaagu

SEQ ID NO: 1558976 - RNA, 16 nt, Human
auaaccaucugaaagu

SEQ ID NO: 1558977 - RNA, 21 nt, Human
auaaucccuggaugauauuuu

SEQ ID NO: 1558978 - RNA, 20 nt, Human
auaaucccuggaugauauuu

SEQ ID NO: 1558979 - RNA, 22 nt, Human
uuagggacaggaccccagcucu

SEQ ID NO: 1558980 - RNA, 21 nt, Human
uuagggacaggaccccagcuc

SEQ ID NO: 1558981 - RNA, 20 nt, Human
auaguucccaggugauauuu

SEQ ID NO: 1558982 - RNA, 18 nt, Human
uuaguuuugugaagguga

SEQ ID NO: 1558983 - RNA, 13 nt, Human
uugaaauuuccua

SEQ ID NO: 1558984 - RNA, 14 nt, Human
uuccuuuuuuugau

SEQ ID NO: 1558985 - RNA, 17 nt, Human
uuuaagcaaguuaagug

SEQ ID NO: 1558986 - RNA, 16 nt, Human
uuuaagcaaguuaagu

SEQ ID NO: 1558987 - RNA, 14 nt, Human
auggccgggcaggg

SEQ ID NO: 1558988 - RNA, 22 nt, Human
uuggaugguguuacauauuaua

SEQ ID NO: 1558989 - RNA, 23 nt, Human
aguugauacuugaauaaccaucu

SEQ ID NO: 1558990 - RNA, 17 nt, Human
aguggccuuccccagca

SEQ ID NO: 1558991 - RNA, 13 nt, Human
agggacuuagcaa

SEQ ID NO: 1558992 - RNA, 21 nt, Human
aggguccugcagccugcagga

SEQ ID NO: 1558993 - RNA, 19 nt, Human
aggguccugcagccugcag

SEQ ID NO: 1558994 - RNA, 17 nt, Human
aggguccugcagccugc

SEQ ID NO: 1558995 - RNA, 16 nt, Human
aggguccugcagccug

SEQ ID NO: 1558996 - RNA, 23 nt, Human
aggcuuagggacaggaccccagc

SEQ ID NO: 1558997 - RNA, 21 nt, Human
aacuuacuugcauaccaaguu

SEQ ID NO: 1558998 - RNA, 17 nt, Human
acagggccagugcaguu

SEQ ID NO: 1558999 - RNA, 22 nt, Human
accaucugaaagugguacuuga

SEQ ID NO: 1559000 - RNA, 22 nt, Human
caagagucgcugugccacaggc

SEQ ID NO: 1559001 - RNA, 19 nt, Human
caagagucgcugugccaca

SEQ ID NO: 1559002 - RNA, 15 nt, Human
ccaugccuccucagg

SEQ ID NO: 1559003 - RNA, 16 nt, Human
ccaugccuccucagga

SEQ ID NO: 1559004 - RNA, 17 nt, Human
cccacgagggugccgug

SEQ ID NO: 1559005 - RNA, 12 nt, Human
cccagcucugcg

SEQ ID NO: 1559006 - RNA, 11 nt, Human
cccagcucugc

SEQ ID NO: 1559007 - RNA, 22 nt, Human
ccagcucugcgucgguccuggu

SEQ ID NO: 1559008 - RNA, 17 nt, Human
ccagugcuuuauguugu

SEQ ID NO: 1559009 - RNA, 15 nt, Human
caugccuccucagga

SEQ ID NO: 1559010 - RNA, 19 nt, Human
cauagaaaacacuacagug

SEQ ID NO: 1559011 - RNA, 19 nt, Human
caguggccuuccccagcau

SEQ ID NO: 1559012 - RNA, 17 nt, Human
caguggccuuccccagc

SEQ ID NO: 1559013 - RNA, 18 nt, Human
caguggccuuccccagca

SEQ ID NO: 1559014 - RNA, 22 nt, Human
cggccaguggccuuccccagca

SEQ ID NO: 1559015 - RNA, 12 nt, Human
cggucccagcuc

SEQ ID NO: 1559016 - RNA, 13 nt, Human
cggucccagcucc

SEQ ID NO: 1559017 - RNA, 13 nt, Human
cgguccuggugcc

SEQ ID NO: 1559018 - RNA, 19 nt, Human
cgugccaccccgagggcug

SEQ ID NO: 1559019 - RNA, 22 nt, Human
cgugccaccccgagggcugagc

SEQ ID NO: 1559020 - RNA, 15 nt, Human
cgugccaccccgagg

SEQ ID NO: 1559021 - RNA, 12 nt, Human
cugacagggcca

SEQ ID NO: 1559022 - RNA, 17 nt, Human
cugacagggccagugca

SEQ ID NO: 1559023 - RNA, 12 nt, Human
cugagccugguc

SEQ ID NO: 1559024 - RNA, 19 nt, Human
cuggucccacgagggugcc

SEQ ID NO: 1559025 - RNA, 17 nt, Human
cuggucccacgagggug

SEQ ID NO: 1559026 - RNA, 14 nt, Human
cuggucccacgagg

SEQ ID NO: 1559027 - RNA, 19 nt, Human
gaaauuacuaauuuuacuu

SEQ ID NO: 1559028 - RNA, 20 nt, Human
gaaauuuccuaauuuauucu

SEQ ID NO: 1559029 - RNA, 20 nt, Human
gaaauuacuaauuuuacuuc

SEQ ID NO: 1559030 - RNA, 20 nt, Human
gacaugggugaacuuacuug

SEQ ID NO: 1559031 - RNA, 14 nt, Human
gaccccagcucugc

SEQ ID NO: 1559032 - RNA, 12 nt, Human
gaccccagcucu

SEQ ID NO: 1559033 - RNA, 15 nt, Human
gagccgaagcccagg

SEQ ID NO: 1559034 - RNA, 14 nt, Human
gagccgaagcccag

SEQ ID NO: 1559035 - RNA, 15 nt, Human
gccaugccuccucag

SEQ ID NO: 1559036 - RNA, 18 nt, Human
gccguguccccugacagg

SEQ ID NO: 1559037 - RNA, 13 nt, Human
gccgaagcccagg

SEQ ID NO: 1559038 - RNA, 12 nt, Human
gccuccucagga

SEQ ID NO: 1559039 - RNA, 15 nt, Human
gcgucgguccuggug

SEQ ID NO: 1559040 - RNA, 18 nt, Human
uuuuggaugguguuacau

SEQ ID NO: 1559041 - RNA, 15 nt, Human
uuuucuaaauuuauc

SEQ ID NO: 1559042 - RNA, 13 nt, Human
uuuuuugauauau

SEQ ID NO: 1559043 - RNA, 13 nt, Human
uuugaauaugaaa

SEQ ID NO: 1559044 - RNA, 15 nt, Human
guauguuuguacuug

SEQ ID NO: 1559045 - RNA, 16 nt, Human
gucaccagacggggcu

SEQ ID NO: 1559046 - RNA, 17 nt, Human
gucaccagacggggcug

SEQ ID NO: 1559047 - RNA, 17 nt, Human
gucgcugugccacaggc

SEQ ID NO: 1559048 - RNA, 18 nt, Human
gucgguccuggugcccug

SEQ ID NO: 1559049 - RNA, 17 nt, Human
gucgguccuggugcccu

SEQ ID NO: 1559050 - RNA, 15 nt, Human
gucgguccuggugcc

SEQ ID NO: 1559051 - RNA, 14 nt, Human
gugauauuuuucuu

SEQ ID NO: 1559052 - RNA, 22 nt, Human
gugcggcggucccagcucccug

SEQ ID NO: 1559053 - RNA, 19 nt, Human
gugcggcggucccagcucc

SEQ ID NO: 1559054 - RNA, 18 nt, Human
gugcggcggucccagcuc

SEQ ID NO: 1559055 - RNA, 21 nt, Human
gugcaguuugguguguccucc

SEQ ID NO: 1559056 - RNA, 14 nt, Human
gugguacuugauca

SEQ ID NO: 1559057 - RNA, 16 nt, Human
guggugaccccaggag

SEQ ID NO: 1559058 - RNA, 18 nt, Human
guggugaccccaggaggg

SEQ ID NO: 1559059 - RNA, 23 nt, Human
guguuacuagccucaaaauacau

SEQ ID NO: 1559060 - RNA, 18 nt, Human
guguccccugacagggcc

SEQ ID NO: 1559061 - RNA, 20 nt, Human
guuacauauuauauguucua

SEQ ID NO: 1559062 - RNA, 21 nt, Human
uaaagaaaaguuuaccaucug

SEQ ID NO: 1559063 - RNA, 15 nt, Human
uaaaguuaguaaaga

SEQ ID NO: 1559064 - RNA, 22 nt, Human
uaagugguucuuugguuccagu

SEQ ID NO: 1559065 - RNA, 18 nt, Human
uaagucauucauaaaccu

SEQ ID NO: 1559066 - RNA, 14 nt, Human
uacagcuccuuuga

SEQ ID NO: 1559067 - RNA, 20 nt, Human
uacagcuccuuugaaaacuc

SEQ ID NO: 1559068 - RNA, 18 nt, Human
uccagcaaaucaagcuga

SEQ ID NO: 1559069 - RNA, 18 nt, Human
ucccacgagggugccgug

SEQ ID NO: 1559070 - RNA, 18 nt, Human
uccuccgccuuaccagga

SEQ ID NO: 1559071 - RNA, 16 nt, Human
ugcgucgguccuggug

SEQ ID NO: 1559072 - RNA, 17 nt, Human
ugcuaaaggagcaucua

SEQ ID NO: 1559073 - RNA, 21 nt, Human
uguccuccgccuuaccaggag

SEQ ID NO: 1559074 - RNA, 13 nt, Human
uuaaauauuuagu

SEQ ID NO: 1559075 - RNA, 21 nt, Human
uuaagagguugauuauaaagu

SEQ ID NO: 1559076 - RNA, 15 nt, Human
uuaagcaaguuaagu

SEQ ID NO: 1559077 - RNA, 22 nt, Human
aauauuauaacucauuuguugu

SEQ ID NO: 1559078 - RNA, 16 nt, Human
agggacaggaccccag

SEQ ID NO: 1559079 - RNA, 13 nt, Human
agggacaggaccc

SEQ ID NO: 1559080 - RNA, 18 nt, Human
agggacaggaccccagcu

SEQ ID NO: 1559081 - RNA, 17 nt, Human
agggacaggaccccagc

SEQ ID NO: 1559082 - RNA, 20 nt, Human
agggacaggaccccagcucu

SEQ ID NO: 1559083 - RNA, 19 nt, Human
aguggccuuccccagcaug

SEQ ID NO: 1559084 - RNA, 18 nt, Human
aguggccuuccccagcau

SEQ ID NO: 1559085 - RNA, 18 nt, Human
cguguccccugacagggc

SEQ ID NO: 1559086 - RNA, 16 nt, Human
cguguccccugacagg

SEQ ID NO: 1559087 - RNA, 19 nt, Human
cguguccccugacagggcc

SEQ ID NO: 1559088 - RNA, 14 nt, Human
ccccgagggcugag

SEQ ID NO: 1559089 - RNA, 21 nt, Human
ccccgagggcugagccugguc

SEQ ID NO: 1559090 - RNA, 19 nt, Human
ccccgagggcugagccugg

SEQ ID NO: 1559091 - RNA, 16 nt, Human
ccccugacagggccag

SEQ ID NO: 1559092 - RNA, 17 nt, Human
ccgaagcccaggggccg

SEQ ID NO: 1559093 - RNA, 16 nt, Human
ccgaagcccaggggcc

SEQ ID NO: 1559094 - RNA, 15 nt, Human
ccgaagcccaggggc

SEQ ID NO: 1559095 - RNA, 14 nt, Human
ccuggaugcccagg

SEQ ID NO: 1559096 - RNA, 17 nt, Human
caggaccccagcucugc

SEQ ID NO: 1559097 - RNA, 16 nt, Human
caggaccccagcucug

SEQ ID NO: 1559098 - RNA, 18 nt, Human
caggaccccagcucugcg

SEQ ID NO: 1559099 - RNA, 21 nt, Human
caggagggaggcaggggaggg

SEQ ID NO: 1559100 - RNA, 15 nt, Human
caggagggaggcagg

SEQ ID NO: 1559101 - RNA, 22 nt, Human
caggguguggggccaugccucc

SEQ ID NO: 1559102 - RNA, 17 nt, Human
caggguguggggccaug

SEQ ID NO: 1559103 - RNA, 16 nt, Human
caggguguggggccau

SEQ ID NO: 1559104 - RNA, 16 nt, Human
ccacgagggugccgug

SEQ ID NO: 1559105 - RNA, 21 nt, Human
caugucaagagucgcugugcc

SEQ ID NO: 1559106 - RNA, 19 nt, Human
caugucaagagucgcugug

SEQ ID NO: 1559107 - RNA, 14 nt, Human
caugcaccacgggc

SEQ ID NO: 1559108 - RNA, 18 nt, Human
cacaggcuuagggacagg

SEQ ID NO: 1559109 - RNA, 22 nt, Human
cacaggcuuagggacaggaccc

SEQ ID NO: 1559110 - RNA, 19 nt, Human
cacaggcuuagggacagga

SEQ ID NO: 1559111 - RNA, 16 nt, Human
ggggccggccaguggc

SEQ ID NO: 1559112 - RNA, 16 nt, Human
gguccugcagccugca

SEQ ID NO: 1559113 - RNA, 15 nt, Human
gguccugcagccugc

SEQ ID NO: 1559114 - RNA, 15 nt, Human
aaauauuauaacuca

SEQ ID NO: 1559115 - RNA, 17 nt, Human
ggacaggaccccagcuc

SEQ ID NO: 1559116 - RNA, 16 nt, Human
ggacaggaccccagcu

SEQ ID NO: 1559117 - RNA, 15 nt, Human
ggacaggaccccagc

SEQ ID NO: 1559118 - RNA, 14 nt, Human
ggacaggaccccag

SEQ ID NO: 1559119 - RNA, 20 nt, Human
ggacaggaccccagcucugc

SEQ ID NO: 1559120 - RNA, 18 nt, Human
ggacaggaccccagcucu

SEQ ID NO: 1559121 - RNA, 21 nt, Human
ggacaggaccccagcucugcg

SEQ ID NO: 1559122 - RNA, 22 nt, Human
cuuagggacaggaccccagcuc

SEQ ID NO: 1559123 - RNA, 21 nt, Human
cuuagggacaggaccccagcu

SEQ ID NO: 1559124 - RNA, 23 nt, Human
cuuagggacaggaccccagcucu

SEQ ID NO: 1559125 - RNA, 20 nt, Human
cuuagggacaggaccccagc

SEQ ID NO: 1559126 - RNA, 18 nt, Human
cuuagggacaggacccca

SEQ ID NO: 1559127 - RNA, 14 nt, Human
guccugcagccugc

SEQ ID NO: 1559128 - RNA, 18 nt, Human
guccugcagccugcagga

SEQ ID NO: 1559129 - RNA, 10 nt, Human
guccugcagc

SEQ ID NO: 1559130 - RNA, 16 nt, Human
aagaaaaguuuaccau

SEQ ID NO: 1559131 - RNA, 21 nt, Human
aagauguagcgcuuugaauau

SEQ ID NO: 1559132 - RNA, 17 nt, Human
gugugaggguccugcag

SEQ ID NO: 1559133 - RNA, 14 nt, Human
aaguuuaccaucug

SEQ ID NO: 1559134 - RNA, 19 nt, Human
aaguuagaacauuugcugu

SEQ ID NO: 1559135 - RNA, 24 nt, Human
guuuuuggaugguguuacauauua

SEQ ID NO: 1559136 - RNA, 12 nt, Human
aaggagcaucua

SEQ ID NO: 1559137 - RNA, 21 nt, Human
guugggucaccagacggggcu

SEQ ID NO: 1559138 - RNA, 14 nt, Human
guugggucaccaga

SEQ ID NO: 1559139 - RNA, 22 nt, Human
aauuuacccucuugaauauaau

SEQ ID NO: 1559140 - RNA, 19 nt, Human
aauuuacccucuugaauau

SEQ ID NO: 1559141 - RNA, 17 nt, Human
aauuuaucaguaccuaa

SEQ ID NO: 1559142 - RNA, 19 nt, Human
uauagauugaaauuuccua

SEQ ID NO: 1559143 - RNA, 16 nt, Human
uauggccgggcagggu

SEQ ID NO: 1559144 - RNA, 13 nt, Human
uauuucauuuauu

SEQ ID NO: 1559145 - RNA, 18 nt, Human
ucauuugacuaagagucu

SEQ ID NO: 1559146 - RNA, 18 nt, Human
accgacguugccaucaaa

SEQ ID NO: 1559147 - RNA, 13 nt, Human
uccugcagccugc

SEQ ID NO: 1559148 - RNA, 11 nt, Human
ugagccugguc

SEQ ID NO: 1559149 - RNA, 19 nt, Human
ugaggguccugcagccugc

SEQ ID NO: 1559150 - RNA, 18 nt, Human
ugaggguccugcagccug

SEQ ID NO: 1559151 - RNA, 15 nt, Human
ugaggguccugcagc

SEQ ID NO: 1559152 - RNA, 14 nt, Human
ugaggguccugcag

SEQ ID NO: 1559153 - RNA, 22 nt, Human
ugaggguccugcagccugcagg

SEQ ID NO: 1559154 - RNA, 21 nt, Human
ugaggguccugcagccugcag

SEQ ID NO: 1559155 - RNA, 23 nt, Human
ugaggguccugcagccugcagga

SEQ ID NO: 1559156 - RNA, 14 nt, Human
agagucgcugugcc

SEQ ID NO: 1559157 - RNA, 19 nt, Human
agagucgcugugccacagg

SEQ ID NO: 1559158 - RNA, 15 nt, Human
agagucgcugugcca

SEQ ID NO: 1559159 - RNA, 14 nt, Human
ugaauauaaucccu

SEQ ID NO: 1559160 - RNA, 22 nt, Human
ucuggucuaaauuguguuacua

SEQ ID NO: 1559161 - RNA, 21 nt, Human
agccugcaggaccucgugcca

SEQ ID NO: 1559162 - RNA, 20 nt, Human
agccugcaggaccucgugcc

SEQ ID NO: 1559163 - RNA, 21 nt, Human
ugcaguuugguguguccuccg

SEQ ID NO: 1559164 - RNA, 22 nt, Human
agcucugcgucgguccuggugc

SEQ ID NO: 1559165 - RNA, 23 nt, Human
agcucugcgucgguccuggugcc

SEQ ID NO: 1559166 - RNA, 17 nt, Human
agggcugagccuggucc

SEQ ID NO: 1559167 - RNA, 16 nt, Human
agggcugagccugguc

SEQ ID NO: 1559168 - RNA, 18 nt, Human
agucgcugugccacaggc

SEQ ID NO: 1559169 - RNA, 18 nt, Human
uguccccugacagggcca

SEQ ID NO: 1559170 - RNA, 16 nt, Human
uguccccugacagggc

SEQ ID NO: 1559171 - RNA, 15 nt, Human
uguccccugacaggg

SEQ ID NO: 1559172 - RNA, 19 nt, Human
agugugaggguccugcagc

SEQ ID NO: 1559173 - RNA, 16 nt, Human
aguuuaccaucugaaa

SEQ ID NO: 1559174 - RNA, 12 nt, Human
aguuuaccaucu

SEQ ID NO: 1559175 - RNA, 21 nt, Human
aguuuugugaaggugauuuau

SEQ ID NO: 1559176 - RNA, 19 nt, Human
auaacucauuuguuguuug

SEQ ID NO: 1559177 - RNA, 17 nt, Human
auaaucaaauacauuuu

SEQ ID NO: 1559178 - RNA, 22 nt, Human
uugacacuuauagauugaaauu

SEQ ID NO: 1559179 - RNA, 13 nt, Human
uugauuauaaagu

SEQ ID NO: 1559180 - RNA, 18 nt, Human
auccuaaauuuacccucu

SEQ ID NO: 1559181 - RNA, 16 nt, Human
auauuuuuuaucauaa

SEQ ID NO: 1559182 - RNA, 18 nt, Human
augccuccucaggagccg

SEQ ID NO: 1559183 - RNA, 14 nt, Human
augccuccucagga

SEQ ID NO: 1559184 - RNA, 15 nt, Human
augccuccucaggag

SEQ ID NO: 1559185 - RNA, 13 nt, Human
augccuccucagg

SEQ ID NO: 1559186 - RNA, 21 nt, Human
auguagcgcuuugaauaugaa

SEQ ID NO: 1559187 - RNA, 19 nt, Human
auguagcgcuuugaauaug

SEQ ID NO: 1559188 - RNA, 18 nt, Human
uuugugaaggugauuuau

SEQ ID NO: 1559189 - RNA, 14 nt, Human
augguguuacauau

SEQ ID NO: 1559190 - RNA, 22 nt, Human
auugguuuuccaaucauuugac

SEQ ID NO: 1559191 - RNA, 13 nt, Human
caaauacauuuua

SEQ ID NO: 1559192 - RNA, 15 nt, Human
caccccgagggcuga

SEQ ID NO: 1559193 - RNA, 19 nt, Human
ccaguggccuuccccagca

SEQ ID NO: 1559194 - RNA, 17 nt, Human
ccaguggccuuccccag

SEQ ID NO: 1559195 - RNA, 23 nt, Human
ccagugcaguuugguguguccuc

SEQ ID NO: 1559196 - RNA, 15 nt, Human
ccgggcagggugugg

SEQ ID NO: 1559197 - RNA, 16 nt, Human
cgaagcccaggggccg

SEQ ID NO: 1559198 - RNA, 13 nt, Human
cggaauauauuuu

SEQ ID NO: 1559199 - RNA, 15 nt, Human
cgcugugccacaggc

SEQ ID NO: 1559200 - RNA, 11 nt, Human
cuaaaaacaua

SEQ ID NO: 1559201 - RNA, 14 nt, Human
cuaaauuuuaagug

SEQ ID NO: 1559202 - RNA, 21 nt, Human
cucaggagccgaagcccaggg

SEQ ID NO: 1559203 - RNA, 23 nt, Human
cucaggagccgaagcccaggggc

SEQ ID NO: 1559204 - RNA, 22 nt, Human
cuguauauauuuauggccgggc

SEQ ID NO: 1559205 - RNA, 13 nt, Human
cugugccacaggc

SEQ ID NO: 1559206 - RNA, 20 nt, Human
gacaggaccccagcucugcg

SEQ ID NO: 1559207 - RNA, 18 nt, Human
gacaggaccccagcucug

SEQ ID NO: 1559208 - RNA, 17 nt, Human
gacaggaccccagcucu

SEQ ID NO: 1559209 - RNA, 16 nt, Human
gacaggaccccagcuc

SEQ ID NO: 1559210 - RNA, 15 nt, Human
gacaggaccccagcu

SEQ ID NO: 1559211 - RNA, 14 nt, Human
gacaggaccccagc

SEQ ID NO: 1559212 - RNA, 19 nt, Human
gacaggaccccagcucugc

SEQ ID NO: 1559213 - RNA, 22 nt, Human
gaggggugcggcggucccagcu

SEQ ID NO: 1559214 - RNA, 19 nt, Human
gaggggugcggcgguccca

SEQ ID NO: 1559215 - RNA, 23 nt, Human
gagggugccguguccccugacag

SEQ ID NO: 1559216 - RNA, 18 nt, Human
gaggguccugcagccugc

SEQ ID NO: 1559217 - RNA, 21 nt, Human
gaggguccugcagccugcagg

SEQ ID NO: 1559218 - RNA, 17 nt, Human
gaggguccugcagccug

SEQ ID NO: 1559219 - RNA, 13 nt, Human
gaggguccugcag

SEQ ID NO: 1559220 - RNA, 20 nt, Human
gcccuggaugcccaggaauc

SEQ ID NO: 1559221 - RNA, 20 nt, Human
gcucugcgucgguccuggug

SEQ ID NO: 1559222 - RNA, 21 nt, Human
gcucugcgucgguccuggugc

SEQ ID NO: 1559223 - RNA, 23 nt, Human
gcuuagggacaggaccccagcuc

SEQ ID NO: 1559224 - RNA, 22 nt, Human
gcuuagggacaggaccccagcu

SEQ ID NO: 1559225 - RNA, 13 nt, Human
ggaccucgugcca

SEQ ID NO: 1559226 - RNA, 23 nt, Human
guacaguugcuguugugugauca

SEQ ID NO: 1559227 - RNA, 21 nt, Human
gguuuuccaaucauuugacua

SEQ ID NO: 1559228 - RNA, 19 nt, Human
ggugcggcggucccagcuc

SEQ ID NO: 1559229 - RNA, 20 nt, Human
ggugcccuggaugcccagga

SEQ ID NO: 1559230 - RNA, 19 nt, Human
ggugcccuggaugcccagg

SEQ ID NO: 1559231 - RNA, 18 nt, Human
ggugcccuggaugcccag

SEQ ID NO: 1559232 - RNA, 15 nt, Human
ggugcccuggaugcc

SEQ ID NO: 1559233 - RNA, 15 nt, Human
ggucccagcucccug

SEQ ID NO: 1559234 - RNA, 14 nt, Human
ggucccagcucccu

SEQ ID NO: 1559235 - RNA, 12 nt, Human
ggucccagcucc

SEQ ID NO: 1559236 - RNA, 20 nt, Human
ggucccagcucccuggcucc

SEQ ID NO: 1559237 - RNA, 13 nt, Human
gggcugagccugg

SEQ ID NO: 1559238 - RNA, 23 nt, Human
gggcugagccuggucccacgagg

SEQ ID NO: 1559239 - RNA, 15 nt, Human
gggcugagccugguc

SEQ ID NO: 1559240 - RNA, 22 nt, Human
gggcccggguugggucaccaga

SEQ ID NO: 1559241 - RNA, 21 nt, Human
gggcccggguugggucaccag

SEQ ID NO: 1559242 - RNA, 19 nt, Human
ggggugcggcggucccagc

SEQ ID NO: 1559243 - RNA, 11 nt, Human
gucccagcucc

SEQ ID NO: 1559244 - RNA, 18 nt, Human
guccuccgccuuaccagg

SEQ ID NO: 1559245 - RNA, 23 nt, Human
guccuggugcccuggaugcccag

SEQ ID NO: 1559246 - RNA, 20 nt, Human
guccuggugcccuggaugcc

SEQ ID NO: 1559247 - RNA, 12 nt, Human
guccuggugccc

SEQ ID NO: 1559248 - RNA, 11 nt, Human
guccuggugcc

SEQ ID NO: 1559249 - RNA, 15 nt, Human
gucccagcucccugg

SEQ ID NO: 1559250 - RNA, 18 nt, Human
gugcccuggaugcccagg

SEQ ID NO: 1559251 - RNA, 19 nt, Human
gugcccuggaugcccagga

SEQ ID NO: 1559252 - RNA, 19 nt, Human
ucaccagacggggcuggag

SEQ ID NO: 1559253 - RNA, 15 nt, Human
ucaccagacggggcu

SEQ ID NO: 1559254 - RNA, 17 nt, Human
uauuauauguucuagaa

SEQ ID NO: 1559255 - RNA, 14 nt, Human
uauuauauguucua

SEQ ID NO: 1559256 - RNA, 20 nt, Human
uccccagcaugcaccacggg

SEQ ID NO: 1559257 - RNA, 19 nt, Human
uccccagcaugcaccacgg

SEQ ID NO: 1559258 - RNA, 21 nt, Human
uccccagcaugcaccacgggc

SEQ ID NO: 1559259 - RNA, 19 nt, Human
uccgccuuaccaggagaag

SEQ ID NO: 1559260 - RNA, 16 nt, Human
ucuaucagauuaaguu

SEQ ID NO: 1559261 - RNA, 13 nt, Human
ugccuccucagga

SEQ ID NO: 1559262 - RNA, 12 nt, Human
ugccuccucagg

SEQ ID NO: 1559263 - RNA, 16 nt, Human
ugccuccucaggagcc

SEQ ID NO: 1559264 - RNA, 19 nt, Human
ugggucaccagacggggcu

SEQ ID NO: 1559265 - RNA, 21 nt, Human
ugggucaccagacggggcugg

SEQ ID NO: 1559266 - RNA, 20 nt, Human
ugggucaccagacggggcug

SEQ ID NO: 1559267 - RNA, 20 nt, Human
uuauugguuuuccaaucauu

SEQ ID NO: 1559268 - RNA, 16 nt, Human
uuauggccgggcaggg

SEQ ID NO: 1559269 - RNA, 13 nt, Human
uuuccuaauuuau

SEQ ID NO: 1559270 - RNA, 21 nt, Human
uuuacccucuugaauauaauc

SEQ ID NO: 1559271 - RNA, 13 nt, Human
uuuaccaucugaa

SEQ ID NO: 1559272 - RNA, 14 nt, Human
uuuaccaucugaaa

SEQ ID NO: 1559273 - RNA, 13 nt, Human
uuguuugguuaua

SEQ ID NO: 1559274 - RNA, 18 nt, Human
uucuaagucauucauaaa

SEQ ID NO: 1559275 - RNA, 14 nt, Human
aaaaauuuuuguuu

SEQ ID NO: 1559276 - RNA, 13 nt, Human
aaaaauuuuuguu

SEQ ID NO: 1559277 - RNA, 15 nt, Human
accccgagggcugag

SEQ ID NO: 1559278 - RNA, 13 nt, Human
agacggggcugga

SEQ ID NO: 1559279 - RNA, 15 nt, Human
agcaugcaccacggg

SEQ ID NO: 1559280 - RNA, 17 nt, Human
aggaccccagcucugcg

SEQ ID NO: 1559281 - RNA, 16 nt, Human
aggaccccagcucugc

SEQ ID NO: 1559282 - RNA, 14 nt, Human
aggaccccagcucu

SEQ ID NO: 1559283 - RNA, 13 nt, Human
aggaccccagcuc

SEQ ID NO: 1559284 - RNA, 14 nt, Human
aggaccucgugcca

SEQ ID NO: 1559285 - RNA, 17 nt, Human
cuaauuuauucuaaauu

SEQ ID NO: 1559286 - RNA, 16 nt, Human
ccugcagccugcagga

SEQ ID NO: 1559287 - RNA, 22 nt, Human
ccucaggagccgaagcccaggg

SEQ ID NO: 1559288 - RNA, 19 nt, Human
ccucaggagccgaagccca

SEQ ID NO: 1559289 - RNA, 12 nt, Human
ccucaggagccg

SEQ ID NO: 1559290 - RNA, 21 nt, Human
ccucaggagccgaagcccagg

SEQ ID NO: 1559291 - RNA, 22 nt, Human
ccaggagggaggcaggggaggg

SEQ ID NO: 1559292 - RNA, 15 nt, Human
ccaggagggaggcag

SEQ ID NO: 1559293 - RNA, 19 nt, Human
ccaggggccggccaguggc

SEQ ID NO: 1559294 - RNA, 21 nt, Human
ccaggagggaggcaggggagg

SEQ ID NO: 1559295 - RNA, 20 nt, Human
cagaauaaucaaauacauuu

SEQ ID NO: 1559296 - RNA, 22 nt, Human
cagugcaguuugguguguccuc

SEQ ID NO: 1559297 - RNA, 23 nt, Human
cuggagugugaggguccugcagc

SEQ ID NO: 1559298 - RNA, 21 nt, Human
cuggugcccuggaugcccagg

SEQ ID NO: 1559299 - RNA, 20 nt, Human
cuggugcccuggaugcccag

SEQ ID NO: 1559300 - RNA, 17 nt, Human
cuggugcccuggaugcc

SEQ ID NO: 1559301 - RNA, 16 nt, Human
gauacuugaauaacca

SEQ ID NO: 1559302 - RNA, 20 nt, Human
ggagugugaggguccugcag

SEQ ID NO: 1559303 - RNA, 18 nt, Human
aaaaaguuugucuuaguu

SEQ ID NO: 1559304 - RNA, 11 nt, Human
aaaaaguuugu

SEQ ID NO: 1559305 - RNA, 13 nt, Human
ggccuuccccagc

SEQ ID NO: 1559306 - RNA, 14 nt, Human
ggccuuccccagca

SEQ ID NO: 1559307 - RNA, 17 nt, Human
gggccggccaguggccu

SEQ ID NO: 1559308 - RNA, 23 nt, Human
ggggccaugccuccucaggagcc

SEQ ID NO: 1559309 - RNA, 19 nt, Human
ggggccaugccuccucagg

SEQ ID NO: 1559310 - RNA, 17 nt, Human
ggggccaugccuccuca

SEQ ID NO: 1559311 - RNA, 14 nt, Human
ggggccaugccucc

SEQ ID NO: 1559312 - RNA, 19 nt, Human
ggguccugcagccugcagg

SEQ ID NO: 1559313 - RNA, 23 nt, Human
ggguccugcagccugcaggaccu

SEQ ID NO: 1559314 - RNA, 18 nt, Human
ggguccugcagccugcag

SEQ ID NO: 1559315 - RNA, 13 nt, Human
guaauccuaaauu

SEQ ID NO: 1559316 - RNA, 23 nt, Human
aaagugguacuugaucauuuuua

SEQ ID NO: 1559317 - RNA, 20 nt, Human
aaagugguacuugaucauuu

SEQ ID NO: 1559318 - RNA, 14 nt, Human
aaagugguacuuga

SEQ ID NO: 1559319 - RNA, 17 nt, Human
gcggcggucccagcucc

SEQ ID NO: 1559320 - RNA, 16 nt, Human
gcggcggucccagcuc

SEQ ID NO: 1559321 - RNA, 14 nt, Human
gcggcggucccagc

SEQ ID NO: 1559322 - RNA, 16 nt, Human
gucgcugugccacagg

SEQ ID NO: 1559323 - RNA, 14 nt, Human
guccccugacaggg

SEQ ID NO: 1559324 - RNA, 14 nt, Human
aagaaacaacagaa

SEQ ID NO: 1559325 - RNA, 21 nt, Human
uagggacaggaccccagcucu

SEQ ID NO: 1559326 - RNA, 22 nt, Human
uagggacaggaccccagcucug

SEQ ID NO: 1559327 - RNA, 20 nt, Human
uagggacaggaccccagcuc

SEQ ID NO: 1559328 - RNA, 19 nt, Human
uagggacaggaccccagcu

SEQ ID NO: 1559329 - RNA, 15 nt, Human
uaguucccaggugau

SEQ ID NO: 1559330 - RNA, 16 nt, Human
acaggcuuagggacag

SEQ ID NO: 1559331 - RNA, 18 nt, Human
acaggaccccagcucugc

SEQ ID NO: 1559332 - RNA, 19 nt, Human
acaggaccccagcucugcg

SEQ ID NO: 1559333 - RNA, 17 nt, Human
acaggaccccagcucug

SEQ ID NO: 1559334 - RNA, 16 nt, Human
acaggaccccagcucu

SEQ ID NO: 1559335 - RNA, 15 nt, Human
acaggaccccagcuc

SEQ ID NO: 1559336 - RNA, 14 nt, Human
acaggaccccagcu

SEQ ID NO: 1559337 - RNA, 13 nt, Human
acaggaccccagc

SEQ ID NO: 1559338 - RNA, 12 nt, Human
acaggaccccag

SEQ ID NO: 1559339 - RNA, 21 nt, Human
aauuaguacagaaauauccau

SEQ ID NO: 1559340 - RNA, 21 nt, Human
uaagcaaguuaaguguccucc

SEQ ID NO: 1559341 - RNA, 10 nt, Human
ucccagcucc

SEQ ID NO: 1559342 - RNA, 15 nt, Human
acuaauuuuacuucu

SEQ ID NO: 1559343 - RNA, 22 nt, Human
uccucaggagccgaagcccagg

SEQ ID NO: 1559344 - RNA, 21 nt, Human
uccucaggagccgaagcccag

SEQ ID NO: 1559345 - RNA, 17 nt, Human
uccugcagccugcagga

SEQ ID NO: 1559346 - RNA, 20 nt, Human
ucugcgucgguccuggugcc

SEQ ID NO: 1559347 - RNA, 20 nt, Human
acuugaucauuuuuaccauu

SEQ ID NO: 1559348 - RNA, 19 nt, Human
ugaaauuuccuaauuuauu

SEQ ID NO: 1559349 - RNA, 19 nt, Human
ugacagggccagugcaguu

SEQ ID NO: 1559350 - RNA, 16 nt, Human
ugacagggccagugca

SEQ ID NO: 1559351 - RNA, 22 nt, Human
aggagggaggcaggggaggggu

SEQ ID NO: 1559352 - RNA, 13 nt, Human
uggccgggcaggg

SEQ ID NO: 1559353 - RNA, 12 nt, Human
uggccgggcagg

SEQ ID NO: 1559354 - RNA, 13 nt, Human
agcccaggggccg

SEQ ID NO: 1559355 - RNA, 14 nt, Human
agccgaagcccagg

SEQ ID NO: 1559356 - RNA, 15 nt, Human
agggugccguguccc

SEQ ID NO: 1559357 - RNA, 24 nt, Human
agggugccguguccccugacaggg

SEQ ID NO: 1559358 - RNA, 22 nt, Human
auaaaccuugucuaugaaauga

SEQ ID NO: 1559359 - RNA, 19 nt, Human
auaccaaguugauacuuga

SEQ ID NO: 1559360 - RNA, 16 nt, Human
aguuugguguguccuc

SEQ ID NO: 1559361 - RNA, 13 nt, Human
agugguuuagaaa

SEQ ID NO: 1559362 - RNA, 19 nt, Human
aucaauucuguauuccaga

SEQ ID NO: 1559363 - RNA, 23 nt, Human
auauauuuauggccgggcagggu

SEQ ID NO: 1559364 - RNA, 22 nt, Human
uuugaaaacucuguguuuggaa

SEQ ID NO: 1559365 - RNA, 14 nt, Human
augaaaugacuucu

SEQ ID NO: 1559366 - RNA, 24 nt, Human
auuacuuacguauguuuguacuug

SEQ ID NO: 1559367 - RNA, 15 nt, Human
uuuugauauaugaaa

SEQ ID NO: 1559368 - RNA, 16 nt, Human
uuuuguuugguuauau

SEQ ID NO: 1559369 - RNA, 13 nt, Human
uuuuguuugguua

SEQ ID NO: 1559370 - RNA, 21 nt, Human
uuuuguuugguuauaucgaaa

SEQ ID NO: 1559371 - RNA, 13 nt, Human
cagacggggcugg

SEQ ID NO: 1559372 - RNA, 19 nt, Human
cagacggggcuggagugug

SEQ ID NO: 1559373 - RNA, 17 nt, Human
cagcaugcaccacgggc

SEQ ID NO: 1559374 - RNA, 18 nt, Human
caggaccucgugccaccc

SEQ ID NO: 1559375 - RNA, 19 nt, Human
caggaaucuguauauauuu

SEQ ID NO: 1559376 - RNA, 19 nt, Human
caggagaagaaccugaaga

SEQ ID NO: 1559377 - RNA, 21 nt, Human
caggagccgaagcccaggggc

SEQ ID NO: 1559378 - RNA, 18 nt, Human
caggagccgaagcccagg

SEQ ID NO: 1559379 - RNA, 17 nt, Human
caggagccgaagcccag

SEQ ID NO: 1559380 - RNA, 17 nt, Human
caggcuuagggacagga

SEQ ID NO: 1559381 - RNA, 16 nt, Human
caggcuuagggacagg

SEQ ID NO: 1559382 - RNA, 16 nt, Human
cagggccagugcaguu

SEQ ID NO: 1559383 - RNA, 13 nt, Human
caggggaggggug

SEQ ID NO: 1559384 - RNA, 22 nt, Human
caggggccggccaguggccuuc

SEQ ID NO: 1559385 - RNA, 17 nt, Human
caggggccggccagugg

SEQ ID NO: 1559386 - RNA, 14 nt, Human
cauuuuuaccauua

SEQ ID NO: 1559387 - RNA, 19 nt, Human
cauucauaaaccuugucua

SEQ ID NO: 1559388 - RNA, 23 nt, Human
ccaccccgagggcugagccuggu

SEQ ID NO: 1559389 - RNA, 20 nt, Human
ccagcaugcaccacgggccc

SEQ ID NO: 1559390 - RNA, 18 nt, Human
ccagcaugcaccacgggc

SEQ ID NO: 1559391 - RNA, 18 nt, Human
ccauuauuuuuaggaugu

SEQ ID NO: 1559392 - RNA, 17 nt, Human
ccaucugaaagugguac

SEQ ID NO: 1559393 - RNA, 18 nt, Human
cccggguugggucaccag

SEQ ID NO: 1559394 - RNA, 23 nt, Human
cccgagggcugagccugguccca

SEQ ID NO: 1559395 - RNA, 19 nt, Human
ccguguccccugacagggc

SEQ ID NO: 1559396 - RNA, 17 nt, Human
ccguguccccugacagg

SEQ ID NO: 1559397 - RNA, 13 nt, Human
ccgccuuaccagg

SEQ ID NO: 1559398 - RNA, 20 nt, Human
ccuggucccacgagggugcc

SEQ ID NO: 1559399 - RNA, 20 nt, Human
ccuggugcccuggaugccca

SEQ ID NO: 1559400 - RNA, 18 nt, Human
ccuggugcccuggaugcc

SEQ ID NO: 1559401 - RNA, 12 nt, Human
ccuggugcccug

SEQ ID NO: 1559402 - RNA, 21 nt, Human
ccuggugcccuggaugcccag

SEQ ID NO: 1559403 - RNA, 22 nt, Human
ccuggugcccuggaugcccagg

SEQ ID NO: 1559404 - RNA, 13 nt, Human
cuccucaggagcc

SEQ ID NO: 1559405 - RNA, 12 nt, Human
cuccucaggagc

SEQ ID NO: 1559406 - RNA, 14 nt, Human
cugaagaacuauuu

SEQ ID NO: 1559407 - RNA, 17 nt, Human
cugcgucgguccuggug

SEQ ID NO: 1559408 - RNA, 18 nt, Human
cugcgucgguccuggugc

SEQ ID NO: 1559409 - RNA, 16 nt, Human
gaaucuguauauauuu

SEQ ID NO: 1559410 - RNA, 18 nt, Human
gaacuuacuugcauacca

SEQ ID NO: 1559411 - RNA, 18 nt, Human
gaaccugaagaacuauuu

SEQ ID NO: 1559412 - RNA, 23 nt, Human
gagccuggucccacgagggugcc

SEQ ID NO: 1559413 - RNA, 19 nt, Human
gagccuggucccacgaggg

SEQ ID NO: 1559414 - RNA, 14 nt, Human
gauagacugcuaca

SEQ ID NO: 1559415 - RNA, 13 nt, Human
gagucgcugugcc

SEQ ID NO: 1559416 - RNA, 17 nt, Human
gcacuaaaguuaguaaa

SEQ ID NO: 1559417 - RNA, 12 nt, Human
gcaggggagggg

SEQ ID NO: 1559418 - RNA, 21 nt, Human
gccuggucccacgagggugcc

SEQ ID NO: 1559419 - RNA, 15 nt, Human
ggcggucccagcucc

SEQ ID NO: 1559420 - RNA, 14 nt, Human
ggcggucccagcuc

SEQ ID NO: 1559421 - RNA, 17 nt, Human
ggcucccaugucaagag

SEQ ID NO: 1559422 - RNA, 22 nt, Human
ggcuuagggacaggaccccagc

SEQ ID NO: 1559423 - RNA, 23 nt, Human
ucaggagccgaagcccaggggcc

SEQ ID NO: 1559424 - RNA, 22 nt, Human
uauuccagacuugggaggaugu

SEQ ID NO: 1559425 - RNA, 22 nt, Human
ucgugccaccccgagggcugag

SEQ ID NO: 1559426 - RNA, 18 nt, Human
ugcccuggaugcccagga

SEQ ID NO: 1559427 - RNA, 16 nt, Human
ugcccuggaugcccag

SEQ ID NO: 1559428 - RNA, 21 nt, Human
ugccguguccccugacagggc

SEQ ID NO: 1559429 - RNA, 20 nt, Human
ugccacaggcuuagggacag

SEQ ID NO: 1559430 - RNA, 21 nt, Human
ugccacaggcuuagggacagg

SEQ ID NO: 1559431 - RNA, 17 nt, Human
ugccacaggcuuaggga

SEQ ID NO: 1559432 - RNA, 19 nt, Human
uuauuagaaaaauauuaua

SEQ ID NO: 1559433 - RNA, 23 nt, Human
uuauguuguuguuguuuuuggau

SEQ ID NO: 1559434 - RNA, 21 nt, Human
uuauaucgaaauaguuacagg

SEQ ID NO: 1559435 - RNA, 20 nt, Human adenovirus D
agguacaugggcaugagccc

SEQ ID NO: 1559436 - RNA, 16 nt, Human adenovirus D
agcgguggacggccac

SEQ ID NO: 1559437 - RNA, 15 nt, Human adenovirus D
aucagcgcgcugcgg

SEQ ID NO: 1559438 - RNA, 15 nt, Human adenovirus D
ccgccgccgccgugc

SEQ ID NO: 1559439 - RNA, 19 nt, Human adenovirus D
cacugcccauauacaugau

SEQ ID NO: 1559440 - RNA, 21 nt, Human adenovirus D
guggcgagaggcgagcagcug

SEQ ID NO: 1559441 - RNA, 21 nt, Human adenovirus D
caaggcgcgcuucacucuggc

SEQ ID NO: 1559442 - RNA, 20 nt, Human adenovirus D
uggacuucacagagagccgc

SEQ ID NO: 1559443 - RNA, 11 nt, Human adenovirus D
gcccaggcgcc

SEQ ID NO: 1559444 - RNA, 15 nt, Human adenovirus D
agccaaagcucaugu

SEQ ID NO: 1559445 - RNA, 21 nt, Human adenovirus D
cagcaguauccgcggagucca

SEQ ID NO: 1559446 - RNA, 15 nt, Human adenovirus D
ggcccuggagcagcg

SEQ ID NO: 1559447 - RNA, 14 nt, Human adenovirus D
gcauaucagccagu

SEQ ID NO: 1559448 - RNA, 22 nt, Human adenovirus D
caggaugcagccaguggcccug

SEQ ID NO: 1559449 - RNA, 14 nt, Human adenovirus D
uccagcuggccggc

SEQ ID NO: 1559450 - RNA, 18 nt, Human adenovirus D
gucccggaggaggggggc

SEQ ID NO: 1559451 - RNA, 22 nt, Human adenovirus D
ccggggguucauguugugcagg

SEQ ID NO: 1559452 - RNA, 19 nt, Human adenovirus D
accugcauuggcagccgag

SEQ ID NO: 1559453 - RNA, 22 nt, Human adenovirus D
acggucugcaggccgggcugca

SEQ ID NO: 1559454 - RNA, 13 nt, Human adenovirus D
ggcagcggggccu

SEQ ID NO: 1559455 - RNA, 24 nt, Human adenovirus D
ucagcauguggaacucugcggugg

SEQ ID NO: 1559456 - RNA, 21 nt, Human adenovirus D
cgugugauuaaaaagcagcac

SEQ ID NO: 1559457 - RNA, 14 nt, Human adenovirus D
gccugaugcaggau

SEQ ID NO: 1559458 - RNA, 23 nt, Human adenovirus D
uagauggaucgagugaaggugac

SEQ ID NO: 1559459 - RNA, 21 nt, Human adenovirus D
acaguucagaaguaaauuuga

SEQ ID NO: 1559460 - RNA, 16 nt, Human adenovirus D
ccacagggcacugccg

SEQ ID NO: 1559461 - RNA, 22 nt, Human adenovirus D
aggggcucguuaguccagcaga

SEQ ID NO: 1559462 - RNA, 18 nt, Human adenovirus D
gaauuugaaaccacuucc

SEQ ID NO: 1559463 - RNA, 22 nt, Human adenovirus D
uacauccauucucgaagauucu

SEQ ID NO: 1559464 - RNA, 17 nt, Human adenovirus D
gcgaggacaccaguacu

SEQ ID NO: 1559465 - RNA, 14 nt, Human adenovirus D
guugggcagcgaga

SEQ ID NO: 1559466 - RNA, 21 nt, Human adenovirus D
augcucgucagggggguccgc

SEQ ID NO: 1559467 - RNA, 16 nt, Human adenovirus D
cauguucaccagcaag

SEQ ID NO: 1559468 - RNA, 23 nt, Human adenovirus D
acagccgucuggacccgcggccg

SEQ ID NO: 1559469 - RNA, 13 nt, Human adenovirus D
gcgccgggcgcug

SEQ ID NO: 1559470 - RNA, 15 nt, Human adenovirus D
cuggcgacgcagccg

SEQ ID NO: 1559471 - RNA, 20 nt, Human adenovirus D
ggcuccucgaggacggagag

SEQ ID NO: 1559472 - RNA, 19 nt, Human adenovirus D
uaaaggcaccuuacacuga

SEQ ID NO: 1559473 - RNA, 20 nt, Human adenovirus D
cggcaaaauggcgugcugga

SEQ ID NO: 1559474 - RNA, 14 nt, Human adenovirus D
ccgccgcggccauc

SEQ ID NO: 1559475 - RNA, 14 nt, Human adenovirus D
ccaggaggcggugc

SEQ ID NO: 1559476 - RNA, 13 nt, Human adenovirus D
ggcagggugagcc

SEQ ID NO: 1559477 - RNA, 13 nt, Human adenovirus D
gcauggcaggcag

SEQ ID NO: 1559478 - RNA, 18 nt, Human adenovirus D
cucccagcgccgcgcugg

SEQ ID NO: 1559479 - RNA, 17 nt, Human adenovirus D
gaggagagcagguuucu

SEQ ID NO: 1559480 - RNA, 19 nt, Human adenovirus D
agcagaaauuucaagcugg

SEQ ID NO: 1559481 - RNA, 14 nt, Human adenovirus D
ggccaugcugcgcc

SEQ ID NO: 1559482 - RNA, 22 nt, Human adenovirus D
acgcagccggcgaacgugccgc

SEQ ID NO: 1559483 - RNA, 20 nt, Human adenovirus D
ugcagucguggacgcugcuc

SEQ ID NO: 1559484 - RNA, 19 nt, Human adenovirus D
agcuccgcgaacagcagca

SEQ ID NO: 1559485 - RNA, 13 nt, Human adenovirus D
aaaagcagcacag

SEQ ID NO: 1559486 - RNA, 14 nt, Human adenovirus D
uugacauccuggau

SEQ ID NO: 1559487 - RNA, 21 nt, Human adenovirus D
ggccgagaucguccucccccg

SEQ ID NO: 1559488 - RNA, 15 nt, Human adenovirus D
uggacuucgcagcca

SEQ ID NO: 1559489 - RNA, 18 nt, Human adenovirus D
guacaacaugcugacugc

SEQ ID NO: 1559490 - RNA, 16 nt, Human adenovirus D
ggccgaggaggagcgc

SEQ ID NO: 1559491 - RNA, 16 nt, Human adenovirus D
cauaauagaaacagau

SEQ ID NO: 1559492 - RNA, 12 nt, Human adenovirus D
cugcagggcgcc

SEQ ID NO: 1559493 - RNA, 16 nt, Human adenovirus D
uacucuaaaugcaaau

SEQ ID NO: 1559494 - RNA, 17 nt, Human adenovirus D
gcgcgucccuugaggag

SEQ ID NO: 1559495 - RNA, 17 nt, Human adenovirus D
agggcguagagcuuggg

SEQ ID NO: 1559496 - RNA, 19 nt, Human adenovirus D
uuccaggagaucacuagcg

SEQ ID NO: 1559497 - RNA, 23 nt, Human adenovirus D
ccagcaacuucauguccaugggc

SEQ ID NO: 1559498 - RNA, 20 nt, Human adenovirus D
uccaaggccaucugccacuc

SEQ ID NO: 1559499 - RNA, 15 nt, Human adenovirus D
ggguaguggcucgcg

SEQ ID NO: 1559500 - RNA, 17 nt, Human adenovirus D
gcccaaacuggggcgac

SEQ ID NO: 1559501 - RNA, 13 nt, Human adenovirus D
aggcggugcugcu

SEQ ID NO: 1559502 - RNA, 18 nt, Human adenovirus D
ggucggcgacgacgcgcu

SEQ ID NO: 1559503 - RNA, 12 nt, Human adenovirus D
ucugcucuucca

SEQ ID NO: 1559504 - RNA, 16 nt, Human adenovirus D
gucaccuucacagcua

SEQ ID NO: 1559505 - RNA, 13 nt, Human adenovirus D
gucaggcaggcau

SEQ ID NO: 1559506 - RNA, 19 nt, Human adenovirus D
gccguaccagugcaacuuu

SEQ ID NO: 1559507 - RNA, 14 nt, Human adenovirus D
gacguuucuggggu

SEQ ID NO: 1559508 - RNA, 16 nt, Human adenovirus D
cgcaugguuucgguga

SEQ ID NO: 1559509 - RNA, 13 nt, Human adenovirus D
acagccuucagca

SEQ ID NO: 1559510 - RNA, 18 nt, Human adenovirus D
ucuaugaaagcauacaga

SEQ ID NO: 1559511 - RNA, 14 nt, Human adenovirus D
gcccgcgagcgagg

SEQ ID NO: 1559512 - RNA, 22 nt, Human adenovirus D
aaaccacuuccuuuaccuucuc

SEQ ID NO: 1559513 - RNA, 13 nt, Human adenovirus D
ggccguagcaggc

SEQ ID NO: 1559514 - RNA, 21 nt, Human adenovirus D
agaacacccaacugagcaggg

SEQ ID NO: 1559515 - RNA, 16 nt, Human adenovirus D
gagggucuggagcucg

SEQ ID NO: 1559516 - RNA, 19 nt, Human adenovirus D
accagcaucgaggugcaga

SEQ ID NO: 1559517 - RNA, 16 nt, Human adenovirus D
cuaccagggcuuccac

SEQ ID NO: 1559518 - RNA, 16 nt, Human adenovirus D
gcauccacugcuccug

SEQ ID NO: 1559519 - RNA, 16 nt, Human adenovirus D
gcgguuccggccccgc

SEQ ID NO: 1559520 - RNA, 20 nt, Human adenovirus D
ugugauuaaaaagcagcaca

SEQ ID NO: 1559521 - RNA, 22 nt, Human adenovirus D
ucgccacggucaccgagccucc

SEQ ID NO: 1559522 - RNA, 13 nt, Human adenovirus D
caucuugcagagc

SEQ ID NO: 1559523 - RNA, 18 nt, Human adenovirus D
ccgucuacucccagcuca

SEQ ID NO: 1559524 - RNA, 20 nt, Human adenovirus D
guaaguuuuauggcugcugg

SEQ ID NO: 1559525 - RNA, 13 nt, Human adenovirus D
ucuggacccgcgg

SEQ ID NO: 1559526 - RNA, 18 nt, Human adenovirus D
ccagcaauaacaccggcu

SEQ ID NO: 1559527 - RNA, 18 nt, Human adenovirus D
gcugcccgccaccugcaa

SEQ ID NO: 1559528 - RNA, 13 nt, Human adenovirus D
gucaguugcacca

SEQ ID NO: 1559529 - RNA, 21 nt, Human adenovirus D
agaagcaaccuuuccaagagg

SEQ ID NO: 1559530 - RNA, 22 nt, Human adenovirus D
ccagccgcgguuaugcagggug

SEQ ID NO: 1559531 - RNA, 22 nt, Human adenovirus D
cugaguggcggcuuucugcccg

SEQ ID NO: 1559532 - RNA, 16 nt, Human adenovirus D
agcugcgcgagggccu

SEQ ID NO: 1559533 - RNA, 16 nt, Human adenovirus D
cacaguccaggucaca

SEQ ID NO: 1559534 - RNA, 13 nt, Human adenovirus D
ccgcaccgcuccu

SEQ ID NO: 1559535 - RNA, 21 nt, Human adenovirus D
cggccuuguagggacagcagc

SEQ ID NO: 1559536 - RNA, 17 nt, Human adenovirus D
cggccauucuggaggcg

SEQ ID NO: 1559537 - RNA, 19 nt, Human adenovirus D
cccugagagcgcuggcgug

SEQ ID NO: 1559538 - RNA, 22 nt, Human adenovirus D
ucuuccccagcgguucuggguc

SEQ ID NO: 1559539 - RNA, 19 nt, Human adenovirus D
ucgggcauuaacggggugg

SEQ ID NO: 1559540 - RNA, 15 nt, Human adenovirus D
cauaguaaagaaaca

SEQ ID NO: 1559541 - RNA, 18 nt, Human adenovirus D
aguacauguucaccagca

SEQ ID NO: 1559542 - RNA, 22 nt, Human adenovirus D
ucuccaucauguucgacuccuc

SEQ ID NO: 1559543 - RNA, 21 nt, Human adenovirus D
cggguauaaaaacccugguga

SEQ ID NO: 1559544 - RNA, 16 nt, Human adenovirus D
ccugcaggggcguccc

SEQ ID NO: 1559545 - RNA, 17 nt, Human adenovirus D
ucuuguaacuuuuaguc

SEQ ID NO: 1559546 - RNA, 23 nt, Human adenovirus D
ugacaauaauugaacugccuaca

SEQ ID NO: 1559547 - RNA, 19 nt, Human adenovirus D
aaaggcgcgcguccacgcc

SEQ ID NO: 1559548 - RNA, 21 nt, Human adenovirus D
acaggagccgcuaguggaaga

SEQ ID NO: 1559549 - RNA, 19 nt, Human adenovirus D
uccacuccgcacauguuga

SEQ ID NO: 1559550 - RNA, 23 nt, Human adenovirus D
ggggccaagaaggccggggccga

SEQ ID NO: 1559551 - RNA, 13 nt, Human adenovirus D
ggccaccucgccg

SEQ ID NO: 1559552 - RNA, 22 nt, Human adenovirus D
ccucgaaucaggcuggagccgc

SEQ ID NO: 1559553 - RNA, 17 nt, Human adenovirus D
ucugcccgcgcucaucc

SEQ ID NO: 1559554 - RNA, 20 nt, Human adenovirus D
ggagccaagaaacgucccag

SEQ ID NO: 1559555 - RNA, 18 nt, Human adenovirus D
cucagccacuccaagugg

SEQ ID NO: 1559556 - RNA, 19 nt, Human adenovirus D
cacagcaguacaagcgcca

SEQ ID NO: 1559557 - RNA, 20 nt, Human adenovirus D
agggcuuccacgugcccgag

SEQ ID NO: 1559558 - RNA, 15 nt, Human adenovirus D
aggccaggaggagac

SEQ ID NO: 1559559 - RNA, 20 nt, Human adenovirus D
cugcagggcgcccagcaugu

SEQ ID NO: 1559560 - RNA, 19 nt, Human adenovirus D
cugccaugggaggaagcaa

SEQ ID NO: 1559561 - RNA, 15 nt, Human adenovirus D
cugcugccgggcugc

SEQ ID NO: 1559562 - RNA, 15 nt, Human adenovirus D
gccagucccucaucc

SEQ ID NO: 1559563 - RNA, 14 nt, Human adenovirus D
ccgccgaggcuagc

SEQ ID NO: 1559564 - RNA, 21 nt, Human adenovirus D
cgcagugggcguacaugcaca

SEQ ID NO: 1559565 - RNA, 16 nt, Human adenovirus D
ccauugucaacacggc

SEQ ID NO: 1559566 - RNA, 21 nt, Human adenovirus D
aagaggggcagcaaccuaaag

SEQ ID NO: 1559567 - RNA, 19 nt, Human adenovirus D
cuuucuuugccaucaugau

SEQ ID NO: 1559568 - RNA, 12 nt, Human adenovirus D
gaggcauggcag

SEQ ID NO: 1559569 - RNA, 20 nt, Human adenovirus D
uugacaaauggagccagaac

SEQ ID NO: 1559570 - RNA, 21 nt, Human adenovirus D
gccagaugcaucccguccugc

SEQ ID NO: 1559571 - RNA, 14 nt, Human adenovirus D
acacccaacugagc

SEQ ID NO: 1559572 - RNA, 17 nt, Human adenovirus D
cagggaguuccugaugg

SEQ ID NO: 1559573 - RNA, 16 nt, Human adenovirus D
auuucagaaccaugaa

SEQ ID NO: 1559574 - RNA, 23 nt, Human adenovirus D
caccgugcgcuaccaccccagca

SEQ ID NO: 1559575 - RNA, 14 nt, Human adenovirus D
agcaggggcgcugg

SEQ ID NO: 1559576 - RNA, 21 nt, Human adenovirus D
aaucuaggaggcccaucuaca

SEQ ID NO: 1559577 - RNA, 14 nt, Human adenovirus D
gagcucgcgggcca

SEQ ID NO: 1559578 - RNA, 13 nt, Human adenovirus D
ggcgcuagccagc

SEQ ID NO: 1559579 - RNA, 15 nt, Human adenovirus D
agguggcccugggcc

SEQ ID NO: 1559580 - RNA, 17 nt, Human adenovirus D
cuggccucgggcauuaa

SEQ ID NO: 1559581 - RNA, 14 nt, Human adenovirus D
acgcgaccgugggg

SEQ ID NO: 1559582 - RNA, 14 nt, Human adenovirus D
aggaccugggcuuc

SEQ ID NO: 1559583 - RNA, 13 nt, Human adenovirus D
acauguugaaaag

SEQ ID NO: 1559584 - RNA, 12 nt, Human adenovirus D
uggaggagcagc

SEQ ID NO: 1559585 - RNA, 22 nt, Human adenovirus D
caucuuuuggaagaucucgguc

SEQ ID NO: 1559586 - RNA, 21 nt, Human adenovirus D
agcaggguacccacugggugg

SEQ ID NO: 1559587 - RNA, 19 nt, Human adenovirus D
ugccgccaaggagcuccuc

SEQ ID NO: 1559588 - RNA, 16 nt, Human adenovirus D
uccccgcccugcugga

SEQ ID NO: 1559589 - RNA, 18 nt, Human adenovirus D
aagaggagucgccggagg

SEQ ID NO: 1559590 - RNA, 18 nt, Human adenovirus D
aagcgcugguugaacaug

SEQ ID NO: 1559591 - RNA, 18 nt, Human adenovirus D
ccugacgacccgcaaccc

SEQ ID NO: 1559592 - RNA, 16 nt, Human adenovirus D
augccaucaacaucca

SEQ ID NO: 1559593 - RNA, 19 nt, Human adenovirus D
gcaucugaugaaauaaaaa

SEQ ID NO: 1559594 - RNA, 20 nt, Human adenovirus D
caugugugauaucacacugc

SEQ ID NO: 1559595 - RNA, 20 nt, Human adenovirus D
gcagcgacugacuacccacu

SEQ ID NO: 1559596 - RNA, 20 nt, Human adenovirus D
cagcagaagaucccggcgca

SEQ ID NO: 1559597 - RNA, 16 nt, Human adenovirus D
caccgaccuugcaaaa

SEQ ID NO: 1559598 - RNA, 13 nt, Human adenovirus D
gccggcucaagca

SEQ ID NO: 1559599 - RNA, 14 nt, Human adenovirus D
gauggugaagaugc

SEQ ID NO: 1559600 - RNA, 15 nt, Human adenovirus D
ccaccaccagcccau

SEQ ID NO: 1559601 - RNA, 16 nt, Human adenovirus D
agagugaggcacugcu

SEQ ID NO: 1559602 - RNA, 22 nt, Human adenovirus D
aagaugauaccaagagaaguua

SEQ ID NO: 1559603 - RNA, 14 nt, Human adenovirus D
cuuccugcagcuca

SEQ ID NO: 1559604 - RNA, 16 nt, Human adenovirus D
cacacgcccugggugu

SEQ ID NO: 1559605 - RNA, 17 nt, Human adenovirus D
cggcacgaucccgggca

SEQ ID NO: 1559606 - RNA, 12 nt, Human adenovirus D
cucugacacacc

SEQ ID NO: 1559607 - RNA, 16 nt, Human adenovirus D
cuuccaggagccugau

SEQ ID NO: 1559608 - RNA, 19 nt, Human adenovirus D
ccguaucgugcugcucucu

SEQ ID NO: 1559609 - RNA, 23 nt, Human adenovirus D
cugcgcaaauuuguacccgagga

SEQ ID NO: 1559610 - RNA, 14 nt, Human adenovirus D
ccgccaagcuccuc

SEQ ID NO: 1559611 - RNA, 16 nt, Human adenovirus D
gugcagucguggacgc

SEQ ID NO: 1559612 - RNA, 15 nt, Human adenovirus D
cugcugccgagccgc

SEQ ID NO: 1559613 - RNA, 22 nt, Human adenovirus D
accauguuauucagcagcccau

SEQ ID NO: 1559614 - RNA, 18 nt, Human adenovirus D
cugaaaguaugucucugg

SEQ ID NO: 1559615 - RNA, 17 nt, Human adenovirus D
cgcacgggccgccgggc

SEQ ID NO: 1559616 - RNA, 18 nt, Human adenovirus D
cgaccgugccgcggugcg

SEQ ID NO: 1559617 - RNA, 22 nt, Human adenovirus D
cggugagcagcuugcugacgcc

SEQ ID NO: 1559618 - RNA, 14 nt, Human adenovirus D
ccucgcgcaacugg

SEQ ID NO: 1559619 - RNA, 22 nt, Human adenovirus D
gagacaguagcgucucaagaga

SEQ ID NO: 1559620 - RNA, 17 nt, Human adenovirus D
gugguccuggucacccu

SEQ ID NO: 1559621 - RNA, 13 nt, Human adenovirus D
cgguccccgaggc

SEQ ID NO: 1559622 - RNA, 17 nt, Human adenovirus D
ggcagcggggacagaga

SEQ ID NO: 1559623 - RNA, 20 nt, Human adenovirus D
gcccgagggucgcuggcugc

SEQ ID NO: 1559624 - RNA, 19 nt, Human adenovirus D
ccacgcgcucgacaugacc

SEQ ID NO: 1559625 - RNA, 12 nt, Human adenovirus D
gaggggcagcaa

SEQ ID NO: 1559626 - RNA, 14 nt, Human adenovirus D
cgcguccaucgugc

SEQ ID NO: 1559627 - RNA, 22 nt, Human adenovirus D
acccucagaagaagaccacccg

SEQ ID NO: 1559628 - RNA, 20 nt, Human adenovirus D
cgccgauuuaaagacccaca

SEQ ID NO: 1559629 - RNA, 14 nt, Human adenovirus D
guuggcuugcccug

SEQ ID NO: 1559630 - RNA, 19 nt, Human adenovirus D
uagcuuagggaguuugcau

SEQ ID NO: 1559631 - RNA, 12 nt, Human adenovirus D
cugcgcaacgac

SEQ ID NO: 1559632 - RNA, 18 nt, Human adenovirus D
gugaagaaaacuggcaag

SEQ ID NO: 1559633 - RNA, 19 nt, Human adenovirus D
cauccaguuaaugcugccu

SEQ ID NO: 1559634 - RNA, 22 nt, Human adenovirus D
ucaggguccgcgugaggguggu

SEQ ID NO: 1559635 - RNA, 15 nt, Human adenovirus D
auaauagaaacagau

SEQ ID NO: 1559636 - RNA, 23 nt, Human adenovirus D
ucucugcgcucgcucacccgcag

SEQ ID NO: 1559637 - RNA, 16 nt, Human adenovirus D
caugcggggggagaug

SEQ ID NO: 1559638 - RNA, 21 nt, Human adenovirus D
caagacugcggggggaacauc

SEQ ID NO: 1559639 - RNA, 21 nt, Human adenovirus D
acccgguucgcggacggccgc

SEQ ID NO: 1559640 - RNA, 15 nt, Human adenovirus D
gcuacaugcccagca

SEQ ID NO: 1559641 - RNA, 12 nt, Human adenovirus D
cagacuggucaa

SEQ ID NO: 1559642 - RNA, 11 nt, Human adenovirus D
caccaugcgcc

SEQ ID NO: 1559643 - RNA, 21 nt, Human adenovirus D
gccaguggaagaggggcagca

SEQ ID NO: 1559644 - RNA, 23 nt, Human adenovirus D
gauguguuuuuagaugcagcaag

SEQ ID NO: 1559645 - RNA, 21 nt, Human adenovirus D
cgugggacucacccuggggcu

SEQ ID NO: 1559646 - RNA, 18 nt, Human adenovirus D
caggcggugcugcugccg

SEQ ID NO: 1559647 - RNA, 15 nt, Human adenovirus D
cgguggccccgaccc

SEQ ID NO: 1559648 - RNA, 13 nt, Human adenovirus D
gacacccccgcgu

SEQ ID NO: 1559649 - RNA, 16 nt, Human adenovirus D
gacgagcugcuugccg

SEQ ID NO: 1559650 - RNA, 17 nt, Human adenovirus D
caugccacgaacagcca

SEQ ID NO: 1559651 - RNA, 15 nt, Human adenovirus D
ugagcgcgagccggc

SEQ ID NO: 1559652 - RNA, 14 nt, Human adenovirus D
auccugaucucugc

SEQ ID NO: 1559653 - RNA, 20 nt, Human adenovirus D
cagucucugccgccggggcu

SEQ ID NO: 1559654 - RNA, 17 nt, Human adenovirus D
agacacuugagcuggcc

SEQ ID NO: 1559655 - RNA, 22 nt, Human adenovirus D
guagagggaaccuaccacugcc

SEQ ID NO: 1559656 - RNA, 19 nt, Human adenovirus D
uacaagcgccaacagcagc

SEQ ID NO: 1559657 - RNA, 11 nt, Human adenovirus D
caccaaggcca

SEQ ID NO: 1559658 - RNA, 23 nt, Human adenovirus D
gcacgucggcguggcgcucgggc

SEQ ID NO: 1559659 - RNA, 19 nt, Human adenovirus D
caggugagcucgggcugcu

SEQ ID NO: 1559660 - RNA, 15 nt, Human adenovirus D
cgguguagcccgugc

SEQ ID NO: 1559661 - RNA, 17 nt, Human adenovirus D
gcacaggcacacugaca

SEQ ID NO: 1559662 - RNA, 16 nt, Human adenovirus D
caggcgcaaccaggag

SEQ ID NO: 1559663 - RNA, 11 nt, Human adenovirus D
aggugcugccc

SEQ ID NO: 1559664 - RNA, 21 nt, Human adenovirus D
ucuggggcgcuuccaagauca

SEQ ID NO: 1559665 - RNA, 15 nt, Human adenovirus D
ucucuucuuguaacu

SEQ ID NO: 1559666 - RNA, 23 nt, Human adenovirus D
uggagaucaaccuccaggccaac

SEQ ID NO: 1559667 - RNA, 19 nt, Human adenovirus D
ugcacuuucuuugccauca

SEQ ID NO: 1559668 - RNA, 19 nt, Human adenovirus D
gccccugcaagugcacaga

SEQ ID NO: 1559669 - RNA, 13 nt, Human adenovirus D
uaugaucccaaca

SEQ ID NO: 1559670 - RNA, 17 nt, Human adenovirus D
ccucuugcagcuggcca

SEQ ID NO: 1559671 - RNA, 17 nt, Human adenovirus D
guuuauaaaucuuacac

SEQ ID NO: 1559672 - RNA, 19 nt, Human adenovirus D
ucccacagugcccccucca

SEQ ID NO: 1559673 - RNA, 15 nt, Human adenovirus D
gaaagucaggagcag

SEQ ID NO: 1559674 - RNA, 22 nt, Human adenovirus D
guacccuccucccaacucuggu

SEQ ID NO: 1559675 - RNA, 15 nt, Human adenovirus D
caaaacgaccacagc

SEQ ID NO: 1559676 - RNA, 12 nt, Human adenovirus D
cuuaaaucauuu

SEQ ID NO: 1559677 - RNA, 23 nt, Human adenovirus D
ugaagacgccgccggucaucucc

SEQ ID NO: 1559678 - RNA, 15 nt, Human adenovirus D
uccaaacuagcagac

SEQ ID NO: 1559679 - RNA, 15 nt, Human adenovirus D
gucagggaacugaua

SEQ ID NO: 1559680 - RNA, 21 nt, Human adenovirus D
gugagccgcgcgcuggggcag

SEQ ID NO: 1559681 - RNA, 13 nt, Human adenovirus D
aucugugcugccu

SEQ ID NO: 1559682 - RNA, 13 nt, Human adenovirus D
cucccacagugcc

SEQ ID NO: 1559683 - RNA, 19 nt, Human adenovirus D
ucaucgcgccacuggccac

SEQ ID NO: 1559684 - RNA, 18 nt, Human adenovirus D
cacagcuagacaccacag

SEQ ID NO: 1559685 - RNA, 19 nt, Human adenovirus D
ggcuggaacccgcgcucgc

SEQ ID NO: 1559686 - RNA, 17 nt, Human adenovirus D
aaagaaguggccagugu

SEQ ID NO: 1559687 - RNA, 19 nt, Human adenovirus D
caccauguuauucagcagc

SEQ ID NO: 1559688 - RNA, 12 nt, Human adenovirus D
gccgaccggagc

SEQ ID NO: 1559689 - RNA, 20 nt, Human adenovirus D
gccaucuaaacuaaagccaa

SEQ ID NO: 1559690 - RNA, 16 nt, Human adenovirus D
caugaacacacugccc

SEQ ID NO: 1559691 - RNA, 15 nt, Human adenovirus D
cucuccugaaccaca

SEQ ID NO: 1559692 - RNA, 22 nt, Human adenovirus D
gucccagcgucugacgcugcgc

SEQ ID NO: 1559693 - RNA, 14 nt, Human adenovirus D
gaccuggcggaggc

SEQ ID NO: 1559694 - RNA, 19 nt, Human adenovirus D
cugaacgacucgcugcugc

SEQ ID NO: 1559695 - RNA, 17 nt, Human adenovirus D
gcugcgcuuugugcccg

SEQ ID NO: 1559696 - RNA, 15 nt, Human adenovirus D
uggagguuuucccgg

SEQ ID NO: 1559697 - RNA, 15 nt, Human adenovirus D
accaccccagcaucc

SEQ ID NO: 1559698 - RNA, 13 nt, Human adenovirus D
gcccgugggcgac

SEQ ID NO: 1559699 - RNA, 13 nt, Human adenovirus D
ugaaaaccaagga

SEQ ID NO: 1559700 - RNA, 14 nt, Human adenovirus D
ccuugaggaggaga

SEQ ID NO: 1559701 - RNA, 17 nt, Human adenovirus D
ugaaaacgugccugcuc

SEQ ID NO: 1559702 - RNA, 16 nt, Human adenovirus D
uugaccaccagggagc

SEQ ID NO: 1559703 - RNA, 20 nt, Human adenovirus D
gcaaugcuuuuuaggagacu

SEQ ID NO: 1559704 - RNA, 18 nt, Human adenovirus D
agcuggacaagcuucuug

SEQ ID NO: 1559705 - RNA, 16 nt, Human adenovirus D
cauggcaggcagcggc

SEQ ID NO: 1559706 - RNA, 19 nt, Human adenovirus D
ggcgccgcccgagcucugc

SEQ ID NO: 1559707 - RNA, 19 nt, Human adenovirus D
ugagguccucggggcauug

SEQ ID NO: 1559708 - RNA, 22 nt, Human adenovirus D
cuaagcuaguacucuacaaucc

SEQ ID NO: 1559709 - RNA, 17 nt, Human adenovirus D
agggcaugggucaggca

SEQ ID NO: 1559710 - RNA, 20 nt, Human adenovirus D
gaccugcagcaggugcugcc

SEQ ID NO: 1559711 - RNA, 13 nt, Human adenovirus D
ccagaggcagacu

SEQ ID NO: 1559712 - RNA, 18 nt, Human adenovirus D
ccuugauuuuuccagccc

SEQ ID NO: 1559713 - RNA, 14 nt, Human adenovirus D
cgccgccugcgcug

SEQ ID NO: 1559714 - RNA, 21 nt, Human adenovirus D
accucuucuauuucuuccucu

SEQ ID NO: 1559715 - RNA, 19 nt, Human adenovirus D
aacauccccgcccugcugg

SEQ ID NO: 1559716 - RNA, 14 nt, Human adenovirus D
auuaaaaagcagca

SEQ ID NO: 1559717 - RNA, 22 nt, Human adenovirus D
caagacgcaggccaggaggaga

SEQ ID NO: 1559718 - RNA, 15 nt, Human adenovirus D
ccgagucucaccugg

SEQ ID NO: 1559719 - RNA, 14 nt, Human adenovirus D
gacgcgcucccggc

SEQ ID NO: 1559720 - RNA, 22 nt, Human adenovirus D
gcccagcagcauguacggagga

SEQ ID NO: 1559721 - RNA, 19 nt, Human adenovirus D
ucagguuacauuccugcac

SEQ ID NO: 1559722 - RNA, 20 nt, Human adenovirus D
ggccaugccccaggccuggc

SEQ ID NO: 1559723 - RNA, 23 nt, Human adenovirus D
aacuacucggugcuuagccuggg

SEQ ID NO: 1559724 - RNA, 17 nt, Human adenovirus D
uccgcaggcgggacaga

SEQ ID NO: 1559725 - RNA, 16 nt, Human adenovirus D
aaagcucccacagugc

SEQ ID NO: 1559726 - RNA, 16 nt, Human adenovirus D
gacgcacgggccgccg

SEQ ID NO: 1559727 - RNA, 23 nt, Human adenovirus D
cgucaaccucccgcccaagguca

SEQ ID NO: 1559728 - RNA, 21 nt, Human adenovirus D
gggucaucuugcacaguuggc

SEQ ID NO: 1559729 - RNA, 19 nt, Human adenovirus D
agcugaacgggggcgccuu

SEQ ID NO: 1559730 - RNA, 17 nt, Human adenovirus D
gcucgcgcaccugcuac

SEQ ID NO: 1559731 - RNA, 20 nt, Human adenovirus D
cagcacaguaaguuccuguc

SEQ ID NO: 1559732 - RNA, 22 nt, Human adenovirus D
uccaccacccacgcccgcucca

SEQ ID NO: 1559733 - RNA, 14 nt, Human adenovirus D
ccuccuccuggaga

SEQ ID NO: 1559734 - RNA, 14 nt, Human adenovirus D
ugggcccgugggcu

SEQ ID NO: 1559735 - RNA, 17 nt, Human adenovirus D
acugaaagaacuuggua

SEQ ID NO: 1559736 - RNA, 15 nt, Human adenovirus D
gucugaagcgccgcc

SEQ ID NO: 1559737 - RNA, 21 nt, Human adenovirus D
gaaggugguggacggccuggc

SEQ ID NO: 1559738 - RNA, 15 nt, Human adenovirus D
gcucgguuguugaug

SEQ ID NO: 1559739 - RNA, 14 nt, Human adenovirus D
gcaaugcgggccug

SEQ ID NO: 1559740 - RNA, 13 nt, Human adenovirus D
cucggaguaccug

SEQ ID NO: 1559741 - RNA, 22 nt, Human adenovirus D
uccgacuuugucccgcugagcu

SEQ ID NO: 1559742 - RNA, 17 nt, Human adenovirus D
cacuucgccuaccccgc

SEQ ID NO: 1559743 - RNA, 16 nt, Human adenovirus D
ugagcgacgaccuggg

SEQ ID NO: 1559744 - RNA, 15 nt, Human adenovirus D
gaccccauggacaac

SEQ ID NO: 1559745 - RNA, 22 nt, Human adenovirus D
cucgagcuacaugcccagcagc

SEQ ID NO: 1559746 - RNA, 19 nt, Human adenovirus D
caacaacucgggcuucacc

SEQ ID NO: 1559747 - RNA, 19 nt, Human adenovirus D
auugucaagcuugguggca

SEQ ID NO: 1559748 - RNA, 20 nt, Human adenovirus D
agcuaagaaaaaaucagagu

SEQ ID NO: 1559749 - RNA, 18 nt, Human adenovirus D
ucaaucucccaccaccag

SEQ ID NO: 1559750 - RNA, 18 nt, Human adenovirus D
ccccgcaaaaucaagcgg

SEQ ID NO: 1559751 - RNA, 14 nt, Human adenovirus D
caguagaaggugag

SEQ ID NO: 1559752 - RNA, 19 nt, Human adenovirus D
gaccggcagcggggccugg

SEQ ID NO: 1559753 - RNA, 21 nt, Human adenovirus D
cuuuagguguugcaugauggg

SEQ ID NO: 1559754 - RNA, 19 nt, Human adenovirus D
agcaggagugcagggauga

SEQ ID NO: 1559755 - RNA, 23 nt, Human adenovirus D
uacaucucggggaacggggcaga

SEQ ID NO: 1559756 - RNA, 20 nt, Human adenovirus D
auuccugcaccauccccagg

SEQ ID NO: 1559757 - RNA, 21 nt, Human adenovirus D
uaugacacgcgcacacuuugg

SEQ ID NO: 1559758 - RNA, 15 nt, Human adenovirus D
agcgcccucagcagu

SEQ ID NO: 1559759 - RNA, 20 nt, Human adenovirus D
gcgguccccgaggcccuugc

SEQ ID NO: 1559760 - RNA, 19 nt, Human adenovirus D
acaagauucaauaagguuc

SEQ ID NO: 1559761 - RNA, 18 nt, Human adenovirus D
uggacgaguggcuguuga

SEQ ID NO: 1559762 - RNA, 17 nt, Human adenovirus D
cuuccaguacucccgga

SEQ ID NO: 1559763 - RNA, 14 nt, Human adenovirus D
ccagguccacgcug

SEQ ID NO: 1559764 - RNA, 20 nt, Human adenovirus D
gcucugcugcgccgcgccag

SEQ ID NO: 1559765 - RNA, 14 nt, Human adenovirus D
aguuuggccuggau

SEQ ID NO: 1559766 - RNA, 22 nt, Human adenovirus D
guacgagagcgugauggcgcag

SEQ ID NO: 1559767 - RNA, 16 nt, Human adenovirus D
gugggcguggggcaag

SEQ ID NO: 1559768 - RNA, 23 nt, Human adenovirus D
cagcuccugagcgagacccaggu

SEQ ID NO: 1559769 - RNA, 16 nt, Human adenovirus D
ucagcaacuaccccgu

SEQ ID NO: 1559770 - RNA, 17 nt, Human adenovirus D
cacuuaaguccugggcc

SEQ ID NO: 1559771 - RNA, 22 nt, Human adenovirus D
gauuagagguagguuugaguag

SEQ ID NO: 1559772 - RNA, 18 nt, Human adenovirus D
ggcuaccuugcacccacc

SEQ ID NO: 1559773 - RNA, 16 nt, Human adenovirus D
agauccugcugcucca

SEQ ID NO: 1559774 - RNA, 20 nt, Human adenovirus D
cgcagcucuucccgcugaac

SEQ ID NO: 1559775 - RNA, 21 nt, Human adenovirus D
ccgccauggggcgccgcccga

SEQ ID NO: 1559776 - RNA, 18 nt, Human adenovirus D
agcaugccgaagaagaac

SEQ ID NO: 1559777 - RNA, 14 nt, Human adenovirus D
gcuggguggccggc

SEQ ID NO: 1559778 - RNA, 18 nt, Human adenovirus D
agguggcccugggccuga

SEQ ID NO: 1559779 - RNA, 20 nt, Human adenovirus D
gcaugaaggggacgagcugc

SEQ ID NO: 1559780 - RNA, 20 nt, Human adenovirus D
gcgaaccgagcacucgugcu

SEQ ID NO: 1559781 - RNA, 13 nt, Human adenovirus D
gugcuccagccaa

SEQ ID NO: 1559782 - RNA, 14 nt, Human adenovirus D
cacugccggugcac

SEQ ID NO: 1559783 - RNA, 18 nt, Human adenovirus D
ccugagccgccagcuggc

SEQ ID NO: 1559784 - RNA, 20 nt, Human adenovirus D
caugaaauugcgggugaugc

SEQ ID NO: 1559785 - RNA, 18 nt, Human adenovirus D
agcucggcgaugguggcg

SEQ ID NO: 1559786 - RNA, 14 nt, Human adenovirus D
gccgcuggacgaga

SEQ ID NO: 1559787 - RNA, 18 nt, Human adenovirus D
gcccgaguuguccuggua

SEQ ID NO: 1559788 - RNA, 24 nt, Human adenovirus D
cagcaguagccccucugugcccag

SEQ ID NO: 1559789 - RNA, 16 nt, Human adenovirus D
gccauagcucagcccg

SEQ ID NO: 1559790 - RNA, 12 nt, Human adenovirus D
ucaccaaggcca

SEQ ID NO: 1559791 - RNA, 18 nt, Human adenovirus D
ucaccucaacgcccaggc

SEQ ID NO: 1559792 - RNA, 22 nt, Human adenovirus D
cggcgguuccggccccgcgggc

SEQ ID NO: 1559793 - RNA, 10 nt, Human adenovirus D
ccaggaggag

SEQ ID NO: 1559794 - RNA, 19 nt, Human adenovirus D
gcagguggacgagccgccu

SEQ ID NO: 1559795 - RNA, 13 nt, Human adenovirus D
uggccugcgccau

SEQ ID NO: 1559796 - RNA, 12 nt, Human adenovirus D
agccgccugagc

SEQ ID NO: 1559797 - RNA, 16 nt, Human adenovirus D
ccauugaauggcacug

SEQ ID NO: 1559798 - RNA, 19 nt, Human adenovirus D
ccgcgccagacgcacgggc

SEQ ID NO: 1559799 - RNA, 16 nt, Human adenovirus D
gcccgggacggaggcu

SEQ ID NO: 1559800 - RNA, 21 nt, Human adenovirus D
cgccaccuucuuccccauggc

SEQ ID NO: 1559801 - RNA, 14 nt, Human adenovirus D
uagcaaggugcuga

SEQ ID NO: 1559802 - RNA, 13 nt, Human adenovirus D
aggccuggcccug

SEQ ID NO: 1559803 - RNA, 14 nt, Human adenovirus D
gaucagccccgcgc

SEQ ID NO: 1559804 - RNA, 21 nt, Human adenovirus D
cgccaacucggcccacgcgcu

SEQ ID NO: 1559805 - RNA, 13 nt, Human adenovirus D
caaugagaggagu

SEQ ID NO: 1559806 - RNA, 21 nt, Human adenovirus D
cuccuggugcgucgagcacag

SEQ ID NO: 1559807 - RNA, 20 nt, Human adenovirus D
gccguacgugcccauagaca

SEQ ID NO: 1559808 - RNA, 16 nt, Human adenovirus D
uaaugacaaacaaaag

SEQ ID NO: 1559809 - RNA, 20 nt, Human adenovirus D
cuuuugguuucaaauucauu

SEQ ID NO: 1559810 - RNA, 23 nt, Human adenovirus D
cauauaucuuggagguuuggcau

SEQ ID NO: 1559811 - RNA, 17 nt, Human adenovirus D
cgcauccugcaacugcg

SEQ ID NO: 1559812 - RNA, 19 nt, Human adenovirus D
ugcuggaggguugaaagau

SEQ ID NO: 1559813 - RNA, 22 nt, Human adenovirus D
aacugcgcguccgucagcagca

SEQ ID NO: 1559814 - RNA, 20 nt, Human adenovirus D
caaccuggaccggcugguga

SEQ ID NO: 1559815 - RNA, 14 nt, Human adenovirus D
aaucagccccuucc

SEQ ID NO: 1559816 - RNA, 14 nt, Human adenovirus D
gacaguggcagcgu

SEQ ID NO: 1559817 - RNA, 16 nt, Human adenovirus D
caacuagccggagccg

SEQ ID NO: 1559818 - RNA, 15 nt, Human adenovirus D
uccugaucucugcca

SEQ ID NO: 1559819 - RNA, 13 nt, Human adenovirus D
cuccgcaccgcuc

SEQ ID NO: 1559820 - RNA, 13 nt, Human adenovirus D
gcugguggcgcug

SEQ ID NO: 1559821 - RNA, 19 nt, Human adenovirus D
aggucagcagcaagagcuc

SEQ ID NO: 1559822 - RNA, 22 nt, Human adenovirus D
cgcugggcguggugcuggauga

SEQ ID NO: 1559823 - RNA, 19 nt, Human adenovirus D
caucggacgacugggaggc

SEQ ID NO: 1559824 - RNA, 20 nt, Human adenovirus D
acggcugcauccacugcucc

SEQ ID NO: 1559825 - RNA, 21 nt, Human adenovirus D
gggguauuacuaggcccagca

SEQ ID NO: 1559826 - RNA, 17 nt, Human adenovirus D
cuggcgagacugggggc

SEQ ID NO: 1559827 - RNA, 16 nt, Human adenovirus D
cggcgggccaugcgca

SEQ ID NO: 1559828 - RNA, 20 nt, Human adenovirus D
ugcaaugucaggucugcugg

SEQ ID NO: 1559829 - RNA, 13 nt, Human adenovirus D
cugcaggccgggc

SEQ ID NO: 1559830 - RNA, 15 nt, Human adenovirus D
cacaacaccgccucc

SEQ ID NO: 1559831 - RNA, 17 nt, Human adenovirus D
aguuuuucauccagaau

SEQ ID NO: 1559832 - RNA, 19 nt, Human adenovirus D
aaguacauagugaccaaga

SEQ ID NO: 1559833 - RNA, 14 nt, Human adenovirus D
accucaucgccacc

SEQ ID NO: 1559834 - RNA, 15 nt, Human adenovirus D
gguggcccugggccu

SEQ ID NO: 1559835 - RNA, 22 nt, Human adenovirus D
gcugaggaaucggaucuucccc

SEQ ID NO: 1559836 - RNA, 20 nt, Human adenovirus D
cacuccccccuuugucuccu

SEQ ID NO: 1559837 - RNA, 15 nt, Human adenovirus D
cgggugaugguggcu

SEQ ID NO: 1559838 - RNA, 12 nt, Human adenovirus D
cgcgcgggcagg

SEQ ID NO: 1559839 - RNA, 16 nt, Human adenovirus D
cgaacaguccacccag

SEQ ID NO: 1559840 - RNA, 21 nt, Human adenovirus D
caaacaggcugucgguguccc

SEQ ID NO: 1559841 - RNA, 24 nt, Human adenovirus D
ccacuacucacacuacacagcuag

SEQ ID NO: 1559842 - RNA, 12 nt, Human adenovirus D
gcuugcccugcc

SEQ ID NO: 1559843 - RNA, 20 nt, Human adenovirus D
uccagaggacuuggaugagg

SEQ ID NO: 1559844 - RNA, 15 nt, Human adenovirus D
cuccacucgacccug

SEQ ID NO: 1559845 - RNA, 14 nt, Human adenovirus D
ugagggccucggcg

SEQ ID NO: 1559846 - RNA, 15 nt, Human adenovirus D
cugcccgccaacacc

SEQ ID NO: 1559847 - RNA, 20 nt, Human adenovirus D
cucgaacaguccacccagac

SEQ ID NO: 1559848 - RNA, 12 nt, Human adenovirus D
ggcggcagagcg

SEQ ID NO: 1559849 - RNA, 13 nt, Human adenovirus D
gucaucgacucgg

SEQ ID NO: 1559850 - RNA, 19 nt, Human adenovirus D
cccagaacuggcagagcac

SEQ ID NO: 1559851 - RNA, 16 nt, Human adenovirus D
gcuggaugcggagccg

SEQ ID NO: 1559852 - RNA, 16 nt, Human adenovirus D
cagcucuucggagccu

SEQ ID NO: 1559853 - RNA, 16 nt, Human adenovirus D
cccuauuuaaaggcac

SEQ ID NO: 1559854 - RNA, 15 nt, Human adenovirus D
uccuggucugcaacc

SEQ ID NO: 1559855 - RNA, 16 nt, Human adenovirus D
uuccgcguaccugcgc

SEQ ID NO: 1559856 - RNA, 16 nt, Human adenovirus D
ccgcuaguggaagaga

SEQ ID NO: 1559857 - RNA, 15 nt, Human adenovirus D
gcggcgcggagcaag

SEQ ID NO: 1559858 - RNA, 12 nt, Human adenovirus D
ucgaucaucucc

SEQ ID NO: 1559859 - RNA, 17 nt, Human adenovirus D
ccgagucgcggaugaag

SEQ ID NO: 1559860 - RNA, 17 nt, Human adenovirus D
ucauaugguagacccac

SEQ ID NO: 1559861 - RNA, 16 nt, Human adenovirus D
ccugcacacggagugc

SEQ ID NO: 1559862 - RNA, 19 nt, Human adenovirus D
acgaggcguucagggaggc

SEQ ID NO: 1559863 - RNA, 15 nt, Human adenovirus D
acaugcccagcagca

SEQ ID NO: 1559864 - RNA, 21 nt, Human adenovirus D
gccaccucgccgcgcaggggc

SEQ ID NO: 1559865 - RNA, 13 nt, Human adenovirus D
ccauagggagccu

SEQ ID NO: 1559866 - RNA, 15 nt, Human adenovirus D
caggaucauugaaaa

SEQ ID NO: 1559867 - RNA, 19 nt, Human adenovirus D
gcccgggucuggugcaguu

SEQ ID NO: 1559868 - RNA, 17 nt, Human adenovirus D
ugccacaugcaccuggg

SEQ ID NO: 1559869 - RNA, 22 nt, Human adenovirus D
gcgucuuucucuuucucugcca

SEQ ID NO: 1559870 - RNA, 20 nt, Human adenovirus D
guaucugaggcauauaaaaa

SEQ ID NO: 1559871 - RNA, 14 nt, Human adenovirus D
gcuagacaccacag

SEQ ID NO: 1559872 - RNA, 12 nt, Human adenovirus D
uggcuugcauga

SEQ ID NO: 1559873 - RNA, 20 nt, Human adenovirus D
cccacgugguauacaagcca

SEQ ID NO: 1559874 - RNA, 13 nt, Human adenovirus D
gagugcagggaug

SEQ ID NO: 1559875 - RNA, 22 nt, Human adenovirus D
gcuccagcgaaagagagcucgc

SEQ ID NO: 1559876 - RNA, 22 nt, Human adenovirus D
ggagggggggaucauguccacc

SEQ ID NO: 1559877 - RNA, 12 nt, Human adenovirus D
uccgcaacuucc

SEQ ID NO: 1559878 - RNA, 13 nt, Human adenovirus D
gggacuggcaagc

SEQ ID NO: 1559879 - RNA, 17 nt, Human adenovirus D
ccugauauugcuucccu

SEQ ID NO: 1559880 - RNA, 13 nt, Human adenovirus D
caauagacagcag

SEQ ID NO: 1559881 - RNA, 17 nt, Human adenovirus D
caagcuggugaugccag

SEQ ID NO: 1559882 - RNA, 15 nt, Human adenovirus D
ugaagcaggagcgca

SEQ ID NO: 1559883 - RNA, 14 nt, Human adenovirus D
uucugguugucugu

SEQ ID NO: 1559884 - RNA, 12 nt, Human adenovirus D
guugugcaggac

SEQ ID NO: 1559885 - RNA, 16 nt, Human adenovirus D
acaugcccagcagcag

SEQ ID NO: 1559886 - RNA, 22 nt, Human adenovirus D
ccaggguugagucgcggcagaa

SEQ ID NO: 1559887 - RNA, 15 nt, Human adenovirus D
gcugggcguggugcu

SEQ ID NO: 1559888 - RNA, 14 nt, Human adenovirus D
ccaggggguccacc

SEQ ID NO: 1559889 - RNA, 16 nt, Human adenovirus D
acacaaaaaugaagcc

SEQ ID NO: 1559890 - RNA, 23 nt, Human adenovirus D
gcccauaauucagggugcuccag

SEQ ID NO: 1559891 - RNA, 17 nt, Human adenovirus D
ggagccgcucggccaug

SEQ ID NO: 1559892 - RNA, 18 nt, Human adenovirus D
gacaauucagagccaggg

SEQ ID NO: 1559893 - RNA, 11 nt, Human adenovirus D
ggccuggagca

SEQ ID NO: 1559894 - RNA, 21 nt, Human adenovirus D
cccauggacgggaaccccacc

SEQ ID NO: 1559895 - RNA, 16 nt, Human adenovirus D
cgcgcaacugggccgc

SEQ ID NO: 1559896 - RNA, 15 nt, Human adenovirus D
aggagggauugcagg

SEQ ID NO: 1559897 - RNA, 17 nt, Human adenovirus D
gcuccggguucuggaga

SEQ ID NO: 1559898 - RNA, 20 nt, Human adenovirus D
gcucgcgcccguagucugga

SEQ ID NO: 1559899 - RNA, 15 nt, Human adenovirus D
cacccugcccuucca

SEQ ID NO: 1559900 - RNA, 21 nt, Human adenovirus D
gcucgucuagaaccccacagg

SEQ ID NO: 1559901 - RNA, 13 nt, Human adenovirus D
caccuagaccacu

SEQ ID NO: 1559902 - RNA, 22 nt, Human adenovirus D
cacccagaucccgccggggguu

SEQ ID NO: 1559903 - RNA, 17 nt, Human adenovirus D
aguccagcagagucugc

SEQ ID NO: 1559904 - RNA, 15 nt, Human adenovirus D
ggacgaguggcuguu

SEQ ID NO: 1559905 - RNA, 13 nt, Human adenovirus D
uccgcaccgcucc

SEQ ID NO: 1559906 - RNA, 14 nt, Human adenovirus D
augaacaggagcac

SEQ ID NO: 1559907 - RNA, 22 nt, Human adenovirus D
cggaaucagaauauccccuucc

SEQ ID NO: 1559908 - RNA, 21 nt, Human adenovirus D
caccaacuuuaucagcgcgcu

SEQ ID NO: 1559909 - RNA, 15 nt, Human adenovirus D
guagucaugcaugag

SEQ ID NO: 1559910 - RNA, 22 nt, Human adenovirus D
caggggcuugaguccgucggcc

SEQ ID NO: 1559911 - RNA, 13 nt, Human adenovirus D
gucaaacaggcaa

SEQ ID NO: 1559912 - RNA, 23 nt, Human adenovirus D
gccauagagggcguuggagagaa

SEQ ID NO: 1559913 - RNA, 21 nt, Human adenovirus D
uugcugacgggggugcccaac

SEQ ID NO: 1559914 - RNA, 22 nt, Human adenovirus D
ugcuccaggucgucgccccgga

SEQ ID NO: 1559915 - RNA, 22 nt, Human adenovirus D
ucgccgcaccauccgcgccgca

SEQ ID NO: 1559916 - RNA, 22 nt, Human adenovirus D
aggagccauagagggcguugga

SEQ ID NO: 1559917 - RNA, 16 nt, Human adenovirus D
cuugcaacuugcaaac

SEQ ID NO: 1559918 - RNA, 18 nt, Human adenovirus D
augaagguagaagaccau

SEQ ID NO: 1559919 - RNA, 17 nt, Human adenovirus D
accgagccucccaggag

SEQ ID NO: 1559920 - RNA, 13 nt, Human adenovirus D
gcugcggcugaug

SEQ ID NO: 1559921 - RNA, 20 nt, Human adenovirus D
cggguguaaugaaacccgcc

SEQ ID NO: 1559922 - RNA, 21 nt, Human adenovirus D
agcucaucgacuggugcugcg

SEQ ID NO: 1559923 - RNA, 16 nt, Human adenovirus D
ggaggccacgugcgag

SEQ ID NO: 1559924 - RNA, 20 nt, Human adenovirus D
aaagugacgucauugaagag

SEQ ID NO: 1559925 - RNA, 13 nt, Human adenovirus D
auguccggggcgg

SEQ ID NO: 1559926 - RNA, 15 nt, Human adenovirus D
ccggucucugcgcuc

SEQ ID NO: 1559927 - RNA, 14 nt, Human adenovirus D
ccacuacagcugac

SEQ ID NO: 1559928 - RNA, 20 nt, Human adenovirus D
ugaggacuuguuacaugaca

SEQ ID NO: 1559929 - RNA, 18 nt, Human adenovirus D
gcgggcgccucccaggac

SEQ ID NO: 1559930 - RNA, 18 nt, Human adenovirus D
gugcacucccaguucuug

SEQ ID NO: 1559931 - RNA, 18 nt, Human adenovirus D
cggacguggugcugcugc

SEQ ID NO: 1559932 - RNA, 18 nt, Human adenovirus D
caccugcggcgcggagca

SEQ ID NO: 1559933 - RNA, 19 nt, Human adenovirus D
auucaaggccauaaaucug

SEQ ID NO: 1559934 - RNA, 17 nt, Human adenovirus D
agcaguccaugcccaac

SEQ ID NO: 1559935 - RNA, 21 nt, Human adenovirus D
ugcugguggaaacagacagcc

SEQ ID NO: 1559936 - RNA, 23 nt, Human adenovirus D
cggcugcauccacugcuccugcg

SEQ ID NO: 1559937 - RNA, 15 nt, Human adenovirus D
acugcuggcccugcu

SEQ ID NO: 1559938 - RNA, 17 nt, Human adenovirus D
gaucauguccaccugcg

SEQ ID NO: 1559939 - RNA, 21 nt, Human adenovirus D
cuuguaccugcccgacuccua

SEQ ID NO: 1559940 - RNA, 23 nt, Human adenovirus D
cugggguauuacuaggcccagca

SEQ ID NO: 1559941 - RNA, 17 nt, Human adenovirus D
ggccaugcgcaggcgcc

SEQ ID NO: 1559942 - RNA, 14 nt, Human adenovirus D
aucccaacagccuu

SEQ ID NO: 1559943 - RNA, 16 nt, Human adenovirus D
gcggaugcuggcgcgc

SEQ ID NO: 1559944 - RNA, 14 nt, Human adenovirus D
ucuuccccauggcg

SEQ ID NO: 1559945 - RNA, 15 nt, Human adenovirus D
ucaacagcugugcua

SEQ ID NO: 1559946 - RNA, 22 nt, Human adenovirus D
gcccgcgccgcggcgacagcgc

SEQ ID NO: 1559947 - RNA, 15 nt, Human adenovirus D
cugaccaacuggucu

SEQ ID NO: 1559948 - RNA, 18 nt, Human adenovirus D
gguaauccacggacagaa

SEQ ID NO: 1559949 - RNA, 17 nt, Human adenovirus D
ccgccgcuaucugcucu

SEQ ID NO: 1559950 - RNA, 17 nt, Human adenovirus D
uccaucgauuucaucaa

SEQ ID NO: 1559951 - RNA, 20 nt, Human adenovirus D
cagcaucagucuccuggugc

SEQ ID NO: 1559952 - RNA, 18 nt, Human adenovirus D
caaaguaaaaaaccgguc

SEQ ID NO: 1559953 - RNA, 11 nt, Human adenovirus D
augaacacacu

SEQ ID NO: 1559954 - RNA, 22 nt, Human adenovirus D
cggcgcuuggugggcagaggag

SEQ ID NO: 1559955 - RNA, 18 nt, Human adenovirus D
caucgugcgcgaccuggg

SEQ ID NO: 1559956 - RNA, 15 nt, Human adenovirus D
acagccuugccccca

SEQ ID NO: 1559957 - RNA, 15 nt, Human adenovirus D
aggagcugagaccag

SEQ ID NO: 1559958 - RNA, 17 nt, Human adenovirus D
uggagcgcguaggccgc

SEQ ID NO: 1559959 - RNA, 21 nt, Human adenovirus D
uccaugaugauggcgaugggc

SEQ ID NO: 1559960 - RNA, 22 nt, Human adenovirus D
cgaccucgccgucuacucccag

SEQ ID NO: 1559961 - RNA, 21 nt, Human adenovirus D
auccgcagcuacaccucccuc

SEQ ID NO: 1559962 - RNA, 16 nt, Human adenovirus D
ggcgccggcgcuagcc

SEQ ID NO: 1559963 - RNA, 23 nt, Human adenovirus D
gagcaggggcuacauucuggacu

SEQ ID NO: 1559964 - RNA, 13 nt, Human adenovirus D
cuugaggaggaac

SEQ ID NO: 1559965 - RNA, 18 nt, Human adenovirus D
auggcuaccugggaggag

SEQ ID NO: 1559966 - RNA, 16 nt, Human adenovirus D
cucccggcggcagcgg

SEQ ID NO: 1559967 - RNA, 15 nt, Human adenovirus D
cuagaaccccacagg

SEQ ID NO: 1559968 - RNA, 15 nt, Human adenovirus D
agccccucugugccc

SEQ ID NO: 1559969 - RNA, 15 nt, Human adenovirus D
gcacccaccacaguu

SEQ ID NO: 1559970 - RNA, 18 nt, Human adenovirus D
ggaugguuuacaauuuug

SEQ ID NO: 1559971 - RNA, 13 nt, Human adenovirus D
agcgcauccugag

SEQ ID NO: 1559972 - RNA, 14 nt, Human adenovirus D
gucugcucgggcau

SEQ ID NO: 1559973 - RNA, 16 nt, Human adenovirus D
cgccucggaccuggcc

SEQ ID NO: 1559974 - RNA, 14 nt, Human adenovirus D
caugagcaggcagg

SEQ ID NO: 1559975 - RNA, 23 nt, Human adenovirus D
ucucugccgccggggcucggugc

SEQ ID NO: 1559976 - RNA, 13 nt, Human adenovirus D
ccugcccuuccag

SEQ ID NO: 1559977 - RNA, 13 nt, Human adenovirus D
gccagcagcacau

SEQ ID NO: 1559978 - RNA, 16 nt, Human adenovirus D
guuucgucaggcaggc

SEQ ID NO: 1559979 - RNA, 22 nt, Human adenovirus D
agagaaggguuaacauuugaca

SEQ ID NO: 1559980 - RNA, 20 nt, Human adenovirus D
gggacuuggucaccccgccg

SEQ ID NO: 1559981 - RNA, 16 nt, Human adenovirus D
gaaccucagccacucc

SEQ ID NO: 1559982 - RNA, 20 nt, Human adenovirus D
acuacuaauucucaaagugu

SEQ ID NO: 1559983 - RNA, 14 nt, Human adenovirus D
gccugaugagcucg

SEQ ID NO: 1559984 - RNA, 16 nt, Human adenovirus D
aggccgugagcgcgag

SEQ ID NO: 1559985 - RNA, 13 nt, Human adenovirus D
ggaccaaccccac

SEQ ID NO: 1559986 - RNA, 20 nt, Human adenovirus D
cugcgcuuugugcccgugga

SEQ ID NO: 1559987 - RNA, 22 nt, Human adenovirus D
cgccgcguaaccaacgcgccgg

SEQ ID NO: 1559988 - RNA, 13 nt, Human adenovirus D
gguggaagaugac

SEQ ID NO: 1559989 - RNA, 22 nt, Human adenovirus D
ugcgcaaaaccuguucagggac

SEQ ID NO: 1559990 - RNA, 13 nt, Human adenovirus D
cgccgagccugaa

SEQ ID NO: 1559991 - RNA, 14 nt, Human adenovirus D
cuggacccccagac

SEQ ID NO: 1559992 - RNA, 15 nt, Human adenovirus D
cacccacgacacagc

SEQ ID NO: 1559993 - RNA, 21 nt, Human adenovirus D
ugaggaucauaucccagggga

SEQ ID NO: 1559994 - RNA, 18 nt, Human adenovirus D
ucauucaaggccauaaau

SEQ ID NO: 1559995 - RNA, 15 nt, Human adenovirus D
uugucccgcugagcu

SEQ ID NO: 1559996 - RNA, 22 nt, Human adenovirus D
agucagcaacuaccccgugguc

SEQ ID NO: 1559997 - RNA, 13 nt, Human adenovirus D
gaugucugugaag

SEQ ID NO: 1559998 - RNA, 23 nt, Human adenovirus D
cccuccacuuucauaaucaggca

SEQ ID NO: 1559999 - RNA, 16 nt, Human adenovirus D
cauaaucaccauguua

SEQ ID NO: 1560000 - RNA, 19 nt, Human adenovirus D
gcaacuuuuccgagaccau

SEQ ID NO: 1560001 - RNA, 23 nt, Human adenovirus D
uuucgggcgggcagggagcugcg

SEQ ID NO: 1560002 - RNA, 18 nt, Human adenovirus D
uggugcgucgagcacagc

SEQ ID NO: 1560003 - RNA, 21 nt, Human adenovirus D
uccugagauaugugcagcaga

SEQ ID NO: 1560004 - RNA, 18 nt, Human adenovirus D
ugaccauaagcagggugg

SEQ ID NO: 1560005 - RNA, 16 nt, Human adenovirus D
uagccagaccaagcug

SEQ ID NO: 1560006 - RNA, 24 nt, Human adenovirus D
gcugccggaccucaugcaagaccc

SEQ ID NO: 1560007 - RNA, 14 nt, Human adenovirus D
acucgcgggcggcc

SEQ ID NO: 1560008 - RNA, 14 nt, Human adenovirus D
cuuagacugcuauc

SEQ ID NO: 1560009 - RNA, 18 nt, Human adenovirus D
aucaaaucgccaagggca

SEQ ID NO: 1560010 - RNA, 22 nt, Human adenovirus D
caaacuauugcuucccauugaa

SEQ ID NO: 1560011 - RNA, 20 nt, Human adenovirus D
uggaaacucuuggagcaggg

SEQ ID NO: 1560012 - RNA, 20 nt, Human adenovirus D
cgcgaguucgcuccgcggcg

SEQ ID NO: 1560013 - RNA, 21 nt, Human adenovirus D
aaucacucuuuccagcagcag

SEQ ID NO: 1560014 - RNA, 22 nt, Human adenovirus D
agcuagcacccaaaaacugcau

SEQ ID NO: 1560015 - RNA, 16 nt, Human adenovirus D
aggagucgccggagga

SEQ ID NO: 1560016 - RNA, 23 nt, Human adenovirus D
gcaggauaaauauggccuggagc

SEQ ID NO: 1560017 - RNA, 23 nt, Human adenovirus D
gacaucgcgaaccaggcagugca

SEQ ID NO: 1560018 - RNA, 20 nt, Human adenovirus D
ccaggggaugaacaguggca

SEQ ID NO: 1560019 - RNA, 19 nt, Human adenovirus D
guuucucaacagcugggac

SEQ ID NO: 1560020 - RNA, 23 nt, Human adenovirus D
aaugucuuauggugacucggcug

SEQ ID NO: 1560021 - RNA, 22 nt, Human adenovirus D
gccacuuccgcgcuccgugggg

SEQ ID NO: 1560022 - RNA, 11 nt, Human adenovirus D
cggcugcugcu

SEQ ID NO: 1560023 - RNA, 11 nt, Human adenovirus D
acaugcacugg

SEQ ID NO: 1560024 - RNA, 21 nt, Human adenovirus D
uggucuuucuggcuugcuucu

SEQ ID NO: 1560025 - RNA, 20 nt, Human adenovirus D
ccgaagaagaacaggagccg

SEQ ID NO: 1560026 - RNA, 21 nt, Human adenovirus D
ggaggcaccaucacaggaggc

SEQ ID NO: 1560027 - RNA, 21 nt, Human adenovirus D
ugugcugguggaaacagacag

SEQ ID NO: 1560028 - RNA, 13 nt, Human adenovirus D
caaguccagggug

SEQ ID NO: 1560029 - RNA, 23 nt, Human adenovirus D
aagcagguggcgccgggccuggg

SEQ ID NO: 1560030 - RNA, 17 nt, Human adenovirus D
accucuacgccaccuuc

SEQ ID NO: 1560031 - RNA, 16 nt, Human adenovirus D
gccgcggcgagcggga

SEQ ID NO: 1560032 - RNA, 22 nt, Human adenovirus D
cgcccaacucgcggcugcugcu

SEQ ID NO: 1560033 - RNA, 24 nt, Human adenovirus D
ucauucucgagcgaucugggaugc

SEQ ID NO: 1560034 - RNA, 17 nt, Human adenovirus D
ggaggcgugcacuggcu

SEQ ID NO: 1560035 - RNA, 19 nt, Human adenovirus D
ggaagaagagacagaagaa

SEQ ID NO: 1560036 - RNA, 22 nt, Human adenovirus D
cuaaugguccugcaagaggaga

SEQ ID NO: 1560037 - RNA, 16 nt, Human adenovirus D
agccaggugagcucgg

SEQ ID NO: 1560038 - RNA, 18 nt, Human adenovirus D
cgccaaccggcugaugcc

SEQ ID NO: 1560039 - RNA, 17 nt, Human adenovirus D
caucaccaccgucagug

SEQ ID NO: 1560040 - RNA, 19 nt, Human adenovirus D
cugcaggggcgucccgcgg

SEQ ID NO: 1560041 - RNA, 18 nt, Human adenovirus D
ggcguggcuaaggugacu

SEQ ID NO: 1560042 - RNA, 12 nt, Human adenovirus D
uccuccaggacu

SEQ ID NO: 1560043 - RNA, 14 nt, Human adenovirus D
ugagcggcugcacg

SEQ ID NO: 1560044 - RNA, 16 nt, Human adenovirus D
cucaaagaccagaacu

SEQ ID NO: 1560045 - RNA, 11 nt, Human adenovirus D
aacaaggccau

SEQ ID NO: 1560046 - RNA, 22 nt, Human adenovirus D
aucaccauguuauucagcagcc

SEQ ID NO: 1560047 - RNA, 14 nt, Human adenovirus D
cagggaggcgcugc

SEQ ID NO: 1560048 - RNA, 21 nt, Human adenovirus D
cucagcugccaugggaggaag

SEQ ID NO: 1560049 - RNA, 12 nt, Human adenovirus D
cucaggcgcaac

SEQ ID NO: 1560050 - RNA, 22 nt, Human adenovirus D
gcuccuucaacgcgcgcugccc

SEQ ID NO: 1560051 - RNA, 22 nt, Human adenovirus D
ggccgcucgcucguucugccca

SEQ ID NO: 1560052 - RNA, 23 nt, Human adenovirus D
augccaagauagcccugcgccca

SEQ ID NO: 1560053 - RNA, 22 nt, Human adenovirus D
cggggcgaaguuccccucgcag

SEQ ID NO: 1560054 - RNA, 15 nt, Human adenovirus D
cggagcccacccgcu

SEQ ID NO: 1560055 - RNA, 21 nt, Human adenovirus D
ccugggcacuggagcacagac

SEQ ID NO: 1560056 - RNA, 17 nt, Human adenovirus D
acaguuauaccaccucc

SEQ ID NO: 1560057 - RNA, 22 nt, Human adenovirus D
cuaacgcuguaccgcgaggcca

SEQ ID NO: 1560058 - RNA, 15 nt, Human adenovirus D
caagugccuuuauca

SEQ ID NO: 1560059 - RNA, 16 nt, Human adenovirus D
gacugacuacccacug

SEQ ID NO: 1560060 - RNA, 20 nt, Human adenovirus D
gcccgccauggggcgccgcc

SEQ ID NO: 1560061 - RNA, 20 nt, Human adenovirus D
cuucacagagagccgccuga

SEQ ID NO: 1560062 - RNA, 18 nt, Human adenovirus D
acucuuaaaucauuuaaa

SEQ ID NO: 1560063 - RNA, 18 nt, Human adenovirus D
ucacucuuuccagcagca

SEQ ID NO: 1560064 - RNA, 20 nt, Human adenovirus D
acuacaaggacuacaaggcc

SEQ ID NO: 1560065 - RNA, 14 nt, Human adenovirus D
gcagcacaguaagu

SEQ ID NO: 1560066 - RNA, 15 nt, Human adenovirus D
cuuuuccugaugcag

SEQ ID NO: 1560067 - RNA, 19 nt, Human adenovirus D
ucgcuguccacgagcgcca

SEQ ID NO: 1560068 - RNA, 16 nt, Human adenovirus D
cacuuaaguccugggc

SEQ ID NO: 1560069 - RNA, 16 nt, Human adenovirus D
gugaccaucguaccag

SEQ ID NO: 1560070 - RNA, 21 nt, Human adenovirus D
acacugcagggagccagggga

SEQ ID NO: 1560071 - RNA, 21 nt, Human adenovirus D
gugcagccgugaucccacagg

SEQ ID NO: 1560072 - RNA, 12 nt, Human adenovirus D
gaggguguccug

SEQ ID NO: 1560073 - RNA, 20 nt, Human adenovirus D
cccugaacuaucaaaacgac

SEQ ID NO: 1560074 - RNA, 17 nt, Human adenovirus D
cugcucaccaccccgga

SEQ ID NO: 1560075 - RNA, 21 nt, Human adenovirus D
auugaaugggacuuauccaca

SEQ ID NO: 1560076 - RNA, 23 nt, Human adenovirus D
agaugcgacccaugagcugcgag

SEQ ID NO: 1560077 - RNA, 16 nt, Human adenovirus D
uuccccuccgcugugc

SEQ ID NO: 1560078 - RNA, 22 nt, Human adenovirus D
gagagcgggcaugaccucggca

SEQ ID NO: 1560079 - RNA, 18 nt, Human adenovirus D
gcaccugugggaccuggc

SEQ ID NO: 1560080 - RNA, 17 nt, Human adenovirus D
guagacaaagagcacag

SEQ ID NO: 1560081 - RNA, 15 nt, Human adenovirus D
cacccuggaagccau

SEQ ID NO: 1560082 - RNA, 20 nt, Human adenovirus D
ugcaccuguggagggcaugg

SEQ ID NO: 1560083 - RNA, 24 nt, Human adenovirus D
ggcugacgagcccgcgcgggagcc

SEQ ID NO: 1560084 - RNA, 20 nt, Human adenovirus D
ugauggccuguaccgggacc

SEQ ID NO: 1560085 - RNA, 15 nt, Human adenovirus D
ugccgcuggacgaga

SEQ ID NO: 1560086 - RNA, 18 nt, Human adenovirus D
gccagaaggggcaccuuc

SEQ ID NO: 1560087 - RNA, 21 nt, Human adenovirus D
cccgcccagguuuuccaugca

SEQ ID NO: 1560088 - RNA, 17 nt, Human adenovirus D
cagucagugaagcccug

SEQ ID NO: 1560089 - RNA, 13 nt, Human adenovirus D
ggcgggcugcccg

SEQ ID NO: 1560090 - RNA, 17 nt, Human adenovirus D
cuccuucaacgcgcgcu

SEQ ID NO: 1560091 - RNA, 19 nt, Human adenovirus D
aaacuugagcuuguuuaug

SEQ ID NO: 1560092 - RNA, 14 nt, Human adenovirus D
ucgaugaucucacg

SEQ ID NO: 1560093 - RNA, 16 nt, Human adenovirus D
guuuuccaugcacuca

SEQ ID NO: 1560094 - RNA, 23 nt, Human adenovirus D
ugggggcaauaccgggaugauga

SEQ ID NO: 1560095 - RNA, 22 nt, Human adenovirus D
gcacguggcggcggccaaccug

SEQ ID NO: 1560096 - RNA, 13 nt, Human adenovirus D
acagaugguagca

SEQ ID NO: 1560097 - RNA, 16 nt, Human adenovirus D
cuccacgugccgcgcg

SEQ ID NO: 1560098 - RNA, 18 nt, Human adenovirus D
cuacgccagccgcaggcg

SEQ ID NO: 1560099 - RNA, 17 nt, Human adenovirus D
cgcgcgaagauggccac

SEQ ID NO: 1560100 - RNA, 15 nt, Human adenovirus D
gcgcaguugggagcu

SEQ ID NO: 1560101 - RNA, 17 nt, Human adenovirus D
ucguacuucugccagca

SEQ ID NO: 1560102 - RNA, 13 nt, Human adenovirus D
gacgcagccggcg

SEQ ID NO: 1560103 - RNA, 21 nt, Human adenovirus D
gccgccggcggcgggccaugc

SEQ ID NO: 1560104 - RNA, 15 nt, Human adenovirus D
ugcauggccagccuu

SEQ ID NO: 1560105 - RNA, 14 nt, Human adenovirus D
cagaacuggcagag

SEQ ID NO: 1560106 - RNA, 13 nt, Human adenovirus D
cccgccgccaggc

SEQ ID NO: 1560107 - RNA, 16 nt, Human adenovirus D
ccgggaccgaguucag

SEQ ID NO: 1560108 - RNA, 19 nt, Human adenovirus D
ugacuuugaaccugaaaga

SEQ ID NO: 1560109 - RNA, 15 nt, Human adenovirus D
cuucucuuacugaaa

SEQ ID NO: 1560110 - RNA, 15 nt, Human adenovirus D
acauccuggaccagg

SEQ ID NO: 1560111 - RNA, 22 nt, Human adenovirus D
ucagccccuuccccuaucccaa

SEQ ID NO: 1560112 - RNA, 17 nt, Human adenovirus D
gaaacgucccaggaaac

SEQ ID NO: 1560113 - RNA, 17 nt, Human adenovirus D
ccuggcuccgcggcacg

SEQ ID NO: 1560114 - RNA, 17 nt, Human adenovirus D
caagcucaugcuggccg

SEQ ID NO: 1560115 - RNA, 19 nt, Human adenovirus D
ugcugcgccgcgccagacg

SEQ ID NO: 1560116 - RNA, 13 nt, Human adenovirus D
caccccccgcagg

SEQ ID NO: 1560117 - RNA, 15 nt, Human adenovirus D
gugaagggcacagcc

SEQ ID NO: 1560118 - RNA, 23 nt, Human adenovirus D
caaucucggcgucauugacggcg

SEQ ID NO: 1560119 - RNA, 22 nt, Human adenovirus D
aggaagcccagagcucgcgggc

SEQ ID NO: 1560120 - RNA, 14 nt, Human adenovirus D
gcguguugcggccc

SEQ ID NO: 1560121 - RNA, 21 nt, Human adenovirus D
cucacaguaagugcagcacau

SEQ ID NO: 1560122 - RNA, 21 nt, Human adenovirus D
caggcccagaacuggcagagc

SEQ ID NO: 1560123 - RNA, 16 nt, Human adenovirus D
ccccgagcgccugagg

SEQ ID NO: 1560124 - RNA, 15 nt, Human adenovirus D
cucucguuccagacg

SEQ ID NO: 1560125 - RNA, 14 nt, Human adenovirus D
uacuguaaagccac

SEQ ID NO: 1560126 - RNA, 13 nt, Human adenovirus D
uccuccgcaucca

SEQ ID NO: 1560127 - RNA, 15 nt, Human adenovirus D
cuggcugcuggagcu

SEQ ID NO: 1560128 - RNA, 19 nt, Human adenovirus D
aggagaacugcuggcccug

SEQ ID NO: 1560129 - RNA, 14 nt, Human adenovirus D
ggaggaugugcugc

SEQ ID NO: 1560130 - RNA, 14 nt, Human adenovirus D
gacgagaacccgag

SEQ ID NO: 1560131 - RNA, 17 nt, Human adenovirus D
gucuaccugcgcacgcc

SEQ ID NO: 1560132 - RNA, 21 nt, Human adenovirus D
caccccuuacauguggagcua

SEQ ID NO: 1560133 - RNA, 15 nt, Human adenovirus D
gucuacuucaacccc

SEQ ID NO: 1560134 - RNA, 21 nt, Human adenovirus D
gcggccagcgcuggguggccg

SEQ ID NO: 1560135 - RNA, 21 nt, Human adenovirus D
ugaucuuuaugaacaugaagu

SEQ ID NO: 1560136 - RNA, 12 nt, Human adenovirus D
gagcccacccgc

SEQ ID NO: 1560137 - RNA, 20 nt, Human adenovirus D
gcugcuucgcccgggagagc

SEQ ID NO: 1560138 - RNA, 21 nt, Human adenovirus D
ugcacucauccaugaugaugg

SEQ ID NO: 1560139 - RNA, 19 nt, Human adenovirus D
gccucccgcccgacacugc

SEQ ID NO: 1560140 - RNA, 20 nt, Human adenovirus D
ggccacgaccgugccgcggu

SEQ ID NO: 1560141 - RNA, 20 nt, Human adenovirus D
ugagaugccccagcagaagc

SEQ ID NO: 1560142 - RNA, 16 nt, Human adenovirus D
ggagcgcguaggccgc

SEQ ID NO: 1560143 - RNA, 22 nt, Human adenovirus D
cacccgcgccgacgcgcuccuc

SEQ ID NO: 1560144 - RNA, 16 nt, Human adenovirus D
ggccaucgugcagaac

SEQ ID NO: 1560145 - RNA, 19 nt, Human adenovirus D
gucaaggugcgccccauca

SEQ ID NO: 1560146 - RNA, 18 nt, Human adenovirus D
ccacugccgccgccugcg

SEQ ID NO: 1560147 - RNA, 16 nt, Human adenovirus D
gacguggugcugcugc

SEQ ID NO: 1560148 - RNA, 19 nt, Human adenovirus D
ugacaacccgccugccagg

SEQ ID NO: 1560149 - RNA, 18 nt, Human adenovirus D
caggguacccacugggug

SEQ ID NO: 1560150 - RNA, 21 nt, Human adenovirus D
gaugaccgagcugacggccag

SEQ ID NO: 1560151 - RNA, 21 nt, Human adenovirus D
agaccaccuggugauggccug

SEQ ID NO: 1560152 - RNA, 15 nt, Human adenovirus D
gcaacccccagcucc

SEQ ID NO: 1560153 - RNA, 15 nt, Human adenovirus D
ugaaguacauccauu

SEQ ID NO: 1560154 - RNA, 19 nt, Human adenovirus D
cgcgagcugaugcugagcc

SEQ ID NO: 1560155 - RNA, 16 nt, Human adenovirus D
agaugccgggacagag

SEQ ID NO: 1560156 - RNA, 22 nt, Human adenovirus D
gccaagauagcccugcgcccag

SEQ ID NO: 1560157 - RNA, 16 nt, Human adenovirus D
agcaauccuccaggac

SEQ ID NO: 1560158 - RNA, 21 nt, Human adenovirus D
ccugugacaugcaaaaucuua

SEQ ID NO: 1560159 - RNA, 22 nt, Human adenovirus D
cugacaauucagagccagggcu

SEQ ID NO: 1560160 - RNA, 16 nt, Human adenovirus D
agcggggacagagaau

SEQ ID NO: 1560161 - RNA, 23 nt, Human adenovirus D
aggagcuggacaagcuucuugcu

SEQ ID NO: 1560162 - RNA, 15 nt, Human adenovirus D
ucguuaguccagcag

SEQ ID NO: 1560163 - RNA, 23 nt, Human adenovirus D
aaacuaaugacaaacaaaagcca

SEQ ID NO: 1560164 - RNA, 19 nt, Human adenovirus D
caacaugggugugcuggcu

SEQ ID NO: 1560165 - RNA, 20 nt, Human adenovirus D
agaucaccuacgagcucgug

SEQ ID NO: 1560166 - RNA, 11 nt, Human adenovirus D
cugggggcgcc

SEQ ID NO: 1560167 - RNA, 20 nt, Human adenovirus D
aucgccacaggugcugccca

SEQ ID NO: 1560168 - RNA, 21 nt, Human adenovirus D
cgggccuacgagcucaaccuc

SEQ ID NO: 1560169 - RNA, 14 nt, Human adenovirus D
agcaucgcgcaggc

SEQ ID NO: 1560170 - RNA, 15 nt, Human adenovirus D
uuguuguacucugug

SEQ ID NO: 1560171 - RNA, 15 nt, Human adenovirus D
cucguaccuggguca

SEQ ID NO: 1560172 - RNA, 20 nt, Human adenovirus D
ccagcccaugagcaggcagg

SEQ ID NO: 1560173 - RNA, 17 nt, Human adenovirus D
acugcaccccccgcagg

SEQ ID NO: 1560174 - RNA, 14 nt, Human adenovirus D
agaaccgccugggg

SEQ ID NO: 1560175 - RNA, 21 nt, Human adenovirus D
cgagcaagggcgaccagcucu

SEQ ID NO: 1560176 - RNA, 16 nt, Human adenovirus D
uugaaaaggcagcuga

SEQ ID NO: 1560177 - RNA, 19 nt, Human adenovirus D
gaguggcggcuuucugccc

SEQ ID NO: 1560178 - RNA, 12 nt, Human adenovirus D
uacaacuacaca

SEQ ID NO: 1560179 - RNA, 13 nt, Human adenovirus D
cgcacgggccgcc

SEQ ID NO: 1560180 - RNA, 18 nt, Human adenovirus D
ccccauggcgcacaacac

SEQ ID NO: 1560181 - RNA, 16 nt, Human adenovirus D
ugcggcugcugcaaau

SEQ ID NO: 1560182 - RNA, 13 nt, Human adenovirus D
aucagccaggacu

SEQ ID NO: 1560183 - RNA, 16 nt, Human adenovirus D
cucucgcuccaugaac

SEQ ID NO: 1560184 - RNA, 18 nt, Human adenovirus D
uccaccgaaggcagcucc

SEQ ID NO: 1560185 - RNA, 18 nt, Human adenovirus D
gccgcgugguagcccccu

SEQ ID NO: 1560186 - RNA, 17 nt, Human adenovirus D
gcacguggcggcggcca

SEQ ID NO: 1560187 - RNA, 14 nt, Human adenovirus D
acuucagccugggc

SEQ ID NO: 1560188 - RNA, 12 nt, Human adenovirus D
ccugcagcccaa

SEQ ID NO: 1560189 - RNA, 16 nt, Human adenovirus D
acugcucgaucuccuc

SEQ ID NO: 1560190 - RNA, 17 nt, Human adenovirus D
gggaccggggaggcacc

SEQ ID NO: 1560191 - RNA, 13 nt, Human adenovirus D
cccagccuccacc

SEQ ID NO: 1560192 - RNA, 19 nt, Human adenovirus D
aaguugaaaaacugggcgu

SEQ ID NO: 1560193 - RNA, 22 nt, Human adenovirus D
acucccgucucgacccgagccc

SEQ ID NO: 1560194 - RNA, 18 nt, Human adenovirus D
accccaggcggaccagaa

SEQ ID NO: 1560195 - RNA, 19 nt, Human adenovirus D
accaccgcgaccgcggccg

SEQ ID NO: 1560196 - RNA, 18 nt, Human adenovirus D
gaugauguccuugaggag

SEQ ID NO: 1560197 - RNA, 18 nt, Human adenovirus D
cuggugcgucgagcacag

SEQ ID NO: 1560198 - RNA, 16 nt, Human adenovirus D
ggcgcaaccaggagga

SEQ ID NO: 1560199 - RNA, 15 nt, Human adenovirus D
ugcccucgcuacugc

SEQ ID NO: 1560200 - RNA, 20 nt, Human adenovirus D
aggacacuaaagggagagcu

SEQ ID NO: 1560201 - RNA, 16 nt, Human adenovirus D
ccucugccguccgccc

SEQ ID NO: 1560202 - RNA, 13 nt, Human adenovirus D
gguccgggggcag

SEQ ID NO: 1560203 - RNA, 15 nt, Human adenovirus D
ggugaaggggugggc

SEQ ID NO: 1560204 - RNA, 14 nt, Human adenovirus D
cgugcccgagggcu

SEQ ID NO: 1560205 - RNA, 16 nt, Human adenovirus D
cuacuggucgcugccg

SEQ ID NO: 1560206 - RNA, 17 nt, Human adenovirus D
gaucugcaucucccagg

SEQ ID NO: 1560207 - RNA, 21 nt, Human adenovirus D
caugcagacacuugagcuggc

SEQ ID NO: 1560208 - RNA, 18 nt, Human adenovirus D
gagcccgaggagaugcgc

SEQ ID NO: 1560209 - RNA, 17 nt, Human adenovirus D
ugcccuuuucccaggac

SEQ ID NO: 1560210 - RNA, 19 nt, Human adenovirus D
cagcaggagcgugccgcca

SEQ ID NO: 1560211 - RNA, 14 nt, Human adenovirus D
ucccaccccuuaca

SEQ ID NO: 1560212 - RNA, 23 nt, Human adenovirus D
ggcaccaucacaggaggcacaga

SEQ ID NO: 1560213 - RNA, 12 nt, Human adenovirus D
cagggagccagg

SEQ ID NO: 1560214 - RNA, 13 nt, Human adenovirus D
auaaacuuaguuu

SEQ ID NO: 1560215 - RNA, 18 nt, Human adenovirus D
cugcagcguguucaaaac

SEQ ID NO: 1560216 - RNA, 17 nt, Human adenovirus D
ccgggucuggugcaguu

SEQ ID NO: 1560217 - RNA, 15 nt, Human adenovirus D
ugaccugcagcaggu

SEQ ID NO: 1560218 - RNA, 22 nt, Human adenovirus D
gggcguguaccgcaacgaccgc

SEQ ID NO: 1560219 - RNA, 23 nt, Human adenovirus D
aaccugcgcgggcuguggggcgu

SEQ ID NO: 1560220 - RNA, 14 nt, Human adenovirus D
cuaccuugcaccca

SEQ ID NO: 1560221 - RNA, 12 nt, Human adenovirus D
cuugaggaggag

SEQ ID NO: 1560222 - RNA, 22 nt, Human adenovirus D
ggcauagcuuccguugcgcugc

SEQ ID NO: 1560223 - RNA, 21 nt, Human adenovirus D
ccagcgucauguccuuccagg

SEQ ID NO: 1560224 - RNA, 19 nt, Human adenovirus D
gagguuccguuugugccuc

SEQ ID NO: 1560225 - RNA, 20 nt, Human adenovirus D
ggacccuuuuaccuuaacca

SEQ ID NO: 1560226 - RNA, 15 nt, Human adenovirus D
uccuuucccuggugg

SEQ ID NO: 1560227 - RNA, 22 nt, Human adenovirus D
gugaaggccggcaugcccacca

SEQ ID NO: 1560228 - RNA, 19 nt, Human adenovirus D
ucuacucccagcucauccg

SEQ ID NO: 1560229 - RNA, 16 nt, Human adenovirus D
uacaaagcugaaagcu

SEQ ID NO: 1560230 - RNA, 20 nt, Human adenovirus D
auguaaguuuuauggcugcu

SEQ ID NO: 1560231 - RNA, 13 nt, Human adenovirus D
ggcccggcacggc

SEQ ID NO: 1560232 - RNA, 18 nt, Human adenovirus D
agcauggcuaccugggag

SEQ ID NO: 1560233 - RNA, 11 nt, Human adenovirus D
cgcagccugag

SEQ ID NO: 1560234 - RNA, 23 nt, Human adenovirus D
cggacuggguuaguaugucccug

SEQ ID NO: 1560235 - RNA, 19 nt, Human adenovirus D
uccaugcgaauuccccuca

SEQ ID NO: 1560236 - RNA, 20 nt, Human adenovirus D
gcacaacaccgccuccaccc

SEQ ID NO: 1560237 - RNA, 18 nt, Human adenovirus D
ccacgcuucuuccccagc

SEQ ID NO: 1560238 - RNA, 19 nt, Human adenovirus D
gcugugcugguggaaacag

SEQ ID NO: 1560239 - RNA, 23 nt, Human adenovirus D
gaggagcugugucgggccuacga

SEQ ID NO: 1560240 - RNA, 20 nt, Human adenovirus D
cucgcacucgacgagccagg

SEQ ID NO: 1560241 - RNA, 18 nt, Human adenovirus D
agcccgggucuggugcag

SEQ ID NO: 1560242 - RNA, 16 nt, Human adenovirus D
ggaggaugcacccgcu

SEQ ID NO: 1560243 - RNA, 17 nt, Human adenovirus D
aggagggauugcagggc

SEQ ID NO: 1560244 - RNA, 20 nt, Human adenovirus D
cugcaccccccgcaggcagg

SEQ ID NO: 1560245 - RNA, 22 nt, Human adenovirus D
ggcggguccccguugggcagcg

SEQ ID NO: 1560246 - RNA, 16 nt, Human adenovirus D
gaugaguugggccuga

SEQ ID NO: 1560247 - RNA, 15 nt, Human adenovirus D
gcgcgagcugagcga

SEQ ID NO: 1560248 - RNA, 23 nt, Human adenovirus D
cgugcuccggcggauagcgcgcc

SEQ ID NO: 1560249 - RNA, 23 nt, Human adenovirus D
gguggaaacagacagccagguca

SEQ ID NO: 1560250 - RNA, 17 nt, Human adenovirus D
ucugaaaagucauccaa

SEQ ID NO: 1560251 - RNA, 22 nt, Human adenovirus D
cggccugcgucaucacccaggg

SEQ ID NO: 1560252 - RNA, 16 nt, Human adenovirus D
uucugggucaccuugg

SEQ ID NO: 1560253 - RNA, 15 nt, Human adenovirus D
ucccucucgagagcg

SEQ ID NO: 1560254 - RNA, 17 nt, Human adenovirus D
cauguucucacaguaag

SEQ ID NO: 1560255 - RNA, 23 nt, Human adenovirus D
ggaagcaaaguuuuucaggggcu

SEQ ID NO: 1560256 - RNA, 12 nt, Human adenovirus D
aucacacugcau

SEQ ID NO: 1560257 - RNA, 17 nt, Human adenovirus D
gccgugcugcucgagcg

SEQ ID NO: 1560258 - RNA, 17 nt, Human adenovirus D
ugaauaucagacaugcu

SEQ ID NO: 1560259 - RNA, 21 nt, Human adenovirus D
uuccccucaucacaucagcca

SEQ ID NO: 1560260 - RNA, 11 nt, Human adenovirus D
uggggcgccgc

SEQ ID NO: 1560261 - RNA, 20 nt, Human adenovirus D
caaaacccacucuauuuuca

SEQ ID NO: 1560262 - RNA, 18 nt, Human adenovirus D
aggcggugcugcugccga

SEQ ID NO: 1560263 - RNA, 21 nt, Human adenovirus D
gcggaucaccguagagggcac

SEQ ID NO: 1560264 - RNA, 15 nt, Human adenovirus D
gccauggggcgccgc

SEQ ID NO: 1560265 - RNA, 12 nt, Human adenovirus D
uuuuuccagccu

SEQ ID NO: 1560266 - RNA, 20 nt, Human adenovirus D
cagcugccaugggaggaagc

SEQ ID NO: 1560267 - RNA, 14 nt, Human adenovirus D
gaauauccccuucc

SEQ ID NO: 1560268 - RNA, 16 nt, Human adenovirus D
ccugguacgagcuaca

SEQ ID NO: 1560269 - RNA, 22 nt, Human adenovirus D
gugcgcgacuccgucacgggcg

SEQ ID NO: 1560270 - RNA, 16 nt, Human adenovirus D
cugcaccauccccagg

SEQ ID NO: 1560271 - RNA, 20 nt, Human adenovirus D
accugcagcaggugcugccc

SEQ ID NO: 1560272 - RNA, 22 nt, Human adenovirus D
uucuggagaaguuccucugcau

SEQ ID NO: 1560273 - RNA, 22 nt, Human adenovirus D
aggauacgcgggaagagcccuu

SEQ ID NO: 1560274 - RNA, 22 nt, Human adenovirus D
ggcccggcaacgaccggcugcu

SEQ ID NO: 1560275 - RNA, 21 nt, Human adenovirus D
ggcgagcgggacuuggucacc

SEQ ID NO: 1560276 - RNA, 18 nt, Human adenovirus D
uccaguaggaaccagcac

SEQ ID NO: 1560277 - RNA, 16 nt, Human adenovirus D
ggccauugcucgcucg

SEQ ID NO: 1560278 - RNA, 21 nt, Human adenovirus D
gagcagcggcgcaagcucaug

SEQ ID NO: 1560279 - RNA, 13 nt, Human adenovirus D
cguggacgcugcu

SEQ ID NO: 1560280 - RNA, 15 nt, Human adenovirus D
ggugacagaaccaga

SEQ ID NO: 1560281 - RNA, 14 nt, Human adenovirus D
cguccgucagcagc

SEQ ID NO: 1560282 - RNA, 14 nt, Human adenovirus D
augaccugggcggc

SEQ ID NO: 1560283 - RNA, 23 nt, Human adenovirus D
gaccuucauaauagaaacagauc

SEQ ID NO: 1560284 - RNA, 16 nt, Human adenovirus D
gagccugcgccgggcg

SEQ ID NO: 1560285 - RNA, 21 nt, Human adenovirus D
cucuacgcguacauccagcau

SEQ ID NO: 1560286 - RNA, 22 nt, Human adenovirus D
aacaggcugucgguguccccgu

SEQ ID NO: 1560287 - RNA, 22 nt, Human adenovirus D
guucagggaccgcagcggggag

SEQ ID NO: 1560288 - RNA, 14 nt, Human adenovirus D
cuccacccuggugu

SEQ ID NO: 1560289 - RNA, 22 nt, Human adenovirus D
cggggcgggggugaugagcugc

SEQ ID NO: 1560290 - RNA, 23 nt, Human adenovirus D
cgucuacacagacaaacauccau

SEQ ID NO: 1560291 - RNA, 17 nt, Human adenovirus D
gacgagaaccugaagga

SEQ ID NO: 1560292 - RNA, 19 nt, Human adenovirus D
cggcuaccagggcuuccac

SEQ ID NO: 1560293 - RNA, 22 nt, Human adenovirus D
ggacggccaggccuccgagcag

SEQ ID NO: 1560294 - RNA, 17 nt, Human adenovirus D
gcaagccucugacggcg

SEQ ID NO: 1560295 - RNA, 17 nt, Human adenovirus D
agccaggugagcucggg

SEQ ID NO: 1560296 - RNA, 19 nt, Human adenovirus D
cagaggacuuggaugagga

SEQ ID NO: 1560297 - RNA, 12 nt, Human adenovirus D
agggccugggcu

SEQ ID NO: 1560298 - RNA, 20 nt, Human adenovirus D
agcguagcuaugacgaggug

SEQ ID NO: 1560299 - RNA, 17 nt, Human adenovirus D
ccaggaggagcucuauc

SEQ ID NO: 1560300 - RNA, 15 nt, Human adenovirus D
acuucugccagcaga

SEQ ID NO: 1560301 - RNA, 16 nt, Human adenovirus D
ggcagagguggucauu

SEQ ID NO: 1560302 - RNA, 17 nt, Human adenovirus D
cacagcaccgcauccug

SEQ ID NO: 1560303 - RNA, 22 nt, Human adenovirus D
aacccgcgcucgcgcaccugcu

SEQ ID NO: 1560304 - RNA, 13 nt, Human adenovirus D
gagcuuggccgag

SEQ ID NO: 1560305 - RNA, 22 nt, Human adenovirus D
agcagcaggguacccacugggu

SEQ ID NO: 1560306 - RNA, 15 nt, Human adenovirus D
gaggggggccaccuc

SEQ ID NO: 1560307 - RNA, 19 nt, Human adenovirus D
gcaaaaaaaauuauaucua

SEQ ID NO: 1560308 - RNA, 22 nt, Human adenovirus D
aggaacuucaggaguggcggcc

SEQ ID NO: 1560309 - RNA, 19 nt, Human adenovirus D
gcuaaugguccugcaagag

SEQ ID NO: 1560310 - RNA, 15 nt, Human adenovirus D
aucccacgccgagcc

SEQ ID NO: 1560311 - RNA, 21 nt, Human adenovirus D
cagcagcccuucuccacgggg

SEQ ID NO: 1560312 - RNA, 14 nt, Human adenovirus D
cgggaucaagcgcg

SEQ ID NO: 1560313 - RNA, 22 nt, Human adenovirus D
uaccauugcaaggcagaaucaa

SEQ ID NO: 1560314 - RNA, 14 nt, Human adenovirus D
uaaagccagcagca

SEQ ID NO: 1560315 - RNA, 20 nt, Human adenovirus D
ugaccuacgcgaccgugggg

SEQ ID NO: 1560316 - RNA, 23 nt, Human adenovirus D
gccgcggcagccgcagccgccau

SEQ ID NO: 1560317 - RNA, 19 nt, Human adenovirus D
caaccuccaggccaaccug

SEQ ID NO: 1560318 - RNA, 16 nt, Human adenovirus D
ugauauccaguaggaa

SEQ ID NO: 1560319 - RNA, 14 nt, Human adenovirus D
caggagcaggagga

SEQ ID NO: 1560320 - RNA, 22 nt, Human adenovirus D
gcccagcaauaacaccggcugg

SEQ ID NO: 1560321 - RNA, 14 nt, Human adenovirus D
agaaauuucaagcu

SEQ ID NO: 1560322 - RNA, 16 nt, Human adenovirus D
ugcaguuuggccugga

SEQ ID NO: 1560323 - RNA, 22 nt, Human adenovirus D
agaacuuguuauugagcccauc

SEQ ID NO: 1560324 - RNA, 12 nt, Human adenovirus D
aagccagcagca

SEQ ID NO: 1560325 - RNA, 15 nt, Human adenovirus D
cagcccuaccccgcc

SEQ ID NO: 1560326 - RNA, 20 nt, Human adenovirus D
ccgauggucgcuggacccca

SEQ ID NO: 1560327 - RNA, 15 nt, Human adenovirus D
gaaacgccccugcaa

SEQ ID NO: 1560328 - RNA, 19 nt, Human adenovirus D
guacugguacuugggcugc

SEQ ID NO: 1560329 - RNA, 13 nt, Human adenovirus D
guacuugggcugc

SEQ ID NO: 1560330 - RNA, 21 nt, Human adenovirus D
cucuccgcaccgcuccugguc

SEQ ID NO: 1560331 - RNA, 19 nt, Human adenovirus D
auccagucauagcaggggc

SEQ ID NO: 1560332 - RNA, 21 nt, Human adenovirus D
ugcggcagcuuuuugagcucc

SEQ ID NO: 1560333 - RNA, 17 nt, Human adenovirus D
agcucgaaaucggugcg

SEQ ID NO: 1560334 - RNA, 22 nt, Human adenovirus D
gcuggucacauccaucuccacc

SEQ ID NO: 1560335 - RNA, 11 nt, Human adenovirus D
aaaagucacuu

SEQ ID NO: 1560336 - RNA, 21 nt, Human adenovirus D
ggcgcgcuccuuggccgcgau

SEQ ID NO: 1560337 - RNA, 20 nt, Human adenovirus D
ggcguggcccuuggcgcgga

SEQ ID NO: 1560338 - RNA, 21 nt, Human adenovirus D
cuaaugacaaacaaaagccau

SEQ ID NO: 1560339 - RNA, 22 nt, Human adenovirus D
augcagccaguggcccuggaug

SEQ ID NO: 1560340 - RNA, 15 nt, Human adenovirus D
cuggccuuccaccuc

SEQ ID NO: 1560341 - RNA, 11 nt, Human adenovirus D
ggcuggccgug

SEQ ID NO: 1560342 - RNA, 23 nt, Human adenovirus D
cugccgguuucgggcgggcaggg

SEQ ID NO: 1560343 - RNA, 20 nt, Human adenovirus D
ugggguauuacuaggcccag

SEQ ID NO: 1560344 - RNA, 13 nt, Human adenovirus D
caugcuggaauaa

SEQ ID NO: 1560345 - RNA, 16 nt, Human adenovirus D
gaacagcagcagcaaa

SEQ ID NO: 1560346 - RNA, 18 nt, Human adenovirus D
ggcgguccccgcccagcg

SEQ ID NO: 1560347 - RNA, 22 nt, Human adenovirus D
caccgcaaugcgggccugcgcu

SEQ ID NO: 1560348 - RNA, 13 nt, Human adenovirus D
ggagcggucugga

SEQ ID NO: 1560349 - RNA, 16 nt, Human adenovirus D
caccugggcgccagaa

SEQ ID NO: 1560350 - RNA, 11 nt, Human adenovirus D
ccucugcaucu

SEQ ID NO: 1560351 - RNA, 17 nt, Human adenovirus D
gacggccuacgagcaga

SEQ ID NO: 1560352 - RNA, 19 nt, Human adenovirus D
cccaggcggugcugcugcc

SEQ ID NO: 1560353 - RNA, 19 nt, Human adenovirus D
caacccgauaucgcgcauc

SEQ ID NO: 1560354 - RNA, 16 nt, Human adenovirus D
cagcgucgaggagcug

SEQ ID NO: 1560355 - RNA, 12 nt, Human adenovirus D
gcccuuccagca

SEQ ID NO: 1560356 - RNA, 14 nt, Human adenovirus D
gcgcccucagcagu

SEQ ID NO: 1560357 - RNA, 14 nt, Human adenovirus D
cucugaaaagucau

SEQ ID NO: 1560358 - RNA, 22 nt, Human adenovirus D
cgcacccggcauccugcacgca

SEQ ID NO: 1560359 - RNA, 13 nt, Human adenovirus D
cgcauugcaugag

SEQ ID NO: 1560360 - RNA, 11 nt, Human adenovirus D
caagcugguga

SEQ ID NO: 1560361 - RNA, 16 nt, Human adenovirus D
gcucaggaccauaggg

SEQ ID NO: 1560362 - RNA, 17 nt, Human adenovirus D
cagaauauccccuuccu

SEQ ID NO: 1560363 - RNA, 18 nt, Human adenovirus D
cggacugccaccgccgcc

SEQ ID NO: 1560364 - RNA, 20 nt, Human adenovirus D
cauaugcuacaucugcugcc

SEQ ID NO: 1560365 - RNA, 21 nt, Human adenovirus D
cuauucucaucucgcccagca

SEQ ID NO: 1560366 - RNA, 13 nt, Human adenovirus D
aucgugcugcucu

SEQ ID NO: 1560367 - RNA, 15 nt, Human adenovirus D
aagauaucauaaaga

SEQ ID NO: 1560368 - RNA, 15 nt, Human adenovirus D
gagugucccccgccg

SEQ ID NO: 1560369 - RNA, 19 nt, Human adenovirus D
uaaugcuccaaagcuagca

SEQ ID NO: 1560370 - RNA, 15 nt, Human adenovirus D
gggaugaacaguggc

SEQ ID NO: 1560371 - RNA, 21 nt, Human adenovirus D
ugaagcccgugaccugcagca

SEQ ID NO: 1560372 - RNA, 18 nt, Human adenovirus D
cggcguaguugcgcaggc

SEQ ID NO: 1560373 - RNA, 14 nt, Human adenovirus D
caccuguggagggc

SEQ ID NO: 1560374 - RNA, 20 nt, Human adenovirus D
cgggcucuuccuccguagcc

SEQ ID NO: 1560375 - RNA, 14 nt, Human adenovirus D
cucuccgcaccgcu

SEQ ID NO: 1560376 - RNA, 12 nt, Human adenovirus D
cuugcagagcau

SEQ ID NO: 1560377 - RNA, 21 nt, Human adenovirus D
gagcaacccaaaaucgagcag

SEQ ID NO: 1560378 - RNA, 12 nt, Human adenovirus D
cggcgcggagca

SEQ ID NO: 1560379 - RNA, 15 nt, Human adenovirus D
aggagcgugccgcca

SEQ ID NO: 1560380 - RNA, 19 nt, Human adenovirus D
cagccuucagcaucagucu

SEQ ID NO: 1560381 - RNA, 20 nt, Human adenovirus D
ccucaucacaucagccagga

SEQ ID NO: 1560382 - RNA, 18 nt, Human adenovirus D
uaguugggccuccaggaa

SEQ ID NO: 1560383 - RNA, 22 nt, Human adenovirus D
caugccgaagaagaacaggagc

SEQ ID NO: 1560384 - RNA, 13 nt, Human adenovirus D
cguccgcaggcgg

SEQ ID NO: 1560385 - RNA, 22 nt, Human adenovirus D
gagcccgagggucgcuggcugc

SEQ ID NO: 1560386 - RNA, 23 nt, Human adenovirus D
uggaagagauggaagaagaaugg

SEQ ID NO: 1560387 - RNA, 13 nt, Human adenovirus D
cggccgcggccag

SEQ ID NO: 1560388 - RNA, 17 nt, Human adenovirus D
aaugcaggauccagcgc

SEQ ID NO: 1560389 - RNA, 19 nt, Human adenovirus D
agcuuguugggccuuggcc

SEQ ID NO: 1560390 - RNA, 17 nt, Human adenovirus D
agcgguugagcugggag

SEQ ID NO: 1560391 - RNA, 21 nt, Human adenovirus D
agcagcauguacggaggagcc

SEQ ID NO: 1560392 - RNA, 18 nt, Human adenovirus D
ggccgcgagaccggaggc

SEQ ID NO: 1560393 - RNA, 16 nt, Human adenovirus D
ucaucacccagcaguc

SEQ ID NO: 1560394 - RNA, 18 nt, Human adenovirus D
ccccuggcucccagccuc

SEQ ID NO: 1560395 - RNA, 17 nt, Human adenovirus D
gagucgaggucagcagc

SEQ ID NO: 1560396 - RNA, 21 nt, Human adenovirus D
guaugccaagauagcccugcg

SEQ ID NO: 1560397 - RNA, 17 nt, Human adenovirus D
ugcccugcucaccugca

SEQ ID NO: 1560398 - RNA, 17 nt, Human adenovirus D
aggaugaacaggagcac

SEQ ID NO: 1560399 - RNA, 21 nt, Human adenovirus D
ccgaggugccccagagcgagg

SEQ ID NO: 1560400 - RNA, 22 nt, Human adenovirus D
agucaaucucccaccaccagcc

SEQ ID NO: 1560401 - RNA, 13 nt, Human adenovirus D
ccggccgcgcuug

SEQ ID NO: 1560402 - RNA, 20 nt, Human adenovirus D
ggcuaccgcggcacccggua

SEQ ID NO: 1560403 - RNA, 16 nt, Human adenovirus D
ccgcgccagacgcacg

SEQ ID NO: 1560404 - RNA, 20 nt, Human adenovirus D
uaagcagaguacucauaaag

SEQ ID NO: 1560405 - RNA, 18 nt, Human adenovirus D
ugcaggcgucgcagcgcc

SEQ ID NO: 1560406 - RNA, 19 nt, Human adenovirus D
gcuagaaaacacccacagg

SEQ ID NO: 1560407 - RNA, 15 nt, Human adenovirus D
agcgaccccgagacc

SEQ ID NO: 1560408 - RNA, 14 nt, Human adenovirus D
ugcaaaaagucacu

SEQ ID NO: 1560409 - RNA, 13 nt, Human adenovirus D
gccgcaggccaac

SEQ ID NO: 1560410 - RNA, 18 nt, Human adenovirus D
cgaacuuucuccacaccu

SEQ ID NO: 1560411 - RNA, 21 nt, Human adenovirus D
uaccugggaggagaggaggau

SEQ ID NO: 1560412 - RNA, 19 nt, Human adenovirus D
cggccagcagggugccucc

SEQ ID NO: 1560413 - RNA, 20 nt, Human adenovirus D
aggaauguggaaagauucag

SEQ ID NO: 1560414 - RNA, 16 nt, Human adenovirus D
gccgaagaagaacagg

SEQ ID NO: 1560415 - RNA, 14 nt, Human adenovirus D
gccuuguagggaca

SEQ ID NO: 1560416 - RNA, 18 nt, Human adenovirus D
gccaggucaaaacccacu

SEQ ID NO: 1560417 - RNA, 22 nt, Human adenovirus D
guacuuuacgcuggccagcacg

SEQ ID NO: 1560418 - RNA, 22 nt, Human adenovirus D
cgagcuccgcgaacagcagcag

SEQ ID NO: 1560419 - RNA, 21 nt, Human adenovirus D
gauuucaucaaucaucagguu

SEQ ID NO: 1560420 - RNA, 15 nt, Human adenovirus D
gucugcucgggcaug

SEQ ID NO: 1560421 - RNA, 21 nt, Human adenovirus D
acagucugagggccacccuga

SEQ ID NO: 1560422 - RNA, 16 nt, Human adenovirus D
gcgccagacgcacggg

SEQ ID NO: 1560423 - RNA, 18 nt, Human adenovirus D
uucaacgacuaccucucg

SEQ ID NO: 1560424 - RNA, 18 nt, Human adenovirus D
gguucaagaacgagggcc

SEQ ID NO: 1560425 - RNA, 21 nt, Human adenovirus D
gagcaggggcuacauucugga

SEQ ID NO: 1560426 - RNA, 18 nt, Human adenovirus D
gcaccugcgucugcagca

SEQ ID NO: 1560427 - RNA, 21 nt, Human adenovirus D
cacacuagaaagcaguucacu

SEQ ID NO: 1560428 - RNA, 23 nt, Human adenovirus D
cgagccgccuucguacgaggagg

SEQ ID NO: 1560429 - RNA, 23 nt, Human adenovirus D
ugcagccgccgcgggucaagaac

SEQ ID NO: 1560430 - RNA, 20 nt, Human adenovirus D
agcaagggcgaccagcucug

SEQ ID NO: 1560431 - RNA, 13 nt, Human adenovirus D
gccgugcucaagc

SEQ ID NO: 1560432 - RNA, 22 nt, Human adenovirus D
ggcaacauccccgcccugcugg

SEQ ID NO: 1560433 - RNA, 16 nt, Human adenovirus D
gcaccgccacccgccg

SEQ ID NO: 1560434 - RNA, 14 nt, Human adenovirus D
uagggacagcagcc

SEQ ID NO: 1560435 - RNA, 15 nt, Human adenovirus D
cacuggagcacagac

SEQ ID NO: 1560436 - RNA, 11 nt, Human adenovirus D
gggagagcugc

SEQ ID NO: 1560437 - RNA, 20 nt, Human adenovirus D
uaagcaugagcggcuccagc

SEQ ID NO: 1560438 - RNA, 17 nt, Human adenovirus D
cggugguaggccccugu

SEQ ID NO: 1560439 - RNA, 14 nt, Human adenovirus D
ccccaaacgccagc

SEQ ID NO: 1560440 - RNA, 15 nt, Human adenovirus D
ucacccgcaguugcu

SEQ ID NO: 1560441 - RNA, 15 nt, Human adenovirus D
acgccguacgugccc

SEQ ID NO: 1560442 - RNA, 19 nt, Human adenovirus D
aaccugaaagacaguucaa

SEQ ID NO: 1560443 - RNA, 20 nt, Human adenovirus D
ggugucagaggauggucauc

SEQ ID NO: 1560444 - RNA, 19 nt, Human adenovirus D
ucagacgggugcuccgggu

SEQ ID NO: 1560445 - RNA, 17 nt, Human adenovirus D
augccuucgugcacugg

SEQ ID NO: 1560446 - RNA, 12 nt, Human adenovirus D
uucacagagagc

SEQ ID NO: 1560447 - RNA, 20 nt, Human adenovirus D
accagaugcggcaguauauc

SEQ ID NO: 1560448 - RNA, 17 nt, Human adenovirus D
gcuggaugauguccuug

SEQ ID NO: 1560449 - RNA, 20 nt, Human adenovirus D
gucaggaaaauaucaauaca

SEQ ID NO: 1560450 - RNA, 14 nt, Human adenovirus D
acauauuggaacuu

SEQ ID NO: 1560451 - RNA, 15 nt, Human adenovirus D
gacggccgcggcgag

SEQ ID NO: 1560452 - RNA, 14 nt, Human adenovirus D
acgcuguaccgcag

SEQ ID NO: 1560453 - RNA, 21 nt, Human adenovirus D
gcauguacaacaugcugacug

SEQ ID NO: 1560454 - RNA, 14 nt, Human adenovirus D
uuacucuaaaugca

SEQ ID NO: 1560455 - RNA, 15 nt, Human adenovirus D
ccgcaggcgcccagc

SEQ ID NO: 1560456 - RNA, 14 nt, Human adenovirus D
cuuucucugccaca

SEQ ID NO: 1560457 - RNA, 14 nt, Human adenovirus D
gccgccgccugcgc

SEQ ID NO: 1560458 - RNA, 14 nt, Human adenovirus D
ugcagaccgcgggc

SEQ ID NO: 1560459 - RNA, 22 nt, Human adenovirus D
uggaacccgcgcucgcgcaccu

SEQ ID NO: 1560460 - RNA, 15 nt, Human adenovirus D
gcgugcgaguuggag

SEQ ID NO: 1560461 - RNA, 18 nt, Human adenovirus D
ccacggaccggucccagc

SEQ ID NO: 1560462 - RNA, 22 nt, Human adenovirus D
uccaucagcgcccucagcaguc

SEQ ID NO: 1560463 - RNA, 16 nt, Human adenovirus D
cgaccgacccauggac

SEQ ID NO: 1560464 - RNA, 24 nt, Human adenovirus D
uacaaucgccacaggugcugccca

SEQ ID NO: 1560465 - RNA, 17 nt, Human adenovirus D
caggccgcagcucuucc

SEQ ID NO: 1560466 - RNA, 14 nt, Human adenovirus D
gcaccgcuccuggu

SEQ ID NO: 1560467 - RNA, 14 nt, Human adenovirus D
gacacugcagggag

SEQ ID NO: 1560468 - RNA, 19 nt, Human adenovirus D
ccgcgcgcgcgcacguggc

SEQ ID NO: 1560469 - RNA, 16 nt, Human adenovirus D
gcccgaccgacccaug

SEQ ID NO: 1560470 - RNA, 13 nt, Human adenovirus D
ggacuaccugcau

SEQ ID NO: 1560471 - RNA, 14 nt, Human adenovirus D
ugggcacuggagca

SEQ ID NO: 1560472 - RNA, 20 nt, Human adenovirus D
uugcacccaccaugcgccaa

SEQ ID NO: 1560473 - RNA, 17 nt, Human adenovirus D
cucggaccuggccgaga

SEQ ID NO: 1560474 - RNA, 22 nt, Human adenovirus D
acguagucguugcaggugcgca

SEQ ID NO: 1560475 - RNA, 22 nt, Human adenovirus D
acugcuaucaggagaaaauuga

SEQ ID NO: 1560476 - RNA, 12 nt, Human adenovirus D
caagcgcccaga

SEQ ID NO: 1560477 - RNA, 14 nt, Human adenovirus D
gcugcuucugccug

SEQ ID NO: 1560478 - RNA, 21 nt, Human adenovirus D
gggcguagagcuugggcgcaa

SEQ ID NO: 1560479 - RNA, 14 nt, Human adenovirus D
augccaagauagcc

SEQ ID NO: 1560480 - RNA, 17 nt, Human adenovirus D
ggcccugggccugaugc

SEQ ID NO: 1560481 - RNA, 14 nt, Human adenovirus D
cagaguaagaggag

SEQ ID NO: 1560482 - RNA, 12 nt, Human adenovirus D
ccgacacugcag

SEQ ID NO: 1560483 - RNA, 19 nt, Human adenovirus D
cacaguagucaucaaaugc

SEQ ID NO: 1560484 - RNA, 20 nt, Human adenovirus D
ugcccaaaaucuucgaaggg

SEQ ID NO: 1560485 - RNA, 22 nt, Human adenovirus D
auccuccgggacgcccuggccg

SEQ ID NO: 1560486 - RNA, 15 nt, Human adenovirus D
ucacucuuuccagca

SEQ ID NO: 1560487 - RNA, 18 nt, Human adenovirus D
cgagauggacggccaggc

SEQ ID NO: 1560488 - RNA, 17 nt, Human adenovirus D
cgcgcaugaccaccugc

SEQ ID NO: 1560489 - RNA, 17 nt, Human adenovirus D
gagcugcgcgagggccu

SEQ ID NO: 1560490 - RNA, 19 nt, Human adenovirus D
ucaggcgcaaccaggagga

SEQ ID NO: 1560491 - RNA, 16 nt, Human adenovirus D
cuaccgggacccugag

SEQ ID NO: 1560492 - RNA, 21 nt, Human adenovirus D
gcuuaaggaaucuucuuuucu

SEQ ID NO: 1560493 - RNA, 12 nt, Human adenovirus D
agaacaggagcc

SEQ ID NO: 1560494 - RNA, 20 nt, Human adenovirus D
cauaaucaccauguuauuca

SEQ ID NO: 1560495 - RNA, 18 nt, Human adenovirus D
cucgccuucggcuggaac

SEQ ID NO: 1560496 - RNA, 18 nt, Human adenovirus D
ugcaacaugaccaaggac

SEQ ID NO: 1560497 - RNA, 18 nt, Human adenovirus D
ucgccgucuacucccagc

SEQ ID NO: 1560498 - RNA, 14 nt, Human adenovirus D
ggccauaggccagg

SEQ ID NO: 1560499 - RNA, 12 nt, Human adenovirus D
gagcacagcagu

SEQ ID NO: 1560500 - RNA, 20 nt, Human adenovirus D
uccuucaacgacuaccucuc

SEQ ID NO: 1560501 - RNA, 15 nt, Human adenovirus D
cgccaagggcagccc

SEQ ID NO: 1560502 - RNA, 15 nt, Human adenovirus D
accuugaaaccccag

SEQ ID NO: 1560503 - RNA, 12 nt, Human adenovirus D
cgcuggggcaga

SEQ ID NO: 1560504 - RNA, 17 nt, Human adenovirus D
gagggcaugggucaggc

SEQ ID NO: 1560505 - RNA, 18 nt, Human adenovirus D
gugugcuggcuggucagg

SEQ ID NO: 1560506 - RNA, 21 nt, Human adenovirus D
accaguacucguacaaggcgc

SEQ ID NO: 1560507 - RNA, 18 nt, Human adenovirus D
cgcgucgcuguccacgag

SEQ ID NO: 1560508 - RNA, 16 nt, Human adenovirus D
cgagcaggaccugggc

SEQ ID NO: 1560509 - RNA, 22 nt, Human adenovirus D
ugcuauggcucauuugcaagac

SEQ ID NO: 1560510 - RNA, 17 nt, Human adenovirus D
caucuguccaaccccga

SEQ ID NO: 1560511 - RNA, 22 nt, Human adenovirus D
cgcgagggccuggaccgccagc

SEQ ID NO: 1560512 - RNA, 20 nt, Human adenovirus D
gccagguccucgagcaugag

SEQ ID NO: 1560513 - RNA, 18 nt, Human adenovirus D
gcagaccgcgggccuccu

SEQ ID NO: 1560514 - RNA, 18 nt, Human adenovirus D
ggcguuuuugaggcggcg

SEQ ID NO: 1560515 - RNA, 18 nt, Human adenovirus D
gccugggaauccugcacg

SEQ ID NO: 1560516 - RNA, 17 nt, Human adenovirus D
aaccuuuggaccugagc

SEQ ID NO: 1560517 - RNA, 23 nt, Human adenovirus D
cucaggcgcaaccaggaggagcu

SEQ ID NO: 1560518 - RNA, 17 nt, Human adenovirus D
caggagcaggaggagga

SEQ ID NO: 1560519 - RNA, 16 nt, Human adenovirus D
cccaacucgcggcugc

SEQ ID NO: 1560520 - RNA, 13 nt, Human adenovirus D
gccgccugcgcug

SEQ ID NO: 1560521 - RNA, 13 nt, Human adenovirus D
gccugaugcagga

SEQ ID NO: 1560522 - RNA, 12 nt, Human adenovirus D
uucagcagcacc

SEQ ID NO: 1560523 - RNA, 15 nt, Human adenovirus D
ggacagcagcccuuc

SEQ ID NO: 1560524 - RNA, 18 nt, Human adenovirus D
augcccuuuucccaggac

SEQ ID NO: 1560525 - RNA, 23 nt, Human adenovirus D
accugaacgacucgcugcugcag

SEQ ID NO: 1560526 - RNA, 19 nt, Human adenovirus D
uugucgcugaucugauccu

SEQ ID NO: 1560527 - RNA, 17 nt, Human adenovirus D
ccgggacgcccuggccg

SEQ ID NO: 1560528 - RNA, 17 nt, Human adenovirus D
gccccaggcggugcugc

SEQ ID NO: 1560529 - RNA, 15 nt, Human adenovirus D
accacaccuucaaga

SEQ ID NO: 1560530 - RNA, 23 nt, Human adenovirus D
aguccccucgaaucaggcuggag

SEQ ID NO: 1560531 - RNA, 13 nt, Human adenovirus D
caugacccugcau

SEQ ID NO: 1560532 - RNA, 20 nt, Human adenovirus D
cagguuacauuccugcacca

SEQ ID NO: 1560533 - RNA, 16 nt, Human adenovirus D
aagaaguaugccaaga

SEQ ID NO: 1560534 - RNA, 22 nt, Human adenovirus D
uccugcacuuucuuugccauca

SEQ ID NO: 1560535 - RNA, 22 nt, Human adenovirus D
ccaugagucuguguccgcgcuc

SEQ ID NO: 1560536 - RNA, 22 nt, Human adenovirus D
agacaucauaauuaugcuccug

SEQ ID NO: 1560537 - RNA, 19 nt, Human adenovirus D
aggacgguguagcccgugc

SEQ ID NO: 1560538 - RNA, 17 nt, Human adenovirus D
ggcgccauucggagcac

SEQ ID NO: 1560539 - RNA, 19 nt, Human adenovirus D
cauaugcuacaucugcugc

SEQ ID NO: 1560540 - RNA, 22 nt, Human adenovirus D
ccggcgcuagccagccacagcc

SEQ ID NO: 1560541 - RNA, 17 nt, Human adenovirus D
cagacggugaagcagga

SEQ ID NO: 1560542 - RNA, 16 nt, Human adenovirus D
cgcgggaagagcccuu

SEQ ID NO: 1560543 - RNA, 23 nt, Human adenovirus D
gugcagggaugaguugggccuga

SEQ ID NO: 1560544 - RNA, 19 nt, Human adenovirus D
cucaucacaucagccagga

SEQ ID NO: 1560545 - RNA, 13 nt, Human adenovirus D
ggugcgcuggggc

SEQ ID NO: 1560546 - RNA, 18 nt, Human adenovirus D
ggaccaggcggcagagcg

SEQ ID NO: 1560547 - RNA, 17 nt, Human adenovirus D
gcgcgccgcgccgccac

SEQ ID NO: 1560548 - RNA, 21 nt, Human adenovirus D
cagugaaaacgugccugcucu

SEQ ID NO: 1560549 - RNA, 21 nt, Human adenovirus D
cugcaacgccuuccccuccga

SEQ ID NO: 1560550 - RNA, 15 nt, Human adenovirus D
ccggagcgacacccc

SEQ ID NO: 1560551 - RNA, 11 nt, Human adenovirus D
gcugguugaac

SEQ ID NO: 1560552 - RNA, 13 nt, Human adenovirus D
cgcgugguagccc

SEQ ID NO: 1560553 - RNA, 14 nt, Human adenovirus D
cuggccgagcugga

SEQ ID NO: 1560554 - RNA, 22 nt, Human adenovirus D
gcacgcggccguucaugggcac

SEQ ID NO: 1560555 - RNA, 20 nt, Human adenovirus D
aucgugcgcgaccugggcug

SEQ ID NO: 1560556 - RNA, 20 nt, Human adenovirus D
cgccgcgcuggggagggcca

SEQ ID NO: 1560557 - RNA, 14 nt, Human adenovirus D
agacagccagguca

SEQ ID NO: 1560558 - RNA, 16 nt, Human adenovirus D
ucuacgccaccuucuu

SEQ ID NO: 1560559 - RNA, 17 nt, Human adenovirus D
aucaaaacgaccacagc

SEQ ID NO: 1560560 - RNA, 18 nt, Human adenovirus D
cccaaaaucgagcaggac

SEQ ID NO: 1560561 - RNA, 14 nt, Human adenovirus D
caccuuccugcagc

SEQ ID NO: 1560562 - RNA, 15 nt, Human adenovirus D
ccccgcgugcagcug

SEQ ID NO: 1560563 - RNA, 16 nt, Human adenovirus D
ggccaaccuguggaag

SEQ ID NO: 1560564 - RNA, 15 nt, Human adenovirus D
caugcgccaagggca

SEQ ID NO: 1560565 - RNA, 15 nt, Human adenovirus D
gacauggccagcacg

SEQ ID NO: 1560566 - RNA, 17 nt, Human adenovirus D
auggacgggaaccccac

SEQ ID NO: 1560567 - RNA, 18 nt, Human adenovirus D
gcuccucgaggacggaga

SEQ ID NO: 1560568 - RNA, 11 nt, Human adenovirus D
cagagccaggg

SEQ ID NO: 1560569 - RNA, 21 nt, Human adenovirus D
aggccuacuacuccugaucag

SEQ ID NO: 1560570 - RNA, 20 nt, Human adenovirus D
cugcgucaucacccagggcg

SEQ ID NO: 1560571 - RNA, 18 nt, Human adenovirus D
gacagaggcaacagcaaa

SEQ ID NO: 1560572 - RNA, 18 nt, Human adenovirus D
cacgggguugcagcacug

SEQ ID NO: 1560573 - RNA, 17 nt, Human adenovirus D
gcgccgcccgagcucug

SEQ ID NO: 1560574 - RNA, 17 nt, Human adenovirus D
cgcaccgcuccuggucu

SEQ ID NO: 1560575 - RNA, 14 nt, Human adenovirus D
ugugauaugcacag

SEQ ID NO: 1560576 - RNA, 20 nt, Human adenovirus D
caagucaaaagaaaacuaau

SEQ ID NO: 1560577 - RNA, 23 nt, Human adenovirus D
aggaggauuugauguuggcuugc

SEQ ID NO: 1560578 - RNA, 23 nt, Human adenovirus D
ggcgcagcuguuccuggugguac

SEQ ID NO: 1560579 - RNA, 14 nt, Human adenovirus D
aucgcgcaggaggc

SEQ ID NO: 1560580 - RNA, 15 nt, Human adenovirus D
gugguaguucaagga

SEQ ID NO: 1560581 - RNA, 23 nt, Human adenovirus D
cgccacaggugcugcccacccuc

SEQ ID NO: 1560582 - RNA, 19 nt, Human adenovirus D
acugaaggaaaaaucacuc

SEQ ID NO: 1560583 - RNA, 15 nt, Human adenovirus D
cgcgccacuggccac

SEQ ID NO: 1560584 - RNA, 20 nt, Human adenovirus D
ggccugggcucgcugguggc

SEQ ID NO: 1560585 - RNA, 19 nt, Human adenovirus D
agaugaggcgugcgguggu

SEQ ID NO: 1560586 - RNA, 21 nt, Human adenovirus D
aucgcgggcuuuguaacucua

SEQ ID NO: 1560587 - RNA, 14 nt, Human adenovirus D
gaggcgugcacugg

SEQ ID NO: 1560588 - RNA, 19 nt, Human adenovirus D
cagcagcaaaauaaaugau

SEQ ID NO: 1560589 - RNA, 12 nt, Human adenovirus D
cgcccugcugga

SEQ ID NO: 1560590 - RNA, 19 nt, Human adenovirus D
cugagcaaccuccugggca

SEQ ID NO: 1560591 - RNA, 21 nt, Human adenovirus D
acauucuggacuucgcagcca

SEQ ID NO: 1560592 - RNA, 19 nt, Human adenovirus D
gucagcaacuaccccgugg

SEQ ID NO: 1560593 - RNA, 17 nt, Human adenovirus D
accugcagcgccagucc

SEQ ID NO: 1560594 - RNA, 20 nt, Human adenovirus D
auugcaggccgugcugcucg

SEQ ID NO: 1560595 - RNA, 15 nt, Human adenovirus D
ggccauucuggaggc

SEQ ID NO: 1560596 - RNA, 13 nt, Human adenovirus D
aaagccagcagca

SEQ ID NO: 1560597 - RNA, 15 nt, Human adenovirus D
gucugcaacccccag

SEQ ID NO: 1560598 - RNA, 14 nt, Human adenovirus D
ugaccaccagggag

SEQ ID NO: 1560599 - RNA, 17 nt, Human adenovirus D
aggccauaaaucugccc

SEQ ID NO: 1560600 - RNA, 20 nt, Human adenovirus D
cggccaauguuacgcugccc

SEQ ID NO: 1560601 - RNA, 13 nt, Human adenovirus D
cuggcugcuggag

SEQ ID NO: 1560602 - RNA, 17 nt, Human adenovirus D
gccgcguaagcaggagc

SEQ ID NO: 1560603 - RNA, 18 nt, Human adenovirus D
accugaaggagcuggaca

SEQ ID NO: 1560604 - RNA, 17 nt, Human adenovirus D
gaagggcaucuucugcc

SEQ ID NO: 1560605 - RNA, 16 nt, Human adenovirus D
accggcagcggggccu

SEQ ID NO: 1560606 - RNA, 16 nt, Human adenovirus D
cgagaaccgccugggg

SEQ ID NO: 1560607 - RNA, 19 nt, Human adenovirus D
acgcugaaaggcgggcugc

SEQ ID NO: 1560608 - RNA, 16 nt, Human adenovirus D
cacuugccgccugcgc

SEQ ID NO: 1560609 - RNA, 21 nt, Human adenovirus D
guacccgaggacuaccacgcc

SEQ ID NO: 1560610 - RNA, 18 nt, Human adenovirus D
cggggaaggucucgcucc

SEQ ID NO: 1560611 - RNA, 17 nt, Human adenovirus D
cucgacgagccagguga

SEQ ID NO: 1560612 - RNA, 21 nt, Human adenovirus D
uacgccaacucggcccacgcg

SEQ ID NO: 1560613 - RNA, 16 nt, Human adenovirus D
gccagcacgcucuugu

SEQ ID NO: 1560614 - RNA, 18 nt, Human adenovirus D
cgaggaggauuugauguu

SEQ ID NO: 1560615 - RNA, 17 nt, Human adenovirus D
ggccugaaccgccgccg

SEQ ID NO: 1560616 - RNA, 16 nt, Human adenovirus D
gaucucugccauguuc

SEQ ID NO: 1560617 - RNA, 23 nt, Human adenovirus D
ggagguagcaccacugcauggcc

SEQ ID NO: 1560618 - RNA, 20 nt, Human adenovirus D
gccaacauuacuucuggcac

SEQ ID NO: 1560619 - RNA, 16 nt, Human adenovirus D
accuacgaguacauga

SEQ ID NO: 1560620 - RNA, 12 nt, Human adenovirus D
acagacagccag

SEQ ID NO: 1560621 - RNA, 15 nt, Human adenovirus D
cuaucuaugaaagca

SEQ ID NO: 1560622 - RNA, 13 nt, Human adenovirus D
aacgagggccugg

SEQ ID NO: 1560623 - RNA, 23 nt, Human adenovirus D
ggaucgacgguggacgggcgccc

SEQ ID NO: 1560624 - RNA, 14 nt, Human adenovirus D
ccgccaaggagcuc

SEQ ID NO: 1560625 - RNA, 13 nt, Human adenovirus D
cgcuggggcagaa

SEQ ID NO: 1560626 - RNA, 18 nt, Human adenovirus D
gcccugcucaccugcacc

SEQ ID NO: 1560627 - RNA, 21 nt, Human adenovirus D
augagcucguaguugagggcc

SEQ ID NO: 1560628 - RNA, 19 nt, Human adenovirus D
ccucgucauccuuccagua

SEQ ID NO: 1560629 - RNA, 21 nt, Human adenovirus D
gcuucgcccgggagagcugcg

SEQ ID NO: 1560630 - RNA, 17 nt, Human adenovirus D
gcucgaaaucggugcgc

SEQ ID NO: 1560631 - RNA, 15 nt, Human adenovirus D
ccuucaccgaccugg

SEQ ID NO: 1560632 - RNA, 13 nt, Human adenovirus D
ugauaaagcgugg

SEQ ID NO: 1560633 - RNA, 17 nt, Human adenovirus D
ccgccaaggagcuccuc

SEQ ID NO: 1560634 - RNA, 15 nt, Human adenovirus D
gugggccccuggcug

SEQ ID NO: 1560635 - RNA, 14 nt, Human adenovirus D
gcgucgagcacagc

SEQ ID NO: 1560636 - RNA, 13 nt, Human adenovirus D
cccaggcggugcu

SEQ ID NO: 1560637 - RNA, 17 nt, Human adenovirus D
caggucgucgccccgga

SEQ ID NO: 1560638 - RNA, 15 nt, Human adenovirus D
agacguuucuggggu

SEQ ID NO: 1560639 - RNA, 12 nt, Human adenovirus D
cggcgaccaccg

SEQ ID NO: 1560640 - RNA, 19 nt, Human adenovirus D
uggaacgagaucggcacca

SEQ ID NO: 1560641 - RNA, 18 nt, Human adenovirus D
gaccagaccaccugguga

SEQ ID NO: 1560642 - RNA, 14 nt, Human adenovirus D
accgagccucccag

SEQ ID NO: 1560643 - RNA, 15 nt, Human adenovirus D
ggggaacggggcaga

SEQ ID NO: 1560644 - RNA, 15 nt, Human adenovirus D
gcagcaccucgguac

SEQ ID NO: 1560645 - RNA, 18 nt, Human adenovirus D
cuccggaccuaugggaac

SEQ ID NO: 1560646 - RNA, 23 nt, Human adenovirus D
caguacuuagaagagcccccucc

SEQ ID NO: 1560647 - RNA, 19 nt, Human adenovirus D
gaggagacugauggccacg

SEQ ID NO: 1560648 - RNA, 13 nt, Human adenovirus D
agugaccaagacc

SEQ ID NO: 1560649 - RNA, 17 nt, Human adenovirus D
gaauaacaugcugauca

SEQ ID NO: 1560650 - RNA, 22 nt, Human adenovirus D
ccaggaaacuaggcgcagcugc

SEQ ID NO: 1560651 - RNA, 18 nt, Human adenovirus D
ugcgcguccgucagcagc

SEQ ID NO: 1560652 - RNA, 14 nt, Human adenovirus D
gaaacaagucaaaa

SEQ ID NO: 1560653 - RNA, 22 nt, Human adenovirus D
cugcucucucuucuuguaacuu

SEQ ID NO: 1560654 - RNA, 12 nt, Human adenovirus D
cgcggcugcugc

SEQ ID NO: 1560655 - RNA, 18 nt, Human adenovirus D
gagcgcgagccggcggcg

SEQ ID NO: 1560656 - RNA, 22 nt, Human adenovirus D
ccagcagucgggcgagaccaac

SEQ ID NO: 1560657 - RNA, 13 nt, Human adenovirus D
guuuauguugauc

SEQ ID NO: 1560658 - RNA, 15 nt, Human adenovirus D
cgauguaacaucacc

SEQ ID NO: 1560659 - RNA, 19 nt, Human adenovirus D
ugccccacaucgaggcccu

SEQ ID NO: 1560660 - RNA, 23 nt, Human adenovirus D
cagcucaucgacuggugcugcgc

SEQ ID NO: 1560661 - RNA, 20 nt, Human adenovirus D
gguuagguucuucacccagc

SEQ ID NO: 1560662 - RNA, 18 nt, Human adenovirus D
cgcgcuugcugggcgagg

SEQ ID NO: 1560663 - RNA, 23 nt, Human adenovirus D
cucuagcaugaccagacccaggc

SEQ ID NO: 1560664 - RNA, 15 nt, Human adenovirus D
gcaggcgcuggaaga

SEQ ID NO: 1560665 - RNA, 17 nt, Human adenovirus D
cccucucgagagcgggc

SEQ ID NO: 1560666 - RNA, 13 nt, Human adenovirus D
gcagccgccgcgg

SEQ ID NO: 1560667 - RNA, 22 nt, Human adenovirus D
gccgcggccagaugcggaggag

SEQ ID NO: 1560668 - RNA, 19 nt, Human adenovirus D
ugucgccgauggccuccag

SEQ ID NO: 1560669 - RNA, 18 nt, Human adenovirus D
cagccgugaucccacagg

SEQ ID NO: 1560670 - RNA, 15 nt, Human adenovirus D
ccuggcuccgcggca

SEQ ID NO: 1560671 - RNA, 16 nt, Human adenovirus D
caugggugugcuggcu

SEQ ID NO: 1560672 - RNA, 16 nt, Human adenovirus D
ggcuuccgccgccggg

SEQ ID NO: 1560673 - RNA, 21 nt, Human adenovirus D
acugccgcugcaaccugugcu

SEQ ID NO: 1560674 - RNA, 20 nt, Human adenovirus D
uccacaaacuacauggacaa

SEQ ID NO: 1560675 - RNA, 21 nt, Human adenovirus D
gaaacacagauuugaauugca

SEQ ID NO: 1560676 - RNA, 13 nt, Human adenovirus D
cagcagcaggagc

SEQ ID NO: 1560677 - RNA, 12 nt, Human adenovirus D
caaguggaugga

SEQ ID NO: 1560678 - RNA, 19 nt, Human adenovirus D
gucccuucucggaccaacc

SEQ ID NO: 1560679 - RNA, 22 nt, Human adenovirus D
aguugcaccacgcuucuucccc

SEQ ID NO: 1560680 - RNA, 17 nt, Human adenovirus D
cccaggcggaccagaaa

SEQ ID NO: 1560681 - RNA, 18 nt, Human adenovirus D
cggccaaucagcaguagc

SEQ ID NO: 1560682 - RNA, 18 nt, Human adenovirus D
caguggggaggacacaga

SEQ ID NO: 1560683 - RNA, 14 nt, Human adenovirus D
ggccaaucagcagu

SEQ ID NO: 1560684 - RNA, 17 nt, Human adenovirus D
gcccgagcucugcugcg

SEQ ID NO: 1560685 - RNA, 15 nt, Human adenovirus D
uccucuucugucucu

SEQ ID NO: 1560686 - RNA, 18 nt, Human adenovirus D
agacggugaagcaggagc

SEQ ID NO: 1560687 - RNA, 21 nt, Human adenovirus D
gggagcugcgcgagggccugg

SEQ ID NO: 1560688 - RNA, 15 nt, Human adenovirus D
augcaaaaucuuaca

SEQ ID NO: 1560689 - RNA, 22 nt, Human adenovirus D
acgagagcgugauggcgcaggc

SEQ ID NO: 1560690 - RNA, 12 nt, Human adenovirus D
ggcgacccagga

SEQ ID NO: 1560691 - RNA, 16 nt, Human adenovirus D
uaggggacgugagcgc

SEQ ID NO: 1560692 - RNA, 22 nt, Human adenovirus D
ccgccacccuugaccugccucc

SEQ ID NO: 1560693 - RNA, 15 nt, Human adenovirus D
aucaacauaggcgcc

SEQ ID NO: 1560694 - RNA, 19 nt, Human adenovirus D
ggccgagaccgugagcucg

SEQ ID NO: 1560695 - RNA, 23 nt, Human adenovirus D
aaaaucacucuuuccagcagcag

SEQ ID NO: 1560696 - RNA, 16 nt, Human adenovirus D
ugccacucgcgggcgg

SEQ ID NO: 1560697 - RNA, 17 nt, Human adenovirus D
agaucauggugcccaag

SEQ ID NO: 1560698 - RNA, 18 nt, Human adenovirus D
ggcggacugccaccgccg

SEQ ID NO: 1560699 - RNA, 14 nt, Human adenovirus D
ugaucaaaacuuaa

SEQ ID NO: 1560700 - RNA, 14 nt, Human adenovirus D
cgccgccgccgcac

SEQ ID NO: 1560701 - RNA, 19 nt, Human adenovirus D
cccgcccgcgugcgccgcg

SEQ ID NO: 1560702 - RNA, 15 nt, Human adenovirus D
guuacgcugcccgcc

SEQ ID NO: 1560703 - RNA, 20 nt, Human adenovirus D
cucgaagacgccgaggcucu

SEQ ID NO: 1560704 - RNA, 19 nt, Human adenovirus D
acauuaugauaaucugcau

SEQ ID NO: 1560705 - RNA, 14 nt, Human adenovirus D
gugcgaggggccaa

SEQ ID NO: 1560706 - RNA, 22 nt, Human adenovirus D
aacgagaucggcaccagccagc

SEQ ID NO: 1560707 - RNA, 17 nt, Human adenovirus D
ugaggauugggaggagg

SEQ ID NO: 1560708 - RNA, 21 nt, Human adenovirus D
acucgacccugaagggcgagg

SEQ ID NO: 1560709 - RNA, 19 nt, Human adenovirus D
caacucgcggcugcugcug

SEQ ID NO: 1560710 - RNA, 16 nt, Human adenovirus D
accucccaccccagaa

SEQ ID NO: 1560711 - RNA, 14 nt, Human adenovirus D
ccccagacacccac

SEQ ID NO: 1560712 - RNA, 17 nt, Human adenovirus D
ccaugcagacucugcuc

SEQ ID NO: 1560713 - RNA, 23 nt, Human adenovirus D
uagaaacagauccugcugcucca

SEQ ID NO: 1560714 - RNA, 19 nt, Human adenovirus D
cugggcguugcgggccgag

SEQ ID NO: 1560715 - RNA, 18 nt, Human adenovirus D
gcgagaccggaggcgugc

SEQ ID NO: 1560716 - RNA, 19 nt, Human adenovirus D
aggggugggccccuggcug

SEQ ID NO: 1560717 - RNA, 17 nt, Human adenovirus D
caaggacuacaaggccg

SEQ ID NO: 1560718 - RNA, 20 nt, Human adenovirus D
ccuggaucugccgccucugc

SEQ ID NO: 1560719 - RNA, 19 nt, Human adenovirus D
ggccgugagcgcgagccgg

SEQ ID NO: 1560720 - RNA, 12 nt, Human adenovirus D
cgucggaagagg

SEQ ID NO: 1560721 - RNA, 15 nt, Human adenovirus D
ggcggcagaggcacg

SEQ ID NO: 1560722 - RNA, 23 nt, Human adenovirus D
agcaugcgcuaaacuaagguggc

SEQ ID NO: 1560723 - RNA, 13 nt, Human adenovirus D
aggcacugcucuu

SEQ ID NO: 1560724 - RNA, 14 nt, Human adenovirus D
aggguaaagccagc

SEQ ID NO: 1560725 - RNA, 14 nt, Human adenovirus D
cucgcucuggggcc

SEQ ID NO: 1560726 - RNA, 22 nt, Human adenovirus D
agccggccgcgcuugcugggcg

SEQ ID NO: 1560727 - RNA, 22 nt, Human adenovirus D
cuccugaaccacacggccagca

SEQ ID NO: 1560728 - RNA, 16 nt, Human adenovirus D
gugcgaguuggaggag

SEQ ID NO: 1560729 - RNA, 21 nt, Human adenovirus D
uacggcaucucgauccagcag

SEQ ID NO: 1560730 - RNA, 16 nt, Human adenovirus D
ccccgcgccgcgcugc

SEQ ID NO: 1560731 - RNA, 14 nt, Human adenovirus D
cauccugaucucug

SEQ ID NO: 1560732 - RNA, 16 nt, Human adenovirus D
cgaacacgccaccgcu

SEQ ID NO: 1560733 - RNA, 12 nt, Human adenovirus D
cucgcugcugca

SEQ ID NO: 1560734 - RNA, 13 nt, Human adenovirus D
uggugcuggauga

SEQ ID NO: 1560735 - RNA, 17 nt, Human adenovirus D
uaaagccacaaccagag

SEQ ID NO: 1560736 - RNA, 14 nt, Human adenovirus D
aggguugaaagauu

SEQ ID NO: 1560737 - RNA, 23 nt, Human adenovirus D
aguuugcauagcuugccgggcuc

SEQ ID NO: 1560738 - RNA, 17 nt, Human adenovirus D
cagggugccucccgccc

SEQ ID NO: 1560739 - RNA, 16 nt, Human adenovirus D
uguagggacagcagcc

SEQ ID NO: 1560740 - RNA, 13 nt, Human adenovirus D
aaaaagucacuua

SEQ ID NO: 1560741 - RNA, 15 nt, Human adenovirus D
cagcgcggccagcgu

SEQ ID NO: 1560742 - RNA, 19 nt, Human adenovirus D
gcgcuggggcugcucggcg

SEQ ID NO: 1560743 - RNA, 15 nt, Human adenovirus D
cccgcgcccaccauc

SEQ ID NO: 1560744 - RNA, 15 nt, Human adenovirus D
gccuggggcagacag

SEQ ID NO: 1560745 - RNA, 19 nt, Human adenovirus D
cgcggccagcgucaugucc

SEQ ID NO: 1560746 - RNA, 12 nt, Human adenovirus D
uggaagaagaau

SEQ ID NO: 1560747 - RNA, 19 nt, Human adenovirus D
cacgugaccaggggucccc

SEQ ID NO: 1560748 - RNA, 13 nt, Human adenovirus D
cccacggccaucu

SEQ ID NO: 1560749 - RNA, 18 nt, Human adenovirus D
ucuacgcguacauccagc

SEQ ID NO: 1560750 - RNA, 13 nt, Human adenovirus D
cuggguggcccuu

SEQ ID NO: 1560751 - RNA, 15 nt, Human adenovirus D
cagguccgggggcag

SEQ ID NO: 1560752 - RNA, 19 nt, Human adenovirus D
ccaacaauaaaagaccaau

SEQ ID NO: 1560753 - RNA, 14 nt, Human adenovirus D
gcgcaaccaggagg

SEQ ID NO: 1560754 - RNA, 14 nt, Human adenovirus D
cacaucggacuggg

SEQ ID NO: 1560755 - RNA, 20 nt, Human adenovirus D
aauaugggagagaacaaaac

SEQ ID NO: 1560756 - RNA, 13 nt, Human adenovirus D
acaguacuggcaa

SEQ ID NO: 1560757 - RNA, 15 nt, Human adenovirus D
ggaccgcagcgggga

SEQ ID NO: 1560758 - RNA, 15 nt, Human adenovirus D
gcuaccucuugcagc

SEQ ID NO: 1560759 - RNA, 15 nt, Human adenovirus D
gcuucuacagccagc

SEQ ID NO: 1560760 - RNA, 16 nt, Human adenovirus D
cugacaauucagagcc

SEQ ID NO: 1560761 - RNA, 15 nt, Human adenovirus D
agguguaggccacgu

SEQ ID NO: 1560762 - RNA, 22 nt, Human adenovirus D
gacgggugcuccggguucugga

SEQ ID NO: 1560763 - RNA, 14 nt, Human adenovirus D
gggcugggacccug

SEQ ID NO: 1560764 - RNA, 22 nt, Human adenovirus D
cgcgcuggcuugguacccgcga

SEQ ID NO: 1560765 - RNA, 18 nt, Human adenovirus D
ggcgugcacuggcucgcc

SEQ ID NO: 1560766 - RNA, 13 nt, Human adenovirus D
agaccuucaaccu

SEQ ID NO: 1560767 - RNA, 23 nt, Human adenovirus D
aguggcaaugcaggauccagcgc

SEQ ID NO: 1560768 - RNA, 21 nt, Human adenovirus D
ugaccagguccacgcuggugg

SEQ ID NO: 1560769 - RNA, 22 nt, Human adenovirus D
augagcccguagcugcgcgggg

SEQ ID NO: 1560770 - RNA, 19 nt, Human adenovirus D
gacgagccaggugagcucg

SEQ ID NO: 1560771 - RNA, 17 nt, Human adenovirus D
aucuccuccuccuggag

SEQ ID NO: 1560772 - RNA, 13 nt, Human adenovirus D
agccgcaggcgcc

SEQ ID NO: 1560773 - RNA, 14 nt, Human adenovirus D
gacaccacagugca

SEQ ID NO: 1560774 - RNA, 23 nt, Human adenovirus D
ccaggaugcagccaguggcccug

SEQ ID NO: 1560775 - RNA, 15 nt, Human adenovirus D
cgaccuccuccccau

SEQ ID NO: 1560776 - RNA, 12 nt, Human adenovirus D
ccgccuggggca

SEQ ID NO: 1560777 - RNA, 23 nt, Human adenovirus D
ggcaacaccugggcacuggagca

SEQ ID NO: 1560778 - RNA, 24 nt, Human adenovirus D
agcagcaccucgguacccuccucc

SEQ ID NO: 1560779 - RNA, 19 nt, Human adenovirus D
aguucgcuccgcggcggcg

SEQ ID NO: 1560780 - RNA, 15 nt, Human adenovirus D
gaucgcgaggacacc

SEQ ID NO: 1560781 - RNA, 19 nt, Human adenovirus D
gggcucguuaguccagcag

SEQ ID NO: 1560782 - RNA, 22 nt, Human adenovirus D
cgcaggaguccaccgcuccgcu

SEQ ID NO: 1560783 - RNA, 17 nt, Human adenovirus D
agggcuuuuccugaugc

SEQ ID NO: 1560784 - RNA, 15 nt, Human adenovirus D
ugcagggagccaggg

SEQ ID NO: 1560785 - RNA, 21 nt, Human adenovirus D
accaugaaggcuuucacagcu

SEQ ID NO: 1560786 - RNA, 15 nt, Human adenovirus D
ggaugugcccaagua

SEQ ID NO: 1560787 - RNA, 17 nt, Human adenovirus D
cugaugaacaacgccau

SEQ ID NO: 1560788 - RNA, 15 nt, Human adenovirus D
agacaccacagugca

SEQ ID NO: 1560789 - RNA, 18 nt, Human adenovirus D
gccccacaucgaggcccu

SEQ ID NO: 1560790 - RNA, 20 nt, Human adenovirus D
augaggagaaggaaaaauug

SEQ ID NO: 1560791 - RNA, 20 nt, Human adenovirus D
cuucagcaucagucuccugg

SEQ ID NO: 1560792 - RNA, 17 nt, Human adenovirus D
ugcagggaagcaaaguu

SEQ ID NO: 1560793 - RNA, 17 nt, Human adenovirus D
agcaauccuccaggacu

SEQ ID NO: 1560794 - RNA, 17 nt, Human adenovirus D
ccucaaugucagcugca

SEQ ID NO: 1560795 - RNA, 15 nt, Human adenovirus D
cuccucucgugcucc

SEQ ID NO: 1560796 - RNA, 19 nt, Human adenovirus D
cuacccacugacuuagcuc

SEQ ID NO: 1560797 - RNA, 18 nt, Human adenovirus D
cacgccaccacccacacc

SEQ ID NO: 1560798 - RNA, 14 nt, Human adenovirus D
ugggacgacgugga

SEQ ID NO: 1560799 - RNA, 18 nt, Human adenovirus D
cucucgaagacgccgagg

SEQ ID NO: 1560800 - RNA, 20 nt, Human adenovirus D
caggaaacuaggcgcagcug

SEQ ID NO: 1560801 - RNA, 13 nt, Human adenovirus D
ugacaaucaaaac

SEQ ID NO: 1560802 - RNA, 12 nt, Human adenovirus D
ugaucucugcca

SEQ ID NO: 1560803 - RNA, 15 nt, Human adenovirus D
acagcaagccucuga

SEQ ID NO: 1560804 - RNA, 15 nt, Human adenovirus D
cugagcaaccuccug

SEQ ID NO: 1560805 - RNA, 14 nt, Human adenovirus D
augccccaggccug

SEQ ID NO: 1560806 - RNA, 16 nt, Human adenovirus D
gcuggcccacggccau

SEQ ID NO: 1560807 - RNA, 14 nt, Human adenovirus D
auugauaaggagaa

SEQ ID NO: 1560808 - RNA, 19 nt, Human adenovirus D
gccgcgcuugcugggcgag

SEQ ID NO: 1560809 - RNA, 12 nt, Human adenovirus D
cccuggcuccgc

SEQ ID NO: 1560810 - RNA, 14 nt, Human adenovirus D
ccccgcaggcagga

SEQ ID NO: 1560811 - RNA, 19 nt, Human adenovirus D
cuggagcgcguaggccgcu

SEQ ID NO: 1560812 - RNA, 18 nt, Human adenovirus D
ugcuggcuggucaggccu

SEQ ID NO: 1560813 - RNA, 17 nt, Human adenovirus D
cucccacaaucacggca

SEQ ID NO: 1560814 - RNA, 18 nt, Human adenovirus D
gccuucuauggaggcaga

SEQ ID NO: 1560815 - RNA, 18 nt, Human adenovirus D
gccagcugaacgggggcg

SEQ ID NO: 1560816 - RNA, 20 nt, Human adenovirus D
agcacugcaaauuuaacuuc

SEQ ID NO: 1560817 - RNA, 17 nt, Human adenovirus D
cguccuuucgcugcugc

SEQ ID NO: 1560818 - RNA, 16 nt, Human adenovirus D
gcagagcacgcugcac

SEQ ID NO: 1560819 - RNA, 15 nt, Human adenovirus D
cuuuuccgagaccau

SEQ ID NO: 1560820 - RNA, 20 nt, Human adenovirus D
ugcaacccccagcuccugag

SEQ ID NO: 1560821 - RNA, 15 nt, Human adenovirus D
agggcgaggcgcggc

SEQ ID NO: 1560822 - RNA, 21 nt, Human adenovirus D
agacuaagcuaguacucuaca

SEQ ID NO: 1560823 - RNA, 22 nt, Human adenovirus D
ccugcuggagcgcguaggccgc

SEQ ID NO: 1560824 - RNA, 16 nt, Human adenovirus D
uucgcagaaccaugaa

SEQ ID NO: 1560825 - RNA, 16 nt, Human adenovirus D
gcccgccaccugcaac

SEQ ID NO: 1560826 - RNA, 15 nt, Human adenovirus D
cuuucauccaucugg

SEQ ID NO: 1560827 - RNA, 18 nt, Human adenovirus D
cuccaugcuucugggcaa

SEQ ID NO: 1560828 - RNA, 16 nt, Human adenovirus D
gcuuccguugcgcugc

SEQ ID NO: 1560829 - RNA, 18 nt, Human adenovirus D
ucaucguugugcgccgcg

SEQ ID NO: 1560830 - RNA, 12 nt, Human adenovirus D
gugcgguggugu

SEQ ID NO: 1560831 - RNA, 22 nt, Human adenovirus D
ccagucccuuuuccaggaaagg

SEQ ID NO: 1560832 - RNA, 13 nt, Human adenovirus D
ucaaacaggcaaa

SEQ ID NO: 1560833 - RNA, 17 nt, Human adenovirus D
cgcagaaaucaguuucc

SEQ ID NO: 1560834 - RNA, 13 nt, Human adenovirus D
ugaaccuuuggac

SEQ ID NO: 1560835 - RNA, 15 nt, Human adenovirus D
aggcacacagcucaa

SEQ ID NO: 1560836 - RNA, 13 nt, Human adenovirus D
guagucuggagaa

SEQ ID NO: 1560837 - RNA, 17 nt, Human adenovirus D
cagccuugcccccaagg

SEQ ID NO: 1560838 - RNA, 13 nt, Human adenovirus D
ccugaugcaggag

SEQ ID NO: 1560839 - RNA, 18 nt, Human adenovirus D
ccacaccugugacaugca

SEQ ID NO: 1560840 - RNA, 19 nt, Human adenovirus D
ucuggagaaguuccucugc

SEQ ID NO: 1560841 - RNA, 13 nt, Human adenovirus D
cugauaagacaca

SEQ ID NO: 1560842 - RNA, 22 nt, Human adenovirus D
gccggcgcgcccggggccaggu

SEQ ID NO: 1560843 - RNA, 20 nt, Human adenovirus D
gucucgaggacgagaaccug

SEQ ID NO: 1560844 - RNA, 17 nt, Human adenovirus D
aggagucgccggaggag

SEQ ID NO: 1560845 - RNA, 15 nt, Human adenovirus D
cuaaucaagacaaaa

SEQ ID NO: 1560846 - RNA, 17 nt, Human adenovirus D
ucaaguuugacagcaga

SEQ ID NO: 1560847 - RNA, 13 nt, Human adenovirus D
gagggccuggacc

SEQ ID NO: 1560848 - RNA, 18 nt, Human adenovirus D
cgugcugcgcgacgagga

SEQ ID NO: 1560849 - RNA, 12 nt, Human adenovirus D
cgcccugggugu

SEQ ID NO: 1560850 - RNA, 15 nt, Human adenovirus D
cgcgcgaggaggugg

SEQ ID NO: 1560851 - RNA, 16 nt, Human adenovirus D
guucaggagcgcagcc

SEQ ID NO: 1560852 - RNA, 22 nt, Human adenovirus D
gcgcuggcggagaacaaggcca

SEQ ID NO: 1560853 - RNA, 15 nt, Human adenovirus D
ugaacuucuugcuga

SEQ ID NO: 1560854 - RNA, 22 nt, Human adenovirus D
cgcguaaauuggaaggggcgca

SEQ ID NO: 1560855 - RNA, 14 nt, Human adenovirus D
uguacuucucccaa

SEQ ID NO: 1560856 - RNA, 12 nt, Human adenovirus D
caucagccagga

SEQ ID NO: 1560857 - RNA, 22 nt, Human adenovirus D
gcccaacucgcggcugcugcug

SEQ ID NO: 1560858 - RNA, 20 nt, Human adenovirus D
caccaccagcccauuucaca

SEQ ID NO: 1560859 - RNA, 14 nt, Human adenovirus D
agccaaacacaccu

SEQ ID NO: 1560860 - RNA, 20 nt, Human adenovirus D
gcaucaaaaauuaucuuuuu

SEQ ID NO: 1560861 - RNA, 17 nt, Human adenovirus D
ugggccacuacagcuga

SEQ ID NO: 1560862 - RNA, 19 nt, Human adenovirus D
guuucuggggucagagaca

SEQ ID NO: 1560863 - RNA, 14 nt, Human adenovirus D
gacuugggcgggag

SEQ ID NO: 1560864 - RNA, 21 nt, Human adenovirus D
cuugaccugccuccaccaccc

SEQ ID NO: 1560865 - RNA, 12 nt, Human adenovirus D
cucggagcuggc

SEQ ID NO: 1560866 - RNA, 11 nt, Human adenovirus D
ccagcagcaca

SEQ ID NO: 1560867 - RNA, 22 nt, Human adenovirus D
caaauuggcggacauauggaau

SEQ ID NO: 1560868 - RNA, 12 nt, Human adenovirus D
ccagcccagggc

SEQ ID NO: 1560869 - RNA, 20 nt, Human adenovirus D
gacagaggcuaccucaagug

SEQ ID NO: 1560870 - RNA, 15 nt, Human adenovirus D
cccauuucacagugu

SEQ ID NO: 1560871 - RNA, 18 nt, Human adenovirus D
gcguccgcggccacuucc

SEQ ID NO: 1560872 - RNA, 14 nt, Human adenovirus D
guccgcuccgcagu

SEQ ID NO: 1560873 - RNA, 22 nt, Human adenovirus D
ugaauaugaauuccaugaucuu

SEQ ID NO: 1560874 - RNA, 13 nt, Human adenovirus D
uccuccuggagau

SEQ ID NO: 1560875 - RNA, 18 nt, Human adenovirus D
gggcgcucccaaucccag

SEQ ID NO: 1560876 - RNA, 16 nt, Human adenovirus D
uaaagaaacagaacaa

SEQ ID NO: 1560877 - RNA, 23 nt, Human adenovirus D
cucgcaguccgccaagcuccucg

SEQ ID NO: 1560878 - RNA, 19 nt, Human adenovirus D
guaugccaagauagcccug

SEQ ID NO: 1560879 - RNA, 21 nt, Human adenovirus D
auguguggacuauccuugcag

SEQ ID NO: 1560880 - RNA, 22 nt, Human adenovirus D
gaggccaucuaaacuaaagcca

SEQ ID NO: 1560881 - RNA, 14 nt, Human adenovirus D
ucuuugacacaccu

SEQ ID NO: 1560882 - RNA, 20 nt, Human adenovirus D
acuccgcgaccuccucccca

SEQ ID NO: 1560883 - RNA, 17 nt, Human adenovirus D
aaugugagugauaaagc

SEQ ID NO: 1560884 - RNA, 13 nt, Human adenovirus D
cucgcugguggcg

SEQ ID NO: 1560885 - RNA, 19 nt, Human adenovirus D
agcaccucgguacccuccu

SEQ ID NO: 1560886 - RNA, 15 nt, Human adenovirus D
gccuggccucgggca

SEQ ID NO: 1560887 - RNA, 16 nt, Human adenovirus D
cucagguugucaguuu

SEQ ID NO: 1560888 - RNA, 22 nt, Human adenovirus D
ggacugguuccucguccagaug

SEQ ID NO: 1560889 - RNA, 14 nt, Human adenovirus D
ccgccgcaggagag

SEQ ID NO: 1560890 - RNA, 22 nt, Human adenovirus D
ccacgugguauacaagccagga

SEQ ID NO: 1560891 - RNA, 13 nt, Human adenovirus D
caacaugcugacu

SEQ ID NO: 1560892 - RNA, 15 nt, Human adenovirus D
gucgcgguggggcgg

SEQ ID NO: 1560893 - RNA, 18 nt, Human adenovirus D
gcuggggagggccacguu

SEQ ID NO: 1560894 - RNA, 21 nt, Human adenovirus D
aucgguccgugugauuaaaaa

SEQ ID NO: 1560895 - RNA, 20 nt, Human adenovirus D
uggcuccuacggagggcaga

SEQ ID NO: 1560896 - RNA, 21 nt, Human adenovirus D
gcaaugcuagagugaggcacu

SEQ ID NO: 1560897 - RNA, 21 nt, Human adenovirus D
cacagcgauucccgggcuuuc

SEQ ID NO: 1560898 - RNA, 14 nt, Human adenovirus D
gaagagcagcacag

SEQ ID NO: 1560899 - RNA, 13 nt, Human adenovirus D
ucgcggaugaugu

SEQ ID NO: 1560900 - RNA, 22 nt, Human adenovirus D
ggccaauguuacgcugcccgcc

SEQ ID NO: 1560901 - RNA, 17 nt, Human adenovirus D
caucguaguucaggagc

SEQ ID NO: 1560902 - RNA, 13 nt, Human adenovirus D
uggcggagcgagc

SEQ ID NO: 1560903 - RNA, 17 nt, Human adenovirus D
ggagccugaugagcucg

SEQ ID NO: 1560904 - RNA, 12 nt, Human adenovirus D
aagaagaaguua

SEQ ID NO: 1560905 - RNA, 13 nt, Human adenovirus D
cucccaccccaga

SEQ ID NO: 1560906 - RNA, 22 nt, Human adenovirus D
accgucgccucggaccuggccg

SEQ ID NO: 1560907 - RNA, 22 nt, Human adenovirus D
ucuggacccuccgucggaagag

SEQ ID NO: 1560908 - RNA, 13 nt, Human adenovirus D
aaaguuuuucagg

SEQ ID NO: 1560909 - RNA, 21 nt, Human adenovirus D
cucugauucaugugaacaaaa

SEQ ID NO: 1560910 - RNA, 22 nt, Human adenovirus D
gcccugagccgccagcuggccg

SEQ ID NO: 1560911 - RNA, 16 nt, Human adenovirus D
ucaaguaggugaagaa

SEQ ID NO: 1560912 - RNA, 12 nt, Human adenovirus D
caucaccacagg

SEQ ID NO: 1560913 - RNA, 22 nt, Human adenovirus D
gaccaugcagaucauggugccc

SEQ ID NO: 1560914 - RNA, 17 nt, Human adenovirus D
caggcgcuggaagaggu

SEQ ID NO: 1560915 - RNA, 16 nt, Human adenovirus D
gcgcuggggagggcca

SEQ ID NO: 1560916 - RNA, 22 nt, Human adenovirus D
gucccgguguugcgcccugaga

SEQ ID NO: 1560917 - RNA, 13 nt, Human adenovirus D
aagaaacagaaca

SEQ ID NO: 1560918 - RNA, 21 nt, Human adenovirus D
accagguccacgcugguggcc

SEQ ID NO: 1560919 - RNA, 13 nt, Human adenovirus D
cgcagccgcggca

SEQ ID NO: 1560920 - RNA, 19 nt, Human adenovirus D
aacggcugcauccacugcu

SEQ ID NO: 1560921 - RNA, 19 nt, Human adenovirus D
ccccagaugggccuggccg

SEQ ID NO: 1560922 - RNA, 12 nt, Human adenovirus D
aguugagggccu

SEQ ID NO: 1560923 - RNA, 18 nt, Human adenovirus D
gcgcccugagagcgcugg

SEQ ID NO: 1560924 - RNA, 22 nt, Human adenovirus D
ggcaacagcaaaagauacagag

SEQ ID NO: 1560925 - RNA, 22 nt, Human adenovirus D
ggagcagugucuggagcgggcu

SEQ ID NO: 1560926 - RNA, 20 nt, Human adenovirus D
ccacccgcaugaacuggcuc

SEQ ID NO: 1560927 - RNA, 16 nt, Human adenovirus D
ucagagugcaccagcc

SEQ ID NO: 1560928 - RNA, 19 nt, Human adenovirus D
cggggaaggucucgcucca

SEQ ID NO: 1560929 - RNA, 20 nt, Human adenovirus D
agaucagcugcagcgcacuc

SEQ ID NO: 1560930 - RNA, 13 nt, Human adenovirus D
gacgagaccagag

SEQ ID NO: 1560931 - RNA, 20 nt, Human adenovirus D
ccacaggugcugcccacccu

SEQ ID NO: 1560932 - RNA, 20 nt, Human adenovirus D
cagcgccacgaccggcagcg

SEQ ID NO: 1560933 - RNA, 18 nt, Human adenovirus D
ugauucaguacuuagaag

SEQ ID NO: 1560934 - RNA, 21 nt, Human adenovirus D
gcugacaauucagagccaggg

SEQ ID NO: 1560935 - RNA, 13 nt, Human adenovirus D
cucccaccaccag

SEQ ID NO: 1560936 - RNA, 17 nt, Human adenovirus D
gcccgccgccaggccca

SEQ ID NO: 1560937 - RNA, 16 nt, Human adenovirus D
caacucgcggcugcug

SEQ ID NO: 1560938 - RNA, 15 nt, Human adenovirus D
caugcaagguguggu

SEQ ID NO: 1560939 - RNA, 18 nt, Human adenovirus D
ugcagacacuugagcugg

SEQ ID NO: 1560940 - RNA, 18 nt, Human adenovirus D
ggaccauagggagccugc

SEQ ID NO: 1560941 - RNA, 23 nt, Human adenovirus D
cuacgccagccgcaggcgcccag

SEQ ID NO: 1560942 - RNA, 19 nt, Human adenovirus D
gaacugauguugauuaaaa

SEQ ID NO: 1560943 - RNA, 21 nt, Human adenovirus D
ugcuaccucuugcagcuggcc

SEQ ID NO: 1560944 - RNA, 16 nt, Human adenovirus D
cuuuccagcagcaggg

SEQ ID NO: 1560945 - RNA, 22 nt, Human adenovirus D
guggguuggcuugcaugaagga

SEQ ID NO: 1560946 - RNA, 17 nt, Human adenovirus D
gagaggagcucuugcag

SEQ ID NO: 1560947 - RNA, 15 nt, Human adenovirus D
cccacgccgagccug

SEQ ID NO: 1560948 - RNA, 14 nt, Human adenovirus D
gugcuggagagcga

SEQ ID NO: 1560949 - RNA, 23 nt, Human adenovirus D
gaggcgaagauggggccccgcca

SEQ ID NO: 1560950 - RNA, 17 nt, Human adenovirus D
aguauugugggccuggg

SEQ ID NO: 1560951 - RNA, 18 nt, Human adenovirus D
acaauaaaagaccaauaa

SEQ ID NO: 1560952 - RNA, 18 nt, Human adenovirus D
auugucaagcuugguggc

SEQ ID NO: 1560953 - RNA, 17 nt, Human adenovirus D
gccugggcgugcagacc

SEQ ID NO: 1560954 - RNA, 22 nt, Human adenovirus D
ccugaucucugccauguucuca

SEQ ID NO: 1560955 - RNA, 13 nt, Human adenovirus D
gcccaacccgcgu

SEQ ID NO: 1560956 - RNA, 15 nt, Human adenovirus D
ggggcgcugggcgug

SEQ ID NO: 1560957 - RNA, 17 nt, Human adenovirus D
ugaagaaaacuggcaag

SEQ ID NO: 1560958 - RNA, 15 nt, Human adenovirus D
ccugaucucugccau

SEQ ID NO: 1560959 - RNA, 18 nt, Human adenovirus D
ggcgagaggcgagcagcu

SEQ ID NO: 1560960 - RNA, 15 nt, Human adenovirus D
gccgcgcgggcagga

SEQ ID NO: 1560961 - RNA, 13 nt, Human adenovirus D
ggucagagugcac

SEQ ID NO: 1560962 - RNA, 16 nt, Human adenovirus D
cgccgccacugcaccc

SEQ ID NO: 1560963 - RNA, 18 nt, Human adenovirus D
uuuaauuggcaaacuugu

SEQ ID NO: 1560964 - RNA, 12 nt, Human adenovirus D
cagcacaguaag

SEQ ID NO: 1560965 - RNA, 15 nt, Human adenovirus D
cccccaggcccugga

SEQ ID NO: 1560966 - RNA, 23 nt, Human adenovirus D
cggcggugguguucacgcccggc

SEQ ID NO: 1560967 - RNA, 22 nt, Human adenovirus D
agcuugguggcaaaggagccau

SEQ ID NO: 1560968 - RNA, 18 nt, Human adenovirus D
ucaacaaccaugugcgca

SEQ ID NO: 1560969 - RNA, 17 nt, Human adenovirus D
uggacgagggggcagua

SEQ ID NO: 1560970 - RNA, 16 nt, Human adenovirus D
uucuacagccagcagc

SEQ ID NO: 1560971 - RNA, 17 nt, Human adenovirus D
cgcugcaaagccagccg

SEQ ID NO: 1560972 - RNA, 15 nt, Human adenovirus D
gaagauggaggagca

SEQ ID NO: 1560973 - RNA, 21 nt, Human adenovirus D
caacaucugugcugccuuugc

SEQ ID NO: 1560974 - RNA, 18 nt, Human adenovirus D
gcgcucccggcggcagcg

SEQ ID NO: 1560975 - RNA, 13 nt, Human adenovirus D
ugcccuuggaaga

SEQ ID NO: 1560976 - RNA, 22 nt, Human adenovirus D
gauaaggagaaggauucaaaac

SEQ ID NO: 1560977 - RNA, 22 nt, Human adenovirus D
gcucggccaugccccaggccug

SEQ ID NO: 1560978 - RNA, 19 nt, Human adenovirus D
agaagaaugggacagccag

SEQ ID NO: 1560979 - RNA, 14 nt, Human adenovirus D
ggugcgcuggggcu

SEQ ID NO: 1560980 - RNA, 19 nt, Human adenovirus D
cuaaucauuuaauaaagau

SEQ ID NO: 1560981 - RNA, 21 nt, Human adenovirus D
ccuacgcgaccguggggaacu

SEQ ID NO: 1560982 - RNA, 19 nt, Human adenovirus D
agccaagaaacgucccagc

SEQ ID NO: 1560983 - RNA, 17 nt, Human adenovirus D
cgcccguagucuggaga

SEQ ID NO: 1560984 - RNA, 22 nt, Human adenovirus D
cucggaguaccugagcccgggu

SEQ ID NO: 1560985 - RNA, 19 nt, Human adenovirus D
ucaccauguuauucagcag

SEQ ID NO: 1560986 - RNA, 16 nt, Human adenovirus D
cguccagcgcggccag

SEQ ID NO: 1560987 - RNA, 15 nt, Human adenovirus D
cugacauccauggcc

SEQ ID NO: 1560988 - RNA, 19 nt, Human adenovirus D
uacagccagcagcuccggg

SEQ ID NO: 1560989 - RNA, 19 nt, Human adenovirus D
agauuuaauuggcaaacuu

SEQ ID NO: 1560990 - RNA, 14 nt, Human adenovirus D
cguguggcagcagu

SEQ ID NO: 1560991 - RNA, 19 nt, Human adenovirus D
gaaagaggcggaacugcug

SEQ ID NO: 1560992 - RNA, 17 nt, Human adenovirus D
cccgggucuggugcagu

SEQ ID NO: 1560993 - RNA, 20 nt, Human adenovirus D
ggcgccgccggcggcgagga

SEQ ID NO: 1560994 - RNA, 20 nt, Human adenovirus D
ggaggcgguccccgcccagc

SEQ ID NO: 1560995 - RNA, 18 nt, Human adenovirus D
ugaacgccuuccuggcga

SEQ ID NO: 1560996 - RNA, 17 nt, Human adenovirus D
gcucccagccuccaccg

SEQ ID NO: 1560997 - RNA, 21 nt, Human adenovirus D
guuggaggaagaaaugaggca

SEQ ID NO: 1560998 - RNA, 16 nt, Human adenovirus D
gcgcagcggcaggaaa

SEQ ID NO: 1560999 - RNA, 16 nt, Human adenovirus D
ccaggcaaagcucaac

SEQ ID NO: 1561000 - RNA, 23 nt, Human adenovirus D
gcgcgcuccacgguggcggcgag

SEQ ID NO: 1561001 - RNA, 21 nt, Human adenovirus D
ggcaccaucacaggaggcaca

SEQ ID NO: 1561002 - RNA, 22 nt, Human adenovirus D
cugucaugccacgaacagccac

SEQ ID NO: 1561003 - RNA, 15 nt, Human adenovirus D
ccaacggcugcaucc

SEQ ID NO: 1561004 - RNA, 15 nt, Human adenovirus D
caugauccagcggcg

SEQ ID NO: 1561005 - RNA, 23 nt, Human adenovirus D
gcagccgugaucccacagggcac

SEQ ID NO: 1561006 - RNA, 14 nt, Human adenovirus D
ggaggggggccacc

SEQ ID NO: 1561007 - RNA, 16 nt, Human adenovirus D
acuuccccccuggggu

SEQ ID NO: 1561008 - RNA, 16 nt, Human adenovirus D
agagcaaucccacgcc

SEQ ID NO: 1561009 - RNA, 14 nt, Human adenovirus D
ccgcgguccuccuc

SEQ ID NO: 1561010 - RNA, 18 nt, Human adenovirus D
gcagggugaccaggucca

SEQ ID NO: 1561011 - RNA, 15 nt, Human adenovirus D
cgcaggcgcccagcc

SEQ ID NO: 1561012 - RNA, 20 nt, Human adenovirus D
ccccauagucaucacccagc

SEQ ID NO: 1561013 - RNA, 21 nt, Human adenovirus D
cugucccuacgucuacaaggc

SEQ ID NO: 1561014 - RNA, 17 nt, Human adenovirus D
ccagaacuuccagcaga

SEQ ID NO: 1561015 - RNA, 13 nt, Human adenovirus D
gcgacccaugagc

SEQ ID NO: 1561016 - RNA, 21 nt, Human adenovirus D
agagguugaaaaggcagcuga

SEQ ID NO: 1561017 - RNA, 15 nt, Human adenovirus D
aucacaucagccagg

SEQ ID NO: 1561018 - RNA, 17 nt, Human adenovirus D
cuccgguggcgaccgcc

SEQ ID NO: 1561019 - RNA, 19 nt, Human adenovirus D
gagcggcgaggggcugcua

SEQ ID NO: 1561020 - RNA, 16 nt, Human adenovirus D
cccaggccuggcccug

SEQ ID NO: 1561021 - RNA, 16 nt, Human adenovirus D
uugccgaaggacccca

SEQ ID NO: 1561022 - RNA, 19 nt, Human adenovirus D
gcccguucucgcuggucac

SEQ ID NO: 1561023 - RNA, 17 nt, Human adenovirus D
gcgaucucggacaugaa

SEQ ID NO: 1561024 - RNA, 16 nt, Human adenovirus D
caccgccuccacccug

SEQ ID NO: 1561025 - RNA, 15 nt, Human adenovirus D
cucuuuccagcagca

SEQ ID NO: 1561026 - RNA, 17 nt, Human adenovirus D
guccuugaggaggagac

SEQ ID NO: 1561027 - RNA, 20 nt, Human adenovirus D
cgcaggcgggacagaggagg

SEQ ID NO: 1561028 - RNA, 14 nt, Human adenovirus D
cuguucagggaccg

SEQ ID NO: 1561029 - RNA, 17 nt, Human adenovirus D
uaacuaugaucccaaca

SEQ ID NO: 1561030 - RNA, 14 nt, Human adenovirus D
gccguccgcccgcg

SEQ ID NO: 1561031 - RNA, 16 nt, Human adenovirus D
acgggauagagagucu

SEQ ID NO: 1561032 - RNA, 22 nt, Human adenovirus D
gaggaugcacccgcugcggggu

SEQ ID NO: 1561033 - RNA, 15 nt, Human adenovirus D
ccggggcggggguga

SEQ ID NO: 1561034 - RNA, 18 nt, Human adenovirus D
agcggccagcgcugggug

SEQ ID NO: 1561035 - RNA, 23 nt, Human adenovirus D
gguaguucaaggacaugcagcug

SEQ ID NO: 1561036 - RNA, 20 nt, Human adenovirus D
aacaaccuuaccaguggacu

SEQ ID NO: 1561037 - RNA, 16 nt, Human adenovirus D
cagggugcuccagcca

SEQ ID NO: 1561038 - RNA, 20 nt, Human adenovirus D
uacuuucgcucccaccgcgc

SEQ ID NO: 1561039 - RNA, 14 nt, Human adenovirus D
agaccaccugguga

SEQ ID NO: 1561040 - RNA, 21 nt, Human adenovirus D
gcugcccguucucgcugguca

SEQ ID NO: 1561041 - RNA, 14 nt, Human adenovirus D
cucagcagucucug

SEQ ID NO: 1561042 - RNA, 11 nt, Human adenovirus D
ggaggcagagc

SEQ ID NO: 1561043 - RNA, 20 nt, Human adenovirus D
uuugcaagaaggaaguauga

SEQ ID NO: 1561044 - RNA, 21 nt, Human adenovirus D
gaacuaaucauuuaauaaaga

SEQ ID NO: 1561045 - RNA, 21 nt, Human adenovirus D
aagcuagcacccaaaaacugc

SEQ ID NO: 1561046 - RNA, 12 nt, Human adenovirus D
uucaagaacugg

SEQ ID NO: 1561047 - RNA, 16 nt, Human adenovirus D
gcuucgaagagccggc

SEQ ID NO: 1561048 - RNA, 20 nt, Human adenovirus D
acaucaauuuugcgucccug

SEQ ID NO: 1561049 - RNA, 15 nt, Human adenovirus D
aaaagcguccgcagu

SEQ ID NO: 1561050 - RNA, 11 nt, Human adenovirus D
gguggcggcga

SEQ ID NO: 1561051 - RNA, 13 nt, Human adenovirus D
guuuaauaaaagc

SEQ ID NO: 1561052 - RNA, 17 nt, Human adenovirus D
caaucucccaccaccag

SEQ ID NO: 1561053 - RNA, 16 nt, Human adenovirus D
cuacgagcucaaccuc

SEQ ID NO: 1561054 - RNA, 22 nt, Human adenovirus D
gcaaggucgaggagaccugcac

SEQ ID NO: 1561055 - RNA, 16 nt, Human adenovirus D
acugauggccacgggg

SEQ ID NO: 1561056 - RNA, 16 nt, Human adenovirus D
ugcugccgcucaguca

SEQ ID NO: 1561057 - RNA, 18 nt, Human adenovirus D
ugcagggcgcccagcaug

SEQ ID NO: 1561058 - RNA, 17 nt, Human adenovirus D
gagggccucggcggcgu

SEQ ID NO: 1561059 - RNA, 12 nt, Human adenovirus D
aaccucagccac

SEQ ID NO: 1561060 - RNA, 16 nt, Human adenovirus D
gaccaggcggcagagc

SEQ ID NO: 1561061 - RNA, 21 nt, Human adenovirus D
acaaccaugugcgcacccuga

SEQ ID NO: 1561062 - RNA, 16 nt, Human adenovirus D
gcgcuggggcugcucg

SEQ ID NO: 1561063 - RNA, 14 nt, Human adenovirus D
caugcuggccgugg

SEQ ID NO: 1561064 - RNA, 18 nt, Human adenovirus D
gcggucgcgguggggcgg

SEQ ID NO: 1561065 - RNA, 20 nt, Human adenovirus D
ccaagaaacgucccagcagc

SEQ ID NO: 1561066 - RNA, 21 nt, Human adenovirus D
guggcgcucgggcaggucccg

SEQ ID NO: 1561067 - RNA, 13 nt, Human adenovirus D
cugaggcagacgc

SEQ ID NO: 1561068 - RNA, 13 nt, Human adenovirus D
gugcgggggcaga

SEQ ID NO: 1561069 - RNA, 18 nt, Human adenovirus D
cgaccggucgacggugag

SEQ ID NO: 1561070 - RNA, 15 nt, Human adenovirus D
cgcaguccgccaagc

SEQ ID NO: 1561071 - RNA, 12 nt, Human adenovirus D
gcgcgcugcccg

SEQ ID NO: 1561072 - RNA, 20 nt, Human adenovirus D
ggccguccuuucgcugcugc

SEQ ID NO: 1561073 - RNA, 13 nt, Human adenovirus D
ucagagugcacca

SEQ ID NO: 1561074 - RNA, 13 nt, Human adenovirus D
ugauauugcuucc

SEQ ID NO: 1561075 - RNA, 19 nt, Human adenovirus D
agaugcgacccaugagcug

SEQ ID NO: 1561076 - RNA, 15 nt, Human adenovirus D
ccacccagaccgugc

SEQ ID NO: 1561077 - RNA, 11 nt, Human adenovirus D
cgucccagcag

SEQ ID NO: 1561078 - RNA, 19 nt, Human adenovirus D
uccugcugcuccaccaccu

SEQ ID NO: 1561079 - RNA, 17 nt, Human adenovirus D
gcagccgccgugcuccc

SEQ ID NO: 1561080 - RNA, 19 nt, Human adenovirus D
accgcgagcugaugcugag

SEQ ID NO: 1561081 - RNA, 13 nt, Human adenovirus D
gagcaggaccugg

SEQ ID NO: 1561082 - RNA, 18 nt, Human adenovirus D
gaggccaucgugcagaac

SEQ ID NO: 1561083 - RNA, 20 nt, Human adenovirus D
caggagccgcuaguggaaga

SEQ ID NO: 1561084 - RNA, 20 nt, Human adenovirus D
ugacgagcccgcgcgggagc

SEQ ID NO: 1561085 - RNA, 19 nt, Human adenovirus D
caguacucccggagcggga

SEQ ID NO: 1561086 - RNA, 13 nt, Human adenovirus D
cggaggcuggcug

SEQ ID NO: 1561087 - RNA, 14 nt, Human adenovirus D
uccaugcgggugac

SEQ ID NO: 1561088 - RNA, 18 nt, Human adenovirus D
gacaagauaucauaaaga

SEQ ID NO: 1561089 - RNA, 12 nt, Human adenovirus D
gguggaggcgcg

SEQ ID NO: 1561090 - RNA, 16 nt, Human adenovirus D
gugcagaccguggaca

SEQ ID NO: 1561091 - RNA, 20 nt, Human adenovirus D
ccauucggagcacgcccgcc

SEQ ID NO: 1561092 - RNA, 20 nt, Human adenovirus D
cgcugguagggggcgccgcc

SEQ ID NO: 1561093 - RNA, 17 nt, Human adenovirus D
cagucguggacgcugcu

SEQ ID NO: 1561094 - RNA, 21 nt, Human adenovirus D
acacuuccuucgcagucucca

SEQ ID NO: 1561095 - RNA, 20 nt, Human adenovirus D
ugccagauugggggacgaug

SEQ ID NO: 1561096 - RNA, 15 nt, Human adenovirus D
gacagcguuccccuc

SEQ ID NO: 1561097 - RNA, 22 nt, Human adenovirus D
cagaaucaaaucgccaagggca

SEQ ID NO: 1561098 - RNA, 12 nt, Human adenovirus D
cagcacgguggc

SEQ ID NO: 1561099 - RNA, 17 nt, Human adenovirus D
gcaucggaacccuccag

SEQ ID NO: 1561100 - RNA, 19 nt, Human adenovirus D
gacgagaccagaggcagac

SEQ ID NO: 1561101 - RNA, 12 nt, Human adenovirus D
cgugcaggcgcc

SEQ ID NO: 1561102 - RNA, 14 nt, Human adenovirus D
cagcaggagugcag

SEQ ID NO: 1561103 - RNA, 20 nt, Human adenovirus D
agcaugaaggggacgagcug

SEQ ID NO: 1561104 - RNA, 17 nt, Human adenovirus D
ccagcgcgugcugcgcg

SEQ ID NO: 1561105 - RNA, 16 nt, Human adenovirus D
cauacaaagcugaaag

SEQ ID NO: 1561106 - RNA, 17 nt, Human adenovirus D
ggucggcgacgacgcgc

SEQ ID NO: 1561107 - RNA, 16 nt, Human adenovirus D
gucacacuuaguucag

SEQ ID NO: 1561108 - RNA, 22 nt, Human adenovirus D
agcgccuuaccugguacgagcu

SEQ ID NO: 1561109 - RNA, 15 nt, Human adenovirus D
acucugugugcugag

SEQ ID NO: 1561110 - RNA, 18 nt, Human adenovirus D
ugccauuuugaacccgca

SEQ ID NO: 1561111 - RNA, 15 nt, Human adenovirus D
cagcaggagugcagg

SEQ ID NO: 1561112 - RNA, 18 nt, Human adenovirus D
guccuugaggaggagacu

SEQ ID NO: 1561113 - RNA, 18 nt, Human adenovirus D
cgcgcgguaggcccuggu

SEQ ID NO: 1561114 - RNA, 19 nt, Human adenovirus D
gcgccgggccugggcgugc

SEQ ID NO: 1561115 - RNA, 12 nt, Human adenovirus D
ugaccaagcugg

SEQ ID NO: 1561116 - RNA, 20 nt, Human adenovirus D
ccaacuggucuccugccugg

SEQ ID NO: 1561117 - RNA, 19 nt, Human adenovirus D
gugcugccccaggcggugc

SEQ ID NO: 1561118 - RNA, 12 nt, Human adenovirus D
ggcuggagccgc

SEQ ID NO: 1561119 - RNA, 23 nt, Human adenovirus D
ucaccugcaccugcgucugcagc

SEQ ID NO: 1561120 - RNA, 22 nt, Human adenovirus D
uccccagcgguucugggucacc

SEQ ID NO: 1561121 - RNA, 19 nt, Human adenovirus D
agacgaugggcguccagcg

SEQ ID NO: 1561122 - RNA, 16 nt, Human adenovirus D
ucuuuagacucugaca

SEQ ID NO: 1561123 - RNA, 16 nt, Human adenovirus D
cgcccgacacugcagg

SEQ ID NO: 1561124 - RNA, 17 nt, Human adenovirus D
cacuugagcuggccuuc

SEQ ID NO: 1561125 - RNA, 15 nt, Human adenovirus D
uccagcccagggcgc

SEQ ID NO: 1561126 - RNA, 11 nt, Human adenovirus D
cugcuggaugg

SEQ ID NO: 1561127 - RNA, 12 nt, Human adenovirus D
gucaucacccag

SEQ ID NO: 1561128 - RNA, 22 nt, Human adenovirus D
aguuucaaacccuacucgggca

SEQ ID NO: 1561129 - RNA, 13 nt, Human adenovirus D
accucucggccgc

SEQ ID NO: 1561130 - RNA, 14 nt, Human adenovirus D
gacccccaggcccu

SEQ ID NO: 1561131 - RNA, 15 nt, Human adenovirus D
cucccaccaccagcc

SEQ ID NO: 1561132 - RNA, 18 nt, Human adenovirus D
ucauggaggcccacaaag

SEQ ID NO: 1561133 - RNA, 18 nt, Human adenovirus D
uucagggugcuccagcca

SEQ ID NO: 1561134 - RNA, 15 nt, Human adenovirus D
gcaguagccccgccc

SEQ ID NO: 1561135 - RNA, 14 nt, Human adenovirus D
ucgccggaggaggc

SEQ ID NO: 1561136 - RNA, 12 nt, Human adenovirus D
agcuugcccuug

SEQ ID NO: 1561137 - RNA, 24 nt, Human adenovirus D
ggaggcguacaugccgcaaauguc

SEQ ID NO: 1561138 - RNA, 19 nt, Human adenovirus D
gaucucggucugcucgggc

SEQ ID NO: 1561139 - RNA, 19 nt, Human adenovirus D
auaaaguuuuucauccaga

SEQ ID NO: 1561140 - RNA, 20 nt, Human adenovirus D
cucacaguaagugcagcaca

SEQ ID NO: 1561141 - RNA, 13 nt, Human adenovirus D
ugaaucucgguuu

SEQ ID NO: 1561142 - RNA, 20 nt, Human adenovirus D
uauagucuaugggaacauau

SEQ ID NO: 1561143 - RNA, 19 nt, Human adenovirus D
ccgcgccgacgcgcuccuc

SEQ ID NO: 1561144 - RNA, 21 nt, Human adenovirus D
ccgucgccucggaccuggccg

SEQ ID NO: 1561145 - RNA, 17 nt, Human adenovirus D
caucacaucagccagga

SEQ ID NO: 1561146 - RNA, 15 nt, Human adenovirus D
ugaggcaggccaugg

SEQ ID NO: 1561147 - RNA, 15 nt, Human adenovirus D
cuuuuuaaaaacacu

SEQ ID NO: 1561148 - RNA, 17 nt, Human adenovirus D
gacaaagagcacagcag

SEQ ID NO: 1561149 - RNA, 20 nt, Human adenovirus D
accucuucuauuucuuccuc

SEQ ID NO: 1561150 - RNA, 16 nt, Human adenovirus D
gagcucuuaagaaaga

SEQ ID NO: 1561151 - RNA, 22 nt, Human adenovirus D
gacgcgcucccggcggcagcgg

SEQ ID NO: 1561152 - RNA, 20 nt, Human adenovirus D
cgugcgcacccguccuccuc

SEQ ID NO: 1561153 - RNA, 16 nt, Human adenovirus D
gcaguugaccaugagc

SEQ ID NO: 1561154 - RNA, 17 nt, Human adenovirus D
augggggcggaccugca

SEQ ID NO: 1561155 - RNA, 22 nt, Human adenovirus D
gccggccaauguuacgcugccc

SEQ ID NO: 1561156 - RNA, 16 nt, Human adenovirus D
caguggcccuggaugu

SEQ ID NO: 1561157 - RNA, 22 nt, Human adenovirus D
uggggcgcuuacaagcgcgggc

SEQ ID NO: 1561158 - RNA, 21 nt, Human adenovirus D
agccaggugagcucgggcugc

SEQ ID NO: 1561159 - RNA, 13 nt, Human adenovirus D
augggcaccugga

SEQ ID NO: 1561160 - RNA, 15 nt, Human adenovirus D
ucuuugcccugcuca

SEQ ID NO: 1561161 - RNA, 18 nt, Human adenovirus D
gaccucccaccccagaaa

SEQ ID NO: 1561162 - RNA, 23 nt, Human adenovirus D
cuucgagguggaccccauggaug

SEQ ID NO: 1561163 - RNA, 18 nt, Human adenovirus D
uuggugggcagaggaggu

SEQ ID NO: 1561164 - RNA, 14 nt, Human adenovirus D
cauuuuuccagccu

SEQ ID NO: 1561165 - RNA, 15 nt, Human adenovirus D
cgcgguccuccucgu

SEQ ID NO: 1561166 - RNA, 14 nt, Human adenovirus D
aguccaccgcuccg

SEQ ID NO: 1561167 - RNA, 21 nt, Human adenovirus D
caggcgccggcgcuagccagc

SEQ ID NO: 1561168 - RNA, 22 nt, Human adenovirus D
gccaggggagugaagagggaga

SEQ ID NO: 1561169 - RNA, 17 nt, Human adenovirus D
caggugaugccggcagc

SEQ ID NO: 1561170 - RNA, 18 nt, Human adenovirus D
augaauuuugggcggagg

SEQ ID NO: 1561171 - RNA, 18 nt, Human adenovirus D
ugaggcggugguagccgu

SEQ ID NO: 1561172 - RNA, 20 nt, Human adenovirus D
ggcgcggcgggggcggagag

SEQ ID NO: 1561173 - RNA, 18 nt, Human adenovirus D
cgugaccugcagcaggug

SEQ ID NO: 1561174 - RNA, 18 nt, Human adenovirus D
ugcgccaagggcagcccu

SEQ ID NO: 1561175 - RNA, 17 nt, Human adenovirus D
caggcccagaacuggca

SEQ ID NO: 1561176 - RNA, 18 nt, Human adenovirus D
gucugucauauccugaag

SEQ ID NO: 1561177 - RNA, 15 nt, Human adenovirus D
cugagccgccagcug

SEQ ID NO: 1561178 - RNA, 12 nt, Human adenovirus D
ggccuggagcag

SEQ ID NO: 1561179 - RNA, 15 nt, Human adenovirus D
gaaaucacacuuuug

SEQ ID NO: 1561180 - RNA, 13 nt, Human adenovirus D
caucaccacaggc

SEQ ID NO: 1561181 - RNA, 22 nt, Human adenovirus D
cgcgaggccauaggccaggcgc

SEQ ID NO: 1561182 - RNA, 22 nt, Human adenovirus D
ucccgucucgacccgagcccga

SEQ ID NO: 1561183 - RNA, 14 nt, Human adenovirus D
ccggucgacgguga

SEQ ID NO: 1561184 - RNA, 14 nt, Human adenovirus D
aggaagcccagagc

SEQ ID NO: 1561185 - RNA, 18 nt, Human adenovirus D
ucaucugcagggcgccca

SEQ ID NO: 1561186 - RNA, 21 nt, Human adenovirus D
uggcgaccgccgugcgccgcg

SEQ ID NO: 1561187 - RNA, 15 nt, Human adenovirus D
aguuuuauggcugcu

SEQ ID NO: 1561188 - RNA, 17 nt, Human adenovirus D
ggccugggagugaaaag

SEQ ID NO: 1561189 - RNA, 22 nt, Human adenovirus D
ggcgcagcugcgcuuagucaug

SEQ ID NO: 1561190 - RNA, 23 nt, Human adenovirus D
guggcuauuuucacugaaggaaa

SEQ ID NO: 1561191 - RNA, 14 nt, Human adenovirus D
gaaaugaggcaggc

SEQ ID NO: 1561192 - RNA, 14 nt, Human adenovirus D
gcuacaauuacuuc

SEQ ID NO: 1561193 - RNA, 13 nt, Human adenovirus D
caggcgccugagu

SEQ ID NO: 1561194 - RNA, 23 nt, Human adenovirus D
ucuccggugaugccuuccaaaau

SEQ ID NO: 1561195 - RNA, 19 nt, Human adenovirus D
gggccccgccaaccggcug

SEQ ID NO: 1561196 - RNA, 16 nt, Human adenovirus D
cuugagaugcagaugg

SEQ ID NO: 1561197 - RNA, 16 nt, Human adenovirus D
ugucaggucugcuggu

SEQ ID NO: 1561198 - RNA, 15 nt, Human adenovirus D
agagcucaaaguaaa

SEQ ID NO: 1561199 - RNA, 16 nt, Human adenovirus D
agcggccgcggccaga

SEQ ID NO: 1561200 - RNA, 22 nt, Human adenovirus D
gcagcuccgguugugcagcccc

SEQ ID NO: 1561201 - RNA, 13 nt, Human adenovirus D
cccgcagcacgcg

SEQ ID NO: 1561202 - RNA, 15 nt, Human adenovirus D
ggagcacgcccgcca

SEQ ID NO: 1561203 - RNA, 14 nt, Human adenovirus D
cagcaagccucuga

SEQ ID NO: 1561204 - RNA, 14 nt, Human adenovirus D
aaaacagaaagcau

SEQ ID NO: 1561205 - RNA, 17 nt, Human adenovirus D
aggaccauagggagccu

SEQ ID NO: 1561206 - RNA, 23 nt, Human adenovirus D
ccgcgccaaccgcacccgcgccg

SEQ ID NO: 1561207 - RNA, 21 nt, Human adenovirus D
cugagcggcugcacgagcgcc

SEQ ID NO: 1561208 - RNA, 23 nt, Human adenovirus D
augugaccucccaccccagaaag

SEQ ID NO: 1561209 - RNA, 17 nt, Human adenovirus D
cagccauagcucagccc

SEQ ID NO: 1561210 - RNA, 14 nt, Human adenovirus D
gggcagaggugguc

SEQ ID NO: 1561211 - RNA, 20 nt, Human adenovirus D
ccgagggucgcuggcugcug

SEQ ID NO: 1561212 - RNA, 13 nt, Human adenovirus D
aaaacccaugaaa

SEQ ID NO: 1561213 - RNA, 19 nt, Human adenovirus D
gacgggcugcuucugccug

SEQ ID NO: 1561214 - RNA, 11 nt, Human adenovirus D
cggcugagcuc

SEQ ID NO: 1561215 - RNA, 17 nt, Human adenovirus D
ccagcgaaagagagcuc

SEQ ID NO: 1561216 - RNA, 16 nt, Human adenovirus D
auggcucagcugccau

SEQ ID NO: 1561217 - RNA, 16 nt, Human adenovirus D
aauucagggugcucca

SEQ ID NO: 1561218 - RNA, 17 nt, Human adenovirus D
ugaaaguaugucucugg

SEQ ID NO: 1561219 - RNA, 21 nt, Human adenovirus D
auugauuuuuacaccagcgcg

SEQ ID NO: 1561220 - RNA, 19 nt, Human adenovirus D
cggccaaucagcaguagcc

SEQ ID NO: 1561221 - RNA, 23 nt, Human adenovirus D
gcaugccgaagaagaacaggagc

SEQ ID NO: 1561222 - RNA, 18 nt, Human adenovirus D
ucucuucaacaucugugc

SEQ ID NO: 1561223 - RNA, 12 nt, Human adenovirus D
aggcgcagcugc

SEQ ID NO: 1561224 - RNA, 18 nt, Human adenovirus D
ccggcagcggggccuggu

SEQ ID NO: 1561225 - RNA, 16 nt, Human adenovirus D
acuugccgccugcgca

SEQ ID NO: 1561226 - RNA, 23 nt, Human adenovirus D
gccugcgcccgcgccgcggcgac

SEQ ID NO: 1561227 - RNA, 16 nt, Human adenovirus D
ccuccgucggaagagg

SEQ ID NO: 1561228 - RNA, 17 nt, Human adenovirus D
ggcagagcucuuaagaa

SEQ ID NO: 1561229 - RNA, 13 nt, Human adenovirus D
gcuagcccuuccu

SEQ ID NO: 1561230 - RNA, 23 nt, Human adenovirus D
accggucucugcgcucgcucacc

SEQ ID NO: 1561231 - RNA, 12 nt, Human adenovirus D
cgauguagaguu

SEQ ID NO: 1561232 - RNA, 22 nt, Human adenovirus D
acuacuaauucucaaaguguga

SEQ ID NO: 1561233 - RNA, 18 nt, Human adenovirus D
gauaaagcgugguaguuu

SEQ ID NO: 1561234 - RNA, 20 nt, Human adenovirus D
ugauccguaucgugcugcuc

SEQ ID NO: 1561235 - RNA, 14 nt, Human adenovirus D
uuaaccuauaaaaa

SEQ ID NO: 1561236 - RNA, 18 nt, Human adenovirus D
cacugaaaauuugcaaaa

SEQ ID NO: 1561237 - RNA, 15 nt, Human adenovirus D
gggcgaagugcucaa

SEQ ID NO: 1561238 - RNA, 19 nt, Human adenovirus D
aaauccacuccgcacaugu

SEQ ID NO: 1561239 - RNA, 23 nt, Human adenovirus D
auugaaauacccaacaaccuuac

SEQ ID NO: 1561240 - RNA, 17 nt, Human adenovirus D
gcuccgcgaacagcagc

SEQ ID NO: 1561241 - RNA, 15 nt, Human adenovirus D
uggagccacugcuac

SEQ ID NO: 1561242 - RNA, 15 nt, Human adenovirus D
caacccuuccugguc

SEQ ID NO: 1561243 - RNA, 13 nt, Human adenovirus D
gcccgcuccaccg

SEQ ID NO: 1561244 - RNA, 14 nt, Human adenovirus D
gccgaggcuagcac

SEQ ID NO: 1561245 - RNA, 16 nt, Human adenovirus D
gccgccgcggccaucu

SEQ ID NO: 1561246 - RNA, 16 nt, Human adenovirus D
gucugcuccugcacuu

SEQ ID NO: 1561247 - RNA, 19 nt, Human adenovirus D
auuagcuaaugugucuuug

SEQ ID NO: 1561248 - RNA, 14 nt, Human adenovirus D
cucgcgcaccugcu

SEQ ID NO: 1561249 - RNA, 23 nt, Human adenovirus D
accaugaaggggcucuugcugau

SEQ ID NO: 1561250 - RNA, 18 nt, Human adenovirus D
gcuuccguugcgcugcag

SEQ ID NO: 1561251 - RNA, 14 nt, Human adenovirus D
ccaggggagugaag

SEQ ID NO: 1561252 - RNA, 18 nt, Human adenovirus D
cgucacggugaaggggug

SEQ ID NO: 1561253 - RNA, 16 nt, Human adenovirus D
acagucaacuguuaag

SEQ ID NO: 1561254 - RNA, 21 nt, Human adenovirus D
gauaugcccuccuauuacuug

SEQ ID NO: 1561255 - RNA, 15 nt, Human adenovirus D
uugaaaucugaaagu

SEQ ID NO: 1561256 - RNA, 23 nt, Human adenovirus D
cgagggccugggcucgcuggugg

SEQ ID NO: 1561257 - RNA, 22 nt, Human adenovirus D
ugcgagaaggcgcccaggccgc

SEQ ID NO: 1561258 - RNA, 23 nt, Human adenovirus D
cuugcaagacagaaacaccgagc

SEQ ID NO: 1561259 - RNA, 16 nt, Human adenovirus D
caggcccuggagcagc

SEQ ID NO: 1561260 - RNA, 22 nt, Human adenovirus D
aaagaggcuccggguggaagau

SEQ ID NO: 1561261 - RNA, 16 nt, Human adenovirus D
agaggcgagcagcugu

SEQ ID NO: 1561262 - RNA, 22 nt, Human adenovirus D
cgccgggccaugaugcgagccg

SEQ ID NO: 1561263 - RNA, 23 nt, Human adenovirus D
caugugugauaucacacugcaug

SEQ ID NO: 1561264 - RNA, 20 nt, Human adenovirus D
cgccgggccugggcgugcag

SEQ ID NO: 1561265 - RNA, 22 nt, Human adenovirus D
aagauggauggaaaaauauuug

SEQ ID NO: 1561266 - RNA, 16 nt, Human adenovirus D
cgcggacggccgcggc

SEQ ID NO: 1561267 - RNA, 16 nt, Human adenovirus D
guuucgggcgggcagg

SEQ ID NO: 1561268 - RNA, 19 nt, Human adenovirus D
cugcaccauccccagguaa

SEQ ID NO: 1561269 - RNA, 20 nt, Human adenovirus D
gaagccguggcgcagcgcga

SEQ ID NO: 1561270 - RNA, 16 nt, Human adenovirus D
ccucguccucuuccuc

SEQ ID NO: 1561271 - RNA, 19 nt, Human adenovirus D
ugucuucccucucagaugu

SEQ ID NO: 1561272 - RNA, 18 nt, Human adenovirus D
gcacauaaucaccauguu

SEQ ID NO: 1561273 - RNA, 20 nt, Human adenovirus D
cugaagauguaaccuugcaa

SEQ ID NO: 1561274 - RNA, 22 nt, Human adenovirus D
cauggccaggggagugaagagg

SEQ ID NO: 1561275 - RNA, 19 nt, Human adenovirus D
gugcuagacauggccagca

SEQ ID NO: 1561276 - RNA, 18 nt, Human adenovirus D
uggcgccgggccugggcg

SEQ ID NO: 1561277 - RNA, 18 nt, Human adenovirus D
cgagcaagacgcaggcca

SEQ ID NO: 1561278 - RNA, 14 nt, Human adenovirus D
ugcgcgagggccug

SEQ ID NO: 1561279 - RNA, 19 nt, Human adenovirus D
aacucgugcgaggggccaa

SEQ ID NO: 1561280 - RNA, 17 nt, Human adenovirus D
ggugaaccugagccagg

SEQ ID NO: 1561281 - RNA, 17 nt, Human adenovirus D
cgucgcuguccacgagc

SEQ ID NO: 1561282 - RNA, 17 nt, Human adenovirus D
gcaaaagcgccaggagg

SEQ ID NO: 1561283 - RNA, 15 nt, Human adenovirus D
cccgcggaugcuggc

SEQ ID NO: 1561284 - RNA, 16 nt, Human adenovirus D
cgcuucuucgagaggg

SEQ ID NO: 1561285 - RNA, 12 nt, Human adenovirus D
aaaacuggcaag

SEQ ID NO: 1561286 - RNA, 13 nt, Human adenovirus D
gcaggcgcccagc

SEQ ID NO: 1561287 - RNA, 20 nt, Human adenovirus D
accccuggcucccagccucc

SEQ ID NO: 1561288 - RNA, 20 nt, Human adenovirus D
gagcuguccauggugucgcg

SEQ ID NO: 1561289 - RNA, 21 nt, Human adenovirus D
uagacaaagagcacagcagua

SEQ ID NO: 1561290 - RNA, 14 nt, Human adenovirus D
cugcugccgcucag

SEQ ID NO: 1561291 - RNA, 19 nt, Human adenovirus D
cgcgucgcuguccacgagc

SEQ ID NO: 1561292 - RNA, 19 nt, Human adenovirus D
aaucaauguaacuaaacuu

SEQ ID NO: 1561293 - RNA, 21 nt, Human adenovirus D
gagcagugucuggagcgggcu

SEQ ID NO: 1561294 - RNA, 18 nt, Human adenovirus D
gagcuugcccuuggaaga

SEQ ID NO: 1561295 - RNA, 13 nt, Human adenovirus D
cuuaguuuaaaag

SEQ ID NO: 1561296 - RNA, 13 nt, Human adenovirus D
gagcucacccacu

SEQ ID NO: 1561297 - RNA, 15 nt, Human adenovirus D
ggcgcggagcuugcc

SEQ ID NO: 1561298 - RNA, 21 nt, Human adenovirus D
ccgcacuggcuuccgccgccg

SEQ ID NO: 1561299 - RNA, 22 nt, Human adenovirus D
ccccgcaggcaggacucgcaga

SEQ ID NO: 1561300 - RNA, 21 nt, Human adenovirus D
gcagcaggugcugccccaggc

SEQ ID NO: 1561301 - RNA, 14 nt, Human adenovirus D
cugcuaaagcuaau

SEQ ID NO: 1561302 - RNA, 18 nt, Human adenovirus D
cagcagagucgaggucag

SEQ ID NO: 1561303 - RNA, 18 nt, Human adenovirus D
ggugacgguaagcacgag

SEQ ID NO: 1561304 - RNA, 17 nt, Human adenovirus D
agcgaugagcagcuugc

SEQ ID NO: 1561305 - RNA, 21 nt, Human adenovirus D
cugguugacaaauggagccag

SEQ ID NO: 1561306 - RNA, 17 nt, Human adenovirus D
cgcccgggagagcugcg

SEQ ID NO: 1561307 - RNA, 14 nt, Human adenovirus D
gcgacgcggcggcg

SEQ ID NO: 1561308 - RNA, 18 nt, Human adenovirus D
aggguccgcgugagggug

SEQ ID NO: 1561309 - RNA, 17 nt, Human adenovirus D
cagcugccgucgucccg

SEQ ID NO: 1561310 - RNA, 22 nt, Human adenovirus D
gccucgagcuacaugcccagca

SEQ ID NO: 1561311 - RNA, 15 nt, Human adenovirus D
cacuacucagcuucu

SEQ ID NO: 1561312 - RNA, 15 nt, Human adenovirus D
agcugcgcgagggcc

SEQ ID NO: 1561313 - RNA, 18 nt, Human adenovirus D
ccaggucaaaacccacuc

SEQ ID NO: 1561314 - RNA, 13 nt, Human adenovirus D
augcuccugggug

SEQ ID NO: 1561315 - RNA, 17 nt, Human adenovirus D
cgccgccgugcgcacca

SEQ ID NO: 1561316 - RNA, 15 nt, Human adenovirus D
gagcgccuuaccugg

SEQ ID NO: 1561317 - RNA, 22 nt, Human adenovirus D
augcccagcagcagcaguagcc

SEQ ID NO: 1561318 - RNA, 22 nt, Human adenovirus D
agggucgcuggcugcuggagcu

SEQ ID NO: 1561319 - RNA, 17 nt, Human adenovirus D
gcaguugggaccggugc

SEQ ID NO: 1561320 - RNA, 17 nt, Human adenovirus D
cuucucccaaguucaaa

SEQ ID NO: 1561321 - RNA, 21 nt, Human adenovirus D
cuggaagccaugcugcgcaac

SEQ ID NO: 1561322 - RNA, 23 nt, Human adenovirus D
accagguccacgcugguggccac

SEQ ID NO: 1561323 - RNA, 17 nt, Human adenovirus D
ucgcgccacuggccacg

SEQ ID NO: 1561324 - RNA, 19 nt, Human adenovirus D
ccuggccgaccggagcgaa

SEQ ID NO: 1561325 - RNA, 21 nt, Human adenovirus D
cgagcgggaccggggaggcac

SEQ ID NO: 1561326 - RNA, 12 nt, Human adenovirus D
ucuuccuggggc

SEQ ID NO: 1561327 - RNA, 18 nt, Human adenovirus D
augacggguugcaggugg

SEQ ID NO: 1561328 - RNA, 18 nt, Human adenovirus D
gcugucuuaccagcucuu

SEQ ID NO: 1561329 - RNA, 16 nt, Human adenovirus D
agcgacgaccugggcg

SEQ ID NO: 1561330 - RNA, 22 nt, Human adenovirus D
ccgcaggaguccaccgcuccgc

SEQ ID NO: 1561331 - RNA, 14 nt, Human adenovirus D
ucuaccgucgccac

SEQ ID NO: 1561332 - RNA, 17 nt, Human adenovirus D
caggcgacccuggaggu

SEQ ID NO: 1561333 - RNA, 13 nt, Human adenovirus D
acuuggggaacuu

SEQ ID NO: 1561334 - RNA, 14 nt, Human adenovirus D
cgacgccccugagc

SEQ ID NO: 1561335 - RNA, 18 nt, Human adenovirus D
cgcgcuggggagggccac

SEQ ID NO: 1561336 - RNA, 16 nt, Human adenovirus D
gagccucccaggaggc

SEQ ID NO: 1561337 - RNA, 12 nt, Human adenovirus D
ccuucauaauag

SEQ ID NO: 1561338 - RNA, 19 nt, Human adenovirus D
auguuauucagcagcccau

SEQ ID NO: 1561339 - RNA, 19 nt, Human adenovirus D
cgcugaaaggcgggcugcc

SEQ ID NO: 1561340 - RNA, 19 nt, Human adenovirus D
ucauccagaauucaaccac

SEQ ID NO: 1561341 - RNA, 19 nt, Human adenovirus D
gagauagcaguugaccaug

SEQ ID NO: 1561342 - RNA, 23 nt, Human adenovirus D
ucacacuuaguucagcugcaaug

SEQ ID NO: 1561343 - RNA, 21 nt, Human adenovirus D
cagacgcacgggccgccgggc

SEQ ID NO: 1561344 - RNA, 17 nt, Human adenovirus D
cagucauagcaggggcg

SEQ ID NO: 1561345 - RNA, 13 nt, Human adenovirus D
gcgugcaggcgcc

SEQ ID NO: 1561346 - RNA, 13 nt, Human adenovirus D
caucauggcccug

SEQ ID NO: 1561347 - RNA, 16 nt, Human adenovirus D
ugcagcccccuccggu

SEQ ID NO: 1561348 - RNA, 18 nt, Human adenovirus D
ccucuugcagcuggccaa

SEQ ID NO: 1561349 - RNA, 19 nt, Human adenovirus D
cucugcgcucgcucacccg

SEQ ID NO: 1561350 - RNA, 22 nt, Human adenovirus D
gccuugauuuuuccagcccagg

SEQ ID NO: 1561351 - RNA, 17 nt, Human adenovirus D
cggcccuggcugguggu

SEQ ID NO: 1561352 - RNA, 14 nt, Human adenovirus D
uccggucuagcauc

SEQ ID NO: 1561353 - RNA, 17 nt, Human adenovirus D
acaacaagauucaauaa

SEQ ID NO: 1561354 - RNA, 12 nt, Human adenovirus D
acucccuucuca

SEQ ID NO: 1561355 - RNA, 20 nt, Human adenovirus D
ccggggcggaguggccucuc

SEQ ID NO: 1561356 - RNA, 19 nt, Human adenovirus D
gcuuggucuuucuggcuug

SEQ ID NO: 1561357 - RNA, 23 nt, Human adenovirus D
cagcgccccgaggacacccggcc

SEQ ID NO: 1561358 - RNA, 14 nt, Human adenovirus D
cacccucaggcgca

SEQ ID NO: 1561359 - RNA, 16 nt, Human adenovirus D
cgcccgagcucugcug

SEQ ID NO: 1561360 - RNA, 16 nt, Human adenovirus D
cgcgcccgcagcacgc

SEQ ID NO: 1561361 - RNA, 16 nt, Human adenovirus D
acguccauggcgcagu

SEQ ID NO: 1561362 - RNA, 18 nt, Human adenovirus D
caggaggcggugcgcacg

SEQ ID NO: 1561363 - RNA, 14 nt, Human adenovirus D
ggucaccuuggcuu

SEQ ID NO: 1561364 - RNA, 15 nt, Human adenovirus D
agguaguugagggug

SEQ ID NO: 1561365 - RNA, 17 nt, Human adenovirus D
cgcuggggcugcucggc

SEQ ID NO: 1561366 - RNA, 11 nt, Human adenovirus D
ugacccugcau

SEQ ID NO: 1561367 - RNA, 15 nt, Human adenovirus D
gcaucuuccuggggc

SEQ ID NO: 1561368 - RNA, 21 nt, Human adenovirus D
ccgccgcuguggagccacugc

SEQ ID NO: 1561369 - RNA, 19 nt, Human adenovirus D
caggcgccauucggagcac

SEQ ID NO: 1561370 - RNA, 21 nt, Human adenovirus D
ugcuccaaagcuagcacccaa

SEQ ID NO: 1561371 - RNA, 13 nt, Human adenovirus D
gcacccaccacag

SEQ ID NO: 1561372 - RNA, 20 nt, Human adenovirus D
ccgacuaggaagugcggcgg

SEQ ID NO: 1561373 - RNA, 21 nt, Human adenovirus D
uccagcagcaggguacccacu

SEQ ID NO: 1561374 - RNA, 21 nt, Human adenovirus D
ggcgcaagcucaugcuggccg

SEQ ID NO: 1561375 - RNA, 22 nt, Human adenovirus D
cgcagaucugcaucucccaggc

SEQ ID NO: 1561376 - RNA, 12 nt, Human adenovirus D
cacucuauuuuc

SEQ ID NO: 1561377 - RNA, 21 nt, Human adenovirus D
uggcgaucgugaacgcgcugg

SEQ ID NO: 1561378 - RNA, 15 nt, Human adenovirus D
ggcgggcagggagcu

SEQ ID NO: 1561379 - RNA, 13 nt, Human adenovirus D
acaacagccgcag

SEQ ID NO: 1561380 - RNA, 14 nt, Human adenovirus D
gcagguggcgccgg

SEQ ID NO: 1561381 - RNA, 23 nt, Human adenovirus D
gagcacgagcaagacgcaggcca

SEQ ID NO: 1561382 - RNA, 14 nt, Human adenovirus D
cgcgcgccgcgccg

SEQ ID NO: 1561383 - RNA, 20 nt, Human adenovirus D
gacacugcagggagccaggg

SEQ ID NO: 1561384 - RNA, 12 nt, Human adenovirus D
acaaggccugga

SEQ ID NO: 1561385 - RNA, 19 nt, Human adenovirus D
ugcacgagaaccgccuggg

SEQ ID NO: 1561386 - RNA, 23 nt, Human adenovirus D
uggcuauuuucacugaaggaaaa

SEQ ID NO: 1561387 - RNA, 17 nt, Human adenovirus D
ccaggcagugcagcgcg

SEQ ID NO: 1561388 - RNA, 16 nt, Human adenovirus D
cccgauggucgcugga

SEQ ID NO: 1561389 - RNA, 22 nt, Human adenovirus D
acgcgcuccucgcucuggggcc

SEQ ID NO: 1561390 - RNA, 21 nt, Human adenovirus D
ccccggacgucaccugcggcg

SEQ ID NO: 1561391 - RNA, 16 nt, Human adenovirus D
uguuguagaugaucca

SEQ ID NO: 1561392 - RNA, 15 nt, Human adenovirus D
augaaggcuuucaca

SEQ ID NO: 1561393 - RNA, 18 nt, Human adenovirus D
ggacuucgcagccaugca

SEQ ID NO: 1561394 - RNA, 21 nt, Human adenovirus D
ccgcaccgccacccgccgccg

SEQ ID NO: 1561395 - RNA, 15 nt, Human adenovirus D
ccgcccgccgccagg

SEQ ID NO: 1561396 - RNA, 20 nt, Human adenovirus D
cccggacguggugcugcugc

SEQ ID NO: 1561397 - RNA, 13 nt, Human adenovirus D
cggguucuggaga

SEQ ID NO: 1561398 - RNA, 16 nt, Human adenovirus D
gguacuuuacgcuggc

SEQ ID NO: 1561399 - RNA, 17 nt, Human adenovirus D
cuugaaaucgcaguugg

SEQ ID NO: 1561400 - RNA, 21 nt, Human adenovirus D
cauccgucccgacgaggccgg

SEQ ID NO: 1561401 - RNA, 19 nt, Human adenovirus D
cagagagccgccugagcaa

SEQ ID NO: 1561402 - RNA, 15 nt, Human adenovirus D
uggcgugcuggagag

SEQ ID NO: 1561403 - RNA, 21 nt, Human adenovirus D
gaccugcagcaggugcugccc

SEQ ID NO: 1561404 - RNA, 21 nt, Human adenovirus D
caugggaggaagcaacaucac

SEQ ID NO: 1561405 - RNA, 16 nt, Human adenovirus D
cucggccauucuggag

SEQ ID NO: 1561406 - RNA, 18 nt, Human adenovirus D
uaaccaucgaaaccagau

SEQ ID NO: 1561407 - RNA, 16 nt, Human adenovirus D
gccggcgcuagccagc

SEQ ID NO: 1561408 - RNA, 20 nt, Human adenovirus D
agugccuuuaucagcacugc

SEQ ID NO: 1561409 - RNA, 21 nt, Human adenovirus D
cugaagcccgugaccugcagc

SEQ ID NO: 1561410 - RNA, 22 nt, Human adenovirus D
cucgcagaucugcaucucccag

SEQ ID NO: 1561411 - RNA, 14 nt, Human adenovirus D
cuggcuggucaggc

SEQ ID NO: 1561412 - RNA, 13 nt, Human adenovirus D
gugaaaacgugcc

SEQ ID NO: 1561413 - RNA, 17 nt, Human adenovirus D
gcuagcccuuccuggac

SEQ ID NO: 1561414 - RNA, 14 nt, Human adenovirus D
ugcaacccccagcu

SEQ ID NO: 1561415 - RNA, 16 nt, Human adenovirus D
auuugacaacccgccu

SEQ ID NO: 1561416 - RNA, 20 nt, Human adenovirus D
cgcagucuccaacgccugcg

SEQ ID NO: 1561417 - RNA, 16 nt, Human adenovirus D
cucaacgcccaggcaa

SEQ ID NO: 1561418 - RNA, 21 nt, Human adenovirus D
acuugcaaguggggcggcaaa

SEQ ID NO: 1561419 - RNA, 21 nt, Human adenovirus D
acagccuugcccccaagggcg

SEQ ID NO: 1561420 - RNA, 12 nt, Human adenovirus D
ccacugcauggc

SEQ ID NO: 1561421 - RNA, 18 nt, Human adenovirus D
gaugaaccuuuggaccug

SEQ ID NO: 1561422 - RNA, 14 nt, Human adenovirus D
gccagccgcaggcg

SEQ ID NO: 1561423 - RNA, 18 nt, Human adenovirus D
aauauggccuggagcaga

SEQ ID NO: 1561424 - RNA, 14 nt, Human adenovirus D
ugcacgcgggugag

SEQ ID NO: 1561425 - RNA, 22 nt, Human adenovirus D
gagauggugggccguuggaaga

SEQ ID NO: 1561426 - RNA, 15 nt, Human adenovirus D
uuuauggcugcugga

SEQ ID NO: 1561427 - RNA, 14 nt, Human adenovirus D
uggccaggggagug

SEQ ID NO: 1561428 - RNA, 13 nt, Human adenovirus D
ggaagagugccca

SEQ ID NO: 1561429 - RNA, 13 nt, Human adenovirus D
uacuccagucucc

SEQ ID NO: 1561430 - RNA, 17 nt, Human adenovirus D
uccgcggaguccagcga

SEQ ID NO: 1561431 - RNA, 14 nt, Human adenovirus D
aggcauggcaggca

SEQ ID NO: 1561432 - RNA, 19 nt, Human adenovirus D
caacgauuucacccccgcc

SEQ ID NO: 1561433 - RNA, 15 nt, Human adenovirus D
ugcgagaaggcgccc

SEQ ID NO: 1561434 - RNA, 19 nt, Human adenovirus D
acuggaaacucuuggagca

SEQ ID NO: 1561435 - RNA, 13 nt, Human adenovirus D
gcagcccuucucc

SEQ ID NO: 1561436 - RNA, 19 nt, Human adenovirus D
ccucaucacaucagccagg

SEQ ID NO: 1561437 - RNA, 17 nt, Human adenovirus D
gguggcccugggccuga

SEQ ID NO: 1561438 - RNA, 18 nt, Human adenovirus D
ggugcuccggguucugga

SEQ ID NO: 1561439 - RNA, 19 nt, Human adenovirus D
uccagggucucaggguccg

SEQ ID NO: 1561440 - RNA, 15 nt, Human adenovirus D
cacccccgcgugcag

SEQ ID NO: 1561441 - RNA, 22 nt, Human adenovirus D
agcgcgcgucauggcuggucag

SEQ ID NO: 1561442 - RNA, 20 nt, Human adenovirus D
caccagccgcaccgcggcgu

SEQ ID NO: 1561443 - RNA, 19 nt, Human adenovirus D
acgccucggaguaccugag

SEQ ID NO: 1561444 - RNA, 19 nt, Human adenovirus D
gaaucuugaacuacuggcu

SEQ ID NO: 1561445 - RNA, 18 nt, Human adenovirus D
acccggcccguggucagc

SEQ ID NO: 1561446 - RNA, 11 nt, Human adenovirus D
acauggcaagc

SEQ ID NO: 1561447 - RNA, 21 nt, Human adenovirus D
auccuccgggacgcccuggcc

SEQ ID NO: 1561448 - RNA, 16 nt, Human adenovirus D
acuaaugacaaacaaa

SEQ ID NO: 1561449 - RNA, 12 nt, Human adenovirus D
agggagccaggg

SEQ ID NO: 1561450 - RNA, 21 nt, Human adenovirus D
ugcugacauccauggccaggg

SEQ ID NO: 1561451 - RNA, 22 nt, Human adenovirus D
ugcacuggcccgaccgacccau

SEQ ID NO: 1561452 - RNA, 19 nt, Human adenovirus D
aguuauggucugcuccugc

SEQ ID NO: 1561453 - RNA, 21 nt, Human adenovirus D
ccaccccuuacauguggagcu

SEQ ID NO: 1561454 - RNA, 18 nt, Human adenovirus D
cuuaagaaagacacaaaa

SEQ ID NO: 1561455 - RNA, 16 nt, Human adenovirus D
caugcaccuguggagg

SEQ ID NO: 1561456 - RNA, 22 nt, Human adenovirus D
ggaacuaaucauuuaauaaaga

SEQ ID NO: 1561457 - RNA, 15 nt, Human adenovirus D
ucaaaaacaaaguga

SEQ ID NO: 1561458 - RNA, 21 nt, Human adenovirus D
caggagggggccacucccagc

SEQ ID NO: 1561459 - RNA, 20 nt, Human adenovirus D
agcaccucgguacccuccuc

SEQ ID NO: 1561460 - RNA, 19 nt, Human adenovirus D
uccgcgguauauggcuccu

SEQ ID NO: 1561461 - RNA, 13 nt, Human adenovirus D
gccuaccccgccg

SEQ ID NO: 1561462 - RNA, 16 nt, Human adenovirus D
guauugugggccuggg

SEQ ID NO: 1561463 - RNA, 17 nt, Human adenovirus D
uccaguaggaaccagca

SEQ ID NO: 1561464 - RNA, 21 nt, Human adenovirus D
ccagauguugcgcagcggcag

SEQ ID NO: 1561465 - RNA, 13 nt, Human adenovirus D
gcuguccacgggg

SEQ ID NO: 1561466 - RNA, 14 nt, Human adenovirus D
accugcggggcgau

SEQ ID NO: 1561467 - RNA, 18 nt, Human adenovirus D
gccacggucaccgagccu

SEQ ID NO: 1561468 - RNA, 13 nt, Human adenovirus D
ggaucgccaggcc

SEQ ID NO: 1561469 - RNA, 15 nt, Human adenovirus D
ggguuaggccgcgcg

SEQ ID NO: 1561470 - RNA, 13 nt, Human adenovirus D
agagccggcgggc

SEQ ID NO: 1561471 - RNA, 15 nt, Human adenovirus D
ccaccagggagcuga

SEQ ID NO: 1561472 - RNA, 23 nt, Human adenovirus D
gucaucaccuuccugcagcucau

SEQ ID NO: 1561473 - RNA, 12 nt, Human adenovirus D
aagcgccguggc

SEQ ID NO: 1561474 - RNA, 12 nt, Human adenovirus D
cccagaacuggc

SEQ ID NO: 1561475 - RNA, 20 nt, Human adenovirus D
gucucgcacucgacgagcca

SEQ ID NO: 1561476 - RNA, 22 nt, Human adenovirus D
ucacacuacacagcuagacacc

SEQ ID NO: 1561477 - RNA, 20 nt, Human adenovirus D
caugaaguucaauggagaga

SEQ ID NO: 1561478 - RNA, 12 nt, Human adenovirus D
aggcccagcagc

SEQ ID NO: 1561479 - RNA, 21 nt, Human adenovirus D
guccucugaaaagucauccaa

SEQ ID NO: 1561480 - RNA, 21 nt, Human adenovirus D
caggggcucguuaguccagca

SEQ ID NO: 1561481 - RNA, 23 nt, Human adenovirus D
cgagcucaaccucuucucgccgc

SEQ ID NO: 1561482 - RNA, 16 nt, Human adenovirus D
gcgucgcugaaagcau

SEQ ID NO: 1561483 - RNA, 16 nt, Human adenovirus D
cgcucucguuccagac

SEQ ID NO: 1561484 - RNA, 15 nt, Human adenovirus D
cgcugcugcagccgc

SEQ ID NO: 1561485 - RNA, 17 nt, Human adenovirus D
ugcaacaugaccaagga

SEQ ID NO: 1561486 - RNA, 19 nt, Human adenovirus D
caguccaaccuggaccggc

SEQ ID NO: 1561487 - RNA, 21 nt, Human adenovirus D
cggcaguuucgcacgccucgc

SEQ ID NO: 1561488 - RNA, 19 nt, Human adenovirus D
cccauggacgggaacccca

SEQ ID NO: 1561489 - RNA, 14 nt, Human adenovirus D
ggccgagaccguga

SEQ ID NO: 1561490 - RNA, 14 nt, Human adenovirus D
ucaucuugcacagu

SEQ ID NO: 1561491 - RNA, 23 nt, Human adenovirus D
acggcaugggaugcgugagggcg

SEQ ID NO: 1561492 - RNA, 14 nt, Human adenovirus D
agauggugggccgu

SEQ ID NO: 1561493 - RNA, 19 nt, Human adenovirus D
ugcaccuguggagggcaug

SEQ ID NO: 1561494 - RNA, 17 nt, Human adenovirus D
ugagaccaaguccaggg

SEQ ID NO: 1561495 - RNA, 13 nt, Human adenovirus D
caguaguccagcg

SEQ ID NO: 1561496 - RNA, 18 nt, Human adenovirus D
cggccgcggcgagcggga

SEQ ID NO: 1561497 - RNA, 17 nt, Human adenovirus D
cagcauugucugccugg

SEQ ID NO: 1561498 - RNA, 12 nt, Human adenovirus D
gcuggccagcac

SEQ ID NO: 1561499 - RNA, 18 nt, Human adenovirus D
ucccucgggccccggggc

SEQ ID NO: 1561500 - RNA, 13 nt, Human adenovirus D
ccgcagcucuucc

SEQ ID NO: 1561501 - RNA, 19 nt, Human adenovirus D
cucugccacacauggcaag

SEQ ID NO: 1561502 - RNA, 16 nt, Human adenovirus D
accgccgccggcggcg

SEQ ID NO: 1561503 - RNA, 16 nt, Human adenovirus D
acaaggcccugggcau

SEQ ID NO: 1561504 - RNA, 15 nt, Human adenovirus D
agcgccaacagcagc

SEQ ID NO: 1561505 - RNA, 18 nt, Human adenovirus D
uugagaauaacaugcuga

SEQ ID NO: 1561506 - RNA, 21 nt, Human adenovirus D
gcgagcugaugcugagccugc

SEQ ID NO: 1561507 - RNA, 18 nt, Human adenovirus D
gccucggaguaccugagc

SEQ ID NO: 1561508 - RNA, 14 nt, Human adenovirus D
ucuuuccagcagca

SEQ ID NO: 1561509 - RNA, 19 nt, Human adenovirus D
ugagcgggcucuuccuccg

SEQ ID NO: 1561510 - RNA, 22 nt, Human adenovirus D
ggccaccucgccgcgcaggggc

SEQ ID NO: 1561511 - RNA, 21 nt, Human adenovirus D
gauucaauaagguucugcccu

SEQ ID NO: 1561512 - RNA, 22 nt, Human adenovirus D
aagucacuuaaguccugggcca

SEQ ID NO: 1561513 - RNA, 19 nt, Human adenovirus D
acccagaucccgccggggg

SEQ ID NO: 1561514 - RNA, 23 nt, Human adenovirus D
agucgaggucagcagcaagagcu

SEQ ID NO: 1561515 - RNA, 16 nt, Human adenovirus D
agugauuggggaaccu

SEQ ID NO: 1561516 - RNA, 12 nt, Human adenovirus D
ccggcugaugcc

SEQ ID NO: 1561517 - RNA, 16 nt, Human adenovirus D
cacuggagcacagacc

SEQ ID NO: 1561518 - RNA, 19 nt, Human adenovirus D
uaucaugcaacuuggaagg

SEQ ID NO: 1561519 - RNA, 14 nt, Human adenovirus D
gcgugcagcugcag

SEQ ID NO: 1561520 - RNA, 20 nt, Human adenovirus D
gcggcagcuuuuugagcucc

SEQ ID NO: 1561521 - RNA, 22 nt, Human adenovirus D
ccagcagcagcaguagccccuc

SEQ ID NO: 1561522 - RNA, 18 nt, Human adenovirus D
aaagcaguucacuagccu

SEQ ID NO: 1561523 - RNA, 15 nt, Human adenovirus D
ugacucggcugagcu

SEQ ID NO: 1561524 - RNA, 14 nt, Human adenovirus D
gcgcuggcuuggua

SEQ ID NO: 1561525 - RNA, 19 nt, Human adenovirus D
ggucucccccagcaugccg

SEQ ID NO: 1561526 - RNA, 19 nt, Human adenovirus D
cauccuggaccaggcggca

SEQ ID NO: 1561527 - RNA, 19 nt, Human adenovirus D
guaaagaaacagaacaaaa

SEQ ID NO: 1561528 - RNA, 17 nt, Human adenovirus D
gcggccguucaugggca

SEQ ID NO: 1561529 - RNA, 18 nt, Human adenovirus D
cgcaaccaggaggagcuc

SEQ ID NO: 1561530 - RNA, 15 nt, Human adenovirus D
gcagccgcggcagcc

SEQ ID NO: 1561531 - RNA, 17 nt, Human adenovirus D
auggccuggagcagaua

SEQ ID NO: 1561532 - RNA, 21 nt, Human adenovirus D
gacgcagccggcgaacgugcc

SEQ ID NO: 1561533 - RNA, 17 nt, Human adenovirus D
gcagugucucgaggacg

SEQ ID NO: 1561534 - RNA, 18 nt, Human adenovirus D
cacagcaguccaugccca

SEQ ID NO: 1561535 - RNA, 14 nt, Human adenovirus D
ucacagucuggugg

SEQ ID NO: 1561536 - RNA, 21 nt, Human adenovirus D
acaguuauaccaccuccuccu

SEQ ID NO: 1561537 - RNA, 18 nt, Human adenovirus D
auccuugcagacuuuagc

SEQ ID NO: 1561538 - RNA, 15 nt, Human adenovirus D
ucccaccgcgccgcc

SEQ ID NO: 1561539 - RNA, 15 nt, Human adenovirus D
ugcgaguuggaggag

SEQ ID NO: 1561540 - RNA, 16 nt, Human adenovirus D
caaucgccacaggugc

SEQ ID NO: 1561541 - RNA, 16 nt, Human adenovirus D
cguguaccgcaacgac

SEQ ID NO: 1561542 - RNA, 18 nt, Human adenovirus D
ccugcaggggcgucccgc

SEQ ID NO: 1561543 - RNA, 16 nt, Human adenovirus D
uacaacgcccugcugg

SEQ ID NO: 1561544 - RNA, 21 nt, Human adenovirus D
cucaggaccauagggagccug

SEQ ID NO: 1561545 - RNA, 19 nt, Human adenovirus D
ggcgcugcaaagccagccg

SEQ ID NO: 1561546 - RNA, 21 nt, Human adenovirus D
cagagauggacuuggaagagg

SEQ ID NO: 1561547 - RNA, 13 nt, Human adenovirus D
ucuaccugcgcac

SEQ ID NO: 1561548 - RNA, 12 nt, Human adenovirus D
cgacuguagggc

SEQ ID NO: 1561549 - RNA, 21 nt, Human adenovirus D
gaucaucuccccgcggcggcg

SEQ ID NO: 1561550 - RNA, 19 nt, Human adenovirus D
ucggcgcuuggugggcaga

SEQ ID NO: 1561551 - RNA, 20 nt, Human adenovirus D
ccgcgcgggagccaggucca

SEQ ID NO: 1561552 - RNA, 15 nt, Human adenovirus D
guucugggucaccuu

SEQ ID NO: 1561553 - RNA, 22 nt, Human adenovirus D
gcagccgugaucccacagggca

SEQ ID NO: 1561554 - RNA, 16 nt, Human adenovirus D
accuugcuuccacacu

SEQ ID NO: 1561555 - RNA, 17 nt, Human adenovirus D
aguuuacccugcccgag

SEQ ID NO: 1561556 - RNA, 20 nt, Human adenovirus D
gaugccggcagcgguggugg

SEQ ID NO: 1561557 - RNA, 19 nt, Human adenovirus D
gccgacccguggccccggg

SEQ ID NO: 1561558 - RNA, 22 nt, Human adenovirus D
gcugccgcuggacgagagcaau

SEQ ID NO: 1561559 - RNA, 15 nt, Human adenovirus D
ggucgucgccccgga

SEQ ID NO: 1561560 - RNA, 20 nt, Human adenovirus D
gacucgcugcugcagccgcc

SEQ ID NO: 1561561 - RNA, 14 nt, Human adenovirus D
gagggcauggguca

SEQ ID NO: 1561562 - RNA, 17 nt, Human adenovirus D
cgcgcucgcgcaccugc

SEQ ID NO: 1561563 - RNA, 22 nt, Human adenovirus D
cuccgagcagcgcauccugcaa

SEQ ID NO: 1561564 - RNA, 15 nt, Human adenovirus D
aucaagacaaaauuc

SEQ ID NO: 1561565 - RNA, 22 nt, Human adenovirus D
ugaagagaaucuugccugcucg

SEQ ID NO: 1561566 - RNA, 17 nt, Human adenovirus D
caggucaaaacccacuc

SEQ ID NO: 1561567 - RNA, 18 nt, Human adenovirus D
gucacuuaaguccugggc

SEQ ID NO: 1561568 - RNA, 20 nt, Human adenovirus D
cacuuucauaaucaggcaga

SEQ ID NO: 1561569 - RNA, 19 nt, Human adenovirus D
guauaaguguaagagcaag

SEQ ID NO: 1561570 - RNA, 22 nt, Human adenovirus D
cgcuccaugaaccggcgcacgu

SEQ ID NO: 1561571 - RNA, 18 nt, Human adenovirus D
auucagggugcuccagcc

SEQ ID NO: 1561572 - RNA, 19 nt, Human adenovirus D
gugaggguguccuggaagu

SEQ ID NO: 1561573 - RNA, 15 nt, Human adenovirus D
aggagcaggaggagg

SEQ ID NO: 1561574 - RNA, 16 nt, Human adenovirus D
aggagcgaugggggca

SEQ ID NO: 1561575 - RNA, 22 nt, Human adenovirus D
cggcacccgguacuacgccagc

SEQ ID NO: 1561576 - RNA, 18 nt, Human adenovirus D
gcugauugcucuggccug

SEQ ID NO: 1561577 - RNA, 17 nt, Human adenovirus D
agaccgacgcugggcuc

SEQ ID NO: 1561578 - RNA, 20 nt, Human adenovirus D
cggcguaguugcgcaggcgc

SEQ ID NO: 1561579 - RNA, 15 nt, Human adenovirus D
cauccuggaccaggc

SEQ ID NO: 1561580 - RNA, 18 nt, Human adenovirus D
aucauuauuuucauaugc

SEQ ID NO: 1561581 - RNA, 19 nt, Human adenovirus D
augaccaugcagacucugc

SEQ ID NO: 1561582 - RNA, 15 nt, Human adenovirus D
gcgucgacggggaag

SEQ ID NO: 1561583 - RNA, 15 nt, Human adenovirus D
aaagaaacagcagag

SEQ ID NO: 1561584 - RNA, 21 nt, Human adenovirus D
ggcggaccugcauuggcagcc

SEQ ID NO: 1561585 - RNA, 15 nt, Human adenovirus D
guagagguagcggga

SEQ ID NO: 1561586 - RNA, 18 nt, Human adenovirus D
agcaggguaaagccagca

SEQ ID NO: 1561587 - RNA, 13 nt, Human adenovirus D
cgggccuacgagc

SEQ ID NO: 1561588 - RNA, 23 nt, Human adenovirus D
gacgcggcgguugacauccugga

SEQ ID NO: 1561589 - RNA, 20 nt, Human adenovirus D
cugccgcugcaaccugugcu

SEQ ID NO: 1561590 - RNA, 13 nt, Human adenovirus D
gcucagcugccau

SEQ ID NO: 1561591 - RNA, 14 nt, Human adenovirus D
gugaugccuuccaa

SEQ ID NO: 1561592 - RNA, 21 nt, Human adenovirus D
agcagacggugaagcaggagc

SEQ ID NO: 1561593 - RNA, 16 nt, Human adenovirus D
auaggccaggcgcagg

SEQ ID NO: 1561594 - RNA, 23 nt, Human adenovirus D
cgcagugcacgggcaucagcauc

SEQ ID NO: 1561595 - RNA, 17 nt, Human adenovirus D
aggaucauaucccaggg

SEQ ID NO: 1561596 - RNA, 22 nt, Human adenovirus D
uagugggcguggcuaaggugac

SEQ ID NO: 1561597 - RNA, 13 nt, Human adenovirus D
auuugaaaccacu

SEQ ID NO: 1561598 - RNA, 17 nt, Human adenovirus D
cacugaaaauuugcaaa

SEQ ID NO: 1561599 - RNA, 11 nt, Human adenovirus D
cagaacaaaaa

SEQ ID NO: 1561600 - RNA, 17 nt, Human adenovirus D
caccucaacgcccaggc

SEQ ID NO: 1561601 - RNA, 20 nt, Human adenovirus D
ccucgagcuacaugcccagc

SEQ ID NO: 1561602 - RNA, 15 nt, Human adenovirus D
cugcaacccccagcu

SEQ ID NO: 1561603 - RNA, 14 nt, Human adenovirus D
uuuaauuggcaaac

SEQ ID NO: 1561604 - RNA, 14 nt, Human adenovirus D
gcggccgcggccag

SEQ ID NO: 1561605 - RNA, 16 nt, Human adenovirus D
cugaaccgcuggaaga

SEQ ID NO: 1561606 - RNA, 21 nt, Human adenovirus D
cgcuccaugcuucugggcaac

SEQ ID NO: 1561607 - RNA, 12 nt, Human adenovirus D
accuccugggca

SEQ ID NO: 1561608 - RNA, 19 nt, Human adenovirus D
ggaggcggugcgcacgccc

SEQ ID NO: 1561609 - RNA, 20 nt, Human adenovirus D
ccugcagcccaaacuggggc

SEQ ID NO: 1561610 - RNA, 18 nt, Human adenovirus D
gaagagccggcucgucua

SEQ ID NO: 1561611 - RNA, 23 nt, Human adenovirus D
acuugcaaacaauaaaaaacuug

SEQ ID NO: 1561612 - RNA, 19 nt, Human adenovirus D
ggucaucaccuuccugcag

SEQ ID NO: 1561613 - RNA, 15 nt, Human adenovirus D
gucgaggagaccugc

SEQ ID NO: 1561614 - RNA, 21 nt, Human adenovirus D
aacuacuugcaaguggggcgg

SEQ ID NO: 1561615 - RNA, 22 nt, Human adenovirus D
gaacuccucuaucucgccuggu

SEQ ID NO: 1561616 - RNA, 13 nt, Human adenovirus D
gcccgagggcaac

SEQ ID NO: 1561617 - RNA, 13 nt, Human adenovirus D
gaaaauuugcaaa

SEQ ID NO: 1561618 - RNA, 14 nt, Human adenovirus D
uugggaagaacugg

SEQ ID NO: 1561619 - RNA, 18 nt, Human adenovirus D
guagacaaagagcacagc

SEQ ID NO: 1561620 - RNA, 14 nt, Human adenovirus D
ucccggccaaggcc

SEQ ID NO: 1561621 - RNA, 20 nt, Human adenovirus D
aaccugagccaggcuuucaa

SEQ ID NO: 1561622 - RNA, 23 nt, Human adenovirus D
acagcaccgccgcagccgcggca

SEQ ID NO: 1561623 - RNA, 15 nt, Human adenovirus D
ucagccauagcucag

SEQ ID NO: 1561624 - RNA, 18 nt, Human adenovirus D
gacccaggaauggcacgc

SEQ ID NO: 1561625 - RNA, 20 nt, Human adenovirus D
gcuagaaaacacccacaggg

SEQ ID NO: 1561626 - RNA, 17 nt, Human adenovirus D
gguagagcggccagcgc

SEQ ID NO: 1561627 - RNA, 15 nt, Human adenovirus D
cgagaccagaggcag

SEQ ID NO: 1561628 - RNA, 13 nt, Human adenovirus D
gcaacuuccagcc

SEQ ID NO: 1561629 - RNA, 14 nt, Human adenovirus D
cauagucaucaccc

SEQ ID NO: 1561630 - RNA, 13 nt, Human adenovirus D
cggcgggccaugc

SEQ ID NO: 1561631 - RNA, 20 nt, Human adenovirus D
ccccaucccggccaaggcca

SEQ ID NO: 1561632 - RNA, 21 nt, Human adenovirus D
gaagggcucggucgggacgag

SEQ ID NO: 1561633 - RNA, 16 nt, Human adenovirus D
caacuggucuccugcc

SEQ ID NO: 1561634 - RNA, 23 nt, Human adenovirus D
caaaaucgagcaggaccugggcu

SEQ ID NO: 1561635 - RNA, 22 nt, Human adenovirus D
uaccccgguucgaguccccucg

SEQ ID NO: 1561636 - RNA, 17 nt, Human adenovirus D
auccugaucucugccau

SEQ ID NO: 1561637 - RNA, 13 nt, Human adenovirus D
agagcgagauguc

SEQ ID NO: 1561638 - RNA, 18 nt, Human adenovirus D
aguaaauuugacacagca

SEQ ID NO: 1561639 - RNA, 20 nt, Human adenovirus D
uucucacaguaagugcagca

SEQ ID NO: 1561640 - RNA, 18 nt, Human adenovirus D
cugagauaugugcagcag

SEQ ID NO: 1561641 - RNA, 17 nt, Human adenovirus D
guaaagccagcagcaca

SEQ ID NO: 1561642 - RNA, 16 nt, Human adenovirus D
ccuggcgacgcagccg

SEQ ID NO: 1561643 - RNA, 17 nt, Human adenovirus D
ucaccuuccugcagcuc

SEQ ID NO: 1561644 - RNA, 16 nt, Human adenovirus D
ucaggagcgcagccug

SEQ ID NO: 1561645 - RNA, 17 nt, Human adenovirus D
cauccacaaggccguga

SEQ ID NO: 1561646 - RNA, 13 nt, Human adenovirus D
ccgcccugagcuc

SEQ ID NO: 1561647 - RNA, 14 nt, Human adenovirus D
ggcgcguggaggaa

SEQ ID NO: 1561648 - RNA, 17 nt, Human adenovirus D
cuacgucuacaaggccc

SEQ ID NO: 1561649 - RNA, 20 nt, Human adenovirus D
cagauccugcugcuccacca

SEQ ID NO: 1561650 - RNA, 20 nt, Human adenovirus D
ccguccgcccgcgcccacca

SEQ ID NO: 1561651 - RNA, 21 nt, Human adenovirus D
gaugcaugcggggggagauga

SEQ ID NO: 1561652 - RNA, 16 nt, Human adenovirus D
auggacuuggaagagg

SEQ ID NO: 1561653 - RNA, 17 nt, Human adenovirus D
gaagugcggcggcggcu

SEQ ID NO: 1561654 - RNA, 22 nt, Human adenovirus D
cugcagcaggugcugccccagg

SEQ ID NO: 1561655 - RNA, 13 nt, Human adenovirus D
cgccgcuaucugc

SEQ ID NO: 1561656 - RNA, 14 nt, Human adenovirus D
ccaacggcugcauc

SEQ ID NO: 1561657 - RNA, 12 nt, Human adenovirus D
ucggacuggguu

SEQ ID NO: 1561658 - RNA, 20 nt, Human adenovirus D
acaggccgcagcucuucccg

SEQ ID NO: 1561659 - RNA, 21 nt, Human adenovirus D
uaaaucauuggaacuaaucau

SEQ ID NO: 1561660 - RNA, 13 nt, Human adenovirus D
ccucggcggcgug

SEQ ID NO: 1561661 - RNA, 12 nt, Human adenovirus D
gccgcggccaga

SEQ ID NO: 1561662 - RNA, 15 nt, Human adenovirus D
ggaauuaccucaucg

SEQ ID NO: 1561663 - RNA, 12 nt, Human adenovirus D
cgcgccacuccc

SEQ ID NO: 1561664 - RNA, 20 nt, Human adenovirus D
auaagacauuuuaaugaauu

SEQ ID NO: 1561665 - RNA, 14 nt, Human adenovirus D
gcggucgcgguggg

SEQ ID NO: 1561666 - RNA, 12 nt, Human adenovirus D
gucugugccucu

SEQ ID NO: 1561667 - RNA, 18 nt, Human adenovirus D
caucaccuuccugcagcu

SEQ ID NO: 1561668 - RNA, 12 nt, Human adenovirus D
acauguggagcu

SEQ ID NO: 1561669 - RNA, 13 nt, Human adenovirus D
cugcuggagcuga

SEQ ID NO: 1561670 - RNA, 17 nt, Human adenovirus D
gugcuggaggguugaaa

SEQ ID NO: 1561671 - RNA, 17 nt, Human adenovirus D
cgggccgccgggccaug

SEQ ID NO: 1561672 - RNA, 21 nt, Human adenovirus D
caagugccacaugcaccuggg

SEQ ID NO: 1561673 - RNA, 20 nt, Human adenovirus D
gccccugcaagugcacagac

SEQ ID NO: 1561674 - RNA, 15 nt, Human adenovirus D
gcacuggagcacaga

SEQ ID NO: 1561675 - RNA, 20 nt, Human adenovirus D
aggggagugaagagggagag

SEQ ID NO: 1561676 - RNA, 14 nt, Human adenovirus D
gaagaacaggagcc

SEQ ID NO: 1561677 - RNA, 15 nt, Human adenovirus D
cgcucgcgcaccugc

SEQ ID NO: 1561678 - RNA, 16 nt, Human adenovirus D
ccugggcgccagaagg

SEQ ID NO: 1561679 - RNA, 21 nt, Human adenovirus D
cggucgacggugagcagcuug

SEQ ID NO: 1561680 - RNA, 16 nt, Human adenovirus D
cguccgucagcagcag

SEQ ID NO: 1561681 - RNA, 20 nt, Human adenovirus D
augcggggggagaugaugug

SEQ ID NO: 1561682 - RNA, 23 nt, Human adenovirus D
gaacaacgauuucacccccgccg

SEQ ID NO: 1561683 - RNA, 18 nt, Human adenovirus D
agcucgucuuccaggagc

SEQ ID NO: 1561684 - RNA, 15 nt, Human adenovirus D
ucgggccccggggcg

SEQ ID NO: 1561685 - RNA, 20 nt, Human adenovirus D
ggcccugcuggccgagcugg

SEQ ID NO: 1561686 - RNA, 24 nt, Human adenovirus D
cccagaacuggcagagcacgcugc

SEQ ID NO: 1561687 - RNA, 16 nt, Human adenovirus D
gcuaccugggaggaga

SEQ ID NO: 1561688 - RNA, 19 nt, Human adenovirus D
ucuuacgagggucuuuuug

SEQ ID NO: 1561689 - RNA, 15 nt, Human adenovirus D
gccaccuucuucccc

SEQ ID NO: 1561690 - RNA, 14 nt, Human adenovirus D
gcagaagguggugg

SEQ ID NO: 1561691 - RNA, 14 nt, Human adenovirus D
accggcagcggggc

SEQ ID NO: 1561692 - RNA, 23 nt, Human adenovirus D
ccuugucguacuucugccagcag

SEQ ID NO: 1561693 - RNA, 19 nt, Human adenovirus D
ucguccagaugcucuccca

SEQ ID NO: 1561694 - RNA, 12 nt, Human adenovirus D
gggcccgacucc

SEQ ID NO: 1561695 - RNA, 14 nt, Human adenovirus D
gaccacguccccgu

SEQ ID NO: 1561696 - RNA, 19 nt, Human adenovirus D
cugcagaguucccucggca

SEQ ID NO: 1561697 - RNA, 22 nt, Human adenovirus D
gcgcgguaggcccugguccacc

SEQ ID NO: 1561698 - RNA, 21 nt, Human adenovirus D
ggccuggagcagauaaaaacc

SEQ ID NO: 1561699 - RNA, 19 nt, Human adenovirus D
cuucuuccgcaacuuccag

SEQ ID NO: 1561700 - RNA, 21 nt, Human adenovirus D
auccacaaggccgugagcgcg

SEQ ID NO: 1561701 - RNA, 14 nt, Human adenovirus D
cacgagaaggugcu

SEQ ID NO: 1561702 - RNA, 22 nt, Human adenovirus D
ccugcgcgucgacggcgccucc

SEQ ID NO: 1561703 - RNA, 17 nt, Human adenovirus D
ucuuuaugaacaugaag

SEQ ID NO: 1561704 - RNA, 12 nt, Human adenovirus D
agccgccagcug

SEQ ID NO: 1561705 - RNA, 19 nt, Human adenovirus D
caaaauggcgugcuggaga

SEQ ID NO: 1561706 - RNA, 20 nt, Human adenovirus D
ggagcaggguaaagccagca

SEQ ID NO: 1561707 - RNA, 14 nt, Human adenovirus D
ccgcccugcuggau

SEQ ID NO: 1561708 - RNA, 15 nt, Human adenovirus D
gcgagggcgagaaca

SEQ ID NO: 1561709 - RNA, 15 nt, Human adenovirus D
gcucguucugcccac

SEQ ID NO: 1561710 - RNA, 18 nt, Human adenovirus D
ccccauggacaacgucaa

SEQ ID NO: 1561711 - RNA, 20 nt, Human adenovirus D
uacaagcgccaacagcagcg

SEQ ID NO: 1561712 - RNA, 17 nt, Human adenovirus D
cgagcaggaccugggcu

SEQ ID NO: 1561713 - RNA, 22 nt, Human adenovirus D
cagccgugaucccacagggcac

SEQ ID NO: 1561714 - RNA, 15 nt, Human adenovirus D
cggcggcgggccaug

SEQ ID NO: 1561715 - RNA, 19 nt, Human adenovirus D
ggugacucggcugagcucg

SEQ ID NO: 1561716 - RNA, 14 nt, Human adenovirus D
aggcuggagccgcg

SEQ ID NO: 1561717 - RNA, 21 nt, Human adenovirus D
uccuggaccgcggucccaguu

SEQ ID NO: 1561718 - RNA, 16 nt, Human adenovirus D
auggauuaaaaauauu

SEQ ID NO: 1561719 - RNA, 15 nt, Human adenovirus D
ucuucaacaucugug

SEQ ID NO: 1561720 - RNA, 18 nt, Human adenovirus D
gcgagaccaacggcugca

SEQ ID NO: 1561721 - RNA, 14 nt, Human adenovirus D
cccgcgacccccag

SEQ ID NO: 1561722 - RNA, 14 nt, Human adenovirus D
uguaaauaagucac

SEQ ID NO: 1561723 - RNA, 17 nt, Human adenovirus D
aggcgacaacgccaggc

SEQ ID NO: 1561724 - RNA, 16 nt, Human adenovirus D
ccagaacuuccagcag

SEQ ID NO: 1561725 - RNA, 18 nt, Human adenovirus D
acacuuaguucagcugca

SEQ ID NO: 1561726 - RNA, 20 nt, Human adenovirus D
gagaccggaggcgugcacug

SEQ ID NO: 1561727 - RNA, 14 nt, Human adenovirus D
caaaagaaaacuaa

SEQ ID NO: 1561728 - RNA, 17 nt, Human adenovirus D
cuggcagagcacgcugc

SEQ ID NO: 1561729 - RNA, 12 nt, Human adenovirus D
cuugaacagcau

SEQ ID NO: 1561730 - RNA, 23 nt, Human adenovirus D
ccacgauguaacaucaccacagg

SEQ ID NO: 1561731 - RNA, 18 nt, Human adenovirus D
ggaggagauggugggccg

SEQ ID NO: 1561732 - RNA, 13 nt, Human adenovirus D
agaugcagcaagc

SEQ ID NO: 1561733 - RNA, 21 nt, Human adenovirus D
cugccgguuucgggcgggcag

SEQ ID NO: 1561734 - RNA, 17 nt, Human adenovirus D
cugcuggcccugcuggc

SEQ ID NO: 1561735 - RNA, 17 nt, Human adenovirus D
cuggcggagaacaaggc

SEQ ID NO: 1561736 - RNA, 23 nt, Human adenovirus D
cggccagcgucauguccuuccag

SEQ ID NO: 1561737 - RNA, 22 nt, Human adenovirus D
ccacggguguaaugaaacccgc

SEQ ID NO: 1561738 - RNA, 17 nt, Human adenovirus D
gagaacugcuggcccug

SEQ ID NO: 1561739 - RNA, 19 nt, Human adenovirus D
gcaauaccgggaugaugac

SEQ ID NO: 1561740 - RNA, 23 nt, Human adenovirus D
cccagcagaagcagaaguucacc

SEQ ID NO: 1561741 - RNA, 18 nt, Human adenovirus D
gcacaucgccgggcagga

SEQ ID NO: 1561742 - RNA, 22 nt, Human adenovirus D
ucagagccagggcuaagcgugg

SEQ ID NO: 1561743 - RNA, 23 nt, Human adenovirus D
gaucaccguagagggcaccaccg

SEQ ID NO: 1561744 - RNA, 18 nt, Human adenovirus D
ccucacaguccaggucac

SEQ ID NO: 1561745 - RNA, 14 nt, Human adenovirus D
aagauaucauaaag

SEQ ID NO: 1561746 - RNA, 17 nt, Human adenovirus D
gcgggcuguggggcgug

SEQ ID NO: 1561747 - RNA, 11 nt, Human adenovirus D
accaaccagac

SEQ ID NO: 1561748 - RNA, 16 nt, Human adenovirus D
ccacucuauuuucaag

SEQ ID NO: 1561749 - RNA, 22 nt, Human adenovirus D
ccgccaucgaacacgccaccgc

SEQ ID NO: 1561750 - RNA, 14 nt, Human adenovirus D
ccaccgacacguac

SEQ ID NO: 1561751 - RNA, 21 nt, Human adenovirus D
gcccauuucacaguguacacg

SEQ ID NO: 1561752 - RNA, 15 nt, Human adenovirus D
uucauugucuucccu

SEQ ID NO: 1561753 - RNA, 15 nt, Human adenovirus D
gauuggccuguccug

SEQ ID NO: 1561754 - RNA, 17 nt, Human adenovirus D
caauucagagccagggc

SEQ ID NO: 1561755 - RNA, 15 nt, Human adenovirus D
cuaaacuaaagccaa

SEQ ID NO: 1561756 - RNA, 20 nt, Human adenovirus D
gcaugguuucggugacggcg

SEQ ID NO: 1561757 - RNA, 17 nt, Human adenovirus D
ugccaggaugggccgga

SEQ ID NO: 1561758 - RNA, 16 nt, Human adenovirus D
ccauccgcgccgcagc

SEQ ID NO: 1561759 - RNA, 13 nt, Human adenovirus D
augcaccugggcg

SEQ ID NO: 1561760 - RNA, 20 nt, Human adenovirus D
cgcggccguucaugggcacc

SEQ ID NO: 1561761 - RNA, 23 nt, Human adenovirus D
gggacucacccuggggcuccucg

SEQ ID NO: 1561762 - RNA, 17 nt, Human adenovirus D
cgcuccaccgaaggcag

SEQ ID NO: 1561763 - RNA, 17 nt, Human adenovirus D
auccccuucuccagcaa

SEQ ID NO: 1561764 - RNA, 15 nt, Human adenovirus D
ugaccagacccaggc

SEQ ID NO: 1561765 - RNA, 18 nt, Human adenovirus D
gggcguggugcuggauga

SEQ ID NO: 1561766 - RNA, 14 nt, Human adenovirus D
gcccgucgccgcac

SEQ ID NO: 1561767 - RNA, 18 nt, Human adenovirus D
ggcgcgcccggggccagg

SEQ ID NO: 1561768 - RNA, 14 nt, Human adenovirus D
aaaacugcaugcug

SEQ ID NO: 1561769 - RNA, 16 nt, Human adenovirus D
gcccggggccaggucc

SEQ ID NO: 1561770 - RNA, 16 nt, Human adenovirus D
ucuucucccacagcuc

SEQ ID NO: 1561771 - RNA, 14 nt, Human adenovirus D
uccgcaacuuccag

SEQ ID NO: 1561772 - RNA, 16 nt, Human adenovirus D
accagaacuuccagca

SEQ ID NO: 1561773 - RNA, 17 nt, Human adenovirus D
ucaaucucccaccacca

SEQ ID NO: 1561774 - RNA, 14 nt, Human adenovirus D
cacccugcccuucc

SEQ ID NO: 1561775 - RNA, 14 nt, Human adenovirus D
ucaucgacuggugc

SEQ ID NO: 1561776 - RNA, 19 nt, Human adenovirus D
cccaggaaacuaggcgcag

SEQ ID NO: 1561777 - RNA, 12 nt, Human adenovirus D
cagcugcagaag

SEQ ID NO: 1561778 - RNA, 23 nt, Human adenovirus D
cagcaugaaggggacgagcugcu

SEQ ID NO: 1561779 - RNA, 18 nt, Human adenovirus D
gugccuuaccgccagaga

SEQ ID NO: 1561780 - RNA, 21 nt, Human adenovirus D
accucauuugcauauuaacuu

SEQ ID NO: 1561781 - RNA, 22 nt, Human adenovirus D
cugcaaacggugaaccugagcc

SEQ ID NO: 1561782 - RNA, 12 nt, Human adenovirus D
ccugaucagaaa

SEQ ID NO: 1561783 - RNA, 23 nt, Human adenovirus D
aagaccauucugcacaccaacau

SEQ ID NO: 1561784 - RNA, 13 nt, Human adenovirus D
cgccaggcuggcc

SEQ ID NO: 1561785 - RNA, 15 nt, Human adenovirus D
gacuccgcgaccucc

SEQ ID NO: 1561786 - RNA, 15 nt, Human adenovirus D
agguguuggcaaagc

SEQ ID NO: 1561787 - RNA, 13 nt, Human adenovirus D
uuaguccagcaga

SEQ ID NO: 1561788 - RNA, 16 nt, Human adenovirus D
ucaauacauagaccac

SEQ ID NO: 1561789 - RNA, 19 nt, Human adenovirus D
auggcccugacgacccgca

SEQ ID NO: 1561790 - RNA, 17 nt, Human adenovirus D
gcaacgaccggcugcuc

SEQ ID NO: 1561791 - RNA, 22 nt, Human adenovirus D
auuuucauugucuucccucuca

SEQ ID NO: 1561792 - RNA, 19 nt, Human adenovirus D
ggaggccgugaaggccggc

SEQ ID NO: 1561793 - RNA, 16 nt, Human adenovirus D
guguaccgcaacgacc

SEQ ID NO: 1561794 - RNA, 17 nt, Human adenovirus D
uuuaaaauaaaacuucu

SEQ ID NO: 1561795 - RNA, 22 nt, Human adenovirus D
uugacuuccggguucccacguu

SEQ ID NO: 1561796 - RNA, 15 nt, Human adenovirus D
cacaguaaguuccug

SEQ ID NO: 1561797 - RNA, 17 nt, Human adenovirus D
cugguacuugggcugcc

SEQ ID NO: 1561798 - RNA, 22 nt, Human adenovirus D
agcaaggugcugacauccaugg

SEQ ID NO: 1561799 - RNA, 16 nt, Human adenovirus D
ccgcugucucagccuc

SEQ ID NO: 1561800 - RNA, 15 nt, Human adenovirus D
ggcacccacgacaca

SEQ ID NO: 1561801 - RNA, 17 nt, Human adenovirus D
agccgcaggcgcccagc

SEQ ID NO: 1561802 - RNA, 14 nt, Human adenovirus D
agcugggcugggac

SEQ ID NO: 1561803 - RNA, 17 nt, Human adenovirus D
ggcacuggagcacagac

SEQ ID NO: 1561804 - RNA, 14 nt, Human adenovirus D
cguggcuucgagca

SEQ ID NO: 1561805 - RNA, 20 nt, Human adenovirus D
cgguccucggucaggagcaa

SEQ ID NO: 1561806 - RNA, 16 nt, Human adenovirus D
ugucaaauuccugguc

SEQ ID NO: 1561807 - RNA, 20 nt, Human adenovirus D
gcuccguuguacgacaccac

SEQ ID NO: 1561808 - RNA, 21 nt, Human adenovirus D
acgcugaaaggcgggcugccc

SEQ ID NO: 1561809 - RNA, 20 nt, Human adenovirus D
cagccgcguaagcaggagca

SEQ ID NO: 1561810 - RNA, 14 nt, Human adenovirus D
cuggacccgcggcc

SEQ ID NO: 1561811 - RNA, 20 nt, Human adenovirus D
gccggcgacaagcuggccug

SEQ ID NO: 1561812 - RNA, 16 nt, Human adenovirus D
guggcgcucgggcagg

SEQ ID NO: 1561813 - RNA, 17 nt, Human adenovirus D
ggcgguuccggccccgc

SEQ ID NO: 1561814 - RNA, 16 nt, Human adenovirus D
gcacguggcggcggcc

SEQ ID NO: 1561815 - RNA, 11 nt, Human adenovirus D
uggugcccaag

SEQ ID NO: 1561816 - RNA, 15 nt, Human adenovirus D
aggaagugcuggaca

SEQ ID NO: 1561817 - RNA, 13 nt, Human adenovirus D
aauuucaagcugg

SEQ ID NO: 1561818 - RNA, 22 nt, Human adenovirus D
gcagcacaguaaguuccugucu

SEQ ID NO: 1561819 - RNA, 19 nt, Human adenovirus D
auugcuucccuggaagagu

SEQ ID NO: 1561820 - RNA, 14 nt, Human adenovirus D
ccgcaacuuccagc

SEQ ID NO: 1561821 - RNA, 21 nt, Human adenovirus D
ccgucagcagcaggagcgugc

SEQ ID NO: 1561822 - RNA, 17 nt, Human adenovirus D
cgaaucaggcuggagcc

SEQ ID NO: 1561823 - RNA, 13 nt, Human adenovirus D
ucgccgagcccga

SEQ ID NO: 1561824 - RNA, 21 nt, Human adenovirus D
ggacggccgcggcgagcggga

SEQ ID NO: 1561825 - RNA, 17 nt, Human adenovirus D
aucgagcaggaccuggg

SEQ ID NO: 1561826 - RNA, 23 nt, Human adenovirus D
uccacuuucauaaucaggcagac

SEQ ID NO: 1561827 - RNA, 19 nt, Human adenovirus D
gcgggcagggagcugcgcg

SEQ ID NO: 1561828 - RNA, 14 nt, Human adenovirus D
cggagcgaggugug

SEQ ID NO: 1561829 - RNA, 20 nt, Human adenovirus D
ucauagcaggggcgcugggc

SEQ ID NO: 1561830 - RNA, 19 nt, Human adenovirus D
ccaucagcgcccucagcag

SEQ ID NO: 1561831 - RNA, 14 nt, Human adenovirus D
ugugcccgcccagg

SEQ ID NO: 1561832 - RNA, 21 nt, Human adenovirus D
augcggaggaauguggaaaga

SEQ ID NO: 1561833 - RNA, 17 nt, Human adenovirus D
aguaugccaagauagcc

SEQ ID NO: 1561834 - RNA, 16 nt, Human adenovirus D
caugagucuguguccg

SEQ ID NO: 1561835 - RNA, 21 nt, Human adenovirus D
agugccuuuaucagcacugca

SEQ ID NO: 1561836 - RNA, 16 nt, Human adenovirus D
gccgcgccaaccgcac

SEQ ID NO: 1561837 - RNA, 18 nt, Human adenovirus D
auccgcagcuacaccucc

SEQ ID NO: 1561838 - RNA, 14 nt, Human adenovirus D
cagcgcccucagca

SEQ ID NO: 1561839 - RNA, 15 nt, Human adenovirus D
gaaacucagucacuc

SEQ ID NO: 1561840 - RNA, 17 nt, Human adenovirus D
ucgaagccguugauguu

SEQ ID NO: 1561841 - RNA, 22 nt, Human adenovirus D
agcggccugaaccgccgccggc

SEQ ID NO: 1561842 - RNA, 16 nt, Human adenovirus D
acagcauauaccccuc

SEQ ID NO: 1561843 - RNA, 20 nt, Human adenovirus D
gaugucugugaagcagugug

SEQ ID NO: 1561844 - RNA, 12 nt, Human adenovirus D
gggagcgagccc

SEQ ID NO: 1561845 - RNA, 14 nt, Human adenovirus D
acagccagcagcuc

SEQ ID NO: 1561846 - RNA, 16 nt, Human adenovirus D
cccgggucucccccag

SEQ ID NO: 1561847 - RNA, 14 nt, Human adenovirus D
gagcggcuccagcg

SEQ ID NO: 1561848 - RNA, 17 nt, Human adenovirus D
cgguccccgaggcccuu

SEQ ID NO: 1561849 - RNA, 15 nt, Human adenovirus D
gcgcagccugagcuu

SEQ ID NO: 1561850 - RNA, 17 nt, Human adenovirus D
uggacaacgucaacccc

SEQ ID NO: 1561851 - RNA, 14 nt, Human adenovirus D
gcgcgcuggggcag

SEQ ID NO: 1561852 - RNA, 19 nt, Human adenovirus D
gggccugcgcuaccgcucc

SEQ ID NO: 1561853 - RNA, 19 nt, Human adenovirus D
ucgcugaaaaacaggccgc

SEQ ID NO: 1561854 - RNA, 14 nt, Human adenovirus D
gaucgccaggccuc

SEQ ID NO: 1561855 - RNA, 15 nt, Human adenovirus D
aggccauaggccagg

SEQ ID NO: 1561856 - RNA, 15 nt, Human adenovirus D
ccagaaaccccgcaa

SEQ ID NO: 1561857 - RNA, 19 nt, Human adenovirus D
ugggcauagucgcgccgcg

SEQ ID NO: 1561858 - RNA, 20 nt, Human adenovirus D
cacacuagcgcccugguaga

SEQ ID NO: 1561859 - RNA, 16 nt, Human adenovirus D
cugccacacauggcaa

SEQ ID NO: 1561860 - RNA, 23 nt, Human adenovirus D
gugagcucgucuuccaggagccu

SEQ ID NO: 1561861 - RNA, 11 nt, Human adenovirus D
ggaucuucccc

SEQ ID NO: 1561862 - RNA, 22 nt, Human adenovirus D
ccuuacuuucgcucccaccgcg

SEQ ID NO: 1561863 - RNA, 11 nt, Human adenovirus D
caagucaaaag

SEQ ID NO: 1561864 - RNA, 16 nt, Human adenovirus D
ggcggcuuucugcccg

SEQ ID NO: 1561865 - RNA, 14 nt, Human adenovirus D
cuguuggagaacga

SEQ ID NO: 1561866 - RNA, 16 nt, Human adenovirus D
aaugucagcugcaaaa

SEQ ID NO: 1561867 - RNA, 19 nt, Human adenovirus D
ggaucuagaagggggcaac

SEQ ID NO: 1561868 - RNA, 22 nt, Human adenovirus D
gaagauguuaaagugggcgugg

SEQ ID NO: 1561869 - RNA, 13 nt, Human adenovirus D
caugcccuuuucc

SEQ ID NO: 1561870 - RNA, 14 nt, Human adenovirus D
caacaauaaaagac

SEQ ID NO: 1561871 - RNA, 17 nt, Human adenovirus D
cgagggucgcuggcugc

SEQ ID NO: 1561872 - RNA, 23 nt, Human adenovirus D
ccccccucagcgucgaggagcug

SEQ ID NO: 1561873 - RNA, 18 nt, Human adenovirus D
ugacaguucagaaguaaa

SEQ ID NO: 1561874 - RNA, 18 nt, Human adenovirus D
uuccguucuacccagcaa

SEQ ID NO: 1561875 - RNA, 17 nt, Human adenovirus D
gcgcauccccuucucca

SEQ ID NO: 1561876 - RNA, 14 nt, Human adenovirus D
ugagccgccagcug

SEQ ID NO: 1561877 - RNA, 19 nt, Human adenovirus D
ucaacuguuaagaccacua

SEQ ID NO: 1561878 - RNA, 15 nt, Human adenovirus D
guggacgcugcucac

SEQ ID NO: 1561879 - RNA, 23 nt, Human adenovirus D
ugcaccugggcgccagaaggggc

SEQ ID NO: 1561880 - RNA, 13 nt, Human adenovirus D
uaaagaaacagaa

SEQ ID NO: 1561881 - RNA, 14 nt, Human adenovirus D
ugcuggaugauguc

SEQ ID NO: 1561882 - RNA, 20 nt, Human adenovirus D
cuacggagggcagaaacagc

SEQ ID NO: 1561883 - RNA, 17 nt, Human adenovirus D
cacaucggacuggguua

SEQ ID NO: 1561884 - RNA, 18 nt, Human adenovirus D
acagcaggagugcaggga

SEQ ID NO: 1561885 - RNA, 22 nt, Human adenovirus D
gcgaagggcuggcgagacuggg

SEQ ID NO: 1561886 - RNA, 17 nt, Human adenovirus D
uuucugcagacaucaug

SEQ ID NO: 1561887 - RNA, 19 nt, Human adenovirus D
cuacccagcaagucagcaa

SEQ ID NO: 1561888 - RNA, 16 nt, Human adenovirus D
acugcagggagccagg

SEQ ID NO: 1561889 - RNA, 15 nt, Human adenovirus D
gguaagagcccagca

SEQ ID NO: 1561890 - RNA, 20 nt, Human adenovirus D
gacgagacuggccucgagcu

SEQ ID NO: 1561891 - RNA, 13 nt, Human adenovirus D
aaaauuugcaaaa

SEQ ID NO: 1561892 - RNA, 20 nt, Human adenovirus D
cccgcucaccaucugagcuc

SEQ ID NO: 1561893 - RNA, 12 nt, Human adenovirus D
uccccccugggg

SEQ ID NO: 1561894 - RNA, 20 nt, Human adenovirus D
cgugccauccgucacccaga

SEQ ID NO: 1561895 - RNA, 21 nt, Human adenovirus D
cagagccagggcuaagcgugg

SEQ ID NO: 1561896 - RNA, 14 nt, Human adenovirus D
ucuugcaugccuuc

SEQ ID NO: 1561897 - RNA, 15 nt, Human adenovirus D
ggcgugcuggagagc

SEQ ID NO: 1561898 - RNA, 16 nt, Human adenovirus D
auuucuuagacugcua

SEQ ID NO: 1561899 - RNA, 19 nt, Human adenovirus D
cacagagagccgccugagc

SEQ ID NO: 1561900 - RNA, 13 nt, Human adenovirus D
cucucucuucuug

SEQ ID NO: 1561901 - RNA, 17 nt, Human adenovirus D
cucggaguaccugagcc

SEQ ID NO: 1561902 - RNA, 21 nt, Human adenovirus D
ggcccucgaugaaagucagga

SEQ ID NO: 1561903 - RNA, 22 nt, Human adenovirus D
ugcuguggucgacuugcaagac

SEQ ID NO: 1561904 - RNA, 18 nt, Human adenovirus D
ggcccugcuggccgagcu

SEQ ID NO: 1561905 - RNA, 21 nt, Human adenovirus D
ggcgaguuugccuacgggaag

SEQ ID NO: 1561906 - RNA, 13 nt, Human adenovirus D
ggcggugcugcug

SEQ ID NO: 1561907 - RNA, 14 nt, Human adenovirus D
cugacgcugagcga

SEQ ID NO: 1561908 - RNA, 16 nt, Human adenovirus D
acagcgacgagacugg

SEQ ID NO: 1561909 - RNA, 22 nt, Human adenovirus D
cagcugacaauucagagccagg

SEQ ID NO: 1561910 - RNA, 21 nt, Human adenovirus D
cugauauugcuucccuggaag

SEQ ID NO: 1561911 - RNA, 20 nt, Human adenovirus D
gaggcccaucuacaggccag

SEQ ID NO: 1561912 - RNA, 23 nt, Human adenovirus D
caagcagguggcgccgggccugg

SEQ ID NO: 1561913 - RNA, 22 nt, Human adenovirus D
uugaagucaugugugauaucac

SEQ ID NO: 1561914 - RNA, 15 nt, Human adenovirus D
uggaggcgcgcggga

SEQ ID NO: 1561915 - RNA, 19 nt, Human adenovirus D
uaagcaggagcaggaggag

SEQ ID NO: 1561916 - RNA, 20 nt, Human adenovirus D
uucucuuacugaaacucagu

SEQ ID NO: 1561917 - RNA, 23 nt, Human adenovirus D
uccagcagcaggguacccacugg

SEQ ID NO: 1561918 - RNA, 23 nt, Human adenovirus D
gagauagcaguugaccaugagcu

SEQ ID NO: 1561919 - RNA, 20 nt, Human adenovirus D
gcgccgcggcgacagcgcca

SEQ ID NO: 1561920 - RNA, 17 nt, Human adenovirus D
uacugccacugccaaca

SEQ ID NO: 1561921 - RNA, 22 nt, Human adenovirus D
ggcacucagguugucaguuucu

SEQ ID NO: 1561922 - RNA, 16 nt, Human adenovirus D
cccacuacucagcuuc

SEQ ID NO: 1561923 - RNA, 20 nt, Human adenovirus D
caucgugcgcgaccugggcu

SEQ ID NO: 1561924 - RNA, 21 nt, Human adenovirus D
gugauggcgcaggcgacccug

SEQ ID NO: 1561925 - RNA, 16 nt, Human adenovirus D
acgugccgcgcgggca

SEQ ID NO: 1561926 - RNA, 12 nt, Human adenovirus D
ccggcacggcgg

SEQ ID NO: 1561927 - RNA, 20 nt, Human adenovirus D
caccgugcgcuaccacccca

SEQ ID NO: 1561928 - RNA, 22 nt, Human adenovirus D
aggagggauugcagggcguaga

SEQ ID NO: 1561929 - RNA, 15 nt, Human adenovirus D
accccaucccggcca

SEQ ID NO: 1561930 - RNA, 23 nt, Human adenovirus D
agaugcagcaagccccggacccc

SEQ ID NO: 1561931 - RNA, 20 nt, Human adenovirus D
ggaaacucuuggagcagggu

SEQ ID NO: 1561932 - RNA, 14 nt, Human adenovirus D
guccucuuccucuu

SEQ ID NO: 1561933 - RNA, 11 nt, Human adenovirus D
aaaacccacuc

SEQ ID NO: 1561934 - RNA, 15 nt, Human adenovirus D
agaagagcagcacag

SEQ ID NO: 1561935 - RNA, 13 nt, Human adenovirus D
cauggcccugacg

SEQ ID NO: 1561936 - RNA, 16 nt, Human adenovirus D
gccccacaucgaggcc

SEQ ID NO: 1561937 - RNA, 18 nt, Human adenovirus D
cgagaggcgagcagcugu

SEQ ID NO: 1561938 - RNA, 20 nt, Human adenovirus D
cuaaaaaaugucuauucuca

SEQ ID NO: 1561939 - RNA, 16 nt, Human adenovirus D
gcggagcuugcccuug

SEQ ID NO: 1561940 - RNA, 15 nt, Human adenovirus D
gugcagcugcagaag

SEQ ID NO: 1561941 - RNA, 18 nt, Human adenovirus D
acuagccggagccgggag

SEQ ID NO: 1561942 - RNA, 14 nt, Human adenovirus D
gaugccgcaguggg

SEQ ID NO: 1561943 - RNA, 18 nt, Human adenovirus D
gaccguggcuucgagcag

SEQ ID NO: 1561944 - RNA, 15 nt, Human adenovirus D
ggaccggucccagcg

SEQ ID NO: 1561945 - RNA, 17 nt, Human adenovirus D
cggcaucuuugacaugg

SEQ ID NO: 1561946 - RNA, 21 nt, Human adenovirus D
ccggcgacaagcuggccugcg

SEQ ID NO: 1561947 - RNA, 23 nt, Human adenovirus D
agcuucuugcuagaaaccucaaa

SEQ ID NO: 1561948 - RNA, 23 nt, Human adenovirus D
gcccaggcgccauucggagcacg

SEQ ID NO: 1561949 - RNA, 19 nt, Human adenovirus D
caagaccuaccaaugaaaa

SEQ ID NO: 1561950 - RNA, 22 nt, Human adenovirus D
cuuaaccacccacgagcaaccc

SEQ ID NO: 1561951 - RNA, 20 nt, Human adenovirus D
ccggcugcucacgccgaacg

SEQ ID NO: 1561952 - RNA, 20 nt, Human adenovirus D
caacaucggcuaccagggcu

SEQ ID NO: 1561953 - RNA, 21 nt, Human adenovirus D
gcuggccgugguccuggucac

SEQ ID NO: 1561954 - RNA, 15 nt, Human adenovirus D
accgcuccuggucug

SEQ ID NO: 1561955 - RNA, 21 nt, Human adenovirus D
cauuacuauuacugccacugc

SEQ ID NO: 1561956 - RNA, 15 nt, Human adenovirus D
ccccagucagaccca

SEQ ID NO: 1561957 - RNA, 22 nt, Human adenovirus D
acaccaacuuuaucagcgcgcu

SEQ ID NO: 1561958 - RNA, 22 nt, Human adenovirus D
gaggcgguccccgcccagcgag

SEQ ID NO: 1561959 - RNA, 15 nt, Human adenovirus D
agcaggggcgcuggg

SEQ ID NO: 1561960 - RNA, 15 nt, Human adenovirus D
ggaauggcacgcucu

SEQ ID NO: 1561961 - RNA, 15 nt, Human adenovirus D
cgcagugggcgcaga

SEQ ID NO: 1561962 - RNA, 13 nt, Human adenovirus D
gaacgagggccug

SEQ ID NO: 1561963 - RNA, 20 nt, Human adenovirus D
gauggacuuggaagagggcg

SEQ ID NO: 1561964 - RNA, 19 nt, Human adenovirus D
cgggcggccauugcucgcu

SEQ ID NO: 1561965 - RNA, 22 nt, Human adenovirus D
cuggcgaucgugaacgcgcugg

SEQ ID NO: 1561966 - RNA, 23 nt, Human adenovirus D
aacuuccugaccacgguggugca

SEQ ID NO: 1561967 - RNA, 22 nt, Human adenovirus D
guggagcugaccaacuggucuc

SEQ ID NO: 1561968 - RNA, 20 nt, Human adenovirus D
ggaugcgugagggcggaggc

SEQ ID NO: 1561969 - RNA, 18 nt, Human adenovirus D
gauaugugcagcagagcg

SEQ ID NO: 1561970 - RNA, 21 nt, Human adenovirus D
caaaaucgagcaggaccuggg

SEQ ID NO: 1561971 - RNA, 14 nt, Human adenovirus D
gcaccugugggacc

SEQ ID NO: 1561972 - RNA, 19 nt, Human adenovirus D
ugcaccugggcgccagaag

SEQ ID NO: 1561973 - RNA, 15 nt, Human adenovirus D
ccuucuccaggguga

SEQ ID NO: 1561974 - RNA, 23 nt, Human adenovirus D
cagcuucgaguacgaggccaugc

SEQ ID NO: 1561975 - RNA, 15 nt, Human adenovirus D
gccugguguacacag

SEQ ID NO: 1561976 - RNA, 13 nt, Human adenovirus D
ggcaacggccgcu

SEQ ID NO: 1561977 - RNA, 15 nt, Human adenovirus D
guuauggucugcucc

SEQ ID NO: 1561978 - RNA, 20 nt, Human adenovirus D
ccaucgugcgcgaccugggc

SEQ ID NO: 1561979 - RNA, 13 nt, Human adenovirus D
aaaacuaaugaca

SEQ ID NO: 1561980 - RNA, 12 nt, Human adenovirus D
cggaggcuggcu

SEQ ID NO: 1561981 - RNA, 14 nt, Human adenovirus D
ugcgaggagagcag

SEQ ID NO: 1561982 - RNA, 22 nt, Human adenovirus D
gaccccgccauaagggcggcgc

SEQ ID NO: 1561983 - RNA, 15 nt, Human adenovirus D
gcacgguaagagccc

SEQ ID NO: 1561984 - RNA, 16 nt, Human adenovirus D
ugagauaugugcagca

SEQ ID NO: 1561985 - RNA, 17 nt, Human adenovirus D
ugaggaucauaucccag

SEQ ID NO: 1561986 - RNA, 19 nt, Human adenovirus D
cgcggaugaagugcgcgua

SEQ ID NO: 1561987 - RNA, 11 nt, Human adenovirus D
gcaagaaggaa

SEQ ID NO: 1561988 - RNA, 13 nt, Human adenovirus D
cugguacuugggc

SEQ ID NO: 1561989 - RNA, 14 nt, Human adenovirus D
ccuggcgacgcagc

SEQ ID NO: 1561990 - RNA, 19 nt, Human adenovirus D
cgccuucaccgaccugggu

SEQ ID NO: 1561991 - RNA, 14 nt, Human adenovirus D
cgagcacucgugcu

SEQ ID NO: 1561992 - RNA, 21 nt, Human adenovirus D
cagcuccgguugugcagcccc

SEQ ID NO: 1561993 - RNA, 20 nt, Human adenovirus D
ggcagacgcugaaaggcggg

SEQ ID NO: 1561994 - RNA, 16 nt, Human adenovirus D
uagcaauggaaaucac

SEQ ID NO: 1561995 - RNA, 12 nt, Human adenovirus D
cgaccacagcaa

SEQ ID NO: 1561996 - RNA, 19 nt, Human adenovirus D
cacguacuucagccugggc

SEQ ID NO: 1561997 - RNA, 16 nt, Human adenovirus D
cccugagcggcugcac

SEQ ID NO: 1561998 - RNA, 12 nt, Human adenovirus D
gcugauggugac

SEQ ID NO: 1561999 - RNA, 16 nt, Human adenovirus D
aaguuuaauggggugc

SEQ ID NO: 1562000 - RNA, 15 nt, Human adenovirus D
agaugaugugcaguu

SEQ ID NO: 1562001 - RNA, 16 nt, Human adenovirus D
ccuugcccccaagggc

SEQ ID NO: 1562002 - RNA, 16 nt, Human adenovirus D
gaccgcgagcugaugc

SEQ ID NO: 1562003 - RNA, 19 nt, Human adenovirus D
ucggcuggaacccgcgcuc

SEQ ID NO: 1562004 - RNA, 12 nt, Human adenovirus D
ggucgcgguggg

SEQ ID NO: 1562005 - RNA, 17 nt, Human adenovirus D
cuggcuucuacagccag

SEQ ID NO: 1562006 - RNA, 19 nt, Human adenovirus D
cugcacgagaaccgccugg

SEQ ID NO: 1562007 - RNA, 16 nt, Human adenovirus D
ccggcgcuagccagcc

SEQ ID NO: 1562008 - RNA, 19 nt, Human adenovirus D
gcagcacauaaucaccaug

SEQ ID NO: 1562009 - RNA, 16 nt, Human adenovirus D
cuccgcgaccuccucc

SEQ ID NO: 1562010 - RNA, 22 nt, Human adenovirus D
cggaggcgugcacuggcucgcc

SEQ ID NO: 1562011 - RNA, 15 nt, Human adenovirus D
gagcugggagggaug

SEQ ID NO: 1562012 - RNA, 16 nt, Human adenovirus D
cgggguugcagcacug

SEQ ID NO: 1562013 - RNA, 23 nt, Human adenovirus D
ccauggacgggaaccccaccaug

SEQ ID NO: 1562014 - RNA, 14 nt, Human adenovirus D
ccaacgcgccgggg

SEQ ID NO: 1562015 - RNA, 14 nt, Human adenovirus D
caaccuccugggca

SEQ ID NO: 1562016 - RNA, 16 nt, Human adenovirus D
cacgcgcacacuuugg

SEQ ID NO: 1562017 - RNA, 14 nt, Human adenovirus D
ccaggcccuggagc

SEQ ID NO: 1562018 - RNA, 22 nt, Human adenovirus D
caggguagcggggcacaggcac

SEQ ID NO: 1562019 - RNA, 19 nt, Human adenovirus D
ucgaugaaagucaggagca

SEQ ID NO: 1562020 - RNA, 15 nt, Human adenovirus D
cgcccgucgccgcac

SEQ ID NO: 1562021 - RNA, 18 nt, Human adenovirus D
auggaacccaaaguauga

SEQ ID NO: 1562022 - RNA, 21 nt, Human adenovirus D
cugaagauguaaccuugcaag

SEQ ID NO: 1562023 - RNA, 18 nt, Human adenovirus D
augcacccguaaaugacu

SEQ ID NO: 1562024 - RNA, 22 nt, Human adenovirus D
ggguguuuuugcgaaaacacuu

SEQ ID NO: 1562025 - RNA, 13 nt, Human adenovirus D
cagaggaagaggg

SEQ ID NO: 1562026 - RNA, 22 nt, Human adenovirus D
ggacaucgcgaaccaggcagug

SEQ ID NO: 1562027 - RNA, 20 nt, Human adenovirus D
cacacuuuugguuucaaauu

SEQ ID NO: 1562028 - RNA, 18 nt, Human adenovirus D
gcaccaucacaggaggca

SEQ ID NO: 1562029 - RNA, 17 nt, Human adenovirus D
cggccguucaugggcac

SEQ ID NO: 1562030 - RNA, 22 nt, Human adenovirus D
acuccccuuacuuucgcuccca

SEQ ID NO: 1562031 - RNA, 18 nt, Human adenovirus D
auucaaauuacuuuucug

SEQ ID NO: 1562032 - RNA, 19 nt, Human adenovirus D
ggaaauguucugauuauug

SEQ ID NO: 1562033 - RNA, 22 nt, Human adenovirus D
gggcgucccgcgguccuccucg

SEQ ID NO: 1562034 - RNA, 17 nt, Human adenovirus D
accaugaauacagugau

SEQ ID NO: 1562035 - RNA, 23 nt, Human adenovirus D
ggaggacuuaaccacccacgagc

SEQ ID NO: 1562036 - RNA, 13 nt, Human adenovirus D
ugcccuuccagca

SEQ ID NO: 1562037 - RNA, 16 nt, Human adenovirus D
gccaggaggcggugcg

SEQ ID NO: 1562038 - RNA, 19 nt, Human adenovirus D
auacagaugguagcagcag

SEQ ID NO: 1562039 - RNA, 13 nt, Human adenovirus D
gccuuccccuccg

SEQ ID NO: 1562040 - RNA, 19 nt, Human adenovirus D
guuccagacgcggcuguag

SEQ ID NO: 1562041 - RNA, 19 nt, Human adenovirus D
acucggugcuuagccuggg

SEQ ID NO: 1562042 - RNA, 17 nt, Human adenovirus D
cccaugagcugcgagaa

SEQ ID NO: 1562043 - RNA, 12 nt, Human adenovirus D
gaggcaggccau

SEQ ID NO: 1562044 - RNA, 19 nt, Human adenovirus D
uggcgugcgaguuggagga

SEQ ID NO: 1562045 - RNA, 19 nt, Human adenovirus D
cugcuccugcucccgggcu

SEQ ID NO: 1562046 - RNA, 14 nt, Human adenovirus D
auugcuagcccuuc

SEQ ID NO: 1562047 - RNA, 15 nt, Human adenovirus D
guacuggcaacaugg

SEQ ID NO: 1562048 - RNA, 19 nt, Human adenovirus D
auccagcggcgcaggggca

SEQ ID NO: 1562049 - RNA, 15 nt, Human adenovirus D
gcgcaggcgacccug

SEQ ID NO: 1562050 - RNA, 17 nt, Human adenovirus D
cgugcgcgaccugggcu

SEQ ID NO: 1562051 - RNA, 16 nt, Human adenovirus D
cucgcuccggaggcau

SEQ ID NO: 1562052 - RNA, 14 nt, Human adenovirus D
ggcgcuggaagagg

SEQ ID NO: 1562053 - RNA, 20 nt, Human adenovirus D
cccgccauaagggcggcgcu

SEQ ID NO: 1562054 - RNA, 20 nt, Human adenovirus D
acugggcguugcgggccgag

SEQ ID NO: 1562055 - RNA, 13 nt, Human adenovirus D
aguugguccagau

SEQ ID NO: 1562056 - RNA, 17 nt, Human adenovirus D
ggcgaagggcuggcgag

SEQ ID NO: 1562057 - RNA, 13 nt, Human adenovirus D
augcgcaggcgcc

SEQ ID NO: 1562058 - RNA, 12 nt, Human adenovirus D
gacgagccaaac

SEQ ID NO: 1562059 - RNA, 20 nt, Human adenovirus D
ggggcgccgccggcggcgag

SEQ ID NO: 1562060 - RNA, 19 nt, Human adenovirus D
ggcgacgacgcgcucggcg

SEQ ID NO: 1562061 - RNA, 15 nt, Human adenovirus D
acacugaaaauguca

SEQ ID NO: 1562062 - RNA, 22 nt, Human adenovirus D
uaaacguguuuuuuauuucaaa

SEQ ID NO: 1562063 - RNA, 23 nt, Human adenovirus D
cgcaggggcucguuaguccagca

SEQ ID NO: 1562064 - RNA, 18 nt, Human adenovirus D
caguccaugcccaacagg

SEQ ID NO: 1562065 - RNA, 21 nt, Human adenovirus D
uccgcgaccuccuccccauga

SEQ ID NO: 1562066 - RNA, 20 nt, Human adenovirus D
augcugagccugcgccgggc

SEQ ID NO: 1562067 - RNA, 13 nt, Human adenovirus D
gacgacggcgacg

SEQ ID NO: 1562068 - RNA, 15 nt, Human adenovirus D
caagcgggccucaca

SEQ ID NO: 1562069 - RNA, 22 nt, Human adenovirus D
cagcagcauguacggaggagcc

SEQ ID NO: 1562070 - RNA, 17 nt, Human adenovirus D
cguacuucugccagcag

SEQ ID NO: 1562071 - RNA, 12 nt, Human adenovirus D
cgacgccccuga

SEQ ID NO: 1562072 - RNA, 18 nt, Human adenovirus D
aagaaacgucccagcagc

SEQ ID NO: 1562073 - RNA, 20 nt, Human adenovirus D
accgcggcgucaucgaggcc

SEQ ID NO: 1562074 - RNA, 15 nt, Human adenovirus D
cuucuauggaggcag

SEQ ID NO: 1562075 - RNA, 13 nt, Human adenovirus D
cgcgaacagcagc

SEQ ID NO: 1562076 - RNA, 17 nt, Human adenovirus D
auugagagugcggugga

SEQ ID NO: 1562077 - RNA, 17 nt, Human adenovirus D
accuggugauggccugu

SEQ ID NO: 1562078 - RNA, 12 nt, Human adenovirus D
cccgccacccuu

SEQ ID NO: 1562079 - RNA, 16 nt, Human adenovirus D
ccuuccugcagcucau

SEQ ID NO: 1562080 - RNA, 13 nt, Human adenovirus D
aggugcugcccca

SEQ ID NO: 1562081 - RNA, 13 nt, Human adenovirus D
acaugcagcugcc

SEQ ID NO: 1562082 - RNA, 17 nt, Human adenovirus D
cucggugcggcugcugc

SEQ ID NO: 1562083 - RNA, 18 nt, Human adenovirus D
agcaggggcgcugggcgu

SEQ ID NO: 1562084 - RNA, 19 nt, Human adenovirus D
accuguucagggaccgcag

SEQ ID NO: 1562085 - RNA, 14 nt, Human adenovirus D
cauggaaccuagca

SEQ ID NO: 1562086 - RNA, 15 nt, Human adenovirus D
gcaccugugggaccu

SEQ ID NO: 1562087 - RNA, 19 nt, Human adenovirus D
gagcucgucuuccaggagc

SEQ ID NO: 1562088 - RNA, 17 nt, Human adenovirus D
cguaagcaggagcagga

SEQ ID NO: 1562089 - RNA, 20 nt, Human adenovirus D
agcccaacggcaccugcgag

SEQ ID NO: 1562090 - RNA, 21 nt, Human adenovirus D
acgugcaguccaaccuggacc

SEQ ID NO: 1562091 - RNA, 19 nt, Human adenovirus D
gacgcugcgcuuugugccc

SEQ ID NO: 1562092 - RNA, 14 nt, Human adenovirus D
uaacauuugaauuu

SEQ ID NO: 1562093 - RNA, 16 nt, Human adenovirus D
gugguuuuucugguug

SEQ ID NO: 1562094 - RNA, 17 nt, Human adenovirus D
cgcgaggccauaggcca

SEQ ID NO: 1562095 - RNA, 20 nt, Human adenovirus D
ggcgcgccuuggaggccgcc

SEQ ID NO: 1562096 - RNA, 21 nt, Human adenovirus D
gagaugccccagcagaagcag

SEQ ID NO: 1562097 - RNA, 20 nt, Human adenovirus D
agaacacccaacugagcagg

SEQ ID NO: 1562098 - RNA, 23 nt, Human adenovirus D
auucuggacuucgcagccaugca

SEQ ID NO: 1562099 - RNA, 15 nt, Human adenovirus D
cgcgugacgcacugg

SEQ ID NO: 1562100 - RNA, 14 nt, Human adenovirus D
auggcaggcagcgg

SEQ ID NO: 1562101 - RNA, 19 nt, Human adenovirus D
cugcgcgagggccuggacc

SEQ ID NO: 1562102 - RNA, 16 nt, Human adenovirus D
ccagcgcgugcugcgc

SEQ ID NO: 1562103 - RNA, 18 nt, Human adenovirus D
ccagccacagccacagac

SEQ ID NO: 1562104 - RNA, 17 nt, Human adenovirus D
ccgugaccugcagcagg

SEQ ID NO: 1562105 - RNA, 17 nt, Human adenovirus D
gcugcacgagcgccagg

SEQ ID NO: 1562106 - RNA, 19 nt, Human adenovirus D
gaaggugguggacggccug

SEQ ID NO: 1562107 - RNA, 16 nt, Human adenovirus D
gaccggucgacgguga

SEQ ID NO: 1562108 - RNA, 20 nt, Human adenovirus D
cugggcguggugcuggauga

SEQ ID NO: 1562109 - RNA, 21 nt, Human adenovirus D
ccucaucacaucagccaggac

SEQ ID NO: 1562110 - RNA, 14 nt, Human adenovirus D
gcaggguaaagcca

SEQ ID NO: 1562111 - RNA, 21 nt, Human adenovirus D
gaaccccacaggaugaacagg

SEQ ID NO: 1562112 - RNA, 17 nt, Human adenovirus D
cagcgcauccugcaacu

SEQ ID NO: 1562113 - RNA, 20 nt, Human adenovirus D
cgcugagcgacgaccugggc

SEQ ID NO: 1562114 - RNA, 19 nt, Human adenovirus D
cagcaagccccggaccccg

SEQ ID NO: 1562115 - RNA, 20 nt, Human adenovirus D
gaugugcaguuuggccugga

SEQ ID NO: 1562116 - RNA, 18 nt, Human adenovirus D
uguaaagccacaaccaga

SEQ ID NO: 1562117 - RNA, 14 nt, Human adenovirus D
ccaaaaaaacacac

SEQ ID NO: 1562118 - RNA, 14 nt, Human adenovirus D
ugggcacccacgac

SEQ ID NO: 1562119 - RNA, 15 nt, Human adenovirus D
uccgcgaccuccucc

SEQ ID NO: 1562120 - RNA, 18 nt, Human adenovirus D
gcgcuuggugggcagagg

SEQ ID NO: 1562121 - RNA, 18 nt, Human adenovirus D
cccucaucacaucagcca

SEQ ID NO: 1562122 - RNA, 14 nt, Human adenovirus D
ccgacagcagcaca

SEQ ID NO: 1562123 - RNA, 15 nt, Human adenovirus D
ugccucuccaucagc

SEQ ID NO: 1562124 - RNA, 18 nt, Human adenovirus D
cauagucaucacccagca

SEQ ID NO: 1562125 - RNA, 15 nt, Human adenovirus D
gaucagaaacacaga

SEQ ID NO: 1562126 - RNA, 16 nt, Human adenovirus D
cguagaaauccacggc

SEQ ID NO: 1562127 - RNA, 13 nt, Human adenovirus D
uccugccugggaa

SEQ ID NO: 1562128 - RNA, 21 nt, Human adenovirus D
gcacccgguacuacgccagcc

SEQ ID NO: 1562129 - RNA, 16 nt, Human adenovirus D
ucuaccuuggucacau

SEQ ID NO: 1562130 - RNA, 23 nt, Human adenovirus D
ccacgaccggcagcggggccugg

SEQ ID NO: 1562131 - RNA, 13 nt, Human adenovirus D
gcgcuaccgcucc

SEQ ID NO: 1562132 - RNA, 20 nt, Human adenovirus D
ggaugcagccaguggcccug

SEQ ID NO: 1562133 - RNA, 16 nt, Human adenovirus D
gcggacugccaccgcc

SEQ ID NO: 1562134 - RNA, 20 nt, Human adenovirus D
ccuuugcggacuccgcgacc

SEQ ID NO: 1562135 - RNA, 22 nt, Human adenovirus D
uugcugaccaauagacagcaga

SEQ ID NO: 1562136 - RNA, 23 nt, Human adenovirus D
caagagcgagaugucugugaagc

SEQ ID NO: 1562137 - RNA, 23 nt, Human adenovirus D
ucaggaguggcggcccuggcugg

SEQ ID NO: 1562138 - RNA, 19 nt, Human adenovirus D
acaccgugaaaauggaugu

SEQ ID NO: 1562139 - RNA, 10 nt, Human adenovirus D
acauguggag

SEQ ID NO: 1562140 - RNA, 12 nt, Human adenovirus D
gcucacccgcag

SEQ ID NO: 1562141 - RNA, 17 nt, Human adenovirus D
cccaggcccuggagcag

SEQ ID NO: 1562142 - RNA, 19 nt, Human adenovirus D
gaaagcgguugagcgggcu

SEQ ID NO: 1562143 - RNA, 17 nt, Human adenovirus D
caagacaaaggaggcca

SEQ ID NO: 1562144 - RNA, 16 nt, Human adenovirus D
gcugcgaggagagcag

SEQ ID NO: 1562145 - RNA, 13 nt, Human adenovirus D
accacaccuguga

SEQ ID NO: 1562146 - RNA, 18 nt, Human adenovirus D
cgagcuggaagcccugag

SEQ ID NO: 1562147 - RNA, 13 nt, Human adenovirus D
uaucauucagagg

SEQ ID NO: 1562148 - RNA, 16 nt, Human adenovirus D
gucgccucggaccugg

SEQ ID NO: 1562149 - RNA, 16 nt, Human adenovirus D
gcggcgggggcggaga

SEQ ID NO: 1562150 - RNA, 22 nt, Human adenovirus D
cucgcugguggacgccuacauc

SEQ ID NO: 1562151 - RNA, 12 nt, Human adenovirus D
agcggcagggcu

SEQ ID NO: 1562152 - RNA, 13 nt, Human adenovirus D
uauaauaagcaga

SEQ ID NO: 1562153 - RNA, 21 nt, Human adenovirus D
gcugcugccgggcugcggggu

SEQ ID NO: 1562154 - RNA, 18 nt, Human adenovirus D
uacccaacaaccuuacca

SEQ ID NO: 1562155 - RNA, 21 nt, Human adenovirus D
gccgcgggcgccucccaggac

SEQ ID NO: 1562156 - RNA, 21 nt, Human adenovirus D
augcugagccugcgccgggcg

SEQ ID NO: 1562157 - RNA, 18 nt, Human adenovirus D
ugcauacaaaugcuucaa

SEQ ID NO: 1562158 - RNA, 17 nt, Human adenovirus D
gcucaaagaccagaacu

SEQ ID NO: 1562159 - RNA, 13 nt, Human adenovirus D
gcagacagggccu

SEQ ID NO: 1562160 - RNA, 17 nt, Human adenovirus D
ccaggcggaccagaaac

SEQ ID NO: 1562161 - RNA, 14 nt, Human adenovirus D
cuccaccacccacg

SEQ ID NO: 1562162 - RNA, 12 nt, Human adenovirus D
uauccccuuccu

SEQ ID NO: 1562163 - RNA, 20 nt, Human adenovirus D
ccucgagcaugaggcggugg

SEQ ID NO: 1562164 - RNA, 16 nt, Human adenovirus D
cgcgaacagcagcagc

SEQ ID NO: 1562165 - RNA, 14 nt, Human adenovirus D
ccauguuggaggaa

SEQ ID NO: 1562166 - RNA, 23 nt, Human adenovirus D
ugaagcaguguguguuugagaaa

SEQ ID NO: 1562167 - RNA, 18 nt, Human adenovirus D
agaucccgccgcaggaga

SEQ ID NO: 1562168 - RNA, 14 nt, Human adenovirus D
cgaaccaggcagug

SEQ ID NO: 1562169 - RNA, 23 nt, Human adenovirus D
gcggccguucaugggcaccugga

SEQ ID NO: 1562170 - RNA, 17 nt, Human adenovirus D
ugcaaguggggcggcaa

SEQ ID NO: 1562171 - RNA, 16 nt, Human adenovirus D
cuggccucgagcuaca

SEQ ID NO: 1562172 - RNA, 18 nt, Human adenovirus D
ugauggauguguggacua

SEQ ID NO: 1562173 - RNA, 15 nt, Human adenovirus D
ggcacgcucugaggc

SEQ ID NO: 1562174 - RNA, 20 nt, Human adenovirus D
aagccaggaaaagaggauga

SEQ ID NO: 1562175 - RNA, 17 nt, Human adenovirus D
cacucgcgggcggccau

SEQ ID NO: 1562176 - RNA, 18 nt, Human adenovirus D
agcgcgccgacccguggc

SEQ ID NO: 1562177 - RNA, 14 nt, Human adenovirus D
ccaaggauaacaug

SEQ ID NO: 1562178 - RNA, 15 nt, Human adenovirus D
cauugcaaggcagaa

SEQ ID NO: 1562179 - RNA, 21 nt, Human adenovirus D
gucaucaccuuccugcagcuc

SEQ ID NO: 1562180 - RNA, 15 nt, Human adenovirus D
cggaguaccugagcc

SEQ ID NO: 1562181 - RNA, 17 nt, Human adenovirus D
ucccagcgccgcgcugg

SEQ ID NO: 1562182 - RNA, 14 nt, Human adenovirus D
ucaaccuccaggcc

SEQ ID NO: 1562183 - RNA, 18 nt, Human adenovirus D
cgccagacgcacgggccg

SEQ ID NO: 1562184 - RNA, 14 nt, Human adenovirus D
ugguggaaacagac

SEQ ID NO: 1562185 - RNA, 16 nt, Human adenovirus D
gaccaccugcgcgagg

SEQ ID NO: 1562186 - RNA, 19 nt, Human adenovirus D
uccuggugguacagcacag

SEQ ID NO: 1562187 - RNA, 11 nt, Human adenovirus D
uuccucugugg

SEQ ID NO: 1562188 - RNA, 19 nt, Human adenovirus D
accugcagcaggugcugcc

SEQ ID NO: 1562189 - RNA, 23 nt, Human adenovirus D
cucgcgcucaucguugugcgccg

SEQ ID NO: 1562190 - RNA, 18 nt, Human adenovirus D
gacucauccugcuggugc

SEQ ID NO: 1562191 - RNA, 20 nt, Human adenovirus D
uggaacaccaucagacuggg

SEQ ID NO: 1562192 - RNA, 14 nt, Human adenovirus D
auggcgugcuggag

SEQ ID NO: 1562193 - RNA, 19 nt, Human adenovirus D
guugagucgcggcagaacc

SEQ ID NO: 1562194 - RNA, 13 nt, Human adenovirus D
cugcuccugcacu

SEQ ID NO: 1562195 - RNA, 23 nt, Human adenovirus D
ccugcucaccugcaccugcgucu

SEQ ID NO: 1562196 - RNA, 23 nt, Human adenovirus D
gaacccuccaguuuguggaggag

SEQ ID NO: 1562197 - RNA, 16 nt, Human adenovirus D
gaagagcguccgcagg

SEQ ID NO: 1562198 - RNA, 14 nt, Human adenovirus D
ugcaaacaauaaaa

SEQ ID NO: 1562199 - RNA, 11 nt, Human adenovirus D
gccgccaggcc

SEQ ID NO: 1562200 - RNA, 16 nt, Human adenovirus D
aggucaaaacccacuc

SEQ ID NO: 1562201 - RNA, 16 nt, Human adenovirus D
caacagauuuaagcaa

SEQ ID NO: 1562202 - RNA, 19 nt, Human adenovirus D
cccugagccgccagcuggc

SEQ ID NO: 1562203 - RNA, 14 nt, Human adenovirus D
cugcugccgagccg

SEQ ID NO: 1562204 - RNA, 16 nt, Human adenovirus D
aggcuggagccgcgac

SEQ ID NO: 1562205 - RNA, 18 nt, Human adenovirus D
aacaaaacccaugaaaga

SEQ ID NO: 1562206 - RNA, 20 nt, Human adenovirus D
acugguacuugggcugccac

SEQ ID NO: 1562207 - RNA, 16 nt, Human adenovirus D
gaugaugccgcagugg

SEQ ID NO: 1562208 - RNA, 12 nt, Human adenovirus D
cagccgagccgg

SEQ ID NO: 1562209 - RNA, 21 nt, Human adenovirus D
ccaguaggaaccagcacacuc

SEQ ID NO: 1562210 - RNA, 18 nt, Human adenovirus D
ugcagccaguggcccugg

SEQ ID NO: 1562211 - RNA, 21 nt, Human adenovirus D
ggucagcgaugagcagcuugc

SEQ ID NO: 1562212 - RNA, 15 nt, Human adenovirus D
gcaggcgggacagag

SEQ ID NO: 1562213 - RNA, 10 nt, Human adenovirus D
cccagugcuu

SEQ ID NO: 1562214 - RNA, 14 nt, Human adenovirus D
gaugggucugugcc

SEQ ID NO: 1562215 - RNA, 16 nt, Human adenovirus D
ucaaagugugaaaauu

SEQ ID NO: 1562216 - RNA, 22 nt, Human adenovirus D
ggccccgccaaccggcugaugc

SEQ ID NO: 1562217 - RNA, 15 nt, Human adenovirus D
augaacaggagcacg

SEQ ID NO: 1562218 - RNA, 20 nt, Human adenovirus D
auccagccuguacccagagc

SEQ ID NO: 1562219 - RNA, 19 nt, Human adenovirus D
gagcaccccaacggcccug

SEQ ID NO: 1562220 - RNA, 20 nt, Human adenovirus D
gagcucuuaagaaagacaca

SEQ ID NO: 1562221 - RNA, 15 nt, Human adenovirus D
cagcagggugccucc

SEQ ID NO: 1562222 - RNA, 18 nt, Human adenovirus D
cuggaccaggcggcagag

SEQ ID NO: 1562223 - RNA, 20 nt, Human adenovirus D
uacccagcaagucagcaacu

SEQ ID NO: 1562224 - RNA, 14 nt, Human adenovirus D
cgccggcucaagca

SEQ ID NO: 1562225 - RNA, 16 nt, Human adenovirus D
gucagaaugugauggg

SEQ ID NO: 1562226 - RNA, 13 nt, Human adenovirus D
uuccagcccaggg

SEQ ID NO: 1562227 - RNA, 16 nt, Human adenovirus D
acucccucccucggcu

SEQ ID NO: 1562228 - RNA, 16 nt, Human adenovirus D
gcgucgacggcgccuc

SEQ ID NO: 1562229 - RNA, 17 nt, Human adenovirus D
gacgcccuugugcccgc

SEQ ID NO: 1562230 - RNA, 14 nt, Human adenovirus D
uacccacugggugg

SEQ ID NO: 1562231 - RNA, 21 nt, Human adenovirus D
gcugacauccauggccagggg

SEQ ID NO: 1562232 - RNA, 14 nt, Human adenovirus D
cccgauagccgcca

SEQ ID NO: 1562233 - RNA, 22 nt, Human adenovirus D
aaagugcuggaggguugaaaga

SEQ ID NO: 1562234 - RNA, 18 nt, Human adenovirus D
gaugugcaguuuggccug

SEQ ID NO: 1562235 - RNA, 20 nt, Human adenovirus D
agcauuacuauuacugccac

SEQ ID NO: 1562236 - RNA, 18 nt, Human adenovirus D
cagggcgcacuacagccg

SEQ ID NO: 1562237 - RNA, 19 nt, Human adenovirus D
cuggaucgaaaucaaaauc

SEQ ID NO: 1562238 - RNA, 15 nt, Human adenovirus D
uggaugcggagccgc

SEQ ID NO: 1562239 - RNA, 23 nt, Human adenovirus D
guccgcacgguaagagcccagca

SEQ ID NO: 1562240 - RNA, 13 nt, Human adenovirus D
gacgagcucgccg

SEQ ID NO: 1562241 - RNA, 17 nt, Human adenovirus D
aggcaaagcucaacccg

SEQ ID NO: 1562242 - RNA, 19 nt, Human adenovirus D
ggccggcgcgcccggggcc

SEQ ID NO: 1562243 - RNA, 13 nt, Human adenovirus D
gaggugcagaccg

SEQ ID NO: 1562244 - RNA, 23 nt, Human adenovirus D
gagccaagaaacgucccagcagc

SEQ ID NO: 1562245 - RNA, 14 nt, Human adenovirus D
cccagcaacccuuc

SEQ ID NO: 1562246 - RNA, 13 nt, Human adenovirus D
accuccugggcau

SEQ ID NO: 1562247 - RNA, 19 nt, Human adenovirus D
cguaggagucuugcagcuu

SEQ ID NO: 1562248 - RNA, 15 nt, Human adenovirus D
guucucgcuggucac

SEQ ID NO: 1562249 - RNA, 22 nt, Human adenovirus D
cccuccccgacccccuuccacu

SEQ ID NO: 1562250 - RNA, 13 nt, Human adenovirus D
accgaaggcagcu

SEQ ID NO: 1562251 - RNA, 13 nt, Human adenovirus D
gaaauaaaaaacc

SEQ ID NO: 1562252 - RNA, 20 nt, Human adenovirus D
cuuaguucagcugcaaugau

SEQ ID NO: 1562253 - RNA, 13 nt, Human adenovirus D
ccgccgcggccau

SEQ ID NO: 1562254 - RNA, 22 nt, Human adenovirus D
cgcugcaaccugugcucuccgc

SEQ ID NO: 1562255 - RNA, 18 nt, Human adenovirus D
gccgccucugcgugaaga

SEQ ID NO: 1562256 - RNA, 13 nt, Human adenovirus D
cucugugcccagu

SEQ ID NO: 1562257 - RNA, 16 nt, Human adenovirus D
cuacaaucgccacagg

SEQ ID NO: 1562258 - RNA, 15 nt, Human adenovirus D
ugggcgugcagaccg

SEQ ID NO: 1562259 - RNA, 16 nt, Human adenovirus D
cggcgcguggaggaag

SEQ ID NO: 1562260 - RNA, 13 nt, Human adenovirus D
ggcgucccgcggu

SEQ ID NO: 1562261 - RNA, 23 nt, Human adenovirus D
ucacagcuaagaaaaaaucagag

SEQ ID NO: 1562262 - RNA, 17 nt, Human adenovirus D
ggcccacggccaucuuu

SEQ ID NO: 1562263 - RNA, 23 nt, Human adenovirus D
ugcgguacugguacuugggcugc

SEQ ID NO: 1562264 - RNA, 18 nt, Human adenovirus D
cuuccuauuuaacauccu

SEQ ID NO: 1562265 - RNA, 18 nt, Human adenovirus D
ccucuuugcccugcucac

SEQ ID NO: 1562266 - RNA, 15 nt, Human adenovirus D
cgggccaugaggguc

SEQ ID NO: 1562267 - RNA, 20 nt, Human adenovirus D
cggccguccuuucgcugcug

SEQ ID NO: 1562268 - RNA, 19 nt, Human adenovirus D
accaggaugcagccagugg

SEQ ID NO: 1562269 - RNA, 16 nt, Human adenovirus D
cucggaguaccugagc

SEQ ID NO: 1562270 - RNA, 17 nt, Human adenovirus D
ugggaucuuuauucuug

SEQ ID NO: 1562271 - RNA, 23 nt, Human adenovirus D
gaagcgcucgaucaucuccccgc

SEQ ID NO: 1562272 - RNA, 20 nt, Human adenovirus D
ucacucuggccgugggcgac

SEQ ID NO: 1562273 - RNA, 17 nt, Human adenovirus D
ccggaggcgugcacugg

SEQ ID NO: 1562274 - RNA, 15 nt, Human adenovirus D
guagcugcgcggggc

SEQ ID NO: 1562275 - RNA, 14 nt, Human adenovirus D
ccugaaggagcugg

SEQ ID NO: 1562276 - RNA, 22 nt, Human adenovirus D
agcugcuugccgaaggacccca

SEQ ID NO: 1562277 - RNA, 15 nt, Human adenovirus D
gccgucacccugccc

SEQ ID NO: 1562278 - RNA, 19 nt, Human adenovirus D
cacaccaggaugcagccag

SEQ ID NO: 1562279 - RNA, 13 nt, Human adenovirus D
acaauaaaaauua

SEQ ID NO: 1562280 - RNA, 12 nt, Human adenovirus D
cucaacaucaca

SEQ ID NO: 1562281 - RNA, 22 nt, Human adenovirus D
cucacccuggggcuccucgagg

SEQ ID NO: 1562282 - RNA, 21 nt, Human adenovirus D
ggcggccuuugaugugcggca

SEQ ID NO: 1562283 - RNA, 13 nt, Human adenovirus D
caccgccuccacc

SEQ ID NO: 1562284 - RNA, 14 nt, Human adenovirus D
cgacccaugagcug

SEQ ID NO: 1562285 - RNA, 18 nt, Human adenovirus D
gaaaaacagaaagcaugc

SEQ ID NO: 1562286 - RNA, 17 nt, Human adenovirus D
gugaccaagcuggugau

SEQ ID NO: 1562287 - RNA, 16 nt, Human adenovirus D
cgguggccccgaccca

SEQ ID NO: 1562288 - RNA, 13 nt, Human adenovirus D
cagacagccaggu

SEQ ID NO: 1562289 - RNA, 22 nt, Human adenovirus D
gccucuccaucagcgcccucag

SEQ ID NO: 1562290 - RNA, 23 nt, Human adenovirus D
agacugauggccacggggagccc

SEQ ID NO: 1562291 - RNA, 15 nt, Human adenovirus D
gagcugagcgaccgc

SEQ ID NO: 1562292 - RNA, 14 nt, Human adenovirus D
cagggaacugaaag

SEQ ID NO: 1562293 - RNA, 14 nt, Human adenovirus D
ccccgcggcggcga

SEQ ID NO: 1562294 - RNA, 20 nt, Human adenovirus D
agcagcaagagcucaaagua

SEQ ID NO: 1562295 - RNA, 15 nt, Human adenovirus D
caucuucugccuggu

SEQ ID NO: 1562296 - RNA, 11 nt, Human adenovirus D
gaaugcugcua

SEQ ID NO: 1562297 - RNA, 18 nt, Human adenovirus D
ggacagccagcagaagaa

SEQ ID NO: 1562298 - RNA, 16 nt, Human adenovirus D
gcgcccuucaccgaca

SEQ ID NO: 1562299 - RNA, 16 nt, Human adenovirus D
cuugaccugccuccac

SEQ ID NO: 1562300 - RNA, 17 nt, Human adenovirus D
gccgcggcgagcgggac

SEQ ID NO: 1562301 - RNA, 15 nt, Human adenovirus D
gcugaugcugagccu

SEQ ID NO: 1562302 - RNA, 21 nt, Human adenovirus D
gccaggccuccgagcagcgca

SEQ ID NO: 1562303 - RNA, 13 nt, Human adenovirus D
cacaggcacacug

SEQ ID NO: 1562304 - RNA, 20 nt, Human adenovirus D
ccaugcccuuuucccaggac

SEQ ID NO: 1562305 - RNA, 13 nt, Human adenovirus D
gugaucugcuuga

SEQ ID NO: 1562306 - RNA, 17 nt, Human adenovirus D
ccgacuucaugagccag

SEQ ID NO: 1562307 - RNA, 13 nt, Human adenovirus D
gcccuugccaccu

SEQ ID NO: 1562308 - RNA, 19 nt, Human adenovirus D
agcagcccuguggacgcug

SEQ ID NO: 1562309 - RNA, 19 nt, Human adenovirus D
cccgcucaucggccagaca

SEQ ID NO: 1562310 - RNA, 23 nt, Human adenovirus D
aauaaaaaacuugagcuuguuua

SEQ ID NO: 1562311 - RNA, 16 nt, Human adenovirus D
gcagggagccagggga

SEQ ID NO: 1562312 - RNA, 20 nt, Human adenovirus D
cgcuuggugggcagaggagg

SEQ ID NO: 1562313 - RNA, 12 nt, Human adenovirus D
ccuugccuuccu

SEQ ID NO: 1562314 - RNA, 21 nt, Human adenovirus D
gagggucacacuagcgcccug

SEQ ID NO: 1562315 - RNA, 18 nt, Human adenovirus D
gcucuucccgcugaacug

SEQ ID NO: 1562316 - RNA, 12 nt, Human adenovirus D
ugccugccccuc

SEQ ID NO: 1562317 - RNA, 21 nt, Human adenovirus D
cuucagcauguggaacucugc

SEQ ID NO: 1562318 - RNA, 22 nt, Human adenovirus D
ugcagaccgaccccuggcuccc

SEQ ID NO: 1562319 - RNA, 13 nt, Human adenovirus D
caccagccgcacc

SEQ ID NO: 1562320 - RNA, 20 nt, Human adenovirus D
ggcauuggagaaugcugcua

SEQ ID NO: 1562321 - RNA, 14 nt, Human adenovirus D
aucucauggucuga

SEQ ID NO: 1562322 - RNA, 14 nt, Human adenovirus D
gccacgugaccagg

SEQ ID NO: 1562323 - RNA, 17 nt, Human adenovirus D
gacguggacagcgcggu

SEQ ID NO: 1562324 - RNA, 12 nt, Human adenovirus D
cgggcucuuccu

SEQ ID NO: 1562325 - RNA, 19 nt, Human adenovirus D
augaccauagaccugauga

SEQ ID NO: 1562326 - RNA, 22 nt, Human adenovirus D
agucaaaagaaaacuaaugaca

SEQ ID NO: 1562327 - RNA, 18 nt, Human adenovirus D
cuggccgugguccugguc

SEQ ID NO: 1562328 - RNA, 18 nt, Human adenovirus D
cgcccggcguacgugccu

SEQ ID NO: 1562329 - RNA, 13 nt, Human adenovirus D
ugcccccuccacu

SEQ ID NO: 1562330 - RNA, 21 nt, Human adenovirus D
cgcccagcaauaacaccggcu

SEQ ID NO: 1562331 - RNA, 20 nt, Human adenovirus D
caccgacagucugagggcca

SEQ ID NO: 1562332 - RNA, 18 nt, Human adenovirus D
caggcgcaaccaggagga

SEQ ID NO: 1562333 - RNA, 21 nt, Human adenovirus D
acucggugcuuagccugggca

SEQ ID NO: 1562334 - RNA, 19 nt, Human adenovirus D
ccuagcauguacgccgcca

SEQ ID NO: 1562335 - RNA, 13 nt, Human adenovirus D
caccacugcaugg

SEQ ID NO: 1562336 - RNA, 15 nt, Human adenovirus D
ccaaccggcugaugc

SEQ ID NO: 1562337 - RNA, 13 nt, Human adenovirus D
guccccgcccgcc

SEQ ID NO: 1562338 - RNA, 19 nt, Human adenovirus D
gagggcaugggucaggcag

SEQ ID NO: 1562339 - RNA, 19 nt, Human adenovirus D
gacggcgcagcuguuccug

SEQ ID NO: 1562340 - RNA, 17 nt, Human adenovirus D
gcuccaccaccugcagc

SEQ ID NO: 1562341 - RNA, 17 nt, Human adenovirus D
ucaaugucagcugcaaa

SEQ ID NO: 1562342 - RNA, 24 nt, Human adenovirus D
ggguagguauucccucucgagagc

SEQ ID NO: 1562343 - RNA, 14 nt, Human adenovirus D
uggccccggggcgg

SEQ ID NO: 1562344 - RNA, 22 nt, Human adenovirus D
cuaagguggcuauuuucacuga

SEQ ID NO: 1562345 - RNA, 15 nt, Human adenovirus D
ggcacagacgaagaa

SEQ ID NO: 1562346 - RNA, 22 nt, Human adenovirus D
auccaacugaaguacauccauu

SEQ ID NO: 1562347 - RNA, 13 nt, Human adenovirus D
gcgagacccaggu

SEQ ID NO: 1562348 - RNA, 16 nt, Human adenovirus D
cggcagccgcagccgc

SEQ ID NO: 1562349 - RNA, 15 nt, Human adenovirus D
ccgcuguggagccac

SEQ ID NO: 1562350 - RNA, 14 nt, Human adenovirus D
cucaaugucagcug

SEQ ID NO: 1562351 - RNA, 18 nt, Human adenovirus D
cucagucacucucauuuc

SEQ ID NO: 1562352 - RNA, 17 nt, Human adenovirus D
gacgacugggaggcugc

SEQ ID NO: 1562353 - RNA, 22 nt, Human adenovirus D
cccauaauucagggugcuccag

SEQ ID NO: 1562354 - RNA, 13 nt, Human adenovirus D
gacggugagcagc

SEQ ID NO: 1562355 - RNA, 15 nt, Human adenovirus D
cugcgauauggauga

SEQ ID NO: 1562356 - RNA, 15 nt, Human adenovirus D
gcuauaaaucuuuuc

SEQ ID NO: 1562357 - RNA, 17 nt, Human adenovirus D
gaagaacauccauguga

SEQ ID NO: 1562358 - RNA, 13 nt, Human adenovirus D
uuaaaggcaccuu

SEQ ID NO: 1562359 - RNA, 15 nt, Human adenovirus D
gccgccgggccauga

SEQ ID NO: 1562360 - RNA, 16 nt, Human adenovirus D
cgcagacgagcggccg

SEQ ID NO: 1562361 - RNA, 21 nt, Human adenovirus D
ucaccguagagggcaccaccg

SEQ ID NO: 1562362 - RNA, 14 nt, Human adenovirus D
gagcugacggccag

SEQ ID NO: 1562363 - RNA, 16 nt, Human adenovirus D
aggggucuaucuggac

SEQ ID NO: 1562364 - RNA, 14 nt, Human adenovirus D
ccgcagcucuuccc

SEQ ID NO: 1562365 - RNA, 16 nt, Human adenovirus D
gcaagggcgaccagcu

SEQ ID NO: 1562366 - RNA, 20 nt, Human adenovirus D
ugcguggaagaauuuggaga

SEQ ID NO: 1562367 - RNA, 19 nt, Human adenovirus D
gcucgccgaggaggcgguc

SEQ ID NO: 1562368 - RNA, 21 nt, Human adenovirus D
gggcgcccagugcuuccagca

SEQ ID NO: 1562369 - RNA, 16 nt, Human adenovirus D
agguguccgagcuccg

SEQ ID NO: 1562370 - RNA, 14 nt, Human adenovirus D
ccaggcccagaacu

SEQ ID NO: 1562371 - RNA, 14 nt, Human adenovirus D
acagcgugguggcg

SEQ ID NO: 1562372 - RNA, 15 nt, Human adenovirus D
gcgauguugccaccc

SEQ ID NO: 1562373 - RNA, 12 nt, Human adenovirus D
gggagcgguggg

SEQ ID NO: 1562374 - RNA, 17 nt, Human adenovirus D
cuccaacgccugcgcca

SEQ ID NO: 1562375 - RNA, 12 nt, Human adenovirus D
agcacagcaccg

SEQ ID NO: 1562376 - RNA, 16 nt, Human adenovirus D
ccaaugcaacaugacc

SEQ ID NO: 1562377 - RNA, 23 nt, Human adenovirus D
ggcggaggcguacaugccgcaaa

SEQ ID NO: 1562378 - RNA, 14 nt, Human adenovirus D
gacaaagagcacag

SEQ ID NO: 1562379 - RNA, 16 nt, Human adenovirus D
ggcgccaucuugccca

SEQ ID NO: 1562380 - RNA, 11 nt, Human adenovirus D
cgcaccucgcg

SEQ ID NO: 1562381 - RNA, 17 nt, Human adenovirus D
augaaggcuuucacagc

SEQ ID NO: 1562382 - RNA, 21 nt, Human adenovirus D
agcacaugguaauccacggac

SEQ ID NO: 1562383 - RNA, 20 nt, Human adenovirus D
cgggaugaugaccgagcuga

SEQ ID NO: 1562384 - RNA, 23 nt, Human adenovirus D
aauaagcagaguacucauaaaga

SEQ ID NO: 1562385 - RNA, 22 nt, Human adenovirus D
cuguauuaccuuccuugcugga

SEQ ID NO: 1562386 - RNA, 16 nt, Human adenovirus D
ggucagaacauguucu

SEQ ID NO: 1562387 - RNA, 15 nt, Human adenovirus D
ucagguguccagcug

SEQ ID NO: 1562388 - RNA, 16 nt, Human adenovirus D
cagaaggacgugcgcc

SEQ ID NO: 1562389 - RNA, 23 nt, Human adenovirus D
ccucacaguccaggucacagucu

SEQ ID NO: 1562390 - RNA, 19 nt, Human adenovirus D
uggucagagugcaccagcc

SEQ ID NO: 1562391 - RNA, 20 nt, Human adenovirus D
ucauggccaacagccacaug

SEQ ID NO: 1562392 - RNA, 20 nt, Human adenovirus D
gugccuuuaucagcacugca

SEQ ID NO: 1562393 - RNA, 13 nt, Human adenovirus D
caggugcugccca

SEQ ID NO: 1562394 - RNA, 12 nt, Human adenovirus D
cgcuagccagcc

SEQ ID NO: 1562395 - RNA, 17 nt, Human adenovirus D
cagcccaaacuggggcg

SEQ ID NO: 1562396 - RNA, 15 nt, Human adenovirus D
augggaacauauauc

SEQ ID NO: 1562397 - RNA, 14 nt, Human adenovirus D
gguaagagcccagc

SEQ ID NO: 1562398 - RNA, 17 nt, Human adenovirus D
ggugagcucgggcugcu

SEQ ID NO: 1562399 - RNA, 22 nt, Human adenovirus D
gcugagcgaccgcgagcugaug

SEQ ID NO: 1562400 - RNA, 16 nt, Human adenovirus D
gacgcaagagccggcg

SEQ ID NO: 1562401 - RNA, 13 nt, Human adenovirus D
aucagcacugcaa

SEQ ID NO: 1562402 - RNA, 18 nt, Human adenovirus D
cccugcaagugcacagac

SEQ ID NO: 1562403 - RNA, 19 nt, Human adenovirus D
acggacuugauuggccugu

SEQ ID NO: 1562404 - RNA, 17 nt, Human adenovirus D
gcccgugggcugcggcu

SEQ ID NO: 1562405 - RNA, 13 nt, Human adenovirus D
gcugaaagcaugg

SEQ ID NO: 1562406 - RNA, 22 nt, Human adenovirus D
cauggcgcucaaggugcugacg

SEQ ID NO: 1562407 - RNA, 19 nt, Human adenovirus D
gaggagcgcauccugagau

SEQ ID NO: 1562408 - RNA, 16 nt, Human adenovirus D
gagcaaccuccugggc

SEQ ID NO: 1562409 - RNA, 19 nt, Human adenovirus D
cugagauaugugcagcaga

SEQ ID NO: 1562410 - RNA, 15 nt, Human adenovirus D
ccuggcucccagccu

SEQ ID NO: 1562411 - RNA, 20 nt, Human adenovirus D
cgaggaggccgugaaggccg

SEQ ID NO: 1562412 - RNA, 22 nt, Human adenovirus D
ucgaagauucuggagaaguucc

SEQ ID NO: 1562413 - RNA, 19 nt, Human adenovirus D
ucccucccucggcucgggu

SEQ ID NO: 1562414 - RNA, 23 nt, Human adenovirus D
uagggcgccaucuugcccacguc

SEQ ID NO: 1562415 - RNA, 15 nt, Human adenovirus D
cagcgaaagagagcu

SEQ ID NO: 1562416 - RNA, 15 nt, Human adenovirus D
ggcucggugcggcug

SEQ ID NO: 1562417 - RNA, 16 nt, Human adenovirus D
gcagacuuuagcaaga

SEQ ID NO: 1562418 - RNA, 17 nt, Human adenovirus D
gcuagagugccacugcc

SEQ ID NO: 1562419 - RNA, 20 nt, Human adenovirus D
aggagaacugcuggcccugc

SEQ ID NO: 1562420 - RNA, 21 nt, Human adenovirus D
gaggcguucagggaggcgcug

SEQ ID NO: 1562421 - RNA, 21 nt, Human adenovirus D
agaggagucgccggaggaggc

SEQ ID NO: 1562422 - RNA, 17 nt, Human adenovirus D
gcgauguugagcuggac

SEQ ID NO: 1562423 - RNA, 19 nt, Human adenovirus D
gcgaccgcgagcugaugcu

SEQ ID NO: 1562424 - RNA, 16 nt, Human adenovirus D
acucuuccgccgccga

SEQ ID NO: 1562425 - RNA, 15 nt, Human adenovirus D
gcggcgcgagcugag

SEQ ID NO: 1562426 - RNA, 23 nt, Human adenovirus D
gaccagggguccccgacgggggg

SEQ ID NO: 1562427 - RNA, 19 nt, Human adenovirus D
acccuaaucaauguaacua

SEQ ID NO: 1562428 - RNA, 16 nt, Human adenovirus D
ucacccugcccuucca

SEQ ID NO: 1562429 - RNA, 14 nt, Human adenovirus D
acgcaagagccggc

SEQ ID NO: 1562430 - RNA, 18 nt, Human adenovirus D
ugccagauugggggacga

SEQ ID NO: 1562431 - RNA, 15 nt, Human adenovirus D
gacguggugcugcug

SEQ ID NO: 1562432 - RNA, 14 nt, Human adenovirus D
aacgucccagcagc

SEQ ID NO: 1562433 - RNA, 13 nt, Human adenovirus D
ugccuugucuauc

SEQ ID NO: 1562434 - RNA, 17 nt, Human adenovirus D
ccaguuugggcacuggg

SEQ ID NO: 1562435 - RNA, 16 nt, Human adenovirus D
cugcuggcccacggcc

SEQ ID NO: 1562436 - RNA, 13 nt, Human adenovirus D
cgcuagccagcca

SEQ ID NO: 1562437 - RNA, 15 nt, Human adenovirus D
gaccauucugcacac

SEQ ID NO: 1562438 - RNA, 15 nt, Human adenovirus D
ucccagccuccaccg

SEQ ID NO: 1562439 - RNA, 18 nt, Human adenovirus D
ucacucuggccgugggcg

SEQ ID NO: 1562440 - RNA, 23 nt, Human adenovirus D
guacuuugucugcuguaaagcca

SEQ ID NO: 1562441 - RNA, 12 nt, Human adenovirus D
agaacaaggcca

SEQ ID NO: 1562442 - RNA, 22 nt, Human adenovirus D
gucacccugcccuuccagcaca

SEQ ID NO: 1562443 - RNA, 15 nt, Human adenovirus D
ggcagggagcugcgc

SEQ ID NO: 1562444 - RNA, 15 nt, Human adenovirus D
acugccgcugcaacc

SEQ ID NO: 1562445 - RNA, 20 nt, Human adenovirus D
uacagaugguagcagcagag

SEQ ID NO: 1562446 - RNA, 22 nt, Human adenovirus D
agcaagacacgccggcuuguag

SEQ ID NO: 1562447 - RNA, 13 nt, Human adenovirus D
aucuuccuggggc

SEQ ID NO: 1562448 - RNA, 23 nt, Human adenovirus D
gauguaaguuuuauggcugcugg

SEQ ID NO: 1562449 - RNA, 15 nt, Human adenovirus D
acuugauuggccugu

SEQ ID NO: 1562450 - RNA, 13 nt, Human adenovirus D
cacaggugcugcc

SEQ ID NO: 1562451 - RNA, 13 nt, Human adenovirus D
agaaggccggggc

SEQ ID NO: 1562452 - RNA, 23 nt, Human adenovirus D
gccagaaggggcaccuuccagcc

SEQ ID NO: 1562453 - RNA, 17 nt, Human adenovirus D
guacaugauccagcggc

SEQ ID NO: 1562454 - RNA, 24 nt, Human adenovirus D
cgcguaaauuggaaggggcgcagg

SEQ ID NO: 1562455 - RNA, 18 nt, Human adenovirus D
aguacauagugaccaaga

SEQ ID NO: 1562456 - RNA, 21 nt, Human adenovirus D
aagccuucuauggaggcagag

SEQ ID NO: 1562457 - RNA, 21 nt, Human adenovirus D
ggcucuuccuccguagccugg

SEQ ID NO: 1562458 - RNA, 19 nt, Human adenovirus D
gcacuuucauucucgagcg

SEQ ID NO: 1562459 - RNA, 14 nt, Human adenovirus D
gcugcucaccaccc

SEQ ID NO: 1562460 - RNA, 18 nt, Human adenovirus D
aguuuaauaaaagcuaaa

SEQ ID NO: 1562461 - RNA, 20 nt, Human adenovirus D
gcacaggcacacugacauac

SEQ ID NO: 1562462 - RNA, 16 nt, Human adenovirus D
gcugcugaucgcgccc

SEQ ID NO: 1562463 - RNA, 22 nt, Human adenovirus D
ugaaccugaacggcaucuuuga

SEQ ID NO: 1562464 - RNA, 15 nt, Human adenovirus D
ccgcucggccaugcc

SEQ ID NO: 1562465 - RNA, 15 nt, Human adenovirus D
ccugcagcgccaguc

SEQ ID NO: 1562466 - RNA, 14 nt, Human adenovirus D
ucgcggaugauguc

SEQ ID NO: 1562467 - RNA, 16 nt, Human adenovirus D
uccgcgaacagcagca

SEQ ID NO: 1562468 - RNA, 20 nt, Human adenovirus D
uuucaaauuuuauguaucuu

SEQ ID NO: 1562469 - RNA, 15 nt, Human adenovirus D
gucugccccccgccc

SEQ ID NO: 1562470 - RNA, 13 nt, Human adenovirus D
aagacccacagcc

SEQ ID NO: 1562471 - RNA, 13 nt, Human adenovirus D
uaccuucgagcug

SEQ ID NO: 1562472 - RNA, 17 nt, Human adenovirus D
ccugcagcaggugcugc

SEQ ID NO: 1562473 - RNA, 17 nt, Human adenovirus D
gguacuccagucuccgg

SEQ ID NO: 1562474 - RNA, 23 nt, Human adenovirus D
agcgguucugggucaccuuggcu

SEQ ID NO: 1562475 - RNA, 20 nt, Human adenovirus D
cuuccguugcgcugcaggcg

SEQ ID NO: 1562476 - RNA, 23 nt, Human adenovirus D
agcgguugagcgggcucuuccuc

SEQ ID NO: 1562477 - RNA, 16 nt, Human adenovirus D
caguuaaugcugccuu

SEQ ID NO: 1562478 - RNA, 22 nt, Human adenovirus D
cagcagugucucgaggacgaga

SEQ ID NO: 1562479 - RNA, 16 nt, Human adenovirus D
gcagaggucuggggcg

SEQ ID NO: 1562480 - RNA, 23 nt, Human adenovirus D
ccccaggcggugcugcugccgag

SEQ ID NO: 1562481 - RNA, 23 nt, Human adenovirus D
ugaacuacuggcuucuacagcca

SEQ ID NO: 1562482 - RNA, 24 nt, Human adenovirus D
cgagcccgagggucgcuggcugcu

SEQ ID NO: 1562483 - RNA, 18 nt, Human adenovirus D
cauugaauggcacuggca

SEQ ID NO: 1562484 - RNA, 15 nt, Human adenovirus D
ugcggcugaugguga

SEQ ID NO: 1562485 - RNA, 11 nt, Human adenovirus D
gcuccaaagcu

SEQ ID NO: 1562486 - RNA, 19 nt, Human adenovirus D
gaaaccccagacacccacg

SEQ ID NO: 1562487 - RNA, 16 nt, Human adenovirus D
agagaugagagucuga

SEQ ID NO: 1562488 - RNA, 14 nt, Human adenovirus D
aacagacagccagg

SEQ ID NO: 1562489 - RNA, 14 nt, Human adenovirus D
gaaccgccuggggc

SEQ ID NO: 1562490 - RNA, 22 nt, Human adenovirus D
accgcagcggggaggagcccga

SEQ ID NO: 1562491 - RNA, 22 nt, Human adenovirus D
gcugaugucgccgauggccucc

SEQ ID NO: 1562492 - RNA, 20 nt, Human adenovirus D
acaggccuaacuacauuggc

SEQ ID NO: 1562493 - RNA, 22 nt, Human adenovirus D
acauuccugcaccauccccagg

SEQ ID NO: 1562494 - RNA, 16 nt, Human adenovirus D
cugcagggagccaggg

SEQ ID NO: 1562495 - RNA, 22 nt, Human adenovirus D
ucauaucccaggggacuggaaa

SEQ ID NO: 1562496 - RNA, 22 nt, Human adenovirus D
ccugcacgagaaccgccugggg

SEQ ID NO: 1562497 - RNA, 23 nt, Human adenovirus D
aaucaggaugguuuacaauuuug

SEQ ID NO: 1562498 - RNA, 14 nt, Human adenovirus D
cuuaaccacccacg

SEQ ID NO: 1562499 - RNA, 16 nt, Human adenovirus D
guugcgcagcggcagg

SEQ ID NO: 1562500 - RNA, 13 nt, Human adenovirus D
ucgagagcgggca

SEQ ID NO: 1562501 - RNA, 11 nt, Human adenovirus D
cuuuggcuuuu

SEQ ID NO: 1562502 - RNA, 13 nt, Human adenovirus D
uagacauggccag

SEQ ID NO: 1562503 - RNA, 16 nt, Human adenovirus D
agacauggccagcacg

SEQ ID NO: 1562504 - RNA, 16 nt, Human adenovirus D
cuccacgccaccaccc

SEQ ID NO: 1562505 - RNA, 14 nt, Human adenovirus D
cugcagacaucaug

SEQ ID NO: 1562506 - RNA, 23 nt, Human adenovirus D
cucgcagaucugcaucucccagg

SEQ ID NO: 1562507 - RNA, 14 nt, Human adenovirus D
caugugaacaaaac

SEQ ID NO: 1562508 - RNA, 18 nt, Human adenovirus D
ccuuguagggacagcagc

SEQ ID NO: 1562509 - RNA, 14 nt, Human adenovirus D
gauggggccccgcc

SEQ ID NO: 1562510 - RNA, 14 nt, Human adenovirus D
cuccguuguacgac

SEQ ID NO: 1562511 - RNA, 13 nt, Human adenovirus D
ccgccaacaccaa

SEQ ID NO: 1562512 - RNA, 22 nt, Human adenovirus D
aggugaugccggcagcgguggu

SEQ ID NO: 1562513 - RNA, 20 nt, Human adenovirus D
gccagcugaacgggggcgcc

SEQ ID NO: 1562514 - RNA, 14 nt, Human adenovirus D
gaagaucagcugca

SEQ ID NO: 1562515 - RNA, 16 nt, Human adenovirus D
cgggcgggcagggagc

SEQ ID NO: 1562516 - RNA, 13 nt, Human adenovirus D
gugcucccauagc

SEQ ID NO: 1562517 - RNA, 17 nt, Human adenovirus D
cggacguggugcugcug

SEQ ID NO: 1562518 - RNA, 18 nt, Human adenovirus D
aucgaacacgccaccgcu

SEQ ID NO: 1562519 - RNA, 22 nt, Human adenovirus D
gcgccucccaggacuacuccac

SEQ ID NO: 1562520 - RNA, 16 nt, Human adenovirus D
cuggcuucuacagcca

SEQ ID NO: 1562521 - RNA, 22 nt, Human adenovirus D
aggagcagcgccccgaggacac

SEQ ID NO: 1562522 - RNA, 16 nt, Human adenovirus D
caucacaucagccagg

SEQ ID NO: 1562523 - RNA, 22 nt, Human adenovirus D
cugagguaaaauucaacugcag

SEQ ID NO: 1562524 - RNA, 17 nt, Human adenovirus D
agggggcgguggcagga

SEQ ID NO: 1562525 - RNA, 18 nt, Human adenovirus D
ccaugagggucuggagcu

SEQ ID NO: 1562526 - RNA, 21 nt, Human adenovirus D
aagaggcuccggguggaagau

SEQ ID NO: 1562527 - RNA, 23 nt, Human adenovirus D
gguccgcaggaguccaccgcucc

SEQ ID NO: 1562528 - RNA, 18 nt, Human adenovirus D
cguucagggaggcgcugc

SEQ ID NO: 1562529 - RNA, 15 nt, Human adenovirus D
uacgugcccuuccac

SEQ ID NO: 1562530 - RNA, 15 nt, Human adenovirus D
gcagaggucuggggc

SEQ ID NO: 1562531 - RNA, 21 nt, Human adenovirus D
gcaacugcgcguccgucagca

SEQ ID NO: 1562532 - RNA, 16 nt, Human adenovirus D
gcaccugugggaccug

SEQ ID NO: 1562533 - RNA, 14 nt, Human adenovirus D
gcguguggcagcag

SEQ ID NO: 1562534 - RNA, 13 nt, Human adenovirus D
gucgcagccgccg

SEQ ID NO: 1562535 - RNA, 22 nt, Human adenovirus D
aaaccuuaguugggccuccagg

SEQ ID NO: 1562536 - RNA, 14 nt, Human adenovirus D
gcuggcugcuggag

SEQ ID NO: 1562537 - RNA, 15 nt, Human adenovirus D
gggcaugagcccguc

SEQ ID NO: 1562538 - RNA, 19 nt, Human adenovirus D
ggagaugcgcgacugccgg

SEQ ID NO: 1562539 - RNA, 21 nt, Human adenovirus D
uccaccgaaggcagcuccggu

SEQ ID NO: 1562540 - RNA, 17 nt, Human adenovirus D
cauggugcccaagcgcc

SEQ ID NO: 1562541 - RNA, 17 nt, Human adenovirus D
caccccaggcggaccag

SEQ ID NO: 1562542 - RNA, 17 nt, Human adenovirus D
ugccuuccaaaauguga

SEQ ID NO: 1562543 - RNA, 23 nt, Human adenovirus D
ggccugugcaaugucaggucugc

SEQ ID NO: 1562544 - RNA, 18 nt, Human adenovirus D
gaaacagauccugcugcu

SEQ ID NO: 1562545 - RNA, 12 nt, Human adenovirus D
guggcggggccc

SEQ ID NO: 1562546 - RNA, 16 nt, Human adenovirus D
cacucaaacuggcuga

SEQ ID NO: 1562547 - RNA, 19 nt, Human adenovirus D
gccuuuccccaccuacucc

SEQ ID NO: 1562548 - RNA, 14 nt, Human adenovirus D
gcucaucggccaga

SEQ ID NO: 1562549 - RNA, 15 nt, Human adenovirus D
cgcggcacggcacgc

SEQ ID NO: 1562550 - RNA, 23 nt, Human adenovirus D
gaagaggagcugaucucgcugcc

SEQ ID NO: 1562551 - RNA, 14 nt, Human adenovirus D
gcugcaaagccagc

SEQ ID NO: 1562552 - RNA, 24 nt, Human adenovirus D
ggugcccaagcgccggcgcgugga

SEQ ID NO: 1562553 - RNA, 16 nt, Human adenovirus D
cugggagggaugcaug

SEQ ID NO: 1562554 - RNA, 22 nt, Human adenovirus D
cacaguuaguacaacuacacag

SEQ ID NO: 1562555 - RNA, 12 nt, Human adenovirus D
accgccuccccg

SEQ ID NO: 1562556 - RNA, 21 nt, Human adenovirus D
caguuaagaauccacagauca

SEQ ID NO: 1562557 - RNA, 15 nt, Human adenovirus D
cgucaucacccaggg

SEQ ID NO: 1562558 - RNA, 20 nt, Human adenovirus D
gccgggccaugaugcgagcc

SEQ ID NO: 1562559 - RNA, 19 nt, Human adenovirus D
agcgugcguucucuuccuu

SEQ ID NO: 1562560 - RNA, 15 nt, Human adenovirus D
cuuccugcagcucau

SEQ ID NO: 1562561 - RNA, 20 nt, Human adenovirus D
gacaguagcgucucaagaga

SEQ ID NO: 1562562 - RNA, 15 nt, Human adenovirus D
cagggugcuccagcc

SEQ ID NO: 1562563 - RNA, 19 nt, Human adenovirus D
acguacuucagccugggca

SEQ ID NO: 1562564 - RNA, 15 nt, Human adenovirus D
gccuguccugcaggg

SEQ ID NO: 1562565 - RNA, 19 nt, Human adenovirus D
agacgcugaaaggcgggcu

SEQ ID NO: 1562566 - RNA, 16 nt, Human adenovirus D
gcauguacaacaugcu

SEQ ID NO: 1562567 - RNA, 16 nt, Human adenovirus D
aacucuguugaggcau

SEQ ID NO: 1562568 - RNA, 20 nt, Human adenovirus D
ccucgccgucuacucccagc

SEQ ID NO: 1562569 - RNA, 15 nt, Human adenovirus D
ccaggcccuggagca

SEQ ID NO: 1562570 - RNA, 14 nt, Human adenovirus D
gaucaagugccaca

SEQ ID NO: 1562571 - RNA, 18 nt, Human adenovirus D
ccgaggugccccagagcg

SEQ ID NO: 1562572 - RNA, 23 nt, Human adenovirus D
ccacucgcgggcggccauugcuc

SEQ ID NO: 1562573 - RNA, 20 nt, Human adenovirus D
aacuacuggcuucuacagcc

SEQ ID NO: 1562574 - RNA, 17 nt, Human adenovirus D
aaagccacaaccagagc

SEQ ID NO: 1562575 - RNA, 19 nt, Human adenovirus D
aucaaaacgaccacagcaa

SEQ ID NO: 1562576 - RNA, 16 nt, Human adenovirus D
cugcuacaucucgggg

SEQ ID NO: 1562577 - RNA, 17 nt, Human adenovirus D
agccaucgcgcaggagg

SEQ ID NO: 1562578 - RNA, 20 nt, Human adenovirus D
guagcugcgcggggccacga

SEQ ID NO: 1562579 - RNA, 20 nt, Human adenovirus D
uggaagaagaaugggacagc

SEQ ID NO: 1562580 - RNA, 18 nt, Human adenovirus D
ucccggcgcaguacgcgc

SEQ ID NO: 1562581 - RNA, 23 nt, Human adenovirus D
guaguugcgcaggcgcuggaaga

SEQ ID NO: 1562582 - RNA, 18 nt, Human adenovirus D
aucgccgaggagaacugc

SEQ ID NO: 1562583 - RNA, 23 nt, Human adenovirus D
ugcguaccuugucguacuucugc

SEQ ID NO: 1562584 - RNA, 23 nt, Human adenovirus D
augggcgccuucaccgaccuggg

SEQ ID NO: 1562585 - RNA, 14 nt, Human adenovirus D
gagagaacaaaacc

SEQ ID NO: 1562586 - RNA, 21 nt, Human adenovirus D
gggggccacucccagcgccgc

SEQ ID NO: 1562587 - RNA, 20 nt, Human adenovirus D
caugaccauagaccugauga

SEQ ID NO: 1562588 - RNA, 18 nt, Human adenovirus D
uccccccuuugucuccuc

SEQ ID NO: 1562589 - RNA, 17 nt, Human adenovirus D
acaugcucuaccccauc

SEQ ID NO: 1562590 - RNA, 17 nt, Human adenovirus D
gugucccugaccaugac

SEQ ID NO: 1562591 - RNA, 23 nt, Human adenovirus D
gcgcuugagacucauccugcugg

SEQ ID NO: 1562592 - RNA, 22 nt, Human adenovirus D
aaucucccaccaccagcccauu

SEQ ID NO: 1562593 - RNA, 15 nt, Human adenovirus D
cagauuuaagcaagg

SEQ ID NO: 1562594 - RNA, 11 nt, Human adenovirus D
agaugcagcaa

SEQ ID NO: 1562595 - RNA, 22 nt, Human adenovirus D
cuucgaguacgaggccaugcug

SEQ ID NO: 1562596 - RNA, 23 nt, Human adenovirus D
ccgacgauguagaguuccaugaa

SEQ ID NO: 1562597 - RNA, 19 nt, Human adenovirus D
cagcggcagggugagccgg

SEQ ID NO: 1562598 - RNA, 21 nt, Human adenovirus D
agaacccggacagcaagccuc

SEQ ID NO: 1562599 - RNA, 14 nt, Human adenovirus D
gggcgugcagaccg

SEQ ID NO: 1562600 - RNA, 11 nt, Human adenovirus D
gcaccgcuccu

SEQ ID NO: 1562601 - RNA, 14 nt, Human adenovirus D
cuggaagcccugag

SEQ ID NO: 1562602 - RNA, 16 nt, Human adenovirus D
gcccugcucaccugca

SEQ ID NO: 1562603 - RNA, 18 nt, Human adenovirus D
cucuacgccaccuucuuc

SEQ ID NO: 1562604 - RNA, 13 nt, Human adenovirus D
gcaggcagcggcc

SEQ ID NO: 1562605 - RNA, 20 nt, Human adenovirus D
ccaggguugagucgcggcag

SEQ ID NO: 1562606 - RNA, 17 nt, Human adenovirus D
ggaguucgucagaaugu

SEQ ID NO: 1562607 - RNA, 19 nt, Human adenovirus D
caugacccugcauggcugc

SEQ ID NO: 1562608 - RNA, 16 nt, Human adenovirus D
agccugaugagcucgg

SEQ ID NO: 1562609 - RNA, 22 nt, Human adenovirus D
ggagaacgaugccuucuccagg

SEQ ID NO: 1562610 - RNA, 16 nt, Human adenovirus D
cgucccggaggagggg

SEQ ID NO: 1562611 - RNA, 21 nt, Human adenovirus D
agcaggagugcagggaugagu

SEQ ID NO: 1562612 - RNA, 24 nt, Human adenovirus D
cggcgaggggcugcuagagugcca

SEQ ID NO: 1562613 - RNA, 21 nt, Human adenovirus D
caaauccaacucuuaaaucau

SEQ ID NO: 1562614 - RNA, 15 nt, Human adenovirus D
ccaacggcaaacagc

SEQ ID NO: 1562615 - RNA, 20 nt, Human adenovirus D
guccacgcugguggccaccu

SEQ ID NO: 1562616 - RNA, 14 nt, Human adenovirus D
cuacaacagcacaa

SEQ ID NO: 1562617 - RNA, 21 nt, Human adenovirus D
acucgcaaaaauaaaucauug

SEQ ID NO: 1562618 - RNA, 14 nt, Human adenovirus D
ucauuuuuccagcc

SEQ ID NO: 1562619 - RNA, 20 nt, Human adenovirus D
cccgccgaggcuagcacgca

SEQ ID NO: 1562620 - RNA, 15 nt, Human adenovirus D
guggaagagauggaa

SEQ ID NO: 1562621 - RNA, 21 nt, Human adenovirus D
cauggugggcgucaaccccau

SEQ ID NO: 1562622 - RNA, 17 nt, Human adenovirus D
ucaucacaucagccagg

SEQ ID NO: 1562623 - RNA, 18 nt, Human adenovirus D
ccaggaugcagccagugg

SEQ ID NO: 1562624 - RNA, 20 nt, Human adenovirus D
gaugacggguugcagguggu

SEQ ID NO: 1562625 - RNA, 16 nt, Human adenovirus D
gcgaucccgcuguggc

SEQ ID NO: 1562626 - RNA, 12 nt, Human adenovirus D
gcguguggcagc

SEQ ID NO: 1562627 - RNA, 16 nt, Human adenovirus D
uguuggagcaggcggc

SEQ ID NO: 1562628 - RNA, 19 nt, Human adenovirus D
caaucuggcgguaccaggg

SEQ ID NO: 1562629 - RNA, 12 nt, Human adenovirus D
ugcuuccagcaa

SEQ ID NO: 1562630 - RNA, 15 nt, Human adenovirus D
cuccaaagcuagcac

SEQ ID NO: 1562631 - RNA, 15 nt, Human adenovirus D
caccuggaggcacca

SEQ ID NO: 1562632 - RNA, 16 nt, Human adenovirus D
auccgcgccgcagccc

SEQ ID NO: 1562633 - RNA, 19 nt, Human adenovirus D
acacgcuguaccgcagcug

SEQ ID NO: 1562634 - RNA, 12 nt, Human adenovirus D
caggucugcugg

SEQ ID NO: 1562635 - RNA, 18 nt, Human adenovirus D
ccgaggagaacugcuggc

SEQ ID NO: 1562636 - RNA, 16 nt, Human adenovirus D
gcccucucaacaucac

SEQ ID NO: 1562637 - RNA, 19 nt, Human adenovirus D
cggcagcggggccuggugu

SEQ ID NO: 1562638 - RNA, 13 nt, Human adenovirus D
ucgcuggacccca

SEQ ID NO: 1562639 - RNA, 14 nt, Human adenovirus D
ugaaccgccgccgg

SEQ ID NO: 1562640 - RNA, 19 nt, Human adenovirus D
ugcaccacgcuucuucccc

SEQ ID NO: 1562641 - RNA, 15 nt, Human adenovirus D
auaaagaauaugcca

SEQ ID NO: 1562642 - RNA, 15 nt, Human adenovirus D
ccaggccuggcccug

SEQ ID NO: 1562643 - RNA, 15 nt, Human adenovirus D
cugaucagaaacaca

SEQ ID NO: 1562644 - RNA, 15 nt, Human adenovirus D
cagguggacgagccg

SEQ ID NO: 1562645 - RNA, 16 nt, Human adenovirus D
ugagcucgucuuccag

SEQ ID NO: 1562646 - RNA, 15 nt, Human adenovirus D
cgucuuugccaugga

SEQ ID NO: 1562647 - RNA, 17 nt, Human adenovirus D
cgagaaccgccuggggc

SEQ ID NO: 1562648 - RNA, 22 nt, Human adenovirus D
gagcagugucuggagcgggcuu

SEQ ID NO: 1562649 - RNA, 19 nt, Human adenovirus D
uagucaucacccagcaguc

SEQ ID NO: 1562650 - RNA, 20 nt, Human adenovirus D
cgcugcacgggcuguaccuc

SEQ ID NO: 1562651 - RNA, 16 nt, Human adenovirus D
gaggggggccaccucg

SEQ ID NO: 1562652 - RNA, 15 nt, Human adenovirus D
ucauguacuacaaca

SEQ ID NO: 1562653 - RNA, 16 nt, Human adenovirus D
agcucaaagaccagaa

SEQ ID NO: 1562654 - RNA, 20 nt, Human adenovirus D
ccaacaugcucuaccccauc

SEQ ID NO: 1562655 - RNA, 23 nt, Human adenovirus D
ccucgaugaaagucaggagcagc

SEQ ID NO: 1562656 - RNA, 15 nt, Human adenovirus D
ccgagcucugcugcg

SEQ ID NO: 1562657 - RNA, 16 nt, Human adenovirus D
cccgagcucugcugcg

SEQ ID NO: 1562658 - RNA, 23 nt, Human adenovirus D
gucauaacccgccucuccuuucu

SEQ ID NO: 1562659 - RNA, 18 nt, Human adenovirus D
aaauuuuuauuuccucug

SEQ ID NO: 1562660 - RNA, 15 nt, Human adenovirus D
cuagagugaggcacu

SEQ ID NO: 1562661 - RNA, 12 nt, Human adenovirus D
agcagcggcgca

SEQ ID NO: 1562662 - RNA, 13 nt, Human adenovirus D
ccgccaaccggcu

SEQ ID NO: 1562663 - RNA, 15 nt, Human adenovirus D
cgcgaggacgcagcg

SEQ ID NO: 1562664 - RNA, 19 nt, Human adenovirus D
gcuaccucuugcagcuggc

SEQ ID NO: 1562665 - RNA, 20 nt, Human adenovirus D
gggcgcucccaaucccaguc

SEQ ID NO: 1562666 - RNA, 18 nt, Human adenovirus D
ggagggauugcagggcgu

SEQ ID NO: 1562667 - RNA, 23 nt, Human adenovirus D
uucgucaggcaggcaugcaagau

SEQ ID NO: 1562668 - RNA, 23 nt, Human adenovirus D
acgcucaggaccauagggagccu

SEQ ID NO: 1562669 - RNA, 14 nt, Human adenovirus D
acagacagccaggu

SEQ ID NO: 1562670 - RNA, 22 nt, Human adenovirus D
acgccggcucaucugcagggcg

SEQ ID NO: 1562671 - RNA, 23 nt, Human adenovirus D
ggcaaugcuagagugaggcacug

SEQ ID NO: 1562672 - RNA, 14 nt, Human adenovirus D
aggcuuucacagcu

SEQ ID NO: 1562673 - RNA, 14 nt, Human adenovirus D
ccugcaagaggaga

SEQ ID NO: 1562674 - RNA, 14 nt, Human adenovirus D
gcccuuccagcaca

SEQ ID NO: 1562675 - RNA, 15 nt, Human adenovirus D
ggcgcaagcucaugc

SEQ ID NO: 1562676 - RNA, 16 nt, Human adenovirus D
caagcucaugcuggcc

SEQ ID NO: 1562677 - RNA, 13 nt, Human adenovirus D
cucccaaguucaa

SEQ ID NO: 1562678 - RNA, 18 nt, Human adenovirus D
aaucagaguaagaggagu

SEQ ID NO: 1562679 - RNA, 13 nt, Human adenovirus D
cagucgcaccuuc

SEQ ID NO: 1562680 - RNA, 16 nt, Human adenovirus D
augggccuggccgcgg

SEQ ID NO: 1562681 - RNA, 19 nt, Human adenovirus D
agaaggugagggggucccg

SEQ ID NO: 1562682 - RNA, 16 nt, Human adenovirus D
agccgcgcgcuggggc

SEQ ID NO: 1562683 - RNA, 19 nt, Human adenovirus D
gcuguggucgacuugcaag

SEQ ID NO: 1562684 - RNA, 11 nt, Human adenovirus D
ggcugcugcug

SEQ ID NO: 1562685 - RNA, 14 nt, Human adenovirus D
uucgacagcgucaa

SEQ ID NO: 1562686 - RNA, 23 nt, Human adenovirus D
gaaaccagauauuguuggagcag

SEQ ID NO: 1562687 - RNA, 19 nt, Human adenovirus D
gugauacgaggcagaggca

SEQ ID NO: 1562688 - RNA, 21 nt, Human adenovirus D
gcacgcccgcgagcgagggcg

SEQ ID NO: 1562689 - RNA, 20 nt, Human adenovirus D
uggcccugggccugaugcac

SEQ ID NO: 1562690 - RNA, 20 nt, Human adenovirus D
  misc_feature (7)..(7): n is a, c, g or u
ggagucnuacuucgacaugg

SEQ ID NO: 1562691 - RNA, 11 nt, Human adenovirus D
gccagcagcac

SEQ ID NO: 1562692 - RNA, 20 nt, Human adenovirus D
auaaaagggggcgggucugu

SEQ ID NO: 1562693 - RNA, 15 nt, Human adenovirus D
ugaaagucaggagca

SEQ ID NO: 1562694 - RNA, 17 nt, Human adenovirus D
aggucgaggagaccugc

SEQ ID NO: 1562695 - RNA, 21 nt, Human adenovirus D
acugccgguuucgggcgggca

SEQ ID NO: 1562696 - RNA, 16 nt, Human adenovirus D
gaggaggggggccacc

SEQ ID NO: 1562697 - RNA, 23 nt, Human adenovirus D
ccagugauuggggaaccucagcc

SEQ ID NO: 1562698 - RNA, 21 nt, Human adenovirus D
uacaccaggccuacuacuccu

SEQ ID NO: 1562699 - RNA, 12 nt, Human adenovirus D
cgcucaggacca

SEQ ID NO: 1562700 - RNA, 16 nt, Human adenovirus D
caucgccgagcccgag

SEQ ID NO: 1562701 - RNA, 15 nt, Human adenovirus D
acgcccuggccgacc

SEQ ID NO: 1562702 - RNA, 22 nt, Human adenovirus D
ccaugcagacacuugagcuggc

SEQ ID NO: 1562703 - RNA, 14 nt, Human adenovirus D
cgggaaccccacca

SEQ ID NO: 1562704 - RNA, 18 nt, Human adenovirus D
caaccucaccaaccagac

SEQ ID NO: 1562705 - RNA, 16 nt, Human adenovirus D
acacguagcagcccug

SEQ ID NO: 1562706 - RNA, 15 nt, Human adenovirus D
ccuggucgagcggga

SEQ ID NO: 1562707 - RNA, 13 nt, Human adenovirus D
cucguaggugagg

SEQ ID NO: 1562708 - RNA, 12 nt, Human adenovirus D
gcagccgagccg

SEQ ID NO: 1562709 - RNA, 12 nt, Human adenovirus D
gugggccccugg

SEQ ID NO: 1562710 - RNA, 16 nt, Human adenovirus D
gcgggugaugguggcu

SEQ ID NO: 1562711 - RNA, 15 nt, Human adenovirus D
gccgccgcaccgcca

SEQ ID NO: 1562712 - RNA, 23 nt, Human adenovirus D
caugagcucguaguugagggccu

SEQ ID NO: 1562713 - RNA, 15 nt, Human adenovirus D
cuucuacagccagca

SEQ ID NO: 1562714 - RNA, 19 nt, Human adenovirus D
gaagagaaucuugccugcu

SEQ ID NO: 1562715 - RNA, 20 nt, Human adenovirus D
auucucauuuuuccagccuu

SEQ ID NO: 1562716 - RNA, 15 nt, Human adenovirus D
acgccgaggcucugu

SEQ ID NO: 1562717 - RNA, 14 nt, Human adenovirus D
gcgccugaggcaga

SEQ ID NO: 1562718 - RNA, 18 nt, Human adenovirus D
cggcaucuuccuggggca

SEQ ID NO: 1562719 - RNA, 18 nt, Human adenovirus D
caggcgggacagaggagg

SEQ ID NO: 1562720 - RNA, 22 nt, Human adenovirus D
aagucacaguuauaccaccucc

SEQ ID NO: 1562721 - RNA, 14 nt, Human adenovirus D
cauagaccugauga

SEQ ID NO: 1562722 - RNA, 16 nt, Human adenovirus D
uggcgcucgggcaggu

SEQ ID NO: 1562723 - RNA, 12 nt, Human adenovirus D
gauugcucuggc

SEQ ID NO: 1562724 - RNA, 18 nt, Human adenovirus D
ucgacgcagugagagaag

SEQ ID NO: 1562725 - RNA, 13 nt, Human adenovirus D
agaaccaugaagg

SEQ ID NO: 1562726 - RNA, 23 nt, Human adenovirus D
acgccguucuccgccggaaacgc

SEQ ID NO: 1562727 - RNA, 20 nt, Human adenovirus D
guauuaccuuccuugcugga

SEQ ID NO: 1562728 - RNA, 17 nt, Human adenovirus D
cauaauagaaacagauc

SEQ ID NO: 1562729 - RNA, 19 nt, Human adenovirus D
cuagacuugaaagcggccg

SEQ ID NO: 1562730 - RNA, 14 nt, Human adenovirus D
cagugucucgagga

SEQ ID NO: 1562731 - RNA, 13 nt, Human adenovirus D
uugcaaggcagaa

SEQ ID NO: 1562732 - RNA, 17 nt, Human adenovirus D
uggacuugggcgggagc

SEQ ID NO: 1562733 - RNA, 12 nt, Human adenovirus D
agaaugcugcua

SEQ ID NO: 1562734 - RNA, 23 nt, Human adenovirus D
gggcucuuccuccguagccuggc

SEQ ID NO: 1562735 - RNA, 20 nt, Human adenovirus D
gcgagugcgggggcagacac

SEQ ID NO: 1562736 - RNA, 20 nt, Human adenovirus D
caacaugaccaaggacuggu

SEQ ID NO: 1562737 - RNA, 19 nt, Human adenovirus D
gcgcgugcccgugcgcacc

SEQ ID NO: 1562738 - RNA, 21 nt, Human adenovirus D
gccggggguucauguugugca

SEQ ID NO: 1562739 - RNA, 17 nt, Human adenovirus D
ugcuccaaagcuagcac

SEQ ID NO: 1562740 - RNA, 22 nt, Human adenovirus D
gcuuguaaaagcguccgcagua

SEQ ID NO: 1562741 - RNA, 13 nt, Human adenovirus D
ugcaaccugugcu

SEQ ID NO: 1562742 - RNA, 20 nt, Human adenovirus D
gcugacauccauggccaggg

SEQ ID NO: 1562743 - RNA, 16 nt, Human adenovirus D
ucagccccuuccccua

SEQ ID NO: 1562744 - RNA, 19 nt, Human adenovirus D
cuaugagaugccccagcag

SEQ ID NO: 1562745 - RNA, 18 nt, Human adenovirus D
acaucacauucaaaaacc

SEQ ID NO: 1562746 - RNA, 19 nt, Human adenovirus D
cgaagacgagggcgcgcag

SEQ ID NO: 1562747 - RNA, 21 nt, Human adenovirus D
gagcucuugcagggaagcaaa

SEQ ID NO: 1562748 - RNA, 15 nt, Human adenovirus D
cagccaaagcucaug

SEQ ID NO: 1562749 - RNA, 16 nt, Human adenovirus D
gccuacgguccagagg

SEQ ID NO: 1562750 - RNA, 18 nt, Human adenovirus D
gguagcaccacugcaugg

SEQ ID NO: 1562751 - RNA, 14 nt, Human adenovirus D
caugaccgcgcgca

SEQ ID NO: 1562752 - RNA, 17 nt, Human adenovirus D
aguugcagaccgcgggc

SEQ ID NO: 1562753 - RNA, 21 nt, Human adenovirus D
caaagaccagaacuuccagca

SEQ ID NO: 1562754 - RNA, 15 nt, Human adenovirus D
cggccagucugauga

SEQ ID NO: 1562755 - RNA, 21 nt, Human adenovirus D
gauggccuguaccgggaccga

SEQ ID NO: 1562756 - RNA, 18 nt, Human adenovirus D
ccgcgguuaugcagggug

SEQ ID NO: 1562757 - RNA, 21 nt, Human adenovirus D
gcaaaauaaaacucaccaagg

SEQ ID NO: 1562758 - RNA, 19 nt, Human adenovirus D
ccauagggagccugcgccc

SEQ ID NO: 1562759 - RNA, 15 nt, Human adenovirus D
ugcugcagccgccgc

SEQ ID NO: 1562760 - RNA, 14 nt, Human adenovirus D
acggagggcagaaa

SEQ ID NO: 1562761 - RNA, 14 nt, Human adenovirus D
gcgccgcgccgcca

SEQ ID NO: 1562762 - RNA, 22 nt, Human adenovirus D
cucccagcucauccgcagcuac

SEQ ID NO: 1562763 - RNA, 13 nt, Human adenovirus D
ucacauuaaaggc

SEQ ID NO: 1562764 - RNA, 15 nt, Human adenovirus D
cgcuggccagcacgc

SEQ ID NO: 1562765 - RNA, 22 nt, Human adenovirus D
ccacgagcgccagcuguugggg

SEQ ID NO: 1562766 - RNA, 14 nt, Human adenovirus D
uagagggcaccacc

SEQ ID NO: 1562767 - RNA, 23 nt, Human adenovirus D
ugacauggguggggaugaaccuu

SEQ ID NO: 1562768 - RNA, 20 nt, Human adenovirus D
agguuuggcauaucagccag

SEQ ID NO: 1562769 - RNA, 15 nt, Human adenovirus D
cuugcugggcgagga

SEQ ID NO: 1562770 - RNA, 15 nt, Human adenovirus D
agcagucucugccgc

SEQ ID NO: 1562771 - RNA, 17 nt, Human adenovirus D
cucagcagucucugccg

SEQ ID NO: 1562772 - RNA, 18 nt, Human adenovirus D
gguacaugggcaugagcc

SEQ ID NO: 1562773 - RNA, 18 nt, Human adenovirus D
gcccgugaccugcagcag

SEQ ID NO: 1562774 - RNA, 23 nt, Human adenovirus D
ccaggaggagaccgacgcugggc

SEQ ID NO: 1562775 - RNA, 21 nt, Human adenovirus D
acuuugucugcuguaaagcca

SEQ ID NO: 1562776 - RNA, 12 nt, Human adenovirus D
gggaggagcccg

SEQ ID NO: 1562777 - RNA, 19 nt, Human adenovirus D
ccagcugaacgggggcgcc

SEQ ID NO: 1562778 - RNA, 17 nt, Human adenovirus D
gccacaugcaccugggc

SEQ ID NO: 1562779 - RNA, 16 nt, Human adenovirus D
uccgcugugcuggugg

SEQ ID NO: 1562780 - RNA, 20 nt, Human adenovirus D
ucccgcccgacacugcaggg

SEQ ID NO: 1562781 - RNA, 15 nt, Human adenovirus D
accaccccaggcgga

SEQ ID NO: 1562782 - RNA, 20 nt, Human adenovirus D
agcacgagcaagacgcaggc

SEQ ID NO: 1562783 - RNA, 20 nt, Human adenovirus D
auggcgcaggcgacccugga

SEQ ID NO: 1562784 - RNA, 23 nt, Human adenovirus D
acgaugagaccaaguccagggug

SEQ ID NO: 1562785 - RNA, 14 nt, Human adenovirus D
gaggcgguccccgc

SEQ ID NO: 1562786 - RNA, 18 nt, Human adenovirus D
ucagcugcagcgcacucu

SEQ ID NO: 1562787 - RNA, 13 nt, Human adenovirus D
gauggcgugcgag

SEQ ID NO: 1562788 - RNA, 16 nt, Human adenovirus D
caggggcggcagaggc

SEQ ID NO: 1562789 - RNA, 18 nt, Human adenovirus D
guacaacgcccugcugga

SEQ ID NO: 1562790 - RNA, 23 nt, Human adenovirus D
uaccugcccgacuccuacaagua

SEQ ID NO: 1562791 - RNA, 13 nt, Human adenovirus D
agagcccccuccc

SEQ ID NO: 1562792 - RNA, 15 nt, Human adenovirus D
gcuugccgggcucug

SEQ ID NO: 1562793 - RNA, 22 nt, Human adenovirus D
cugacgcccaacucgcggcugc

SEQ ID NO: 1562794 - RNA, 15 nt, Human adenovirus D
cggcgaggggcugcu

SEQ ID NO: 1562795 - RNA, 17 nt, Human adenovirus D
gaccccuggcucccagc

SEQ ID NO: 1562796 - RNA, 18 nt, Human adenovirus D
ccagcgagugaccgucac

SEQ ID NO: 1562797 - RNA, 13 nt, Human adenovirus D
ucucaacagcugg

SEQ ID NO: 1562798 - RNA, 16 nt, Human adenovirus D
acucguaccuggguca

SEQ ID NO: 1562799 - RNA, 20 nt, Human adenovirus D
gaugcugcccgccaccugca

SEQ ID NO: 1562800 - RNA, 19 nt, Human adenovirus D
gccaggugagcucgggcug

SEQ ID NO: 1562801 - RNA, 21 nt, Human adenovirus D
cagcgcgaguagucaaucucc

SEQ ID NO: 1562802 - RNA, 13 nt, Human adenovirus D
ugauuuuuccagc

SEQ ID NO: 1562803 - RNA, 19 nt, Human adenovirus D
gcgcgggcggacugccacc

SEQ ID NO: 1562804 - RNA, 16 nt, Human adenovirus D
auuccucgaccaugac

SEQ ID NO: 1562805 - RNA, 18 nt, Human adenovirus D
caacucuuaaaucauuua

SEQ ID NO: 1562806 - RNA, 20 nt, Human adenovirus D
aggauggucaucacccucag

SEQ ID NO: 1562807 - RNA, 20 nt, Human adenovirus D
uggcgaccgccgugcgccgc

SEQ ID NO: 1562808 - RNA, 13 nt, Human adenovirus D
ucccucccucggc

SEQ ID NO: 1562809 - RNA, 18 nt, Human adenovirus D
gugaccagguccacgcug

SEQ ID NO: 1562810 - RNA, 12 nt, Human adenovirus D
auuucacagugu

SEQ ID NO: 1562811 - RNA, 20 nt, Human adenovirus D
guagcccgugcacuugggga

SEQ ID NO: 1562812 - RNA, 16 nt, Human adenovirus D
cagacacaucuccuaa

SEQ ID NO: 1562813 - RNA, 14 nt, Human adenovirus D
guugaggguggugg

SEQ ID NO: 1562814 - RNA, 12 nt, Human adenovirus D
cugccuggucaa

SEQ ID NO: 1562815 - RNA, 22 nt, Human adenovirus D
acccggacguggugcugcugcc

SEQ ID NO: 1562816 - RNA, 11 nt, Human adenovirus D
uuuccggggcg

SEQ ID NO: 1562817 - RNA, 15 nt, Human adenovirus D
gugggcguggggcaa

SEQ ID NO: 1562818 - RNA, 13 nt, Human adenovirus D
acgagggccuggg

SEQ ID NO: 1562819 - RNA, 15 nt, Human adenovirus D
ucccgcucccagcga

SEQ ID NO: 1562820 - RNA, 13 nt, Human adenovirus D
gcggcggcuggcg

SEQ ID NO: 1562821 - RNA, 19 nt, Human adenovirus D
ugcgcaggcgccugagugg

SEQ ID NO: 1562822 - RNA, 20 nt, Human adenovirus D
gcugcugaaacaccugcagc

SEQ ID NO: 1562823 - RNA, 20 nt, Human adenovirus D
gcagcccaaacuggggcgac

SEQ ID NO: 1562824 - RNA, 19 nt, Human adenovirus D
cggcugcacgagcgccagg

SEQ ID NO: 1562825 - RNA, 13 nt, Human adenovirus D
aagguucugcccu

SEQ ID NO: 1562826 - RNA, 17 nt, Human adenovirus D
guggguuggcuugcaug

SEQ ID NO: 1562827 - RNA, 21 nt, Human adenovirus D
acaacagccuugcccccaagg

SEQ ID NO: 1562828 - RNA, 22 nt, Human adenovirus D
cacugccgccgccugcgcugcu

SEQ ID NO: 1562829 - RNA, 18 nt, Human adenovirus D
acugcuggcccugcuggc

SEQ ID NO: 1562830 - RNA, 22 nt, Human adenovirus D
gcgcuuccaagaucaggggaug

SEQ ID NO: 1562831 - RNA, 21 nt, Human adenovirus D
gcugcccgacuucaugagcca

SEQ ID NO: 1562832 - RNA, 17 nt, Human adenovirus D
ugagguacaugggcaug

SEQ ID NO: 1562833 - RNA, 18 nt, Human adenovirus D
caaaaccuaccacuggcu

SEQ ID NO: 1562834 - RNA, 16 nt, Human adenovirus D
ucaaaacucacuuugg

SEQ ID NO: 1562835 - RNA, 16 nt, Human adenovirus D
cagaccuucagggagu

SEQ ID NO: 1562836 - RNA, 16 nt, Human adenovirus D
gcaacaccugggcacu

SEQ ID NO: 1562837 - RNA, 15 nt, Human adenovirus D
gcaggcgccggcgcu

SEQ ID NO: 1562838 - RNA, 17 nt, Human adenovirus D
caucguugugcgccgcg

SEQ ID NO: 1562839 - RNA, 16 nt, Human adenovirus D
caggcggugcugcugc

SEQ ID NO: 1562840 - RNA, 17 nt, Human adenovirus D
cgcuguggagccacugc

SEQ ID NO: 1562841 - RNA, 18 nt, Human adenovirus D
cuccggguucuggagaca

SEQ ID NO: 1562842 - RNA, 17 nt, Human adenovirus D
augcgccaagggcagcc

SEQ ID NO: 1562843 - RNA, 18 nt, Human adenovirus D
aguuacgggagcgagccc

SEQ ID NO: 1562844 - RNA, 16 nt, Human adenovirus D
cggcgcugcaaagcca

SEQ ID NO: 1562845 - RNA, 14 nt, Human adenovirus D
gacaaauggagcca

SEQ ID NO: 1562846 - RNA, 19 nt, Human adenovirus D
ggccgcgauguugagcugg

SEQ ID NO: 1562847 - RNA, 19 nt, Human adenovirus D
cuacaucguaggugacaaa

SEQ ID NO: 1562848 - RNA, 14 nt, Human adenovirus D
gccuggucaaacag

SEQ ID NO: 1562849 - RNA, 18 nt, Human adenovirus D
cagcugggacuugccgca

SEQ ID NO: 1562850 - RNA, 19 nt, Human adenovirus D
agcgggaucaucgccugcu

SEQ ID NO: 1562851 - RNA, 14 nt, Human adenovirus D
guaagagcccagca

SEQ ID NO: 1562852 - RNA, 14 nt, Human adenovirus D
ggaaggaggacacu

SEQ ID NO: 1562853 - RNA, 16 nt, Human adenovirus D
ggagccugaugagcuc

SEQ ID NO: 1562854 - RNA, 10 nt, Human adenovirus D
agcagcacag

SEQ ID NO: 1562855 - RNA, 21 nt, Human adenovirus D
gcaagagccggcgggcggacg

SEQ ID NO: 1562856 - RNA, 19 nt, Human adenovirus D
agcaccgccgcagccgcgg

SEQ ID NO: 1562857 - RNA, 15 nt, Human adenovirus D
cugacgccuccguga

SEQ ID NO: 1562858 - RNA, 17 nt, Human adenovirus D
cgacccaugagcugcga

SEQ ID NO: 1562859 - RNA, 13 nt, Human adenovirus D
agauggccacccc

SEQ ID NO: 1562860 - RNA, 18 nt, Human adenovirus D
uggcggagaacaaggcca

SEQ ID NO: 1562861 - RNA, 18 nt, Human adenovirus D
caaagcuagcacccaaaa

SEQ ID NO: 1562862 - RNA, 15 nt, Human adenovirus D
gugagcucgggcugc

SEQ ID NO: 1562863 - RNA, 19 nt, Human adenovirus D
ugaaggccggcaugcccac

SEQ ID NO: 1562864 - RNA, 15 nt, Human adenovirus D
acuagcgcccuggua

SEQ ID NO: 1562865 - RNA, 14 nt, Human adenovirus D
acgagacuggccuc

SEQ ID NO: 1562866 - RNA, 18 nt, Human adenovirus D
gaauaggcacugaaaauu

SEQ ID NO: 1562867 - RNA, 15 nt, Human adenovirus D
aggggagugaagagg

SEQ ID NO: 1562868 - RNA, 14 nt, Human adenovirus D
cgcuccguggggcg

SEQ ID NO: 1562869 - RNA, 18 nt, Human adenovirus D
gccuggaauaguagcacg

SEQ ID NO: 1562870 - RNA, 16 nt, Human adenovirus D
uagcaccacugcaugg

SEQ ID NO: 1562871 - RNA, 16 nt, Human adenovirus D
ucuaaacuaaagccaa

SEQ ID NO: 1562872 - RNA, 20 nt, Human adenovirus D
guaugucucugguguaguug

SEQ ID NO: 1562873 - RNA, 18 nt, Human adenovirus D
acguuaccgacagcagca

SEQ ID NO: 1562874 - RNA, 19 nt, Human adenovirus D
cuuguagggacagcagccc

SEQ ID NO: 1562875 - RNA, 23 nt, Human adenovirus D
aagugccacaugcaccugggcgc

SEQ ID NO: 1562876 - RNA, 22 nt, Human adenovirus D
gagaccggaggcgugcacuggc

SEQ ID NO: 1562877 - RNA, 16 nt, Human adenovirus D
acucuuaaaucauuua

SEQ ID NO: 1562878 - RNA, 21 nt, Human adenovirus D
accgugaauaucagacaugcu

SEQ ID NO: 1562879 - RNA, 18 nt, Human adenovirus D
gugaugagcugcgaggag

SEQ ID NO: 1562880 - RNA, 19 nt, Human adenovirus D
cugcaugcuggaauaagcu

SEQ ID NO: 1562881 - RNA, 23 nt, Human adenovirus D
cauguugugcaggaccaccagga

SEQ ID NO: 1562882 - RNA, 22 nt, Human adenovirus D
cugcauauucggguagaggccu

SEQ ID NO: 1562883 - RNA, 17 nt, Human adenovirus D
gcaaggucgaggagacc

SEQ ID NO: 1562884 - RNA, 21 nt, Human adenovirus D
ggccagugauuggggaaccuc

SEQ ID NO: 1562885 - RNA, 22 nt, Human adenovirus D
agccugcgccgggcgcugguag

SEQ ID NO: 1562886 - RNA, 22 nt, Human adenovirus D
auuucaaauuuuauguaucuuu

SEQ ID NO: 1562887 - RNA, 18 nt, Human adenovirus D
uaggaaccagcacacuca

SEQ ID NO: 1562888 - RNA, 17 nt, Human adenovirus D
ggccacgaccgugccgc

SEQ ID NO: 1562889 - RNA, 17 nt, Human adenovirus D
ggcgcugggcguggugc

SEQ ID NO: 1562890 - RNA, 12 nt, Human adenovirus D
ccgcggucccag

SEQ ID NO: 1562891 - RNA, 19 nt, Human adenovirus D
ugcuaaacaucgccgagcc

SEQ ID NO: 1562892 - RNA, 14 nt, Human adenovirus D
cagcucauccgcag

SEQ ID NO: 1562893 - RNA, 16 nt, Human adenovirus D
gcgcggcgggggcgga

SEQ ID NO: 1562894 - RNA, 21 nt, Human adenovirus D
acaaucuggcgguaccagggg

SEQ ID NO: 1562895 - RNA, 15 nt, Human adenovirus D
gagaucggcaccagc

SEQ ID NO: 1562896 - RNA, 15 nt, Human adenovirus D
aucccggccaaggcc

SEQ ID NO: 1562897 - RNA, 16 nt, Human adenovirus D
cagacgcaagagccgg

SEQ ID NO: 1562898 - RNA, 20 nt, Human adenovirus D
ucugguugacaaauggagcc

SEQ ID NO: 1562899 - RNA, 12 nt, Human adenovirus D
uuggcagccgag

SEQ ID NO: 1562900 - RNA, 14 nt, Human adenovirus D
gaccgcagcgggga

SEQ ID NO: 1562901 - RNA, 23 nt, Human adenovirus D
cgccccugcaagugcacagaccc

SEQ ID NO: 1562902 - RNA, 15 nt, Human adenovirus D
acugccaccgccgcc

SEQ ID NO: 1562903 - RNA, 13 nt, Human adenovirus D
guggcuguugaug

SEQ ID NO: 1562904 - RNA, 22 nt, Human adenovirus D
gcggcguggcccuuggcgcgga

SEQ ID NO: 1562905 - RNA, 16 nt, Human adenovirus D
uacaugcccagcagca

SEQ ID NO: 1562906 - RNA, 23 nt, Human adenovirus D
ccgguggcgaccgccgugcgccg

SEQ ID NO: 1562907 - RNA, 12 nt, Human adenovirus D
gaguuguccugg

SEQ ID NO: 1562908 - RNA, 20 nt, Human adenovirus D
guggcaacaccugggcacug

SEQ ID NO: 1562909 - RNA, 21 nt, Human adenovirus D
gccaagaaacgucccagcagc

SEQ ID NO: 1562910 - RNA, 18 nt, Human adenovirus D
ugaccacgguggugcaga

SEQ ID NO: 1562911 - RNA, 22 nt, Human adenovirus D
gauccagucauagcaggggcgc

SEQ ID NO: 1562912 - RNA, 17 nt, Human adenovirus D
gcaagguccgcaggagu

SEQ ID NO: 1562913 - RNA, 16 nt, Human adenovirus D
gaaccugaaggagcug

SEQ ID NO: 1562914 - RNA, 14 nt, Human adenovirus D
caucgaaaccagau

SEQ ID NO: 1562915 - RNA, 13 nt, Human adenovirus D
ggcggccauugcu

SEQ ID NO: 1562916 - RNA, 23 nt, Human adenovirus D
cuaguguacaacgcccugcugga

SEQ ID NO: 1562917 - RNA, 22 nt, Human adenovirus D
cacuggcuuccgccgccggggu

SEQ ID NO: 1562918 - RNA, 19 nt, Human adenovirus D
agcugcgcgagggccugga

SEQ ID NO: 1562919 - RNA, 15 nt, Human adenovirus D
ccuacuacuccugau

SEQ ID NO: 1562920 - RNA, 22 nt, Human adenovirus D
gcacccguccuccucgucccug

SEQ ID NO: 1562921 - RNA, 20 nt, Human adenovirus D
aggcaucggaacccuccagu

SEQ ID NO: 1562922 - RNA, 19 nt, Human adenovirus D
agccgcguaagcaggagca

SEQ ID NO: 1562923 - RNA, 18 nt, Human adenovirus D
cgccgaagcgccguggcc

SEQ ID NO: 1562924 - RNA, 15 nt, Human adenovirus D
gcuggaugcggagcc

SEQ ID NO: 1562925 - RNA, 22 nt, Human adenovirus D
gcgguucaagaacgagggccug

SEQ ID NO: 1562926 - RNA, 19 nt, Human adenovirus D
cacagcuagacaccacagu

SEQ ID NO: 1562927 - RNA, 17 nt, Human adenovirus D
gcuacaaucgccacagg

SEQ ID NO: 1562928 - RNA, 18 nt, Human adenovirus D
gcgacccaugauggugcu

SEQ ID NO: 1562929 - RNA, 21 nt, Human adenovirus D
gcuccaaagcuagcacccaaa

SEQ ID NO: 1562930 - RNA, 17 nt, Human adenovirus D
gccuccacccuggaagc

SEQ ID NO: 1562931 - RNA, 22 nt, Human adenovirus D
ugcggacuuuucuguugcaugu

SEQ ID NO: 1562932 - RNA, 16 nt, Human adenovirus D
uacgccaacucggccc

SEQ ID NO: 1562933 - RNA, 21 nt, Human adenovirus D
gaucccgcuguggcugaagau

SEQ ID NO: 1562934 - RNA, 16 nt, Human adenovirus D
ugcgcgagggccugga

SEQ ID NO: 1562935 - RNA, 20 nt, Human adenovirus D
ucucugccauguucucacag

SEQ ID NO: 1562936 - RNA, 17 nt, Human adenovirus D
ugcagcaggugcugccc

SEQ ID NO: 1562937 - RNA, 20 nt, Human adenovirus D
uccuggucugcaacccccag

SEQ ID NO: 1562938 - RNA, 14 nt, Human adenovirus D
ugggaacaaggccu

SEQ ID NO: 1562939 - RNA, 17 nt, Human adenovirus D
caacuacacagucaacu

SEQ ID NO: 1562940 - RNA, 20 nt, Human adenovirus D
caagccucugacggcgcagc

SEQ ID NO: 1562941 - RNA, 16 nt, Human adenovirus D
accuucaaccucacca

SEQ ID NO: 1562942 - RNA, 20 nt, Human adenovirus D
acgagcccgcgcgggagcca

SEQ ID NO: 1562943 - RNA, 22 nt, Human adenovirus D
gucggaagacccaagagcgaga

SEQ ID NO: 1562944 - RNA, 14 nt, Human adenovirus D
agaaacaagucaaa

SEQ ID NO: 1562945 - RNA, 16 nt, Human adenovirus D
ccacgcccgcuccacc

SEQ ID NO: 1562946 - RNA, 13 nt, Human adenovirus D
gcgcccggggcca

SEQ ID NO: 1562947 - RNA, 20 nt, Human adenovirus D
cucagcgucgaggagcugug

SEQ ID NO: 1562948 - RNA, 23 nt, Human adenovirus D
ccuugcgcgagcagaacgggggc

SEQ ID NO: 1562949 - RNA, 18 nt, Human adenovirus D
gggcgccgccggcggcga

SEQ ID NO: 1562950 - RNA, 14 nt, Human adenovirus D
ugcugcccgccacc

SEQ ID NO: 1562951 - RNA, 23 nt, Human adenovirus D
ccucugacggcgcagcuguuccu

SEQ ID NO: 1562952 - RNA, 19 nt, Human adenovirus D
agcagcaggguacccacug

SEQ ID NO: 1562953 - RNA, 16 nt, Human adenovirus D
cucgauccccuaccuu

SEQ ID NO: 1562954 - RNA, 12 nt, Human adenovirus D
cugccagcagaa

SEQ ID NO: 1562955 - RNA, 12 nt, Human adenovirus D
ggcgggacagag

SEQ ID NO: 1562956 - RNA, 13 nt, Human adenovirus D
ggggcgugcaggc

SEQ ID NO: 1562957 - RNA, 18 nt, Human adenovirus D
cgagccgcgcgccgcgcc

SEQ ID NO: 1562958 - RNA, 13 nt, Human adenovirus D
uucagagccaggg

SEQ ID NO: 1562959 - RNA, 22 nt, Human adenovirus D
aaaucugcccugauauccagua

SEQ ID NO: 1562960 - RNA, 14 nt, Human adenovirus D
uuugcgaaaacacu

SEQ ID NO: 1562961 - RNA, 18 nt, Human adenovirus D
augggaaugagagccgga

SEQ ID NO: 1562962 - RNA, 17 nt, Human adenovirus D
agcagaagaagacgaau

SEQ ID NO: 1562963 - RNA, 20 nt, Human adenovirus D
cgucacccugcccuuccagc

SEQ ID NO: 1562964 - RNA, 12 nt, Human adenovirus D
uggcucagcugc

SEQ ID NO: 1562965 - RNA, 17 nt, Human adenovirus D
aucuuugacauggaugu

SEQ ID NO: 1562966 - RNA, 23 nt, Human adenovirus D
gcgguacacgggguugcagcacu

SEQ ID NO: 1562967 - RNA, 20 nt, Human adenovirus D
ugccagacgcaagagccggc

SEQ ID NO: 1562968 - RNA, 22 nt, Human adenovirus D
cgccgauuuaaagacccacagc

SEQ ID NO: 1562969 - RNA, 24 nt, Human adenovirus D
cgccagccgcgguuaugcagggug

SEQ ID NO: 1562970 - RNA, 14 nt, Human adenovirus D
uggugucaggaaaa

SEQ ID NO: 1562971 - RNA, 14 nt, Human adenovirus D
agcuggaagcccug

SEQ ID NO: 1562972 - RNA, 18 nt, Human adenovirus D
gcagacacaccaggaugc

SEQ ID NO: 1562973 - RNA, 13 nt, Human adenovirus D
guacucauaaaga

SEQ ID NO: 1562974 - RNA, 17 nt, Human adenovirus D
ucacucuuuccagcagc

SEQ ID NO: 1562975 - RNA, 13 nt, Human adenovirus D
gcgcaggcgaccc

SEQ ID NO: 1562976 - RNA, 22 nt, Human adenovirus D
aggcgaagauggggccccgcca

SEQ ID NO: 1562977 - RNA, 20 nt, Human adenovirus D
ggggugaugagcugcgagga

SEQ ID NO: 1562978 - RNA, 11 nt, Human adenovirus D
ugaugcccaac

SEQ ID NO: 1562979 - RNA, 14 nt, Human adenovirus D
caggcgggacagag

SEQ ID NO: 1562980 - RNA, 20 nt, Human adenovirus D
caguagacaaagagcacagc

SEQ ID NO: 1562981 - RNA, 13 nt, Human adenovirus D
guugugcgccgcg

SEQ ID NO: 1562982 - RNA, 17 nt, Human adenovirus D
gcauuggcagccgagcc

SEQ ID NO: 1562983 - RNA, 17 nt, Human adenovirus D
cggcaguauaucaggug

SEQ ID NO: 1562984 - RNA, 14 nt, Human adenovirus D
ucaucacccagcag

SEQ ID NO: 1562985 - RNA, 17 nt, Human adenovirus D
gggcugcucggcgcgga

SEQ ID NO: 1562986 - RNA, 17 nt, Human adenovirus D
gaagaaaacuggcaaga

SEQ ID NO: 1562987 - RNA, 17 nt, Human adenovirus D
caggaugaacaggagca

SEQ ID NO: 1562988 - RNA, 21 nt, Human adenovirus D
cccagcgucugacgcugcgcu

SEQ ID NO: 1562989 - RNA, 17 nt, Human adenovirus D
guaagugcagcacauaa

SEQ ID NO: 1562990 - RNA, 15 nt, Human adenovirus D
gcaguugaccaugag

SEQ ID NO: 1562991 - RNA, 22 nt, Human adenovirus D
ccucugcgugaagaccacuggc

SEQ ID NO: 1562992 - RNA, 20 nt, Human adenovirus D
gaaggugagggggucccgcu

SEQ ID NO: 1562993 - RNA, 15 nt, Human adenovirus D
ucaucucgcccagca

SEQ ID NO: 1562994 - RNA, 20 nt, Human adenovirus D
cagucagugaagcccugguu

SEQ ID NO: 1562995 - RNA, 14 nt, Human adenovirus D
accgugaaaaugga

SEQ ID NO: 1562996 - RNA, 19 nt, Human adenovirus D
ugaauaucagacaugcugc

SEQ ID NO: 1562997 - RNA, 17 nt, Human adenovirus D
cuuacucagguuuggau

SEQ ID NO: 1562998 - RNA, 18 nt, Human adenovirus D
cgccaucuugcccacguc

SEQ ID NO: 1562999 - RNA, 22 nt, Human adenovirus D
cauccacaaggccgugagcgcg

SEQ ID NO: 1563000 - RNA, 20 nt, Human adenovirus D
accggaggcgugcacuggcu

SEQ ID NO: 1563001 - RNA, 12 nt, Human adenovirus D
cauucaaggcca

SEQ ID NO: 1563002 - RNA, 21 nt, Human adenovirus D
gccuuguagggacagcagccc

SEQ ID NO: 1563003 - RNA, 13 nt, Human adenovirus D
acaucagccagga

SEQ ID NO: 1563004 - RNA, 16 nt, Human adenovirus D
guugaccaugagcucg

SEQ ID NO: 1563005 - RNA, 17 nt, Human adenovirus D
gaggccacgugcgaggg

SEQ ID NO: 1563006 - RNA, 22 nt, Human adenovirus D
acaacaagauucaauaagguuc

SEQ ID NO: 1563007 - RNA, 18 nt, Human adenovirus D
cagcaggagcgugccgcc

SEQ ID NO: 1563008 - RNA, 20 nt, Human adenovirus D
ccuucuuccgcaacuuccag

SEQ ID NO: 1563009 - RNA, 13 nt, Human adenovirus D
cggggcacaggca

SEQ ID NO: 1563010 - RNA, 17 nt, Human adenovirus D
auaugcuacaucugcug

SEQ ID NO: 1563011 - RNA, 19 nt, Human adenovirus D
uuccguuugugccuccgcg

SEQ ID NO: 1563012 - RNA, 21 nt, Human adenovirus D
gucgucgcagccgccgugcuc

SEQ ID NO: 1563013 - RNA, 16 nt, Human adenovirus D
cguccacgccaagaca

SEQ ID NO: 1563014 - RNA, 22 nt, Human adenovirus D
augucagcugcaaaaagucacu

SEQ ID NO: 1563015 - RNA, 16 nt, Human adenovirus D
gccaagauagcccugc

SEQ ID NO: 1563016 - RNA, 21 nt, Human adenovirus D
cgauaaagugcaagucacgca

SEQ ID NO: 1563017 - RNA, 21 nt, Human adenovirus D
cgcuggaagaccuacgcucag

SEQ ID NO: 1563018 - RNA, 13 nt, Human adenovirus D
ccccuuccacugu

SEQ ID NO: 1563019 - RNA, 21 nt, Human adenovirus D
ccagcgcucguacccgcucac

SEQ ID NO: 1563020 - RNA, 14 nt, Human adenovirus D
ccacggggagggcg

SEQ ID NO: 1563021 - RNA, 14 nt, Human adenovirus D
cgucauugaagaga

SEQ ID NO: 1563022 - RNA, 21 nt, Human adenovirus D
ucaucaccguuccaugcagac

SEQ ID NO: 1563023 - RNA, 22 nt, Human adenovirus D
agcacuuuuauuuuacaugcac

SEQ ID NO: 1563024 - RNA, 14 nt, Human adenovirus D
caaugucagcugca

SEQ ID NO: 1563025 - RNA, 19 nt, Human adenovirus D
gucuggacccgcggccgcc

SEQ ID NO: 1563026 - RNA, 19 nt, Human adenovirus D
gaguaccugaacgacucgc

SEQ ID NO: 1563027 - RNA, 16 nt, Human adenovirus D
ggccgccaacaugcuc

SEQ ID NO: 1563028 - RNA, 20 nt, Human adenovirus D
agcaccccaacggcccugca

SEQ ID NO: 1563029 - RNA, 15 nt, Human adenovirus D
gacgagcccgcgcgg

SEQ ID NO: 1563030 - RNA, 23 nt, Human adenovirus D
auccagaauucaaccacaccugu

SEQ ID NO: 1563031 - RNA, 16 nt, Human adenovirus D
agaaggcgcccaggcc

SEQ ID NO: 1563032 - RNA, 18 nt, Human adenovirus D
gagacgcccuugugcccg

SEQ ID NO: 1563033 - RNA, 19 nt, Human adenovirus D
ugauccuuguccagauccu

SEQ ID NO: 1563034 - RNA, 16 nt, Human adenovirus D
ugaccugccuccacca

SEQ ID NO: 1563035 - RNA, 20 nt, Human adenovirus D
ggaugucaaauuccuggucc

SEQ ID NO: 1563036 - RNA, 18 nt, Human adenovirus D
uagcagcccuguggacgc

SEQ ID NO: 1563037 - RNA, 13 nt, Human adenovirus D
ugcccccaagggc

SEQ ID NO: 1563038 - RNA, 22 nt, Human adenovirus D
ugcaaaaagucacuuaaguccu

SEQ ID NO: 1563039 - RNA, 21 nt, Human adenovirus D
agaggagcugaucucgcugcc

SEQ ID NO: 1563040 - RNA, 19 nt, Human adenovirus D
cagauagugcuuacucuau

SEQ ID NO: 1563041 - RNA, 19 nt, Human adenovirus D
uucagccauagcucagccc

SEQ ID NO: 1563042 - RNA, 17 nt, Human adenovirus D
aggcgcaaccaggagga

SEQ ID NO: 1563043 - RNA, 14 nt, Human adenovirus D
acucgcugcugcag

SEQ ID NO: 1563044 - RNA, 22 nt, Human adenovirus D
ucgguacccuccucccaacucu

SEQ ID NO: 1563045 - RNA, 16 nt, Human adenovirus D
ccugugacaugcaaaa

SEQ ID NO: 1563046 - RNA, 15 nt, Human adenovirus D
uauaaaucuuacaca

SEQ ID NO: 1563047 - RNA, 15 nt, Human adenovirus D
ugcaguuuggccugg

SEQ ID NO: 1563048 - RNA, 18 nt, Human adenovirus D
auuuaaagacccacagcc

SEQ ID NO: 1563049 - RNA, 19 nt, Human adenovirus D
cauccugagauaugugcag

SEQ ID NO: 1563050 - RNA, 17 nt, Human adenovirus D
gcccacggugguggaga

SEQ ID NO: 1563051 - RNA, 14 nt, Human adenovirus D
cggaccggucccag

SEQ ID NO: 1563052 - RNA, 22 nt, Human adenovirus D
aggcagaggcacacagcucaac

SEQ ID NO: 1563053 - RNA, 14 nt, Human adenovirus D
ccucugugcccagu

SEQ ID NO: 1563054 - RNA, 17 nt, Human adenovirus D
ccuggucaucaccuucc

SEQ ID NO: 1563055 - RNA, 16 nt, Human adenovirus D
cgcaggccaggaggag

SEQ ID NO: 1563056 - RNA, 20 nt, Human adenovirus D
gcuguauuaccuuccuugcu

SEQ ID NO: 1563057 - RNA, 14 nt, Human adenovirus D
ggaugagguggacg

SEQ ID NO: 1563058 - RNA, 16 nt, Human adenovirus D
ggaaccuaccacugcc

SEQ ID NO: 1563059 - RNA, 17 nt, Human adenovirus D
agccacaugacccugca

SEQ ID NO: 1563060 - RNA, 17 nt, Human adenovirus D
ggcccuggagcagcggc

SEQ ID NO: 1563061 - RNA, 16 nt, Human adenovirus D
gcuaucugcucuucca

SEQ ID NO: 1563062 - RNA, 20 nt, Human adenovirus D
ccugggcacuggagcacaga

SEQ ID NO: 1563063 - RNA, 23 nt, Human adenovirus D
auagucacacuuaguucagcugc

SEQ ID NO: 1563064 - RNA, 22 nt, Human adenovirus D
acgucgcccgaguuguccuggu

SEQ ID NO: 1563065 - RNA, 17 nt, Human adenovirus D
agcaggugcugccccag

SEQ ID NO: 1563066 - RNA, 23 nt, Human adenovirus D
guccaugguagcaauggaaauca

SEQ ID NO: 1563067 - RNA, 20 nt, Human adenovirus D
agcgguccucggucaggagc

SEQ ID NO: 1563068 - RNA, 16 nt, Human adenovirus D
gccgagaccgugagcu

SEQ ID NO: 1563069 - RNA, 15 nt, Human adenovirus D
cugccgcgccaaccg

SEQ ID NO: 1563070 - RNA, 13 nt, Human adenovirus D
gagcuugcccuug

SEQ ID NO: 1563071 - RNA, 12 nt, Human adenovirus D
uguaacaucacc

SEQ ID NO: 1563072 - RNA, 21 nt, Human adenovirus D
ggagcgaggugugcgucaggg

SEQ ID NO: 1563073 - RNA, 17 nt, Human adenovirus D
cggcuuacaacagccuu

SEQ ID NO: 1563074 - RNA, 18 nt, Human adenovirus D
uguuuauaaaucuuacac

SEQ ID NO: 1563075 - RNA, 23 nt, Human adenovirus D
cagccuugauuuuuccagcccag

SEQ ID NO: 1563076 - RNA, 12 nt, Human adenovirus D
cccuggaagagu

SEQ ID NO: 1563077 - RNA, 12 nt, Human adenovirus D
gagcagcacaga

SEQ ID NO: 1563078 - RNA, 21 nt, Human adenovirus D
ugccgagccgcgggaucaagc

SEQ ID NO: 1563079 - RNA, 17 nt, Human adenovirus D
aucacccucagaagaag

SEQ ID NO: 1563080 - RNA, 22 nt, Human adenovirus D
acuggcuucuacagccagcagc

SEQ ID NO: 1563081 - RNA, 19 nt, Human adenovirus D
uccccucaucacaucagcc

SEQ ID NO: 1563082 - RNA, 19 nt, Human adenovirus D
ugugagugauaaagcgugg

SEQ ID NO: 1563083 - RNA, 18 nt, Human adenovirus D
cugaaccacacggccagc

SEQ ID NO: 1563084 - RNA, 18 nt, Human adenovirus D
ccccgacccccuuccacu

SEQ ID NO: 1563085 - RNA, 16 nt, Human adenovirus D
gaggcauggcaggcag

SEQ ID NO: 1563086 - RNA, 20 nt, Human adenovirus D
ucgaguacgaggccaugcug

SEQ ID NO: 1563087 - RNA, 13 nt, Human adenovirus D
ucgcucuggggcc

SEQ ID NO: 1563088 - RNA, 14 nt, Human adenovirus D
gugcgaggaugaga

SEQ ID NO: 1563089 - RNA, 17 nt, Human adenovirus D
ugcagaccgaccccugg

SEQ ID NO: 1563090 - RNA, 15 nt, Human adenovirus D
agauggaagaagaau

SEQ ID NO: 1563091 - RNA, 20 nt, Human adenovirus D
gcagcgccagucccucaucc

SEQ ID NO: 1563092 - RNA, 15 nt, Human adenovirus D
agcuggccgcccuga

SEQ ID NO: 1563093 - RNA, 20 nt, Human adenovirus D
ucgccacaggugcugcccac

SEQ ID NO: 1563094 - RNA, 15 nt, Human adenovirus D
gaccgacgcugggcu

SEQ ID NO: 1563095 - RNA, 13 nt, Human adenovirus D
uuucuccacaccu

SEQ ID NO: 1563096 - RNA, 19 nt, Human adenovirus D
gccgucgucccggaggagg

SEQ ID NO: 1563097 - RNA, 12 nt, Human adenovirus D
aaacuggggcga

SEQ ID NO: 1563098 - RNA, 14 nt, Human adenovirus D
ggccaaccugguga

SEQ ID NO: 1563099 - RNA, 18 nt, Human adenovirus D
gagagcgugauggcgcag

SEQ ID NO: 1563100 - RNA, 16 nt, Human adenovirus D
cgaagauggggccccg

SEQ ID NO: 1563101 - RNA, 21 nt, Human adenovirus D
ggauguaaguuuuauggcugc

SEQ ID NO: 1563102 - RNA, 23 nt, Human adenovirus D
cccaggaaacuaggcgcagcugc

SEQ ID NO: 1563103 - RNA, 16 nt, Human adenovirus D
cggagggugccagauu

SEQ ID NO: 1563104 - RNA, 14 nt, Human adenovirus D
cccagcgccgcgcu

SEQ ID NO: 1563105 - RNA, 21 nt, Human adenovirus D
gaggccaucuaaacuaaagcc

SEQ ID NO: 1563106 - RNA, 14 nt, Human adenovirus D
uaucuaugaaagca

SEQ ID NO: 1563107 - RNA, 15 nt, Human adenovirus D
ccaacaugcucuacc

SEQ ID NO: 1563108 - RNA, 22 nt, Human adenovirus D
ugguggaaacagacagccaggu

SEQ ID NO: 1563109 - RNA, 13 nt, Human adenovirus D
ucuggcuugcuuc

SEQ ID NO: 1563110 - RNA, 14 nt, Human adenovirus D
ugccaggggucuac

SEQ ID NO: 1563111 - RNA, 16 nt, Human adenovirus D
uggaagaagagcagca

SEQ ID NO: 1563112 - RNA, 22 nt, Human adenovirus D
guuggaggaagaaaugaggcag

SEQ ID NO: 1563113 - RNA, 21 nt, Human adenovirus D
ccgccauaagggcggcgcugc

SEQ ID NO: 1563114 - RNA, 17 nt, Human adenovirus D
aggcaaagaucaccuac

SEQ ID NO: 1563115 - RNA, 19 nt, Human adenovirus D
cgcaguugggagcugucca

SEQ ID NO: 1563116 - RNA, 14 nt, Human adenovirus D
aucccgccgcagga

SEQ ID NO: 1563117 - RNA, 13 nt, Human adenovirus D
ggcaaagcgguug

SEQ ID NO: 1563118 - RNA, 19 nt, Human adenovirus D
cacagcaacuuccugacca

SEQ ID NO: 1563119 - RNA, 13 nt, Human adenovirus D
uggccuggagcag

SEQ ID NO: 1563120 - RNA, 18 nt, Human adenovirus D
ggcuacgcgcggaaucag

SEQ ID NO: 1563121 - RNA, 12 nt, Human adenovirus D
uugaaaaaauug

SEQ ID NO: 1563122 - RNA, 17 nt, Human adenovirus D
ggaccaggcggcagagc

SEQ ID NO: 1563123 - RNA, 19 nt, Human adenovirus D
gagccacugcuaccucuug

SEQ ID NO: 1563124 - RNA, 18 nt, Human adenovirus D
ucauugacggcgggcuga

SEQ ID NO: 1563125 - RNA, 16 nt, Human adenovirus D
gagcugcgcgagggcc

SEQ ID NO: 1563126 - RNA, 15 nt, Human adenovirus D
acuguaaagccacaa

SEQ ID NO: 1563127 - RNA, 15 nt, Human adenovirus D
ggucacacuagcgcc

SEQ ID NO: 1563128 - RNA, 21 nt, Human adenovirus D
gaacgacucgcugcugcagcc

SEQ ID NO: 1563129 - RNA, 13 nt, Human adenovirus D
gcgagguugagcu

SEQ ID NO: 1563130 - RNA, 18 nt, Human adenovirus D
ugcacaucgccgggcagg

SEQ ID NO: 1563131 - RNA, 20 nt, Human adenovirus D
ggcuccuacggagggcagaa

SEQ ID NO: 1563132 - RNA, 15 nt, Human adenovirus D
augacugaccaccac

SEQ ID NO: 1563133 - RNA, 16 nt, Human adenovirus D
ugaacgcgcuggcgga

SEQ ID NO: 1563134 - RNA, 16 nt, Human adenovirus D
acgagcccgcgcggga

SEQ ID NO: 1563135 - RNA, 22 nt, Human adenovirus D
ggaaucggaucuuccccacucu

SEQ ID NO: 1563136 - RNA, 13 nt, Human adenovirus D
ggcagugcagcgc

SEQ ID NO: 1563137 - RNA, 23 nt, Human adenovirus D
cccuucaccgacaguggcagcgu

SEQ ID NO: 1563138 - RNA, 11 nt, Human adenovirus D
ggaagcccuga

SEQ ID NO: 1563139 - RNA, 20 nt, Human adenovirus D
ggcaggccauggacgagaac

SEQ ID NO: 1563140 - RNA, 15 nt, Human adenovirus D
cauguugaaaagcuc

SEQ ID NO: 1563141 - RNA, 17 nt, Human adenovirus D
aggauaaauauggccug

SEQ ID NO: 1563142 - RNA, 22 nt, Human adenovirus D
gcggcaaaauggcgugcuggag

SEQ ID NO: 1563143 - RNA, 20 nt, Human adenovirus D
aggcauggcaggcagcggcc

SEQ ID NO: 1563144 - RNA, 12 nt, Human adenovirus D
cuggaacaccau

SEQ ID NO: 1563145 - RNA, 16 nt, Human adenovirus D
guccgcaggcgggaca

SEQ ID NO: 1563146 - RNA, 13 nt, Human adenovirus D
agcaggcaggugg

SEQ ID NO: 1563147 - RNA, 17 nt, Human adenovirus D
cgcgauguugagcugga

SEQ ID NO: 1563148 - RNA, 22 nt, Human adenovirus D
gcagcggugguggaggcgcgcg

SEQ ID NO: 1563149 - RNA, 12 nt, Human adenovirus D
cacgcccugggu

SEQ ID NO: 1563150 - RNA, 22 nt, Human adenovirus D
cgggcgggcagggagcugcgcg

SEQ ID NO: 1563151 - RNA, 16 nt, Human adenovirus D
aggaagugcggcggcg

SEQ ID NO: 1563152 - RNA, 13 nt, Human adenovirus D
cguccuggaccgc

SEQ ID NO: 1563153 - RNA, 21 nt, Human adenovirus D
gaccggaggcgugcacuggcu

SEQ ID NO: 1563154 - RNA, 14 nt, Human adenovirus D
acguggugcugcug

SEQ ID NO: 1563155 - RNA, 14 nt, Human adenovirus D
agcagaggaagagg

SEQ ID NO: 1563156 - RNA, 19 nt, Human adenovirus D
ucgccagggaacugaaaga

SEQ ID NO: 1563157 - RNA, 21 nt, Human adenovirus D
ucgaggacgugagcggcgagg

SEQ ID NO: 1563158 - RNA, 13 nt, Human adenovirus D
gcuccagccaaag

SEQ ID NO: 1563159 - RNA, 21 nt, Human adenovirus D
acgugcccauagacaaggagg

SEQ ID NO: 1563160 - RNA, 18 nt, Human adenovirus D
cucagcagucucugccgc

SEQ ID NO: 1563161 - RNA, 15 nt, Human adenovirus D
uccaccacccacgcc

SEQ ID NO: 1563162 - RNA, 21 nt, Human adenovirus D
ugcccagcagcagcaguagcc

SEQ ID NO: 1563163 - RNA, 17 nt, Human adenovirus D
ucgcucuggggcccggc

SEQ ID NO: 1563164 - RNA, 18 nt, Human adenovirus D
cgcuccaccgaaggcagc

SEQ ID NO: 1563165 - RNA, 23 nt, Human adenovirus D
ugagcgcauguacaacaugcuga

SEQ ID NO: 1563166 - RNA, 13 nt, Human adenovirus D
auguguggacuau

SEQ ID NO: 1563167 - RNA, 19 nt, Human adenovirus D
uauccaguaggaaccagca

SEQ ID NO: 1563168 - RNA, 14 nt, Human adenovirus D
cacagugcccccuc

SEQ ID NO: 1563169 - RNA, 19 nt, Human adenovirus D
agacggugaagcaggagcg

SEQ ID NO: 1563170 - RNA, 18 nt, Human adenovirus D
cagcucaucgacuggugc

SEQ ID NO: 1563171 - RNA, 19 nt, Human adenovirus D
gcuggccagcacgcucuug

SEQ ID NO: 1563172 - RNA, 16 nt, Human adenovirus D
cugcuucugccuggug

SEQ ID NO: 1563173 - RNA, 21 nt, Human adenovirus D
agggcacagccucucugaagc

SEQ ID NO: 1563174 - RNA, 11 nt, Human adenovirus D
cgcccaggcgc

SEQ ID NO: 1563175 - RNA, 19 nt, Human adenovirus D
gagcaaucccacgccgagc

SEQ ID NO: 1563176 - RNA, 14 nt, Human adenovirus D
gccacaugacccug

SEQ ID NO: 1563177 - RNA, 18 nt, Human adenovirus D
agguggacgagcagaccu

SEQ ID NO: 1563178 - RNA, 19 nt, Human adenovirus D
gcagaccuucauaauagaa

SEQ ID NO: 1563179 - RNA, 17 nt, Human adenovirus D
agcuugggcgcaagaaa

SEQ ID NO: 1563180 - RNA, 18 nt, Human adenovirus D
gcccagguuuuccaugca

SEQ ID NO: 1563181 - RNA, 22 nt, Human adenovirus D
agaaggugguggacggccuggc

SEQ ID NO: 1563182 - RNA, 20 nt, Human adenovirus D
cugcgcguccgucagcagca

SEQ ID NO: 1563183 - RNA, 17 nt, Human adenovirus D
ggugcaguuugcccgcg

SEQ ID NO: 1563184 - RNA, 15 nt, Human adenovirus D
cucaccaaggccaua

SEQ ID NO: 1563185 - RNA, 23 nt, Human adenovirus D
ccacaaaaacgaagaucagcugc

SEQ ID NO: 1563186 - RNA, 15 nt, Human adenovirus D
gcaaccaggaggagc

SEQ ID NO: 1563187 - RNA, 20 nt, Human adenovirus D
cagccacagacagagaugga

SEQ ID NO: 1563188 - RNA, 14 nt, Human adenovirus D
gcaggggcggcaga

SEQ ID NO: 1563189 - RNA, 15 nt, Human adenovirus D
guccagcgcggccag

SEQ ID NO: 1563190 - RNA, 13 nt, Human adenovirus D
guuaucgaggacg

SEQ ID NO: 1563191 - RNA, 18 nt, Human adenovirus D
cacugacuuagcucccua

SEQ ID NO: 1563192 - RNA, 17 nt, Human adenovirus D
gcagcguguuggacuug

SEQ ID NO: 1563193 - RNA, 22 nt, Human adenovirus D
gaaaccucaaaaagcuguggac

SEQ ID NO: 1563194 - RNA, 17 nt, Human adenovirus D
gcaggcgacccuggagg

SEQ ID NO: 1563195 - RNA, 21 nt, Human adenovirus D
gaucgugguaaacgggcccug

SEQ ID NO: 1563196 - RNA, 15 nt, Human adenovirus D
cgaugugcucgguga

SEQ ID NO: 1563197 - RNA, 20 nt, Human adenovirus D
uacauagaccacgcuacaaa

SEQ ID NO: 1563198 - RNA, 17 nt, Human adenovirus D
ccugaacggcaucuuug

SEQ ID NO: 1563199 - RNA, 16 nt, Human adenovirus D
ugcuacaucugcugcc

SEQ ID NO: 1563200 - RNA, 17 nt, Human adenovirus D
uccaguuaaugcugccu

SEQ ID NO: 1563201 - RNA, 11 nt, Human adenovirus D
ggaagaagagc

SEQ ID NO: 1563202 - RNA, 17 nt, Human adenovirus D
ggcgcugcaaagccagc

SEQ ID NO: 1563203 - RNA, 16 nt, Human adenovirus D
caggagaggcauggca

SEQ ID NO: 1563204 - RNA, 18 nt, Human adenovirus D
aguacuuggaaagcaaga

SEQ ID NO: 1563205 - RNA, 19 nt, Human adenovirus D
agccggcucgucuagaacc

SEQ ID NO: 1563206 - RNA, 13 nt, Human adenovirus D
gcugugcuggugg

SEQ ID NO: 1563207 - RNA, 13 nt, Human adenovirus D
gcccugcuggccg

SEQ ID NO: 1563208 - RNA, 13 nt, Human adenovirus D
aaaaccacauuug

SEQ ID NO: 1563209 - RNA, 14 nt, Human adenovirus D
ccacacggccagca

SEQ ID NO: 1563210 - RNA, 21 nt, Human adenovirus D
ggacacgcuguaccgcagcug

SEQ ID NO: 1563211 - RNA, 17 nt, Human adenovirus D
uuccaguacucccggag

SEQ ID NO: 1563212 - RNA, 17 nt, Human adenovirus D
gccaggugagcucgggc

SEQ ID NO: 1563213 - RNA, 17 nt, Human adenovirus D
ucgcggcgaacgagcca

SEQ ID NO: 1563214 - RNA, 22 nt, Human adenovirus D
guccaucgugcgcgaccugggc

SEQ ID NO: 1563215 - RNA, 16 nt, Human adenovirus D
caggccgggcugcacg

SEQ ID NO: 1563216 - RNA, 17 nt, Human adenovirus D
gcgugauggcgcaggcg

SEQ ID NO: 1563217 - RNA, 15 nt, Human adenovirus D
ggggacgagcugcuu

SEQ ID NO: 1563218 - RNA, 22 nt, Human adenovirus D
cucgcggacgcgguuccagaug

SEQ ID NO: 1563219 - RNA, 20 nt, Human adenovirus D
gaauauccccuuccucacuc

SEQ ID NO: 1563220 - RNA, 21 nt, Human adenovirus D
ugcucuccgcaccgcuccugg

SEQ ID NO: 1563221 - RNA, 22 nt, Human adenovirus D
caccauguuauucagcagccca

SEQ ID NO: 1563222 - RNA, 21 nt, Human adenovirus D
cugggguacuuuacgcuggcc

SEQ ID NO: 1563223 - RNA, 21 nt, Human adenovirus D
ucaauguaacuaaacuuuaug

SEQ ID NO: 1563224 - RNA, 21 nt, Human adenovirus D
acgcaaacggguuaggccgcg

SEQ ID NO: 1563225 - RNA, 19 nt, Human adenovirus D
ccucaugaacacacugccc

SEQ ID NO: 1563226 - RNA, 19 nt, Human adenovirus D
aagcgggccucacagucca

SEQ ID NO: 1563227 - RNA, 19 nt, Human adenovirus D
caccgugcgcuaccacccc

SEQ ID NO: 1563228 - RNA, 24 nt, Human adenovirus D
cgcucaggaccauagggagccugc

SEQ ID NO: 1563229 - RNA, 15 nt, Human adenovirus D
cacaucggacugggu

SEQ ID NO: 1563230 - RNA, 17 nt, Human adenovirus D
uaaugaucaaaacuuaa

SEQ ID NO: 1563231 - RNA, 18 nt, Human adenovirus D
gacucgggggucugucau

SEQ ID NO: 1563232 - RNA, 17 nt, Human adenovirus D
cacuagcgcccugguag

SEQ ID NO: 1563233 - RNA, 14 nt, Human adenovirus D
agcagucucugccg

SEQ ID NO: 1563234 - RNA, 18 nt, Human adenovirus D
acaggaugggucugugcc

SEQ ID NO: 1563235 - RNA, 14 nt, Human adenovirus D
ugcuagcccuuccu

SEQ ID NO: 1563236 - RNA, 19 nt, Human adenovirus D
agcggcgcaagcucaugcu

SEQ ID NO: 1563237 - RNA, 23 nt, Human adenovirus D
ucagaucgugguaaacgggcccu

SEQ ID NO: 1563238 - RNA, 16 nt, Human adenovirus D
agaggcgacccaugau

SEQ ID NO: 1563239 - RNA, 13 nt, Human adenovirus D
gaucuuggaugga

SEQ ID NO: 1563240 - RNA, 19 nt, Human adenovirus D
acaagcgccaacagcagcg

SEQ ID NO: 1563241 - RNA, 12 nt, Human adenovirus D
cgcaggccagga

SEQ ID NO: 1563242 - RNA, 23 nt, Human adenovirus D
cuccuggugcgucgagcacagca

SEQ ID NO: 1563243 - RNA, 16 nt, Human adenovirus D
cgcucgggcagguccc

SEQ ID NO: 1563244 - RNA, 13 nt, Human adenovirus D
ucaaccuccaggc

SEQ ID NO: 1563245 - RNA, 14 nt, Human adenovirus D
acccgcucaccauc

SEQ ID NO: 1563246 - RNA, 14 nt, Human adenovirus D
cgguaagcacgagc

SEQ ID NO: 1563247 - RNA, 16 nt, Human adenovirus D
ccgggcuaccgcggca

SEQ ID NO: 1563248 - RNA, 16 nt, Human adenovirus D
gcaggccauggacgag

SEQ ID NO: 1563249 - RNA, 15 nt, Human adenovirus D
aaggcgcgcccaccc

SEQ ID NO: 1563250 - RNA, 13 nt, Human adenovirus D
cagccgcaggcgc

SEQ ID NO: 1563251 - RNA, 13 nt, Human adenovirus D
gacaaaggaggcc

SEQ ID NO: 1563252 - RNA, 19 nt, Human adenovirus D
ucacaguaagugcagcaca

SEQ ID NO: 1563253 - RNA, 20 nt, Human adenovirus D
cagcuccgguugugcagccc

SEQ ID NO: 1563254 - RNA, 16 nt, Human adenovirus D
caccgcuaccgcuucc

SEQ ID NO: 1563255 - RNA, 19 nt, Human adenovirus D
cgaagaagaacaggagccg

SEQ ID NO: 1563256 - RNA, 18 nt, Human adenovirus D
agcaucagucuccuggug

SEQ ID NO: 1563257 - RNA, 14 nt, Human adenovirus D
uaauagaaacagau

SEQ ID NO: 1563258 - RNA, 21 nt, Human adenovirus D
uccugggccacuacagcugac

SEQ ID NO: 1563259 - RNA, 15 nt, Human adenovirus D
gaccggggaggcacc

SEQ ID NO: 1563260 - RNA, 16 nt, Human adenovirus D
augagagucugaaaaa

SEQ ID NO: 1563261 - RNA, 22 nt, Human adenovirus D
ucugauuagcauagucacacuu

SEQ ID NO: 1563262 - RNA, 19 nt, Human adenovirus D
ugccaccaguuggacgagu

SEQ ID NO: 1563263 - RNA, 19 nt, Human adenovirus D
uggcagagcacgcugcaca

SEQ ID NO: 1563264 - RNA, 16 nt, Human adenovirus D
uacacacuagaaagca

SEQ ID NO: 1563265 - RNA, 18 nt, Human adenovirus D
gcugagcgacgaccuggg

SEQ ID NO: 1563266 - RNA, 18 nt, Human adenovirus D
guuuaugacucaugggcg

SEQ ID NO: 1563267 - RNA, 23 nt, Human adenovirus D
cggcgcguggaggaagugcugga

SEQ ID NO: 1563268 - RNA, 13 nt, Human adenovirus D
aguacgaggccau

SEQ ID NO: 1563269 - RNA, 14 nt, Human adenovirus D
cugcucuucccugg

SEQ ID NO: 1563270 - RNA, 13 nt, Human adenovirus D
ggcugcuggagcu

SEQ ID NO: 1563271 - RNA, 19 nt, Human adenovirus D
caggaugcagccaguggcc

SEQ ID NO: 1563272 - RNA, 15 nt, Human adenovirus D
ggagggauugcaggg

SEQ ID NO: 1563273 - RNA, 13 nt, Human adenovirus D
gcccgcgccgcgg

SEQ ID NO: 1563274 - RNA, 14 nt, Human adenovirus D
gcgauguugccacc

SEQ ID NO: 1563275 - RNA, 15 nt, Human adenovirus D
cauccauggccaggg

SEQ ID NO: 1563276 - RNA, 22 nt, Human adenovirus D
cauucuggacuucgcagccaug

SEQ ID NO: 1563277 - RNA, 14 nt, Human adenovirus D
gcugggcucgagca

SEQ ID NO: 1563278 - RNA, 11 nt, Human adenovirus D
cgggagcgagc

SEQ ID NO: 1563279 - RNA, 21 nt, Human adenovirus D
ucauggccaacagccacauga

SEQ ID NO: 1563280 - RNA, 15 nt, Human adenovirus D
guaguugcgcaggcg

SEQ ID NO: 1563281 - RNA, 18 nt, Human adenovirus D
cggaggccaucgugcaga

SEQ ID NO: 1563282 - RNA, 23 nt, Human adenovirus D
gaagccuucuauggaggcagagc

SEQ ID NO: 1563283 - RNA, 14 nt, Human adenovirus D
cuccaggccaaccu

SEQ ID NO: 1563284 - RNA, 14 nt, Human adenovirus D
acgcgccagccgcg

SEQ ID NO: 1563285 - RNA, 18 nt, Human adenovirus D
gugcaggaccaccaggac

SEQ ID NO: 1563286 - RNA, 20 nt, Human adenovirus D
uggccgcgauguugagcugg

SEQ ID NO: 1563287 - RNA, 16 nt, Human adenovirus D
ggcuucuacagccagc

SEQ ID NO: 1563288 - RNA, 12 nt, Human adenovirus D
ggcauccugcac

SEQ ID NO: 1563289 - RNA, 20 nt, Human adenovirus D
cuacuggcuucuacagccag

SEQ ID NO: 1563290 - RNA, 16 nt, Human adenovirus D
cugccgagccgcggga

SEQ ID NO: 1563291 - RNA, 15 nt, Human adenovirus D
ugcucaccaccccgg

SEQ ID NO: 1563292 - RNA, 22 nt, Human adenovirus D
ugagguacaugggcaugagccc

SEQ ID NO: 1563293 - RNA, 17 nt, Human adenovirus D
gggcuucgaagagccgg

SEQ ID NO: 1563294 - RNA, 14 nt, Human adenovirus D
cuacaaggaccgca

SEQ ID NO: 1563295 - RNA, 18 nt, Human adenovirus D
ccccagggaccacaaugu

SEQ ID NO: 1563296 - RNA, 15 nt, Human adenovirus D
ucaacuacuguggca

SEQ ID NO: 1563297 - RNA, 15 nt, Human adenovirus D
cgacacguacuucag

SEQ ID NO: 1563298 - RNA, 12 nt, Human adenovirus D
uugagcuggccu

SEQ ID NO: 1563299 - RNA, 16 nt, Human adenovirus D
caccgcuccuggucug

SEQ ID NO: 1563300 - RNA, 22 nt, Human adenovirus D
gaccgcggccguagcaggcgcc

SEQ ID NO: 1563301 - RNA, 20 nt, Human adenovirus D
ggcauggcaggcagcggccu

SEQ ID NO: 1563302 - RNA, 18 nt, Human adenovirus D
gagaccaacggcugcauc

SEQ ID NO: 1563303 - RNA, 14 nt, Human adenovirus D
aggacacccggccc

SEQ ID NO: 1563304 - RNA, 15 nt, Human adenovirus D
cccgagcucugcugc

SEQ ID NO: 1563305 - RNA, 14 nt, Human adenovirus D
uagucaaucuccca

SEQ ID NO: 1563306 - RNA, 20 nt, Human adenovirus D
cagaugucaggaucauugaa

SEQ ID NO: 1563307 - RNA, 15 nt, Human adenovirus D
cuucgcagccaugca

SEQ ID NO: 1563308 - RNA, 17 nt, Human adenovirus D
uucucggccaaucagca

SEQ ID NO: 1563309 - RNA, 17 nt, Human adenovirus D
caccacccacgcccgcu

SEQ ID NO: 1563310 - RNA, 21 nt, Human adenovirus D
cgcgggcuguggggcgugcag

SEQ ID NO: 1563311 - RNA, 22 nt, Human adenovirus D
ggugcgccccaucaagcaggug

SEQ ID NO: 1563312 - RNA, 16 nt, Human adenovirus D
cccaaaaucgagcagg

SEQ ID NO: 1563313 - RNA, 20 nt, Human adenovirus D
gcaucagcaucauccccgcg

SEQ ID NO: 1563314 - RNA, 23 nt, Human adenovirus D
guguaucucaauaaacagcacuu

SEQ ID NO: 1563315 - RNA, 19 nt, Human adenovirus D
cuggcgacgcagccggcga

SEQ ID NO: 1563316 - RNA, 20 nt, Human adenovirus D
uuuuaggagacuuucaucca

SEQ ID NO: 1563317 - RNA, 14 nt, Human adenovirus D
ugagguggacgagg

SEQ ID NO: 1563318 - RNA, 19 nt, Human adenovirus D
aucacaucggacuggguua

SEQ ID NO: 1563319 - RNA, 21 nt, Human adenovirus D
ucaacagcugggacuugccgc

SEQ ID NO: 1563320 - RNA, 17 nt, Human adenovirus D
caggagaggcauggcag

SEQ ID NO: 1563321 - RNA, 20 nt, Human adenovirus D
acucgcagacgagcggccgc

SEQ ID NO: 1563322 - RNA, 14 nt, Human adenovirus D
gccaugcgcaggcg

SEQ ID NO: 1563323 - RNA, 14 nt, Human adenovirus D
accggaggcuggcu

SEQ ID NO: 1563324 - RNA, 16 nt, Human adenovirus D
aucccaacagccuuca

SEQ ID NO: 1563325 - RNA, 19 nt, Human adenovirus D
cagugaaaacgugccugcu

SEQ ID NO: 1563326 - RNA, 20 nt, Human adenovirus D
cgcaaaaccuguucagggac

SEQ ID NO: 1563327 - RNA, 20 nt, Human adenovirus D
guacauguucaccagcaagu

SEQ ID NO: 1563328 - RNA, 18 nt, Human adenovirus D
gugcgcgaccugggcugc

SEQ ID NO: 1563329 - RNA, 15 nt, Human adenovirus D
ucggacgacugggag

SEQ ID NO: 1563330 - RNA, 18 nt, Human adenovirus D
ccuggggcaucucuucgu

SEQ ID NO: 1563331 - RNA, 20 nt, Human adenovirus D
augcgacccaugagcugcga

SEQ ID NO: 1563332 - RNA, 13 nt, Human adenovirus D
uggggcagacagu

SEQ ID NO: 1563333 - RNA, 17 nt, Human adenovirus D
cugcugccgcucaguca

SEQ ID NO: 1563334 - RNA, 13 nt, Human adenovirus D
gagcucuugcagg

SEQ ID NO: 1563335 - RNA, 13 nt, Human adenovirus D
gcuggcccuccau

SEQ ID NO: 1563336 - RNA, 17 nt, Human adenovirus D
aguggaagaagagcagc

SEQ ID NO: 1563337 - RNA, 14 nt, Human adenovirus D
ccucggugcagccg

SEQ ID NO: 1563338 - RNA, 23 nt, Human adenovirus D
gcggcuuuggcaaagacguuucu

SEQ ID NO: 1563339 - RNA, 14 nt, Human adenovirus D
aguuaaugcugccu

SEQ ID NO: 1563340 - RNA, 15 nt, Human adenovirus D
acagauccugcugcu

SEQ ID NO: 1563341 - RNA, 17 nt, Human adenovirus D
ugcugaucaagugccac

SEQ ID NO: 1563342 - RNA, 19 nt, Human adenovirus D
cggcggcgaggggcuccuc

SEQ ID NO: 1563343 - RNA, 16 nt, Human adenovirus D
cuaccucucggccgcc

SEQ ID NO: 1563344 - RNA, 15 nt, Human adenovirus D
gcgaggaggaccagg

SEQ ID NO: 1563345 - RNA, 15 nt, Human adenovirus D
ccugcggggcgauga

SEQ ID NO: 1563346 - RNA, 23 nt, Human adenovirus D
cagcaaauuccucgaccaugacc

SEQ ID NO: 1563347 - RNA, 19 nt, Human adenovirus D
ugguccuggucacccucga

SEQ ID NO: 1563348 - RNA, 22 nt, Human adenovirus D
agcagcgcgcgucauggcuggu

SEQ ID NO: 1563349 - RNA, 17 nt, Human adenovirus D
cgccgcuaucugcucuu

SEQ ID NO: 1563350 - RNA, 20 nt, Human adenovirus D
agacucauccugcuggugcu

SEQ ID NO: 1563351 - RNA, 21 nt, Human adenovirus D
uaagcaggagcaggaggagga

SEQ ID NO: 1563352 - RNA, 18 nt, Human adenovirus D
uaaauuuaaaaccucauu

SEQ ID NO: 1563353 - RNA, 21 nt, Human adenovirus D
agaugcagcaagccccggacc

SEQ ID NO: 1563354 - RNA, 18 nt, Human adenovirus D
gccagcgcuggguggccg

SEQ ID NO: 1563355 - RNA, 14 nt, Human adenovirus D
gcgcaggaggccau

SEQ ID NO: 1563356 - RNA, 12 nt, Human adenovirus D
gccaggaggaga

SEQ ID NO: 1563357 - RNA, 17 nt, Human adenovirus D
gacgagccaggugagcu

SEQ ID NO: 1563358 - RNA, 20 nt, Human adenovirus D
acacgggguugcagcacugg

SEQ ID NO: 1563359 - RNA, 22 nt, Human adenovirus D
gcacagacccaccccagucaga

SEQ ID NO: 1563360 - RNA, 15 nt, Human adenovirus D
aggaugaacaggagc

SEQ ID NO: 1563361 - RNA, 21 nt, Human adenovirus D
cauguccaccugcggggcgau

SEQ ID NO: 1563362 - RNA, 22 nt, Human adenovirus D
caacccgcguaauuggcccucc

SEQ ID NO: 1563363 - RNA, 22 nt, Human adenovirus D
uacuuuuaaugaagaagcagau

SEQ ID NO: 1563364 - RNA, 14 nt, Human adenovirus D
aucgccgaggagaa

SEQ ID NO: 1563365 - RNA, 12 nt, Human adenovirus D
uuuuuccagccc

SEQ ID NO: 1563366 - RNA, 13 nt, Human adenovirus D
cguccgcggccac

SEQ ID NO: 1563367 - RNA, 15 nt, Human adenovirus D
ggaccaccccaggcg

SEQ ID NO: 1563368 - RNA, 18 nt, Human adenovirus D
ccgcguaagcaggagcag

SEQ ID NO: 1563369 - RNA, 22 nt, Human adenovirus D
cguccgcaguacucgcagcgcu

SEQ ID NO: 1563370 - RNA, 21 nt, Human adenovirus D
cccaggcaaagcucaacccgc

SEQ ID NO: 1563371 - RNA, 18 nt, Human adenovirus D
cauccuggaccaggcggc

SEQ ID NO: 1563372 - RNA, 23 nt, Human adenovirus D
cagaaguaaauuugacacagcag

SEQ ID NO: 1563373 - RNA, 18 nt, Human adenovirus D
gcagccgcguaagcagga

SEQ ID NO: 1563374 - RNA, 17 nt, Human adenovirus D
cucuuuccagcagcagg

SEQ ID NO: 1563375 - RNA, 14 nt, Human adenovirus D
ccuugcagagcagc

SEQ ID NO: 1563376 - RNA, 14 nt, Human adenovirus D
uggcgugcuggaga

SEQ ID NO: 1563377 - RNA, 22 nt, Human adenovirus D
ggauuaucucuacaaauuguug

SEQ ID NO: 1563378 - RNA, 13 nt, Human adenovirus D
ccuggcccugaca

SEQ ID NO: 1563379 - RNA, 18 nt, Human adenovirus D
uggauagcuaugauccag

SEQ ID NO: 1563380 - RNA, 16 nt, Human adenovirus D
caccgagccucccagg

SEQ ID NO: 1563381 - RNA, 18 nt, Human adenovirus D
cgaagauggggccccgcc

SEQ ID NO: 1563382 - RNA, 16 nt, Human adenovirus D
uggaagaggggcagca

SEQ ID NO: 1563383 - RNA, 14 nt, Human adenovirus D
ggcgaacgugccgc

SEQ ID NO: 1563384 - RNA, 15 nt, Human adenovirus D
gugcugccccaggcg

SEQ ID NO: 1563385 - RNA, 15 nt, Human adenovirus D
ggccgcccugaccca

SEQ ID NO: 1563386 - RNA, 19 nt, Human adenovirus D
gugagcggcgaggggcugc

SEQ ID NO: 1563387 - RNA, 18 nt, Human adenovirus D
ucgggaucgccaggccuc

SEQ ID NO: 1563388 - RNA, 18 nt, Human adenovirus D
gcgcccaccaucaccacc

SEQ ID NO: 1563389 - RNA, 18 nt, Human adenovirus D
ggccgcccacgguggugg

SEQ ID NO: 1563390 - RNA, 13 nt, Human adenovirus D
aucacccagcagu

SEQ ID NO: 1563391 - RNA, 20 nt, Human adenovirus D
gaggugccccagagcgaggu

SEQ ID NO: 1563392 - RNA, 19 nt, Human adenovirus D
agaggcggaacugcuggcc

SEQ ID NO: 1563393 - RNA, 16 nt, Human adenovirus D
uaccucuugcagcugg

SEQ ID NO: 1563394 - RNA, 16 nt, Human adenovirus D
gagucgcggcagaacc

SEQ ID NO: 1563395 - RNA, 15 nt, Human adenovirus D
cagaacuggcagagc

SEQ ID NO: 1563396 - RNA, 15 nt, Human adenovirus D
auuuuuuccaagacc

SEQ ID NO: 1563397 - RNA, 12 nt, Human adenovirus D
cgcaccucgcgc

SEQ ID NO: 1563398 - RNA, 13 nt, Human adenovirus D
gcauguucuugca

SEQ ID NO: 1563399 - RNA, 21 nt, Human adenovirus D
gcucaggaccauagggagccu

SEQ ID NO: 1563400 - RNA, 21 nt, Human adenovirus D
uaauucagggugcuccagcca

SEQ ID NO: 1563401 - RNA, 18 nt, Human adenovirus D
ccucgaggacggagaggc

SEQ ID NO: 1563402 - RNA, 17 nt, Human adenovirus D
ggccaugaugcgagccg

SEQ ID NO: 1563403 - RNA, 20 nt, Human adenovirus D
gccgcucgcucguucugccc

SEQ ID NO: 1563404 - RNA, 15 nt, Human adenovirus D
gcgcgguaggcccug

SEQ ID NO: 1563405 - RNA, 23 nt, Human adenovirus D
ucgccuucggcuggaacccgcgc

SEQ ID NO: 1563406 - RNA, 15 nt, Human adenovirus D
ucagguauccagccu

SEQ ID NO: 1563407 - RNA, 14 nt, Human adenovirus D
ccacuuccgcgcuc

SEQ ID NO: 1563408 - RNA, 12 nt, Human adenovirus D
ccacagccagcc

SEQ ID NO: 1563409 - RNA, 17 nt, Human adenovirus D
cuuuaucagcacugcaa

SEQ ID NO: 1563410 - RNA, 18 nt, Human adenovirus D
gcuaccaccccagcaucc

SEQ ID NO: 1563411 - RNA, 19 nt, Human adenovirus D
gguagggggcgccgccggc

SEQ ID NO: 1563412 - RNA, 14 nt, Human adenovirus D
cugagccgccagcu

SEQ ID NO: 1563413 - RNA, 19 nt, Human adenovirus D
gcuguggggcgugcaggcg

SEQ ID NO: 1563414 - RNA, 13 nt, Human adenovirus D
cagccugggcaac

SEQ ID NO: 1563415 - RNA, 20 nt, Human adenovirus D
guguacaacgcccugcugga

SEQ ID NO: 1563416 - RNA, 21 nt, Human adenovirus D
cgcuguccacgagcgccagcu

SEQ ID NO: 1563417 - RNA, 22 nt, Human adenovirus D
cacccucagaagaagaccaccc

SEQ ID NO: 1563418 - RNA, 18 nt, Human adenovirus D
ucacaguuauaccaccuc

SEQ ID NO: 1563419 - RNA, 18 nt, Human adenovirus D
cuugaggaggaacuucag

SEQ ID NO: 1563420 - RNA, 13 nt, Human adenovirus D
guccaggucacag

SEQ ID NO: 1563421 - RNA, 13 nt, Human adenovirus D
guuggugagcucu

SEQ ID NO: 1563422 - RNA, 21 nt, Human adenovirus D
guccacgagcgccagcuguug

SEQ ID NO: 1563423 - RNA, 14 nt, Human adenovirus D
gguggugcagaaca

SEQ ID NO: 1563424 - RNA, 22 nt, Human adenovirus D
ugcuccacucgacccugaaggg

SEQ ID NO: 1563425 - RNA, 17 nt, Human adenovirus D
caagcuggccugcgcca

SEQ ID NO: 1563426 - RNA, 12 nt, Human adenovirus D
gcagccugagcu

SEQ ID NO: 1563427 - RNA, 17 nt, Human adenovirus D
gagauaugugcagcaga

SEQ ID NO: 1563428 - RNA, 16 nt, Human adenovirus D
cuccauccccucgcgc

SEQ ID NO: 1563429 - RNA, 16 nt, Human adenovirus D
ugcuccagccaaagcu

SEQ ID NO: 1563430 - RNA, 22 nt, Human adenovirus D
ggguagaagcaacagauuuaag

SEQ ID NO: 1563431 - RNA, 21 nt, Human adenovirus D
caaucuggcgguaccagggga

SEQ ID NO: 1563432 - RNA, 22 nt, Human adenovirus D
cagagcagcucuucggagccuc

SEQ ID NO: 1563433 - RNA, 16 nt, Human adenovirus D
gggcagacacaccagg

SEQ ID NO: 1563434 - RNA, 16 nt, Human adenovirus D
gcgccuuggaggccgc

SEQ ID NO: 1563435 - RNA, 23 nt, Human adenovirus D
gcacguggcggcggccaaccugg

SEQ ID NO: 1563436 - RNA, 16 nt, Human adenovirus D
acgacucgcugcugca

SEQ ID NO: 1563437 - RNA, 19 nt, Human adenovirus D
caguuauaccaccuccucc

SEQ ID NO: 1563438 - RNA, 15 nt, Human adenovirus D
accaggggguccacc

SEQ ID NO: 1563439 - RNA, 14 nt, Human adenovirus D
accguggggaacuc

SEQ ID NO: 1563440 - RNA, 13 nt, Human adenovirus D
cgcggccgcccac

SEQ ID NO: 1563441 - RNA, 16 nt, Human adenovirus D
uccugcacgcagcagc

SEQ ID NO: 1563442 - RNA, 16 nt, Human adenovirus D
cagccuguacccagag

SEQ ID NO: 1563443 - RNA, 16 nt, Human adenovirus D
uaguuguucagcagca

SEQ ID NO: 1563444 - RNA, 23 nt, Human adenovirus D
agcucagcccgcuuaccaguaga

SEQ ID NO: 1563445 - RNA, 19 nt, Human adenovirus D
aucgcgggcuuuguaacuc

SEQ ID NO: 1563446 - RNA, 18 nt, Human adenovirus D
cuaugagaugccccagca

SEQ ID NO: 1563447 - RNA, 17 nt, Human adenovirus D
ccagaccaagcugcugu

SEQ ID NO: 1563448 - RNA, 12 nt, Human adenovirus D
ucgugcgagggg

SEQ ID NO: 1563449 - RNA, 15 nt, Human adenovirus D
gaccuugcagagcag

SEQ ID NO: 1563450 - RNA, 13 nt, Human adenovirus D
acccguccuccuc

SEQ ID NO: 1563451 - RNA, 16 nt, Human adenovirus D
cacguacuucagccug

SEQ ID NO: 1563452 - RNA, 19 nt, Human adenovirus D
gauggccuccagccuuucc

SEQ ID NO: 1563453 - RNA, 14 nt, Human adenovirus D
gcucuugcagggaa

SEQ ID NO: 1563454 - RNA, 19 nt, Human adenovirus D
cucguagaggcgggugagg

SEQ ID NO: 1563455 - RNA, 17 nt, Human adenovirus D
acaacccgccugccagg

SEQ ID NO: 1563456 - RNA, 18 nt, Human adenovirus D
aacagcaaaagauacaga

SEQ ID NO: 1563457 - RNA, 20 nt, Human adenovirus D
agccaggucaaaacccacuc

SEQ ID NO: 1563458 - RNA, 17 nt, Human adenovirus D
guggacuauccuugcag

SEQ ID NO: 1563459 - RNA, 12 nt, Human adenovirus D
gcuccagccaaa

SEQ ID NO: 1563460 - RNA, 20 nt, Human adenovirus D
gccaugggcguguggcagca

SEQ ID NO: 1563461 - RNA, 21 nt, Human adenovirus D
gggcauuaacgggguggugga

SEQ ID NO: 1563462 - RNA, 16 nt, Human adenovirus D
cuugugguucuucugu

SEQ ID NO: 1563463 - RNA, 21 nt, Human adenovirus D
ugaggcauauaaaaaugcagu

SEQ ID NO: 1563464 - RNA, 23 nt, Human adenovirus D
gcucucucuucuuguaacuuuua

SEQ ID NO: 1563465 - RNA, 18 nt, Human adenovirus D
cuuguuacaugacauggg

SEQ ID NO: 1563466 - RNA, 18 nt, Human adenovirus D
ugcaguccaaccuggacc

SEQ ID NO: 1563467 - RNA, 14 nt, Human adenovirus D
aaaccccgccaaaa

SEQ ID NO: 1563468 - RNA, 22 nt, Human adenovirus D
gcacgagcaagacgcaggccag

SEQ ID NO: 1563469 - RNA, 23 nt, Human adenovirus D
agacggacuugauuggccugucc

SEQ ID NO: 1563470 - RNA, 22 nt, Human adenovirus D
cacccccucgaugaugccgcag

SEQ ID NO: 1563471 - RNA, 14 nt, Human adenovirus D
gggugcgcgacucc

SEQ ID NO: 1563472 - RNA, 20 nt, Human adenovirus D
cauggggcgccgcccgagcu

SEQ ID NO: 1563473 - RNA, 16 nt, Human adenovirus D
uagcagacagggccug

SEQ ID NO: 1563474 - RNA, 21 nt, Human adenovirus D
ccugcgcgagguugagcucca

SEQ ID NO: 1563475 - RNA, 13 nt, Human adenovirus D
uggucggcgccga

SEQ ID NO: 1563476 - RNA, 18 nt, Human adenovirus D
ccaggucgucgccccgga

SEQ ID NO: 1563477 - RNA, 22 nt, Human adenovirus D
acucuccugaaccacacggcca

SEQ ID NO: 1563478 - RNA, 13 nt, Human adenovirus D
ugcaucucccagg

SEQ ID NO: 1563479 - RNA, 22 nt, Human adenovirus D
cuuuaguugguccagauggaaa

SEQ ID NO: 1563480 - RNA, 14 nt, Human adenovirus D
caaggcacccacca

SEQ ID NO: 1563481 - RNA, 17 nt, Human adenovirus D
caucuuugacauggaug

SEQ ID NO: 1563482 - RNA, 13 nt, Human adenovirus D
cgcugaaagcaug

SEQ ID NO: 1563483 - RNA, 15 nt, Human adenovirus D
gucgcuggcugcugg

SEQ ID NO: 1563484 - RNA, 19 nt, Human adenovirus D
gccuucgugcacuggcccg

SEQ ID NO: 1563485 - RNA, 16 nt, Human adenovirus D
gacggucugcaggccg

SEQ ID NO: 1563486 - RNA, 16 nt, Human adenovirus D
aagacguuucuggggu

SEQ ID NO: 1563487 - RNA, 13 nt, Human adenovirus D
cuacauucuggac

SEQ ID NO: 1563488 - RNA, 23 nt, Human adenovirus D
acgccuuccuggcgacgcagccg

SEQ ID NO: 1563489 - RNA, 18 nt, Human adenovirus D
gcacucauccaugaugau

SEQ ID NO: 1563490 - RNA, 19 nt, Human adenovirus D
ucuggacuucgcagccaug

SEQ ID NO: 1563491 - RNA, 13 nt, Human adenovirus D
agagcacagcagu

SEQ ID NO: 1563492 - RNA, 23 nt, Human adenovirus D
gaugaacaacgccaucuuggaaa

SEQ ID NO: 1563493 - RNA, 18 nt, Human adenovirus D
accacagcaacuuccuga

SEQ ID NO: 1563494 - RNA, 14 nt, Human adenovirus D
gcagugggcgcaga

SEQ ID NO: 1563495 - RNA, 15 nt, Human adenovirus D
gccgucuggacccgc

SEQ ID NO: 1563496 - RNA, 12 nt, Human adenovirus D
cagcgugguggc

SEQ ID NO: 1563497 - RNA, 16 nt, Human adenovirus D
guggucagcgaugagc

SEQ ID NO: 1563498 - RNA, 14 nt, Human adenovirus D
cuuuaucugcuggg

SEQ ID NO: 1563499 - RNA, 16 nt, Human adenovirus D
aguuguaaugaucaaa

SEQ ID NO: 1563500 - RNA, 14 nt, Human adenovirus D
gcguccgcuccgca

SEQ ID NO: 1563501 - RNA, 23 nt, Human adenovirus D
ccaguagacaaagagcacagcag

SEQ ID NO: 1563502 - RNA, 18 nt, Human adenovirus D
gagggcuacaaggaccgc

SEQ ID NO: 1563503 - RNA, 17 nt, Human adenovirus D
gccagcaaacgccgccg

SEQ ID NO: 1563504 - RNA, 11 nt, Human adenovirus D
ucuucugccug

SEQ ID NO: 1563505 - RNA, 23 nt, Human adenovirus D
uagaugggcuccgagaagaugcc

SEQ ID NO: 1563506 - RNA, 12 nt, Human adenovirus D
cgcuguggagcc

SEQ ID NO: 1563507 - RNA, 21 nt, Human adenovirus D
ggaacgagaagaacgcacaga

SEQ ID NO: 1563508 - RNA, 18 nt, Human adenovirus D
cuugaaagggaugucaaa

SEQ ID NO: 1563509 - RNA, 16 nt, Human adenovirus D
aguggaagaagagcag

SEQ ID NO: 1563510 - RNA, 22 nt, Human adenovirus D
agcccugagccgccagcuggcc

SEQ ID NO: 1563511 - RNA, 13 nt, Human adenovirus D
ccagaccaccugg

SEQ ID NO: 1563512 - RNA, 22 nt, Human adenovirus D
gccccaggcggugcugcugccg

SEQ ID NO: 1563513 - RNA, 14 nt, Human adenovirus D
accgcggucccagu

SEQ ID NO: 1563514 - RNA, 22 nt, Human adenovirus D
gagcuuaacuuguaugugccuu

SEQ ID NO: 1563515 - RNA, 23 nt, Human adenovirus D
guagaagcaacagauuuaagcaa

SEQ ID NO: 1563516 - RNA, 21 nt, Human adenovirus D
cagcucaucgacuggugcugc

SEQ ID NO: 1563517 - RNA, 15 nt, Human adenovirus D
cgccgcaccauccgc

SEQ ID NO: 1563518 - RNA, 21 nt, Human adenovirus D
acccaaaaccuaccacuggcu

SEQ ID NO: 1563519 - RNA, 22 nt, Human adenovirus D
ccagacgggcgaagugcucaac

SEQ ID NO: 1563520 - RNA, 22 nt, Human adenovirus D
gugcugacauccauggccaggg

SEQ ID NO: 1563521 - RNA, 13 nt, Human adenovirus D
ugagagcgcuggc

SEQ ID NO: 1563522 - RNA, 22 nt, Human adenovirus D
uaaagugcaagucacgcaggug

SEQ ID NO: 1563523 - RNA, 17 nt, Human adenovirus D
aggcggacaagcuaaau

SEQ ID NO: 1563524 - RNA, 23 nt, Human adenovirus D
ugucuccuccgauggauucaaaa

SEQ ID NO: 1563525 - RNA, 19 nt, Human adenovirus D
gccgccgaagggcgagaag

SEQ ID NO: 1563526 - RNA, 17 nt, Human adenovirus D
acaacagccgcaggcca

SEQ ID NO: 1563527 - RNA, 22 nt, Human adenovirus D
gguggauuuuuuccaagacccg

SEQ ID NO: 1563528 - RNA, 21 nt, Human adenovirus D
ucgacggggaaggcuacaacg

SEQ ID NO: 1563529 - RNA, 17 nt, Human adenovirus D
ggcggcgcugcaaagcc

SEQ ID NO: 1563530 - RNA, 18 nt, Human adenovirus D
accuuggcuuugcugggu

SEQ ID NO: 1563531 - RNA, 22 nt, Human adenovirus D
uugagagagaggaaggaggaca

SEQ ID NO: 1563532 - RNA, 13 nt, Human adenovirus D
gcuccucucgugc

SEQ ID NO: 1563533 - RNA, 15 nt, Human adenovirus D
agcaagccccggacc

SEQ ID NO: 1563534 - RNA, 14 nt, Human adenovirus D
uggucaucacccuc

SEQ ID NO: 1563535 - RNA, 14 nt, Human adenovirus D
agccagccacagcc

SEQ ID NO: 1563536 - RNA, 21 nt, Human adenovirus D
ccgccgcuaucugcucuucca

SEQ ID NO: 1563537 - RNA, 23 nt, Human adenovirus D
ugcacaguagucaucaaaugcga

SEQ ID NO: 1563538 - RNA, 15 nt, Human adenovirus D
gccaugccccaggcc

SEQ ID NO: 1563539 - RNA, 18 nt, Human adenovirus D
uguacuccuucuuccgca

SEQ ID NO: 1563540 - RNA, 20 nt, Human adenovirus D
gacuuggaugaggaagagga

SEQ ID NO: 1563541 - RNA, 12 nt, Human adenovirus D
uccuuucgcugc

SEQ ID NO: 1563542 - RNA, 17 nt, Human adenovirus D
ccagccguaccagugca

SEQ ID NO: 1563543 - RNA, 17 nt, Human adenovirus D
caccgccacccgccgcc

SEQ ID NO: 1563544 - RNA, 19 nt, Human adenovirus D
uccacugcuccugcgaaag

SEQ ID NO: 1563545 - RNA, 16 nt, Human adenovirus D
gaccagggguccccga

SEQ ID NO: 1563546 - RNA, 17 nt, Human adenovirus D
ucgcgaaccaggcagug

SEQ ID NO: 1563547 - RNA, 12 nt, Human adenovirus D
cguggcgcagcg

SEQ ID NO: 1563548 - RNA, 19 nt, Human adenovirus D
cgguaccuucgagcugcaa

SEQ ID NO: 1563549 - RNA, 20 nt, Human adenovirus D
ggagaucacuagcgugagcc

SEQ ID NO: 1563550 - RNA, 20 nt, Human adenovirus D
cagcagcacaugguaaucca

SEQ ID NO: 1563551 - RNA, 23 nt, Human adenovirus D
augcuggccgugguccuggucac

SEQ ID NO: 1563552 - RNA, 14 nt, Human adenovirus D
cugcagcgccaguc

SEQ ID NO: 1563553 - RNA, 20 nt, Human adenovirus D
ucugccauguucucacagua

SEQ ID NO: 1563554 - RNA, 15 nt, Human adenovirus D
caacuuccccuaccc

SEQ ID NO: 1563555 - RNA, 15 nt, Human adenovirus D
gacacaccuggaggc

SEQ ID NO: 1563556 - RNA, 16 nt, Human adenovirus D
gagauaugugcagcag

SEQ ID NO: 1563557 - RNA, 18 nt, Human adenovirus D
ucaauaagguucugcccu

SEQ ID NO: 1563558 - RNA, 22 nt, Human adenovirus D
cauccagaauucaaccacaccu

SEQ ID NO: 1563559 - RNA, 14 nt, Human adenovirus D
acaugcccagcagc

SEQ ID NO: 1563560 - RNA, 17 nt, Human adenovirus D
cucguacccgcucacca

SEQ ID NO: 1563561 - RNA, 14 nt, Human adenovirus D
ccuuuaucagcacu

SEQ ID NO: 1563562 - RNA, 17 nt, Human adenovirus D
acgaugugaccacggac

SEQ ID NO: 1563563 - RNA, 21 nt, Human adenovirus D
ccacaggaugaacaggagcac

SEQ ID NO: 1563564 - RNA, 16 nt, Human adenovirus D
ggacgggcgcccagug

SEQ ID NO: 1563565 - RNA, 24 nt, Human adenovirus D
gacggcguaguugcgcaggcgcug

SEQ ID NO: 1563566 - RNA, 21 nt, Human adenovirus D
gguagcaccacugcauggccu

SEQ ID NO: 1563567 - RNA, 21 nt, Human adenovirus D
cuugauuuuuccagcccaggg

SEQ ID NO: 1563568 - RNA, 17 nt, Human adenovirus D
cuccucgcucuggggcc

SEQ ID NO: 1563569 - RNA, 17 nt, Human adenovirus D
gggugagccggccgcgc

SEQ ID NO: 1563570 - RNA, 14 nt, Human adenovirus D
cagcaggugcugcc

SEQ ID NO: 1563571 - RNA, 16 nt, Human adenovirus D
ggcgaagggcuggcga

SEQ ID NO: 1563572 - RNA, 12 nt, Human adenovirus D
ccgccgccgccg

SEQ ID NO: 1563573 - RNA, 23 nt, Human adenovirus D
ucaccauguuauucagcagccca

SEQ ID NO: 1563574 - RNA, 22 nt, Human adenovirus D
cggucaccgagccucccaggag

SEQ ID NO: 1563575 - RNA, 22 nt, Human adenovirus D
gcugcacgagcgccaggucggc

SEQ ID NO: 1563576 - RNA, 21 nt, Human adenovirus D
ccugaaccacacggccagcag

SEQ ID NO: 1563577 - RNA, 23 nt, Human adenovirus D
gugauccguaucgugcugcucuc

SEQ ID NO: 1563578 - RNA, 16 nt, Human adenovirus D
cuggccagcacgcucu

SEQ ID NO: 1563579 - RNA, 15 nt, Human adenovirus D
gaccugccuccacca

SEQ ID NO: 1563580 - RNA, 16 nt, Human adenovirus D
gcuggcugcuggagcu

SEQ ID NO: 1563581 - RNA, 20 nt, Human adenovirus D
gcccgucgccgcaccugucc

SEQ ID NO: 1563582 - RNA, 20 nt, Human adenovirus D
cuucaacaucugugcugccu

SEQ ID NO: 1563583 - RNA, 24 nt, Human adenovirus D
augcacccguaaaugacucuccug

SEQ ID NO: 1563584 - RNA, 19 nt, Human adenovirus D
caccuuggcuuugcugggu

SEQ ID NO: 1563585 - RNA, 16 nt, Human adenovirus D
aggcccuggagcagcg

SEQ ID NO: 1563586 - RNA, 14 nt, Human adenovirus D
cuuuccauggccuc

SEQ ID NO: 1563587 - RNA, 20 nt, Human adenovirus D
guugaugaccugggcggcga

SEQ ID NO: 1563588 - RNA, 24 nt, Human adenovirus D
agguggacgagggggcaguagagu

SEQ ID NO: 1563589 - RNA, 24 nt, Human adenovirus D
gacggacuugauuggccuguccug

SEQ ID NO: 1563590 - RNA, 20 nt, Human adenovirus D
uuccugucuucuuccggcaa

SEQ ID NO: 1563591 - RNA, 23 nt, Human adenovirus D
augcaggauaaauauggccugga

SEQ ID NO: 1563592 - RNA, 12 nt, Human adenovirus D
acaguacuggca

SEQ ID NO: 1563593 - RNA, 20 nt, Human adenovirus D
cgggaccgaguucagcucca

SEQ ID NO: 1563594 - RNA, 20 nt, Human adenovirus D
guuccggccccgcgggcagg

SEQ ID NO: 1563595 - RNA, 16 nt, Human adenovirus D
gccuuuaucagcacug

SEQ ID NO: 1563596 - RNA, 17 nt, Human adenovirus D
cgccaggaggcggugcg

SEQ ID NO: 1563597 - RNA, 13 nt, Human adenovirus D
ggggacgugagcg

SEQ ID NO: 1563598 - RNA, 19 nt, Human adenovirus D
cgacuucaugagccagagc

SEQ ID NO: 1563599 - RNA, 16 nt, Human adenovirus D
agacucauccugcugg

SEQ ID NO: 1563600 - RNA, 13 nt, Human adenovirus D
uggcggaggccau

SEQ ID NO: 1563601 - RNA, 19 nt, Human adenovirus D
cugcgcgagguugagcucc

SEQ ID NO: 1563602 - RNA, 15 nt, Human adenovirus D
ccauccccauccagu

SEQ ID NO: 1563603 - RNA, 12 nt, Human adenovirus D
cucuuggagcag

SEQ ID NO: 1563604 - RNA, 17 nt, Human adenovirus D
acugccaccgccgccgc

SEQ ID NO: 1563605 - RNA, 22 nt, Human adenovirus D
gguagcggucguuguccaccag

SEQ ID NO: 1563606 - RNA, 15 nt, Human adenovirus D
caccugcaccugcgu

SEQ ID NO: 1563607 - RNA, 14 nt, Human adenovirus D
uucuguacuuuguc

SEQ ID NO: 1563608 - RNA, 11 nt, Human adenovirus D
gccacucccag

SEQ ID NO: 1563609 - RNA, 20 nt, Human adenovirus D
cgcggcgggggcggagagcg

SEQ ID NO: 1563610 - RNA, 16 nt, Human adenovirus D
gcuggaugugcccaag

SEQ ID NO: 1563611 - RNA, 12 nt, Human adenovirus D
augagcugcgag

SEQ ID NO: 1563612 - RNA, 19 nt, Human adenovirus D
gcauguacaacaugcugac

SEQ ID NO: 1563613 - RNA, 17 nt, Human adenovirus D
uuguugagggaggaaag

SEQ ID NO: 1563614 - RNA, 17 nt, Human adenovirus D
gggcucgcugguggcgc

SEQ ID NO: 1563615 - RNA, 17 nt, Human adenovirus D
cuagagugccacugccg

SEQ ID NO: 1563616 - RNA, 20 nt, Human adenovirus D
gcagacacauguccccuucc

SEQ ID NO: 1563617 - RNA, 18 nt, Human adenovirus D
accugcaccugcgucugc

SEQ ID NO: 1563618 - RNA, 20 nt, Human adenovirus D
uaccugggaggagaggagga

SEQ ID NO: 1563619 - RNA, 17 nt, Human adenovirus D
cugcagggagccagggg

SEQ ID NO: 1563620 - RNA, 14 nt, Human adenovirus D
gcgcgggcaggaug

SEQ ID NO: 1563621 - RNA, 22 nt, Human adenovirus D
acuccuacaaguacacgccggc

SEQ ID NO: 1563622 - RNA, 20 nt, Human adenovirus D
cgacugucuagggccuuucc

SEQ ID NO: 1563623 - RNA, 21 nt, Human adenovirus D
uuauaucuauugcuagcccuu

SEQ ID NO: 1563624 - RNA, 14 nt, Human adenovirus D
uacuuuucugguug

SEQ ID NO: 1563625 - RNA, 17 nt, Human adenovirus D
cacuggcuuccgccgcc

SEQ ID NO: 1563626 - RNA, 15 nt, Human adenovirus D
cacagugcccccucc

SEQ ID NO: 1563627 - RNA, 23 nt, Human adenovirus D
cgcuccgugcgaggaugagagcc

SEQ ID NO: 1563628 - RNA, 17 nt, Human adenovirus D
cguguccacgcauugca

SEQ ID NO: 1563629 - RNA, 21 nt, Human adenovirus D
cuuugacacaccuggaggcac

SEQ ID NO: 1563630 - RNA, 16 nt, Human adenovirus D
aaaccuaccacuggcu

SEQ ID NO: 1563631 - RNA, 21 nt, Human adenovirus D
gcuucccauugaauggcacug

SEQ ID NO: 1563632 - RNA, 16 nt, Human adenovirus D
cuucaaccccuucucg

SEQ ID NO: 1563633 - RNA, 19 nt, Human adenovirus D
gcgcugggcguggugcugg

SEQ ID NO: 1563634 - RNA, 22 nt, Human adenovirus D
ggagcaggguaaagccagcagc

SEQ ID NO: 1563635 - RNA, 13 nt, Human adenovirus D
uugaagauucugg

SEQ ID NO: 1563636 - RNA, 21 nt, Human adenovirus D
acggcaucucgauccagcaga

SEQ ID NO: 1563637 - RNA, 19 nt, Human adenovirus D
gaugucaucacuggcggag

SEQ ID NO: 1563638 - RNA, 21 nt, Human adenovirus D
ucaggcagcggggacagagaa

SEQ ID NO: 1563639 - RNA, 19 nt, Human adenovirus D
gcucggcgaggauggccug

SEQ ID NO: 1563640 - RNA, 14 nt, Human adenovirus D
ggccagcacgcucu

SEQ ID NO: 1563641 - RNA, 15 nt, Human adenovirus D
gcaaaaauaaaucau

SEQ ID NO: 1563642 - RNA, 17 nt, Human adenovirus D
uggaagcccugagccgc

SEQ ID NO: 1563643 - RNA, 22 nt, Human adenovirus D
agauccugagauacgaugagac

SEQ ID NO: 1563644 - RNA, 22 nt, Human adenovirus D
augcggagccgcucggccaugc

SEQ ID NO: 1563645 - RNA, 18 nt, Human adenovirus D
ggccguagcaggcgccgg

SEQ ID NO: 1563646 - RNA, 19 nt, Human adenovirus D
gcugcccgacuucaugagc

SEQ ID NO: 1563647 - RNA, 23 nt, Human adenovirus D
ccguggcuucgagcaguggcucu

SEQ ID NO: 1563648 - RNA, 12 nt, Human adenovirus D
agccuacccaaa

SEQ ID NO: 1563649 - RNA, 19 nt, Human adenovirus D
gaagggguucucgcgcuca

SEQ ID NO: 1563650 - RNA, 20 nt, Human adenovirus D
uccaggucuggcacaucuuu

SEQ ID NO: 1563651 - RNA, 16 nt, Human adenovirus D
ggaaagacgguggugc

SEQ ID NO: 1563652 - RNA, 21 nt, Human adenovirus D
uuucgugacuugacuuccggg

SEQ ID NO: 1563653 - RNA, 17 nt, Human adenovirus D
cggccgaggaggagcgc

SEQ ID NO: 1563654 - RNA, 23 nt, Human adenovirus D
uggcggaggcggagucuuccaug

SEQ ID NO: 1563655 - RNA, 13 nt, Human adenovirus D
gcacugccggugc

SEQ ID NO: 1563656 - RNA, 22 nt, Human adenovirus D
gacgcugaaaggcgggcugccc

SEQ ID NO: 1563657 - RNA, 12 nt, Human adenovirus D
ggagggcagaaa

SEQ ID NO: 1563658 - RNA, 12 nt, Human adenovirus D
agcggggccugg

SEQ ID NO: 1563659 - RNA, 16 nt, Human adenovirus D
cguacgugccugcgca

SEQ ID NO: 1563660 - RNA, 13 nt, Human adenovirus D
caauggaaaucac

SEQ ID NO: 1563661 - RNA, 21 nt, Human adenovirus D
gcaacucguaccugggucacc

SEQ ID NO: 1563662 - RNA, 19 nt, Human adenovirus D
acuuccgcguaccugcgca

SEQ ID NO: 1563663 - RNA, 15 nt, Human adenovirus D
gaagugcucaacccg

SEQ ID NO: 1563664 - RNA, 21 nt, Human adenovirus D
cacucacuuuuaggugaagca

SEQ ID NO: 1563665 - RNA, 14 nt, Human adenovirus D
aggggcggacccca

SEQ ID NO: 1563666 - RNA, 15 nt, Human adenovirus D
gcguccgucagcagc

SEQ ID NO: 1563667 - RNA, 14 nt, Human adenovirus D
uggcgacccaggaa

SEQ ID NO: 1563668 - RNA, 13 nt, Human adenovirus D
uagagcggccagc

SEQ ID NO: 1563669 - RNA, 13 nt, Human adenovirus D
ccgcgaggccaua

SEQ ID NO: 1563670 - RNA, 20 nt, Human adenovirus D
ccgcgcgccgcgccgccacu

SEQ ID NO: 1563671 - RNA, 15 nt, Human adenovirus D
ugggcguguggcagc

SEQ ID NO: 1563672 - RNA, 23 nt, Human adenovirus D
ugugcaaugucaggucugcuggu

SEQ ID NO: 1563673 - RNA, 21 nt, Human adenovirus D
ccaggugagcucgggcugcuc

SEQ ID NO: 1563674 - RNA, 18 nt, Human adenovirus D
ccugcaagugcacagacc

SEQ ID NO: 1563675 - RNA, 18 nt, Human adenovirus D
gccgccggcggcgggcca

SEQ ID NO: 1563676 - RNA, 18 nt, Human adenovirus D
ugcgagccgcgcgccgcg

SEQ ID NO: 1563677 - RNA, 19 nt, Human adenovirus D
ccaugcagaucauggugcc

SEQ ID NO: 1563678 - RNA, 22 nt, Human adenovirus D
auuacucgcaaaaauaaaucau

SEQ ID NO: 1563679 - RNA, 12 nt, Human adenovirus D
cgauccagcaga

SEQ ID NO: 1563680 - RNA, 14 nt, Human adenovirus D
ggucccgguguugc

SEQ ID NO: 1563681 - RNA, 14 nt, Human adenovirus D
cagcgagaggagcu

SEQ ID NO: 1563682 - RNA, 19 nt, Human adenovirus D
gugggaccuggcggaggcc

SEQ ID NO: 1563683 - RNA, 14 nt, Human adenovirus D
gugggcguggggca

SEQ ID NO: 1563684 - RNA, 13 nt, Human adenovirus D
uucugccagcaga

SEQ ID NO: 1563685 - RNA, 19 nt, Human adenovirus D
agcggugguaggccccugu

SEQ ID NO: 1563686 - RNA, 17 nt, Human adenovirus D
cccugagcucgcgccuc

SEQ ID NO: 1563687 - RNA, 17 nt, Human adenovirus D
cgcggcgaaacgcucug

SEQ ID NO: 1563688 - RNA, 18 nt, Human adenovirus D
ccgcaggaguccaccgcu

SEQ ID NO: 1563689 - RNA, 18 nt, Human adenovirus D
augagaugccccagcaga

SEQ ID NO: 1563690 - RNA, 19 nt, Human adenovirus D
ucugcccaccgugcgcuac

SEQ ID NO: 1563691 - RNA, 23 nt, Human adenovirus D
uccugccugggaauccugcacga

SEQ ID NO: 1563692 - RNA, 15 nt, Human adenovirus D
gcaucagucuccugg

SEQ ID NO: 1563693 - RNA, 16 nt, Human adenovirus D
ugaaauugcgggugau

SEQ ID NO: 1563694 - RNA, 18 nt, Human adenovirus D
cgcgcccguagucuggag

SEQ ID NO: 1563695 - RNA, 16 nt, Human adenovirus D
ugccgucgucccggag

SEQ ID NO: 1563696 - RNA, 23 nt, Human adenovirus D
ugggguacuuuacgcuggccagc

SEQ ID NO: 1563697 - RNA, 21 nt, Human adenovirus D
gccucggcggcguggcccuug

SEQ ID NO: 1563698 - RNA, 18 nt, Human adenovirus D
gucgcggacgcgcucccg

SEQ ID NO: 1563699 - RNA, 15 nt, Human adenovirus D
uaaaggcgggugucu

SEQ ID NO: 1563700 - RNA, 20 nt, Human adenovirus D
gccagcgucauguccuucca

SEQ ID NO: 1563701 - RNA, 16 nt, Human adenovirus D
guggacuucacagaga

SEQ ID NO: 1563702 - RNA, 18 nt, Human adenovirus D
caggugaugccggcagcg

SEQ ID NO: 1563703 - RNA, 21 nt, Human adenovirus D
gaccucggaguaccugagccg

SEQ ID NO: 1563704 - RNA, 17 nt, Human adenovirus D
ggccggcaugcccacca

SEQ ID NO: 1563705 - RNA, 22 nt, Human adenovirus D
ccccucgaaucaggcuggagcc

SEQ ID NO: 1563706 - RNA, 14 nt, Human adenovirus D
cacaguagucauca

SEQ ID NO: 1563707 - RNA, 18 nt, Human adenovirus D
acgaggauuucgagccga

SEQ ID NO: 1563708 - RNA, 23 nt, Human adenovirus D
acccggacguggugcugcugccg

SEQ ID NO: 1563709 - RNA, 16 nt, Human adenovirus D
uuuuaaugaagaagca

SEQ ID NO: 1563710 - RNA, 21 nt, Human adenovirus D
gcgcagguggacgagcagacc

SEQ ID NO: 1563711 - RNA, 13 nt, Human adenovirus D
aaaagaaacaagu

SEQ ID NO: 1563712 - RNA, 13 nt, Human adenovirus D
auuaugcuccugg

SEQ ID NO: 1563713 - RNA, 23 nt, Human adenovirus D
cacccgguacuacgccagccgca

SEQ ID NO: 1563714 - RNA, 15 nt, Human adenovirus D
cagggagccagggga

SEQ ID NO: 1563715 - RNA, 17 nt, Human adenovirus D
cgagcuggaagcccuga

SEQ ID NO: 1563716 - RNA, 22 nt, Human adenovirus D
aggccgccuacgguccagagga

SEQ ID NO: 1563717 - RNA, 21 nt, Human adenovirus D
ccucugccguccgcccgcgcc

SEQ ID NO: 1563718 - RNA, 13 nt, Human adenovirus D
cgcguccgcggcc

SEQ ID NO: 1563719 - RNA, 19 nt, Human adenovirus D
ccuggugauacgaggcaga

SEQ ID NO: 1563720 - RNA, 20 nt, Human adenovirus D
gcucgucuuccaggagccug

SEQ ID NO: 1563721 - RNA, 21 nt, Human adenovirus D
acucccgucucgacccgagcc

SEQ ID NO: 1563722 - RNA, 18 nt, Human adenovirus D
uccagcagagucugccgc

SEQ ID NO: 1563723 - RNA, 13 nt, Human adenovirus D
aaaauacagaugg

SEQ ID NO: 1563724 - RNA, 18 nt, Human adenovirus D
ucggaguaccugagccgc

SEQ ID NO: 1563725 - RNA, 20 nt, Human adenovirus D
cggcgacgacgacauccugg

SEQ ID NO: 1563726 - RNA, 14 nt, Human adenovirus D
gcacgauccugacg

SEQ ID NO: 1563727 - RNA, 19 nt, Human adenovirus D
agcgcgccgacccguggcc

SEQ ID NO: 1563728 - RNA, 11 nt, Human adenovirus D
ucgcugcugcc

SEQ ID NO: 1563729 - RNA, 19 nt, Human adenovirus D
gaaccuuuggaccugagcu

SEQ ID NO: 1563730 - RNA, 19 nt, Human adenovirus D
gcagaguacucauaaagaa

SEQ ID NO: 1563731 - RNA, 23 nt, Human adenovirus D
cuggaguuucacccgucugaaaa

SEQ ID NO: 1563732 - RNA, 17 nt, Human adenovirus D
cuucgaguacgaggcca

SEQ ID NO: 1563733 - RNA, 22 nt, Human adenovirus D
acgagcaagacgcaggccagga

SEQ ID NO: 1563734 - RNA, 15 nt, Human adenovirus D
cagcaacccuuccug

SEQ ID NO: 1563735 - RNA, 17 nt, Human adenovirus D
ggaacucgcggacgcgg

SEQ ID NO: 1563736 - RNA, 11 nt, Human adenovirus D
ucaugcaagac

SEQ ID NO: 1563737 - RNA, 22 nt, Human adenovirus D
caguauccgcggaguccagcga

SEQ ID NO: 1563738 - RNA, 18 nt, Human adenovirus D
agaagugacaauuuaacu

SEQ ID NO: 1563739 - RNA, 19 nt, Human adenovirus D
gggccuacgagcucaaccu

SEQ ID NO: 1563740 - RNA, 19 nt, Human adenovirus D
ccugagcaaccuccugggc

SEQ ID NO: 1563741 - RNA, 20 nt, Human adenovirus D
uaccccaucccggccaaggc

SEQ ID NO: 1563742 - RNA, 20 nt, Human adenovirus D
ccagacgcaagagccggcgg

SEQ ID NO: 1563743 - RNA, 12 nt, Human adenovirus D
ugaagcgccgcc

SEQ ID NO: 1563744 - RNA, 18 nt, Human adenovirus D
ccgcccgagcucugcugc

SEQ ID NO: 1563745 - RNA, 21 nt, Human adenovirus D
agcacaaacgugcaguccaac

SEQ ID NO: 1563746 - RNA, 13 nt, Human adenovirus D
aagcugggcuggg

SEQ ID NO: 1563747 - RNA, 12 nt, Human adenovirus D
cacgugaccagg

SEQ ID NO: 1563748 - RNA, 19 nt, Human adenovirus D
cucgcaguccgccaagcuc

SEQ ID NO: 1563749 - RNA, 16 nt, Human adenovirus D
gggaccggcggggccu

SEQ ID NO: 1563750 - RNA, 18 nt, Human adenovirus D
ugcaagucacgcagguga

SEQ ID NO: 1563751 - RNA, 22 nt, Human adenovirus D
aacaggagccgcuaguggaaga

SEQ ID NO: 1563752 - RNA, 14 nt, Human adenovirus D
cgaggggcuccucu

SEQ ID NO: 1563753 - RNA, 13 nt, Human adenovirus D
cgccaacagcagc

SEQ ID NO: 1563754 - RNA, 18 nt, Human adenovirus D
uguaagugugacaaucaa

SEQ ID NO: 1563755 - RNA, 14 nt, Human adenovirus D
agguggcuauuuuc

SEQ ID NO: 1563756 - RNA, 16 nt, Human adenovirus D
gaauaucagacaugcu

SEQ ID NO: 1563757 - RNA, 13 nt, Human adenovirus D
gcagagagauggc

SEQ ID NO: 1563758 - RNA, 13 nt, Human adenovirus D
aaacaggcugucg

SEQ ID NO: 1563759 - RNA, 17 nt, Human adenovirus D
ugacaaauggagccaga

SEQ ID NO: 1563760 - RNA, 23 nt, Human adenovirus D
caccaggacgguguagcccgugc

SEQ ID NO: 1563761 - RNA, 14 nt, Human adenovirus D
gggcacuggagcac

SEQ ID NO: 1563762 - RNA, 12 nt, Human adenovirus D
ucguucugccca

SEQ ID NO: 1563763 - RNA, 22 nt, Human adenovirus D
gacagagauggacuuggaagag

SEQ ID NO: 1563764 - RNA, 19 nt, Human adenovirus D
ucaccuuggcuuugcuggg

SEQ ID NO: 1563765 - RNA, 20 nt, Human adenovirus D
ugagguuggcgauguugcca

SEQ ID NO: 1563766 - RNA, 23 nt, Human adenovirus D
ccuguauauuuuuagaauggaag

SEQ ID NO: 1563767 - RNA, 13 nt, Human adenovirus D
ugaaacaccugca

SEQ ID NO: 1563768 - RNA, 14 nt, Human adenovirus D
ccacaggugcugcc

SEQ ID NO: 1563769 - RNA, 21 nt, Human adenovirus D
cggggugaacaucccccgcaa

SEQ ID NO: 1563770 - RNA, 12 nt, Human adenovirus D
cccgcaggcagg

SEQ ID NO: 1563771 - RNA, 16 nt, Human adenovirus D
ccggccccgcgggcag

SEQ ID NO: 1563772 - RNA, 19 nt, Human adenovirus D
ggaacaccaucagacuggg

SEQ ID NO: 1563773 - RNA, 23 nt, Human adenovirus D
augaaaaagcugaggauggcaaa

SEQ ID NO: 1563774 - RNA, 16 nt, Human adenovirus D
ucaagcugggcuggga

SEQ ID NO: 1563775 - RNA, 15 nt, Human adenovirus D
aggacaugcagcugc

SEQ ID NO: 1563776 - RNA, 21 nt, Human adenovirus D
gugguggcgacgcggcggcga

SEQ ID NO: 1563777 - RNA, 16 nt, Human adenovirus D
gaagacuauaaaguca

SEQ ID NO: 1563778 - RNA, 14 nt, Human adenovirus D
ccacgguggugcag

SEQ ID NO: 1563779 - RNA, 13 nt, Human adenovirus D
agcguccgcuccg

SEQ ID NO: 1563780 - RNA, 12 nt, Human adenovirus D
cuccguagccug

SEQ ID NO: 1563781 - RNA, 14 nt, Human adenovirus D
acagaacaaaaaca

SEQ ID NO: 1563782 - RNA, 22 nt, Human adenovirus D
gagagguugaaaaggcagcuga

SEQ ID NO: 1563783 - RNA, 17 nt, Human adenovirus D
accgcugucucagccuc

SEQ ID NO: 1563784 - RNA, 14 nt, Human adenovirus D
gcgcagcggcagga

SEQ ID NO: 1563785 - RNA, 14 nt, Human adenovirus D
ucaacugcagaccg

SEQ ID NO: 1563786 - RNA, 22 nt, Human adenovirus D
gcucgaucuccuccuccuggag

SEQ ID NO: 1563787 - RNA, 11 nt, Human adenovirus D
uaugccagacg

SEQ ID NO: 1563788 - RNA, 20 nt, Human adenovirus D
cugcugccgcucagucaucc

SEQ ID NO: 1563789 - RNA, 19 nt, Human adenovirus D
ccaggguugagucgcggca

SEQ ID NO: 1563790 - RNA, 19 nt, Human adenovirus D
caagaacgagggccugggc

SEQ ID NO: 1563791 - RNA, 23 nt, Human adenovirus D
accccuuuggguucucggaccgc

SEQ ID NO: 1563792 - RNA, 13 nt, Human adenovirus D
ucugccagcagaa

SEQ ID NO: 1563793 - RNA, 15 nt, Human adenovirus D
cugaacgggggcgcc

SEQ ID NO: 1563794 - RNA, 20 nt, Human adenovirus D
uggagacgcccuugugcccg

SEQ ID NO: 1563795 - RNA, 17 nt, Human adenovirus D
uaauucucaaaguguga

SEQ ID NO: 1563796 - RNA, 15 nt, Human adenovirus D
gcgccgccggcggcg

SEQ ID NO: 1563797 - RNA, 22 nt, Human adenovirus D
uguuauugagcccaucaagcaa

SEQ ID NO: 1563798 - RNA, 19 nt, Human adenovirus D
caggggaugaacaguggca

SEQ ID NO: 1563799 - RNA, 18 nt, Human adenovirus D
guuugagaauaacaugcu

SEQ ID NO: 1563800 - RNA, 23 nt, Human adenovirus D
ggcgcacaacaccgccuccaccc

SEQ ID NO: 1563801 - RNA, 16 nt, Human adenovirus D
auaccauugcaaggca

SEQ ID NO: 1563802 - RNA, 15 nt, Human adenovirus D
ccacugcauggccuc

SEQ ID NO: 1563803 - RNA, 23 nt, Human adenovirus D
gagcgaggugugcgucagggcga

SEQ ID NO: 1563804 - RNA, 16 nt, Human adenovirus D
gagccgccagcuggcc

SEQ ID NO: 1563805 - RNA, 15 nt, Human adenovirus D
gcuggcgcgcacgua

SEQ ID NO: 1563806 - RNA, 16 nt, Human adenovirus D
gaacgcgcgaagaugg

SEQ ID NO: 1563807 - RNA, 13 nt, Human adenovirus D
ccgugcgcaccac

SEQ ID NO: 1563808 - RNA, 16 nt, Human adenovirus D
gcaccagccgcaccgc

SEQ ID NO: 1563809 - RNA, 15 nt, Human adenovirus D
ugcccgccaccugca

SEQ ID NO: 1563810 - RNA, 17 nt, Human adenovirus D
caguaggaaccagcaca

SEQ ID NO: 1563811 - RNA, 22 nt, Human adenovirus D
cgccuggggcagacagugcucc

SEQ ID NO: 1563812 - RNA, 17 nt, Human adenovirus D
cgggcuguggggcgugc

SEQ ID NO: 1563813 - RNA, 14 nt, Human adenovirus D
caauaccgggauga

SEQ ID NO: 1563814 - RNA, 14 nt, Human adenovirus D
cugcaaccugugcu

SEQ ID NO: 1563815 - RNA, 16 nt, Human adenovirus D
agcaggaccugggcuu

SEQ ID NO: 1563816 - RNA, 16 nt, Human adenovirus D
cgauguaacaucacca

SEQ ID NO: 1563817 - RNA, 17 nt, Human adenovirus D
gccaaccgcacccgcgc

SEQ ID NO: 1563818 - RNA, 18 nt, Human adenovirus D
gugagcucuucaaucggu

SEQ ID NO: 1563819 - RNA, 14 nt, Human adenovirus D
cgagccucccagga

SEQ ID NO: 1563820 - RNA, 17 nt, Human adenovirus D
ggcauccugcacgcagc

SEQ ID NO: 1563821 - RNA, 13 nt, Human adenovirus D
ugaaucucggcca

SEQ ID NO: 1563822 - RNA, 20 nt, Human adenovirus D
ggcacagccucucugaagca

SEQ ID NO: 1563823 - RNA, 19 nt, Human adenovirus D
gcgcgaagccguggcgcag

SEQ ID NO: 1563824 - RNA, 13 nt, Human adenovirus D
cccggccaaggcc

SEQ ID NO: 1563825 - RNA, 14 nt, Human adenovirus D
gcucccaccgcgcc

SEQ ID NO: 1563826 - RNA, 15 nt, Human adenovirus D
acgccuuccuggcga

SEQ ID NO: 1563827 - RNA, 20 nt, Human adenovirus D
gaccgcggccguagcaggcg

SEQ ID NO: 1563828 - RNA, 16 nt, Human adenovirus D
ccuuccaccucggugc

SEQ ID NO: 1563829 - RNA, 14 nt, Human adenovirus D
gaggcgagcagcug

SEQ ID NO: 1563830 - RNA, 12 nt, Human adenovirus D
uuaucugcuggg

SEQ ID NO: 1563831 - RNA, 20 nt, Human adenovirus D
gcuuacaacagccuugcccc

SEQ ID NO: 1563832 - RNA, 11 nt, Human adenovirus D
gacaccacagu

SEQ ID NO: 1563833 - RNA, 16 nt, Human adenovirus D
ccgucagcagcaggag

SEQ ID NO: 1563834 - RNA, 14 nt, Human adenovirus D
gaggggcagcaacc

SEQ ID NO: 1563835 - RNA, 14 nt, Human adenovirus D
guggcggggcccga

SEQ ID NO: 1563836 - RNA, 16 nt, Human adenovirus D
aucccacgccgagccu

SEQ ID NO: 1563837 - RNA, 15 nt, Human adenovirus D
gcugcuucugccugg

SEQ ID NO: 1563838 - RNA, 21 nt, Human adenovirus D
caaaagaguuucaacaaccau

SEQ ID NO: 1563839 - RNA, 14 nt, Human adenovirus D
gguuggcuugcaug

SEQ ID NO: 1563840 - RNA, 15 nt, Human adenovirus D
cagcaagagcucaaa

SEQ ID NO: 1563841 - RNA, 14 nt, Human adenovirus D
accaggggguccac

SEQ ID NO: 1563842 - RNA, 22 nt, Human adenovirus D
gaagaaccauuuuuauuccaaa

SEQ ID NO: 1563843 - RNA, 18 nt, Human adenovirus D
cuacauguucgaccccuu

SEQ ID NO: 1563844 - RNA, 17 nt, Human adenovirus D
ugcugcucgagcgccca

SEQ ID NO: 1563845 - RNA, 15 nt, Human adenovirus D
ugggcaacggccgcu

SEQ ID NO: 1563846 - RNA, 19 nt, Human adenovirus D
guuagguucuucacccagc

SEQ ID NO: 1563847 - RNA, 12 nt, Human adenovirus D
augccccaggcc

SEQ ID NO: 1563848 - RNA, 16 nt, Human adenovirus D
ugaggcaggccaugga

SEQ ID NO: 1563849 - RNA, 17 nt, Human adenovirus D
ggacuucacagagagcc

SEQ ID NO: 1563850 - RNA, 15 nt, Human adenovirus D
aaucggaucuucccc

SEQ ID NO: 1563851 - RNA, 16 nt, Human adenovirus D
caugacaaccucuucu

SEQ ID NO: 1563852 - RNA, 14 nt, Human adenovirus D
uuaagaauccacag

SEQ ID NO: 1563853 - RNA, 17 nt, Human adenovirus D
gaacaguccacccagac

SEQ ID NO: 1563854 - RNA, 17 nt, Human adenovirus D
caaacuagcagacaggg

SEQ ID NO: 1563855 - RNA, 24 nt, Human adenovirus D
agaaaugggcccuugaacagcaua

SEQ ID NO: 1563856 - RNA, 15 nt, Human adenovirus D
gccgaggcucuguuc

SEQ ID NO: 1563857 - RNA, 17 nt, Human adenovirus D
accucgguacccuccuc

SEQ ID NO: 1563858 - RNA, 18 nt, Human adenovirus D
cugguggcgcugaacgcc

SEQ ID NO: 1563859 - RNA, 15 nt, Human adenovirus D
uccccaccuacuccu

SEQ ID NO: 1563860 - RNA, 14 nt, Human adenovirus D
ccauagcucagccc

SEQ ID NO: 1563861 - RNA, 13 nt, Human adenovirus D
agcgagacccagg

SEQ ID NO: 1563862 - RNA, 16 nt, Human adenovirus D
cugaugagcucggcga

SEQ ID NO: 1563863 - RNA, 22 nt, Human adenovirus D
agccgcuccgugcgaggaugag

SEQ ID NO: 1563864 - RNA, 17 nt, Human adenovirus D
cgcguucucacuuccuc

SEQ ID NO: 1563865 - RNA, 14 nt, Human adenovirus D
cucccucacccacg

SEQ ID NO: 1563866 - RNA, 18 nt, Human adenovirus D
ugcuggaugcggagccgc

SEQ ID NO: 1563867 - RNA, 15 nt, Human adenovirus D
ggcagccgagccggc

SEQ ID NO: 1563868 - RNA, 20 nt, Human adenovirus D
acuucagccugggcaacaag

SEQ ID NO: 1563869 - RNA, 18 nt, Human adenovirus D
cucacaguccaggucaca

SEQ ID NO: 1563870 - RNA, 16 nt, Human adenovirus D
acagcguuccccuccg

SEQ ID NO: 1563871 - RNA, 15 nt, Human adenovirus D
cuccuccuccuggag

SEQ ID NO: 1563872 - RNA, 19 nt, Human adenovirus D
agccacgauguaacaucac

SEQ ID NO: 1563873 - RNA, 13 nt, Human adenovirus D
aacagcagaggaa

SEQ ID NO: 1563874 - RNA, 17 nt, Human adenovirus D
cgcuucuuaccucgcgu

SEQ ID NO: 1563875 - RNA, 23 nt, Human adenovirus D
cugcgcaaaaccuguucagggac

SEQ ID NO: 1563876 - RNA, 20 nt, Human adenovirus D
caaguaggugaagaaaacug

SEQ ID NO: 1563877 - RNA, 17 nt, Human adenovirus D
gcauccugcagcccaaa

SEQ ID NO: 1563878 - RNA, 13 nt, Human adenovirus D
cgcaacuuccagc

SEQ ID NO: 1563879 - RNA, 23 nt, Human adenovirus D
cagucacucucauuucagaacca

SEQ ID NO: 1563880 - RNA, 16 nt, Human adenovirus D
ccgcugugcuggugga

SEQ ID NO: 1563881 - RNA, 11 nt, Human adenovirus D
agcggccagcg

SEQ ID NO: 1563882 - RNA, 20 nt, Human adenovirus D
cucgcugguggcgcugaacg

SEQ ID NO: 1563883 - RNA, 18 nt, Human adenovirus D
gccuuguagggacagcag

SEQ ID NO: 1563884 - RNA, 16 nt, Human adenovirus D
ccucucgugcuccggc

SEQ ID NO: 1563885 - RNA, 17 nt, Human adenovirus D
cugggcucgcugguggc

SEQ ID NO: 1563886 - RNA, 14 nt, Human adenovirus D
acgcacgggccgcc

SEQ ID NO: 1563887 - RNA, 22 nt, Human adenovirus D
cagccugagcuuggccgagaag

SEQ ID NO: 1563888 - RNA, 20 nt, Human adenovirus D
ggcaaagcgguugagcuggg

SEQ ID NO: 1563889 - RNA, 19 nt, Human adenovirus D
guccgcaggcgggacagag

SEQ ID NO: 1563890 - RNA, 22 nt, Human adenovirus D
ggccgaaauuggugcgcugggg

SEQ ID NO: 1563891 - RNA, 13 nt, Human adenovirus D
agcaucaaaaauu

SEQ ID NO: 1563892 - RNA, 23 nt, Human adenovirus D
cagacaaacauccauguuggagg

SEQ ID NO: 1563893 - RNA, 23 nt, Human adenovirus D
ugcaacugcgcguccgucagcag

SEQ ID NO: 1563894 - RNA, 19 nt, Human adenovirus D
ggccgaaaaccccgccggg

SEQ ID NO: 1563895 - RNA, 20 nt, Human adenovirus D
uccacgcugguggccaccuc

SEQ ID NO: 1563896 - RNA, 21 nt, Human adenovirus D
cgggauagagagucuggugga

SEQ ID NO: 1563897 - RNA, 15 nt, Human adenovirus D
aggaggaugugcugc

SEQ ID NO: 1563898 - RNA, 19 nt, Human adenovirus D
cgaaauuggugcgcugggg

SEQ ID NO: 1563899 - RNA, 14 nt, Human adenovirus D
ggcagcggggccug

SEQ ID NO: 1563900 - RNA, 18 nt, Human adenovirus D
gcgcacguggcggcggcc

SEQ ID NO: 1563901 - RNA, 21 nt, Human adenovirus D
agacugauggccacggggagc

SEQ ID NO: 1563902 - RNA, 15 nt, Human adenovirus D
aaacuaaagccaaac

SEQ ID NO: 1563903 - RNA, 16 nt, Human adenovirus D
cucggcugagcucgcu

SEQ ID NO: 1563904 - RNA, 15 nt, Human adenovirus D
ucgccgcgcaggggc

SEQ ID NO: 1563905 - RNA, 13 nt, Human adenovirus D
cggccgcccacgg

SEQ ID NO: 1563906 - RNA, 22 nt, Human adenovirus D
uggucgagcgggaccggggagg

SEQ ID NO: 1563907 - RNA, 23 nt, Human adenovirus D
uuucuggggucagagacaucaua

SEQ ID NO: 1563908 - RNA, 22 nt, Human adenovirus D
gaugaaagucaggagcagcgcc

SEQ ID NO: 1563909 - RNA, 23 nt, Human adenovirus D
cggggguucauguugugcaggac

SEQ ID NO: 1563910 - RNA, 17 nt, Human adenovirus D
acagcaggagugcaggg

SEQ ID NO: 1563911 - RNA, 18 nt, Human adenovirus D
gaagccaugcugcgcaac

SEQ ID NO: 1563912 - RNA, 22 nt, Human adenovirus D
ugacuucaaccccgucuacccc

SEQ ID NO: 1563913 - RNA, 20 nt, Human adenovirus D
uuaaaaaccaaaaaaaacaa

SEQ ID NO: 1563914 - RNA, 13 nt, Human adenovirus D
cacaccugugaca

SEQ ID NO: 1563915 - RNA, 12 nt, Human adenovirus D
gugcgcuggggc

SEQ ID NO: 1563916 - RNA, 14 nt, Human adenovirus D
uucagauccccacc

SEQ ID NO: 1563917 - RNA, 12 nt, Human adenovirus D
gcauggcaggca

SEQ ID NO: 1563918 - RNA, 15 nt, Human adenovirus D
gcuuccguugcgcug

SEQ ID NO: 1563919 - RNA, 16 nt, Human adenovirus D
aggaugaacaggagca

SEQ ID NO: 1563920 - RNA, 13 nt, Human adenovirus D
ucagggugcucca

SEQ ID NO: 1563921 - RNA, 15 nt, Human adenovirus D
gaccccauggaugag

SEQ ID NO: 1563922 - RNA, 15 nt, Human adenovirus D
acucgcggcugcugc

SEQ ID NO: 1563923 - RNA, 22 nt, Human adenovirus D
agcccgaggucaaggugcgccc

SEQ ID NO: 1563924 - RNA, 13 nt, Human adenovirus D
ccaggcccagaac

SEQ ID NO: 1563925 - RNA, 16 nt, Human adenovirus D
gcucgucuuccaggag

SEQ ID NO: 1563926 - RNA, 24 nt, Human adenovirus D
cacuagaaagcaguucacuagccu

SEQ ID NO: 1563927 - RNA, 18 nt, Human adenovirus D
agacgauccugcaggugg

SEQ ID NO: 1563928 - RNA, 21 nt, Human adenovirus D
cggcgaacuuucuccacaccu

SEQ ID NO: 1563929 - RNA, 20 nt, Human adenovirus D
augcaccugugggaccuggc

SEQ ID NO: 1563930 - RNA, 19 nt, Human adenovirus D
ggccagcgcuggguggccg

SEQ ID NO: 1563931 - RNA, 23 nt, Human adenovirus D
ugugcucuccgcaccgcuccugg

SEQ ID NO: 1563932 - RNA, 19 nt, Human adenovirus D
gcaggguaaagccagcagc

SEQ ID NO: 1563933 - RNA, 19 nt, Human adenovirus D
acggcaucuuccuggggca

SEQ ID NO: 1563934 - RNA, 19 nt, Human adenovirus D
ggccgagaagguggcggca

SEQ ID NO: 1563935 - RNA, 16 nt, Human adenovirus D
aggagaacugcuggcc

SEQ ID NO: 1563936 - RNA, 18 nt, Human adenovirus D
ccuccgguggcgaccgcc

SEQ ID NO: 1563937 - RNA, 20 nt, Human adenovirus D
ucgcagcgcugcacgggcug

SEQ ID NO: 1563938 - RNA, 21 nt, Human adenovirus D
ggcgcuagccagccacagcca

SEQ ID NO: 1563939 - RNA, 21 nt, Human adenovirus D
caacuuuaucagcgcgcugcg

SEQ ID NO: 1563940 - RNA, 19 nt, Human adenovirus D
cauccauggccaggggagu

SEQ ID NO: 1563941 - RNA, 17 nt, Human adenovirus D
ugcuagcccuuccugga

SEQ ID NO: 1563942 - RNA, 16 nt, Human adenovirus D
uuuacaugcacuggag

SEQ ID NO: 1563943 - RNA, 16 nt, Human adenovirus D
acgaccggcugcucac

SEQ ID NO: 1563944 - RNA, 13 nt, Human adenovirus D
ugacuacccacug

SEQ ID NO: 1563945 - RNA, 17 nt, Human adenovirus D
gcucccaccgcgccgcc

SEQ ID NO: 1563946 - RNA, 16 nt, Human adenovirus D
gcagggagcugcgcga

SEQ ID NO: 1563947 - RNA, 16 nt, Human adenovirus D
cagcaucagucuccug

SEQ ID NO: 1563948 - RNA, 16 nt, Human adenovirus D
uggcagccgagccggc

SEQ ID NO: 1563949 - RNA, 18 nt, Human adenovirus D
gcgcgucauggcugguca

SEQ ID NO: 1563950 - RNA, 20 nt, Human adenovirus D
auacaacucgugcgaggggc

SEQ ID NO: 1563951 - RNA, 13 nt, Human adenovirus D
cacacgcccuggg

SEQ ID NO: 1563952 - RNA, 13 nt, Human adenovirus D
cccggaggagggg

SEQ ID NO: 1563953 - RNA, 15 nt, Human adenovirus D
acuaggcccagcagc

SEQ ID NO: 1563954 - RNA, 17 nt, Human adenovirus D
cgccgauggccuccagc

SEQ ID NO: 1563955 - RNA, 22 nt, Human adenovirus D
cgugugcugugauacuguugca

SEQ ID NO: 1563956 - RNA, 13 nt, Human adenovirus D
cagcaccccgucc

SEQ ID NO: 1563957 - RNA, 22 nt, Human adenovirus D
uuacaccgcgucgcugaaagca

SEQ ID NO: 1563958 - RNA, 23 nt, Human adenovirus D
gggacccugagaacggggugcag

SEQ ID NO: 1563959 - RNA, 18 nt, Human adenovirus D
ggacgagaaccugaagga

SEQ ID NO: 1563960 - RNA, 14 nt, Human adenovirus D
cucggggcauugca

SEQ ID NO: 1563961 - RNA, 17 nt, Human adenovirus D
gagaacggggugcaguc

SEQ ID NO: 1563962 - RNA, 19 nt, Human adenovirus D
aacccgccugccaggaugg

SEQ ID NO: 1563963 - RNA, 17 nt, Human adenovirus D
agaaggguuaacauuug

SEQ ID NO: 1563964 - RNA, 20 nt, Human adenovirus D
cgccagccgcaggcgcccag

SEQ ID NO: 1563965 - RNA, 14 nt, Human adenovirus D
gcccugacccagca

SEQ ID NO: 1563966 - RNA, 16 nt, Human adenovirus D
gcgcaucuacaagaga

SEQ ID NO: 1563967 - RNA, 20 nt, Human adenovirus D
ggaaacuaggcgcagcugcg

SEQ ID NO: 1563968 - RNA, 19 nt, Human adenovirus D
ucauguuggggaugaugga

SEQ ID NO: 1563969 - RNA, 17 nt, Human adenovirus D
gcgagaggagcucuugc

SEQ ID NO: 1563970 - RNA, 22 nt, Human adenovirus D
cgcgaggagguggcccugggcc

SEQ ID NO: 1563971 - RNA, 17 nt, Human adenovirus D
ccggggaggcaccaccu

SEQ ID NO: 1563972 - RNA, 16 nt, Human adenovirus D
aaagccagcagcacau

SEQ ID NO: 1563973 - RNA, 17 nt, Human adenovirus D
gcccugcuauggcucau

SEQ ID NO: 1563974 - RNA, 20 nt, Human adenovirus D
caucgcggggugaacauccc

SEQ ID NO: 1563975 - RNA, 17 nt, Human adenovirus D
gcccugcucaccugcac

SEQ ID NO: 1563976 - RNA, 16 nt, Human adenovirus D
guaauuggaacugaug

SEQ ID NO: 1563977 - RNA, 13 nt, Human adenovirus D
gcucgggcugcuc

SEQ ID NO: 1563978 - RNA, 14 nt, Human adenovirus D
cgcccagcaugucc

SEQ ID NO: 1563979 - RNA, 23 nt, Human adenovirus D
cuggacuucgcagccaugcaccu

SEQ ID NO: 1563980 - RNA, 13 nt, Human adenovirus D
uccccgcgccgcg

SEQ ID NO: 1563981 - RNA, 15 nt, Human adenovirus D
caugagccagagcau

SEQ ID NO: 1563982 - RNA, 15 nt, Human adenovirus D
cgccggggcucggug

SEQ ID NO: 1563983 - RNA, 18 nt, Human adenovirus D
cccugcuggccgagcugg

SEQ ID NO: 1563984 - RNA, 22 nt, Human adenovirus D
cacuccuaaaaccggaggugag

SEQ ID NO: 1563985 - RNA, 17 nt, Human adenovirus D
ccagggcuuccacgugc

SEQ ID NO: 1563986 - RNA, 16 nt, Human adenovirus D
ggcgcgagcugagcga

SEQ ID NO: 1563987 - RNA, 20 nt, Human adenovirus D
cguaccugggucaccugcua

SEQ ID NO: 1563988 - RNA, 13 nt, Human adenovirus D
aggcaaugagagg

SEQ ID NO: 1563989 - RNA, 12 nt, Human adenovirus D
augagggucugg

SEQ ID NO: 1563990 - RNA, 19 nt, Human adenovirus D
gcucccacagugcccccuc

SEQ ID NO: 1563991 - RNA, 22 nt, Human adenovirus D
aggccggggccgaaauuggugc

SEQ ID NO: 1563992 - RNA, 16 nt, Human adenovirus D
auuacuauuacugcca

SEQ ID NO: 1563993 - RNA, 16 nt, Human adenovirus D
ggagccagaacaccca

SEQ ID NO: 1563994 - RNA, 21 nt, Human adenovirus D
ucuacgcguacauccagcaua

SEQ ID NO: 1563995 - RNA, 20 nt, Human adenovirus D
ugcggccuugcggagcgagg

SEQ ID NO: 1563996 - RNA, 14 nt, Human adenovirus D
gcaagcgcccagag

SEQ ID NO: 1563997 - RNA, 19 nt, Human adenovirus D
gcaagaugauaccaagaga

SEQ ID NO: 1563998 - RNA, 11 nt, Human adenovirus D
aaaauaugcaa

SEQ ID NO: 1563999 - RNA, 14 nt, Human adenovirus D
ccuggaccaggcgg

SEQ ID NO: 1564000 - RNA, 21 nt, Human adenovirus D
auccuuuuguagagggaaccu

SEQ ID NO: 1564001 - RNA, 23 nt, Human adenovirus D
ugcccgagggcuacaaggaccgc

SEQ ID NO: 1564002 - RNA, 17 nt, Human adenovirus D
aaacuaggcgcagcugc

SEQ ID NO: 1564003 - RNA, 22 nt, Human adenovirus D
augugcaguuuggccuggaucu

SEQ ID NO: 1564004 - RNA, 21 nt, Human adenovirus D
acgaccacagcaacuuccuga

SEQ ID NO: 1564005 - RNA, 13 nt, Human adenovirus D
caccggcuggggu

SEQ ID NO: 1564006 - RNA, 23 nt, Human adenovirus D
cugguggaaacagacagccaggu

SEQ ID NO: 1564007 - RNA, 16 nt, Human adenovirus D
cuaucauucagagggg

SEQ ID NO: 1564008 - RNA, 13 nt, Human adenovirus D
ugcaaugucaggu

SEQ ID NO: 1564009 - RNA, 22 nt, Human adenovirus D
caucgcgaaccaggcagugcag

SEQ ID NO: 1564010 - RNA, 14 nt, Human adenovirus D
ugccgcagugggcg

SEQ ID NO: 1564011 - RNA, 23 nt, Human adenovirus D
ggcgugcgcgugcccgugcgcac

SEQ ID NO: 1564012 - RNA, 23 nt, Human adenovirus D
gcucucacuugccgccugcgcau

SEQ ID NO: 1564013 - RNA, 14 nt, Human adenovirus D
uucagggugcucca

SEQ ID NO: 1564014 - RNA, 16 nt, Human adenovirus D
ggcgcgccuuggaggc

SEQ ID NO: 1564015 - RNA, 17 nt, Human adenovirus D
aagccucugacggcgca

SEQ ID NO: 1564016 - RNA, 13 nt, Human adenovirus D
caggaggcacaga

SEQ ID NO: 1564017 - RNA, 19 nt, Human adenovirus D
ccggcgaacgugccgcgcg

SEQ ID NO: 1564018 - RNA, 14 nt, Human adenovirus D
acugcuaccucuug

SEQ ID NO: 1564019 - RNA, 19 nt, Human adenovirus D
uggccuguccugcaggggc

SEQ ID NO: 1564020 - RNA, 13 nt, Human adenovirus D
guacuucugccag

SEQ ID NO: 1564021 - RNA, 17 nt, Human adenovirus D
gcccgccauggggcgcc

SEQ ID NO: 1564022 - RNA, 17 nt, Human adenovirus D
agccguacaccaggccu

SEQ ID NO: 1564023 - RNA, 21 nt, Human adenovirus D
gacgggagcaauccuccagga

SEQ ID NO: 1564024 - RNA, 21 nt, Human adenovirus D
cagcaacuaccccguggucgg

SEQ ID NO: 1564025 - RNA, 14 nt, Human adenovirus D
ggugucccugacca

SEQ ID NO: 1564026 - RNA, 17 nt, Human adenovirus D
cuuguagggacagcagc

SEQ ID NO: 1564027 - RNA, 22 nt, Human adenovirus D
ucaacaucacauucaaaaaccg

SEQ ID NO: 1564028 - RNA, 15 nt, Human adenovirus D
ucccaggucauacaa

SEQ ID NO: 1564029 - RNA, 17 nt, Human adenovirus D
ggucugcuccugcacuu

SEQ ID NO: 1564030 - RNA, 17 nt, Human adenovirus D
augccaucaacauccac

SEQ ID NO: 1564031 - RNA, 23 nt, Human adenovirus D
gccgccggcggcgggccaugcgc

SEQ ID NO: 1564032 - RNA, 20 nt, Human adenovirus D
accaaggcacccaccacagu

SEQ ID NO: 1564033 - RNA, 13 nt, Human adenovirus D
acuguaaagccac

SEQ ID NO: 1564034 - RNA, 12 nt, Human adenovirus D
cggaaaacagga

SEQ ID NO: 1564035 - RNA, 15 nt, Human adenovirus D
cgacagucugagggc

SEQ ID NO: 1564036 - RNA, 17 nt, Human adenovirus D
cauguuauucagcagcc

SEQ ID NO: 1564037 - RNA, 19 nt, Human adenovirus D
ucgagccgaacgagcagac

SEQ ID NO: 1564038 - RNA, 20 nt, Human adenovirus D
ccgaggagaacugcuggccc

SEQ ID NO: 1564039 - RNA, 18 nt, Human adenovirus D
cgggaccggggaggcacc

SEQ ID NO: 1564040 - RNA, 17 nt, Human adenovirus D
aguuggcgacccaggaa

SEQ ID NO: 1564041 - RNA, 11 nt, Human adenovirus D
cggcaccugcg

SEQ ID NO: 1564042 - RNA, 19 nt, Human adenovirus D
gaggagcggucuggacccu

SEQ ID NO: 1564043 - RNA, 16 nt, Human adenovirus D
aaccggaggcuggcug

SEQ ID NO: 1564044 - RNA, 15 nt, Human adenovirus D
gcugaaacaccugca

SEQ ID NO: 1564045 - RNA, 19 nt, Human adenovirus D
uagacaaagagcacagcag

SEQ ID NO: 1564046 - RNA, 20 nt, Human adenovirus D
caugccuucgugcacuggcc

SEQ ID NO: 1564047 - RNA, 13 nt, Human adenovirus D
cugcgccgggcgc

SEQ ID NO: 1564048 - RNA, 22 nt, Human adenovirus D
cuuugacacaccuggaggcacc

SEQ ID NO: 1564049 - RNA, 12 nt, Human adenovirus D
ggccaugcugcg

SEQ ID NO: 1564050 - RNA, 14 nt, Human adenovirus D
cccugacccagcag

SEQ ID NO: 1564051 - RNA, 15 nt, Human adenovirus D
uggaccggcugguga

SEQ ID NO: 1564052 - RNA, 16 nt, Human adenovirus D
gaagauggggccccgc

SEQ ID NO: 1564053 - RNA, 24 nt, Human adenovirus D
gccagcccaacggcaccugcgagc

SEQ ID NO: 1564054 - RNA, 13 nt, Human adenovirus D
uaccucucggccg

SEQ ID NO: 1564055 - RNA, 15 nt, Human adenovirus D
gcgaagauggccacc

SEQ ID NO: 1564056 - RNA, 15 nt, Human adenovirus D
aaucgcggcggccau

SEQ ID NO: 1564057 - RNA, 17 nt, Human adenovirus D
ggacaucgcgaaccagg

SEQ ID NO: 1564058 - RNA, 15 nt, Human adenovirus D
gcccuugcgcgagca

SEQ ID NO: 1564059 - RNA, 19 nt, Human adenovirus D
guuugaguagugggcgugg

SEQ ID NO: 1564060 - RNA, 15 nt, Human adenovirus D
ucagucuccuggugc

SEQ ID NO: 1564061 - RNA, 15 nt, Human adenovirus D
cauccaaggccaucu

SEQ ID NO: 1564062 - RNA, 13 nt, Human adenovirus D
cgccuccacccug

SEQ ID NO: 1564063 - RNA, 17 nt, Human adenovirus D
uuaaaaagcagcacagu

SEQ ID NO: 1564064 - RNA, 18 nt, Human adenovirus D
gaccgugccgcggugcgc

SEQ ID NO: 1564065 - RNA, 18 nt, Human adenovirus D
uacgccaacucggcccac

SEQ ID NO: 1564066 - RNA, 15 nt, Human adenovirus D
cggacugccaccgcc

SEQ ID NO: 1564067 - RNA, 20 nt, Human adenovirus D
gauauugcuucccuggaaga

SEQ ID NO: 1564068 - RNA, 20 nt, Human adenovirus D
gaaagggcccgggacggagg

SEQ ID NO: 1564069 - RNA, 17 nt, Human adenovirus D
gacccaugagcugcgag

SEQ ID NO: 1564070 - RNA, 14 nt, Human adenovirus D
agccagcagcacau

SEQ ID NO: 1564071 - RNA, 23 nt, Human adenovirus D
uggccggcgcgcccggggccagg

SEQ ID NO: 1564072 - RNA, 15 nt, Human adenovirus D
uugaaaccacuuccu

SEQ ID NO: 1564073 - RNA, 17 nt, Human adenovirus D
cacaggaugaacaggag

SEQ ID NO: 1564074 - RNA, 22 nt, Human adenovirus D
agugcuuacucuauaacauuug

SEQ ID NO: 1564075 - RNA, 17 nt, Human adenovirus D
aacugaaccgcuggaag

SEQ ID NO: 1564076 - RNA, 14 nt, Human adenovirus D
gagugggauaaaga

SEQ ID NO: 1564077 - RNA, 16 nt, Human adenovirus D
gauggacuuggaagag

SEQ ID NO: 1564078 - RNA, 14 nt, Human adenovirus D
gcgaccugggcugc

SEQ ID NO: 1564079 - RNA, 13 nt, Human adenovirus D
cauaucagccagu

SEQ ID NO: 1564080 - RNA, 15 nt, Human adenovirus D
uggauguggagcccg

SEQ ID NO: 1564081 - RNA, 15 nt, Human adenovirus D
gauaaauauggccug

SEQ ID NO: 1564082 - RNA, 18 nt, Human adenovirus D
acgcuguaccgcagcugg

SEQ ID NO: 1564083 - RNA, 20 nt, Human adenovirus D
uaaacuaaagccaaacacac

SEQ ID NO: 1564084 - RNA, 23 nt, Human adenovirus D
acggggaucagccccgcgcgcgc

SEQ ID NO: 1564085 - RNA, 19 nt, Human adenovirus D
aggcgcgcuucacucuggc

SEQ ID NO: 1564086 - RNA, 12 nt, Human adenovirus D
ucuacaaggccc

SEQ ID NO: 1564087 - RNA, 21 nt, Human adenovirus D
cccggacguggugcugcugcc

SEQ ID NO: 1564088 - RNA, 18 nt, Human adenovirus D
ccuccaggacuaucuaug

SEQ ID NO: 1564089 - RNA, 22 nt, Human adenovirus D
agcagguggcgccgggccuggg

SEQ ID NO: 1564090 - RNA, 12 nt, Human adenovirus D
gggcgguggugg

SEQ ID NO: 1564091 - RNA, 19 nt, Human adenovirus D
agccgccugagcaaccucc

SEQ ID NO: 1564092 - RNA, 13 nt, Human adenovirus D
gagggucugcgag

SEQ ID NO: 1564093 - RNA, 12 nt, Human adenovirus D
ggcaaaggagcc

SEQ ID NO: 1564094 - RNA, 19 nt, Human adenovirus D
ggcaaagcucaacccgcgu

SEQ ID NO: 1564095 - RNA, 18 nt, Human adenovirus D
cuguggucgacuugcaag

SEQ ID NO: 1564096 - RNA, 17 nt, Human adenovirus D
augccuucuccagggug

SEQ ID NO: 1564097 - RNA, 20 nt, Human adenovirus D
cugcagguggacgagccgcc

SEQ ID NO: 1564098 - RNA, 16 nt, Human adenovirus D
ccucccccgcaagcga

SEQ ID NO: 1564099 - RNA, 17 nt, Human adenovirus D
cuaccacgcccaugaga

SEQ ID NO: 1564100 - RNA, 15 nt, Human adenovirus D
agucugccgcccuug

SEQ ID NO: 1564101 - RNA, 13 nt, Human adenovirus D
gaccgcagcgggg

SEQ ID NO: 1564102 - RNA, 13 nt, Human adenovirus D
cagcccagggcgc

SEQ ID NO: 1564103 - RNA, 10 nt, Human adenovirus D
gucugccccc

SEQ ID NO: 1564104 - RNA, 21 nt, Human adenovirus D
ggccaucgugcagaacccgga

SEQ ID NO: 1564105 - RNA, 14 nt, Human adenovirus D
gacaacagccgcag

SEQ ID NO: 1564106 - RNA, 13 nt, Human adenovirus D
gcaugagcggcuc

SEQ ID NO: 1564107 - RNA, 13 nt, Human adenovirus D
gcagcggggccug

SEQ ID NO: 1564108 - RNA, 16 nt, Human adenovirus D
aauucucauuuuucca

SEQ ID NO: 1564109 - RNA, 20 nt, Human adenovirus D
ugagcagcuugcgcgcuggc

SEQ ID NO: 1564110 - RNA, 19 nt, Human adenovirus D
uccagcagcaggguaccca

SEQ ID NO: 1564111 - RNA, 17 nt, Human adenovirus D
agcggccgaaaaccccg

SEQ ID NO: 1564112 - RNA, 22 nt, Human adenovirus D
aagaagggcaucuucugccugg

SEQ ID NO: 1564113 - RNA, 16 nt, Human adenovirus D
aggcauggcaggcagc

SEQ ID NO: 1564114 - RNA, 16 nt, Human adenovirus D
acagcaccgccgcagc

SEQ ID NO: 1564115 - RNA, 21 nt, Human adenovirus D
ggcgccgcccgagcucugcug

SEQ ID NO: 1564116 - RNA, 18 nt, Human adenovirus D
gccucugacggcgcagcu

SEQ ID NO: 1564117 - RNA, 13 nt, Human adenovirus D
uugaauugcaaau

SEQ ID NO: 1564118 - RNA, 17 nt, Human adenovirus D
gcugaccaacuggucuc

SEQ ID NO: 1564119 - RNA, 20 nt, Human adenovirus D
aguccuguaaauaagucacu

SEQ ID NO: 1564120 - RNA, 20 nt, Human adenovirus D
gauggaacucuguugaggca

SEQ ID NO: 1564121 - RNA, 14 nt, Human adenovirus D
gggcgggcagggag

SEQ ID NO: 1564122 - RNA, 22 nt, Human adenovirus D
gcacccgguacuacgccagccg

SEQ ID NO: 1564123 - RNA, 14 nt, Human adenovirus D
agugaccgucacug

SEQ ID NO: 1564124 - RNA, 17 nt, Human adenovirus D
gcuagacauggccagca

SEQ ID NO: 1564125 - RNA, 18 nt, Human adenovirus D
gcagcccuucuccacggg

SEQ ID NO: 1564126 - RNA, 18 nt, Human adenovirus D
acugccgccgccugcgcu

SEQ ID NO: 1564127 - RNA, 22 nt, Human adenovirus D
gcgcgagcagaacgggggcagc

SEQ ID NO: 1564128 - RNA, 16 nt, Human adenovirus D
guacuucagccugggc

SEQ ID NO: 1564129 - RNA, 12 nt, Human adenovirus D
acuaaucauuua

SEQ ID NO: 1564130 - RNA, 19 nt, Human adenovirus D
cgugagcgcgagccggcgg

SEQ ID NO: 1564131 - RNA, 14 nt, Human adenovirus D
cgaccccuggcucc

SEQ ID NO: 1564132 - RNA, 16 nt, Human adenovirus D
caaaugcgagcauaca

SEQ ID NO: 1564133 - RNA, 17 nt, Human adenovirus D
acucgcggcugcugcug

SEQ ID NO: 1564134 - RNA, 15 nt, Human adenovirus D
cagcgccacgaccgg

SEQ ID NO: 1564135 - RNA, 17 nt, Human adenovirus D
uaaauauggccuggagc

SEQ ID NO: 1564136 - RNA, 21 nt, Human adenovirus D
acugcuaucaggagaaaauug

SEQ ID NO: 1564137 - RNA, 15 nt, Human adenovirus D
ccgcugcgcagcagu

SEQ ID NO: 1564138 - RNA, 15 nt, Human adenovirus D
ucucgauccagcaga

SEQ ID NO: 1564139 - RNA, 16 nt, Human adenovirus D
accagauacuucagca

SEQ ID NO: 1564140 - RNA, 16 nt, Human adenovirus D
cggugggucggagccc

SEQ ID NO: 1564141 - RNA, 16 nt, Human adenovirus D
caugauccagcggcgc

SEQ ID NO: 1564142 - RNA, 15 nt, Human adenovirus D
ucgcggcugcugcug

SEQ ID NO: 1564143 - RNA, 14 nt, Human adenovirus D
ggcgggggcggaga

SEQ ID NO: 1564144 - RNA, 21 nt, Human adenovirus D
ccagucccuuuuccaggaaag

SEQ ID NO: 1564145 - RNA, 12 nt, Human adenovirus D
gaccaugagcuc

SEQ ID NO: 1564146 - RNA, 17 nt, Human adenovirus D
cugcuguaaagccagaa

SEQ ID NO: 1564147 - RNA, 17 nt, Human adenovirus D
gcuauaauaagcagagu

SEQ ID NO: 1564148 - RNA, 19 nt, Human adenovirus D
caguauaucaggugccugc

SEQ ID NO: 1564149 - RNA, 17 nt, Human adenovirus D
cguucuacccagcaagu

SEQ ID NO: 1564150 - RNA, 22 nt, Human adenovirus D
gagucugaaaaacagaaagcau

SEQ ID NO: 1564151 - RNA, 20 nt, Human adenovirus D
gcauguacaacaugcugacu

SEQ ID NO: 1564152 - RNA, 17 nt, Human adenovirus D
cccacaggaugaacagg

SEQ ID NO: 1564153 - RNA, 16 nt, Human adenovirus D
aguaggaaccagcaca

SEQ ID NO: 1564154 - RNA, 21 nt, Human adenovirus D
gccaagacaaaggaggccacg

SEQ ID NO: 1564155 - RNA, 22 nt, Human adenovirus D
gccagacgcacgggccgccggg

SEQ ID NO: 1564156 - RNA, 16 nt, Human adenovirus D
caaccggcugaugccc

SEQ ID NO: 1564157 - RNA, 18 nt, Human adenovirus D
agagcgugauggcgcagg

SEQ ID NO: 1564158 - RNA, 13 nt, Human adenovirus D
accaccccaggcg

SEQ ID NO: 1564159 - RNA, 22 nt, Human adenovirus D
gugaucccacagggcacugccg

SEQ ID NO: 1564160 - RNA, 17 nt, Human adenovirus D
gaugaggauugggagga

SEQ ID NO: 1564161 - RNA, 17 nt, Human adenovirus D
ggcgcuuggugggcaga

SEQ ID NO: 1564162 - RNA, 14 nt, Human adenovirus D
gccgagcccgaggg

SEQ ID NO: 1564163 - RNA, 18 nt, Human adenovirus D
ugcgcgagguugagcucc

SEQ ID NO: 1564164 - RNA, 13 nt, Human adenovirus D
agccgccagcugg

SEQ ID NO: 1564165 - RNA, 15 nt, Human adenovirus D
cugacgcugagcgac

SEQ ID NO: 1564166 - RNA, 16 nt, Human adenovirus D
caaaaaaaacaaucag

SEQ ID NO: 1564167 - RNA, 20 nt, Human adenovirus D
cugacugccgccggccauug

SEQ ID NO: 1564168 - RNA, 16 nt, Human adenovirus D
ccacauccaagugccc

SEQ ID NO: 1564169 - RNA, 20 nt, Human adenovirus D
cgcagguggacgagcagacc

SEQ ID NO: 1564170 - RNA, 17 nt, Human adenovirus D
caacaucugugcugccu

SEQ ID NO: 1564171 - RNA, 18 nt, Human adenovirus D
ucacggcaucuuccuggg

SEQ ID NO: 1564172 - RNA, 20 nt, Human adenovirus D
cuggcgguagagcggccagc

SEQ ID NO: 1564173 - RNA, 20 nt, Human adenovirus D
aggugcgccccaucaagcag

SEQ ID NO: 1564174 - RNA, 13 nt, Human adenovirus D
uaagagcccagca

SEQ ID NO: 1564175 - RNA, 21 nt, Human adenovirus D
gaggcauuggagaaugcugcu

SEQ ID NO: 1564176 - RNA, 18 nt, Human adenovirus D
ucaccuuccugcagcuca

SEQ ID NO: 1564177 - RNA, 14 nt, Human adenovirus D
ucuuuaucugcugg

SEQ ID NO: 1564178 - RNA, 14 nt, Human adenovirus D
cacaggcacacuga

SEQ ID NO: 1564179 - RNA, 17 nt, Human adenovirus D
cuuggucacaugcuugg

SEQ ID NO: 1564180 - RNA, 21 nt, Human adenovirus D
cgacgacauccuggaccaggc

SEQ ID NO: 1564181 - RNA, 18 nt, Human adenovirus D
uccaacggcaaacagcau

SEQ ID NO: 1564182 - RNA, 13 nt, Human adenovirus D
cagaggagggauu

SEQ ID NO: 1564183 - RNA, 17 nt, Human adenovirus D
cggccaugccccaggcc

SEQ ID NO: 1564184 - RNA, 17 nt, Human adenovirus D
ccguucuccgccggaaa

SEQ ID NO: 1564185 - RNA, 16 nt, Human adenovirus D
caaccaugugcgcacc

SEQ ID NO: 1564186 - RNA, 13 nt, Human adenovirus D
cugggaggcugcg

SEQ ID NO: 1564187 - RNA, 17 nt, Human adenovirus D
cgcaacuuccagcccau

SEQ ID NO: 1564188 - RNA, 19 nt, Human adenovirus D
ucuucaacaucugugcugc

SEQ ID NO: 1564189 - RNA, 17 nt, Human adenovirus D
acgucggcguggcgcuc

SEQ ID NO: 1564190 - RNA, 13 nt, Human adenovirus D
augcuccaaagcu

SEQ ID NO: 1564191 - RNA, 16 nt, Human adenovirus D
ugccagacgcaagagc

SEQ ID NO: 1564192 - RNA, 16 nt, Human adenovirus D
gacaaacaaaagccau

SEQ ID NO: 1564193 - RNA, 22 nt, Human adenovirus D
gcccgacuucaugagccagagc

SEQ ID NO: 1564194 - RNA, 22 nt, Human adenovirus D
gggcucuuccuccguagccugg

SEQ ID NO: 1564195 - RNA, 12 nt, Human adenovirus D
aacuuaacucug

SEQ ID NO: 1564196 - RNA, 13 nt, Human adenovirus D
guccgggggcagg

SEQ ID NO: 1564197 - RNA, 19 nt, Human adenovirus D
ugcagaacccggacagcaa

SEQ ID NO: 1564198 - RNA, 17 nt, Human adenovirus D
acaguaagugcagcaca

SEQ ID NO: 1564199 - RNA, 15 nt, Human adenovirus D
ccgcccgacacugca

SEQ ID NO: 1564200 - RNA, 18 nt, Human adenovirus D
agugcaacuuuagccaga

SEQ ID NO: 1564201 - RNA, 16 nt, Human adenovirus D
uaaggagaaggauuca

SEQ ID NO: 1564202 - RNA, 19 nt, Human adenovirus D
gucugcucgggcaugagcu

SEQ ID NO: 1564203 - RNA, 11 nt, Human adenovirus D
ccucagccacu

SEQ ID NO: 1564204 - RNA, 15 nt, Human adenovirus D
ugcuggcccugcugg

SEQ ID NO: 1564205 - RNA, 23 nt, Human adenovirus D
auucuggaaauuaugagcaucaa

SEQ ID NO: 1564206 - RNA, 19 nt, Human adenovirus D
cuuuguaacucuaaucauu

SEQ ID NO: 1564207 - RNA, 17 nt, Human adenovirus D
cagauggaaaggucacu

SEQ ID NO: 1564208 - RNA, 20 nt, Human adenovirus D
cgaggccgucuaccugcgca

SEQ ID NO: 1564209 - RNA, 13 nt, Human adenovirus D
cugccgcugcaac

SEQ ID NO: 1564210 - RNA, 17 nt, Human adenovirus D
ggaccuggcggaggcca

SEQ ID NO: 1564211 - RNA, 16 nt, Human adenovirus D
ggugaagcaggagcgc

SEQ ID NO: 1564212 - RNA, 16 nt, Human adenovirus D
acuauaaagucacagu

SEQ ID NO: 1564213 - RNA, 17 nt, Human adenovirus D
cgggcgggcagggagcu

SEQ ID NO: 1564214 - RNA, 10 nt, Human adenovirus D
acccagcagg

SEQ ID NO: 1564215 - RNA, 14 nt, Human adenovirus D
cuugggcugccacu

SEQ ID NO: 1564216 - RNA, 16 nt, Human adenovirus D
cgaggagcugagacca

SEQ ID NO: 1564217 - RNA, 15 nt, Human adenovirus D
cgguauauggcuccu

SEQ ID NO: 1564218 - RNA, 22 nt, Human adenovirus D
aguacaagcgccaacagcagcg

SEQ ID NO: 1564219 - RNA, 14 nt, Human adenovirus D
ggaacggggcagag

SEQ ID NO: 1564220 - RNA, 21 nt, Human adenovirus D
accugaacgacucgcugcugc

SEQ ID NO: 1564221 - RNA, 22 nt, Human adenovirus D
agaacaaaaacagacuggucaa

SEQ ID NO: 1564222 - RNA, 12 nt, Human adenovirus D
gaggacggagag

SEQ ID NO: 1564223 - RNA, 14 nt, Human adenovirus D
cugcccaccgugcg

SEQ ID NO: 1564224 - RNA, 17 nt, Human adenovirus D
gcagaggcacacagcuc

SEQ ID NO: 1564225 - RNA, 23 nt, Human adenovirus D
acucgcagacgagcggccgccgc

SEQ ID NO: 1564226 - RNA, 16 nt, Human adenovirus D
acccacucuauuuuca

SEQ ID NO: 1564227 - RNA, 19 nt, Human adenovirus D
gcgcgaucccgcuguggcu

SEQ ID NO: 1564228 - RNA, 23 nt, Human adenovirus D
ccaucaagcagguggcgccgggc

SEQ ID NO: 1564229 - RNA, 17 nt, Human adenovirus D
ucccaacagccuucagc

SEQ ID NO: 1564230 - RNA, 22 nt, Human adenovirus D
ugcaggauaaauauggccugga

SEQ ID NO: 1564231 - RNA, 15 nt, Human adenovirus D
ccgcgcuugcugggc

SEQ ID NO: 1564232 - RNA, 21 nt, Human adenovirus D
cgggugcuagacauggccagc

SEQ ID NO: 1564233 - RNA, 15 nt, Human adenovirus D
ccugccgcgccaacc

SEQ ID NO: 1564234 - RNA, 15 nt, Human adenovirus D
uugcccuuacaugua

SEQ ID NO: 1564235 - RNA, 14 nt, Human adenovirus D
uggggcuccucgag

SEQ ID NO: 1564236 - RNA, 13 nt, Human adenovirus D
ccgccggcggcga

SEQ ID NO: 1564237 - RNA, 21 nt, Human adenovirus D
cacucccgucucgacccgagc

SEQ ID NO: 1564238 - RNA, 13 nt, Human adenovirus D
uguugcagagaga

SEQ ID NO: 1564239 - RNA, 15 nt, Human adenovirus D
guguugcggcccggc

SEQ ID NO: 1564240 - RNA, 15 nt, Human adenovirus D
guggcgccgggccug

SEQ ID NO: 1564241 - RNA, 21 nt, Human adenovirus D
cgggugaccccgacgccccug

SEQ ID NO: 1564242 - RNA, 17 nt, Human adenovirus D
ccaugcgaauuccccuc

SEQ ID NO: 1564243 - RNA, 15 nt, Human adenovirus D
cgggugagggcgugc

SEQ ID NO: 1564244 - RNA, 15 nt, Human adenovirus D
aguggaagagaugga

SEQ ID NO: 1564245 - RNA, 13 nt, Human adenovirus D
gcugcuggagcug

SEQ ID NO: 1564246 - RNA, 16 nt, Human adenovirus D
gcucugcugcgccgcg

SEQ ID NO: 1564247 - RNA, 12 nt, Human adenovirus D
aaauuugcaaaa

SEQ ID NO: 1564248 - RNA, 18 nt, Human adenovirus D
gaccgccggcucaagcag

SEQ ID NO: 1564249 - RNA, 18 nt, Human adenovirus D
gccguccuuucgcugcug

SEQ ID NO: 1564250 - RNA, 17 nt, Human adenovirus D
cacggucuucgcccugc

SEQ ID NO: 1564251 - RNA, 22 nt, Human adenovirus D
augccgaagaagaacaggagcc

SEQ ID NO: 1564252 - RNA, 19 nt, Human adenovirus D
aggcgggaauuaccucauc

SEQ ID NO: 1564253 - RNA, 19 nt, Human adenovirus D
guucauggccaacagccac

SEQ ID NO: 1564254 - RNA, 19 nt, Human adenovirus D
gucuggugcaguuugcccg

SEQ ID NO: 1564255 - RNA, 15 nt, Human adenovirus D
cggccagcagggugc

SEQ ID NO: 1564256 - RNA, 23 nt, Human adenovirus D
cgcgcaucaucgcgccacuggcc

SEQ ID NO: 1564257 - RNA, 18 nt, Human adenovirus D
ggaagaaaugaggcaggc

SEQ ID NO: 1564258 - RNA, 15 nt, Human adenovirus D
caaugucagcugcaa

SEQ ID NO: 1564259 - RNA, 13 nt, Human adenovirus D
gcagugggcgcag

SEQ ID NO: 1564260 - RNA, 15 nt, Human adenovirus D
uggauugcaauuuug

SEQ ID NO: 1564261 - RNA, 22 nt, Human adenovirus D
auaauucagggugcuccagcca

SEQ ID NO: 1564262 - RNA, 15 nt, Human adenovirus D
gccuguacccagagc

SEQ ID NO: 1564263 - RNA, 14 nt, Human adenovirus D
gcgggagcgguggg

SEQ ID NO: 1564264 - RNA, 15 nt, Human adenovirus D
augaaagucaggagc

SEQ ID NO: 1564265 - RNA, 18 nt, Human adenovirus D
ccugggcgugcagaccgu

SEQ ID NO: 1564266 - RNA, 22 nt, Human adenovirus D
gcggguccccguugggcagcga

SEQ ID NO: 1564267 - RNA, 13 nt, Human adenovirus D
uugcagagcagcu

SEQ ID NO: 1564268 - RNA, 19 nt, Human adenovirus D
cccugcaagugcacagacc

SEQ ID NO: 1564269 - RNA, 12 nt, Human adenovirus D
ggaggagcagcc

SEQ ID NO: 1564270 - RNA, 15 nt, Human adenovirus D
ugcaucccguccugc

SEQ ID NO: 1564271 - RNA, 20 nt, Human adenovirus D
cgagcagaacgggggcagca

SEQ ID NO: 1564272 - RNA, 18 nt, Human adenovirus D
acggccuggccucgggca

SEQ ID NO: 1564273 - RNA, 16 nt, Human adenovirus D
cggccgaaaaccccgc

SEQ ID NO: 1564274 - RNA, 19 nt, Human adenovirus D
agugcaguuggccaugagc

SEQ ID NO: 1564275 - RNA, 14 nt, Human adenovirus D
aaggaugaggugga

SEQ ID NO: 1564276 - RNA, 15 nt, Human adenovirus D
ccgugguccugguca

SEQ ID NO: 1564277 - RNA, 18 nt, Human adenovirus D
agcagagucugccgcccu

SEQ ID NO: 1564278 - RNA, 17 nt, Human adenovirus D
gaccagaacuuccagca

SEQ ID NO: 1564279 - RNA, 16 nt, Human adenovirus D
gaccaauagacagcag

SEQ ID NO: 1564280 - RNA, 14 nt, Human adenovirus D
caucauggcccuga

SEQ ID NO: 1564281 - RNA, 20 nt, Human adenovirus D
acagaacaaaaacagacugg

SEQ ID NO: 1564282 - RNA, 16 nt, Human adenovirus D
gaagaagaacaggagc

SEQ ID NO: 1564283 - RNA, 16 nt, Human adenovirus D
cccuccgcccugagcu

SEQ ID NO: 1564284 - RNA, 18 nt, Human adenovirus D
gguagggggcgccgccgg

SEQ ID NO: 1564285 - RNA, 17 nt, Human adenovirus D
cggccugaaccgccgcc

SEQ ID NO: 1564286 - RNA, 20 nt, Human adenovirus D
ggcguucagggaggcgcugc

SEQ ID NO: 1564287 - RNA, 21 nt, Human adenovirus D
agucacuaggaccccagggac

SEQ ID NO: 1564288 - RNA, 21 nt, Human adenovirus D
ccugggagucucuaccgaggg

SEQ ID NO: 1564289 - RNA, 22 nt, Human adenovirus D
cagagauggacuuggaagaggg

SEQ ID NO: 1564290 - RNA, 15 nt, Human adenovirus D
gguacccuccuccca

SEQ ID NO: 1564291 - RNA, 14 nt, Human adenovirus D
uguuuauaaaucuu

SEQ ID NO: 1564292 - RNA, 23 nt, Human adenovirus D
cgcggacgcgcucccggcggcag

SEQ ID NO: 1564293 - RNA, 14 nt, Human adenovirus D
cgagcacagcaccg

SEQ ID NO: 1564294 - RNA, 23 nt, Human adenovirus D
acuggagcacagaccuucaggga

SEQ ID NO: 1564295 - RNA, 22 nt, Human adenovirus D
ccaggcccagaacuggcagagc

SEQ ID NO: 1564296 - RNA, 15 nt, Human adenovirus D
ccccagacacccacg

SEQ ID NO: 1564297 - RNA, 14 nt, Human adenovirus D
ggcugcuucugccu

SEQ ID NO: 1564298 - RNA, 16 nt, Human adenovirus D
ucugcucauacugcua

SEQ ID NO: 1564299 - RNA, 15 nt, Human adenovirus D
ccucacucucuuccg

SEQ ID NO: 1564300 - RNA, 22 nt, Human adenovirus D
ggccucucaauugaaugcugug

SEQ ID NO: 1564301 - RNA, 20 nt, Human adenovirus D
auggcgugcgaguuggagga

SEQ ID NO: 1564302 - RNA, 19 nt, Human adenovirus D
uggacaucgcgaaccaggc

SEQ ID NO: 1564303 - RNA, 16 nt, Human adenovirus D
auaugguagacccacu

SEQ ID NO: 1564304 - RNA, 13 nt, Human adenovirus D
gcccgagcucugc

SEQ ID NO: 1564305 - RNA, 14 nt, Human adenovirus D
aggucucgcuccac

SEQ ID NO: 1564306 - RNA, 16 nt, Human adenovirus D
cuggcugcuggagcug

SEQ ID NO: 1564307 - RNA, 17 nt, Human adenovirus D
guaaaugacucuccuga

SEQ ID NO: 1564308 - RNA, 17 nt, Human adenovirus D
ccacaggugcugcccac

SEQ ID NO: 1564309 - RNA, 21 nt, Human adenovirus D
cucaacaucacauucaaaaac

SEQ ID NO: 1564310 - RNA, 12 nt, Human adenovirus D
aggggccaagaa

SEQ ID NO: 1564311 - RNA, 15 nt, Human adenovirus D
cucugcugcgccgcg

SEQ ID NO: 1564312 - RNA, 12 nt, Human adenovirus D
ccugcgccgggc

SEQ ID NO: 1564313 - RNA, 14 nt, Human adenovirus D
ucugcccuccgccc

SEQ ID NO: 1564314 - RNA, 14 nt, Human adenovirus D
acugcgacucgggg

SEQ ID NO: 1564315 - RNA, 18 nt, Human adenovirus D
uucaauaagguucugccc

SEQ ID NO: 1564316 - RNA, 17 nt, Human adenovirus D
cgacccaugauggugcu

SEQ ID NO: 1564317 - RNA, 19 nt, Human adenovirus D
cugcucccgggcuccuaca

SEQ ID NO: 1564318 - RNA, 14 nt, Human adenovirus D
agccguggcgcagc

SEQ ID NO: 1564319 - RNA, 14 nt, Human adenovirus D
caccgacacguacu

SEQ ID NO: 1564320 - RNA, 16 nt, Human adenovirus D
ggcgagauagcaguug

SEQ ID NO: 1564321 - RNA, 15 nt, Human adenovirus D
gcgaccaccgcgacc

SEQ ID NO: 1564322 - RNA, 20 nt, Human adenovirus D
gacaaugauggauacuuggu

SEQ ID NO: 1564323 - RNA, 18 nt, Human adenovirus D
ccucaugaacacacugcc

SEQ ID NO: 1564324 - RNA, 15 nt, Human adenovirus D
agaagagcccccucc

SEQ ID NO: 1564325 - RNA, 17 nt, Human adenovirus D
ccagacccaggcgcgga

SEQ ID NO: 1564326 - RNA, 23 nt, Human adenovirus D
cugcagcauugucugccugguca

SEQ ID NO: 1564327 - RNA, 17 nt, Human adenovirus D
agcccaugagcaggcag

SEQ ID NO: 1564328 - RNA, 16 nt, Human adenovirus D
uccaacgccugcgcca

SEQ ID NO: 1564329 - RNA, 20 nt, Human adenovirus D
gggagcugcgcgagggccug

SEQ ID NO: 1564330 - RNA, 13 nt, Human adenovirus D
cuaaagcucuucu

SEQ ID NO: 1564331 - RNA, 23 nt, Human adenovirus D
ucaucguugugcgccgcgcuggg

SEQ ID NO: 1564332 - RNA, 16 nt, Human adenovirus D
gcucuaucgcuuccuc

SEQ ID NO: 1564333 - RNA, 16 nt, Human adenovirus D
aagaaguuagaggagg

SEQ ID NO: 1564334 - RNA, 17 nt, Human adenovirus D
ggugaugccggcagcgg

SEQ ID NO: 1564335 - RNA, 13 nt, Human adenovirus D
ccgaaggacccca

SEQ ID NO: 1564336 - RNA, 12 nt, Human adenovirus D
gaacaaggccau

SEQ ID NO: 1564337 - RNA, 23 nt, Human adenovirus D
ccgccaucgaacacgccaccgcu

SEQ ID NO: 1564338 - RNA, 15 nt, Human adenovirus D
ugcgcggggccacga

SEQ ID NO: 1564339 - RNA, 20 nt, Human adenovirus D
cgcaaggucgaggagaccug

SEQ ID NO: 1564340 - RNA, 21 nt, Human adenovirus D
cauccaacugaaguacaucca

SEQ ID NO: 1564341 - RNA, 12 nt, Human adenovirus D
cuaaugacaaac

SEQ ID NO: 1564342 - RNA, 16 nt, Human adenovirus D
cacgguucucucagca

SEQ ID NO: 1564343 - RNA, 17 nt, Human adenovirus D
uguaguuguucagcagc

SEQ ID NO: 1564344 - RNA, 13 nt, Human adenovirus D
ggccuggagcaga

SEQ ID NO: 1564345 - RNA, 19 nt, Human adenovirus D
gggagcugcgcgagggccu

SEQ ID NO: 1564346 - RNA, 17 nt, Human adenovirus D
auuggugcgcuggggcu

SEQ ID NO: 1564347 - RNA, 13 nt, Human adenovirus D
cauauaccccucc

SEQ ID NO: 1564348 - RNA, 15 nt, Human adenovirus D
gguucuucacccagc

SEQ ID NO: 1564349 - RNA, 15 nt, Human adenovirus D
ccgcgccgccacugc

SEQ ID NO: 1564350 - RNA, 19 nt, Human adenovirus D
ggugacgguaagcacgagc

SEQ ID NO: 1564351 - RNA, 14 nt, Human adenovirus D
cucaugcccuuccg

SEQ ID NO: 1564352 - RNA, 21 nt, Human adenovirus D
ucagcccgcuuaccaguagac

SEQ ID NO: 1564353 - RNA, 22 nt, Human adenovirus D
cuugaacucggggaucaccagu

SEQ ID NO: 1564354 - RNA, 12 nt, Human adenovirus D
ucgagcugcaag

SEQ ID NO: 1564355 - RNA, 22 nt, Human adenovirus D
agcaggguacccacuggguggc

SEQ ID NO: 1564356 - RNA, 14 nt, Human adenovirus D
ggcgccucccagga

SEQ ID NO: 1564357 - RNA, 13 nt, Human adenovirus D
cgcucgcucaccc

SEQ ID NO: 1564358 - RNA, 19 nt, Human adenovirus D
ugccuggucaaacaggcaa

SEQ ID NO: 1564359 - RNA, 19 nt, Human adenovirus D
ugaaaaaaacgguuuccgg

SEQ ID NO: 1564360 - RNA, 11 nt, Human adenovirus D
ugccaauaaac

SEQ ID NO: 1564361 - RNA, 13 nt, Human adenovirus D
ugcaccuguggga

SEQ ID NO: 1564362 - RNA, 20 nt, Human adenovirus D
caagggcgcucccaauccca

SEQ ID NO: 1564363 - RNA, 23 nt, Human adenovirus D
ccgggcucugugaacagcggcag

SEQ ID NO: 1564364 - RNA, 15 nt, Human adenovirus D
gaccggcagcggggc

SEQ ID NO: 1564365 - RNA, 15 nt, Human adenovirus D
gagcgcgagccggcg

SEQ ID NO: 1564366 - RNA, 22 nt, Human adenovirus D
accuuccagccguaccagugca

SEQ ID NO: 1564367 - RNA, 13 nt, Human adenovirus D
gaacuuucuccac

SEQ ID NO: 1564368 - RNA, 22 nt, Human adenovirus D
ugcccuuccacauccaagugcc

SEQ ID NO: 1564369 - RNA, 16 nt, Human adenovirus D
cgcgugacgcacuggc

SEQ ID NO: 1564370 - RNA, 14 nt, Human adenovirus D
ggaggcggugcgca

SEQ ID NO: 1564371 - RNA, 21 nt, Human adenovirus D
accgcaaugcgggccugcgcu

SEQ ID NO: 1564372 - RNA, 16 nt, Human adenovirus D
gccaugcgcaggcgcc

SEQ ID NO: 1564373 - RNA, 15 nt, Human adenovirus D
uagaagagcccccuc

SEQ ID NO: 1564374 - RNA, 16 nt, Human adenovirus D
acgguggugcagaaca

SEQ ID NO: 1564375 - RNA, 14 nt, Human adenovirus D
agaagaacgcacag

SEQ ID NO: 1564376 - RNA, 22 nt, Human adenovirus D
ggacuuuucuguugcauguucu

SEQ ID NO: 1564377 - RNA, 18 nt, Human adenovirus D
gaccgaguucagcuccag

SEQ ID NO: 1564378 - RNA, 16 nt, Human adenovirus D
caucgcgcaggaggcc

SEQ ID NO: 1564379 - RNA, 15 nt, Human adenovirus D
gcgcgcaugaccacc

SEQ ID NO: 1564380 - RNA, 12 nt, Human adenovirus D
aaacuaaagcca

SEQ ID NO: 1564381 - RNA, 15 nt, Human adenovirus D
aagacccacagccag

SEQ ID NO: 1564382 - RNA, 12 nt, Human adenovirus D
uccacugcuccu

SEQ ID NO: 1564383 - RNA, 15 nt, Human adenovirus D
gcuggcgaucgugaa

SEQ ID NO: 1564384 - RNA, 19 nt, Human adenovirus D
ugcccaacggcaugcuaca

SEQ ID NO: 1564385 - RNA, 21 nt, Human adenovirus D
cggggcgggggugaugagcug

SEQ ID NO: 1564386 - RNA, 20 nt, Human adenovirus D
guggaaacagacagccaggu

SEQ ID NO: 1564387 - RNA, 15 nt, Human adenovirus D
ggaugcggagccgcu

SEQ ID NO: 1564388 - RNA, 18 nt, Human adenovirus D
ucucagaugucaaagagg

SEQ ID NO: 1564389 - RNA, 13 nt, Human adenovirus D
cuggcucccagcc

SEQ ID NO: 1564390 - RNA, 18 nt, Human adenovirus D
ccaaacuauugcuuccca

SEQ ID NO: 1564391 - RNA, 16 nt, Human adenovirus D
caccuguggagggcau

SEQ ID NO: 1564392 - RNA, 18 nt, Human adenovirus D
acaauaauugaacugccu

SEQ ID NO: 1564393 - RNA, 17 nt, Human adenovirus D
auguugauuaaaaacca

SEQ ID NO: 1564394 - RNA, 22 nt, Human adenovirus D
auggacgagaacccgaggagcg

SEQ ID NO: 1564395 - RNA, 17 nt, Human adenovirus D
cggccguagcaggcgcc

SEQ ID NO: 1564396 - RNA, 20 nt, Human adenovirus D
ggcgccuucaauuggagcag

SEQ ID NO: 1564397 - RNA, 17 nt, Human adenovirus D
ccgcuaucugcucuucc

SEQ ID NO: 1564398 - RNA, 13 nt, Human adenovirus D
acgcugcccgcca

SEQ ID NO: 1564399 - RNA, 17 nt, Human adenovirus D
cucaccaaggccauagc

SEQ ID NO: 1564400 - RNA, 16 nt, Human adenovirus D
gacggacuugauuggc

SEQ ID NO: 1564401 - RNA, 22 nt, Human adenovirus D
aucaacaucuugcagagcaucg

SEQ ID NO: 1564402 - RNA, 16 nt, Human adenovirus D
uggaggaagugcugga

SEQ ID NO: 1564403 - RNA, 17 nt, Human adenovirus D
ccgcgauguugagcugg

SEQ ID NO: 1564404 - RNA, 16 nt, Human adenovirus D
uggaggagcagccgcg

SEQ ID NO: 1564405 - RNA, 15 nt, Human adenovirus D
agaucaggggaugua

SEQ ID NO: 1564406 - RNA, 21 nt, Human adenovirus D
cagccgcaggcgcccagccag

SEQ ID NO: 1564407 - RNA, 17 nt, Human adenovirus D
ggcgggcagggagcugc

SEQ ID NO: 1564408 - RNA, 15 nt, Human adenovirus D
gaagccguggcgcag

SEQ ID NO: 1564409 - RNA, 17 nt, Human adenovirus D
cgauccugacgcgccag

SEQ ID NO: 1564410 - RNA, 13 nt, Human adenovirus D
ggggaagauggag

SEQ ID NO: 1564411 - RNA, 16 nt, Human adenovirus D
ccgcaggccaacagac

SEQ ID NO: 1564412 - RNA, 16 nt, Human adenovirus D
cgagucgucgcagccg

SEQ ID NO: 1564413 - RNA, 14 nt, Human adenovirus D
cugccuccaccacc

SEQ ID NO: 1564414 - RNA, 20 nt, Human adenovirus D
gacgcugagcgacgaccugg

SEQ ID NO: 1564415 - RNA, 15 nt, Human adenovirus D
ccgucggccaugggc

SEQ ID NO: 1564416 - RNA, 15 nt, Human adenovirus D
ccuggugauggccug

SEQ ID NO: 1564417 - RNA, 22 nt, Human adenovirus D
ggcuuuuccugaugcaggaggg

SEQ ID NO: 1564418 - RNA, 14 nt, Human adenovirus D
aguaaguuccuguc

SEQ ID NO: 1564419 - RNA, 19 nt, Human adenovirus D
cccugcccgagggcaacuu

SEQ ID NO: 1564420 - RNA, 19 nt, Human adenovirus D
acuuacuugaaaucugaaa

SEQ ID NO: 1564421 - RNA, 14 nt, Human adenovirus D
ccgagccucccagg

SEQ ID NO: 1564422 - RNA, 17 nt, Human adenovirus D
caguuugggcacugggg

SEQ ID NO: 1564423 - RNA, 17 nt, Human adenovirus D
cgcggaucucacggccu

SEQ ID NO: 1564424 - RNA, 19 nt, Human adenovirus D
cagccggcgaacgugccgc

SEQ ID NO: 1564425 - RNA, 20 nt, Human adenovirus D
acaguauugugggccuggga

SEQ ID NO: 1564426 - RNA, 13 nt, Human adenovirus D
cagcacugcaaau

SEQ ID NO: 1564427 - RNA, 23 nt, Human adenovirus D
ggucggaagacccaagagcgaga

SEQ ID NO: 1564428 - RNA, 18 nt, Human adenovirus D
auccccgucuccugccgc

SEQ ID NO: 1564429 - RNA, 18 nt, Human adenovirus D
ugacaauucagagccagg

SEQ ID NO: 1564430 - RNA, 14 nt, Human adenovirus D
ugauuaaaaaccaa

SEQ ID NO: 1564431 - RNA, 22 nt, Human adenovirus D
gacccaguggcgagaggcgagc

SEQ ID NO: 1564432 - RNA, 17 nt, Human adenovirus D
ugaguccgucggccaug

SEQ ID NO: 1564433 - RNA, 16 nt, Human adenovirus D
ggucgacggugagcag

SEQ ID NO: 1564434 - RNA, 13 nt, Human adenovirus D
uggcccugggccu

SEQ ID NO: 1564435 - RNA, 19 nt, Human adenovirus D
auggugcccaagcgccggc

SEQ ID NO: 1564436 - RNA, 14 nt, Human adenovirus D
cgcguacauccagc

SEQ ID NO: 1564437 - RNA, 11 nt, Human adenovirus D
gacagaagaag

SEQ ID NO: 1564438 - RNA, 20 nt, Human adenovirus D
ggccacgugcgagggguagc

SEQ ID NO: 1564439 - RNA, 17 nt, Human adenovirus D
ccagcuggccgcccuga

SEQ ID NO: 1564440 - RNA, 21 nt, Human adenovirus D
ugcugcuccaccaccugcagc

SEQ ID NO: 1564441 - RNA, 19 nt, Human adenovirus D
acgagcaagacgcaggcca

SEQ ID NO: 1564442 - RNA, 14 nt, Human adenovirus D
acgaggcagaggca

SEQ ID NO: 1564443 - RNA, 13 nt, Human adenovirus D
augaauuccauga

SEQ ID NO: 1564444 - RNA, 22 nt, Human adenovirus D
gaccucgccgucuacucccagc

SEQ ID NO: 1564445 - RNA, 17 nt, Human adenovirus D
cccaggcggugcugcug

SEQ ID NO: 1564446 - RNA, 14 nt, Human adenovirus D
augacucaugggcg

SEQ ID NO: 1564447 - RNA, 21 nt, Human adenovirus D
acuaccugcaucgcgcggcgu

SEQ ID NO: 1564448 - RNA, 18 nt, Human adenovirus D
caugcccuuuucccagga

SEQ ID NO: 1564449 - RNA, 11 nt, Human adenovirus D
aacccugguga

SEQ ID NO: 1564450 - RNA, 18 nt, Human adenovirus D
ugcugaaacaccugcagc

SEQ ID NO: 1564451 - RNA, 22 nt, Human adenovirus D
agcagggugggcaaaaagaaac

SEQ ID NO: 1564452 - RNA, 14 nt, Human adenovirus D
cacccaccacaguu

SEQ ID NO: 1564453 - RNA, 18 nt, Human adenovirus D
ccgagucgucgcagccgc

SEQ ID NO: 1564454 - RNA, 13 nt, Human adenovirus D
aacgcccugcugg

SEQ ID NO: 1564455 - RNA, 14 nt, Human adenovirus D
ccaccacgcgcauc

SEQ ID NO: 1564456 - RNA, 13 nt, Human adenovirus D
gcgcggggccacg

SEQ ID NO: 1564457 - RNA, 13 nt, Human adenovirus D
gcgaggggccaag

SEQ ID NO: 1564458 - RNA, 20 nt, Human adenovirus D
cgcgaccgcggccguagcag

SEQ ID NO: 1564459 - RNA, 14 nt, Human adenovirus D
ccagugcuuccagc

SEQ ID NO: 1564460 - RNA, 17 nt, Human adenovirus D
gucuccaacgccugcgc

SEQ ID NO: 1564461 - RNA, 20 nt, Human adenovirus D
auacagaugguagcagcaga

SEQ ID NO: 1564462 - RNA, 16 nt, Human adenovirus D
ccugggccugaugcac

SEQ ID NO: 1564463 - RNA, 17 nt, Human adenovirus D
cgagccauugaccacca

SEQ ID NO: 1564464 - RNA, 11 nt, Human adenovirus D
aucgccaggcc

SEQ ID NO: 1564465 - RNA, 16 nt, Human adenovirus D
gcugagaccagaccac

SEQ ID NO: 1564466 - RNA, 14 nt, Human adenovirus D
cguaagcaggagca

SEQ ID NO: 1564467 - RNA, 17 nt, Human adenovirus D
ccuugucguacuucugc

SEQ ID NO: 1564468 - RNA, 22 nt, Human adenovirus D
gccaucaacauccaccagugca

SEQ ID NO: 1564469 - RNA, 20 nt, Human adenovirus D
ugccccaggcggugcugcug

SEQ ID NO: 1564470 - RNA, 22 nt, Human adenovirus D
cuccggaggcaucggaacccuc

SEQ ID NO: 1564471 - RNA, 10 nt, Human adenovirus D
uuuccucugu

SEQ ID NO: 1564472 - RNA, 21 nt, Human adenovirus D
ucguugugcgccgcgcugggg

SEQ ID NO: 1564473 - RNA, 19 nt, Human adenovirus D
gagcuggacaagcuucuug

SEQ ID NO: 1564474 - RNA, 18 nt, Human adenovirus D
ccaacagccuucagcauc

SEQ ID NO: 1564475 - RNA, 14 nt, Human adenovirus D
gggacgugagcgcg

SEQ ID NO: 1564476 - RNA, 20 nt, Human adenovirus D
agaacugcuggcccugcugg

SEQ ID NO: 1564477 - RNA, 18 nt, Human adenovirus D
ggccucgagcuacaugcc

SEQ ID NO: 1564478 - RNA, 14 nt, Human adenovirus D
cugcuucugccugg

SEQ ID NO: 1564479 - RNA, 23 nt, Human adenovirus D
cgagcuacaugcccagcagcagc

SEQ ID NO: 1564480 - RNA, 19 nt, Human adenovirus D
ccccaggcccuggagcagc

SEQ ID NO: 1564481 - RNA, 19 nt, Human adenovirus D
cccuccccgacccccuucc

SEQ ID NO: 1564482 - RNA, 14 nt, Human adenovirus D
cgcgcccacccgga

SEQ ID NO: 1564483 - RNA, 12 nt, Human adenovirus D
caacuuccagcc

SEQ ID NO: 1564484 - RNA, 20 nt, Human adenovirus D
gcaaaaccuguucagggacc

SEQ ID NO: 1564485 - RNA, 14 nt, Human adenovirus D
ccgucacccagaaa

SEQ ID NO: 1564486 - RNA, 19 nt, Human adenovirus D
acgaugguuucccucgggc

SEQ ID NO: 1564487 - RNA, 20 nt, Human adenovirus D
gaaccugaaggagcuggaca

SEQ ID NO: 1564488 - RNA, 15 nt, Human adenovirus D
cugaaaaacagaaag

SEQ ID NO: 1564489 - RNA, 21 nt, Human adenovirus D
gguggaaacagacagccaggu

SEQ ID NO: 1564490 - RNA, 20 nt, Human adenovirus D
uccugggccacuacagcuga

SEQ ID NO: 1564491 - RNA, 13 nt, Human adenovirus D
uacaugcacugga

SEQ ID NO: 1564492 - RNA, 13 nt, Human adenovirus D
accagaccaccug

SEQ ID NO: 1564493 - RNA, 17 nt, Human adenovirus D
agcgugggacuggcaag

SEQ ID NO: 1564494 - RNA, 16 nt, Human adenovirus D
accgacaguggcagcg

SEQ ID NO: 1564495 - RNA, 14 nt, Human adenovirus D
cucuaucuucucuu

SEQ ID NO: 1564496 - RNA, 17 nt, Human adenovirus D
aucacucuuuccagcag

SEQ ID NO: 1564497 - RNA, 15 nt, Human adenovirus D
uggaagaagagcagc

SEQ ID NO: 1564498 - RNA, 14 nt, Human adenovirus D
aagcagguggcgcc

SEQ ID NO: 1564499 - RNA, 15 nt, Human adenovirus D
gguuccggccccgcg

SEQ ID NO: 1564500 - RNA, 19 nt, Human adenovirus D
augcccuuccgcgccaaga

SEQ ID NO: 1564501 - RNA, 23 nt, Human adenovirus D
uccugaaccacacggccagcagg

SEQ ID NO: 1564502 - RNA, 16 nt, Human adenovirus D
cggaguaccugagccg

SEQ ID NO: 1564503 - RNA, 20 nt, Human adenovirus D
uaaauauggccuggagcaga

SEQ ID NO: 1564504 - RNA, 14 nt, Human adenovirus D
aaccugcgcgggcu

SEQ ID NO: 1564505 - RNA, 13 nt, Human adenovirus D
ucccacuacaaca

SEQ ID NO: 1564506 - RNA, 17 nt, Human adenovirus D
gcaggagcaggaggagg

SEQ ID NO: 1564507 - RNA, 18 nt, Human adenovirus D
agcugcaaaaagucacuu

SEQ ID NO: 1564508 - RNA, 13 nt, Human adenovirus D
ucccaggacgaga

SEQ ID NO: 1564509 - RNA, 19 nt, Human adenovirus D
cgauccugacgcgccagcc

SEQ ID NO: 1564510 - RNA, 15 nt, Human adenovirus D
ccagugcuuccagca

SEQ ID NO: 1564511 - RNA, 15 nt, Human adenovirus D
ccggcgaccaccgcg

SEQ ID NO: 1564512 - RNA, 12 nt, Human adenovirus D
agcgcauccuga

SEQ ID NO: 1564513 - RNA, 12 nt, Human adenovirus D
auccacaaacua

SEQ ID NO: 1564514 - RNA, 15 nt, Human adenovirus D
caaggucgaggagac

SEQ ID NO: 1564515 - RNA, 15 nt, Human adenovirus D
gcgccugaggcagac

SEQ ID NO: 1564516 - RNA, 14 nt, Human adenovirus D
cagacaugcugcua

SEQ ID NO: 1564517 - RNA, 19 nt, Human adenovirus D
cgcagugagagaagcggug

SEQ ID NO: 1564518 - RNA, 23 nt, Human adenovirus D
aucugcccugauauccaguagga

SEQ ID NO: 1564519 - RNA, 16 nt, Human adenovirus D
ccuggcggaggccauc

SEQ ID NO: 1564520 - RNA, 19 nt, Human adenovirus D
ucaugaucuaccccuguuu

SEQ ID NO: 1564521 - RNA, 15 nt, Human adenovirus D
gcggagggugccaga

SEQ ID NO: 1564522 - RNA, 16 nt, Human adenovirus D
ggugaguugguggccg

SEQ ID NO: 1564523 - RNA, 21 nt, Human adenovirus D
cuuacucuauaacauuugaau

SEQ ID NO: 1564524 - RNA, 19 nt, Human adenovirus D
gggcagcgagagggcgcug

SEQ ID NO: 1564525 - RNA, 16 nt, Human adenovirus D
ccaaacgccagcccaa

SEQ ID NO: 1564526 - RNA, 17 nt, Human adenovirus D
cuugugguuuuaacagg

SEQ ID NO: 1564527 - RNA, 17 nt, Human adenovirus D
gccuggugaagggcaca

SEQ ID NO: 1564528 - RNA, 16 nt, Human adenovirus D
gccugaguggcggcuu

SEQ ID NO: 1564529 - RNA, 15 nt, Human adenovirus D
ugcgcgaccugggcu

SEQ ID NO: 1564530 - RNA, 16 nt, Human adenovirus D
accuggcggaggccau

SEQ ID NO: 1564531 - RNA, 14 nt, Human adenovirus D
ggggacgugagcgc

SEQ ID NO: 1564532 - RNA, 19 nt, Human adenovirus D
guuccaugaaucgcgggcg

SEQ ID NO: 1564533 - RNA, 13 nt, Human adenovirus D
ggggacgagcugc

SEQ ID NO: 1564534 - RNA, 12 nt, Human adenovirus D
cgagucucaccu

SEQ ID NO: 1564535 - RNA, 22 nt, Human adenovirus D
aaaaaucacucuuuccagcagc

SEQ ID NO: 1564536 - RNA, 15 nt, Human adenovirus D
gcugcugccgagccg

SEQ ID NO: 1564537 - RNA, 23 nt, Human adenovirus D
caaccgggugcuagacauggcca

SEQ ID NO: 1564538 - RNA, 18 nt, Human adenovirus D
ccaaucgcgcccgcagca

SEQ ID NO: 1564539 - RNA, 22 nt, Human adenovirus D
guaugacacgcgcacacuuugg

SEQ ID NO: 1564540 - RNA, 16 nt, Human adenovirus D
gccccgcgggcagggg

SEQ ID NO: 1564541 - RNA, 19 nt, Human adenovirus D
gcgccaaaugcgucccacc

SEQ ID NO: 1564542 - RNA, 17 nt, Human adenovirus D
aaaugcuaccugggagu

SEQ ID NO: 1564543 - RNA, 15 nt, Human adenovirus D
gcggacgcgcucccg

SEQ ID NO: 1564544 - RNA, 12 nt, Human adenovirus D
augccgcagugg

SEQ ID NO: 1564545 - RNA, 20 nt, Human adenovirus D
aguaugucccuggcauggua

SEQ ID NO: 1564546 - RNA, 21 nt, Human adenovirus D
gcggcgguuccggccccgcgg

SEQ ID NO: 1564547 - RNA, 23 nt, Human adenovirus D
agcgacacccccgcgugcagcug

SEQ ID NO: 1564548 - RNA, 13 nt, Human adenovirus D
gugaagcaauacc

SEQ ID NO: 1564549 - RNA, 15 nt, Human adenovirus D
uggccggugagacgc

SEQ ID NO: 1564550 - RNA, 20 nt, Human adenovirus D
ugcuucugggcaacggccgc

SEQ ID NO: 1564551 - RNA, 18 nt, Human adenovirus D
caaaagauacagaguaaa

SEQ ID NO: 1564552 - RNA, 15 nt, Human adenovirus D
gucaucacccucaga

SEQ ID NO: 1564553 - RNA, 21 nt, Human adenovirus D
aucacucuuuccagcagcagg

SEQ ID NO: 1564554 - RNA, 14 nt, Human adenovirus D
ggcaccagccagcu

SEQ ID NO: 1564555 - RNA, 13 nt, Human adenovirus D
ccuggucaucacc

SEQ ID NO: 1564556 - RNA, 12 nt, Human adenovirus D
cugcuccugcac

SEQ ID NO: 1564557 - RNA, 22 nt, Human adenovirus D
aacuaucaaaacgaccacagca

SEQ ID NO: 1564558 - RNA, 15 nt, Human adenovirus D
ccgugcgcaccaccg

SEQ ID NO: 1564559 - RNA, 21 nt, Human adenovirus D
cauugaccaccagggagcuga

SEQ ID NO: 1564560 - RNA, 20 nt, Human adenovirus D
cuggaugauguccuugagga

SEQ ID NO: 1564561 - RNA, 13 nt, Human adenovirus D
guggacgagcaga

SEQ ID NO: 1564562 - RNA, 16 nt, Human adenovirus D
guucucgcuggucaca

SEQ ID NO: 1564563 - RNA, 14 nt, Human adenovirus D
cgaggugcagaccg

SEQ ID NO: 1564564 - RNA, 18 nt, Human adenovirus D
uccccgcccagcgagagg

SEQ ID NO: 1564565 - RNA, 13 nt, Human adenovirus D
cagcacacucacu

SEQ ID NO: 1564566 - RNA, 18 nt, Human adenovirus D
gcgacgacgacauccugg

SEQ ID NO: 1564567 - RNA, 14 nt, Human adenovirus D
ccgacgcgcuccuc

SEQ ID NO: 1564568 - RNA, 18 nt, Human adenovirus D
agggguugaggggcggac

SEQ ID NO: 1564569 - RNA, 16 nt, Human adenovirus D
aacugaugaaaaagcu

SEQ ID NO: 1564570 - RNA, 23 nt, Human adenovirus D
ccuuccaguacucccggagcggg

SEQ ID NO: 1564571 - RNA, 15 nt, Human adenovirus D
cucaucggccagaca

SEQ ID NO: 1564572 - RNA, 20 nt, Human adenovirus D
ugcggcagcuuuuugagcuc

SEQ ID NO: 1564573 - RNA, 21 nt, Human adenovirus D
gucaggagcagcgccccgagg

SEQ ID NO: 1564574 - RNA, 22 nt, Human adenovirus D
gcgcacguucaggacaccgggg

SEQ ID NO: 1564575 - RNA, 16 nt, Human adenovirus D
gcagacacaccaggau

SEQ ID NO: 1564576 - RNA, 19 nt, Human adenovirus D
cugcccuccgcccugagcu

SEQ ID NO: 1564577 - RNA, 13 nt, Human adenovirus D
ucucgauccagca

SEQ ID NO: 1564578 - RNA, 15 nt, Human adenovirus D
cgagaccgugagcuc

SEQ ID NO: 1564579 - RNA, 18 nt, Human adenovirus D
cacgagaaccgccugggg

SEQ ID NO: 1564580 - RNA, 22 nt, Human adenovirus D
cuguacuuugucugcuguaaag

SEQ ID NO: 1564581 - RNA, 14 nt, Human adenovirus D
guucuugcaugccu

SEQ ID NO: 1564582 - RNA, 16 nt, Human adenovirus D
cgccggcggcgggcca

SEQ ID NO: 1564583 - RNA, 21 nt, Human adenovirus D
ggcagccgagccggcgcgccu

SEQ ID NO: 1564584 - RNA, 20 nt, Human adenovirus D
ccuugcagagcagcucuucg

SEQ ID NO: 1564585 - RNA, 22 nt, Human adenovirus D
ugcaagggugcgcuugagacuc

SEQ ID NO: 1564586 - RNA, 20 nt, Human adenovirus D
guucaagaacgagggccugg

SEQ ID NO: 1564587 - RNA, 21 nt, Human adenovirus D
gccucugcgugaagaccacug

SEQ ID NO: 1564588 - RNA, 17 nt, Human adenovirus D
cuuccguucuacccagc

SEQ ID NO: 1564589 - RNA, 23 nt, Human adenovirus D
ugacacagcaguccaugcccaac

SEQ ID NO: 1564590 - RNA, 20 nt, Human adenovirus D
ccaggcggcagagcgggcgg

SEQ ID NO: 1564591 - RNA, 22 nt, Human adenovirus D
agcgggaucaucgccugcuugc

SEQ ID NO: 1564592 - RNA, 20 nt, Human adenovirus D
caacucuuaaaucauuuaaa

SEQ ID NO: 1564593 - RNA, 14 nt, Human adenovirus D
cacucgcagugcac

SEQ ID NO: 1564594 - RNA, 21 nt, Human adenovirus D
aggugacaaagagccgcuccg

SEQ ID NO: 1564595 - RNA, 19 nt, Human adenovirus D
gagcuacaugcccagcagc

SEQ ID NO: 1564596 - RNA, 17 nt, Human adenovirus D
cgaagccguggcgcagc

SEQ ID NO: 1564597 - RNA, 20 nt, Human adenovirus D
gucuagaaccccacaggaug

SEQ ID NO: 1564598 - RNA, 16 nt, Human adenovirus D
cucuucuuccaugaca

SEQ ID NO: 1564599 - RNA, 21 nt, Human adenovirus D
ccuaggggaagauggaggagc

SEQ ID NO: 1564600 - RNA, 17 nt, Human adenovirus D
gggagcaauccuccagg

SEQ ID NO: 1564601 - RNA, 15 nt, Human adenovirus D
ugcgccaagggcagc

SEQ ID NO: 1564602 - RNA, 15 nt, Human adenovirus D
agaauauccccuucc

SEQ ID NO: 1564603 - RNA, 15 nt, Human adenovirus D
ccacacggccagcag

SEQ ID NO: 1564604 - RNA, 21 nt, Human adenovirus D
caggugacagcguuccccucc

SEQ ID NO: 1564605 - RNA, 22 nt, Human adenovirus D
uuugacaacccgccugccagga

SEQ ID NO: 1564606 - RNA, 23 nt, Human adenovirus D
ugggcugcggcuuuggcaaagac

SEQ ID NO: 1564607 - RNA, 16 nt, Human adenovirus D
uggguggccggcgcgc

SEQ ID NO: 1564608 - RNA, 19 nt, Human adenovirus D
ccacgucuucaaccgcuuc

SEQ ID NO: 1564609 - RNA, 22 nt, Human adenovirus D
gagcugaucucgcugccgcugg

SEQ ID NO: 1564610 - RNA, 22 nt, Human adenovirus D
cucgagcgcccauuccuggaga

SEQ ID NO: 1564611 - RNA, 18 nt, Human adenovirus D
ccaccuggugauggccug

SEQ ID NO: 1564612 - RNA, 20 nt, Human adenovirus D
ugaagauucuggaaauuaug

SEQ ID NO: 1564613 - RNA, 18 nt, Human adenovirus D
uguagguguuggcaaagc

SEQ ID NO: 1564614 - RNA, 21 nt, Human adenovirus D
gcaagggcgaccagcucuggg

SEQ ID NO: 1564615 - RNA, 19 nt, Human adenovirus D
ucuacgcguacauccagca

SEQ ID NO: 1564616 - RNA, 16 nt, Human adenovirus D
uaauuaugcuccuggg

SEQ ID NO: 1564617 - RNA, 16 nt, Human adenovirus D
caggccuccgagcagc

SEQ ID NO: 1564618 - RNA, 12 nt, Human adenovirus D
uccgcgcuccgu

SEQ ID NO: 1564619 - RNA, 18 nt, Human adenovirus D
cuccaguuuguggaggag

SEQ ID NO: 1564620 - RNA, 21 nt, Human adenovirus D
accgcaacucguaccuggguc

SEQ ID NO: 1564621 - RNA, 16 nt, Human adenovirus D
gcaggaguccaccgcu

SEQ ID NO: 1564622 - RNA, 15 nt, Human adenovirus D
aguagucaucaaaug

SEQ ID NO: 1564623 - RNA, 22 nt, Human adenovirus D
ccuuucacccggacguggugcu

SEQ ID NO: 1564624 - RNA, 18 nt, Human adenovirus D
acuaugaucccaacagcc

SEQ ID NO: 1564625 - RNA, 17 nt, Human adenovirus D
cgcugguagggggcgcc

SEQ ID NO: 1564626 - RNA, 22 nt, Human adenovirus D
uacuacuccugaucagaaacac

SEQ ID NO: 1564627 - RNA, 22 nt, Human adenovirus D
aacggcugcauccacugcuccu

SEQ ID NO: 1564628 - RNA, 11 nt, Human adenovirus D
ccguccucuga

SEQ ID NO: 1564629 - RNA, 22 nt, Human adenovirus D
caaccaugugcgcacccugauc

SEQ ID NO: 1564630 - RNA, 21 nt, Human adenovirus D
cagccgugaucccacagggca

SEQ ID NO: 1564631 - RNA, 15 nt, Human adenovirus D
aacgccaggcuggcc

SEQ ID NO: 1564632 - RNA, 23 nt, Human adenovirus D
gcuugguacccgcgacccccagg

SEQ ID NO: 1564633 - RNA, 16 nt, Human adenovirus D
cacugcuccugcgaaa

SEQ ID NO: 1564634 - RNA, 12 nt, Human adenovirus D
gacaaugaugga

SEQ ID NO: 1564635 - RNA, 19 nt, Human adenovirus D
augucgacgaagcgguggu

SEQ ID NO: 1564636 - RNA, 11 nt, Human adenovirus D
aacugcuggcc

SEQ ID NO: 1564637 - RNA, 12 nt, Human adenovirus D
aguucaggagcg

SEQ ID NO: 1564638 - RNA, 15 nt, Human adenovirus D
cgacguggacagcgc

SEQ ID NO: 1564639 - RNA, 12 nt, Human adenovirus D
gaagaagagaca

SEQ ID NO: 1564640 - RNA, 13 nt, Human adenovirus D
auuucuuccucug

SEQ ID NO: 1564641 - RNA, 14 nt, Human adenovirus D
ucuguccaaccccg

SEQ ID NO: 1564642 - RNA, 16 nt, Human adenovirus D
cagcccaaacuggggc

SEQ ID NO: 1564643 - RNA, 15 nt, Human adenovirus D
gaggcuauuaagaag

SEQ ID NO: 1564644 - RNA, 22 nt, Human adenovirus D
gcuggcggagaacaaggccauc

SEQ ID NO: 1564645 - RNA, 19 nt, Human adenovirus D
acggugaaggggugggccc

SEQ ID NO: 1564646 - RNA, 23 nt, Human adenovirus D
uacggaccaccccaggcggacca

SEQ ID NO: 1564647 - RNA, 19 nt, Human adenovirus D
caaugucaggucugcuggu

SEQ ID NO: 1564648 - RNA, 16 nt, Human adenovirus D
gggagccagguccaga

SEQ ID NO: 1564649 - RNA, 22 nt, Human adenovirus D
cgagcaacccaaaaucgagcag

SEQ ID NO: 1564650 - RNA, 15 nt, Human adenovirus D
auaaauuuugacgag

SEQ ID NO: 1564651 - RNA, 15 nt, Human adenovirus D
caaggugcugacauc

SEQ ID NO: 1564652 - RNA, 14 nt, Human adenovirus D
cgcauguacuccuu

SEQ ID NO: 1564653 - RNA, 19 nt, Human adenovirus D
agcagcuugcgcgcuggcu

SEQ ID NO: 1564654 - RNA, 13 nt, Human adenovirus D
gcgcgaccugggc

SEQ ID NO: 1564655 - RNA, 15 nt, Human adenovirus D
aagagcccuuuuugc

SEQ ID NO: 1564656 - RNA, 23 nt, Human adenovirus D
gcuggucacauccaucuccacca

SEQ ID NO: 1564657 - RNA, 17 nt, Human adenovirus D
ucacucaaacuggcuga

SEQ ID NO: 1564658 - RNA, 15 nt, Human adenovirus D
uccagcgcggccagc

SEQ ID NO: 1564659 - RNA, 22 nt, Human adenovirus D
aaaauagucuauuuuugaggau

SEQ ID NO: 1564660 - RNA, 15 nt, Human adenovirus D
cguggugcuggauga

SEQ ID NO: 1564661 - RNA, 17 nt, Human adenovirus D
gcccugagccgccagcu

SEQ ID NO: 1564662 - RNA, 14 nt, Human adenovirus D
cacaggaggcacag

SEQ ID NO: 1564663 - RNA, 16 nt, Human adenovirus D
aguucagcuccagugg

SEQ ID NO: 1564664 - RNA, 23 nt, Human adenovirus D
cggcgaacgugccgcgcgggcag

SEQ ID NO: 1564665 - RNA, 13 nt, Human adenovirus D
ggagcgcauccug

SEQ ID NO: 1564666 - RNA, 18 nt, Human adenovirus D
gucauugauacccuggac

SEQ ID NO: 1564667 - RNA, 22 nt, Human adenovirus D
gccugccaggaugggccggagu

SEQ ID NO: 1564668 - RNA, 20 nt, Human adenovirus D
gcugcucaccaccccggacg

SEQ ID NO: 1564669 - RNA, 18 nt, Human adenovirus D
ccccagaaagaaguggcc

SEQ ID NO: 1564670 - RNA, 17 nt, Human adenovirus D
cccgagcucugcugcgc

SEQ ID NO: 1564671 - RNA, 20 nt, Human adenovirus D
uccaugcagacacuugagcu

SEQ ID NO: 1564672 - RNA, 14 nt, Human adenovirus D
cguuaguccagcag

SEQ ID NO: 1564673 - RNA, 13 nt, Human adenovirus D
cucaacagcuggg

SEQ ID NO: 1564674 - RNA, 20 nt, Human adenovirus D
gagcccgcgcgggagccagg

SEQ ID NO: 1564675 - RNA, 13 nt, Human adenovirus D
cugacccagcagg

SEQ ID NO: 1564676 - RNA, 13 nt, Human adenovirus D
gcuggggcugcuc

SEQ ID NO: 1564677 - RNA, 12 nt, Human adenovirus D
auugcuucccau

SEQ ID NO: 1564678 - RNA, 23 nt, Human adenovirus D
augccgaagaagaacaggagccg

SEQ ID NO: 1564679 - RNA, 19 nt, Human adenovirus D
gcgucagggcgaagguguc

SEQ ID NO: 1564680 - RNA, 18 nt, Human adenovirus D
gaagaaugggacagccag

SEQ ID NO: 1564681 - RNA, 16 nt, Human adenovirus D
ccgucugccccccgcc

SEQ ID NO: 1564682 - RNA, 15 nt, Human adenovirus D
ugccacucgcgggcg

SEQ ID NO: 1564683 - RNA, 21 nt, Human adenovirus D
gcucaacccgggucuccccca

SEQ ID NO: 1564684 - RNA, 15 nt, Human adenovirus D
ugagccgcgcgcugg

SEQ ID NO: 1564685 - RNA, 15 nt, Human adenovirus D
cagcgcgcugcggcu

SEQ ID NO: 1564686 - RNA, 19 nt, Human adenovirus D
caggcgcuggaagagguag

SEQ ID NO: 1564687 - RNA, 18 nt, Human adenovirus D
cagcugcagcgcacucuc

SEQ ID NO: 1564688 - RNA, 15 nt, Human adenovirus D
ccccuccgcugugcu

SEQ ID NO: 1564689 - RNA, 21 nt, Human adenovirus D
gggugaccagguccacgcugg

SEQ ID NO: 1564690 - RNA, 19 nt, Human adenovirus D
ccugacgcgccagccgcgg

SEQ ID NO: 1564691 - RNA, 14 nt, Human adenovirus D
ugaagcccugguuu

SEQ ID NO: 1564692 - RNA, 21 nt, Human adenovirus D
gcccuugcggacauacaaaaa

SEQ ID NO: 1564693 - RNA, 18 nt, Human adenovirus D
ugggcaaaaagaaacaag

SEQ ID NO: 1564694 - RNA, 19 nt, Human adenovirus D
caccguuccaugcagacac

SEQ ID NO: 1564695 - RNA, 20 nt, Human adenovirus D
gcggcggaugguggcgagga

SEQ ID NO: 1564696 - RNA, 19 nt, Human adenovirus D
agaaucuugccugcucgcg

SEQ ID NO: 1564697 - RNA, 16 nt, Human adenovirus D
gcauaauauggugaag

SEQ ID NO: 1564698 - RNA, 22 nt, Human adenovirus D
cggggcucggugcggcugcugc

SEQ ID NO: 1564699 - RNA, 21 nt, Human adenovirus D
agcagaagaucccggcgcagu

SEQ ID NO: 1564700 - RNA, 16 nt, Human adenovirus D
caggugcugccccagg

SEQ ID NO: 1564701 - RNA, 14 nt, Human adenovirus D
ccugcucaccugca

SEQ ID NO: 1564702 - RNA, 17 nt, Human adenovirus D
caucucgauccagcaga

SEQ ID NO: 1564703 - RNA, 15 nt, Human adenovirus D
guggcccugggccug

SEQ ID NO: 1564704 - RNA, 14 nt, Human adenovirus D
guccaccgcuccgc

SEQ ID NO: 1564705 - RNA, 15 nt, Human adenovirus D
uccgcgaacagcagc

SEQ ID NO: 1564706 - RNA, 20 nt, Human adenovirus D
cgacacccccgcgugcagcu

SEQ ID NO: 1564707 - RNA, 18 nt, Human adenovirus D
ggucagcgaugagcagcu

SEQ ID NO: 1564708 - RNA, 13 nt, Human adenovirus D
augaacaugaagu

SEQ ID NO: 1564709 - RNA, 18 nt, Human adenovirus D
cgcugcugccgcucaguc

SEQ ID NO: 1564710 - RNA, 13 nt, Human adenovirus D
aguaccugagccc

SEQ ID NO: 1564711 - RNA, 15 nt, Human adenovirus D
acuauugcuucccau

SEQ ID NO: 1564712 - RNA, 14 nt, Human adenovirus D
gccaugacagcgac

SEQ ID NO: 1564713 - RNA, 14 nt, Human adenovirus D
ccaggcggcagagc

SEQ ID NO: 1564714 - RNA, 16 nt, Human adenovirus D
agcaagacgcaggcca

SEQ ID NO: 1564715 - RNA, 15 nt, Human adenovirus D
caaagcgggaucauc

SEQ ID NO: 1564716 - RNA, 13 nt, Human adenovirus D
accagcacacuca

SEQ ID NO: 1564717 - RNA, 23 nt, Human adenovirus D
cgaccuugcaaaagcgccaggag

SEQ ID NO: 1564718 - RNA, 18 nt, Human adenovirus D
accacugcauggccucgu

SEQ ID NO: 1564719 - RNA, 20 nt, Human adenovirus D
uggagcaggcggcggucacc

SEQ ID NO: 1564720 - RNA, 15 nt, Human adenovirus D
cugcgcccgcgccgc

SEQ ID NO: 1564721 - RNA, 17 nt, Human adenovirus D
gcuugcuggaugcggag

SEQ ID NO: 1564722 - RNA, 13 nt, Human adenovirus D
cuacaucugcugc

SEQ ID NO: 1564723 - RNA, 15 nt, Human adenovirus D
ggcgcaaccaggagg

SEQ ID NO: 1564724 - RNA, 14 nt, Human adenovirus D
cagcccaugagcag

SEQ ID NO: 1564725 - RNA, 20 nt, Human adenovirus D
aggcguuuuugaggcggcgg

SEQ ID NO: 1564726 - RNA, 16 nt, Human adenovirus D
uuaaaggcuggcccuc

SEQ ID NO: 1564727 - RNA, 14 nt, Human adenovirus D
gcagcacuggaaca

SEQ ID NO: 1564728 - RNA, 20 nt, Human adenovirus D
uggaaagauucagggcaaaa

SEQ ID NO: 1564729 - RNA, 18 nt, Human adenovirus D
aggccaggcgcaggugga

SEQ ID NO: 1564730 - RNA, 15 nt, Human adenovirus D
gacgagcggccgccg

SEQ ID NO: 1564731 - RNA, 21 nt, Human adenovirus D
aggcucauaugaccaugcaga

SEQ ID NO: 1564732 - RNA, 19 nt, Human adenovirus D
cuuccguucuacccagcaa

SEQ ID NO: 1564733 - RNA, 18 nt, Human adenovirus D
ugcgcacccguccuccuc

SEQ ID NO: 1564734 - RNA, 19 nt, Human adenovirus D
gacgugcgcccggcguacg

SEQ ID NO: 1564735 - RNA, 15 nt, Human adenovirus D
auugcucuggccugc

SEQ ID NO: 1564736 - RNA, 23 nt, Human adenovirus D
cacaaguacugcgcgcucacucu

SEQ ID NO: 1564737 - RNA, 15 nt, Human adenovirus D
gggccgccgggccau

SEQ ID NO: 1564738 - RNA, 17 nt, Human adenovirus D
ccugcucaccugcaccu

SEQ ID NO: 1564739 - RNA, 11 nt, Human adenovirus D
cagccagaacc

SEQ ID NO: 1564740 - RNA, 13 nt, Human adenovirus D
gagccgccugagc

SEQ ID NO: 1564741 - RNA, 22 nt, Human adenovirus D
accccgccauaagggcggcgcu

SEQ ID NO: 1564742 - RNA, 11 nt, Human adenovirus D
ccccgccgggu

SEQ ID NO: 1564743 - RNA, 16 nt, Human adenovirus D
gccacaggugcugccc

SEQ ID NO: 1564744 - RNA, 17 nt, Human adenovirus D
gcugcaagguccgcagg

SEQ ID NO: 1564745 - RNA, 16 nt, Human adenovirus D
gaaagcaguucacuag

SEQ ID NO: 1564746 - RNA, 22 nt, Human adenovirus D
ugcacgagaaccgccuggggca

SEQ ID NO: 1564747 - RNA, 14 nt, Human adenovirus D
ggaucgccaggccu

SEQ ID NO: 1564748 - RNA, 11 nt, Human adenovirus D
gcuccugagcg

SEQ ID NO: 1564749 - RNA, 22 nt, Human adenovirus D
aguuucaacaaccaugugcgca

SEQ ID NO: 1564750 - RNA, 20 nt, Human adenovirus D
aaccagcacacucacuuuua

SEQ ID NO: 1564751 - RNA, 13 nt, Human adenovirus D
aauucucaaagug

SEQ ID NO: 1564752 - RNA, 15 nt, Human adenovirus D
aaggugaaaccagau

SEQ ID NO: 1564753 - RNA, 19 nt, Human adenovirus D
cucugguacuccagucucc

SEQ ID NO: 1564754 - RNA, 14 nt, Human adenovirus D
cagccuugccccca

SEQ ID NO: 1564755 - RNA, 23 nt, Human adenovirus D
cuaaacuaagguggcuauuuuca

SEQ ID NO: 1564756 - RNA, 19 nt, Human adenovirus D
cgaggucagcagcaagagc

SEQ ID NO: 1564757 - RNA, 16 nt, Human adenovirus D
cgcugcugcagccgcc

SEQ ID NO: 1564758 - RNA, 12 nt, Human adenovirus D
ccagcagcaggg

SEQ ID NO: 1564759 - RNA, 14 nt, Human adenovirus D
cagauccugcugcu

SEQ ID NO: 1564760 - RNA, 17 nt, Human adenovirus D
augcaaaaucuuacacu

SEQ ID NO: 1564761 - RNA, 14 nt, Human adenovirus D
cuaucugcucuucc

SEQ ID NO: 1564762 - RNA, 13 nt, Human adenovirus D
aggggacgugagc

SEQ ID NO: 1564763 - RNA, 20 nt, Human adenovirus D
ggcgugcgaguuggaggaga

SEQ ID NO: 1564764 - RNA, 19 nt, Human adenovirus D
gcuguaccgcagcugguac

SEQ ID NO: 1564765 - RNA, 17 nt, Human adenovirus D
ucaugcaacuuggaagg

SEQ ID NO: 1564766 - RNA, 23 nt, Human adenovirus D
cugcuugcaagacugcgggggga

SEQ ID NO: 1564767 - RNA, 13 nt, Human adenovirus D
ggcucagcugcca

SEQ ID NO: 1564768 - RNA, 17 nt, Human adenovirus D
cgcccgugggcgaccgg

SEQ ID NO: 1564769 - RNA, 16 nt, Human adenovirus D
ccggucaucucccggu

SEQ ID NO: 1564770 - RNA, 13 nt, Human adenovirus D
ugauuccacauau

SEQ ID NO: 1564771 - RNA, 21 nt, Human adenovirus D
cggggccuucgaaggggggcu

SEQ ID NO: 1564772 - RNA, 23 nt, Human adenovirus D
agccgucuggacccgcggccgcc

SEQ ID NO: 1564773 - RNA, 20 nt, Human adenovirus D
cagguccacgcugguggcca

SEQ ID NO: 1564774 - RNA, 17 nt, Human adenovirus D
ucaccgagccucccagg

SEQ ID NO: 1564775 - RNA, 12 nt, Human adenovirus D
caaaaagaaaca

SEQ ID NO: 1564776 - RNA, 15 nt, Human adenovirus D
cagauccugcugcuc

SEQ ID NO: 1564777 - RNA, 17 nt, Human adenovirus D
gagaucguccuucacuc

SEQ ID NO: 1564778 - RNA, 18 nt, Human adenovirus D
gugcccaacggcaugcua

SEQ ID NO: 1564779 - RNA, 14 nt, Human adenovirus D
ugcccaacaggccu

SEQ ID NO: 1564780 - RNA, 12 nt, Human adenovirus D
cagccuucagca

SEQ ID NO: 1564781 - RNA, 22 nt, Human adenovirus D
gcagcgucgacggggaaggcua

SEQ ID NO: 1564782 - RNA, 19 nt, Human adenovirus D
agccgcgcgcuggggcaga

SEQ ID NO: 1564783 - RNA, 15 nt, Human adenovirus D
gagcagcacagacac

SEQ ID NO: 1564784 - RNA, 15 nt, Human adenovirus D
ggagcugaccaacug

SEQ ID NO: 1564785 - RNA, 18 nt, Human adenovirus D
aguuccugauggaugugu

SEQ ID NO: 1564786 - RNA, 13 nt, Human adenovirus D
gaguggcggcccu

SEQ ID NO: 1564787 - RNA, 20 nt, Human adenovirus D
gacacguacuucagccuggg

SEQ ID NO: 1564788 - RNA, 17 nt, Human adenovirus D
cacugcaccccccgcag

SEQ ID NO: 1564789 - RNA, 13 nt, Human adenovirus D
acgcacgggccgc

SEQ ID NO: 1564790 - RNA, 16 nt, Human adenovirus D
agcugaucucgcugcc

SEQ ID NO: 1564791 - RNA, 18 nt, Human adenovirus D
gcgaccugggcugcgggc

SEQ ID NO: 1564792 - RNA, 19 nt, Human adenovirus D
acgcacgagaaggugcugg

SEQ ID NO: 1564793 - RNA, 23 nt, Human adenovirus D
acuacucggugcuuagccugggc

SEQ ID NO: 1564794 - RNA, 17 nt, Human adenovirus D
uggucggcacggucugg

SEQ ID NO: 1564795 - RNA, 15 nt, Human adenovirus D
gucgacggcgccucc

SEQ ID NO: 1564796 - RNA, 23 nt, Human adenovirus D
cagcagcaccucgguacccuccu

SEQ ID NO: 1564797 - RNA, 18 nt, Human adenovirus D
cgucacccugcccuucca

SEQ ID NO: 1564798 - RNA, 17 nt, Human adenovirus D
gggcuccgagaagaugc

SEQ ID NO: 1564799 - RNA, 13 nt, Human adenovirus D
auggccuggagca

SEQ ID NO: 1564800 - RNA, 23 nt, Human adenovirus D
gggccucggcggcguggcccuug

SEQ ID NO: 1564801 - RNA, 22 nt, Human adenovirus D
guggacaucgcgaaccaggcag

SEQ ID NO: 1564802 - RNA, 18 nt, Human adenovirus D
ggcaccuagaccacugcc

SEQ ID NO: 1564803 - RNA, 18 nt, Human adenovirus D
ccaccgagucucaccugg

SEQ ID NO: 1564804 - RNA, 12 nt, Human adenovirus D
uaucacaucuuu

SEQ ID NO: 1564805 - RNA, 14 nt, Human adenovirus D
aggggaugaacagu

SEQ ID NO: 1564806 - RNA, 17 nt, Human adenovirus D
cagguccgggggcaggg

SEQ ID NO: 1564807 - RNA, 18 nt, Human adenovirus D
gguuucucaacagcuggg

SEQ ID NO: 1564808 - RNA, 17 nt, Human adenovirus D
accgcuaccgcuuccac

SEQ ID NO: 1564809 - RNA, 18 nt, Human adenovirus D
gggaugucaaauuccugg

SEQ ID NO: 1564810 - RNA, 17 nt, Human adenovirus D
gaaacgucccagcagca

SEQ ID NO: 1564811 - RNA, 22 nt, Human adenovirus D
guggccaccucgccgcgcaggg

SEQ ID NO: 1564812 - RNA, 17 nt, Human adenovirus D
ucacccugcccuuccag

SEQ ID NO: 1564813 - RNA, 23 nt, Human adenovirus D
cugcagaccgggggacaaauaca

SEQ ID NO: 1564814 - RNA, 13 nt, Human adenovirus D
ccacgugaccauc

SEQ ID NO: 1564815 - RNA, 16 nt, Human adenovirus D
uaguugaggguggugg

SEQ ID NO: 1564816 - RNA, 16 nt, Human adenovirus D
gcagcagcaguagccc

SEQ ID NO: 1564817 - RNA, 17 nt, Human adenovirus D
gcgcgagguugagcucc

SEQ ID NO: 1564818 - RNA, 15 nt, Human adenovirus D
ccuugaccugccucc

SEQ ID NO: 1564819 - RNA, 14 nt, Human adenovirus D
aggguguccuggaa

SEQ ID NO: 1564820 - RNA, 21 nt, Human adenovirus D
ccagccuuuccauggccucgu

SEQ ID NO: 1564821 - RNA, 13 nt, Human adenovirus D
cucaccaaggcca

SEQ ID NO: 1564822 - RNA, 14 nt, Human adenovirus D
gaguggcggcccug

SEQ ID NO: 1564823 - RNA, 17 nt, Human adenovirus D
ucaaggacaugcagcug

SEQ ID NO: 1564824 - RNA, 14 nt, Human adenovirus D
gaacguagccagaa

SEQ ID NO: 1564825 - RNA, 17 nt, Human adenovirus D
ugcgcgagguugagcuc

SEQ ID NO: 1564826 - RNA, 23 nt, Human adenovirus D
gcucgagcgcccauuccuggaga

SEQ ID NO: 1564827 - RNA, 14 nt, Human adenovirus D
cacagccucucuga

SEQ ID NO: 1564828 - RNA, 17 nt, Human adenovirus D
ccauguuauucagcagc

SEQ ID NO: 1564829 - RNA, 20 nt, Human adenovirus D
cuaccugggaggagaggagg

SEQ ID NO: 1564830 - RNA, 19 nt, Human adenovirus D
gcgggccucacaguccagg

SEQ ID NO: 1564831 - RNA, 24 nt, Human adenovirus D
ugguagggggcgccgccggcggcg

SEQ ID NO: 1564832 - RNA, 21 nt, Human adenovirus D
cauccagcauaagaaucacau

SEQ ID NO: 1564833 - RNA, 22 nt, Human adenovirus D
gacaugaccgcgcgcaacaugg

SEQ ID NO: 1564834 - RNA, 13 nt, Human adenovirus D
cagagagauggcu

SEQ ID NO: 1564835 - RNA, 16 nt, Human adenovirus D
ugaccagacccaggcg

SEQ ID NO: 1564836 - RNA, 20 nt, Human adenovirus D
cacgguaagagcccagcaug

SEQ ID NO: 1564837 - RNA, 12 nt, Human adenovirus D
gaauaacaugcu

SEQ ID NO: 1564838 - RNA, 22 nt, Human adenovirus D
cgacaugggggcggaccugcau

SEQ ID NO: 1564839 - RNA, 14 nt, Human adenovirus D
agcagcaccucggu

SEQ ID NO: 1564840 - RNA, 13 nt, Human adenovirus D
agccguaccagug

SEQ ID NO: 1564841 - RNA, 21 nt, Human adenovirus D
gagccauugaccaccagggag

SEQ ID NO: 1564842 - RNA, 23 nt, Human adenovirus D
cugcacgagaaccgccuggggca

SEQ ID NO: 1564843 - RNA, 16 nt, Human adenovirus D
gcccacggugguggag

SEQ ID NO: 1564844 - RNA, 14 nt, Human adenovirus D
ugcuucugggcaac

SEQ ID NO: 1564845 - RNA, 21 nt, Human adenovirus D
gcagguuucucaacagcuggg

SEQ ID NO: 1564846 - RNA, 18 nt, Human adenovirus D
ucaugccacgaacagcca

SEQ ID NO: 1564847 - RNA, 22 nt, Human adenovirus D
gaugugcccaaguacuuggaaa

SEQ ID NO: 1564848 - RNA, 15 nt, Human adenovirus D
agacgagcggccgcc

SEQ ID NO: 1564849 - RNA, 19 nt, Human adenovirus D
cgcauccugaucucugcca

SEQ ID NO: 1564850 - RNA, 15 nt, Human adenovirus D
ggagauggaagaugc

SEQ ID NO: 1564851 - RNA, 23 nt, Human adenovirus D
aaagugcuggaggguugaaagau

SEQ ID NO: 1564852 - RNA, 19 nt, Human adenovirus D
aaaaacugcaugcuggaau

SEQ ID NO: 1564853 - RNA, 20 nt, Human adenovirus D
gcaagaccuaccaaugaaaa

SEQ ID NO: 1564854 - RNA, 17 nt, Human adenovirus D
ccuggugcgucgagcac

SEQ ID NO: 1564855 - RNA, 15 nt, Human adenovirus D
ucgcgcaggccgcug

SEQ ID NO: 1564856 - RNA, 12 nt, Human adenovirus D
cagggggguccg

SEQ ID NO: 1564857 - RNA, 16 nt, Human adenovirus D
ggaauccugcacgaga

SEQ ID NO: 1564858 - RNA, 17 nt, Human adenovirus D
cggugaaccugagccag

SEQ ID NO: 1564859 - RNA, 13 nt, Human adenovirus D
agccagaccaagc

SEQ ID NO: 1564860 - RNA, 20 nt, Human adenovirus D
ccgccaaggagcuccucgau

SEQ ID NO: 1564861 - RNA, 11 nt, Human adenovirus D
ucauucaaggc

SEQ ID NO: 1564862 - RNA, 17 nt, Human adenovirus D
gacacugguuuggaacu

SEQ ID NO: 1564863 - RNA, 16 nt, Human adenovirus D
cacucccagcgccgcg

SEQ ID NO: 1564864 - RNA, 13 nt, Human adenovirus D
gagcucugcugcg

SEQ ID NO: 1564865 - RNA, 18 nt, Human adenovirus D
gauuaaaaagcagcacag

SEQ ID NO: 1564866 - RNA, 19 nt, Human adenovirus D
gccccuucgaccguggacg

SEQ ID NO: 1564867 - RNA, 13 nt, Human adenovirus D
cuggucaaaaaca

SEQ ID NO: 1564868 - RNA, 14 nt, Human adenovirus D
ucuaaccuucuuuu

SEQ ID NO: 1564869 - RNA, 22 nt, Human adenovirus D
aggcacugcucuucccuggaga

SEQ ID NO: 1564870 - RNA, 18 nt, Human adenovirus D
caccugcgagcccaaccc

SEQ ID NO: 1564871 - RNA, 21 nt, Human adenovirus D
aagaaccugcgcgggcugugg

SEQ ID NO: 1564872 - RNA, 22 nt, Human adenovirus D
cagcgcccucagcagucucugc

SEQ ID NO: 1564873 - RNA, 14 nt, Human adenovirus D
cggagccucgcucc

SEQ ID NO: 1564874 - RNA, 19 nt, Human adenovirus D
gaaggaagcccagagcucg

SEQ ID NO: 1564875 - RNA, 18 nt, Human adenovirus D
cuucaccgaccuggguca

SEQ ID NO: 1564876 - RNA, 23 nt, Human adenovirus D
gcggagucuuccaugcgggugac

SEQ ID NO: 1564877 - RNA, 14 nt, Human adenovirus D
ugcccuuacaugua

SEQ ID NO: 1564878 - RNA, 20 nt, Human adenovirus D
gcauccugagauaugugcag

SEQ ID NO: 1564879 - RNA, 14 nt, Human adenovirus D
aggaaccaugaagg

SEQ ID NO: 1564880 - RNA, 14 nt, Human adenovirus D
agcucgcgggccau

SEQ ID NO: 1564881 - RNA, 21 nt, Human adenovirus D
uggcggcggccaaccugguga

SEQ ID NO: 1564882 - RNA, 16 nt, Human adenovirus D
gcagcguguucaaaac

SEQ ID NO: 1564883 - RNA, 15 nt, Human adenovirus D
caugcagacucugcu

SEQ ID NO: 1564884 - RNA, 23 nt, Human adenovirus D
ucgaccguggcuucgagcagugg

SEQ ID NO: 1564885 - RNA, 14 nt, Human adenovirus D
cuggaucgaaauca

SEQ ID NO: 1564886 - RNA, 15 nt, Human adenovirus D
gcagcgccccgagga

SEQ ID NO: 1564887 - RNA, 16 nt, Human adenovirus D
guacuucugccagcag

SEQ ID NO: 1564888 - RNA, 15 nt, Human adenovirus D
ccagauugggggacg

SEQ ID NO: 1564889 - RNA, 21 nt, Human adenovirus D
agauguggguuggcuugcaug

SEQ ID NO: 1564890 - RNA, 15 nt, Human adenovirus D
acugcuaccucuugc

SEQ ID NO: 1564891 - RNA, 22 nt, Human adenovirus D
gcaugaaggggacgagcugcuu

SEQ ID NO: 1564892 - RNA, 20 nt, Human adenovirus D
accccgaugacggguugcag

SEQ ID NO: 1564893 - RNA, 17 nt, Human adenovirus D
aggccgucacccugccc

SEQ ID NO: 1564894 - RNA, 16 nt, Human adenovirus D
ugcuuguaccacaaaa

SEQ ID NO: 1564895 - RNA, 21 nt, Human adenovirus D
cugcgccauugucaacacggc

SEQ ID NO: 1564896 - RNA, 21 nt, Human adenovirus D
ggggcgccgccggcggcgagg

SEQ ID NO: 1564897 - RNA, 20 nt, Human adenovirus D
gcugcaaccugugcucuccg

SEQ ID NO: 1564898 - RNA, 12 nt, Human adenovirus D
gucugagggcca

SEQ ID NO: 1564899 - RNA, 13 nt, Human adenovirus D
gccaagacaaagg

SEQ ID NO: 1564900 - RNA, 21 nt, Human adenovirus D
cccgcguaauuggcccuccac

SEQ ID NO: 1564901 - RNA, 20 nt, Human adenovirus D
cggcacggucuggccgguga

SEQ ID NO: 1564902 - RNA, 14 nt, Human adenovirus D
gcccuccacccugg

SEQ ID NO: 1564903 - RNA, 16 nt, Human adenovirus D
auguacaacaugcuga

SEQ ID NO: 1564904 - RNA, 20 nt, Human adenovirus D
ugagcucgucuuccaggagc

SEQ ID NO: 1564905 - RNA, 21 nt, Human adenovirus D
agggggacuuacuuugcaaga

SEQ ID NO: 1564906 - RNA, 17 nt, Human adenovirus D
gaagaccuacgcucagg

SEQ ID NO: 1564907 - RNA, 21 nt, Human adenovirus D
cguagaggcgggugagggcgu

SEQ ID NO: 1564908 - RNA, 18 nt, Human adenovirus D
caggcgccauucggagca

SEQ ID NO: 1564909 - RNA, 21 nt, Human adenovirus D
gucuccugccugggaauccug

SEQ ID NO: 1564910 - RNA, 19 nt, Human adenovirus D
gguccgcgugagggugguc

SEQ ID NO: 1564911 - RNA, 18 nt, Human adenovirus D
cacguuucgucaggcagg

SEQ ID NO: 1564912 - RNA, 22 nt, Human adenovirus D
gccgggguucuauacgggcgag

SEQ ID NO: 1564913 - RNA, 23 nt, Human adenovirus D
ggcaacauccccgcccugcugga

SEQ ID NO: 1564914 - RNA, 13 nt, Human adenovirus D
acagccagcagcu

SEQ ID NO: 1564915 - RNA, 14 nt, Human adenovirus D
gcaggcgcccagcc

SEQ ID NO: 1564916 - RNA, 21 nt, Human adenovirus D
gacuggguuaguaugucccug

SEQ ID NO: 1564917 - RNA, 16 nt, Human adenovirus D
ccuacgcgaccguggg

SEQ ID NO: 1564918 - RNA, 21 nt, Human adenovirus D
acuaauucucaaagugugaaa

SEQ ID NO: 1564919 - RNA, 23 nt, Human adenovirus D
caccuuccguucuacccagcaag

SEQ ID NO: 1564920 - RNA, 14 nt, Human adenovirus D
cuccugccugggaa

SEQ ID NO: 1564921 - RNA, 15 nt, Human adenovirus D
gacgccgaggcucug

SEQ ID NO: 1564922 - RNA, 15 nt, Human adenovirus D
gucauggcuggucag

SEQ ID NO: 1564923 - RNA, 18 nt, Human adenovirus D
gcccugcuggaugugccc

SEQ ID NO: 1564924 - RNA, 15 nt, Human adenovirus D
gccuggugaagggca

SEQ ID NO: 1564925 - RNA, 14 nt, Human adenovirus D
cccguccugcgcca

SEQ ID NO: 1564926 - RNA, 16 nt, Human adenovirus D
uggaccgcggucccag

SEQ ID NO: 1564927 - RNA, 13 nt, Human adenovirus D
uaaauaagucacu

SEQ ID NO: 1564928 - RNA, 18 nt, Human adenovirus D
aggccgugaaggccggca

SEQ ID NO: 1564929 - RNA, 15 nt, Human adenovirus D
cucugcaucugauga

SEQ ID NO: 1564930 - RNA, 16 nt, Human adenovirus D
cagaugguagcagcag

SEQ ID NO: 1564931 - RNA, 19 nt, Human adenovirus D
cucacaguaagugcagcac

SEQ ID NO: 1564932 - RNA, 21 nt, Human adenovirus D
agcucgucuuccaggagccug

SEQ ID NO: 1564933 - RNA, 19 nt, Human adenovirus D
cucguagaaauccacggcg

SEQ ID NO: 1564934 - RNA, 14 nt, Human adenovirus D
guaagugcagcaca

SEQ ID NO: 1564935 - RNA, 18 nt, Human adenovirus D
gccagcgcgugcugcgcg

SEQ ID NO: 1564936 - RNA, 23 nt, Human adenovirus D
gcccugcuggccgagcuggaagc

SEQ ID NO: 1564937 - RNA, 14 nt, Human adenovirus D
uacaacguggccca

SEQ ID NO: 1564938 - RNA, 20 nt, Human adenovirus D
cgaccucggaguaccugagc

SEQ ID NO: 1564939 - RNA, 22 nt, Human adenovirus D
ccgaaauuggugcgcuggggcu

SEQ ID NO: 1564940 - RNA, 20 nt, Human adenovirus D
ggucgaggagaccugcacua

SEQ ID NO: 1564941 - RNA, 18 nt, Human adenovirus D
gccaccucgccgcgcagg

SEQ ID NO: 1564942 - RNA, 13 nt, Human adenovirus D
ccugcucccgggc

SEQ ID NO: 1564943 - RNA, 23 nt, Human adenovirus D
ggugaggaucauaucccagggga

SEQ ID NO: 1564944 - RNA, 21 nt, Human adenovirus D
gacgcccuggccgaccggagc

SEQ ID NO: 1564945 - RNA, 19 nt, Human adenovirus D
cccccaggcccuggagcag

SEQ ID NO: 1564946 - RNA, 22 nt, Human adenovirus D
gcgcgaguagucaaucucccac

SEQ ID NO: 1564947 - RNA, 13 nt, Human adenovirus D
cugccccaggcgg

SEQ ID NO: 1564948 - RNA, 13 nt, Human adenovirus D
acccacaccgccu

SEQ ID NO: 1564949 - RNA, 17 nt, Human adenovirus D
caugccccaggccuggc

SEQ ID NO: 1564950 - RNA, 15 nt, Human adenovirus D
cgcccgccgccaggc

SEQ ID NO: 1564951 - RNA, 15 nt, Human adenovirus D
gcccgccgccaggcc

SEQ ID NO: 1564952 - RNA, 18 nt, Human adenovirus D
cauggcaagcugccaugg

SEQ ID NO: 1564953 - RNA, 13 nt, Human adenovirus D
ucucaacaucaca

SEQ ID NO: 1564954 - RNA, 14 nt, Human adenovirus D
cuuuccagcagcag

SEQ ID NO: 1564955 - RNA, 21 nt, Human adenovirus D
gcugcuagagugccacugccg

SEQ ID NO: 1564956 - RNA, 18 nt, Human adenovirus D
cacugccgccgccugcgc

SEQ ID NO: 1564957 - RNA, 18 nt, Human adenovirus D
ccgugcacuuggggaacu

SEQ ID NO: 1564958 - RNA, 17 nt, Human adenovirus D
gaaaacuuuaaugcucc

SEQ ID NO: 1564959 - RNA, 12 nt, Human adenovirus D
aucgccgagccc

SEQ ID NO: 1564960 - RNA, 17 nt, Human adenovirus D
gcucggucgggacgaga

SEQ ID NO: 1564961 - RNA, 15 nt, Human adenovirus D
ggucugcuccugcac

SEQ ID NO: 1564962 - RNA, 15 nt, Human adenovirus D
ucacucuggccgugg

SEQ ID NO: 1564963 - RNA, 16 nt, Human adenovirus D
gagccgaacgagcaga

SEQ ID NO: 1564964 - RNA, 17 nt, Human adenovirus D
gaaggcuuucacagcuu

SEQ ID NO: 1564965 - RNA, 20 nt, Human adenovirus D
cagcggccugaaccgccgcc

SEQ ID NO: 1564966 - RNA, 15 nt, Human adenovirus D
caacagccuucagca

SEQ ID NO: 1564967 - RNA, 18 nt, Human adenovirus D
acgcacgggccgccgggc

SEQ ID NO: 1564968 - RNA, 19 nt, Human adenovirus D
uugaauuuguauggaauaa

SEQ ID NO: 1564969 - RNA, 14 nt, Human adenovirus D
cguguucaaaacaa

SEQ ID NO: 1564970 - RNA, 15 nt, Human adenovirus D
agccucccaggaggc

SEQ ID NO: 1564971 - RNA, 15 nt, Human adenovirus D
cccaggcggugcugc

SEQ ID NO: 1564972 - RNA, 16 nt, Human adenovirus D
gucgcuggcugcugga

SEQ ID NO: 1564973 - RNA, 19 nt, Human adenovirus D
ccuauaaaaacaacaaaac

SEQ ID NO: 1564974 - RNA, 21 nt, Human adenovirus D
gcaguagccccucugugccca

SEQ ID NO: 1564975 - RNA, 18 nt, Human adenovirus D
cccaggcggugcugcugc

SEQ ID NO: 1564976 - RNA, 17 nt, Human adenovirus D
gcaggcgcuggaagagg

SEQ ID NO: 1564977 - RNA, 19 nt, Human adenovirus D
gcuagacauggccagcacg

SEQ ID NO: 1564978 - RNA, 16 nt, Human adenovirus D
cgcccgccgccaggcc

SEQ ID NO: 1564979 - RNA, 15 nt, Human adenovirus D
ucuggacccccagac

SEQ ID NO: 1564980 - RNA, 17 nt, Human adenovirus D
ucgauggugaagaugcc

SEQ ID NO: 1564981 - RNA, 14 nt, Human adenovirus D
gcuccguggggcgc

SEQ ID NO: 1564982 - RNA, 22 nt, Human adenovirus D
cagugcaacuuuagccagacca

SEQ ID NO: 1564983 - RNA, 22 nt, Human adenovirus D
aacagauccugcugcuccacca

SEQ ID NO: 1564984 - RNA, 22 nt, Human adenovirus D
cggcgcagcuguuccugguggu

SEQ ID NO: 1564985 - RNA, 18 nt, Human adenovirus D
gagguacaugggcaugag

SEQ ID NO: 1564986 - RNA, 15 nt, Human adenovirus D
ggugagggggucccg

SEQ ID NO: 1564987 - RNA, 23 nt, Human adenovirus D
aacugcgcguccgucagcagcag

SEQ ID NO: 1564988 - RNA, 19 nt, Human adenovirus D
cagaaggggcaccuuccag

SEQ ID NO: 1564989 - RNA, 23 nt, Human adenovirus D
gccgagcuggaagcccugagccg

SEQ ID NO: 1564990 - RNA, 17 nt, Human adenovirus D
cacucuuuccagcagca

SEQ ID NO: 1564991 - RNA, 17 nt, Human adenovirus D
cagaccgaccccuggcu

SEQ ID NO: 1564992 - RNA, 20 nt, Human adenovirus D
gcccgaguuguccugguagg

SEQ ID NO: 1564993 - RNA, 20 nt, Human adenovirus D
aacacacacgcccugggugu

SEQ ID NO: 1564994 - RNA, 20 nt, Human adenovirus D
cagcggcgcaagcucaugcu

SEQ ID NO: 1564995 - RNA, 16 nt, Human adenovirus D
ccgcgggaucaagcgc

SEQ ID NO: 1564996 - RNA, 22 nt, Human adenovirus D
caugccccaggccuggcccuga

SEQ ID NO: 1564997 - RNA, 13 nt, Human adenovirus D
gcgcaacugggcc

SEQ ID NO: 1564998 - RNA, 17 nt, Human adenovirus D
gcccaacggcaccugcg

SEQ ID NO: 1564999 - RNA, 21 nt, Human adenovirus D
ucaucgcgccacuggccacgg

SEQ ID NO: 1565000 - RNA, 15 nt, Human adenovirus D
ccugugggaccuggc

SEQ ID NO: 1565001 - RNA, 19 nt, Human adenovirus D
cggcaugaaauugcgggug

SEQ ID NO: 1565002 - RNA, 15 nt, Human adenovirus D
cauugucugccuggu

SEQ ID NO: 1565003 - RNA, 22 nt, Human adenovirus D
uggagggcaugggucaggcagc

SEQ ID NO: 1565004 - RNA, 16 nt, Human adenovirus D
cgccaccaugagcaag

SEQ ID NO: 1565005 - RNA, 23 nt, Human adenovirus D
ugcagaacccggacagcaagccu

SEQ ID NO: 1565006 - RNA, 16 nt, Human adenovirus D
gcgcaggcgcuggaag

SEQ ID NO: 1565007 - RNA, 22 nt, Human adenovirus D
gccgggccaugaugcgagccgc

SEQ ID NO: 1565008 - RNA, 16 nt, Human adenovirus D
cugcaaaaagucacuu

SEQ ID NO: 1565009 - RNA, 20 nt, Human adenovirus D
ccaggccuccgagcagcgca

SEQ ID NO: 1565010 - RNA, 14 nt, Human adenovirus D
ggaugaggaagagg

SEQ ID NO: 1565011 - RNA, 21 nt, Human adenovirus D
acugcaccccccgcaggcagg

SEQ ID NO: 1565012 - RNA, 15 nt, Human adenovirus D
gcucaggaccauagg

SEQ ID NO: 1565013 - RNA, 21 nt, Human adenovirus D
gagcaggguaaagccagcagc

SEQ ID NO: 1565014 - RNA, 16 nt, Human adenovirus D
ugucgccgauggccuc

SEQ ID NO: 1565015 - RNA, 17 nt, Human adenovirus D
cggccgaaaaccccgcc

SEQ ID NO: 1565016 - RNA, 17 nt, Human adenovirus D
uucaaaacucacuuugg

SEQ ID NO: 1565017 - RNA, 15 nt, Human adenovirus D
cgccggcucaucugc

SEQ ID NO: 1565018 - RNA, 20 nt, Human adenovirus D
cagagggggcgguggcagga

SEQ ID NO: 1565019 - RNA, 20 nt, Human adenovirus D
cauccuggaccaggcggcag

SEQ ID NO: 1565020 - RNA, 18 nt, Human adenovirus D
ccgggccugggcgugcag

SEQ ID NO: 1565021 - RNA, 20 nt, Human adenovirus D
ggagauuuacggaccacccc

SEQ ID NO: 1565022 - RNA, 20 nt, Human adenovirus D
gcgccggggccgcucgcucg

SEQ ID NO: 1565023 - RNA, 13 nt, Human adenovirus D
ggccgccgggcca

SEQ ID NO: 1565024 - RNA, 15 nt, Human adenovirus D
gaaaugcuaccuggg

SEQ ID NO: 1565025 - RNA, 14 nt, Human adenovirus D
cagcuacaccuccc

SEQ ID NO: 1565026 - RNA, 13 nt, Human adenovirus D
cgaggaggagcgc

SEQ ID NO: 1565027 - RNA, 15 nt, Human adenovirus D
aaagcugaggauggc

SEQ ID NO: 1565028 - RNA, 14 nt, Human adenovirus D
ccacgcgcucgaca

SEQ ID NO: 1565029 - RNA, 20 nt, Human adenovirus D
cuggacccgcggccgcccac

SEQ ID NO: 1565030 - RNA, 14 nt, Human adenovirus D
cgcgagcugaugcu

SEQ ID NO: 1565031 - RNA, 20 nt, Human adenovirus D
ggccaaucagcaguagcccc

SEQ ID NO: 1565032 - RNA, 14 nt, Human adenovirus D
aggagcaggaggag

SEQ ID NO: 1565033 - RNA, 21 nt, Human adenovirus D
gugcccaaguacuuggaaagc

SEQ ID NO: 1565034 - RNA, 15 nt, Human adenovirus D
ugcaguuggccauga

SEQ ID NO: 1565035 - RNA, 19 nt, Human adenovirus D
ccauggacaacgucaaccc

SEQ ID NO: 1565036 - RNA, 15 nt, Human adenovirus D
acugaaaauuugcaa

SEQ ID NO: 1565037 - RNA, 14 nt, Human adenovirus D
gugcugacauccau

SEQ ID NO: 1565038 - RNA, 22 nt, Human adenovirus D
cucucugaagcauaauauggug

SEQ ID NO: 1565039 - RNA, 17 nt, Human adenovirus D
gugcacucccaguucuu

SEQ ID NO: 1565040 - RNA, 23 nt, Human adenovirus D
ggcgaacgugccgcgcgggcagg

SEQ ID NO: 1565041 - RNA, 23 nt, Human adenovirus D
cccagcaauaacaccggcugggg

SEQ ID NO: 1565042 - RNA, 18 nt, Human adenovirus D
aaugcaggauccagcgcu

SEQ ID NO: 1565043 - RNA, 23 nt, Human adenovirus D
cucguacaaggcgcgcuucacuc

SEQ ID NO: 1565044 - RNA, 20 nt, Human adenovirus D
cccaacucgcggcugcugcu

SEQ ID NO: 1565045 - RNA, 19 nt, Human adenovirus D
cccggacgucaccugcggc

SEQ ID NO: 1565046 - RNA, 20 nt, Human adenovirus D
gagccgcuaguggaagagau

SEQ ID NO: 1565047 - RNA, 19 nt, Human adenovirus D
gagguacaugggcaugagc

SEQ ID NO: 1565048 - RNA, 13 nt, Human adenovirus D
cgcuguggagcca

SEQ ID NO: 1565049 - RNA, 13 nt, Human adenovirus D
uaguccagcagag

SEQ ID NO: 1565050 - RNA, 15 nt, Human adenovirus D
agaacggggugcagu

SEQ ID NO: 1565051 - RNA, 17 nt, Human adenovirus D
gcgguagagcggccagc

SEQ ID NO: 1565052 - RNA, 21 nt, Human adenovirus D
cgucacggugaaggggugggc

SEQ ID NO: 1565053 - RNA, 21 nt, Human adenovirus D
guucaaaacaacaagauucaa

SEQ ID NO: 1565054 - RNA, 18 nt, Human adenovirus D
caaugucaggucugcugg

SEQ ID NO: 1565055 - RNA, 15 nt, Human adenovirus D
ucgagagcgggcaug

SEQ ID NO: 1565056 - RNA, 12 nt, Human adenovirus D
gaucucugccau

SEQ ID NO: 1565057 - RNA, 14 nt, Human adenovirus D
gcucaaccucuucu

SEQ ID NO: 1565058 - RNA, 17 nt, Human adenovirus D
cagggcgaagguguccc

SEQ ID NO: 1565059 - RNA, 17 nt, Human adenovirus D
ccacgcugguggccacc

SEQ ID NO: 1565060 - RNA, 15 nt, Human adenovirus D
uucagccugggcaac

SEQ ID NO: 1565061 - RNA, 16 nt, Human adenovirus D
ggcgggcagggagcug

SEQ ID NO: 1565062 - RNA, 12 nt, Human adenovirus D
cucucagcacgg

SEQ ID NO: 1565063 - RNA, 21 nt, Human adenovirus D
gcacaguuggcgacccaggaa

SEQ ID NO: 1565064 - RNA, 13 nt, Human adenovirus D
caucgugcagaac

SEQ ID NO: 1565065 - RNA, 22 nt, Human adenovirus D
ggucugucauauccugaagaac

SEQ ID NO: 1565066 - RNA, 13 nt, Human adenovirus D
gcagucucugccg

SEQ ID NO: 1565067 - RNA, 22 nt, Human adenovirus D
ccagcugaacgggggcgccuuc

SEQ ID NO: 1565068 - RNA, 21 nt, Human adenovirus D
ccccucaucacaucagccagg

SEQ ID NO: 1565069 - RNA, 20 nt, Human adenovirus D
gcacccgcugcgggguacug

SEQ ID NO: 1565070 - RNA, 21 nt, Human adenovirus D
caacccgggucucccccagca

SEQ ID NO: 1565071 - RNA, 21 nt, Human adenovirus D
ccuacaaguacacgccggcca

SEQ ID NO: 1565072 - RNA, 16 nt, Human adenovirus D
cggcagcggggccugg

SEQ ID NO: 1565073 - RNA, 13 nt, Human adenovirus D
ccagcuggccgcc

SEQ ID NO: 1565074 - RNA, 20 nt, Human adenovirus D
agucacuaggaccccaggga

SEQ ID NO: 1565075 - RNA, 19 nt, Human adenovirus D
acgugcccaucuccauccc

SEQ ID NO: 1565076 - RNA, 21 nt, Human adenovirus D
ggaggagaccgacgcugggcu

SEQ ID NO: 1565077 - RNA, 23 nt, Human adenovirus D
cgcugggcucgagcauggcuacc

SEQ ID NO: 1565078 - RNA, 17 nt, Human adenovirus D
ucucugaaucucggcca

SEQ ID NO: 1565079 - RNA, 23 nt, Human adenovirus D
ugcuccaggucgucgccccggag

SEQ ID NO: 1565080 - RNA, 21 nt, Human adenovirus D
caccgagucucaccugguuag

SEQ ID NO: 1565081 - RNA, 18 nt, Human adenovirus D
aggcauauaaaaaugcag

SEQ ID NO: 1565082 - RNA, 18 nt, Human adenovirus D
gcagguggacgagcagac

SEQ ID NO: 1565083 - RNA, 19 nt, Human adenovirus D
gggugcuagacauggccag

SEQ ID NO: 1565084 - RNA, 21 nt, Human adenovirus D
uaugguacuaaugacagaggc

SEQ ID NO: 1565085 - RNA, 18 nt, Human adenovirus D
cagcccauuucacagugu

SEQ ID NO: 1565086 - RNA, 15 nt, Human adenovirus D
gcuaaucaugcccca

SEQ ID NO: 1565087 - RNA, 22 nt, Human adenovirus D
uggcggagaacaaggccauccg

SEQ ID NO: 1565088 - RNA, 15 nt, Human adenovirus D
ccagcaacccuuccu

SEQ ID NO: 1565089 - RNA, 15 nt, Human adenovirus D
cagcacagcagggac

SEQ ID NO: 1565090 - RNA, 17 nt, Human adenovirus D
guagcggggcacaggca

SEQ ID NO: 1565091 - RNA, 13 nt, Human adenovirus D
augaucccaacag

SEQ ID NO: 1565092 - RNA, 12 nt, Human adenovirus D
caauacucuggg

SEQ ID NO: 1565093 - RNA, 22 nt, Human adenovirus D
cgacgaguuggugagcucuuca

SEQ ID NO: 1565094 - RNA, 15 nt, Human adenovirus D
uucaaaaacuucccc

SEQ ID NO: 1565095 - RNA, 21 nt, Human adenovirus D
gugaacaaaacccaugaaaga

SEQ ID NO: 1565096 - RNA, 11 nt, Human adenovirus D
ucggagccccu

SEQ ID NO: 1565097 - RNA, 21 nt, Human adenovirus D
agcgcgcgucauggcugguca

SEQ ID NO: 1565098 - RNA, 19 nt, Human adenovirus D
ggaggcgaagauggggccc

SEQ ID NO: 1565099 - RNA, 22 nt, Human adenovirus D
auaucauaaagauggauggaaa

SEQ ID NO: 1565100 - RNA, 21 nt, Human adenovirus D
cgugaucccacagggcacugc

SEQ ID NO: 1565101 - RNA, 15 nt, Human adenovirus D
cgcccugcuggagcg

SEQ ID NO: 1565102 - RNA, 16 nt, Human adenovirus D
cacagcaguccaugcc

SEQ ID NO: 1565103 - RNA, 19 nt, Human adenovirus D
gaaucgcaagcgcccagag

SEQ ID NO: 1565104 - RNA, 20 nt, Human adenovirus D
cauaccugauauugcuuccc

SEQ ID NO: 1565105 - RNA, 23 nt, Human adenovirus D
ggcgaccggucgacggugagcag

SEQ ID NO: 1565106 - RNA, 17 nt, Human adenovirus D
gccgugagcgcgagccg

SEQ ID NO: 1565107 - RNA, 17 nt, Human adenovirus D
gcgugcuggagagcgau

SEQ ID NO: 1565108 - RNA, 17 nt, Human adenovirus D
guggcgccgggccuggg

SEQ ID NO: 1565109 - RNA, 17 nt, Human adenovirus D
caggcggugcugcugcc

SEQ ID NO: 1565110 - RNA, 20 nt, Human adenovirus D
gugggccccuggcugggcgc

SEQ ID NO: 1565111 - RNA, 22 nt, Human adenovirus D
cgggcggcgaacuuucuccaca

SEQ ID NO: 1565112 - RNA, 20 nt, Human adenovirus D
gacgucccagagcucgguga

SEQ ID NO: 1565113 - RNA, 14 nt, Human adenovirus D
gaaaaaauugagga

SEQ ID NO: 1565114 - RNA, 22 nt, Human adenovirus D
ucccgccgcaggagaggcaugg

SEQ ID NO: 1565115 - RNA, 15 nt, Human adenovirus D
cgucgcuugacagca

SEQ ID NO: 1565116 - RNA, 14 nt, Human adenovirus D
ccaugugcgcaccc

SEQ ID NO: 1565117 - RNA, 19 nt, Human adenovirus D
ugguggcgcgcaccucgcg

SEQ ID NO: 1565118 - RNA, 20 nt, Human adenovirus D
cugccgccggggcucggugc

SEQ ID NO: 1565119 - RNA, 15 nt, Human adenovirus D
agaaccugcgcgggc

SEQ ID NO: 1565120 - RNA, 14 nt, Human adenovirus D
ccggcggcagcggc

SEQ ID NO: 1565121 - RNA, 14 nt, Human adenovirus D
ccauuccuggagau

SEQ ID NO: 1565122 - RNA, 13 nt, Human adenovirus D
acagcacagcagg

SEQ ID NO: 1565123 - RNA, 14 nt, Human adenovirus D
cugagccugcgccg

SEQ ID NO: 1565124 - RNA, 16 nt, Human adenovirus D
uggugcgucgagcaca

SEQ ID NO: 1565125 - RNA, 17 nt, Human adenovirus D
cgcgggcggacugccac

SEQ ID NO: 1565126 - RNA, 21 nt, Human adenovirus D
agcugcaagguccgcaggagu

SEQ ID NO: 1565127 - RNA, 15 nt, Human adenovirus D
ugaaaucugaaagua

SEQ ID NO: 1565128 - RNA, 12 nt, Human adenovirus D
ccagccagcaaa

SEQ ID NO: 1565129 - RNA, 15 nt, Human adenovirus D
gacaccacagugcag

SEQ ID NO: 1565130 - RNA, 19 nt, Human adenovirus D
cagacggugaagcaggagc

SEQ ID NO: 1565131 - RNA, 13 nt, Human adenovirus D
uugcccgcgccac

SEQ ID NO: 1565132 - RNA, 15 nt, Human adenovirus D
gaugauaccaagaga

SEQ ID NO: 1565133 - RNA, 16 nt, Human adenovirus D
accucuacgccaccuu

SEQ ID NO: 1565134 - RNA, 20 nt, Human adenovirus D
ggagccgcuaguggaagaga

SEQ ID NO: 1565135 - RNA, 19 nt, Human adenovirus D
acucccagcgccgcgcugg

SEQ ID NO: 1565136 - RNA, 22 nt, Human adenovirus D
uccugucacucaaacuggcuga

SEQ ID NO: 1565137 - RNA, 16 nt, Human adenovirus D
agcccugcgcccagau

SEQ ID NO: 1565138 - RNA, 19 nt, Human adenovirus D
aucucccaccaccagccca

SEQ ID NO: 1565139 - RNA, 16 nt, Human adenovirus D
ccaagaucaggggaug

SEQ ID NO: 1565140 - RNA, 17 nt, Human adenovirus D
uggaaaaguggaagaag

SEQ ID NO: 1565141 - RNA, 19 nt, Human adenovirus D
aaguacuacugaacagaca

SEQ ID NO: 1565142 - RNA, 23 nt, Human adenovirus D
gcagcaccucgguacccuccucc

SEQ ID NO: 1565143 - RNA, 14 nt, Human adenovirus D
ucacaggaggcaca

SEQ ID NO: 1565144 - RNA, 20 nt, Human adenovirus D
ccugggcauucgcaagaagc

SEQ ID NO: 1565145 - RNA, 14 nt, Human adenovirus D
acgacucgcugcug

SEQ ID NO: 1565146 - RNA, 18 nt, Human adenovirus D
ccuucagcaucagucucc

SEQ ID NO: 1565147 - RNA, 16 nt, Human adenovirus D
aggcauucacauacac

SEQ ID NO: 1565148 - RNA, 19 nt, Human adenovirus D
ggcuuacaacagccuugcc

SEQ ID NO: 1565149 - RNA, 15 nt, Human adenovirus D
aucagacaugcugcu

SEQ ID NO: 1565150 - RNA, 13 nt, Human adenovirus D
gaucucgcugccg

SEQ ID NO: 1565151 - RNA, 22 nt, Human adenovirus D
auuaacuuuuguuuacuuugug

SEQ ID NO: 1565152 - RNA, 21 nt, Human adenovirus D
cauaauuaugcuccuggguga

SEQ ID NO: 1565153 - RNA, 18 nt, Human adenovirus D
gccuacuuuuugggcacc

SEQ ID NO: 1565154 - RNA, 14 nt, Human adenovirus D
cggcugcugcaaau

SEQ ID NO: 1565155 - RNA, 15 nt, Human adenovirus D
ccgucuacugcaucu

SEQ ID NO: 1565156 - RNA, 12 nt, Human adenovirus D
auaucagccagu

SEQ ID NO: 1565157 - RNA, 20 nt, Human adenovirus D
ucuuccuccguagccuggcg

SEQ ID NO: 1565158 - RNA, 14 nt, Human adenovirus D
uccaguaggaacca

SEQ ID NO: 1565159 - RNA, 24 nt, Human adenovirus D
caaaaaugaagcccugcuauggcu

SEQ ID NO: 1565160 - RNA, 18 nt, Human adenovirus D
auugcuucccuggaagag

SEQ ID NO: 1565161 - RNA, 23 nt, Human adenovirus D
ugaccgagcugacggccagucug

SEQ ID NO: 1565162 - RNA, 15 nt, Human adenovirus D
agcauauaccccucc

SEQ ID NO: 1565163 - RNA, 18 nt, Human adenovirus D
agccauugaccaccaggg

SEQ ID NO: 1565164 - RNA, 21 nt, Human adenovirus D
uguugcaugaugggaaugaga

SEQ ID NO: 1565165 - RNA, 16 nt, Human adenovirus D
aggacgaguaccugaa

SEQ ID NO: 1565166 - RNA, 23 nt, Human adenovirus D
gucgcuagacuugaaagcggccg

SEQ ID NO: 1565167 - RNA, 15 nt, Human adenovirus D
cugcugcagccgccg

SEQ ID NO: 1565168 - RNA, 20 nt, Human adenovirus D
cacccuggaagccaugcugc

SEQ ID NO: 1565169 - RNA, 17 nt, Human adenovirus D
acaccagacacaucucc

SEQ ID NO: 1565170 - RNA, 22 nt, Human adenovirus D
cagcacaacaacucgggcuuca

SEQ ID NO: 1565171 - RNA, 21 nt, Human adenovirus D
acgcagccggcgaacgugccg

SEQ ID NO: 1565172 - RNA, 15 nt, Human adenovirus D
gcaaacaauaaaaaa

SEQ ID NO: 1565173 - RNA, 23 nt, Human adenovirus D
ugucagaugguuuuccaaaauca

SEQ ID NO: 1565174 - RNA, 15 nt, Human adenovirus D
ucggagcuggcuccg

SEQ ID NO: 1565175 - RNA, 14 nt, Human adenovirus D
gaagcaucgccagg

SEQ ID NO: 1565176 - RNA, 22 nt, Human adenovirus D
gucacacuagcgcccugguaga

SEQ ID NO: 1565177 - RNA, 19 nt, Human adenovirus D
ggcgggggugaugagcugc

SEQ ID NO: 1565178 - RNA, 17 nt, Human adenovirus D
gacguggugcugcugcc

SEQ ID NO: 1565179 - RNA, 19 nt, Human adenovirus D
ugaccgaggagcugagacc

SEQ ID NO: 1565180 - RNA, 14 nt, Human adenovirus D
acucacgccggggu

SEQ ID NO: 1565181 - RNA, 16 nt, Human adenovirus D
ggaggagacugauggc

SEQ ID NO: 1565182 - RNA, 17 nt, Human adenovirus D
cagacacaucuccuaau

SEQ ID NO: 1565183 - RNA, 17 nt, Human adenovirus D
ggagucuugcagcuugg

SEQ ID NO: 1565184 - RNA, 20 nt, Human adenovirus D
agggcgcgcaguugggagcu

SEQ ID NO: 1565185 - RNA, 12 nt, Human adenovirus D
ugcuccagccaa

SEQ ID NO: 1565186 - RNA, 18 nt, Human adenovirus D
uggcccugacgacccgca

SEQ ID NO: 1565187 - RNA, 18 nt, Human adenovirus D
cccgagggcuacaaggac

SEQ ID NO: 1565188 - RNA, 14 nt, Human adenovirus D
gcccuugccaccua

SEQ ID NO: 1565189 - RNA, 21 nt, Human adenovirus D
cggccuacgagcagacgguga

SEQ ID NO: 1565190 - RNA, 18 nt, Human adenovirus D
caacuggucuccugccug

SEQ ID NO: 1565191 - RNA, 13 nt, Human adenovirus D
gagaccugcacua

SEQ ID NO: 1565192 - RNA, 13 nt, Human adenovirus D
agaaguuccucug

SEQ ID NO: 1565193 - RNA, 16 nt, Human adenovirus D
guccgugugauuaaaa

SEQ ID NO: 1565194 - RNA, 22 nt, Human adenovirus D
cccgagggucgcuggcugcugg

SEQ ID NO: 1565195 - RNA, 17 nt, Human adenovirus D
caaccccauagucauca

SEQ ID NO: 1565196 - RNA, 22 nt, Human adenovirus D
uccagcagcaggguacccacug

SEQ ID NO: 1565197 - RNA, 15 nt, Human adenovirus D
gcucgacgcuccgga

SEQ ID NO: 1565198 - RNA, 14 nt, Human adenovirus D
aagcugccaugggc

SEQ ID NO: 1565199 - RNA, 16 nt, Human adenovirus D
cugacacaccuggucc

SEQ ID NO: 1565200 - RNA, 20 nt, Human adenovirus D
gguccugcaagaggagacag

SEQ ID NO: 1565201 - RNA, 14 nt, Human adenovirus D
uuucacagcuugcg

SEQ ID NO: 1565202 - RNA, 19 nt, Human adenovirus D
cgaggagcaccccaacggc

SEQ ID NO: 1565203 - RNA, 12 nt, Human adenovirus D
cacgcgggugag

SEQ ID NO: 1565204 - RNA, 16 nt, Human adenovirus D
ucccacgccgagccug

SEQ ID NO: 1565205 - RNA, 18 nt, Human adenovirus D
ugaacgacucgcugcugc

SEQ ID NO: 1565206 - RNA, 12 nt, Human adenovirus D
acucgcugcugc

SEQ ID NO: 1565207 - RNA, 21 nt, Human adenovirus D
cgcgagggccuggaccgccag

SEQ ID NO: 1565208 - RNA, 15 nt, Human adenovirus D
uccacgagcgccagc

SEQ ID NO: 1565209 - RNA, 23 nt, Human adenovirus D
agcagguggcgccgggccugggc

SEQ ID NO: 1565210 - RNA, 12 nt, Human adenovirus D
cgucgcaucaug

SEQ ID NO: 1565211 - RNA, 23 nt, Human adenovirus D
ugggaugcugcccgccaccugca

SEQ ID NO: 1565212 - RNA, 22 nt, Human adenovirus D
uaacuaugaucccaacagccuu

SEQ ID NO: 1565213 - RNA, 17 nt, Human adenovirus D
ugauuuuuacaccagcg

SEQ ID NO: 1565214 - RNA, 15 nt, Human adenovirus D
uaaaaguaaacacua

SEQ ID NO: 1565215 - RNA, 20 nt, Human adenovirus D
cucgagcuacaugcccagca

SEQ ID NO: 1565216 - RNA, 18 nt, Human adenovirus D
ugcugacgggggugccca

SEQ ID NO: 1565217 - RNA, 21 nt, Human adenovirus D
ggggcagacacaccaggaugc

SEQ ID NO: 1565218 - RNA, 13 nt, Human adenovirus D
ugggacagccagc

SEQ ID NO: 1565219 - RNA, 14 nt, Human adenovirus D
cugaagcgccgccg

SEQ ID NO: 1565220 - RNA, 19 nt, Human adenovirus D
caucggcuaccagggcuuc

SEQ ID NO: 1565221 - RNA, 12 nt, Human adenovirus D
auggcaggcagc

SEQ ID NO: 1565222 - RNA, 22 nt, Human adenovirus D
gcgacacccccgcgugcagcug

SEQ ID NO: 1565223 - RNA, 17 nt, Human adenovirus D
acggcaucuuccugggg

SEQ ID NO: 1565224 - RNA, 18 nt, Human adenovirus D
cccaacuacguguugcau

SEQ ID NO: 1565225 - RNA, 15 nt, Human adenovirus D
cagaguaagaggagu

SEQ ID NO: 1565226 - RNA, 19 nt, Human adenovirus D
gcgccucaaugucagcugc

SEQ ID NO: 1565227 - RNA, 13 nt, Human adenovirus D
cugcgagaggagu

SEQ ID NO: 1565228 - RNA, 15 nt, Human adenovirus D
uccuggaccaggcgg

SEQ ID NO: 1565229 - RNA, 13 nt, Human adenovirus D
cauaaucaggcag

SEQ ID NO: 1565230 - RNA, 22 nt, Human adenovirus D
acguggugcugcugccgggcug

SEQ ID NO: 1565231 - RNA, 16 nt, Human adenovirus D
caccauccgcgccgca

SEQ ID NO: 1565232 - RNA, 18 nt, Human adenovirus D
aggaugugcugcugaaac

SEQ ID NO: 1565233 - RNA, 22 nt, Human adenovirus D
gucuggcacaucuuuuggaaga

SEQ ID NO: 1565234 - RNA, 15 nt, Human adenovirus D
cccuggagguuccgu

SEQ ID NO: 1565235 - RNA, 16 nt, Human adenovirus D
aacaucaccacaggca

SEQ ID NO: 1565236 - RNA, 20 nt, Human adenovirus D
gagcgcccauuccuggagau

SEQ ID NO: 1565237 - RNA, 15 nt, Human adenovirus D
ggaugcgugagggcg

SEQ ID NO: 1565238 - RNA, 21 nt, Human adenovirus D
auggcuaccugggaggagagg

SEQ ID NO: 1565239 - RNA, 19 nt, Human adenovirus D
gccaucaagaaccugcucc

SEQ ID NO: 1565240 - RNA, 17 nt, Human adenovirus D
aguaccugagccgcgag

SEQ ID NO: 1565241 - RNA, 14 nt, Human adenovirus D
aagcaucgcgcagg

SEQ ID NO: 1565242 - RNA, 15 nt, Human adenovirus D
gccgggguuguggac

SEQ ID NO: 1565243 - RNA, 14 nt, Human adenovirus D
gaacuggcagagca

SEQ ID NO: 1565244 - RNA, 13 nt, Human adenovirus D
gcuggacgagagc

SEQ ID NO: 1565245 - RNA, 19 nt, Human adenovirus D
gagcuggaagcccugagcc

SEQ ID NO: 1565246 - RNA, 14 nt, Human adenovirus D
cuucugggcaacgg

SEQ ID NO: 1565247 - RNA, 19 nt, Human adenovirus D
auagcuuccguugcgcugc

SEQ ID NO: 1565248 - RNA, 17 nt, Human adenovirus D
ccucuucucgccgcgcg

SEQ ID NO: 1565249 - RNA, 13 nt, Human adenovirus D
cucugcgcgcgcg

SEQ ID NO: 1565250 - RNA, 17 nt, Human adenovirus D
agcagcuugcgcgcugg

SEQ ID NO: 1565251 - RNA, 15 nt, Human adenovirus D
aggcgggugagggcg

SEQ ID NO: 1565252 - RNA, 17 nt, Human adenovirus D
gcagcgccccgaggaca

SEQ ID NO: 1565253 - RNA, 14 nt, Human adenovirus D
gaccaagcugcugu

SEQ ID NO: 1565254 - RNA, 19 nt, Human adenovirus D
agcgcauguacaacaugcu

SEQ ID NO: 1565255 - RNA, 22 nt, Human adenovirus D
gccacugcaccccccgcaggca

SEQ ID NO: 1565256 - RNA, 13 nt, Human adenovirus D
uggccccggggcg

SEQ ID NO: 1565257 - RNA, 21 nt, Human adenovirus D
gcgacccaugagcugcgagaa

SEQ ID NO: 1565258 - RNA, 20 nt, Human adenovirus D
ugcagacacuugagcuggcc

SEQ ID NO: 1565259 - RNA, 15 nt, Human adenovirus D
agcacugcaaauuua

SEQ ID NO: 1565260 - RNA, 16 nt, Human adenovirus D
ccugcuccugcucccg

SEQ ID NO: 1565261 - RNA, 18 nt, Human adenovirus D
cccccaagggcgcuccca

SEQ ID NO: 1565262 - RNA, 23 nt, Human adenovirus D
ccgaccuugcaaaagcgccagga

SEQ ID NO: 1565263 - RNA, 12 nt, Human adenovirus D
acccgccacccu

SEQ ID NO: 1565264 - RNA, 20 nt, Human adenovirus D
cuuuuuauauguugacaaua

SEQ ID NO: 1565265 - RNA, 19 nt, Human adenovirus D
cugaacgggggcgccuuca

SEQ ID NO: 1565266 - RNA, 13 nt, Human adenovirus D
acgaacagccacg

SEQ ID NO: 1565267 - RNA, 17 nt, Human adenovirus D
cccgugaccugcagcag

SEQ ID NO: 1565268 - RNA, 15 nt, Human adenovirus D
gcgaagaggagcuga

SEQ ID NO: 1565269 - RNA, 16 nt, Human adenovirus D
ugccgcgcgggcagga

SEQ ID NO: 1565270 - RNA, 14 nt, Human adenovirus D
guccuugccuuccu

SEQ ID NO: 1565271 - RNA, 13 nt, Human adenovirus D
cagggagccaggg

SEQ ID NO: 1565272 - RNA, 16 nt, Human adenovirus D
cucugaaaagucaucc

SEQ ID NO: 1565273 - RNA, 13 nt, Human adenovirus D
cggaggagccaag

SEQ ID NO: 1565274 - RNA, 20 nt, Human adenovirus D
aggaggcuauuaagaaguau

SEQ ID NO: 1565275 - RNA, 13 nt, Human adenovirus D
cggcgggggcgga

SEQ ID NO: 1565276 - RNA, 16 nt, Human adenovirus D
auguacuacaacagua

SEQ ID NO: 1565277 - RNA, 14 nt, Human adenovirus D
guuagagaugaggc

SEQ ID NO: 1565278 - RNA, 16 nt, Human adenovirus D
cacaggaggcacagac

SEQ ID NO: 1565279 - RNA, 10 nt, Human adenovirus D
acuacagccg

SEQ ID NO: 1565280 - RNA, 16 nt, Human adenovirus D
aagcgggccucacagu

SEQ ID NO: 1565281 - RNA, 15 nt, Human adenovirus D
gaugaguugggccug

SEQ ID NO: 1565282 - RNA, 14 nt, Human adenovirus D
ucgcggacggccgc

SEQ ID NO: 1565283 - RNA, 16 nt, Human adenovirus D
cagaugggccuggccg

SEQ ID NO: 1565284 - RNA, 15 nt, Human adenovirus D
ccugcacuuucuuug

SEQ ID NO: 1565285 - RNA, 14 nt, Human adenovirus D
gcuggucaggccuc

SEQ ID NO: 1565286 - RNA, 21 nt, Human adenovirus D
agcguagggcuuuuccugaug

SEQ ID NO: 1565287 - RNA, 15 nt, Human adenovirus D
aucgauggugaagau

SEQ ID NO: 1565288 - RNA, 19 nt, Human adenovirus D
gcuccgcccacaaucgggu

SEQ ID NO: 1565289 - RNA, 18 nt, Human adenovirus D
gugaugcuucaacagcug

SEQ ID NO: 1565290 - RNA, 20 nt, Human adenovirus D
gguuccucguccagaugcuc

SEQ ID NO: 1565291 - RNA, 19 nt, Human adenovirus D
gcccguagcugcgcggggc

SEQ ID NO: 1565292 - RNA, 14 nt, Human adenovirus D
cgcaccgcuccugg

SEQ ID NO: 1565293 - RNA, 18 nt, Human adenovirus D
uggucagcgaugagcagc

SEQ ID NO: 1565294 - RNA, 24 nt, Human adenovirus D
cccgcuugcuggaugcggagccgc

SEQ ID NO: 1565295 - RNA, 22 nt, Human adenovirus D
accccauccagguguagguuuc

SEQ ID NO: 1565296 - RNA, 19 nt, Human adenovirus D
cacugcucuucccuggaga

SEQ ID NO: 1565297 - RNA, 12 nt, Human adenovirus D
gagcgggacuug

SEQ ID NO: 1565298 - RNA, 16 nt, Human adenovirus D
cgcgguauauggcucc

SEQ ID NO: 1565299 - RNA, 14 nt, Human adenovirus D
uagcuacuuucaca

SEQ ID NO: 1565300 - RNA, 17 nt, Human adenovirus D
caccaugagcaaggaga

SEQ ID NO: 1565301 - RNA, 11 nt, Human adenovirus D
cagaaagaaau

SEQ ID NO: 1565302 - RNA, 17 nt, Human adenovirus D
ugcagggagccagggga

SEQ ID NO: 1565303 - RNA, 21 nt, Human adenovirus D
cggagcaagucuacuggucgc

SEQ ID NO: 1565304 - RNA, 19 nt, Human adenovirus D
caggagaggcauggcaggc

SEQ ID NO: 1565305 - RNA, 21 nt, Human adenovirus D
ucaaccucaccaaccagacug

SEQ ID NO: 1565306 - RNA, 13 nt, Human adenovirus D
agggacagcagcc

SEQ ID NO: 1565307 - RNA, 16 nt, Human adenovirus D
acucgcggcugcugcu

SEQ ID NO: 1565308 - RNA, 17 nt, Human adenovirus D
guacggcgacgacgaca

SEQ ID NO: 1565309 - RNA, 20 nt, Human adenovirus D
aggagccgcuaguggaagag

SEQ ID NO: 1565310 - RNA, 22 nt, Human adenovirus D
aaaugaagccguccucugaaaa

SEQ ID NO: 1565311 - RNA, 20 nt, Human adenovirus D
uggugcaguuugcccgcgcc

SEQ ID NO: 1565312 - RNA, 23 nt, Human adenovirus D
gacaagauaucauaaagauggau

SEQ ID NO: 1565313 - RNA, 21 nt, Human adenovirus D
caguggcgagaggcgagcagc

SEQ ID NO: 1565314 - RNA, 12 nt, Human adenovirus D
aacuaaagccaa

SEQ ID NO: 1565315 - RNA, 20 nt, Human adenovirus D
acacaugauggagcuuaucu

SEQ ID NO: 1565316 - RNA, 17 nt, Human adenovirus D
uggcuucuacagccagc

SEQ ID NO: 1565317 - RNA, 19 nt, Human adenovirus D
gcugcucgagcgcccauuc

SEQ ID NO: 1565318 - RNA, 19 nt, Human adenovirus D
aaaccccgccaaaaaaaca

SEQ ID NO: 1565319 - RNA, 16 nt, Human adenovirus D
gugggcguacaugcac

SEQ ID NO: 1565320 - RNA, 15 nt, Human adenovirus D
acuucagccugggca

SEQ ID NO: 1565321 - RNA, 13 nt, Human adenovirus D
cagccacagccac

SEQ ID NO: 1565322 - RNA, 19 nt, Human adenovirus D
cauguacccgaccaugcag

SEQ ID NO: 1565323 - RNA, 16 nt, Human adenovirus D
acgacccgcaaccccg

SEQ ID NO: 1565324 - RNA, 15 nt, Human adenovirus D
aucuuuaucugcugg

SEQ ID NO: 1565325 - RNA, 21 nt, Human adenovirus D
cccacuucgccuaccccgccg

SEQ ID NO: 1565326 - RNA, 12 nt, Human adenovirus D
ccacuuccuuua

SEQ ID NO: 1565327 - RNA, 16 nt, Human adenovirus D
gaaggcgcccaggccg

SEQ ID NO: 1565328 - RNA, 22 nt, Human adenovirus D
gaauaucagacaugcugcuaca

SEQ ID NO: 1565329 - RNA, 22 nt, Human adenovirus D
ccugaagaacauccaugugacc

SEQ ID NO: 1565330 - RNA, 15 nt, Human adenovirus D
acugaccaccaccug

SEQ ID NO: 1565331 - RNA, 16 nt, Human adenovirus D
accacccacaccgccu

SEQ ID NO: 1565332 - RNA, 15 nt, Human adenovirus D
acgucaccugcggcg

SEQ ID NO: 1565333 - RNA, 22 nt, Human adenovirus D
cuggaaacucuuggagcagggu

SEQ ID NO: 1565334 - RNA, 23 nt, Human adenovirus D
ugcagcacauaaucaccauguua

SEQ ID NO: 1565335 - RNA, 15 nt, Human adenovirus D
ggcgacgcagccggc

SEQ ID NO: 1565336 - RNA, 20 nt, Human adenovirus D
aggagaccgacgcugggcuc

SEQ ID NO: 1565337 - RNA, 23 nt, Human adenovirus D
agcacccaaaaacugcaugcugg

SEQ ID NO: 1565338 - RNA, 19 nt, Human adenovirus D
cugggcauagucgcgccgc

SEQ ID NO: 1565339 - RNA, 17 nt, Human adenovirus D
gcuggccgagcuggaag

SEQ ID NO: 1565340 - RNA, 14 nt, Human adenovirus D
uuaaaaagcagcac

SEQ ID NO: 1565341 - RNA, 17 nt, Human adenovirus D
caugccuucgugcacug

SEQ ID NO: 1565342 - RNA, 21 nt, Human adenovirus D
cguggggcgcuuacaagcgcg

SEQ ID NO: 1565343 - RNA, 13 nt, Human adenovirus D
aagcucccacagu

SEQ ID NO: 1565344 - RNA, 17 nt, Human adenovirus D
ccagcguaagcgcgcgg

SEQ ID NO: 1565345 - RNA, 20 nt, Human adenovirus D
caacuggucuccugccuggg

SEQ ID NO: 1565346 - RNA, 20 nt, Human adenovirus D
ccucuuugcccugcucaccu

SEQ ID NO: 1565347 - RNA, 19 nt, Human adenovirus D
cuguaggccauccccaucc

SEQ ID NO: 1565348 - RNA, 20 nt, Human adenovirus D
gcuccggcggauagcgcgcc

SEQ ID NO: 1565349 - RNA, 16 nt, Human adenovirus D
gcccgacuccgccgcc

SEQ ID NO: 1565350 - RNA, 18 nt, Human adenovirus D
caggugcugcccacccuc

SEQ ID NO: 1565351 - RNA, 21 nt, Human adenovirus D
uccguaaccaucgaaaccaga

SEQ ID NO: 1565352 - RNA, 16 nt, Human adenovirus D
cuagccagccacagcc

SEQ ID NO: 1565353 - RNA, 20 nt, Human adenovirus D
caagaucaggggauguaagu

SEQ ID NO: 1565354 - RNA, 15 nt, Human adenovirus D
cagcaagccccggac

SEQ ID NO: 1565355 - RNA, 14 nt, Human adenovirus D
cgguggggcgguga

SEQ ID NO: 1565356 - RNA, 13 nt, Human adenovirus D
cuccguccgcuuc

SEQ ID NO: 1565357 - RNA, 18 nt, Human adenovirus D
cuccccgacccccuucca

SEQ ID NO: 1565358 - RNA, 19 nt, Human adenovirus D
uggguuggcuugcaugaag

SEQ ID NO: 1565359 - RNA, 12 nt, Human adenovirus D
uugauuggccug

SEQ ID NO: 1565360 - RNA, 12 nt, Human adenovirus D
ucccuggcuccg

SEQ ID NO: 1565361 - RNA, 17 nt, Human adenovirus D
agaaccugaaggagcug

SEQ ID NO: 1565362 - RNA, 21 nt, Human adenovirus D
caugaaggggacgagcugcuu

SEQ ID NO: 1565363 - RNA, 20 nt, Human adenovirus D
gaaggggacgagcugcuugc

SEQ ID NO: 1565364 - RNA, 20 nt, Human adenovirus D
agagagguugaaaaggcagc

SEQ ID NO: 1565365 - RNA, 15 nt, Human adenovirus D
gagucgcggaugaag

SEQ ID NO: 1565366 - RNA, 15 nt, Human adenovirus D
gugcgucgagcacag

SEQ ID NO: 1565367 - RNA, 22 nt, Human adenovirus D
ucgaugaaagucaggagcagcg

SEQ ID NO: 1565368 - RNA, 22 nt, Human adenovirus D
uacaguuaagaauccacagauc

SEQ ID NO: 1565369 - RNA, 18 nt, Human adenovirus D
cuauugcuagcccuuccu

SEQ ID NO: 1565370 - RNA, 18 nt, Human adenovirus D
caggggcgucccgcgguc

SEQ ID NO: 1565371 - RNA, 17 nt, Human adenovirus D
gggccacuacagcugac

SEQ ID NO: 1565372 - RNA, 15 nt, Human adenovirus D
caguuaaugcugccu

SEQ ID NO: 1565373 - RNA, 11 nt, Human adenovirus D
ucucaaagugu

SEQ ID NO: 1565374 - RNA, 14 nt, Human adenovirus D
cgacagcagcacag

SEQ ID NO: 1565375 - RNA, 18 nt, Human adenovirus D
gcaccugcuacauguucg

SEQ ID NO: 1565376 - RNA, 16 nt, Human adenovirus D
ccgaagggcgagaagc

SEQ ID NO: 1565377 - RNA, 19 nt, Human adenovirus D
aaaaaucacucuuuccagc

SEQ ID NO: 1565378 - RNA, 21 nt, Human adenovirus D
gccaucggcacgaucccgggc

SEQ ID NO: 1565379 - RNA, 16 nt, Human adenovirus D
cagcuacaccucccuc

SEQ ID NO: 1565380 - RNA, 18 nt, Human adenovirus D
gagaaguuccucugcauc

SEQ ID NO: 1565381 - RNA, 12 nt, Human adenovirus D
aucucuagcaug

SEQ ID NO: 1565382 - RNA, 22 nt, Human adenovirus D
gagguccucggggcauugcagg

SEQ ID NO: 1565383 - RNA, 24 nt, Human adenovirus D
gcagcaguauccgcggaguccagc

SEQ ID NO: 1565384 - RNA, 13 nt, Human adenovirus D
ccauggcgcagua

SEQ ID NO: 1565385 - RNA, 18 nt, Human adenovirus D
cuacuuuuugggcaccca

SEQ ID NO: 1565386 - RNA, 23 nt, Human adenovirus D
auaugaccaugcagacucugcuc

SEQ ID NO: 1565387 - RNA, 13 nt, Human adenovirus D
ugcgcgaccuggg

SEQ ID NO: 1565388 - RNA, 21 nt, Human adenovirus D
aggaggacuuaaccacccacg

SEQ ID NO: 1565389 - RNA, 18 nt, Human adenovirus D
aauaugggagagaacaaa

SEQ ID NO: 1565390 - RNA, 17 nt, Human adenovirus D
caccuggugauggccug

SEQ ID NO: 1565391 - RNA, 15 nt, Human adenovirus D
ugcaagucacgcagg

SEQ ID NO: 1565392 - RNA, 21 nt, Human adenovirus D
ugaagauguaaccuugcaaga

SEQ ID NO: 1565393 - RNA, 13 nt, Human adenovirus D
uagggacagcagc

SEQ ID NO: 1565394 - RNA, 19 nt, Human adenovirus D
guugacaaauggagccaga

SEQ ID NO: 1565395 - RNA, 21 nt, Human adenovirus D
guagguauucccucucgagag

SEQ ID NO: 1565396 - RNA, 16 nt, Human adenovirus D
ccgcagccgcggcagc

SEQ ID NO: 1565397 - RNA, 15 nt, Human adenovirus D
ccggagcccacccgc

SEQ ID NO: 1565398 - RNA, 22 nt, Human adenovirus D
ccaccugcgcgagguugagcuc

SEQ ID NO: 1565399 - RNA, 20 nt, Human adenovirus D
aguaggacauggauuaaaaa

SEQ ID NO: 1565400 - RNA, 11 nt, Human adenovirus D
ggcgcccagcc

SEQ ID NO: 1565401 - RNA, 22 nt, Human adenovirus D
cggguauaaaaacccuggugau

SEQ ID NO: 1565402 - RNA, 14 nt, Human adenovirus D
acccgccucuccuu

SEQ ID NO: 1565403 - RNA, 14 nt, Human adenovirus D
cggaaacgccacca

SEQ ID NO: 1565404 - RNA, 18 nt, Human adenovirus D
cgcccugagagcgcuggc

SEQ ID NO: 1565405 - RNA, 20 nt, Human adenovirus D
cacuuccuuuaccuucuccu

SEQ ID NO: 1565406 - RNA, 19 nt, Human adenovirus D
aaaucacaucggacugggu

SEQ ID NO: 1565407 - RNA, 14 nt, Human adenovirus D
ggccgggcugcacg

SEQ ID NO: 1565408 - RNA, 16 nt, Human adenovirus D
guggcuguugauguga

SEQ ID NO: 1565409 - RNA, 17 nt, Human adenovirus D
gggcgaaggugucccug

SEQ ID NO: 1565410 - RNA, 19 nt, Human adenovirus D
gaacagcauauaccccucc

SEQ ID NO: 1565411 - RNA, 16 nt, Human adenovirus D
ggaauguuacugcaua

SEQ ID NO: 1565412 - RNA, 15 nt, Human adenovirus D
caaaacaacaagauu

SEQ ID NO: 1565413 - RNA, 18 nt, Human adenovirus D
ggccuccaggaauuccag

SEQ ID NO: 1565414 - RNA, 22 nt, Human adenovirus D
accagauccucugccguccgcc

SEQ ID NO: 1565415 - RNA, 17 nt, Human adenovirus D
ccugcgucaucacccag

SEQ ID NO: 1565416 - RNA, 17 nt, Human adenovirus D
gucaaguuugacagcag

SEQ ID NO: 1565417 - RNA, 13 nt, Human adenovirus D
ucugcugcgccgc

SEQ ID NO: 1565418 - RNA, 15 nt, Human adenovirus D
uagacauggccagca

SEQ ID NO: 1565419 - RNA, 15 nt, Human adenovirus D
ugaggguguccugga

SEQ ID NO: 1565420 - RNA, 15 nt, Human adenovirus D
cuaccaccccagcau

SEQ ID NO: 1565421 - RNA, 20 nt, Human adenovirus D
gcacaguauugugggccugg

SEQ ID NO: 1565422 - RNA, 23 nt, Human adenovirus D
guggucgacuugcaagacagaaa

SEQ ID NO: 1565423 - RNA, 20 nt, Human adenovirus D
gccgauuuaaagacccacag

SEQ ID NO: 1565424 - RNA, 19 nt, Human adenovirus D
cgaugaaagucaggagcag

SEQ ID NO: 1565425 - RNA, 14 nt, Human adenovirus D
ugccucuccaucag

SEQ ID NO: 1565426 - RNA, 17 nt, Human adenovirus D
uccuacggagggcagaa

SEQ ID NO: 1565427 - RNA, 19 nt, Human adenovirus D
ggcuggcgagacugggggc

SEQ ID NO: 1565428 - RNA, 19 nt, Human adenovirus D
gucagacccaguggcgaga

SEQ ID NO: 1565429 - RNA, 16 nt, Human adenovirus D
ugguggccaccucgcc

SEQ ID NO: 1565430 - RNA, 14 nt, Human adenovirus D
ccacuacucacacu

SEQ ID NO: 1565431 - RNA, 13 nt, Human adenovirus D
acguggugcugcu

SEQ ID NO: 1565432 - RNA, 14 nt, Human adenovirus D
gcccacccucaggc

SEQ ID NO: 1565433 - RNA, 18 nt, Human adenovirus D
ugcacgcgggugagggug

SEQ ID NO: 1565434 - RNA, 21 nt, Human adenovirus D
cagccuugauuuuuccagccc

SEQ ID NO: 1565435 - RNA, 20 nt, Human adenovirus D
agauggaagaagaaugggac

SEQ ID NO: 1565436 - RNA, 12 nt, Human adenovirus D
ccgugcgcaccc

SEQ ID NO: 1565437 - RNA, 20 nt, Human adenovirus D
cggacguggugcugcugccg

SEQ ID NO: 1565438 - RNA, 14 nt, Human adenovirus D
cgacucgcugcugc

SEQ ID NO: 1565439 - RNA, 16 nt, Human adenovirus D
ccuccgcauccaagaa

SEQ ID NO: 1565440 - RNA, 21 nt, Human adenovirus D
guacaacgcccugcuggagcg

SEQ ID NO: 1565441 - RNA, 16 nt, Human adenovirus D
ccuuguagggacagca

SEQ ID NO: 1565442 - RNA, 14 nt, Human adenovirus D
gaacgagggccugg

SEQ ID NO: 1565443 - RNA, 15 nt, Human adenovirus D
gugaguugguggccg

SEQ ID NO: 1565444 - RNA, 18 nt, Human adenovirus D
accgagccucccaggagg

SEQ ID NO: 1565445 - RNA, 18 nt, Human adenovirus D
cacagaccuucagggagu

SEQ ID NO: 1565446 - RNA, 16 nt, Human adenovirus D
cgaguggaacuuccgc

SEQ ID NO: 1565447 - RNA, 20 nt, Human adenovirus D
ucacucuuuccagcagcagg

SEQ ID NO: 1565448 - RNA, 12 nt, Human adenovirus D
gugcaaugucag

SEQ ID NO: 1565449 - RNA, 17 nt, Human adenovirus D
ggccguucaugggcacc

SEQ ID NO: 1565450 - RNA, 20 nt, Human adenovirus D
gcgccccgaggacacccggc

SEQ ID NO: 1565451 - RNA, 18 nt, Human adenovirus D
guuggcgacccaggaaug

SEQ ID NO: 1565452 - RNA, 17 nt, Human adenovirus D
auucaaaacucacuuug

SEQ ID NO: 1565453 - RNA, 18 nt, Human adenovirus D
aauuggaaaaguggaaga

SEQ ID NO: 1565454 - RNA, 19 nt, Human adenovirus D
cgcccagcgagaggagcuc

SEQ ID NO: 1565455 - RNA, 18 nt, Human adenovirus D
aggaaccccacgguggcc

SEQ ID NO: 1565456 - RNA, 22 nt, Human adenovirus D
gccaggccucuacccggacgag

SEQ ID NO: 1565457 - RNA, 16 nt, Human adenovirus D
gccguagcaggcgccg

SEQ ID NO: 1565458 - RNA, 16 nt, Human adenovirus D
ccaacucuuaaaucau

SEQ ID NO: 1565459 - RNA, 17 nt, Human adenovirus D
cucucuuugugucuccg

SEQ ID NO: 1565460 - RNA, 23 nt, Human adenovirus D
augucucgguguacaagauccug

SEQ ID NO: 1565461 - RNA, 17 nt, Human adenovirus D
ugagaauaacaugcuga

SEQ ID NO: 1565462 - RNA, 11 nt, Human adenovirus D
acuccacagcc

SEQ ID NO: 1565463 - RNA, 13 nt, Human adenovirus D
ugugaccacggac

SEQ ID NO: 1565464 - RNA, 18 nt, Human adenovirus D
cacacuuaguucagcugc

SEQ ID NO: 1565465 - RNA, 15 nt, Human adenovirus D
cgccgcggccaucuc

SEQ ID NO: 1565466 - RNA, 17 nt, Human adenovirus D
gccacgaccggcagcgg

SEQ ID NO: 1565467 - RNA, 22 nt, Human adenovirus D
ccagaugaggauugggaggagg

SEQ ID NO: 1565468 - RNA, 16 nt, Human adenovirus D
cggugcggcugcugca

SEQ ID NO: 1565469 - RNA, 17 nt, Human adenovirus D
ugccacugccaacauua

SEQ ID NO: 1565470 - RNA, 15 nt, Human adenovirus D
cgagggcgcgcaguu

SEQ ID NO: 1565471 - RNA, 13 nt, Human adenovirus D
aguuggaggagau

SEQ ID NO: 1565472 - RNA, 13 nt, Human adenovirus D
cagaguaagagga

SEQ ID NO: 1565473 - RNA, 17 nt, Human adenovirus D
accggggaggcaccacc

SEQ ID NO: 1565474 - RNA, 17 nt, Human adenovirus D
ucgcgguggggcgguga

SEQ ID NO: 1565475 - RNA, 15 nt, Human adenovirus D
gcuaccgcggcaccc

SEQ ID NO: 1565476 - RNA, 14 nt, Human adenovirus D
gcucccgggcuccu

SEQ ID NO: 1565477 - RNA, 17 nt, Human adenovirus D
accggaggcgugcacug

SEQ ID NO: 1565478 - RNA, 15 nt, Human adenovirus D
gccgcagcccggcgg

SEQ ID NO: 1565479 - RNA, 13 nt, Human adenovirus D
aggucuggggcgc

SEQ ID NO: 1565480 - RNA, 22 nt, Human adenovirus D
accaccgagucucaccugguua

SEQ ID NO: 1565481 - RNA, 21 nt, Human adenovirus D
cacaguuauaccaccuccucc

SEQ ID NO: 1565482 - RNA, 22 nt, Human adenovirus D
gcagcgacugacuacccacuga

SEQ ID NO: 1565483 - RNA, 15 nt, Human adenovirus D
gguggcgccgggccu

SEQ ID NO: 1565484 - RNA, 14 nt, Human adenovirus D
cagggagcugagga

SEQ ID NO: 1565485 - RNA, 15 nt, Human adenovirus D
gccauagcucagccc

SEQ ID NO: 1565486 - RNA, 14 nt, Human adenovirus D
ugcuccugggugag

SEQ ID NO: 1565487 - RNA, 12 nt, Human adenovirus D
gcgccgcccgag

SEQ ID NO: 1565488 - RNA, 14 nt, Human adenovirus D
aaccaaaaaaaaca

SEQ ID NO: 1565489 - RNA, 20 nt, Human adenovirus D
gaucucggcgcggcgggggc

SEQ ID NO: 1565490 - RNA, 20 nt, Human adenovirus D
ccagauguugcgcagcggca

SEQ ID NO: 1565491 - RNA, 16 nt, Human adenovirus D
ucgcgccacuggccac

SEQ ID NO: 1565492 - RNA, 16 nt, Human adenovirus D
cgcgcgguaggcccug

SEQ ID NO: 1565493 - RNA, 22 nt, Human adenovirus D
guggacauucagauccccaccg

SEQ ID NO: 1565494 - RNA, 17 nt, Human adenovirus D
aacuuaguuuaaaagua

SEQ ID NO: 1565495 - RNA, 18 nt, Human adenovirus D
cagcaccgcauccugauc

SEQ ID NO: 1565496 - RNA, 21 nt, Human adenovirus D
cggcugggguauuacuaggcc

SEQ ID NO: 1565497 - RNA, 15 nt, Human adenovirus D
ccugagagcgcuggc

SEQ ID NO: 1565498 - RNA, 13 nt, Human adenovirus D
ggcgcaaccagga

SEQ ID NO: 1565499 - RNA, 22 nt, Human adenovirus D
cucggccgacgauagcagcgug

SEQ ID NO: 1565500 - RNA, 13 nt, Human adenovirus D
caaacgccagccc

SEQ ID NO: 1565501 - RNA, 13 nt, Human adenovirus D
guguccagcuggc

SEQ ID NO: 1565502 - RNA, 15 nt, Human adenovirus D
cgaggcagaggcaca

SEQ ID NO: 1565503 - RNA, 13 nt, Human adenovirus D
cagcgaaagagag

SEQ ID NO: 1565504 - RNA, 21 nt, Human adenovirus D
gugcacuggcccgaccgaccc

SEQ ID NO: 1565505 - RNA, 19 nt, Human adenovirus D
uugaguuucccgaggagca

SEQ ID NO: 1565506 - RNA, 22 nt, Human adenovirus D
agcaguagccccucugugccca

SEQ ID NO: 1565507 - RNA, 17 nt, Human adenovirus D
gcagguggacgagcaga

SEQ ID NO: 1565508 - RNA, 22 nt, Human adenovirus D
ccaccaugcgccaagggcagcc

SEQ ID NO: 1565509 - RNA, 23 nt, Human adenovirus D
ugcggagccgcucggccaugccc

SEQ ID NO: 1565510 - RNA, 14 nt, Human adenovirus D
gggcgccuucaccg

SEQ ID NO: 1565511 - RNA, 16 nt, Human adenovirus D
gcacaguuggcgaccc

SEQ ID NO: 1565512 - RNA, 17 nt, Human adenovirus D
aacucgcggcugcugcu

SEQ ID NO: 1565513 - RNA, 14 nt, Human adenovirus D
gcuggccuuccacc

SEQ ID NO: 1565514 - RNA, 15 nt, Human adenovirus D
ggcgacaagcuggcc

SEQ ID NO: 1565515 - RNA, 18 nt, Human adenovirus D
cugagccgccagcuggcc

SEQ ID NO: 1565516 - RNA, 13 nt, Human adenovirus D
ccggcagcggugg

SEQ ID NO: 1565517 - RNA, 14 nt, Human adenovirus D
cguucuacccagca

SEQ ID NO: 1565518 - RNA, 20 nt, Human adenovirus D
augcaccugggcgccagaag

SEQ ID NO: 1565519 - RNA, 23 nt, Human adenovirus D
cagacgggcgaagugcucaaccc

SEQ ID NO: 1565520 - RNA, 16 nt, Human adenovirus D
uccaccucggugcagc

SEQ ID NO: 1565521 - RNA, 20 nt, Human adenovirus D
aguaugccaagauagcccug

SEQ ID NO: 1565522 - RNA, 16 nt, Human adenovirus D
ugggaagaagagacag

SEQ ID NO: 1565523 - RNA, 16 nt, Human adenovirus D
aucauaucccagggga

SEQ ID NO: 1565524 - RNA, 15 nt, Human adenovirus D
cgccgggccugggcg

SEQ ID NO: 1565525 - RNA, 19 nt, Human adenovirus D
guaacaucaccacaggcaa

SEQ ID NO: 1565526 - RNA, 21 nt, Human adenovirus D
ccugcuggccgagcuggaagc

SEQ ID NO: 1565527 - RNA, 20 nt, Human adenovirus D
caagugccacaugcaccugg

SEQ ID NO: 1565528 - RNA, 18 nt, Human adenovirus D
gaggcgagcagcuguuga

SEQ ID NO: 1565529 - RNA, 21 nt, Human adenovirus D
gcagccgcguaagcaggagca

SEQ ID NO: 1565530 - RNA, 18 nt, Human adenovirus D
acgggcugcuucugccug

SEQ ID NO: 1565531 - RNA, 21 nt, Human adenovirus D
uugccggcgacaagcuggccu

SEQ ID NO: 1565532 - RNA, 12 nt, Human adenovirus D
gcgggcuguggg

SEQ ID NO: 1565533 - RNA, 20 nt, Human adenovirus D
caggguacccacuggguggc

SEQ ID NO: 1565534 - RNA, 14 nt, Human adenovirus D
cuauuacugccacu

SEQ ID NO: 1565535 - RNA, 19 nt, Human adenovirus D
cuaaugacagaggcaacag

SEQ ID NO: 1565536 - RNA, 22 nt, Human adenovirus D
ccacagccuugauuuuuccagc

SEQ ID NO: 1565537 - RNA, 16 nt, Human adenovirus D
uucaugaccagcauga

SEQ ID NO: 1565538 - RNA, 16 nt, Human adenovirus D
uucaauaauggaagca

SEQ ID NO: 1565539 - RNA, 14 nt, Human adenovirus D
gcugggcguggugc

SEQ ID NO: 1565540 - RNA, 17 nt, Human adenovirus D
gaacgacucgcugcugc

SEQ ID NO: 1565541 - RNA, 17 nt, Human adenovirus D
augauggaacccacgug

SEQ ID NO: 1565542 - RNA, 19 nt, Human adenovirus D
cgcagccgcggcagccgca

SEQ ID NO: 1565543 - RNA, 18 nt, Human adenovirus D
uuuugaagucauguguga

SEQ ID NO: 1565544 - RNA, 16 nt, Human adenovirus D
ggcgacgcaccgggag

SEQ ID NO: 1565545 - RNA, 18 nt, Human adenovirus D
ggcggcuuucugcccgcg

SEQ ID NO: 1565546 - RNA, 21 nt, Human adenovirus D
gcauacagagauucagccaua

SEQ ID NO: 1565547 - RNA, 16 nt, Human adenovirus D
cccaaugcaacaugac

SEQ ID NO: 1565548 - RNA, 22 nt, Human adenovirus D
ggcucgguuguugaugaccugg

SEQ ID NO: 1565549 - RNA, 14 nt, Human adenovirus D
gcgccagccgcggu

SEQ ID NO: 1565550 - RNA, 15 nt, Human adenovirus D
aggaggacacuaaag

SEQ ID NO: 1565551 - RNA, 22 nt, Human adenovirus D
gcuccgguugugcagcccccuc

SEQ ID NO: 1565552 - RNA, 19 nt, Human adenovirus D
augaaggcuuucacagcuu

SEQ ID NO: 1565553 - RNA, 22 nt, Human adenovirus D
acagccgucuggacccgcggcc

SEQ ID NO: 1565554 - RNA, 16 nt, Human adenovirus D
ucgggccccggggcga

SEQ ID NO: 1565555 - RNA, 14 nt, Human adenovirus D
gccgaagggcgaga

SEQ ID NO: 1565556 - RNA, 15 nt, Human adenovirus D
acagacccaccccag

SEQ ID NO: 1565557 - RNA, 14 nt, Human adenovirus D
accccagacaccca

SEQ ID NO: 1565558 - RNA, 20 nt, Human adenovirus D
ccgcgagcugaugcugagcc

SEQ ID NO: 1565559 - RNA, 19 nt, Human adenovirus D
ggaauaaagaauaugccag

SEQ ID NO: 1565560 - RNA, 12 nt, Human adenovirus D
ggaauccugcac

SEQ ID NO: 1565561 - RNA, 13 nt, Human adenovirus D
aaacucagucacu

SEQ ID NO: 1565562 - RNA, 19 nt, Human adenovirus D
gacuuugucccgcugagcu

SEQ ID NO: 1565563 - RNA, 18 nt, Human adenovirus D
ggccaugaugcgagccgc

SEQ ID NO: 1565564 - RNA, 23 nt, Human adenovirus D
acgaccucgccgucuacucccag

SEQ ID NO: 1565565 - RNA, 16 nt, Human adenovirus D
gagaagcuuggcgaug

SEQ ID NO: 1565566 - RNA, 21 nt, Human adenovirus D
aaaaagcagcacaguaaguuc

SEQ ID NO: 1565567 - RNA, 22 nt, Human adenovirus D
cuuacauguccaguuacgccuc

SEQ ID NO: 1565568 - RNA, 13 nt, Human adenovirus D
cggcgcaggggca

SEQ ID NO: 1565569 - RNA, 21 nt, Human adenovirus D
ccacaggugcugcccacccuc

SEQ ID NO: 1565570 - RNA, 18 nt, Human adenovirus D
ucaaguuugacagcagaa

SEQ ID NO: 1565571 - RNA, 14 nt, Human adenovirus D
ugguggaggcgcgc

SEQ ID NO: 1565572 - RNA, 12 nt, Human adenovirus D
ucugugcugccu

SEQ ID NO: 1565573 - RNA, 24 nt, Human adenovirus D
ccuuaccugguacgagcuacagca

SEQ ID NO: 1565574 - RNA, 14 nt, Human adenovirus D
augaggagaaggaa

SEQ ID NO: 1565575 - RNA, 19 nt, Human adenovirus D
ggacgcugcucaccacccc

SEQ ID NO: 1565576 - RNA, 19 nt, Human adenovirus D
caacagccuucagcaucag

SEQ ID NO: 1565577 - RNA, 18 nt, Human adenovirus D
gugcuagacauggccagc

SEQ ID NO: 1565578 - RNA, 12 nt, Human adenovirus D
ccagcagcacau

SEQ ID NO: 1565579 - RNA, 15 nt, Human adenovirus D
uagcacggggcaguu

SEQ ID NO: 1565580 - RNA, 19 nt, Human adenovirus D
ccccgccgaggcuagcacg

SEQ ID NO: 1565581 - RNA, 20 nt, Human adenovirus D
aggggcugcuagagugccac

SEQ ID NO: 1565582 - RNA, 20 nt, Human adenovirus D
cucgcugaaaaacaggccgc

SEQ ID NO: 1565583 - RNA, 20 nt, Human adenovirus D
ccccuucaaccaccaccgca

SEQ ID NO: 1565584 - RNA, 17 nt, Human adenovirus D
acgaggaauuugaaaau

SEQ ID NO: 1565585 - RNA, 22 nt, Human adenovirus D
ucgcggcugcugcugcugcuga

SEQ ID NO: 1565586 - RNA, 11 nt, Human adenovirus D
aagggcggcgc

SEQ ID NO: 1565587 - RNA, 20 nt, Human adenovirus D
ggggaugaaccuuuggaccu

SEQ ID NO: 1565588 - RNA, 15 nt, Human adenovirus D
gagcuggaagcccug

SEQ ID NO: 1565589 - RNA, 21 nt, Human adenovirus D
aggcgaagauggggccccgcc

SEQ ID NO: 1565590 - RNA, 12 nt, Human adenovirus D
aggugcagaccg

SEQ ID NO: 1565591 - RNA, 20 nt, Human adenovirus D
aagcuaaugguccugcaaga

SEQ ID NO: 1565592 - RNA, 20 nt, Human adenovirus D
acuuauggcucagcugccau

SEQ ID NO: 1565593 - RNA, 20 nt, Human adenovirus D
cgcacgguaagagcccagca

SEQ ID NO: 1565594 - RNA, 14 nt, Human adenovirus D
agcgguucaagaac

SEQ ID NO: 1565595 - RNA, 15 nt, Human adenovirus D
gacuugauuggccug

SEQ ID NO: 1565596 - RNA, 15 nt, Human adenovirus D
gaggagguggcccug

SEQ ID NO: 1565597 - RNA, 16 nt, Human adenovirus D
ugugcaguuuggccug

SEQ ID NO: 1565598 - RNA, 13 nt, Human adenovirus D
cgucggaagagga

SEQ ID NO: 1565599 - RNA, 14 nt, Human adenovirus D
cggagggcagaaac

SEQ ID NO: 1565600 - RNA, 15 nt, Human adenovirus D
gcgcuugcaagggug

SEQ ID NO: 1565601 - RNA, 20 nt, Human adenovirus D
cugaccaauagacagcagaa

SEQ ID NO: 1565602 - RNA, 18 nt, Human adenovirus D
caugcccucucaacauca

SEQ ID NO: 1565603 - RNA, 23 nt, Human adenovirus D
cagcaaguuuaaggcgcggguga

SEQ ID NO: 1565604 - RNA, 12 nt, Human adenovirus D
caaauacauccu

SEQ ID NO: 1565605 - RNA, 21 nt, Human adenovirus D
agagggcgaagggcuggcgag

SEQ ID NO: 1565606 - RNA, 19 nt, Human adenovirus D
gaaagauuuaauuggcaaa

SEQ ID NO: 1565607 - RNA, 21 nt, Human adenovirus D
ggcgcugggcguggugcugga

SEQ ID NO: 1565608 - RNA, 18 nt, Human adenovirus D
ggccucgugcucuggggu

SEQ ID NO: 1565609 - RNA, 16 nt, Human adenovirus D
cguggacgcugcucac

SEQ ID NO: 1565610 - RNA, 20 nt, Human adenovirus D
gucaggcagcggggacagag

SEQ ID NO: 1565611 - RNA, 20 nt, Human adenovirus D
aagaggcuccggguggaaga

SEQ ID NO: 1565612 - RNA, 14 nt, Human adenovirus D
gauggaugugugga

SEQ ID NO: 1565613 - RNA, 13 nt, Human adenovirus D
cgccgccgcggcc

SEQ ID NO: 1565614 - RNA, 13 nt, Human adenovirus D
caccgccgcagcc

SEQ ID NO: 1565615 - RNA, 22 nt, Human adenovirus D
ccgagcuccgcgaacagcagca

SEQ ID NO: 1565616 - RNA, 15 nt, Human adenovirus D
acgcguacauccagc

SEQ ID NO: 1565617 - RNA, 13 nt, Human adenovirus D
caacucgggcuuc

SEQ ID NO: 1565618 - RNA, 13 nt, Human adenovirus D
cauuuuuccagcc

SEQ ID NO: 1565619 - RNA, 15 nt, Human adenovirus D
uaaagccacaaccag

SEQ ID NO: 1565620 - RNA, 22 nt, Human adenovirus D
gauccccgucuccugccgcgcc

SEQ ID NO: 1565621 - RNA, 18 nt, Human adenovirus D
acacuagaaagcaguuca

SEQ ID NO: 1565622 - RNA, 18 nt, Human adenovirus D
gggcgccuuccccggagc

SEQ ID NO: 1565623 - RNA, 15 nt, Human adenovirus D
gcacgcucugaggcu

SEQ ID NO: 1565624 - RNA, 14 nt, Human adenovirus D
cgccuggggcagac

SEQ ID NO: 1565625 - RNA, 22 nt, Human adenovirus D
auuaccucaucgccaccaugag

SEQ ID NO: 1565626 - RNA, 16 nt, Human adenovirus D
ggcggaugguggcgag

SEQ ID NO: 1565627 - RNA, 19 nt, Human adenovirus D
ccuucaacagaaccggagg

SEQ ID NO: 1565628 - RNA, 17 nt, Human adenovirus D
gcaagucuacuggucgc

SEQ ID NO: 1565629 - RNA, 19 nt, Human adenovirus D
auuacuaggcccagcagca

SEQ ID NO: 1565630 - RNA, 12 nt, Human adenovirus D
agauacuucagc

SEQ ID NO: 1565631 - RNA, 22 nt, Human adenovirus D
cugaaccacacggccagcaggg

SEQ ID NO: 1565632 - RNA, 15 nt, Human adenovirus D
gaagugcggcggcgg

SEQ ID NO: 1565633 - RNA, 19 nt, Human adenovirus D
augcaaaaucuuacacugu

SEQ ID NO: 1565634 - RNA, 21 nt, Human adenovirus D
uacacgggguugcagcacugg

SEQ ID NO: 1565635 - RNA, 11 nt, Human adenovirus D
agucaggagca

SEQ ID NO: 1565636 - RNA, 12 nt, Human adenovirus D
gagccauagagg

SEQ ID NO: 1565637 - RNA, 13 nt, Human adenovirus D
ccccagacaccca

SEQ ID NO: 1565638 - RNA, 22 nt, Human adenovirus D
uccaucgugcgcgaccugggcu

SEQ ID NO: 1565639 - RNA, 15 nt, Human adenovirus D
gagggaugcaugcgg

SEQ ID NO: 1565640 - RNA, 17 nt, Human adenovirus D
agaacgagggccugggc

SEQ ID NO: 1565641 - RNA, 17 nt, Human adenovirus D
cgcacccguccuccucg

SEQ ID NO: 1565642 - RNA, 20 nt, Human adenovirus D
cgccgacccguggccccggg

SEQ ID NO: 1565643 - RNA, 19 nt, Human adenovirus D
uccagcgcucguacccgcu

SEQ ID NO: 1565644 - RNA, 14 nt, Human adenovirus D
gacucgggagcaaa

SEQ ID NO: 1565645 - RNA, 23 nt, Human adenovirus D
cagguccacgcugguggccaccu

SEQ ID NO: 1565646 - RNA, 18 nt, Human adenovirus D
gcccgauagccgccagga

SEQ ID NO: 1565647 - RNA, 17 nt, Human adenovirus D
gcagaaggugguggacg

SEQ ID NO: 1565648 - RNA, 23 nt, Human adenovirus D
ugcagccgugaucccacagggca

SEQ ID NO: 1565649 - RNA, 22 nt, Human adenovirus D
ugacagcgacgagacuggccuc

SEQ ID NO: 1565650 - RNA, 18 nt, Human adenovirus D
cccucgggccccggggcg

SEQ ID NO: 1565651 - RNA, 15 nt, Human adenovirus D
cugggcacuggagca

SEQ ID NO: 1565652 - RNA, 22 nt, Human adenovirus D
cacgaccgugccgcggugcgcu

SEQ ID NO: 1565653 - RNA, 22 nt, Human adenovirus D
ggauucaaaaacuuccccccug

SEQ ID NO: 1565654 - RNA, 16 nt, Human adenovirus D
gccaggccuccgagca

SEQ ID NO: 1565655 - RNA, 19 nt, Human adenovirus D
cgcugcugccgcucaguca

SEQ ID NO: 1565656 - RNA, 14 nt, Human adenovirus D
auggaggagcagcc

SEQ ID NO: 1565657 - RNA, 20 nt, Human adenovirus D
uuggugggauaacagcgccc

SEQ ID NO: 1565658 - RNA, 20 nt, Human adenovirus D
cccacgaugugaccacggac

SEQ ID NO: 1565659 - RNA, 21 nt, Human adenovirus D
gcucguagggguugaggggcg

SEQ ID NO: 1565660 - RNA, 21 nt, Human adenovirus D
ggcaacaccugggcacuggag

SEQ ID NO: 1565661 - RNA, 15 nt, Human adenovirus D
uggggucucggggaa

SEQ ID NO: 1565662 - RNA, 16 nt, Human adenovirus D
cggccgcggcgagcgg

SEQ ID NO: 1565663 - RNA, 20 nt, Human adenovirus D
cgggugaggguguccuggaa

SEQ ID NO: 1565664 - RNA, 16 nt, Human adenovirus D
gcgcauccugcagccc

SEQ ID NO: 1565665 - RNA, 15 nt, Human adenovirus D
uacaugcccagcagc

SEQ ID NO: 1565666 - RNA, 19 nt, Human adenovirus D
gcucuuaagaaagacacaa

SEQ ID NO: 1565667 - RNA, 12 nt, Human adenovirus D
uggccgaccgga

SEQ ID NO: 1565668 - RNA, 16 nt, Human adenovirus D
cgaggccgggcuagug

SEQ ID NO: 1565669 - RNA, 12 nt, Human adenovirus D
cgagcaggaccu

SEQ ID NO: 1565670 - RNA, 14 nt, Human adenovirus D
ccggccccgcgggc

SEQ ID NO: 1565671 - RNA, 14 nt, Human adenovirus D
auaaagaagacuau

SEQ ID NO: 1565672 - RNA, 21 nt, Human adenovirus D
caggaaaggguacuccacagc

SEQ ID NO: 1565673 - RNA, 16 nt, Human adenovirus D
ucggagggggggauca

SEQ ID NO: 1565674 - RNA, 13 nt, Human adenovirus D
aacggcaccugcg

SEQ ID NO: 1565675 - RNA, 12 nt, Human adenovirus D
cacuccccccuu

SEQ ID NO: 1565676 - RNA, 16 nt, Human adenovirus D
gcagggcgcccagcau

SEQ ID NO: 1565677 - RNA, 21 nt, Human adenovirus D
aaccugcgcgggcuguggggc

SEQ ID NO: 1565678 - RNA, 15 nt, Human adenovirus D
cgcuggguggccggc

SEQ ID NO: 1565679 - RNA, 20 nt, Human adenovirus D
cgucuacaaggcccugggca

SEQ ID NO: 1565680 - RNA, 17 nt, Human adenovirus D
ggaccccacggcauggg

SEQ ID NO: 1565681 - RNA, 20 nt, Human adenovirus D
cugcuaccucuugcagcugg

SEQ ID NO: 1565682 - RNA, 16 nt, Human adenovirus D
ggcaggggcggcagag

SEQ ID NO: 1565683 - RNA, 20 nt, Human adenovirus D
ccgaugcuauugagagagag

SEQ ID NO: 1565684 - RNA, 22 nt, Human adenovirus D
aguugacggucugcaggccggg

SEQ ID NO: 1565685 - RNA, 16 nt, Human adenovirus D
ggccccuggcugggcg

SEQ ID NO: 1565686 - RNA, 15 nt, Human adenovirus D
acucgacgagccagg

SEQ ID NO: 1565687 - RNA, 15 nt, Human adenovirus D
gcgguugagcgggcu

SEQ ID NO: 1565688 - RNA, 15 nt, Human adenovirus D
gaauugguauaagug

SEQ ID NO: 1565689 - RNA, 21 nt, Human adenovirus D
agcacgcccgccauggggcgc

SEQ ID NO: 1565690 - RNA, 14 nt, Human adenovirus D
ggcacggcgguggu

SEQ ID NO: 1565691 - RNA, 13 nt, Human adenovirus D
gacugauggccac

SEQ ID NO: 1565692 - RNA, 20 nt, Human adenovirus D
cccuggcucccagccuccac

SEQ ID NO: 1565693 - RNA, 17 nt, Human adenovirus D
cgagcugacggccaguc

SEQ ID NO: 1565694 - RNA, 23 nt, Human adenovirus D
augcaccuguggagggcaugggu

SEQ ID NO: 1565695 - RNA, 13 nt, Human adenovirus D
gcugggcugggac

SEQ ID NO: 1565696 - RNA, 18 nt, Human adenovirus D
gcaugcccaccacgcgca

SEQ ID NO: 1565697 - RNA, 22 nt, Human adenovirus D
ugaggaggagacugauggccac

SEQ ID NO: 1565698 - RNA, 22 nt, Human adenovirus D
agccucgaacaguccacccaga

SEQ ID NO: 1565699 - RNA, 15 nt, Human adenovirus D
ucucacucaaggugg

SEQ ID NO: 1565700 - RNA, 16 nt, Human adenovirus D
cgcugagcuaccgcga

SEQ ID NO: 1565701 - RNA, 19 nt, Human adenovirus D
gagcugcgcgagggccugg

SEQ ID NO: 1565702 - RNA, 23 nt, Human adenovirus D
ucugccagcagaaaugggcccuu

SEQ ID NO: 1565703 - RNA, 18 nt, Human adenovirus D
cggucguuguccaccagg

SEQ ID NO: 1565704 - RNA, 13 nt, Human adenovirus D
gccgccgccgcgg

SEQ ID NO: 1565705 - RNA, 21 nt, Human adenovirus D
uucuggaaauuaugagcauca

SEQ ID NO: 1565706 - RNA, 19 nt, Human adenovirus D
gacaugggggcggaccugc

SEQ ID NO: 1565707 - RNA, 13 nt, Human adenovirus D
ccccgcgcgcgcg

SEQ ID NO: 1565708 - RNA, 19 nt, Human adenovirus D
gcagguggcgccgggccug

SEQ ID NO: 1565709 - RNA, 15 nt, Human adenovirus D
uaacagggaaaggaa

SEQ ID NO: 1565710 - RNA, 17 nt, Human adenovirus D
cgaaugggaagaagaga

SEQ ID NO: 1565711 - RNA, 14 nt, Human adenovirus D
cagagucugccgcc

SEQ ID NO: 1565712 - RNA, 12 nt, Human adenovirus D
uccagggugcgc

SEQ ID NO: 1565713 - RNA, 21 nt, Human adenovirus D
ggccauucuggaggcgguggu

SEQ ID NO: 1565714 - RNA, 23 nt, Human adenovirus D
agcagcuugcgcgcuggcuuggu

SEQ ID NO: 1565715 - RNA, 19 nt, Human adenovirus D
agcugaccaacuggucucc

SEQ ID NO: 1565716 - RNA, 14 nt, Human adenovirus D
aggccaacagacuc

SEQ ID NO: 1565717 - RNA, 12 nt, Human adenovirus D
ggaucagccccg

SEQ ID NO: 1565718 - RNA, 19 nt, Human adenovirus D
gccaggaggcggugcgcac

SEQ ID NO: 1565719 - RNA, 21 nt, Human adenovirus D
ggcguaguugcgcaggcgcug

SEQ ID NO: 1565720 - RNA, 13 nt, Human adenovirus D
ucgacggugagca

SEQ ID NO: 1565721 - RNA, 20 nt, Human adenovirus D
cgcccagcaauaacaccggc

SEQ ID NO: 1565722 - RNA, 16 nt, Human adenovirus D
gccuucgaaggggggc

SEQ ID NO: 1565723 - RNA, 17 nt, Human adenovirus D
uaugcuccugggugaga

SEQ ID NO: 1565724 - RNA, 22 nt, Human adenovirus D
gucgccacggucaccgagccuc

SEQ ID NO: 1565725 - RNA, 22 nt, Human adenovirus D
cugcugaaacaccugcagcgcc

SEQ ID NO: 1565726 - RNA, 17 nt, Human adenovirus D
ucggaguaccugagccc

SEQ ID NO: 1565727 - RNA, 22 nt, Human adenovirus D
uuucacugaaggaaaaaucacu

SEQ ID NO: 1565728 - RNA, 15 nt, Human adenovirus D
gucaggucugcuggu

SEQ ID NO: 1565729 - RNA, 21 nt, Human adenovirus D
cccucgcgcaacugggccgcu

SEQ ID NO: 1565730 - RNA, 22 nt, Human adenovirus D
ccauggcgcacaacaccgccuc

SEQ ID NO: 1565731 - RNA, 15 nt, Human adenovirus D
gcagcggggccuggu

SEQ ID NO: 1565732 - RNA, 18 nt, Human adenovirus D
ucgaggagaccugcacua

SEQ ID NO: 1565733 - RNA, 14 nt, Human adenovirus D
cacccacaccgccu

SEQ ID NO: 1565734 - RNA, 19 nt, Human adenovirus D
aagcuagcacccaaaaacu

SEQ ID NO: 1565735 - RNA, 16 nt, Human adenovirus D
cuucaccgaccugggu

SEQ ID NO: 1565736 - RNA, 12 nt, Human adenovirus D
ccaccgccgccg

SEQ ID NO: 1565737 - RNA, 16 nt, Human adenovirus D
agcucgccgaggaggc

SEQ ID NO: 1565738 - RNA, 19 nt, Human adenovirus D
uggcuucuacagccagcag

SEQ ID NO: 1565739 - RNA, 15 nt, Human adenovirus D
gacuauccuugcaga

SEQ ID NO: 1565740 - RNA, 15 nt, Human adenovirus D
cacauggcaagcugc

SEQ ID NO: 1565741 - RNA, 15 nt, Human adenovirus D
ugcccccaagggcgc

SEQ ID NO: 1565742 - RNA, 14 nt, Human adenovirus D
uagugaccaagacc

SEQ ID NO: 1565743 - RNA, 12 nt, Human adenovirus D
auucaaggccau

SEQ ID NO: 1565744 - RNA, 22 nt, Human adenovirus D
gcaaguacauagugaccaagac

SEQ ID NO: 1565745 - RNA, 23 nt, Human adenovirus D
cacauguccccuuccuccgcauc

SEQ ID NO: 1565746 - RNA, 13 nt, Human adenovirus D
auccagcggcgca

SEQ ID NO: 1565747 - RNA, 20 nt, Human adenovirus D
caagaagaaguuagaggagg

SEQ ID NO: 1565748 - RNA, 17 nt, Human adenovirus D
cggugcuuagccugggc

SEQ ID NO: 1565749 - RNA, 15 nt, Human adenovirus D
gccuucuauggaggc

SEQ ID NO: 1565750 - RNA, 15 nt, Human adenovirus D
cuggugcgucgagca

SEQ ID NO: 1565751 - RNA, 19 nt, Human adenovirus D
acgcgcaucaucgcgccac

SEQ ID NO: 1565752 - RNA, 22 nt, Human adenovirus D
ucacccagaaaagucuccucug

SEQ ID NO: 1565753 - RNA, 21 nt, Human adenovirus D
ugcgcgaagccguggcgcagc

SEQ ID NO: 1565754 - RNA, 17 nt, Human adenovirus D
ggugacggccuacgagc

SEQ ID NO: 1565755 - RNA, 20 nt, Human adenovirus D
gggguauuacuaggcccagc

SEQ ID NO: 1565756 - RNA, 23 nt, Human adenovirus D
acaugcagcugccgucgucccgg

SEQ ID NO: 1565757 - RNA, 23 nt, Human adenovirus D
cucgaaggacgauaaagugcaag

SEQ ID NO: 1565758 - RNA, 14 nt, Human adenovirus D
ccgcuaucugcucu

SEQ ID NO: 1565759 - RNA, 20 nt, Human adenovirus D
cagaaggacgugcgcccggc

SEQ ID NO: 1565760 - RNA, 16 nt, Human adenovirus D
ucgacggugagcagcu

SEQ ID NO: 1565761 - RNA, 20 nt, Human adenovirus D
gauuauccuuucccuggugg

SEQ ID NO: 1565762 - RNA, 22 nt, Human adenovirus D
ccaggaggagaccgacgcuggg

SEQ ID NO: 1565763 - RNA, 22 nt, Human adenovirus D
uguacacgguucucucagcacg

SEQ ID NO: 1565764 - RNA, 16 nt, Human adenovirus D
gcagcuugcgcgcugg

SEQ ID NO: 1565765 - RNA, 13 nt, Human adenovirus D
cgcagaaaucagu

SEQ ID NO: 1565766 - RNA, 20 nt, Human adenovirus D
uuuagugggaccucagauau

SEQ ID NO: 1565767 - RNA, 13 nt, Human adenovirus D
gaaaaggcagcug

SEQ ID NO: 1565768 - RNA, 15 nt, Human adenovirus D
cagucaacuguuaag

SEQ ID NO: 1565769 - RNA, 23 nt, Human adenovirus D
cuaaucauuuaauaaagaucacu

SEQ ID NO: 1565770 - RNA, 20 nt, Human adenovirus D
cgccauugucaacacggccg

SEQ ID NO: 1565771 - RNA, 18 nt, Human adenovirus D
aaacuuuaaugcuccaaa

SEQ ID NO: 1565772 - RNA, 17 nt, Human adenovirus D
gcaaguacauagugacc

SEQ ID NO: 1565773 - RNA, 20 nt, Human adenovirus D
gaucuccaacguggagcuga

SEQ ID NO: 1565774 - RNA, 15 nt, Human adenovirus D
ugcgcuuugugcccg

SEQ ID NO: 1565775 - RNA, 11 nt, Human adenovirus D
cccucgcuggu

SEQ ID NO: 1565776 - RNA, 20 nt, Human adenovirus D
gccacgugaccagggguccc

SEQ ID NO: 1565777 - RNA, 12 nt, Human adenovirus D
augcaggagggg

SEQ ID NO: 1565778 - RNA, 11 nt, Human adenovirus D
gugcugcugcc

SEQ ID NO: 1565779 - RNA, 23 nt, Human adenovirus D
cggcgaggggcuccucucgugcu

SEQ ID NO: 1565780 - RNA, 15 nt, Human adenovirus D
cgggguacugacgcc

SEQ ID NO: 1565781 - RNA, 18 nt, Human adenovirus D
cuugcagacuuuagcaag

SEQ ID NO: 1565782 - RNA, 18 nt, Human adenovirus D
ugacagaggcaacagcaa

SEQ ID NO: 1565783 - RNA, 21 nt, Human adenovirus D
guccaucgugcgcgaccuggg

SEQ ID NO: 1565784 - RNA, 16 nt, Human adenovirus D
gggcaugggucaggca

SEQ ID NO: 1565785 - RNA, 20 nt, Human adenovirus D
cugccacuugaacucgggga

SEQ ID NO: 1565786 - RNA, 15 nt, Human adenovirus D
agggcgaaggugucc

SEQ ID NO: 1565787 - RNA, 15 nt, Human adenovirus D
ccauaggccaggcgc

SEQ ID NO: 1565788 - RNA, 12 nt, Human adenovirus D
ggucugcaggcc

SEQ ID NO: 1565789 - RNA, 17 nt, Human adenovirus D
ggcuuucuuugacacac

SEQ ID NO: 1565790 - RNA, 17 nt, Human adenovirus D
cccugcaagugcacaga

SEQ ID NO: 1565791 - RNA, 22 nt, Human adenovirus D
aguggcgagaggcgagcagcug

SEQ ID NO: 1565792 - RNA, 16 nt, Human adenovirus D
ggccgagaccgugagc

SEQ ID NO: 1565793 - RNA, 19 nt, Human adenovirus D
caguauugugggccuggga

SEQ ID NO: 1565794 - RNA, 18 nt, Human adenovirus D
gggccacuacagcugaca

SEQ ID NO: 1565795 - RNA, 14 nt, Human adenovirus D
ucaagcugggcugg

SEQ ID NO: 1565796 - RNA, 19 nt, Human adenovirus D
cuccgcggcacggcacgcg

SEQ ID NO: 1565797 - RNA, 22 nt, Human adenovirus D
uggucggcgccgagcucaugcc

SEQ ID NO: 1565798 - RNA, 15 nt, Human adenovirus D
cagcagcgacugacu

SEQ ID NO: 1565799 - RNA, 13 nt, Human adenovirus D
ucacgcaggugac

SEQ ID NO: 1565800 - RNA, 20 nt, Human adenovirus D
cauguugaaaagcucccaca

SEQ ID NO: 1565801 - RNA, 15 nt, Human adenovirus D
ugauucaaacagcaa

SEQ ID NO: 1565802 - RNA, 12 nt, Human adenovirus D
cagaaacagcau

SEQ ID NO: 1565803 - RNA, 11 nt, Human adenovirus D
aaucugcauga

SEQ ID NO: 1565804 - RNA, 17 nt, Human adenovirus D
uacagcacagcagggac

SEQ ID NO: 1565805 - RNA, 17 nt, Human adenovirus D
cucgcgcaacugggccg

SEQ ID NO: 1565806 - RNA, 17 nt, Human adenovirus D
aagcaggagcaggagga

SEQ ID NO: 1565807 - RNA, 15 nt, Human adenovirus D
aaggcucauaugacc

SEQ ID NO: 1565808 - RNA, 16 nt, Human adenovirus D
cgcccauuccuggaga

SEQ ID NO: 1565809 - RNA, 16 nt, Human adenovirus D
cacucgacgagccagg

SEQ ID NO: 1565810 - RNA, 22 nt, Human adenovirus D
cgagccggcggcgcgagcugag

SEQ ID NO: 1565811 - RNA, 15 nt, Human adenovirus D
gcauugucugccugg

SEQ ID NO: 1565812 - RNA, 20 nt, Human adenovirus D
cuuccguucuacccagcaag

SEQ ID NO: 1565813 - RNA, 20 nt, Human adenovirus D
ggcggagggugccagauugg

SEQ ID NO: 1565814 - RNA, 19 nt, Human adenovirus D
cugcagggcgcccagcaug

SEQ ID NO: 1565815 - RNA, 15 nt, Human adenovirus D
cucaugaacacacug

SEQ ID NO: 1565816 - RNA, 16 nt, Human adenovirus D
ucaagacaaaauucca

SEQ ID NO: 1565817 - RNA, 16 nt, Human adenovirus D
ugcuccaccaccugca

SEQ ID NO: 1565818 - RNA, 20 nt, Human adenovirus D
gcaacucguaccugggucac

SEQ ID NO: 1565819 - RNA, 20 nt, Human adenovirus D
ggcacggucuucgcccugcg

SEQ ID NO: 1565820 - RNA, 20 nt, Human adenovirus D
gcggggccacgaccgugccg

SEQ ID NO: 1565821 - RNA, 16 nt, Human adenovirus D
auacucggaaaacagg

SEQ ID NO: 1565822 - RNA, 15 nt, Human adenovirus D
gccugccccucauga

SEQ ID NO: 1565823 - RNA, 12 nt, Human adenovirus D
cagccugagcuu

SEQ ID NO: 1565824 - RNA, 22 nt, Human adenovirus D
cugggguauuacuaggcccagc

SEQ ID NO: 1565825 - RNA, 14 nt, Human adenovirus D
gcgggcaggggcgg

SEQ ID NO: 1565826 - RNA, 20 nt, Human adenovirus D
uagucccgaauacagggacg

SEQ ID NO: 1565827 - RNA, 18 nt, Human adenovirus D
cugggcguugcgggccga

SEQ ID NO: 1565828 - RNA, 21 nt, Human adenovirus D
ugcucgcucguagggguugag

SEQ ID NO: 1565829 - RNA, 13 nt, Human adenovirus D
cccgucuccugcc

SEQ ID NO: 1565830 - RNA, 19 nt, Human adenovirus D
gaacugcuggcccugcugg

SEQ ID NO: 1565831 - RNA, 22 nt, Human adenovirus D
cggcaugggaugcgugagggcg

SEQ ID NO: 1565832 - RNA, 22 nt, Human adenovirus D
agcagccgcguaagcaggagca

SEQ ID NO: 1565833 - RNA, 17 nt, Human adenovirus D
cauugucuucccucuca

SEQ ID NO: 1565834 - RNA, 12 nt, Human adenovirus D
uggacgagccgc

SEQ ID NO: 1565835 - RNA, 15 nt, Human adenovirus D
gaccugaugaacaac

SEQ ID NO: 1565836 - RNA, 13 nt, Human adenovirus D
gucucgcacucga

SEQ ID NO: 1565837 - RNA, 18 nt, Human adenovirus D
ccucgucauccuuccagu

SEQ ID NO: 1565838 - RNA, 16 nt, Human adenovirus D
cuuucuuugacacacc

SEQ ID NO: 1565839 - RNA, 21 nt, Human adenovirus D
cggccauucuggaggcggugg

SEQ ID NO: 1565840 - RNA, 18 nt, Human adenovirus D
ggcugcuggaugggcgug

SEQ ID NO: 1565841 - RNA, 20 nt, Human adenovirus D
gaaaaauugcuauaaaucuu

SEQ ID NO: 1565842 - RNA, 14 nt, Human adenovirus D
gcuaccgcggcacc

SEQ ID NO: 1565843 - RNA, 12 nt, Human adenovirus D
gauccagcggcg

SEQ ID NO: 1565844 - RNA, 16 nt, Human adenovirus D
cgcucuggggcccggc

SEQ ID NO: 1565845 - RNA, 23 nt, Human adenovirus D
aagauacagaguaaaaguaaaca

SEQ ID NO: 1565846 - RNA, 15 nt, Human adenovirus D
ugagaauaacaugcu

SEQ ID NO: 1565847 - RNA, 14 nt, Human adenovirus D
acaggaggcacaga

SEQ ID NO: 1565848 - RNA, 20 nt, Human adenovirus D
gaaaugggcccuugaacagc

SEQ ID NO: 1565849 - RNA, 17 nt, Human adenovirus D
aggcgcccagccagcaa

SEQ ID NO: 1565850 - RNA, 18 nt, Human adenovirus D
aggccuuucacccggacg

SEQ ID NO: 1565851 - RNA, 20 nt, Human adenovirus D
augcaacaugaccaaggacu

SEQ ID NO: 1565852 - RNA, 23 nt, Human adenovirus D
cacgcggaucucacggccugcgu

SEQ ID NO: 1565853 - RNA, 13 nt, Human adenovirus D
aaucgcggcggcc

SEQ ID NO: 1565854 - RNA, 20 nt, Human adenovirus D
acacuuccuucgcagucucc

SEQ ID NO: 1565855 - RNA, 18 nt, Human adenovirus D
ccgcggccguagcaggcg

SEQ ID NO: 1565856 - RNA, 18 nt, Human adenovirus D
uaccugguacgagcuaca

SEQ ID NO: 1565857 - RNA, 17 nt, Human adenovirus D
ucgcgcaggaggccauc

SEQ ID NO: 1565858 - RNA, 14 nt, Human adenovirus D
cucuuccgccgccg

SEQ ID NO: 1565859 - RNA, 14 nt, Human adenovirus D
ucgucgccccggag

SEQ ID NO: 1565860 - RNA, 23 nt, Human adenovirus D
gcccgagggucgcuggcugcugg

SEQ ID NO: 1565861 - RNA, 16 nt, Human adenovirus D
cagcgcuggguggccg

SEQ ID NO: 1565862 - RNA, 14 nt, Human adenovirus D
ugucccccgccgcu

SEQ ID NO: 1565863 - RNA, 21 nt, Human adenovirus D
acuccucggucagcuggcccg

SEQ ID NO: 1565864 - RNA, 23 nt, Human adenovirus D
agcaguguguguuugagaaaugc

SEQ ID NO: 1565865 - RNA, 14 nt, Human adenovirus D
ggcguucagggagg

SEQ ID NO: 1565866 - RNA, 20 nt, Human adenovirus D
gaggcggagucuuccaugcg

SEQ ID NO: 1565867 - RNA, 20 nt, Human adenovirus D
acaacaucggcuaccagggc

SEQ ID NO: 1565868 - RNA, 17 nt, Human adenovirus D
gcgaccccgagaccugc

SEQ ID NO: 1565869 - RNA, 22 nt, Human adenovirus D
caugguagcaauggaaaucaca

SEQ ID NO: 1565870 - RNA, 15 nt, Human adenovirus D
cggccaaggccacca

SEQ ID NO: 1565871 - RNA, 17 nt, Human adenovirus D
ugaagguuaguugcaga

SEQ ID NO: 1565872 - RNA, 18 nt, Human adenovirus D
caggcccagaacuggcag

SEQ ID NO: 1565873 - RNA, 21 nt, Human adenovirus D
acauguggagcuaucagcccc

SEQ ID NO: 1565874 - RNA, 12 nt, Human adenovirus D
cgcggcagaacc

SEQ ID NO: 1565875 - RNA, 19 nt, Human adenovirus D
cacccaacugagcaggggc

SEQ ID NO: 1565876 - RNA, 20 nt, Human adenovirus D
ccuccgggacgcccuggccg

SEQ ID NO: 1565877 - RNA, 20 nt, Human adenovirus D
cgucugacugccgccggcca

SEQ ID NO: 1565878 - RNA, 15 nt, Human adenovirus D
gucauugauacccug

SEQ ID NO: 1565879 - RNA, 22 nt, Human adenovirus D
cagcacgcggaucucacggccu

SEQ ID NO: 1565880 - RNA, 13 nt, Human adenovirus D
ccacucugagaca

SEQ ID NO: 1565881 - RNA, 17 nt, Human adenovirus D
gcggcgcaagcucaugc

SEQ ID NO: 1565882 - RNA, 23 nt, Human adenovirus D
uccccucgaaucaggcuggagcc

SEQ ID NO: 1565883 - RNA, 14 nt, Human adenovirus D
ccgccgccgccgcc

SEQ ID NO: 1565884 - RNA, 21 nt, Human adenovirus D
ggaggcgguccccgcccagcg

SEQ ID NO: 1565885 - RNA, 22 nt, Human adenovirus D
caacgugcccaucuccaucccc

SEQ ID NO: 1565886 - RNA, 18 nt, Human adenovirus D
gcauguacggaggagcca

SEQ ID NO: 1565887 - RNA, 16 nt, Human adenovirus D
cggacgugcgcgaagc

SEQ ID NO: 1565888 - RNA, 14 nt, Human adenovirus D
gcugccgcuggacg

SEQ ID NO: 1565889 - RNA, 13 nt, Human adenovirus D
agugcaagaaggg

SEQ ID NO: 1565890 - RNA, 14 nt, Human adenovirus D
cuugguaugaugau

SEQ ID NO: 1565891 - RNA, 15 nt, Human adenovirus D
ugaaggaaaaaucac

SEQ ID NO: 1565892 - RNA, 13 nt, Human adenovirus D
cacaucgccgggc

SEQ ID NO: 1565893 - RNA, 17 nt, Human adenovirus D
caggguaaagccagcag

SEQ ID NO: 1565894 - RNA, 15 nt, Human adenovirus D
aagggcggcgcugca

SEQ ID NO: 1565895 - RNA, 16 nt, Human adenovirus D
agcagcuguugaaaaa

SEQ ID NO: 1565896 - RNA, 18 nt, Human adenovirus D
ggccugcgucaucaccca

SEQ ID NO: 1565897 - RNA, 20 nt, Human adenovirus D
uagagggcguuggagagaag

SEQ ID NO: 1565898 - RNA, 15 nt, Human adenovirus D
aagagggagaggagc

SEQ ID NO: 1565899 - RNA, 14 nt, Human adenovirus D
cuccguagccuggc

SEQ ID NO: 1565900 - RNA, 18 nt, Human adenovirus D
augaggauugggaggagg

SEQ ID NO: 1565901 - RNA, 21 nt, Human adenovirus D
gaugguggcgaggaggaccag

SEQ ID NO: 1565902 - RNA, 21 nt, Human adenovirus D
augccggcagcggugguggag

SEQ ID NO: 1565903 - RNA, 17 nt, Human adenovirus D
acagccucucugaagca

SEQ ID NO: 1565904 - RNA, 20 nt, Human adenovirus D
gggguacuuuacgcuggcca

SEQ ID NO: 1565905 - RNA, 21 nt, Human adenovirus D
cccucggcaacgaccugcgcg

SEQ ID NO: 1565906 - RNA, 24 nt, Human adenovirus D
cagacgauaaauuuugacgagcgg

SEQ ID NO: 1565907 - RNA, 16 nt, Human adenovirus D
auuacucgcaaaaaua

SEQ ID NO: 1565908 - RNA, 22 nt, Human adenovirus D
accacgcuacaaauccaacucu

SEQ ID NO: 1565909 - RNA, 20 nt, Human adenovirus D
ugcugguggaaacagacagc

SEQ ID NO: 1565910 - RNA, 16 nt, Human adenovirus D
cgcaggaguccaccgc

SEQ ID NO: 1565911 - RNA, 13 nt, Human adenovirus D
aaccgccuggggc

SEQ ID NO: 1565912 - RNA, 22 nt, Human adenovirus D
gccaggccuccgagcagcgcau

SEQ ID NO: 1565913 - RNA, 21 nt, Human adenovirus D
acggccggccgcgagaccgga

SEQ ID NO: 1565914 - RNA, 18 nt, Human adenovirus D
gccugcgcccgcgccgcg

SEQ ID NO: 1565915 - RNA, 14 nt, Human adenovirus D
cgucaccugcggcg

SEQ ID NO: 1565916 - RNA, 16 nt, Human adenovirus D
ccgggccugggcgugc

SEQ ID NO: 1565917 - RNA, 12 nt, Human adenovirus D
cauacugcuauc

SEQ ID NO: 1565918 - RNA, 23 nt, Human adenovirus D
ucgacagcgucaaccucuacgcc

SEQ ID NO: 1565919 - RNA, 15 nt, Human adenovirus D
cgccaaaaaaacaca

SEQ ID NO: 1565920 - RNA, 18 nt, Human adenovirus D
gccagccgacuucuccag

SEQ ID NO: 1565921 - RNA, 18 nt, Human adenovirus D
gcaccugggcgccagaag

SEQ ID NO: 1565922 - RNA, 17 nt, Human adenovirus D
cauggccucgugcucug

SEQ ID NO: 1565923 - RNA, 16 nt, Human adenovirus D
ggcggauagcgcgccg

SEQ ID NO: 1565924 - RNA, 22 nt, Human adenovirus D
gcuggaagaccuacgcucagga

SEQ ID NO: 1565925 - RNA, 23 nt, Human adenovirus D
uaugggagagaacaaaaccuuag

SEQ ID NO: 1565926 - RNA, 21 nt, Human adenovirus D
aacucugauucaugugaacaa

SEQ ID NO: 1565927 - RNA, 18 nt, Human adenovirus D
aaaaagaaacaagucaaa

SEQ ID NO: 1565928 - RNA, 18 nt, Human adenovirus D
ggccgaaauuggugcgcu

SEQ ID NO: 1565929 - RNA, 16 nt, Human adenovirus D
caccaucaccaccguc

SEQ ID NO: 1565930 - RNA, 21 nt, Human adenovirus D
cagcagaagaucccggcgcag

SEQ ID NO: 1565931 - RNA, 15 nt, Human adenovirus D
ggugcuuagccuggg

SEQ ID NO: 1565932 - RNA, 12 nt, Human adenovirus D
ggucagcuggcc

SEQ ID NO: 1565933 - RNA, 23 nt, Human adenovirus D
uaagacauaacugggugaugcuu

SEQ ID NO: 1565934 - RNA, 19 nt, Human adenovirus D
agagaaguuuaauggggug

SEQ ID NO: 1565935 - RNA, 21 nt, Human adenovirus D
ucacagcuaagaaaaaaucag

SEQ ID NO: 1565936 - RNA, 22 nt, Human adenovirus D
gcaugcaagaucuccaacgugg

SEQ ID NO: 1565937 - RNA, 19 nt, Human adenovirus D
ugccauuuuucagcagagu

SEQ ID NO: 1565938 - RNA, 15 nt, Human adenovirus D
cucacuugccgccug

SEQ ID NO: 1565939 - RNA, 16 nt, Human adenovirus D
gcgagaaggcgcccag

SEQ ID NO: 1565940 - RNA, 16 nt, Human adenovirus D
gcuccaaagcuagcac

SEQ ID NO: 1565941 - RNA, 14 nt, Human adenovirus D
cacgcccugggugu

SEQ ID NO: 1565942 - RNA, 18 nt, Human adenovirus D
cugcagcucaucgacugg

SEQ ID NO: 1565943 - RNA, 12 nt, Human adenovirus D
gggacgugagcg

SEQ ID NO: 1565944 - RNA, 17 nt, Human adenovirus D
agcauggcuaccuggga

SEQ ID NO: 1565945 - RNA, 16 nt, Human adenovirus D
gcgcauccccuucucc

SEQ ID NO: 1565946 - RNA, 12 nt, Human adenovirus D
cuacagccagca

SEQ ID NO: 1565947 - RNA, 22 nt, Human adenovirus D
ccuggugcgucgagcacagcac

SEQ ID NO: 1565948 - RNA, 14 nt, Human adenovirus D
uuuaacuguaucug

SEQ ID NO: 1565949 - RNA, 23 nt, Human adenovirus D
cgcacuggcuuccgccgccgggg

SEQ ID NO: 1565950 - RNA, 18 nt, Human adenovirus D
gaucuccuccuccuggag

SEQ ID NO: 1565951 - RNA, 19 nt, Human adenovirus D
ugggcgugcagaccgugga

SEQ ID NO: 1565952 - RNA, 23 nt, Human adenovirus D
guuauugagcccaucaagcaaga

SEQ ID NO: 1565953 - RNA, 22 nt, Human adenovirus D
gacgagaacguccauggcgcag

SEQ ID NO: 1565954 - RNA, 21 nt, Human adenovirus D
acgccccugagcggcugcacg

SEQ ID NO: 1565955 - RNA, 17 nt, Human adenovirus D
ggugcgucgagcacagc

SEQ ID NO: 1565956 - RNA, 15 nt, Human adenovirus D
caacaccgccuccac

SEQ ID NO: 1565957 - RNA, 22 nt, Human adenovirus D
uccgcggccacuuccgcgcucc

SEQ ID NO: 1565958 - RNA, 16 nt, Human adenovirus D
cgugaucccacagggc

SEQ ID NO: 1565959 - RNA, 15 nt, Human adenovirus D
ugcgucccuggcucc

SEQ ID NO: 1565960 - RNA, 18 nt, Human adenovirus D
cuggcgguagagcggcca

SEQ ID NO: 1565961 - RNA, 15 nt, Human adenovirus D
cccugcucaccugca

SEQ ID NO: 1565962 - RNA, 15 nt, Human adenovirus D
ccgaggacacccggc

SEQ ID NO: 1565963 - RNA, 13 nt, Human adenovirus D
ccaacagccacau

SEQ ID NO: 1565964 - RNA, 15 nt, Human adenovirus D
gagccacugcuaccu

SEQ ID NO: 1565965 - RNA, 19 nt, Human adenovirus D
cagagucgaggucagcagc

SEQ ID NO: 1565966 - RNA, 18 nt, Human adenovirus D
ucuuccucuccuccuccc

SEQ ID NO: 1565967 - RNA, 22 nt, Human adenovirus D
cgagcucaugcccuuccgcgcc

SEQ ID NO: 1565968 - RNA, 13 nt, Human adenovirus D
ggccucucgcucc

SEQ ID NO: 1565969 - RNA, 18 nt, Human adenovirus D
agacaaaggaggccacgu

SEQ ID NO: 1565970 - RNA, 16 nt, Human adenovirus D
uuucugcagacaucau

SEQ ID NO: 1565971 - RNA, 14 nt, Human adenovirus D
cagccgccaugaca

SEQ ID NO: 1565972 - RNA, 14 nt, Human adenovirus D
gaccuuccaggaga

SEQ ID NO: 1565973 - RNA, 16 nt, Human adenovirus D
guugguuuaaucagga

SEQ ID NO: 1565974 - RNA, 19 nt, Human adenovirus D
gccacugcaccccccgcag

SEQ ID NO: 1565975 - RNA, 15 nt, Human adenovirus D
accaacaugcccaau

SEQ ID NO: 1565976 - RNA, 18 nt, Human adenovirus D
cucaauaaacagcacuuu

SEQ ID NO: 1565977 - RNA, 12 nt, Human adenovirus D
caaagagcacag

SEQ ID NO: 1565978 - RNA, 19 nt, Human adenovirus D
gcagcaggugcugccccag

SEQ ID NO: 1565979 - RNA, 12 nt, Human adenovirus D
caccagcccauu

SEQ ID NO: 1565980 - RNA, 13 nt, Human adenovirus D
gcgcccaggccgc

SEQ ID NO: 1565981 - RNA, 15 nt, Human adenovirus D
ccaugcgccaagggc

SEQ ID NO: 1565982 - RNA, 14 nt, Human adenovirus D
cauaaaucugcccu

SEQ ID NO: 1565983 - RNA, 17 nt, Human adenovirus D
uggucccuucucggacc

SEQ ID NO: 1565984 - RNA, 13 nt, Human adenovirus D
ccuuccaguacuc

SEQ ID NO: 1565985 - RNA, 15 nt, Human adenovirus D
cucgcgcaacugggc

SEQ ID NO: 1565986 - RNA, 15 nt, Human adenovirus D
gagccgccagcuggc

SEQ ID NO: 1565987 - RNA, 17 nt, Human adenovirus D
ugucguacuucugccag

SEQ ID NO: 1565988 - RNA, 12 nt, Human adenovirus D
accugagccgcg

SEQ ID NO: 1565989 - RNA, 18 nt, Human adenovirus D
ccggugagacgcgcgcag

SEQ ID NO: 1565990 - RNA, 22 nt, Human adenovirus D
ugcucuccgcaccgcuccuggu

SEQ ID NO: 1565991 - RNA, 15 nt, Human adenovirus D
aaacaauaaaaaacu

SEQ ID NO: 1565992 - RNA, 12 nt, Human adenovirus D
aagaagagcagc

SEQ ID NO: 1565993 - RNA, 12 nt, Human adenovirus D
ccgccagcuggc

SEQ ID NO: 1565994 - RNA, 22 nt, Human adenovirus D
cgccggcgcuagccagccacag

SEQ ID NO: 1565995 - RNA, 15 nt, Human adenovirus D
caguccgccaagcuc

SEQ ID NO: 1565996 - RNA, 18 nt, Human adenovirus D
gccgcugcaaccugugcu

SEQ ID NO: 1565997 - RNA, 14 nt, Human adenovirus D
gcgcgaccugggcu

SEQ ID NO: 1565998 - RNA, 14 nt, Human adenovirus D
ggaaccauggacac

SEQ ID NO: 1565999 - RNA, 23 nt, Human adenovirus D
ccacagccuugauuuuuccagcc

SEQ ID NO: 1566000 - RNA, 15 nt, Human adenovirus D
gucccuggcuccgcg

SEQ ID NO: 1566001 - RNA, 19 nt, Human adenovirus D
acugggcguugcgggccga

SEQ ID NO: 1566002 - RNA, 21 nt, Human adenovirus D
agcagcuugcugacgcccaac

SEQ ID NO: 1566003 - RNA, 18 nt, Human adenovirus D
caguacuggcaacauggg

SEQ ID NO: 1566004 - RNA, 21 nt, Human adenovirus D
gugcaguuugcccgcgccacc

SEQ ID NO: 1566005 - RNA, 15 nt, Human adenovirus D
cugggcucgcuggug

SEQ ID NO: 1566006 - RNA, 16 nt, Human adenovirus D
cugaacgccuuccugg

SEQ ID NO: 1566007 - RNA, 17 nt, Human adenovirus D
cuacaugcccagcagca

SEQ ID NO: 1566008 - RNA, 19 nt, Human adenovirus D
accgaggugccccagagcg

SEQ ID NO: 1566009 - RNA, 15 nt, Human adenovirus D
cacuggguggcccuu

SEQ ID NO: 1566010 - RNA, 23 nt, Human adenovirus D
caaacggugaaccugagccaggc

SEQ ID NO: 1566011 - RNA, 19 nt, Human adenovirus D
ggcgcgccuuggaggccgc

SEQ ID NO: 1566012 - RNA, 13 nt, Human adenovirus D
gcuucuacagcca

SEQ ID NO: 1566013 - RNA, 14 nt, Human adenovirus D
gaucccgcuguggc

SEQ ID NO: 1566014 - RNA, 13 nt, Human adenovirus D
ucccgcucccagc

SEQ ID NO: 1566015 - RNA, 18 nt, Human adenovirus D
cuuuaucagcacugcaaa

SEQ ID NO: 1566016 - RNA, 15 nt, Human adenovirus D
gagugaggcacugcu

SEQ ID NO: 1566017 - RNA, 15 nt, Human adenovirus D
cacagucaacuguua

SEQ ID NO: 1566018 - RNA, 12 nt, Human adenovirus D
ccaccaacgugc

SEQ ID NO: 1566019 - RNA, 20 nt, Human adenovirus D
gauuuggcuuucuuugacac

SEQ ID NO: 1566020 - RNA, 12 nt, Human adenovirus D
aggcgugcacug

SEQ ID NO: 1566021 - RNA, 22 nt, Human adenovirus D
gccgccacugcaccccccgcag

SEQ ID NO: 1566022 - RNA, 14 nt, Human adenovirus D
gccuucgaaggggg

SEQ ID NO: 1566023 - RNA, 20 nt, Human adenovirus D
caggagggggccacucccag

SEQ ID NO: 1566024 - RNA, 16 nt, Human adenovirus D
uguugcacgcggguga

SEQ ID NO: 1566025 - RNA, 13 nt, Human adenovirus D
gcgcuaccacccc

SEQ ID NO: 1566026 - RNA, 22 nt, Human adenovirus D
cuguccaugguagcaauggaaa

SEQ ID NO: 1566027 - RNA, 17 nt, Human adenovirus D
cggcggccaaccuggug

SEQ ID NO: 1566028 - RNA, 13 nt, Human adenovirus D
cuuaaccacccac

SEQ ID NO: 1566029 - RNA, 21 nt, Human adenovirus D
ccucgagcuacaugcccagca

SEQ ID NO: 1566030 - RNA, 14 nt, Human adenovirus D
ucaugaccagcaug

SEQ ID NO: 1566031 - RNA, 20 nt, Human adenovirus D
agaccagaacuuccagcaga

SEQ ID NO: 1566032 - RNA, 20 nt, Human adenovirus D
accccuuacauguggagcua

SEQ ID NO: 1566033 - RNA, 21 nt, Human adenovirus D
ggcagcuccgguugugcagcc

SEQ ID NO: 1566034 - RNA, 20 nt, Human adenovirus D
cgacugacuacccacugacu

SEQ ID NO: 1566035 - RNA, 18 nt, Human adenovirus D
ugcuauaaaucuuuucuc

SEQ ID NO: 1566036 - RNA, 20 nt, Human adenovirus D
gcgcuggggcugcucggcgc

SEQ ID NO: 1566037 - RNA, 14 nt, Human adenovirus D
accggugcucugcg

SEQ ID NO: 1566038 - RNA, 18 nt, Human adenovirus D
uuagacucugacacaccu

SEQ ID NO: 1566039 - RNA, 18 nt, Human adenovirus D
accugcgcaaggucgagg

SEQ ID NO: 1566040 - RNA, 15 nt, Human adenovirus D
gggcaccuuccagcc

SEQ ID NO: 1566041 - RNA, 21 nt, Human adenovirus D
ugagacucauccugcuggugc

SEQ ID NO: 1566042 - RNA, 18 nt, Human adenovirus D
caagaccccgucaccuuc

SEQ ID NO: 1566043 - RNA, 19 nt, Human adenovirus D
gccccaggcggugcugcug

SEQ ID NO: 1566044 - RNA, 17 nt, Human adenovirus D
ucaugaccagcaugaag

SEQ ID NO: 1566045 - RNA, 16 nt, Human adenovirus D
uuaaccacccacgagc

SEQ ID NO: 1566046 - RNA, 17 nt, Human adenovirus D
gcucaggaccauaggga

SEQ ID NO: 1566047 - RNA, 22 nt, Human adenovirus D
aucagccccagaugggccuggc

SEQ ID NO: 1566048 - RNA, 13 nt, Human adenovirus D
ggccgagcuggaa

SEQ ID NO: 1566049 - RNA, 20 nt, Human adenovirus D
cccaguuucaaacccuacuc

SEQ ID NO: 1566050 - RNA, 21 nt, Human adenovirus D
uauaaucgccagggaacugaa

SEQ ID NO: 1566051 - RNA, 24 nt, Human adenovirus D
cuuacucagguuuggauauucaaa

SEQ ID NO: 1566052 - RNA, 21 nt, Human adenovirus D
gcccguagcugcgcggggcca

SEQ ID NO: 1566053 - RNA, 19 nt, Human adenovirus D
ugcaggauaaauauggccu

SEQ ID NO: 1566054 - RNA, 15 nt, Human adenovirus D
cuaccacgcccauga

SEQ ID NO: 1566055 - RNA, 18 nt, Human adenovirus D
aaaaacagacuggucaaa

SEQ ID NO: 1566056 - RNA, 23 nt, Human adenovirus D
cauuacuauuacugccacugcca

SEQ ID NO: 1566057 - RNA, 14 nt, Human adenovirus D
acauccauggccag

SEQ ID NO: 1566058 - RNA, 18 nt, Human adenovirus D
ccacccacgagcaaccca

SEQ ID NO: 1566059 - RNA, 21 nt, Human adenovirus D
cguguccacgcauugcaugag

SEQ ID NO: 1566060 - RNA, 12 nt, Human adenovirus D
uaagcaggagca

SEQ ID NO: 1566061 - RNA, 22 nt, Human adenovirus D
cugcuaaacaucgccgagcccg

SEQ ID NO: 1566062 - RNA, 18 nt, Human adenovirus D
agggagcugcgcgagggc

SEQ ID NO: 1566063 - RNA, 19 nt, Human adenovirus D
cccaggaauggcacgcucu

SEQ ID NO: 1566064 - RNA, 13 nt, Human adenovirus D
cgcaagcucaugc

SEQ ID NO: 1566065 - RNA, 17 nt, Human adenovirus D
uguaaagccagaaagaa

SEQ ID NO: 1566066 - RNA, 22 nt, Human adenovirus D
aggugcugacauccauggccag

SEQ ID NO: 1566067 - RNA, 22 nt, Human adenovirus D
cauccuggaccaggcggcagag

SEQ ID NO: 1566068 - RNA, 23 nt, Human adenovirus D
gaacuuccaaacuauugcuuccc

SEQ ID NO: 1566069 - RNA, 20 nt, Human adenovirus D
cccgcgugcagcugcagaag

SEQ ID NO: 1566070 - RNA, 15 nt, Human adenovirus D
guccugucacucaaa

SEQ ID NO: 1566071 - RNA, 16 nt, Human adenovirus D
gccugcaaacggugaa

SEQ ID NO: 1566072 - RNA, 13 nt, Human adenovirus D
ugaaggggacgag

SEQ ID NO: 1566073 - RNA, 21 nt, Human adenovirus D
aucaccauguuauucagcagc

SEQ ID NO: 1566074 - RNA, 22 nt, Human adenovirus D
gcagcacauaaucaccauguua

SEQ ID NO: 1566075 - RNA, 18 nt, Human adenovirus D
uccgcagcuacaccuccc

SEQ ID NO: 1566076 - RNA, 20 nt, Human adenovirus D
uuggcagccgagccggcgcg

SEQ ID NO: 1566077 - RNA, 15 nt, Human adenovirus D
gguaaagccagcagc

SEQ ID NO: 1566078 - RNA, 12 nt, Human adenovirus D
cggaggugagcu

SEQ ID NO: 1566079 - RNA, 12 nt, Human adenovirus D
gcgcccucagca

SEQ ID NO: 1566080 - RNA, 21 nt, Human adenovirus D
cguccaucgugcgcgaccugg

SEQ ID NO: 1566081 - RNA, 20 nt, Human adenovirus D
ugacaugcaaaaucuuacac

SEQ ID NO: 1566082 - RNA, 22 nt, Human adenovirus D
gagguggacgagggggcaguag

SEQ ID NO: 1566083 - RNA, 23 nt, Human adenovirus D
aucggacgacugggaggcugcga

SEQ ID NO: 1566084 - RNA, 15 nt, Human adenovirus D
gagccauagagggcg

SEQ ID NO: 1566085 - RNA, 17 nt, Human adenovirus D
accgucaccuucacagc

SEQ ID NO: 1566086 - RNA, 15 nt, Human adenovirus D
cugggaauccugcac

SEQ ID NO: 1566087 - RNA, 16 nt, Human adenovirus D
cagaaguucaccugca

SEQ ID NO: 1566088 - RNA, 16 nt, Human adenovirus D
ugaacccgcacuggcu

SEQ ID NO: 1566089 - RNA, 13 nt, Human adenovirus D
gaaagcauacaga

SEQ ID NO: 1566090 - RNA, 17 nt, Human adenovirus D
gacuggaaacucuugga

SEQ ID NO: 1566091 - RNA, 19 nt, Human adenovirus D
augcuguggucgacuugca

SEQ ID NO: 1566092 - RNA, 13 nt, Human adenovirus D
guccucuuccucu

SEQ ID NO: 1566093 - RNA, 16 nt, Human adenovirus D
cgcccugagagcgcug

SEQ ID NO: 1566094 - RNA, 14 nt, Human adenovirus D
acagccacaugacc

SEQ ID NO: 1566095 - RNA, 21 nt, Human adenovirus D
aaaucugaaaguaugucucug

SEQ ID NO: 1566096 - RNA, 18 nt, Human adenovirus D
auggcgugcuggagagcg

SEQ ID NO: 1566097 - RNA, 20 nt, Human adenovirus D
uucuuccggcaaaaaucaca

SEQ ID NO: 1566098 - RNA, 11 nt, Human adenovirus D
gacagccaggu

SEQ ID NO: 1566099 - RNA, 14 nt, Human adenovirus D
cucauccugcuggu

SEQ ID NO: 1566100 - RNA, 19 nt, Human adenovirus D
acaccugugacaugcaaaa

SEQ ID NO: 1566101 - RNA, 13 nt, Human adenovirus D
ccgccgcaccgcc

SEQ ID NO: 1566102 - RNA, 21 nt, Human adenovirus D
agccauugaccaccagggagc

SEQ ID NO: 1566103 - RNA, 22 nt, Human adenovirus D
ucauccaugaugauggcgaugg

SEQ ID NO: 1566104 - RNA, 23 nt, Human adenovirus D
cgagcagacggugaagcaggagc

SEQ ID NO: 1566105 - RNA, 21 nt, Human adenovirus D
ccuugcaaaagcgccaggagg

SEQ ID NO: 1566106 - RNA, 16 nt, Human adenovirus D
cgaggacuaccacgcc

SEQ ID NO: 1566107 - RNA, 17 nt, Human adenovirus D
cgcgagugucccccgcc

SEQ ID NO: 1566108 - RNA, 16 nt, Human adenovirus D
caggccgcagcucuuc

SEQ ID NO: 1566109 - RNA, 19 nt, Human adenovirus D
ggagcucuugcagggaagc

SEQ ID NO: 1566110 - RNA, 13 nt, Human adenovirus D
cagcugcagcgca

SEQ ID NO: 1566111 - RNA, 18 nt, Human adenovirus D
gaucaaccuccaggccaa

SEQ ID NO: 1566112 - RNA, 23 nt, Human adenovirus D
uuucuacgggugaguugguggcc

SEQ ID NO: 1566113 - RNA, 20 nt, Human adenovirus D
aggagcugaucucgcugccg

SEQ ID NO: 1566114 - RNA, 18 nt, Human adenovirus D
gaagugcggcggcggcug

SEQ ID NO: 1566115 - RNA, 12 nt, Human adenovirus D
cuuccagcagaa

SEQ ID NO: 1566116 - RNA, 13 nt, Human adenovirus D
agcgcgugcugcg

SEQ ID NO: 1566117 - RNA, 12 nt, Human adenovirus D
caagugcacaga

SEQ ID NO: 1566118 - RNA, 20 nt, Human adenovirus D
gcugaccaauagacagcaga

SEQ ID NO: 1566119 - RNA, 13 nt, Human adenovirus D
ccagaugaggauu

SEQ ID NO: 1566120 - RNA, 22 nt, Human adenovirus D
ugauaaggagaaggauucaaaa

SEQ ID NO: 1566121 - RNA, 22 nt, Human adenovirus D
agcgacacccccgcgugcagcu

SEQ ID NO: 1566122 - RNA, 16 nt, Human adenovirus D
cauguuauucagcagc

SEQ ID NO: 1566123 - RNA, 20 nt, Human adenovirus D
uggccgcccugacccagcag

SEQ ID NO: 1566124 - RNA, 18 nt, Human adenovirus D
gcgccagacgcacgggcc

SEQ ID NO: 1566125 - RNA, 15 nt, Human adenovirus D
ugcgauauggaugau

SEQ ID NO: 1566126 - RNA, 21 nt, Human adenovirus D
ccagaaagaaguggccagugu

SEQ ID NO: 1566127 - RNA, 18 nt, Human adenovirus D
gacacaccuggaggcacc

SEQ ID NO: 1566128 - RNA, 18 nt, Human adenovirus D
cuacgaaucauggaggcc

SEQ ID NO: 1566129 - RNA, 18 nt, Human adenovirus D
guccgcccgcgcccacca

SEQ ID NO: 1566130 - RNA, 21 nt, Human adenovirus D
aggucccgguguugcgcccug

SEQ ID NO: 1566131 - RNA, 14 nt, Human adenovirus D
gucaggcaggcaug

SEQ ID NO: 1566132 - RNA, 19 nt, Human adenovirus D
aggugguggacggccuggc

SEQ ID NO: 1566133 - RNA, 12 nt, Human adenovirus D
cugauguugauu

SEQ ID NO: 1566134 - RNA, 13 nt, Human adenovirus D
ggaugcaugcggg

SEQ ID NO: 1566135 - RNA, 19 nt, Human adenovirus D
acgcggaucucacggccug

SEQ ID NO: 1566136 - RNA, 20 nt, Human adenovirus D
aucagcacugcaaauuuaac

SEQ ID NO: 1566137 - RNA, 12 nt, Human adenovirus D
ucuucugggugg

SEQ ID NO: 1566138 - RNA, 15 nt, Human adenovirus D
caccgcgaccgcggc

SEQ ID NO: 1566139 - RNA, 14 nt, Human adenovirus D
caagucucucuaac

SEQ ID NO: 1566140 - RNA, 13 nt, Human adenovirus D
agcucugcugcgc

SEQ ID NO: 1566141 - RNA, 14 nt, Human adenovirus D
gcugcuggaugggc

SEQ ID NO: 1566142 - RNA, 22 nt, Human adenovirus D
cgccaccuucuuccccauggcg

SEQ ID NO: 1566143 - RNA, 23 nt, Human adenovirus D
caggauaaauauggccuggagca

SEQ ID NO: 1566144 - RNA, 21 nt, Human adenovirus D
guccgcaugacuaacucaggu

SEQ ID NO: 1566145 - RNA, 18 nt, Human adenovirus D
ccggaggcgugcacuggc

SEQ ID NO: 1566146 - RNA, 19 nt, Human adenovirus D
cuggcgaaagauggcgugc

SEQ ID NO: 1566147 - RNA, 20 nt, Human adenovirus D
ccgccggaaacgccaccacc

SEQ ID NO: 1566148 - RNA, 16 nt, Human adenovirus D
gaucugggaugcugcc

SEQ ID NO: 1566149 - RNA, 14 nt, Human adenovirus D
ggcagggugagccg

SEQ ID NO: 1566150 - RNA, 15 nt, Human adenovirus D
gaugaugaccgagcu

SEQ ID NO: 1566151 - RNA, 17 nt, Human adenovirus D
aucgugaacgcgcuggc

SEQ ID NO: 1566152 - RNA, 14 nt, Human adenovirus D
aggaaccagcacac

SEQ ID NO: 1566153 - RNA, 19 nt, Human adenovirus D
accaugaccauagaccuga

SEQ ID NO: 1566154 - RNA, 16 nt, Human adenovirus D
gcaucagucuccuggu

SEQ ID NO: 1566155 - RNA, 18 nt, Human adenovirus D
cgagaucggcaccagcca

SEQ ID NO: 1566156 - RNA, 14 nt, Human adenovirus D
gcaagugcacagac

SEQ ID NO: 1566157 - RNA, 17 nt, Human adenovirus D
accacacggccagcagg

SEQ ID NO: 1566158 - RNA, 18 nt, Human adenovirus D
cgacccccaggcccugga

SEQ ID NO: 1566159 - RNA, 15 nt, Human adenovirus D
gaaucgcgggcggcc

SEQ ID NO: 1566160 - RNA, 20 nt, Human adenovirus D
gugcugacauccauggccag

SEQ ID NO: 1566161 - RNA, 17 nt, Human adenovirus D
ccucuguggugaggauc

SEQ ID NO: 1566162 - RNA, 19 nt, Human adenovirus D
gcuucugccuggugaaggg

SEQ ID NO: 1566163 - RNA, 23 nt, Human adenovirus D
augcuccaggucgucgccccgga

SEQ ID NO: 1566164 - RNA, 21 nt, Human adenovirus D
aaucgagcaggaccugggcuu

SEQ ID NO: 1566165 - RNA, 14 nt, Human adenovirus D
ccucgcuacugcug

SEQ ID NO: 1566166 - RNA, 23 nt, Human adenovirus D
gcugacaauucagagccagggcu

SEQ ID NO: 1566167 - RNA, 12 nt, Human adenovirus D
augaccucggca

SEQ ID NO: 1566168 - RNA, 19 nt, Human adenovirus D
agggcaccaccgagucuca

SEQ ID NO: 1566169 - RNA, 17 nt, Human adenovirus D
cucugacggcgcagcug

SEQ ID NO: 1566170 - RNA, 14 nt, Human adenovirus D
gaccacgguggugc

SEQ ID NO: 1566171 - RNA, 14 nt, Human adenovirus D
ucacaagucucucu

SEQ ID NO: 1566172 - RNA, 16 nt, Human adenovirus D
acagugcccccuccac

SEQ ID NO: 1566173 - RNA, 23 nt, Human adenovirus D
gggccugcaaacggugaaccuga

SEQ ID NO: 1566174 - RNA, 16 nt, Human adenovirus D
agcaaccuccugggca

SEQ ID NO: 1566175 - RNA, 22 nt, Human adenovirus D
augcccuccuauuacuugguga

SEQ ID NO: 1566176 - RNA, 23 nt, Human adenovirus D
cgccgcgcuggggagggccacgu

SEQ ID NO: 1566177 - RNA, 18 nt, Human adenovirus D
ucugcccgcgcucauccc

SEQ ID NO: 1566178 - RNA, 16 nt, Human adenovirus D
ucuauugcuagcccuu

SEQ ID NO: 1566179 - RNA, 17 nt, Human adenovirus D
uccaacucuuaaaucau

SEQ ID NO: 1566180 - RNA, 14 nt, Human adenovirus D
acccugugaccaag

SEQ ID NO: 1566181 - RNA, 17 nt, Human adenovirus D
uggauugcaauuuugug

SEQ ID NO: 1566182 - RNA, 14 nt, Human adenovirus D
caccugucccuacg

SEQ ID NO: 1566183 - RNA, 16 nt, Human adenovirus D
acuggucaaaaacaaa

SEQ ID NO: 1566184 - RNA, 16 nt, Human adenovirus D
agggcagcccuacccc

SEQ ID NO: 1566185 - RNA, 12 nt, Human adenovirus D
cuuccuggggca

SEQ ID NO: 1566186 - RNA, 15 nt, Human adenovirus D
ucggacaugaacugc

SEQ ID NO: 1566187 - RNA, 14 nt, Human adenovirus D
cggcgcgcuccuug

SEQ ID NO: 1566188 - RNA, 12 nt, Human adenovirus D
uguaaagccaga

SEQ ID NO: 1566189 - RNA, 20 nt, Human adenovirus D
gcaagguccgcaggagucca

SEQ ID NO: 1566190 - RNA, 18 nt, Human adenovirus D
gcacguucaggacaccgg

SEQ ID NO: 1566191 - RNA, 11 nt, Human adenovirus D
agcagcagggu

SEQ ID NO: 1566192 - RNA, 20 nt, Human adenovirus D
aauuuuuguuguacucugug

SEQ ID NO: 1566193 - RNA, 15 nt, Human adenovirus D
cuaccgcggcacccg

SEQ ID NO: 1566194 - RNA, 15 nt, Human adenovirus D
uggcuucagagacaa

SEQ ID NO: 1566195 - RNA, 22 nt, Human adenovirus D
cagcaguacaagcgccaacagc

SEQ ID NO: 1566196 - RNA, 12 nt, Human adenovirus D
ugaacaggagca

SEQ ID NO: 1566197 - RNA, 18 nt, Human adenovirus D
gaaaugguucacggccuu

SEQ ID NO: 1566198 - RNA, 20 nt, Human adenovirus D
gaucuccuccuccuggagau

SEQ ID NO: 1566199 - RNA, 18 nt, Human adenovirus D
gucccgcuugcuggaugc

SEQ ID NO: 1566200 - RNA, 14 nt, Human adenovirus D
aggccggcaugccc

SEQ ID NO: 1566201 - RNA, 13 nt, Human adenovirus D
gcuggccgagcug

SEQ ID NO: 1566202 - RNA, 16 nt, Human adenovirus D
accagguccacgcugg

SEQ ID NO: 1566203 - RNA, 21 nt, Human adenovirus D
cacauguccccuuccuccgca

SEQ ID NO: 1566204 - RNA, 23 nt, Human adenovirus D
cugaaaaacaggccgcagcucuu

SEQ ID NO: 1566205 - RNA, 20 nt, Human adenovirus D
cagcaggugcugccccaggc

SEQ ID NO: 1566206 - RNA, 14 nt, Human adenovirus D
gccggugcacuccc

SEQ ID NO: 1566207 - RNA, 16 nt, Human adenovirus D
uggguuggcuugcaug

SEQ ID NO: 1566208 - RNA, 13 nt, Human adenovirus D
ucacccagcaguc

SEQ ID NO: 1566209 - RNA, 22 nt, Human adenovirus D
ccucggggcauugcaggccgug

SEQ ID NO: 1566210 - RNA, 16 nt, Human adenovirus D
gugcggccuugcggag

SEQ ID NO: 1566211 - RNA, 22 nt, Human adenovirus D
gccuacuuuuugggcacccacg

SEQ ID NO: 1566212 - RNA, 22 nt, Human adenovirus D
ggggugcccaacggcaugcuac

SEQ ID NO: 1566213 - RNA, 15 nt, Human adenovirus D
auggauucaaaaacu

SEQ ID NO: 1566214 - RNA, 23 nt, Human adenovirus D
ggcucaucugcagggcgcccagc

SEQ ID NO: 1566215 - RNA, 20 nt, Human adenovirus D
gcaacccaaaaucgagcagg

SEQ ID NO: 1566216 - RNA, 21 nt, Human adenovirus D
gcugccuugucuaucauucag

SEQ ID NO: 1566217 - RNA, 15 nt, Human adenovirus D
gacggaucgcccagg

SEQ ID NO: 1566218 - RNA, 15 nt, Human adenovirus D
augaugauuuaaaaa

SEQ ID NO: 1566219 - RNA, 16 nt, Human adenovirus D
uacauggacaagauau

SEQ ID NO: 1566220 - RNA, 19 nt, Human adenovirus D
gcgcagcaguauccgcgga

SEQ ID NO: 1566221 - RNA, 19 nt, Human adenovirus D
ggccaugccccaggccugg

SEQ ID NO: 1566222 - RNA, 18 nt, Human adenovirus D
ggcgacaagcuggccugc

SEQ ID NO: 1566223 - RNA, 17 nt, Human adenovirus D
augccgauguugguggg

SEQ ID NO: 1566224 - RNA, 14 nt, Human adenovirus D
gugucuuccucucc

SEQ ID NO: 1566225 - RNA, 22 nt, Human adenovirus D
gcgcugguagggggcgccgccg

SEQ ID NO: 1566226 - RNA, 21 nt, Human adenovirus D
ggcuccagcgaaagagagcuc

SEQ ID NO: 1566227 - RNA, 15 nt, Human adenovirus D
gccgccgucugcccc

SEQ ID NO: 1566228 - RNA, 22 nt, Human adenovirus D
aagcgcagcguugagcucaccc

SEQ ID NO: 1566229 - RNA, 15 nt, Human adenovirus D
aaucuuuaucugcug

SEQ ID NO: 1566230 - RNA, 13 nt, Human adenovirus D
augaggcgguggu

SEQ ID NO: 1566231 - RNA, 11 nt, Human adenovirus D
guucaccugca

SEQ ID NO: 1566232 - RNA, 22 nt, Human adenovirus D
ccgacacugcagggagccaggg

SEQ ID NO: 1566233 - RNA, 13 nt, Human adenovirus D
uccagcaacuuca

SEQ ID NO: 1566234 - RNA, 17 nt, Human adenovirus D
agggacagcagcccuuc

SEQ ID NO: 1566235 - RNA, 15 nt, Human adenovirus D
gcuggucaggccucu

SEQ ID NO: 1566236 - RNA, 21 nt, Human adenovirus D
cuggucaucaccuuccugcag

SEQ ID NO: 1566237 - RNA, 19 nt, Human adenovirus D
cgagccauugaccaccagg

SEQ ID NO: 1566238 - RNA, 20 nt, Human adenovirus D
gagaucaaccuccaggccaa

SEQ ID NO: 1566239 - RNA, 22 nt, Human adenovirus D
uggcaaagcgguugagcuggga

SEQ ID NO: 1566240 - RNA, 24 nt, Human adenovirus D
caugcggggggagaugaugugcag

SEQ ID NO: 1566241 - RNA, 20 nt, Human adenovirus D
ggacgcgcucccggcggcag

SEQ ID NO: 1566242 - RNA, 13 nt, Human adenovirus D
ucgagcacagcac

SEQ ID NO: 1566243 - RNA, 16 nt, Human adenovirus D
ccgucuacugcaucug

SEQ ID NO: 1566244 - RNA, 14 nt, Human adenovirus D
uauaaaaacaacaa

SEQ ID NO: 1566245 - RNA, 15 nt, Human adenovirus D
ccgcgcgcuggggca

SEQ ID NO: 1566246 - RNA, 17 nt, Human adenovirus D
ggcgcgauccucgccca

SEQ ID NO: 1566247 - RNA, 15 nt, Human adenovirus D
ccaccgaaggcagcu

SEQ ID NO: 1566248 - RNA, 21 nt, Human adenovirus D
ccggcgcaguacgcgcugucg

SEQ ID NO: 1566249 - RNA, 18 nt, Human adenovirus D
acaguaagugcagcacau

SEQ ID NO: 1566250 - RNA, 16 nt, Human adenovirus D
ggucacaugcuugguc

SEQ ID NO: 1566251 - RNA, 19 nt, Human adenovirus D
cuccagcaacuucaugucc

SEQ ID NO: 1566252 - RNA, 20 nt, Human adenovirus D
gugccgccaaggagcuccuc

SEQ ID NO: 1566253 - RNA, 22 nt, Human adenovirus D
uuccccaccuacuccucuuugc

SEQ ID NO: 1566254 - RNA, 21 nt, Human adenovirus D
cgagaccggaggcgugcacug

SEQ ID NO: 1566255 - RNA, 21 nt, Human adenovirus D
ccgucuggacccgcggccgcc

SEQ ID NO: 1566256 - RNA, 19 nt, Human adenovirus D
gagagcgugauggcgcagg

SEQ ID NO: 1566257 - RNA, 16 nt, Human adenovirus D
aucggcuaccagggcu

SEQ ID NO: 1566258 - RNA, 17 nt, Human adenovirus D
cccggccaaggccacca

SEQ ID NO: 1566259 - RNA, 22 nt, Human adenovirus D
cuaggaagugcggcggcggcug

SEQ ID NO: 1566260 - RNA, 19 nt, Human adenovirus D
ugcugauugcucuggccug

SEQ ID NO: 1566261 - RNA, 12 nt, Human adenovirus D
accuucacagcu

SEQ ID NO: 1566262 - RNA, 22 nt, Human adenovirus D
ggcuggucaguugcaccacgcu

SEQ ID NO: 1566263 - RNA, 17 nt, Human adenovirus D
aggcgcgcccacccgga

SEQ ID NO: 1566264 - RNA, 14 nt, Human adenovirus D
aaaucuuacacaug

SEQ ID NO: 1566265 - RNA, 15 nt, Human adenovirus D
guagcagcagaggaa

SEQ ID NO: 1566266 - RNA, 21 nt, Human adenovirus D
ggcccggcacggcgguggugu

SEQ ID NO: 1566267 - RNA, 12 nt, Human adenovirus D
ccccgcgggcag

SEQ ID NO: 1566268 - RNA, 14 nt, Human adenovirus D
aggugagcucgggc

SEQ ID NO: 1566269 - RNA, 15 nt, Human adenovirus D
cagcaggugcugccc

SEQ ID NO: 1566270 - RNA, 18 nt, Human adenovirus D
ugccugggaauccugcac

SEQ ID NO: 1566271 - RNA, 22 nt, Human adenovirus D
guggucauugauacccuggaca

SEQ ID NO: 1566272 - RNA, 22 nt, Human adenovirus D
guugccaaagaaaauggucagg

SEQ ID NO: 1566273 - RNA, 18 nt, Human adenovirus D
ugacccaaucaccauagc

SEQ ID NO: 1566274 - RNA, 17 nt, Human adenovirus D
cugaucugauccuuguc

SEQ ID NO: 1566275 - RNA, 22 nt, Human adenovirus D
cgcacaacaccgccuccacccu

SEQ ID NO: 1566276 - RNA, 17 nt, Human adenovirus D
gagagcaaucccacgcc

SEQ ID NO: 1566277 - RNA, 16 nt, Human adenovirus D
accgccuccccgcaga

SEQ ID NO: 1566278 - RNA, 16 nt, Human adenovirus D
ccgagggucgcuggcu

SEQ ID NO: 1566279 - RNA, 13 nt, Human adenovirus D
cucguagauggau

SEQ ID NO: 1566280 - RNA, 22 nt, Human adenovirus D
aucgcggcggccaucggcacga

SEQ ID NO: 1566281 - RNA, 14 nt, Human adenovirus D
cagcaagccccgga

SEQ ID NO: 1566282 - RNA, 17 nt, Human adenovirus D
gaugucauaacccgccu

SEQ ID NO: 1566283 - RNA, 18 nt, Human adenovirus D
cucggcaacgaccugcgc

SEQ ID NO: 1566284 - RNA, 18 nt, Human adenovirus D
agguauuuguugagggag

SEQ ID NO: 1566285 - RNA, 23 nt, Human adenovirus D
gagccgcgcgcuggggcagaacg

SEQ ID NO: 1566286 - RNA, 18 nt, Human adenovirus D
ccgcaggcgggacagagg

SEQ ID NO: 1566287 - RNA, 15 nt, Human adenovirus D
gugugcgucagggcg

SEQ ID NO: 1566288 - RNA, 22 nt, Human adenovirus D
cccccaggcccuggagcagcgg

SEQ ID NO: 1566289 - RNA, 18 nt, Human adenovirus D
ccagucccuuuuccagga

SEQ ID NO: 1566290 - RNA, 22 nt, Human adenovirus D
cgucagggcgaaggugucccug

SEQ ID NO: 1566291 - RNA, 15 nt, Human adenovirus D
gggccugaugcagga

SEQ ID NO: 1566292 - RNA, 13 nt, Human adenovirus D
cccaacggcccug

SEQ ID NO: 1566293 - RNA, 20 nt, Human adenovirus D
gccgccaucgaacacgccac

SEQ ID NO: 1566294 - RNA, 17 nt, Human adenovirus D
gacucugacacaccugg

SEQ ID NO: 1566295 - RNA, 21 nt, Human adenovirus D
uccaccucucccgaucauuga

SEQ ID NO: 1566296 - RNA, 12 nt, Human adenovirus D
gggcagggagcu

SEQ ID NO: 1566297 - RNA, 22 nt, Human adenovirus D
gggcaugaccucggcacucagg

SEQ ID NO: 1566298 - RNA, 14 nt, Human adenovirus D
accacaaaaacgaa

SEQ ID NO: 1566299 - RNA, 17 nt, Human adenovirus D
aguacaagcgccaacag

SEQ ID NO: 1566300 - RNA, 16 nt, Human adenovirus D
ugcaugagaauuuuug

SEQ ID NO: 1566301 - RNA, 18 nt, Human adenovirus D
accagaacuuccagcaga

SEQ ID NO: 1566302 - RNA, 17 nt, Human adenovirus D
ggaagccaugcugcgca

SEQ ID NO: 1566303 - RNA, 13 nt, Human adenovirus D
cgccacuggccac

SEQ ID NO: 1566304 - RNA, 17 nt, Human adenovirus D
ggcgccgagcucaugcc

SEQ ID NO: 1566305 - RNA, 14 nt, Human adenovirus D
uccaccucucccga

SEQ ID NO: 1566306 - RNA, 17 nt, Human adenovirus D
aagcgcugguugaacau

SEQ ID NO: 1566307 - RNA, 20 nt, Human adenovirus D
caacaaguuuaggaacccca

SEQ ID NO: 1566308 - RNA, 12 nt, Human adenovirus D
caccgaccuggg

SEQ ID NO: 1566309 - RNA, 15 nt, Human adenovirus D
gcucgaucuccuccu

SEQ ID NO: 1566310 - RNA, 16 nt, Human adenovirus D
gggcgccucccaggac

SEQ ID NO: 1566311 - RNA, 21 nt, Human adenovirus D
acgucuacaaggcccugggca

SEQ ID NO: 1566312 - RNA, 22 nt, Human adenovirus D
uuucuggggucagagacaucau

SEQ ID NO: 1566313 - RNA, 13 nt, Human adenovirus D
uggaggagcagcc

SEQ ID NO: 1566314 - RNA, 15 nt, Human adenovirus D
ccacuggccacgggu

SEQ ID NO: 1566315 - RNA, 18 nt, Human adenovirus D
cgcaggcgacccuggagg

SEQ ID NO: 1566316 - RNA, 20 nt, Human adenovirus D
ggucaccccgccgauuuaaa

SEQ ID NO: 1566317 - RNA, 22 nt, Human adenovirus D
uggcgaugggcccgugggcugc

SEQ ID NO: 1566318 - RNA, 20 nt, Human adenovirus D
gcuccagccaaagcucaugu

SEQ ID NO: 1566319 - RNA, 21 nt, Human adenovirus D
cgaugccaucaacauccacca

SEQ ID NO: 1566320 - RNA, 13 nt, Human adenovirus D
gggaagagcccuu

SEQ ID NO: 1566321 - RNA, 23 nt, Human adenovirus D
gcgcccagauugcaaguacauag

SEQ ID NO: 1566322 - RNA, 22 nt, Human adenovirus D
accuaugggaacaaggccugga

SEQ ID NO: 1566323 - RNA, 24 nt, Human adenovirus D
uccaucgugcgcgaccugggcugc

SEQ ID NO: 1566324 - RNA, 16 nt, Human adenovirus D
ccugcgcgggcugugg

SEQ ID NO: 1566325 - RNA, 14 nt, Human adenovirus D
uuaguucagcugca

SEQ ID NO: 1566326 - RNA, 17 nt, Human adenovirus D
caugugaacaaaaccca

SEQ ID NO: 1566327 - RNA, 17 nt, Human adenovirus D
aagcaaccuuuccaaga

SEQ ID NO: 1566328 - RNA, 18 nt, Human adenovirus D
aggcgggacagaggaggg

SEQ ID NO: 1566329 - RNA, 14 nt, Human adenovirus D
cacgagcgccaggu

SEQ ID NO: 1566330 - RNA, 14 nt, Human adenovirus D
gucgccggaggagg

SEQ ID NO: 1566331 - RNA, 16 nt, Human adenovirus D
cgcugcaaagccagcc

SEQ ID NO: 1566332 - RNA, 21 nt, Human adenovirus D
augguacuaaugacagaggca

SEQ ID NO: 1566333 - RNA, 23 nt, Human adenovirus D
agucuccuggugcgucgagcaca

SEQ ID NO: 1566334 - RNA, 23 nt, Human adenovirus D
caagaggcgacccaugauggugc

SEQ ID NO: 1566335 - RNA, 15 nt, Human adenovirus D
gccccuggcugggcg

SEQ ID NO: 1566336 - RNA, 15 nt, Human adenovirus D
gccagucugaugaau

SEQ ID NO: 1566337 - RNA, 18 nt, Human adenovirus D
uggugggccguuggaaga

SEQ ID NO: 1566338 - RNA, 16 nt, Human adenovirus D
gcccugagagcgcugg

SEQ ID NO: 1566339 - RNA, 14 nt, Human adenovirus D
cccuggcucccagc

SEQ ID NO: 1566340 - RNA, 21 nt, Human adenovirus D
cgagcagaacgggggcagcac

SEQ ID NO: 1566341 - RNA, 18 nt, Human adenovirus D
cagcaucauccccgcgcc

SEQ ID NO: 1566342 - RNA, 17 nt, Human adenovirus D
gccacggucaccgagcc

SEQ ID NO: 1566343 - RNA, 21 nt, Human adenovirus D
acggucugcaggccgggcugc

SEQ ID NO: 1566344 - RNA, 19 nt, Human adenovirus D
gcgugcgaguuggaggaga

SEQ ID NO: 1566345 - RNA, 12 nt, Human adenovirus D
cuggcccgaccg

SEQ ID NO: 1566346 - RNA, 18 nt, Human adenovirus D
gcuggcugcuggagcuga

SEQ ID NO: 1566347 - RNA, 22 nt, Human adenovirus D
agucacacuuaguucagcugca

SEQ ID NO: 1566348 - RNA, 18 nt, Human adenovirus D
gauguaacaucaccacag

SEQ ID NO: 1566349 - RNA, 21 nt, Human adenovirus D
ugcagcaggugcugccccagg

SEQ ID NO: 1566350 - RNA, 13 nt, Human adenovirus D
accgccuggggca

SEQ ID NO: 1566351 - RNA, 15 nt, Human adenovirus D
cacccuggggcuccu

SEQ ID NO: 1566352 - RNA, 19 nt, Human adenovirus D
gaccacgguggugcagaac

SEQ ID NO: 1566353 - RNA, 21 nt, Human adenovirus D
gccggcggcgcgagcugagcg

SEQ ID NO: 1566354 - RNA, 17 nt, Human adenovirus D
ccgcauccacaaggccg

SEQ ID NO: 1566355 - RNA, 19 nt, Human adenovirus D
gagcagaccuuccaggaga

SEQ ID NO: 1566356 - RNA, 21 nt, Human adenovirus D
ggcugcauccacugcuccugc

SEQ ID NO: 1566357 - RNA, 17 nt, Human adenovirus D
ccagcacacucacuuuu

SEQ ID NO: 1566358 - RNA, 17 nt, Human adenovirus D
guugacggucugcaggc

SEQ ID NO: 1566359 - RNA, 14 nt, Human adenovirus D
cgcgcccggggcca

SEQ ID NO: 1566360 - RNA, 22 nt, Human adenovirus D
cgcgcgcaugaccaccugcgcg

SEQ ID NO: 1566361 - RNA, 21 nt, Human adenovirus D
gcacgucugacugccgccggc

SEQ ID NO: 1566362 - RNA, 17 nt, Human adenovirus D
cgcuagccagccacagc

SEQ ID NO: 1566363 - RNA, 23 nt, Human adenovirus D
cccaggcggugcugcugccgagc

SEQ ID NO: 1566364 - RNA, 19 nt, Human adenovirus D
ggcucggugcggcugcugc

SEQ ID NO: 1566365 - RNA, 22 nt, Human adenovirus D
acuuuugcccuuacauguaacu

SEQ ID NO: 1566366 - RNA, 13 nt, Human adenovirus D
gacgcgcuccucg

SEQ ID NO: 1566367 - RNA, 16 nt, Human adenovirus D
aggaggggggccaccu

SEQ ID NO: 1566368 - RNA, 16 nt, Human adenovirus D
guugguccagauggaa

SEQ ID NO: 1566369 - RNA, 17 nt, Human adenovirus D
gugcgaggaugagagcc

SEQ ID NO: 1566370 - RNA, 15 nt, Human adenovirus D
aagccacaaccagag

SEQ ID NO: 1566371 - RNA, 21 nt, Human adenovirus D
cugaccaauagacagcagaag

SEQ ID NO: 1566372 - RNA, 22 nt, Human adenovirus D
ggacgcccuggccgaccggagc

SEQ ID NO: 1566373 - RNA, 16 nt, Human adenovirus D
cagccgcaccgcggcg

SEQ ID NO: 1566374 - RNA, 15 nt, Human adenovirus D
gaucccgccgcagga

SEQ ID NO: 1566375 - RNA, 17 nt, Human adenovirus D
uccaucaacuacugugg

SEQ ID NO: 1566376 - RNA, 20 nt, Human adenovirus D
acguggccuuguaccugccc

SEQ ID NO: 1566377 - RNA, 16 nt, Human adenovirus D
acccugcccuuccagc

SEQ ID NO: 1566378 - RNA, 17 nt, Human adenovirus D
gggggcagacacaccag

SEQ ID NO: 1566379 - RNA, 12 nt, Human adenovirus D
aaagccagcagc

SEQ ID NO: 1566380 - RNA, 18 nt, Human adenovirus D
gcagcaggguacccacug

SEQ ID NO: 1566381 - RNA, 18 nt, Human adenovirus D
cacgagcaagacgcaggc

SEQ ID NO: 1566382 - RNA, 12 nt, Human adenovirus D
gcucuugcaggg

SEQ ID NO: 1566383 - RNA, 14 nt, Human adenovirus D
caccagacacaucu

SEQ ID NO: 1566384 - RNA, 13 nt, Human adenovirus D
ugcugcuccacca

SEQ ID NO: 1566385 - RNA, 16 nt, Human adenovirus D
cgacccccaggcccug

SEQ ID NO: 1566386 - RNA, 19 nt, Human adenovirus D
cgagaucguccucccccga

SEQ ID NO: 1566387 - RNA, 14 nt, Human adenovirus D
gcggggggagauga

SEQ ID NO: 1566388 - RNA, 21 nt, Human adenovirus D
aagacgaaugggaagaagaga

SEQ ID NO: 1566389 - RNA, 20 nt, Human adenovirus D
gaacaaaacccaugaaagaa

SEQ ID NO: 1566390 - RNA, 14 nt, Human adenovirus D
auaagguucugccc

SEQ ID NO: 1566391 - RNA, 20 nt, Human adenovirus D
ucuggaggcgguggucccuu

SEQ ID NO: 1566392 - RNA, 20 nt, Human adenovirus D
uucugcccuccgcccugagc

SEQ ID NO: 1566393 - RNA, 14 nt, Human adenovirus D
ggagcgaggugugc

SEQ ID NO: 1566394 - RNA, 23 nt, Human adenovirus D
ugcacccaccaugcgccaagggc

SEQ ID NO: 1566395 - RNA, 22 nt, Human adenovirus D
aggagacgauccugcaggugga

SEQ ID NO: 1566396 - RNA, 17 nt, Human adenovirus D
acagugcccccuccacu

SEQ ID NO: 1566397 - RNA, 21 nt, Human adenovirus D
gucacacuuaguucagcugca

SEQ ID NO: 1566398 - RNA, 15 nt, Human adenovirus D
ggugagcagcuugcu

SEQ ID NO: 1566399 - RNA, 18 nt, Human adenovirus D
caacgugcccaucuccau

SEQ ID NO: 1566400 - RNA, 16 nt, Human adenovirus D
cgacacugcagggagc

SEQ ID NO: 1566401 - RNA, 21 nt, Human adenovirus D
cgcugagcgacgaccugggcg

SEQ ID NO: 1566402 - RNA, 19 nt, Human adenovirus D
ggagacuuucauccaucug

SEQ ID NO: 1566403 - RNA, 14 nt, Human adenovirus D
cgcgacccccaggc

SEQ ID NO: 1566404 - RNA, 18 nt, Human adenovirus D
ccacccuggaagccaugc

SEQ ID NO: 1566405 - RNA, 17 nt, Human adenovirus D
gcucacucuuaaagacu

SEQ ID NO: 1566406 - RNA, 19 nt, Human adenovirus D
agcaggggcuacauucugg

SEQ ID NO: 1566407 - RNA, 18 nt, Human adenovirus D
ugcaccauccccagguaa

SEQ ID NO: 1566408 - RNA, 13 nt, Human adenovirus D
cuggggagggcca

SEQ ID NO: 1566409 - RNA, 16 nt, Human adenovirus D
ccagugcuuccagcaa

SEQ ID NO: 1566410 - RNA, 18 nt, Human adenovirus D
gaucccaacagccuucag

SEQ ID NO: 1566411 - RNA, 14 nt, Human adenovirus D
guagagcggccagc

SEQ ID NO: 1566412 - RNA, 15 nt, Human adenovirus D
ggaggcggugcgcac

SEQ ID NO: 1566413 - RNA, 19 nt, Human adenovirus D
caggucacagucuggugga

SEQ ID NO: 1566414 - RNA, 20 nt, Human adenovirus D
cucguucugcccaccgugcg

SEQ ID NO: 1566415 - RNA, 15 nt, Human adenovirus D
gcagaacgggggcag

SEQ ID NO: 1566416 - RNA, 16 nt, Human adenovirus D
agcgcccauuccugga

SEQ ID NO: 1566417 - RNA, 23 nt, Human adenovirus D
auuugacacagcaguccaugccc

SEQ ID NO: 1566418 - RNA, 16 nt, Human adenovirus D
ugaggggcggacccca

SEQ ID NO: 1566419 - RNA, 15 nt, Human adenovirus D
ucacuugccgccugc

SEQ ID NO: 1566420 - RNA, 18 nt, Human adenovirus D
ugcgucaucacccagggc

SEQ ID NO: 1566421 - RNA, 15 nt, Human adenovirus D
uugagagagaggaag

SEQ ID NO: 1566422 - RNA, 12 nt, Human adenovirus D
gagcuggcuccg

SEQ ID NO: 1566423 - RNA, 14 nt, Human adenovirus D
uguacuuugucugc

SEQ ID NO: 1566424 - RNA, 20 nt, Human adenovirus D
gaccugcauuggcagccgag

SEQ ID NO: 1566425 - RNA, 16 nt, Human adenovirus D
aucaacuacaaggacu

SEQ ID NO: 1566426 - RNA, 16 nt, Human adenovirus D
caggaaauccccgggc

SEQ ID NO: 1566427 - RNA, 14 nt, Human adenovirus D
ccucagcagucucu

SEQ ID NO: 1566428 - RNA, 16 nt, Human adenovirus D
cguugagcucacccac

SEQ ID NO: 1566429 - RNA, 20 nt, Human adenovirus D
cagauguugcgcagcggcag

SEQ ID NO: 1566430 - RNA, 12 nt, Human adenovirus D
cuauuuucacug

SEQ ID NO: 1566431 - RNA, 14 nt, Human adenovirus D
acggccagcagggu

SEQ ID NO: 1566432 - RNA, 21 nt, Human adenovirus D
gaggccuugacaaaggccgug

SEQ ID NO: 1566433 - RNA, 19 nt, Human adenovirus D
cuauacgggcgaguacgac

SEQ ID NO: 1566434 - RNA, 20 nt, Human adenovirus D
ggucugcaacccccagcucc

SEQ ID NO: 1566435 - RNA, 22 nt, Human adenovirus D
ccagcacaacaacucgggcuuc

SEQ ID NO: 1566436 - RNA, 16 nt, Human adenovirus D
aguuggugagcucuuc

SEQ ID NO: 1566437 - RNA, 17 nt, Human adenovirus D
gcuccucgcucuggggc

SEQ ID NO: 1566438 - RNA, 15 nt, Human adenovirus D
ccguucuacccagca

SEQ ID NO: 1566439 - RNA, 21 nt, Human adenovirus D
gcuggcgguagagcggccagc

SEQ ID NO: 1566440 - RNA, 13 nt, Human adenovirus D
acugccacugcca

SEQ ID NO: 1566441 - RNA, 14 nt, Human adenovirus D
caaaagcgccagga

SEQ ID NO: 1566442 - RNA, 16 nt, Human adenovirus D
gagagccgccugagca

SEQ ID NO: 1566443 - RNA, 21 nt, Human adenovirus D
acaccuggaggcaccaucaca

SEQ ID NO: 1566444 - RNA, 17 nt, Human adenovirus D
cggacgacugggaggcu

SEQ ID NO: 1566445 - RNA, 23 nt, Human adenovirus D
ucugccuggugaagggcacagcc

SEQ ID NO: 1566446 - RNA, 13 nt, Human adenovirus D
ugugaccucccac

SEQ ID NO: 1566447 - RNA, 15 nt, Human adenovirus D
aggagaacugcuggc

SEQ ID NO: 1566448 - RNA, 17 nt, Human adenovirus D
ccgcgcuugcugggcga

SEQ ID NO: 1566449 - RNA, 15 nt, Human adenovirus D
gcaaacuugugguuu

SEQ ID NO: 1566450 - RNA, 16 nt, Human adenovirus D
cuuuacgcuggccagc

SEQ ID NO: 1566451 - RNA, 14 nt, Human adenovirus D
cugcgcgagggccu

SEQ ID NO: 1566452 - RNA, 22 nt, Human adenovirus D
cuggacgggagcaauccuccag

SEQ ID NO: 1566453 - RNA, 22 nt, Human adenovirus D
augugaugggaucgacggugga

SEQ ID NO: 1566454 - RNA, 18 nt, Human adenovirus D
gaaccugcuccugcuccc

SEQ ID NO: 1566455 - RNA, 13 nt, Human adenovirus D
cugcaagaggaga

SEQ ID NO: 1566456 - RNA, 23 nt, Human adenovirus D
gagcccgagggucgcuggcugcu

SEQ ID NO: 1566457 - RNA, 19 nt, Human adenovirus D
gcaaaguuuuucaggggcu

SEQ ID NO: 1566458 - RNA, 19 nt, Human adenovirus D
gugacggccuacgagcaga

SEQ ID NO: 1566459 - RNA, 15 nt, Human adenovirus D
ucagcaucagucucc

SEQ ID NO: 1566460 - RNA, 19 nt, Human adenovirus D
agcuggacaagcuucuugc

SEQ ID NO: 1566461 - RNA, 14 nt, Human adenovirus D
ccaggaauggcacg

SEQ ID NO: 1566462 - RNA, 19 nt, Human adenovirus D
uggaacaccaucagacugg

SEQ ID NO: 1566463 - RNA, 17 nt, Human adenovirus D
caccugugggaccuggc

SEQ ID NO: 1566464 - RNA, 13 nt, Human adenovirus D
ugcagggugacca

SEQ ID NO: 1566465 - RNA, 17 nt, Human adenovirus D
ccccaaacgccagccca

SEQ ID NO: 1566466 - RNA, 18 nt, Human adenovirus D
ccgguuucgggcgggcag

SEQ ID NO: 1566467 - RNA, 15 nt, Human adenovirus D
aguuguucagcagca

SEQ ID NO: 1566468 - RNA, 13 nt, Human adenovirus D
gccaggcgcaggu

SEQ ID NO: 1566469 - RNA, 19 nt, Human adenovirus D
gggcggcaaaauggcgugc

SEQ ID NO: 1566470 - RNA, 14 nt, Human adenovirus D
cggacguggugcug

SEQ ID NO: 1566471 - RNA, 23 nt, Human adenovirus D
gaugcaacgcaucauggcccuga

SEQ ID NO: 1566472 - RNA, 14 nt, Human adenovirus D
gaugaguugggccu

SEQ ID NO: 1566473 - RNA, 14 nt, Human adenovirus D
gugacggcgcgacc

SEQ ID NO: 1566474 - RNA, 14 nt, Human adenovirus D
gccgcucagucauc

SEQ ID NO: 1566475 - RNA, 17 nt, Human adenovirus D
cugcugaaacaccugca

SEQ ID NO: 1566476 - RNA, 15 nt, Human adenovirus D
gggcugcuagagugc

SEQ ID NO: 1566477 - RNA, 14 nt, Human adenovirus D
ggcgaccaccgcga

SEQ ID NO: 1566478 - RNA, 21 nt, Human adenovirus D
cacggucaccgagccucccag

SEQ ID NO: 1566479 - RNA, 22 nt, Human adenovirus D
aagcggucgcgcgaagaggagc

SEQ ID NO: 1566480 - RNA, 19 nt, Human adenovirus D
guacacgguucucucagca

SEQ ID NO: 1566481 - RNA, 12 nt, Human adenovirus D
aggcgagcagcu

SEQ ID NO: 1566482 - RNA, 20 nt, Human adenovirus D
ccauagucaucacccagcag

SEQ ID NO: 1566483 - RNA, 19 nt, Human adenovirus D
ggcucgccuucggcuggaa

SEQ ID NO: 1566484 - RNA, 18 nt, Human adenovirus D
cuuagcucccuauuuaaa

SEQ ID NO: 1566485 - RNA, 19 nt, Human adenovirus D
uuaaaaagcagcacaguaa

SEQ ID NO: 1566486 - RNA, 18 nt, Human adenovirus D
ucggucagcuggcccggc

SEQ ID NO: 1566487 - RNA, 12 nt, Human adenovirus D
cagcagcacagc

SEQ ID NO: 1566488 - RNA, 17 nt, Human adenovirus D
cggaaacgccaccaccu

SEQ ID NO: 1566489 - RNA, 22 nt, Human adenovirus D
aagcguccgcuccgcagugggc

SEQ ID NO: 1566490 - RNA, 13 nt, Human adenovirus D
cuacagaaacauc

SEQ ID NO: 1566491 - RNA, 18 nt, Human adenovirus D
gaguagucaaucucccac

SEQ ID NO: 1566492 - RNA, 17 nt, Human adenovirus D
ccuucaccgaccugggu

SEQ ID NO: 1566493 - RNA, 17 nt, Human adenovirus D
gucgcuggcugcuggag

SEQ ID NO: 1566494 - RNA, 19 nt, Human adenovirus D
ugcgucgagcacagcaccg

SEQ ID NO: 1566495 - RNA, 17 nt, Human adenovirus D
cgaggaccaaucgcgcc

SEQ ID NO: 1566496 - RNA, 13 nt, Human adenovirus D
cgccgcaccuguc

SEQ ID NO: 1566497 - RNA, 19 nt, Human adenovirus D
gcgcacgccguucuccgcc

SEQ ID NO: 1566498 - RNA, 14 nt, Human adenovirus D
gcacuacagccggg

SEQ ID NO: 1566499 - RNA, 23 nt, Human adenovirus D
cggcacgcggccguucaugggca

SEQ ID NO: 1566500 - RNA, 17 nt, Human adenovirus D
uggcgacccaggaaugg

SEQ ID NO: 1566501 - RNA, 20 nt, Human adenovirus D
uguccuggaagucguccaug

SEQ ID NO: 1566502 - RNA, 14 nt, Human adenovirus D
gccaucaagaaccu

SEQ ID NO: 1566503 - RNA, 20 nt, Human adenovirus D
gggcgugcagaccguggaca

SEQ ID NO: 1566504 - RNA, 18 nt, Human adenovirus D
ggcaugggucaggcagcg

SEQ ID NO: 1566505 - RNA, 18 nt, Human adenovirus D
caagcgccaacagcagcg

SEQ ID NO: 1566506 - RNA, 16 nt, Human adenovirus D
ucgcucguucugccca

SEQ ID NO: 1566507 - RNA, 16 nt, Human adenovirus D
ggacucacccuggggc

SEQ ID NO: 1566508 - RNA, 13 nt, Human adenovirus D
acgagaccagagg

SEQ ID NO: 1566509 - RNA, 22 nt, Human adenovirus D
cauagagggcguuggagagaag

SEQ ID NO: 1566510 - RNA, 14 nt, Human adenovirus D
aauggcgugcugga

SEQ ID NO: 1566511 - RNA, 18 nt, Human adenovirus D
agucugaagcgccgccga

SEQ ID NO: 1566512 - RNA, 22 nt, Human adenovirus D
agggaaaagcucaaagaccaga

SEQ ID NO: 1566513 - RNA, 16 nt, Human adenovirus D
ccgagcugacggccag

SEQ ID NO: 1566514 - RNA, 12 nt, Human adenovirus D
gcaacagcaaaa

SEQ ID NO: 1566515 - RNA, 14 nt, Human adenovirus D
aggugucccugacc

SEQ ID NO: 1566516 - RNA, 14 nt, Human adenovirus D
caggggguagaagc

SEQ ID NO: 1566517 - RNA, 17 nt, Human adenovirus D
agcgcccauuccuggag

SEQ ID NO: 1566518 - RNA, 17 nt, Human adenovirus D
cccuccgcccugagcuc

SEQ ID NO: 1566519 - RNA, 14 nt, Human adenovirus D
gccuguacccagag

SEQ ID NO: 1566520 - RNA, 19 nt, Human adenovirus D
ccgcgauguugagcuggac

SEQ ID NO: 1566521 - RNA, 19 nt, Human adenovirus D
gccagacagccgugccauc

SEQ ID NO: 1566522 - RNA, 15 nt, Human adenovirus D
uugucuucccucuca

SEQ ID NO: 1566523 - RNA, 19 nt, Human adenovirus D
aagcaagaugauaccaaga

SEQ ID NO: 1566524 - RNA, 14 nt, Human adenovirus D
agagacagaagaag

SEQ ID NO: 1566525 - RNA, 18 nt, Human adenovirus D
caggguaaagccagcagc

SEQ ID NO: 1566526 - RNA, 17 nt, Human adenovirus D
cugcacuuucuuugcca

SEQ ID NO: 1566527 - RNA, 23 nt, Human adenovirus D
agcucaaacacguagcagcccug

SEQ ID NO: 1566528 - RNA, 16 nt, Human adenovirus D
ggugagccggccgcgc

SEQ ID NO: 1566529 - RNA, 15 nt, Human adenovirus D
ggggcgggucugugc

SEQ ID NO: 1566530 - RNA, 23 nt, Human adenovirus D
acggcugcauccacugcuccugc

SEQ ID NO: 1566531 - RNA, 14 nt, Human adenovirus D
cagguauccagccu

SEQ ID NO: 1566532 - RNA, 20 nt, Human adenovirus D
gucagacccaguggcgagag

SEQ ID NO: 1566533 - RNA, 14 nt, Human adenovirus D
cagaacaaaaacag

SEQ ID NO: 1566534 - RNA, 21 nt, Human adenovirus D
ggccgcccugacccagcaggu

SEQ ID NO: 1566535 - RNA, 20 nt, Human adenovirus D
gaagccuucuauggaggcag

SEQ ID NO: 1566536 - RNA, 13 nt, Human adenovirus D
cccgccaccugca

SEQ ID NO: 1566537 - RNA, 21 nt, Human adenovirus D
cugguagggggcgccgccggc

SEQ ID NO: 1566538 - RNA, 23 nt, Human adenovirus D
gcggagcuugcccuuggaagagc

SEQ ID NO: 1566539 - RNA, 21 nt, Human adenovirus D
cacccggacguggugcugcug

SEQ ID NO: 1566540 - RNA, 13 nt, Human adenovirus D
uggcaccaauuca

SEQ ID NO: 1566541 - RNA, 16 nt, Human adenovirus D
cgccacaggugcugcc

SEQ ID NO: 1566542 - RNA, 23 nt, Human adenovirus D
cauggcuaccugggaggagagga

SEQ ID NO: 1566543 - RNA, 20 nt, Human adenovirus D
caggugagcucgggcugcuc

SEQ ID NO: 1566544 - RNA, 14 nt, Human adenovirus D
gcaugaccagaccc

SEQ ID NO: 1566545 - RNA, 13 nt, Human adenovirus D
cucgcccagcaau

SEQ ID NO: 1566546 - RNA, 15 nt, Human adenovirus D
cgguguugcgcccug

SEQ ID NO: 1566547 - RNA, 13 nt, Human adenovirus D
cagacgcugaaag

SEQ ID NO: 1566548 - RNA, 17 nt, Human adenovirus D
uuccgcaaggaugucaa

SEQ ID NO: 1566549 - RNA, 18 nt, Human adenovirus D
caggcugucggugucccc

SEQ ID NO: 1566550 - RNA, 22 nt, Human adenovirus D
uggccgagcuggaagcccugag

SEQ ID NO: 1566551 - RNA, 15 nt, Human adenovirus D
aacaugcucuacccc

SEQ ID NO: 1566552 - RNA, 15 nt, Human adenovirus D
ugcucuggggucgug

SEQ ID NO: 1566553 - RNA, 12 nt, Human adenovirus D
gcugucgguguc

SEQ ID NO: 1566554 - RNA, 22 nt, Human adenovirus D
ccggaccccgccauaagggcgg

SEQ ID NO: 1566555 - RNA, 23 nt, Human adenovirus D
cgccuuccuggcgacgcagccgg

SEQ ID NO: 1566556 - RNA, 14 nt, Human adenovirus D
cgggcuaccgcggc

SEQ ID NO: 1566557 - RNA, 17 nt, Human adenovirus D
gccccugcaagugcaca

SEQ ID NO: 1566558 - RNA, 20 nt, Human adenovirus D
ccauuaucccgacgccgggc

SEQ ID NO: 1566559 - RNA, 17 nt, Human adenovirus D
ggcguggugcuggauga

SEQ ID NO: 1566560 - RNA, 20 nt, Human adenovirus D
ugcaggauaaauauggccug

SEQ ID NO: 1566561 - RNA, 19 nt, Human adenovirus D
ucacacuuaguucagcugc

SEQ ID NO: 1566562 - RNA, 14 nt, Human adenovirus D
cguguacugggugc

SEQ ID NO: 1566563 - RNA, 13 nt, Human adenovirus D
acgccagccgcag

SEQ ID NO: 1566564 - RNA, 15 nt, Human adenovirus D
cugcuucgcccggga

SEQ ID NO: 1566565 - RNA, 14 nt, Human adenovirus D
ccggcgaccaccgc

SEQ ID NO: 1566566 - RNA, 13 nt, Human adenovirus D
cacccucaggcgc

SEQ ID NO: 1566567 - RNA, 17 nt, Human adenovirus D
gaaaguaugucucuggu

SEQ ID NO: 1566568 - RNA, 16 nt, Human adenovirus D
gacgcaggccaggagg

SEQ ID NO: 1566569 - RNA, 15 nt, Human adenovirus D
accugugacaugcaa

SEQ ID NO: 1566570 - RNA, 15 nt, Human adenovirus D
cauagaugggcuccg

SEQ ID NO: 1566571 - RNA, 17 nt, Human adenovirus D
caggggagugaagaggg

SEQ ID NO: 1566572 - RNA, 13 nt, Human adenovirus D
cagccgcaggcca

SEQ ID NO: 1566573 - RNA, 20 nt, Human adenovirus D
agccuugauuuuuccagccc

SEQ ID NO: 1566574 - RNA, 15 nt, Human adenovirus D
cagaucauggugccc

SEQ ID NO: 1566575 - RNA, 19 nt, Human adenovirus D
cuaccugcaucgcgcggcg

SEQ ID NO: 1566576 - RNA, 20 nt, Human adenovirus D
caaucgccacaggugcugcc

SEQ ID NO: 1566577 - RNA, 16 nt, Human adenovirus D
cuaacuuauacuacca

SEQ ID NO: 1566578 - RNA, 17 nt, Human adenovirus D
acaaucagccccuuccc

SEQ ID NO: 1566579 - RNA, 16 nt, Human adenovirus D
cgagcagcgcauccug

SEQ ID NO: 1566580 - RNA, 14 nt, Human adenovirus D
ucaggagcagcgcc

SEQ ID NO: 1566581 - RNA, 13 nt, Human adenovirus D
gcggcguccugga

SEQ ID NO: 1566582 - RNA, 13 nt, Human adenovirus D
ccccacgguggcc

SEQ ID NO: 1566583 - RNA, 22 nt, Human adenovirus D
ucccgucuuugcgguccccgag

SEQ ID NO: 1566584 - RNA, 18 nt, Human adenovirus D
ggaucgacgguggacggg

SEQ ID NO: 1566585 - RNA, 13 nt, Human adenovirus D
aacuuccagcaga

SEQ ID NO: 1566586 - RNA, 21 nt, Human adenovirus D
aaacuaagguggcuauuuuca

SEQ ID NO: 1566587 - RNA, 19 nt, Human adenovirus D
cggcggacaucgcuucccu

SEQ ID NO: 1566588 - RNA, 16 nt, Human adenovirus D
ugcgcgagcagaacgg

SEQ ID NO: 1566589 - RNA, 15 nt, Human adenovirus D
gcacgcccgccaugg

SEQ ID NO: 1566590 - RNA, 13 nt, Human adenovirus D
ggcguacaugcac

SEQ ID NO: 1566591 - RNA, 18 nt, Human adenovirus D
ccacaugacccugcaugg

SEQ ID NO: 1566592 - RNA, 12 nt, Human adenovirus D
ugucucuggugu

SEQ ID NO: 1566593 - RNA, 23 nt, Human adenovirus D
ccauggccaggggagugaagagg

SEQ ID NO: 1566594 - RNA, 13 nt, Human adenovirus D
gaugucucggugu

SEQ ID NO: 1566595 - RNA, 21 nt, Human adenovirus D
agcaguauccgcggaguccag

SEQ ID NO: 1566596 - RNA, 23 nt, Human adenovirus D
cugagcucuuaccaaguccaggg

SEQ ID NO: 1566597 - RNA, 15 nt, Human adenovirus D
caacugcagaccggg

SEQ ID NO: 1566598 - RNA, 18 nt, Human adenovirus D
agcgccagucccucaucc

SEQ ID NO: 1566599 - RNA, 15 nt, Human adenovirus D
ugauugcucuggccu

SEQ ID NO: 1566600 - RNA, 14 nt, Human adenovirus D
acuaaucauuuaau

SEQ ID NO: 1566601 - RNA, 23 nt, Human adenovirus D
augcagccaguggcccuggaugu

SEQ ID NO: 1566602 - RNA, 15 nt, Human adenovirus D
caacaugcugacugc

SEQ ID NO: 1566603 - RNA, 16 nt, Human adenovirus D
cacggccuuguaggga

SEQ ID NO: 1566604 - RNA, 18 nt, Human adenovirus D
ucacacuacacagcuaga

SEQ ID NO: 1566605 - RNA, 17 nt, Human adenovirus D
agacccggagcccaccc

SEQ ID NO: 1566606 - RNA, 20 nt, Human adenovirus D
gccgccaaggagcuccucga

SEQ ID NO: 1566607 - RNA, 14 nt, Human adenovirus D
gagaaggugcuggc

SEQ ID NO: 1566608 - RNA, 21 nt, Human adenovirus D
acgcgcugucggccgaggagg

SEQ ID NO: 1566609 - RNA, 18 nt, Human adenovirus D
ggcgcugcaaagccagcc

SEQ ID NO: 1566610 - RNA, 23 nt, Human adenovirus D
cacgggacgcuaccgcugcgcag

SEQ ID NO: 1566611 - RNA, 14 nt, Human adenovirus D
ggagacgggcugcu

SEQ ID NO: 1566612 - RNA, 21 nt, Human adenovirus D
cgugccccccaaacgccagcc

SEQ ID NO: 1566613 - RNA, 12 nt, Human adenovirus D
gagcucacccac

SEQ ID NO: 1566614 - RNA, 14 nt, Human adenovirus D
ccugggucagaaca

SEQ ID NO: 1566615 - RNA, 23 nt, Human adenovirus D
ggagcagccgcguaagcaggagc

SEQ ID NO: 1566616 - RNA, 16 nt, Human adenovirus D
ccagacgcggcuguag

SEQ ID NO: 1566617 - RNA, 15 nt, Human adenovirus D
gcgagcugagcgacc

SEQ ID NO: 1566618 - RNA, 19 nt, Human adenovirus D
cgcguguugcggcccggca

SEQ ID NO: 1566619 - RNA, 20 nt, Human adenovirus D
ugaagggcacagccucucug

SEQ ID NO: 1566620 - RNA, 14 nt, Human adenovirus D
aaauauggccugga

SEQ ID NO: 1566621 - RNA, 14 nt, Human adenovirus D
acgccuuccuggcg

SEQ ID NO: 1566622 - RNA, 21 nt, Human adenovirus D
accgacacguacuucagccug

SEQ ID NO: 1566623 - RNA, 15 nt, Human adenovirus D
uccucgcucuggggc

SEQ ID NO: 1566624 - RNA, 22 nt, Human adenovirus D
gccgguuucgggcgggcaggga

SEQ ID NO: 1566625 - RNA, 14 nt, Human adenovirus D
gccccgccaaccgg

SEQ ID NO: 1566626 - RNA, 16 nt, Human adenovirus D
caugugcgcacccuga

SEQ ID NO: 1566627 - RNA, 17 nt, Human adenovirus D
ggaguccaccgcuccgc

SEQ ID NO: 1566628 - RNA, 13 nt, Human adenovirus D
gccagcacgcucu

SEQ ID NO: 1566629 - RNA, 16 nt, Human adenovirus D
agcagacagggccugc

SEQ ID NO: 1566630 - RNA, 12 nt, Human adenovirus D
uuucuucuccca

SEQ ID NO: 1566631 - RNA, 22 nt, Human adenovirus D
cggagcgacacccccgcgugca

SEQ ID NO: 1566632 - RNA, 23 nt, Human adenovirus D
ugguggcuagaaaacacccacag

SEQ ID NO: 1566633 - RNA, 23 nt, Human adenovirus D
cccucaucacaucagccaggacu

SEQ ID NO: 1566634 - RNA, 12 nt, Human adenovirus D
cuacaaggccgu

SEQ ID NO: 1566635 - RNA, 20 nt, Human adenovirus D
gacugauggccacggggagc

SEQ ID NO: 1566636 - RNA, 21 nt, Human adenovirus D
gcagugggcgcagacggucuc

SEQ ID NO: 1566637 - RNA, 19 nt, Human adenovirus D
gacaucgcgaaccaggcag

SEQ ID NO: 1566638 - RNA, 13 nt, Human adenovirus D
cggugcugcugcc

SEQ ID NO: 1566639 - RNA, 15 nt, Human adenovirus D
ggcgcaggcgacccu

SEQ ID NO: 1566640 - RNA, 21 nt, Human adenovirus D
ccgcucgcucguucugcccac

SEQ ID NO: 1566641 - RNA, 15 nt, Human adenovirus D
uggaagccaugcugc

SEQ ID NO: 1566642 - RNA, 16 nt, Human adenovirus D
cccaacggcaccugcg

SEQ ID NO: 1566643 - RNA, 15 nt, Human adenovirus D
cagggucucaggguc

SEQ ID NO: 1566644 - RNA, 11 nt, Human adenovirus D
agcagcacagu

SEQ ID NO: 1566645 - RNA, 16 nt, Human adenovirus D
ccugcgcuaccgcucc

SEQ ID NO: 1566646 - RNA, 14 nt, Human adenovirus D
cgcaagcucaugcu

SEQ ID NO: 1566647 - RNA, 20 nt, Human adenovirus D
gccacccgccgccgucugcc

SEQ ID NO: 1566648 - RNA, 16 nt, Human adenovirus D
ucaccuuccugcagcu

SEQ ID NO: 1566649 - RNA, 19 nt, Human adenovirus D
gccaauguuacgcugcccg

SEQ ID NO: 1566650 - RNA, 22 nt, Human adenovirus D
gaggagcaccccaacggcccug

SEQ ID NO: 1566651 - RNA, 23 nt, Human adenovirus D
gggcgcuugcaagggugcgcuug

SEQ ID NO: 1566652 - RNA, 16 nt, Human adenovirus D
gcucggugacgugcuc

SEQ ID NO: 1566653 - RNA, 16 nt, Human adenovirus D
gggcuggcgagacugg

SEQ ID NO: 1566654 - RNA, 24 nt, Human adenovirus D
gaggaggacuuaaccacccacgag

SEQ ID NO: 1566655 - RNA, 13 nt, Human adenovirus D
accaggaugcagc

SEQ ID NO: 1566656 - RNA, 12 nt, Human adenovirus D
ccuggcucccag

SEQ ID NO: 1566657 - RNA, 18 nt, Human adenovirus D
cgcccagguuuuccaugc

SEQ ID NO: 1566658 - RNA, 23 nt, Human adenovirus D
gaacccgcgcucgcgcaccugcu

SEQ ID NO: 1566659 - RNA, 13 nt, Human adenovirus D
ccgcguccccgcc

SEQ ID NO: 1566660 - RNA, 16 nt, Human adenovirus D
cugaaaauuugcaaaa

SEQ ID NO: 1566661 - RNA, 16 nt, Human adenovirus D
ccggugcccgcuccgc

SEQ ID NO: 1566662 - RNA, 20 nt, Human adenovirus D
gcagcggggaggagcccgag

SEQ ID NO: 1566663 - RNA, 14 nt, Human adenovirus D
ggccguuggaagau

SEQ ID NO: 1566664 - RNA, 22 nt, Human adenovirus D
gccagcaaacgccgccgccgca

SEQ ID NO: 1566665 - RNA, 17 nt, Human adenovirus D
gguuaguaugucccugg

SEQ ID NO: 1566666 - RNA, 10 nt, Human adenovirus D
cucaccaccc

SEQ ID NO: 1566667 - RNA, 20 nt, Human adenovirus D
caugccacgaacagccacga

SEQ ID NO: 1566668 - RNA, 17 nt, Human adenovirus D
aaacucuuggagcaggg

SEQ ID NO: 1566669 - RNA, 21 nt, Human adenovirus D
ucaccauguuauucagcagcc

SEQ ID NO: 1566670 - RNA, 20 nt, Human adenovirus D
cgagcccgagggucgcuggc

SEQ ID NO: 1566671 - RNA, 14 nt, Human adenovirus D
cgcaccgucgccuc

SEQ ID NO: 1566672 - RNA, 16 nt, Human adenovirus D
cucacuuuuaggugaa

SEQ ID NO: 1566673 - RNA, 18 nt, Human adenovirus D
uccaaggccaucugccac

SEQ ID NO: 1566674 - RNA, 19 nt, Human adenovirus D
cgagaccugcgcaaggucg

SEQ ID NO: 1566675 - RNA, 20 nt, Human adenovirus D
ccgcacgguaagagcccagc

SEQ ID NO: 1566676 - RNA, 18 nt, Human adenovirus D
gcaggguaaagccagcag

SEQ ID NO: 1566677 - RNA, 15 nt, Human adenovirus D
ccgcggccgcccacg

SEQ ID NO: 1566678 - RNA, 15 nt, Human adenovirus D
uaucagcgcgcugcg

SEQ ID NO: 1566679 - RNA, 22 nt, Human adenovirus D
gcccgagggucgcuggcugcug

SEQ ID NO: 1566680 - RNA, 21 nt, Human adenovirus D
accccacgguggccccgaccc

SEQ ID NO: 1566681 - RNA, 18 nt, Human adenovirus D
gagaccaaguccagggug

SEQ ID NO: 1566682 - RNA, 15 nt, Human adenovirus D
aauggcgugcuggag

SEQ ID NO: 1566683 - RNA, 16 nt, Human adenovirus D
cgucgacggcgccucc

SEQ ID NO: 1566684 - RNA, 18 nt, Human adenovirus D
caucccggccaaggccac

SEQ ID NO: 1566685 - RNA, 19 nt, Human adenovirus D
augacagaggcaacagcaa

SEQ ID NO: 1566686 - RNA, 21 nt, Human adenovirus D
ggccuggaauaguagcacggg

SEQ ID NO: 1566687 - RNA, 21 nt, Human adenovirus D
agagaaggguuaacauuugac

SEQ ID NO: 1566688 - RNA, 21 nt, Human adenovirus D
ccaacggcugcauccacugcu

SEQ ID NO: 1566689 - RNA, 17 nt, Human adenovirus D
gagccaggugagcucgg

SEQ ID NO: 1566690 - RNA, 14 nt, Human adenovirus D
aacaguacuggcaa

SEQ ID NO: 1566691 - RNA, 16 nt, Human adenovirus D
gcuucccuggaagagu

SEQ ID NO: 1566692 - RNA, 16 nt, Human adenovirus D
cgccauggggcgccgc

SEQ ID NO: 1566693 - RNA, 20 nt, Human adenovirus D
aauacagaugguagcagcag

SEQ ID NO: 1566694 - RNA, 13 nt, Human adenovirus D
agacagcagaaga

SEQ ID NO: 1566695 - RNA, 22 nt, Human adenovirus D
cugcuaccucuugcagcuggcc

SEQ ID NO: 1566696 - RNA, 21 nt, Human adenovirus D
cacgucugacugccgccggcc

SEQ ID NO: 1566697 - RNA, 21 nt, Human adenovirus D
cgcucggugacaaacaggcug

SEQ ID NO: 1566698 - RNA, 15 nt, Human adenovirus D
gugaagauagacagc

SEQ ID NO: 1566699 - RNA, 18 nt, Human adenovirus D
gucaucaccuuccugcag

SEQ ID NO: 1566700 - RNA, 13 nt, Human adenovirus D
acgaggcagaggc

SEQ ID NO: 1566701 - RNA, 21 nt, Human adenovirus D
ccgagcuccgcgaacagcagc

SEQ ID NO: 1566702 - RNA, 20 nt, Human adenovirus D
cucuacgcguacauccagca

SEQ ID NO: 1566703 - RNA, 23 nt, Human adenovirus D
cacgugaccagggguccccgacg

SEQ ID NO: 1566704 - RNA, 13 nt, Human adenovirus D
gaacugaugaaaa

SEQ ID NO: 1566705 - RNA, 21 nt, Human adenovirus D
ccggaguaucauugaugcaug

SEQ ID NO: 1566706 - RNA, 13 nt, Human adenovirus D
caucaucgcgcca

SEQ ID NO: 1566707 - RNA, 22 nt, Human adenovirus D
ccgacuuugucccgcugagcua

SEQ ID NO: 1566708 - RNA, 23 nt, Human adenovirus D
caaccaugugcgcacccugaucg

SEQ ID NO: 1566709 - RNA, 13 nt, Human adenovirus D
cgugaccaggggu

SEQ ID NO: 1566710 - RNA, 19 nt, Human adenovirus D
gcgccuucaauuggagcag

SEQ ID NO: 1566711 - RNA, 15 nt, Human adenovirus D
aagucuacuggucgc

SEQ ID NO: 1566712 - RNA, 21 nt, Human adenovirus D
uccgcaggaguccaccgcucc

SEQ ID NO: 1566713 - RNA, 23 nt, Human adenovirus D
agcgauucccgggcuuucuugcc

SEQ ID NO: 1566714 - RNA, 14 nt, Human adenovirus D
aucuugcccacguc

SEQ ID NO: 1566715 - RNA, 14 nt, Human adenovirus D
ggaacugaugaaaa

SEQ ID NO: 1566716 - RNA, 20 nt, Human adenovirus D
ggaggccaucgugcagaacc

SEQ ID NO: 1566717 - RNA, 23 nt, Human adenovirus D
gagcuacagcaggagugcaggga

SEQ ID NO: 1566718 - RNA, 21 nt, Human adenovirus D
gaagcccgugaccugcagcag

SEQ ID NO: 1566719 - RNA, 23 nt, Human adenovirus D
gagauccagguccgggggcaggg

SEQ ID NO: 1566720 - RNA, 16 nt, Human adenovirus D
ccaggcuggccgugcu

SEQ ID NO: 1566721 - RNA, 16 nt, Human adenovirus D
ucggaaaacaggaugg

SEQ ID NO: 1566722 - RNA, 17 nt, Human adenovirus D
guacagcacagcaggga

SEQ ID NO: 1566723 - RNA, 16 nt, Human adenovirus D
cgcgggcggccauugc

SEQ ID NO: 1566724 - RNA, 12 nt, Human adenovirus D
gacgguggugcg

SEQ ID NO: 1566725 - RNA, 15 nt, Human adenovirus D
uggccuguccugcag

SEQ ID NO: 1566726 - RNA, 18 nt, Human adenovirus D
cggcagcuuuuugagcuc

SEQ ID NO: 1566727 - RNA, 15 nt, Human adenovirus D
cuaccugggaggaga

SEQ ID NO: 1566728 - RNA, 15 nt, Human adenovirus D
cuacggagggcagaa

SEQ ID NO: 1566729 - RNA, 14 nt, Human adenovirus D
accuugaaagggau

SEQ ID NO: 1566730 - RNA, 23 nt, Human adenovirus D
aaguuuaauggggugcuguucau

SEQ ID NO: 1566731 - RNA, 17 nt, Human adenovirus D
agaaccccacaggauga

SEQ ID NO: 1566732 - RNA, 21 nt, Human adenovirus D
caggagaugagcagaacuaca

SEQ ID NO: 1566733 - RNA, 16 nt, Human adenovirus D
cgcugccggaccucau

SEQ ID NO: 1566734 - RNA, 20 nt, Human adenovirus D
uccgguugugcagcccccuc

SEQ ID NO: 1566735 - RNA, 20 nt, Human adenovirus D
uuuugaggaugcaucaucca

SEQ ID NO: 1566736 - RNA, 21 nt, Human adenovirus D
uacaagagagaugcuccaggu

SEQ ID NO: 1566737 - RNA, 18 nt, Human adenovirus D
cggccugaaccgccgccg

SEQ ID NO: 1566738 - RNA, 23 nt, Human adenovirus D
ugagagucugaaaaacagaaagc

SEQ ID NO: 1566739 - RNA, 22 nt, Human adenovirus D
caggaugggucugugccucucc

SEQ ID NO: 1566740 - RNA, 14 nt, Human adenovirus D
cacggccagcaggg

SEQ ID NO: 1566741 - RNA, 20 nt, Human adenovirus D
uggauggaaaaauauuugug

SEQ ID NO: 1566742 - RNA, 19 nt, Human adenovirus D
aaugacaaacaaaagccau

SEQ ID NO: 1566743 - RNA, 23 nt, Human adenovirus D
caggcuggccgugcucaagcgca

SEQ ID NO: 1566744 - RNA, 12 nt, Human adenovirus D
aucugaaaguau

SEQ ID NO: 1566745 - RNA, 18 nt, Human adenovirus D
aggugcgccccaucaagc

SEQ ID NO: 1566746 - RNA, 23 nt, Human adenovirus D
ucacggccuuguagggacagcag

SEQ ID NO: 1566747 - RNA, 14 nt, Human adenovirus D
ggccucuacccgga

SEQ ID NO: 1566748 - RNA, 22 nt, Human adenovirus D
gcggccguccuuucgcugcugc

SEQ ID NO: 1566749 - RNA, 18 nt, Human adenovirus D
cgcgaggagguggcccug

SEQ ID NO: 1566750 - RNA, 18 nt, Human adenovirus D
gggugcgcuugagacuca

SEQ ID NO: 1566751 - RNA, 14 nt, Human adenovirus D
cgagaucaagcgca

SEQ ID NO: 1566752 - RNA, 19 nt, Human adenovirus D
gccguggccucuucgcccg

SEQ ID NO: 1566753 - RNA, 23 nt, Human adenovirus D
cuggugauacgaggcagaggcac

SEQ ID NO: 1566754 - RNA, 17 nt, Human adenovirus D
agcuccugagcgagacc

SEQ ID NO: 1566755 - RNA, 15 nt, Human adenovirus D
acaucugugcugccu

SEQ ID NO: 1566756 - RNA, 22 nt, Human adenovirus D
uaagaauccacagaucagacau

SEQ ID NO: 1566757 - RNA, 23 nt, Human adenovirus D
ccccucgaaucaggcuggagccg

SEQ ID NO: 1566758 - RNA, 22 nt, Human adenovirus D
cgcccacggugguggagaugga

SEQ ID NO: 1566759 - RNA, 13 nt, Human adenovirus D
ccuccaggccaac

SEQ ID NO: 1566760 - RNA, 14 nt, Human adenovirus D
caucuccaccacgu

SEQ ID NO: 1566761 - RNA, 14 nt, Human adenovirus D
ucuacagccagcag

SEQ ID NO: 1566762 - RNA, 18 nt, Human adenovirus D
acucgcagugcacgggca

SEQ ID NO: 1566763 - RNA, 21 nt, Human adenovirus D
cugcacaccaacaugcccaau

SEQ ID NO: 1566764 - RNA, 17 nt, Human adenovirus D
gaugguuucccucgggc

SEQ ID NO: 1566765 - RNA, 23 nt, Human adenovirus D
ucagggcgaaggugucccugacc

SEQ ID NO: 1566766 - RNA, 17 nt, Human adenovirus D
cacgccguucuccgccg

SEQ ID NO: 1566767 - RNA, 20 nt, Human adenovirus D
caugugaacaaaacccauga

SEQ ID NO: 1566768 - RNA, 22 nt, Human adenovirus D
ggaagcccugagccgccagcug

SEQ ID NO: 1566769 - RNA, 14 nt, Human adenovirus D
aggccuggcccuga

SEQ ID NO: 1566770 - RNA, 15 nt, Human adenovirus D
cggaccaccccaggc

SEQ ID NO: 1566771 - RNA, 14 nt, Human adenovirus D
cggugcugcugccg

SEQ ID NO: 1566772 - RNA, 17 nt, Human adenovirus D
cugaguuuaauaaaagc

SEQ ID NO: 1566773 - RNA, 17 nt, Human adenovirus D
ucucggaccaaccccac

SEQ ID NO: 1566774 - RNA, 14 nt, Human adenovirus D
gaaaagucauccaa

SEQ ID NO: 1566775 - RNA, 20 nt, Human adenovirus D
gggcauuaacgggguggugg

SEQ ID NO: 1566776 - RNA, 19 nt, Human adenovirus D
caggccuaacuacauuggc

SEQ ID NO: 1566777 - RNA, 21 nt, Human adenovirus D
gaagaaaugaggcaggccaug

SEQ ID NO: 1566778 - RNA, 12 nt, Human adenovirus D
gacaacgccagg

SEQ ID NO: 1566779 - RNA, 18 nt, Human adenovirus D
auacauccucuggcuuuu

SEQ ID NO: 1566780 - RNA, 12 nt, Human adenovirus D
caagaacgccau

SEQ ID NO: 1566781 - RNA, 14 nt, Human adenovirus D
gacaagcuggccug

SEQ ID NO: 1566782 - RNA, 11 nt, Human adenovirus D
gggcacccacg

SEQ ID NO: 1566783 - RNA, 16 nt, Human adenovirus D
ggcccuggcugguggu

SEQ ID NO: 1566784 - RNA, 13 nt, Human adenovirus D
uuccaaaaucaga

SEQ ID NO: 1566785 - RNA, 17 nt, Human adenovirus D
uguagaugauccaguca

SEQ ID NO: 1566786 - RNA, 17 nt, Human adenovirus D
uguuuacaaucuggcgg

SEQ ID NO: 1566787 - RNA, 14 nt, Human adenovirus D
gccccccgcccgcg

SEQ ID NO: 1566788 - RNA, 16 nt, Human adenovirus D
agucucaccugguuag

SEQ ID NO: 1566789 - RNA, 21 nt, Human adenovirus D
ggcucccagccuccaccgcua

SEQ ID NO: 1566790 - RNA, 20 nt, Human adenovirus D
cucaccaccccggacgucac

SEQ ID NO: 1566791 - RNA, 15 nt, Human adenovirus D
acgagggccugggcu

SEQ ID NO: 1566792 - RNA, 21 nt, Human adenovirus D
cagaaggugguggacggccug

SEQ ID NO: 1566793 - RNA, 17 nt, Human adenovirus D
cagcaggagcgugccgc

SEQ ID NO: 1566794 - RNA, 14 nt, Human adenovirus D
ugcaggccgggcug

SEQ ID NO: 1566795 - RNA, 14 nt, Human adenovirus D
aaucaauguaacua

SEQ ID NO: 1566796 - RNA, 14 nt, Human adenovirus D
gggugggccccugg

SEQ ID NO: 1566797 - RNA, 22 nt, Human adenovirus D
aacucugauucaugugaacaaa

SEQ ID NO: 1566798 - RNA, 23 nt, Human adenovirus D
agcuggcccggcaacgaccggcu

SEQ ID NO: 1566799 - RNA, 14 nt, Human adenovirus D
cuaaugacaaacaa

SEQ ID NO: 1566800 - RNA, 14 nt, Human adenovirus D
ccagacccaggcgc

SEQ ID NO: 1566801 - RNA, 15 nt, Human adenovirus D
cauccugcacgcagc

SEQ ID NO: 1566802 - RNA, 22 nt, Human adenovirus D
caggaggagaccgacgcugggc

SEQ ID NO: 1566803 - RNA, 15 nt, Human adenovirus D
ugcuacaucugcugc

SEQ ID NO: 1566804 - RNA, 12 nt, Human adenovirus D
ccaucaccaccg

SEQ ID NO: 1566805 - RNA, 21 nt, Human adenovirus D
gacauccuggaccaggcggca

SEQ ID NO: 1566806 - RNA, 16 nt, Human adenovirus D
ggaccgcagcggggag

SEQ ID NO: 1566807 - RNA, 22 nt, Human adenovirus D
ugguaguuuuuucuuuaaucau

SEQ ID NO: 1566808 - RNA, 15 nt, Human adenovirus D
uauggccuggagcag

SEQ ID NO: 1566809 - RNA, 17 nt, Human adenovirus D
ucggcucgacgcuccgg

SEQ ID NO: 1566810 - RNA, 23 nt, Human adenovirus D
gcacgcgggugaggguguccugg

SEQ ID NO: 1566811 - RNA, 13 nt, Human adenovirus D
ccugcccgacucc

SEQ ID NO: 1566812 - RNA, 16 nt, Human adenovirus D
gcccagcgagaggagc

SEQ ID NO: 1566813 - RNA, 13 nt, Human adenovirus D
agcaggcgccggc

SEQ ID NO: 1566814 - RNA, 17 nt, Human adenovirus D
gccggcgaaccgagcac

SEQ ID NO: 1566815 - RNA, 13 nt, Human adenovirus D
caggaccaccagg

SEQ ID NO: 1566816 - RNA, 13 nt, Human adenovirus D
cgcaugaccaccu

SEQ ID NO: 1566817 - RNA, 19 nt, Human adenovirus D
uagcacguuucgucaggca

SEQ ID NO: 1566818 - RNA, 12 nt, Human adenovirus D
ccgagcucugcu

SEQ ID NO: 1566819 - RNA, 14 nt, Human adenovirus D
caggccaggaggag

SEQ ID NO: 1566820 - RNA, 14 nt, Human adenovirus D
aggcgagcagcugu

SEQ ID NO: 1566821 - RNA, 17 nt, Human adenovirus D
gcggagaacaaggccau

SEQ ID NO: 1566822 - RNA, 12 nt, Human adenovirus D
cagcgcgagcgg

SEQ ID NO: 1566823 - RNA, 20 nt, Human adenovirus D
cgggccuacuuuuugggcac

SEQ ID NO: 1566824 - RNA, 19 nt, Human adenovirus D
uuuuccaugcacucaucca

SEQ ID NO: 1566825 - RNA, 14 nt, Human adenovirus D
gcgccgcgccagac

SEQ ID NO: 1566826 - RNA, 14 nt, Human adenovirus D
uaucagacaugcug

SEQ ID NO: 1566827 - RNA, 12 nt, Human adenovirus D
ggagccacugcu

SEQ ID NO: 1566828 - RNA, 15 nt, Human adenovirus D
ggcacccaccacagu

SEQ ID NO: 1566829 - RNA, 23 nt, Human adenovirus D
agucacaguuauaccaccuccuc

SEQ ID NO: 1566830 - RNA, 17 nt, Human adenovirus D
cgucgacggggaaggcu

SEQ ID NO: 1566831 - RNA, 17 nt, Human adenovirus D
ggcgccggcgcuagcca

SEQ ID NO: 1566832 - RNA, 23 nt, Human adenovirus D
cuuucacccggacguggugcugc

SEQ ID NO: 1566833 - RNA, 14 nt, Human adenovirus D
cgcuaccgcuucca

SEQ ID NO: 1566834 - RNA, 17 nt, Human adenovirus D
ccucaggcgcaaccagg

SEQ ID NO: 1566835 - RNA, 14 nt, Human adenovirus D
gauacccuggacaa

SEQ ID NO: 1566836 - RNA, 11 nt, Human adenovirus D
acauguaacuu

SEQ ID NO: 1566837 - RNA, 12 nt, Human adenovirus D
uagaaacagauc

SEQ ID NO: 1566838 - RNA, 15 nt, Human adenovirus D
augggucaggcagcg

SEQ ID NO: 1566839 - RNA, 17 nt, Human adenovirus D
gaaacagauccugcugc

SEQ ID NO: 1566840 - RNA, 16 nt, Human adenovirus D
uuuuagaauggaagac

SEQ ID NO: 1566841 - RNA, 18 nt, Human adenovirus D
gaaagaacauacaugggc

SEQ ID NO: 1566842 - RNA, 17 nt, Human adenovirus D
ccaagaucaggggaugu

SEQ ID NO: 1566843 - RNA, 15 nt, Human adenovirus D
ucacggugaaggggu

SEQ ID NO: 1566844 - RNA, 12 nt, Human adenovirus D
cauucuggaggc

SEQ ID NO: 1566845 - RNA, 11 nt, Human adenovirus D
ggcacuggcac

SEQ ID NO: 1566846 - RNA, 17 nt, Human adenovirus D
cugaaaggcgggcugcc

SEQ ID NO: 1566847 - RNA, 16 nt, Human adenovirus D
gguggacgagcagacc

SEQ ID NO: 1566848 - RNA, 13 nt, Human adenovirus D
gcagaggaagagg

SEQ ID NO: 1566849 - RNA, 13 nt, Human adenovirus D
cuaucauucagag

SEQ ID NO: 1566850 - RNA, 15 nt, Human adenovirus D
aagaagacuauaaag

SEQ ID NO: 1566851 - RNA, 22 nt, Human adenovirus D
cguuacgucacuuuugcccuua

SEQ ID NO: 1566852 - RNA, 17 nt, Human adenovirus D
guucaggagcgcagccu

SEQ ID NO: 1566853 - RNA, 15 nt, Human adenovirus D
cgcuguaccgcagcu

SEQ ID NO: 1566854 - RNA, 13 nt, Human adenovirus D
gucagugaagccc

SEQ ID NO: 1566855 - RNA, 22 nt, Human adenovirus D
gaggaucgcggcgaacgagcca

SEQ ID NO: 1566856 - RNA, 17 nt, Human adenovirus D
gcaccuagaccacugcc

SEQ ID NO: 1566857 - RNA, 19 nt, Human adenovirus D
auuggccuguccugcaggg

SEQ ID NO: 1566858 - RNA, 17 nt, Human adenovirus D
ggccagaugcggaggag

SEQ ID NO: 1566859 - RNA, 18 nt, Human adenovirus D
ucacauacacacuagaaa

SEQ ID NO: 1566860 - RNA, 23 nt, Human adenovirus D
accugcagcguguucaaaacaac

SEQ ID NO: 1566861 - RNA, 13 nt, Human adenovirus D
cagccggcgaacg

SEQ ID NO: 1566862 - RNA, 23 nt, Human adenovirus D
cuugcacaguuggcgacccagga

SEQ ID NO: 1566863 - RNA, 15 nt, Human adenovirus D
accacucugagacaa

SEQ ID NO: 1566864 - RNA, 22 nt, Human adenovirus D
cucuguaggccauccccaucca

SEQ ID NO: 1566865 - RNA, 24 nt, Human adenovirus D
ggccuccgagcagcgcauccugca

SEQ ID NO: 1566866 - RNA, 22 nt, Human adenovirus D
ugguggcuagaaaacacccaca

SEQ ID NO: 1566867 - RNA, 17 nt, Human adenovirus D
auuggagaaugcugcua

SEQ ID NO: 1566868 - RNA, 17 nt, Human adenovirus D
gacuccgcgaccuccuc

SEQ ID NO: 1566869 - RNA, 24 nt, Human adenovirus D
cgggcuucaccggcuaccuugcac

SEQ ID NO: 1566870 - RNA, 19 nt, Human adenovirus D
uggucagcgaugagcagcu

SEQ ID NO: 1566871 - RNA, 11 nt, Human adenovirus D
uacaacaugcu

SEQ ID NO: 1566872 - RNA, 15 nt, Human adenovirus D
cgcuggggcagaacg

SEQ ID NO: 1566873 - RNA, 19 nt, Human adenovirus D
gccgcguccccgcccgccg

SEQ ID NO: 1566874 - RNA, 17 nt, Human adenovirus D
ccggugucagaggaugg

SEQ ID NO: 1566875 - RNA, 18 nt, Human adenovirus D
ggagaggcauggcaggca

SEQ ID NO: 1566876 - RNA, 14 nt, Human adenovirus D
uggugaagggcugc

SEQ ID NO: 1566877 - RNA, 13 nt, Human adenovirus D
gcugaugcccaac

SEQ ID NO: 1566878 - RNA, 12 nt, Human adenovirus D
accggcuggggu

SEQ ID NO: 1566879 - RNA, 15 nt, Human adenovirus D
caccagggagcugag

SEQ ID NO: 1566880 - RNA, 16 nt, Human adenovirus D
gguugacauccuggau

SEQ ID NO: 1566881 - RNA, 16 nt, Human adenovirus D
cagcaacccuuccugg

SEQ ID NO: 1566882 - RNA, 15 nt, Human adenovirus D
cccugcauggcugcg

SEQ ID NO: 1566883 - RNA, 17 nt, Human adenovirus D
caucagcgcccucagca

SEQ ID NO: 1566884 - RNA, 14 nt, Human adenovirus D
gcagcgccccgagg

SEQ ID NO: 1566885 - RNA, 13 nt, Human adenovirus D
gucugcuccugca

SEQ ID NO: 1566886 - RNA, 15 nt, Human adenovirus D
cgguugugcagcccc

SEQ ID NO: 1566887 - RNA, 17 nt, Human adenovirus D
uaugagaugccccagca

SEQ ID NO: 1566888 - RNA, 21 nt, Human adenovirus D
aggagaggcauggcaggcagc

SEQ ID NO: 1566889 - RNA, 13 nt, Human adenovirus D
ggggacagagaau

SEQ ID NO: 1566890 - RNA, 18 nt, Human adenovirus D
aauaucagacaugcugcu

SEQ ID NO: 1566891 - RNA, 21 nt, Human adenovirus D
uccaccgugugcagacacaug

SEQ ID NO: 1566892 - RNA, 20 nt, Human adenovirus D
ggcagcggugguggaggcgc

SEQ ID NO: 1566893 - RNA, 18 nt, Human adenovirus D
gcuccaugcuucugggca

SEQ ID NO: 1566894 - RNA, 14 nt, Human adenovirus D
gcggcgcaggggca

SEQ ID NO: 1566895 - RNA, 22 nt, Human adenovirus D
cggggguucauguugugcagga

SEQ ID NO: 1566896 - RNA, 16 nt, Human adenovirus D
ccagccaaagcucaug

SEQ ID NO: 1566897 - RNA, 17 nt, Human adenovirus D
guaguugcgcaggcgcu

SEQ ID NO: 1566898 - RNA, 18 nt, Human adenovirus D
ccugcucaccugcaccug

SEQ ID NO: 1566899 - RNA, 22 nt, Human adenovirus D
cccuggugauacgaggcagagg

SEQ ID NO: 1566900 - RNA, 13 nt, Human adenovirus D
acugcuggcccug

SEQ ID NO: 1566901 - RNA, 20 nt, Human adenovirus D
guucgagaucaagcgcagcg

SEQ ID NO: 1566902 - RNA, 13 nt, Human adenovirus D
gcgcuccgugggg

SEQ ID NO: 1566903 - RNA, 15 nt, Human adenovirus D
uccuccguagccugg

SEQ ID NO: 1566904 - RNA, 16 nt, Human adenovirus D
ggcaugggucaggcag

SEQ ID NO: 1566905 - RNA, 18 nt, Human adenovirus D
ggcgaugggcccgugggc

SEQ ID NO: 1566906 - RNA, 12 nt, Human adenovirus D
cccacugggugg

SEQ ID NO: 1566907 - RNA, 16 nt, Human adenovirus D
ucgacuugcaagacag

SEQ ID NO: 1566908 - RNA, 18 nt, Human adenovirus D
cgaggagaacugcuggcc

SEQ ID NO: 1566909 - RNA, 22 nt, Human adenovirus D
gcccuaaauuuaaaaccucauu

SEQ ID NO: 1566910 - RNA, 16 nt, Human adenovirus D
ccagacacccacgugg

SEQ ID NO: 1566911 - RNA, 16 nt, Human adenovirus D
cgccaggaggcggugc

SEQ ID NO: 1566912 - RNA, 22 nt, Human adenovirus D
gccacccuugaccugccuccac

SEQ ID NO: 1566913 - RNA, 15 nt, Human adenovirus D
agauacagaguaaaa

SEQ ID NO: 1566914 - RNA, 20 nt, Human adenovirus D
gcguccgcuccgcagugggc

SEQ ID NO: 1566915 - RNA, 17 nt, Human adenovirus D
gcaggccgggcugcacg

SEQ ID NO: 1566916 - RNA, 16 nt, Human adenovirus D
agaaccugcuccugcu

SEQ ID NO: 1566917 - RNA, 19 nt, Human adenovirus D
ugaaucagguauccagccu

SEQ ID NO: 1566918 - RNA, 18 nt, Human adenovirus D
gcuccuggucugcaaccc

SEQ ID NO: 1566919 - RNA, 23 nt, Human adenovirus D
aagggauauagucuaugggaaca

SEQ ID NO: 1566920 - RNA, 21 nt, Human adenovirus D
ugcccgacgauguagaguucc

SEQ ID NO: 1566921 - RNA, 15 nt, Human adenovirus D
aaaucuuacacauga

SEQ ID NO: 1566922 - RNA, 13 nt, Human adenovirus D
gcuggccagcacg

SEQ ID NO: 1566923 - RNA, 17 nt, Human adenovirus D
cucggcgaugguggcgc

SEQ ID NO: 1566924 - RNA, 20 nt, Human adenovirus D
cuuccacuguuagcuacuuu

SEQ ID NO: 1566925 - RNA, 17 nt, Human adenovirus D
guagguauucccucucg

SEQ ID NO: 1566926 - RNA, 14 nt, Human adenovirus D
gggucaggcagcgg

SEQ ID NO: 1566927 - RNA, 16 nt, Human adenovirus D
aggacauggauuaaaa

SEQ ID NO: 1566928 - RNA, 20 nt, Human adenovirus D
uccaaaauggcuuacauguc

SEQ ID NO: 1566929 - RNA, 23 nt, Human adenovirus D
uccgcacgguaagagcccagcau

SEQ ID NO: 1566930 - RNA, 21 nt, Human adenovirus D
uuuuugaggaugcaucaucca

SEQ ID NO: 1566931 - RNA, 21 nt, Human adenovirus D
ggccccggggcggaguggccu

SEQ ID NO: 1566932 - RNA, 16 nt, Human adenovirus D
cacaucggacuggguu

SEQ ID NO: 1566933 - RNA, 15 nt, Human adenovirus D
ugcagcacuggaaca

SEQ ID NO: 1566934 - RNA, 19 nt, Human adenovirus D
ccggcgacaagcuggccug

SEQ ID NO: 1566935 - RNA, 21 nt, Human adenovirus D
uacaaccaaggcacccaccac

SEQ ID NO: 1566936 - RNA, 15 nt, Human adenovirus D
gcguaagcaggagca

SEQ ID NO: 1566937 - RNA, 19 nt, Human adenovirus D
agcccgcgcgggagccagg

SEQ ID NO: 1566938 - RNA, 21 nt, Human adenovirus D
augcauggccagccuuacuca

SEQ ID NO: 1566939 - RNA, 19 nt, Human adenovirus D
uuacacucgcagugcacgg

SEQ ID NO: 1566940 - RNA, 16 nt, Human adenovirus D
cucggcggcguggccc

SEQ ID NO: 1566941 - RNA, 15 nt, Human adenovirus D
gcgcccguagucugg

SEQ ID NO: 1566942 - RNA, 16 nt, Human adenovirus D
aggcuggcccuccauc

SEQ ID NO: 1566943 - RNA, 17 nt, Human adenovirus D
aggucagcagcaagagc

SEQ ID NO: 1566944 - RNA, 17 nt, Human adenovirus D
aaguuuuucauccagaa

SEQ ID NO: 1566945 - RNA, 13 nt, Human adenovirus D
caagcgcccagag

SEQ ID NO: 1566946 - RNA, 22 nt, Human adenovirus D
ggcaaaauggcgugcuggagag

SEQ ID NO: 1566947 - RNA, 14 nt, Human adenovirus D
cccugguccaccuc

SEQ ID NO: 1566948 - RNA, 23 nt, Human adenovirus D
ucccggaggaggggggccaccuc

SEQ ID NO: 1566949 - RNA, 15 nt, Human adenovirus D
gaggagaccugcacu

SEQ ID NO: 1566950 - RNA, 16 nt, Human adenovirus D
cugcaacgccuucccc

SEQ ID NO: 1566951 - RNA, 15 nt, Human adenovirus D
ccccuggcucccagc

SEQ ID NO: 1566952 - RNA, 23 nt, Human adenovirus D
caugcaagaccccgucaccuucc

SEQ ID NO: 1566953 - RNA, 23 nt, Human adenovirus D
ggauuaaaaauauuagaugacaa

SEQ ID NO: 1566954 - RNA, 13 nt, Human adenovirus D
gaggggcuccucu

SEQ ID NO: 1566955 - RNA, 18 nt, Human adenovirus D
uguccagauccucggcgu

SEQ ID NO: 1566956 - RNA, 18 nt, Human adenovirus D
caugacauggguggggau

SEQ ID NO: 1566957 - RNA, 23 nt, Human adenovirus D
cgagaacguccauggcgcaguag

SEQ ID NO: 1566958 - RNA, 12 nt, Human adenovirus D
uggcccugcugg

SEQ ID NO: 1566959 - RNA, 14 nt, Human adenovirus D
accgaccccuggcu

SEQ ID NO: 1566960 - RNA, 15 nt, Human adenovirus D
gccgcguccccgccc

SEQ ID NO: 1566961 - RNA, 15 nt, Human adenovirus D
ugaaccugagccagg

SEQ ID NO: 1566962 - RNA, 15 nt, Human adenovirus D
cuggccgugggcgac

SEQ ID NO: 1566963 - RNA, 15 nt, Human adenovirus D
acguagcagcccugu

SEQ ID NO: 1566964 - RNA, 18 nt, Human adenovirus D
guccgcaggcgggacaga

SEQ ID NO: 1566965 - RNA, 19 nt, Human adenovirus D
gcgguguaggggacgugag

SEQ ID NO: 1566966 - RNA, 20 nt, Human adenovirus D
gcgcaaauuuguacccgagg

SEQ ID NO: 1566967 - RNA, 19 nt, Human adenovirus D
gcaagggcgaccagcucug

SEQ ID NO: 1566968 - RNA, 16 nt, Human adenovirus D
gauggaaaggucacuu

SEQ ID NO: 1566969 - RNA, 20 nt, Human adenovirus D
caagacgcaggccaggagga

SEQ ID NO: 1566970 - RNA, 15 nt, Human adenovirus D
cagcaguagccccgc

SEQ ID NO: 1566971 - RNA, 20 nt, Human adenovirus D
uggaaacagacagccagguc

SEQ ID NO: 1566972 - RNA, 15 nt, Human adenovirus D
ccagaaggggcaccu

SEQ ID NO: 1566973 - RNA, 19 nt, Human adenovirus D
caugcucuaccccaucccg

SEQ ID NO: 1566974 - RNA, 12 nt, Human adenovirus D
accuuggucaca

SEQ ID NO: 1566975 - RNA, 14 nt, Human adenovirus D
ccugaucucugcca

SEQ ID NO: 1566976 - RNA, 21 nt, Human adenovirus D
ugcgcuaccgcuccaugcuuc

SEQ ID NO: 1566977 - RNA, 19 nt, Human adenovirus D
cgugaccugcagcaggugc

SEQ ID NO: 1566978 - RNA, 15 nt, Human adenovirus D
ccaggaugcagccag

SEQ ID NO: 1566979 - RNA, 18 nt, Human adenovirus D
cauagaccugaugaacaa

SEQ ID NO: 1566980 - RNA, 18 nt, Human adenovirus D
augggccuggccgcgggc

SEQ ID NO: 1566981 - RNA, 20 nt, Human adenovirus D
acaguaaguuccugucuucu

SEQ ID NO: 1566982 - RNA, 15 nt, Human adenovirus D
cgcgaaccaggcagu

SEQ ID NO: 1566983 - RNA, 20 nt, Human adenovirus D
ccccgcgugcagcugcagaa

SEQ ID NO: 1566984 - RNA, 20 nt, Human adenovirus D
uguuguacucugugugcuga

SEQ ID NO: 1566985 - RNA, 12 nt, Human adenovirus D
ucacccagcagu

SEQ ID NO: 1566986 - RNA, 15 nt, Human adenovirus D
guggccuuguaccug

SEQ ID NO: 1566987 - RNA, 15 nt, Human adenovirus D
ggccugggcucgcug

SEQ ID NO: 1566988 - RNA, 18 nt, Human adenovirus D
cccugcucaccugcaccu

SEQ ID NO: 1566989 - RNA, 17 nt, Human adenovirus D
acuaucuaugaaagcau

SEQ ID NO: 1566990 - RNA, 13 nt, Human adenovirus D
cacugcaaauuua

SEQ ID NO: 1566991 - RNA, 19 nt, Human adenovirus D
ggugcugaaacgggcacgg

SEQ ID NO: 1566992 - RNA, 14 nt, Human adenovirus D
cuccuccuggagau

SEQ ID NO: 1566993 - RNA, 20 nt, Human adenovirus D
ggcuccucucgugcuccggc

SEQ ID NO: 1566994 - RNA, 16 nt, Human adenovirus D
cagcuguuccuggugg

SEQ ID NO: 1566995 - RNA, 14 nt, Human adenovirus D
gguguggaagauga

SEQ ID NO: 1566996 - RNA, 17 nt, Human adenovirus D
agcgaccccgagaccug

SEQ ID NO: 1566997 - RNA, 22 nt, Human adenovirus D
cuucccauugaauggcacuggc

SEQ ID NO: 1566998 - RNA, 18 nt, Human adenovirus D
caaccuugaaaccccaga

SEQ ID NO: 1566999 - RNA, 15 nt, Human adenovirus D
cgucggccaugggca

SEQ ID NO: 1567000 - RNA, 17 nt, Human adenovirus D
cagaacccggacagcaa

SEQ ID NO: 1567001 - RNA, 15 nt, Human adenovirus D
cugguggaaacagac

SEQ ID NO: 1567002 - RNA, 13 nt, Human adenovirus D
acgcccugggugu

SEQ ID NO: 1567003 - RNA, 21 nt, Human adenovirus D
agucaaauauuagcuaaugug

SEQ ID NO: 1567004 - RNA, 22 nt, Human adenovirus D
ugugggccugggagugaaaagu

SEQ ID NO: 1567005 - RNA, 22 nt, Human adenovirus D
cagcauguacggaggagccaag

SEQ ID NO: 1567006 - RNA, 16 nt, Human adenovirus D
cuucaugagccagagc

SEQ ID NO: 1567007 - RNA, 17 nt, Human adenovirus D
cgccgucaaccucccgc

SEQ ID NO: 1567008 - RNA, 14 nt, Human adenovirus D
ggagccagguccag

SEQ ID NO: 1567009 - RNA, 16 nt, Human adenovirus D
ggacggaucgcccagg

SEQ ID NO: 1567010 - RNA, 20 nt, Human adenovirus D
gaccagguccacgcuggugg

SEQ ID NO: 1567011 - RNA, 15 nt, Human adenovirus D
caaccagagccagaa

SEQ ID NO: 1567012 - RNA, 15 nt, Human adenovirus D
uccucuucuuccaug

SEQ ID NO: 1567013 - RNA, 12 nt, Human adenovirus D
ccaccaccugca

SEQ ID NO: 1567014 - RNA, 21 nt, Human adenovirus D
auccugacgcgccagccgcgg

SEQ ID NO: 1567015 - RNA, 14 nt, Human adenovirus D
cgcccggcgagcgg

SEQ ID NO: 1567016 - RNA, 19 nt, Human adenovirus D
ucaaggacaugcagcugcc

SEQ ID NO: 1567017 - RNA, 15 nt, Human adenovirus D
caaaacccacucuau

SEQ ID NO: 1567018 - RNA, 21 nt, Human adenovirus D
cggucguuguccaccaggggg

SEQ ID NO: 1567019 - RNA, 12 nt, Human adenovirus D
cggccaaggcca

SEQ ID NO: 1567020 - RNA, 17 nt, Human adenovirus D
ccuacaucaacauaggc

SEQ ID NO: 1567021 - RNA, 16 nt, Human adenovirus D
gagaccaaguccaggg

SEQ ID NO: 1567022 - RNA, 15 nt, Human adenovirus D
cucgucuuccaggag

SEQ ID NO: 1567023 - RNA, 22 nt, Human adenovirus D
guaccuugucguacuucugcca

SEQ ID NO: 1567024 - RNA, 17 nt, Human adenovirus D
ggccaggccuccgagca

SEQ ID NO: 1567025 - RNA, 15 nt, Human adenovirus D
cagcagcaagagcuc

SEQ ID NO: 1567026 - RNA, 16 nt, Human adenovirus D
cugcucgggcaugagc

SEQ ID NO: 1567027 - RNA, 23 nt, Human adenovirus D
agcugcgagaaggcgcccaggcc

SEQ ID NO: 1567028 - RNA, 16 nt, Human adenovirus D
cuggcccggcaacgac

SEQ ID NO: 1567029 - RNA, 12 nt, Human adenovirus D
acaucugugcug

SEQ ID NO: 1567030 - RNA, 20 nt, Human adenovirus D
gagccugcgccgggcgcugg

SEQ ID NO: 1567031 - RNA, 11 nt, Human adenovirus D
guacccagagc

SEQ ID NO: 1567032 - RNA, 15 nt, Human adenovirus D
gcuagacaccacagu

SEQ ID NO: 1567033 - RNA, 21 nt, Human adenovirus D
aagucacuaggaccccaggga

SEQ ID NO: 1567034 - RNA, 13 nt, Human adenovirus D
cuggucaucaccu

SEQ ID NO: 1567035 - RNA, 20 nt, Human adenovirus D
cuucgaguacgaggccaugc

SEQ ID NO: 1567036 - RNA, 14 nt, Human adenovirus D
aucagcugcagcgc

SEQ ID NO: 1567037 - RNA, 19 nt, Human adenovirus D
gcaggggcuacauucugga

SEQ ID NO: 1567038 - RNA, 13 nt, Human adenovirus D
gccaggcuggccg

SEQ ID NO: 1567039 - RNA, 22 nt, Human adenovirus D
acuuagaagagcccccuccccg

SEQ ID NO: 1567040 - RNA, 22 nt, Human adenovirus D
ucaaagaccagaacuuccagca

SEQ ID NO: 1567041 - RNA, 22 nt, Human adenovirus D
gcgcccaccaucaccaccguca

SEQ ID NO: 1567042 - RNA, 13 nt, Human adenovirus D
gaugcagcaagcc

SEQ ID NO: 1567043 - RNA, 15 nt, Human adenovirus D
uggaggguugaaaga

SEQ ID NO: 1567044 - RNA, 12 nt, Human adenovirus D
gccaggcccaga

SEQ ID NO: 1567045 - RNA, 19 nt, Human adenovirus D
agcagaaguucaccugcau

SEQ ID NO: 1567046 - RNA, 23 nt, Human adenovirus D
gaucagccccgcgcgcgcgcacg

SEQ ID NO: 1567047 - RNA, 15 nt, Human adenovirus D
uccaccugcggggcg

SEQ ID NO: 1567048 - RNA, 22 nt, Human adenovirus D
cgacccaggaauggcacgcucu

SEQ ID NO: 1567049 - RNA, 15 nt, Human adenovirus D
ccaaguccagggugc

SEQ ID NO: 1567050 - RNA, 16 nt, Human adenovirus D
accacgguggugcaga

SEQ ID NO: 1567051 - RNA, 22 nt, Human adenovirus D
cccuucucgggaucgccaggcc

SEQ ID NO: 1567052 - RNA, 20 nt, Human adenovirus D
ccgccgaggcuagcacgcag

SEQ ID NO: 1567053 - RNA, 15 nt, Human adenovirus D
ggaccgagucgcgga

SEQ ID NO: 1567054 - RNA, 22 nt, Human adenovirus D
cacgauguaacaucaccacagg

SEQ ID NO: 1567055 - RNA, 14 nt, Human adenovirus D
ggaggcgaagaugg

SEQ ID NO: 1567056 - RNA, 20 nt, Human adenovirus D
agucacuuaaguccugggcc

SEQ ID NO: 1567057 - RNA, 13 nt, Human adenovirus D
cagcugcagaagg

SEQ ID NO: 1567058 - RNA, 13 nt, Human adenovirus D
augaauaugaauu

SEQ ID NO: 1567059 - RNA, 17 nt, Human adenovirus D
gcuaccucuugcagcug

SEQ ID NO: 1567060 - RNA, 20 nt, Human adenovirus D
gcgggaucaucgccugcuug

SEQ ID NO: 1567061 - RNA, 15 nt, Human adenovirus D
caaccugugcucucc

SEQ ID NO: 1567062 - RNA, 14 nt, Human adenovirus D
aauuacagucacua

SEQ ID NO: 1567063 - RNA, 20 nt, Human adenovirus D
aaucuggcgguaccagggga

SEQ ID NO: 1567064 - RNA, 15 nt, Human adenovirus D
gcagccugagcuugg

SEQ ID NO: 1567065 - RNA, 22 nt, Human adenovirus D
cugccccaggcggugcugcugc

SEQ ID NO: 1567066 - RNA, 11 nt, Human adenovirus D
cuuucaagaac

SEQ ID NO: 1567067 - RNA, 11 nt, Human adenovirus D
aaggcagcuga

SEQ ID NO: 1567068 - RNA, 18 nt, Human adenovirus D
acccggacguggugcugc

SEQ ID NO: 1567069 - RNA, 15 nt, Human adenovirus D
ucgucauccuuccag

SEQ ID NO: 1567070 - RNA, 22 nt, Human adenovirus D
gcagccgcguaagcaggagcag

SEQ ID NO: 1567071 - RNA, 16 nt, Human adenovirus D
agguggcccugggccu

SEQ ID NO: 1567072 - RNA, 15 nt, Human adenovirus D
gcuguucauggccaa

SEQ ID NO: 1567073 - RNA, 16 nt, Human adenovirus D
gcuggggcugcucggc

SEQ ID NO: 1567074 - RNA, 13 nt, Human adenovirus D
ucagauauuccag

SEQ ID NO: 1567075 - RNA, 19 nt, Human adenovirus D
ucaccgagccucccaggag

SEQ ID NO: 1567076 - RNA, 15 nt, Human adenovirus D
gcaguuuggccugga

SEQ ID NO: 1567077 - RNA, 14 nt, Human adenovirus D
gcgccaagggcagc

SEQ ID NO: 1567078 - RNA, 23 nt, Human adenovirus D
gcaguccaugcccaacaggccua

SEQ ID NO: 1567079 - RNA, 21 nt, Human adenovirus D
ccgcagccgcggcagccgcag

SEQ ID NO: 1567080 - RNA, 14 nt, Human adenovirus D
caggaugaacagga

SEQ ID NO: 1567081 - RNA, 17 nt, Human adenovirus D
cuacuugcaaguggggc

SEQ ID NO: 1567082 - RNA, 16 nt, Human adenovirus D
uuccggcaaaaaucac

SEQ ID NO: 1567083 - RNA, 15 nt, Human adenovirus D
uacagucacuagugg

SEQ ID NO: 1567084 - RNA, 17 nt, Human adenovirus D
cugaccuugcagagcag

SEQ ID NO: 1567085 - RNA, 21 nt, Human adenovirus D
gauccagucauagcaggggcg

SEQ ID NO: 1567086 - RNA, 19 nt, Human adenovirus D
gcccgggacggaggcucgg

SEQ ID NO: 1567087 - RNA, 12 nt, Human adenovirus D
ugccccagcaga

SEQ ID NO: 1567088 - RNA, 22 nt, Human adenovirus D
gaccacugccgccgccugcgcu

SEQ ID NO: 1567089 - RNA, 23 nt, Human adenovirus D
cgccaaaaaaacacacacgcccu

SEQ ID NO: 1567090 - RNA, 11 nt, Human adenovirus D
cccgaggcccu

SEQ ID NO: 1567091 - RNA, 12 nt, Human adenovirus D
ggccgagcugga

SEQ ID NO: 1567092 - RNA, 20 nt, Human adenovirus D
uggcagccgagccggcgcgc

SEQ ID NO: 1567093 - RNA, 20 nt, Human adenovirus D
gcugcuucugccuggugaag

SEQ ID NO: 1567094 - RNA, 23 nt, Human adenovirus D
cagauccugcugcuccaccaccu

SEQ ID NO: 1567095 - RNA, 17 nt, Human adenovirus D
uucgagacgucccagag

SEQ ID NO: 1567096 - RNA, 16 nt, Human adenovirus D
cccguggucggcgccg

SEQ ID NO: 1567097 - RNA, 15 nt, Human adenovirus D
uggcuucuacagcca

SEQ ID NO: 1567098 - RNA, 17 nt, Human adenovirus D
ucaugaacacacugccc

SEQ ID NO: 1567099 - RNA, 16 nt, Human adenovirus D
cucaucucgcccagca

SEQ ID NO: 1567100 - RNA, 22 nt, Human adenovirus D
caagcgcgggcggacugccacc

SEQ ID NO: 1567101 - RNA, 23 nt, Human adenovirus D
auaggcacugaaaauuugcaaaa

SEQ ID NO: 1567102 - RNA, 16 nt, Human adenovirus D
gcgcgcccggggccag

SEQ ID NO: 1567103 - RNA, 19 nt, Human adenovirus D
uacaacaguacuggcaaca

SEQ ID NO: 1567104 - RNA, 18 nt, Human adenovirus D
gccaccuaucacaucuuu

SEQ ID NO: 1567105 - RNA, 15 nt, Human adenovirus D
gagcuacagcaggag

SEQ ID NO: 1567106 - RNA, 19 nt, Human adenovirus D
gcagaaauuucaagcuggg

SEQ ID NO: 1567107 - RNA, 21 nt, Human adenovirus D
uggugcgcucgucgggcacga

SEQ ID NO: 1567108 - RNA, 21 nt, Human adenovirus D
gccuucuauggaggcagagcu

SEQ ID NO: 1567109 - RNA, 21 nt, Human adenovirus D
uggagcaggguaaagccagca

SEQ ID NO: 1567110 - RNA, 16 nt, Human adenovirus D
ucgccucggaccuggc

SEQ ID NO: 1567111 - RNA, 12 nt, Human adenovirus D
gaguggcggcuu

SEQ ID NO: 1567112 - RNA, 16 nt, Human adenovirus D
cuacugcaucugucca

SEQ ID NO: 1567113 - RNA, 14 nt, Human adenovirus D
cugccgccggggcu

SEQ ID NO: 1567114 - RNA, 21 nt, Human adenovirus D
uugaugcgcuucuuaccucgc

SEQ ID NO: 1567115 - RNA, 23 nt, Human adenovirus D
cacguacuuugacauccgcggcg

SEQ ID NO: 1567116 - RNA, 16 nt, Human adenovirus D
ccacaggaugaacagg

SEQ ID NO: 1567117 - RNA, 12 nt, Human adenovirus D
ggccaggggagu

SEQ ID NO: 1567118 - RNA, 22 nt, Human adenovirus D
gugugauuaaaaagcagcacag

SEQ ID NO: 1567119 - RNA, 13 nt, Human adenovirus D
caaggcgcgcuuc

SEQ ID NO: 1567120 - RNA, 16 nt, Human adenovirus D
cugguuccucguccag

SEQ ID NO: 1567121 - RNA, 19 nt, Human adenovirus D
gagcaggguaaagccagca

SEQ ID NO: 1567122 - RNA, 14 nt, Human adenovirus D
gggacagaguuucu

SEQ ID NO: 1567123 - RNA, 16 nt, Human adenovirus D
ggaucgcgaggacacc

SEQ ID NO: 1567124 - RNA, 16 nt, Human adenovirus D
gcaggcgggacagagg

SEQ ID NO: 1567125 - RNA, 17 nt, Human adenovirus D
caccgagucucaccugg

SEQ ID NO: 1567126 - RNA, 20 nt, Human adenovirus D
uacucuacaauccuuuugua

SEQ ID NO: 1567127 - RNA, 22 nt, Human adenovirus D
gccauggggcgccgcccgagcu

SEQ ID NO: 1567128 - RNA, 17 nt, Human adenovirus D
cauuggagaaugcugcu

SEQ ID NO: 1567129 - RNA, 14 nt, Human adenovirus D
augcuaccugggag

SEQ ID NO: 1567130 - RNA, 17 nt, Human adenovirus D
caagaaacgucccagca

SEQ ID NO: 1567131 - RNA, 18 nt, Human adenovirus D
uguaccgcgaggccauag

SEQ ID NO: 1567132 - RNA, 14 nt, Human adenovirus D
acuuacuuugcaag

SEQ ID NO: 1567133 - RNA, 16 nt, Human adenovirus D
cuugccgaaggacccc

SEQ ID NO: 1567134 - RNA, 21 nt, Human adenovirus D
uacgaggcagaggcacacagc

SEQ ID NO: 1567135 - RNA, 19 nt, Human adenovirus D
gaaccugcgcgggcugugg

SEQ ID NO: 1567136 - RNA, 14 nt, Human adenovirus D
gcugguggccaccu

SEQ ID NO: 1567137 - RNA, 19 nt, Human adenovirus D
gacgcgcucccggcggcag

SEQ ID NO: 1567138 - RNA, 14 nt, Human adenovirus D
gcucgguugaggca

SEQ ID NO: 1567139 - RNA, 13 nt, Human adenovirus D
uaccgacagcagc

SEQ ID NO: 1567140 - RNA, 22 nt, Human adenovirus D
gcagcacaugguaauccacgga

SEQ ID NO: 1567141 - RNA, 23 nt, Human adenovirus D
gcguaagcaggagcaggaggagg

SEQ ID NO: 1567142 - RNA, 16 nt, Human adenovirus D
uggcggcccuggcugg

SEQ ID NO: 1567143 - RNA, 16 nt, Human adenovirus D
accagcccauuucaca

SEQ ID NO: 1567144 - RNA, 12 nt, Human adenovirus D
ucaaccacaccu

SEQ ID NO: 1567145 - RNA, 15 nt, Human adenovirus D
auuuuuacaccagcg

SEQ ID NO: 1567146 - RNA, 18 nt, Human adenovirus D
ggccgagaccgugagcuc

SEQ ID NO: 1567147 - RNA, 17 nt, Human adenovirus D
gcuccuggucugcaacc

SEQ ID NO: 1567148 - RNA, 19 nt, Human adenovirus D
cucgagcucgaaugcaugc

SEQ ID NO: 1567149 - RNA, 22 nt, Human adenovirus D
agcgguucaagaacgagggccu

SEQ ID NO: 1567150 - RNA, 20 nt, Human adenovirus D
gaucuuuaugaacaugaagu

SEQ ID NO: 1567151 - RNA, 16 nt, Human adenovirus D
ucaaacaggcaaagau

SEQ ID NO: 1567152 - RNA, 20 nt, Human adenovirus D
ggucugucauauccugaaga

SEQ ID NO: 1567153 - RNA, 22 nt, Human adenovirus D
cacaugcuuggucuuucuggcu

SEQ ID NO: 1567154 - RNA, 23 nt, Human adenovirus D
acaugggcaugagcccgucccgg

SEQ ID NO: 1567155 - RNA, 19 nt, Human adenovirus D
gaugcuucaacagcugugc

SEQ ID NO: 1567156 - RNA, 22 nt, Human adenovirus D
acguuucuggggucagagacau

SEQ ID NO: 1567157 - RNA, 13 nt, Human adenovirus D
cuuuccagcagca

SEQ ID NO: 1567158 - RNA, 17 nt, Human adenovirus D
acccgcgacccccaggc

SEQ ID NO: 1567159 - RNA, 18 nt, Human adenovirus D
cacccugcccuuccagca

SEQ ID NO: 1567160 - RNA, 19 nt, Human adenovirus D
auguuacugcauacaaaug

SEQ ID NO: 1567161 - RNA, 21 nt, Human adenovirus D
caggagaucacuagcgugagc

SEQ ID NO: 1567162 - RNA, 14 nt, Human adenovirus D
accuaccacugcca

SEQ ID NO: 1567163 - RNA, 17 nt, Human adenovirus D
accaggggguccaccuu

SEQ ID NO: 1567164 - RNA, 15 nt, Human adenovirus D
gacucacccuggggc

SEQ ID NO: 1567165 - RNA, 17 nt, Human adenovirus D
cccugcccuuccagcac

SEQ ID NO: 1567166 - RNA, 16 nt, Human adenovirus D
cucguucauccagguc

SEQ ID NO: 1567167 - RNA, 14 nt, Human adenovirus D
ugaagagggagagg

SEQ ID NO: 1567168 - RNA, 16 nt, Human adenovirus D
uaccaugggaaaugca

SEQ ID NO: 1567169 - RNA, 13 nt, Human adenovirus D
gcggcgggggcgg

SEQ ID NO: 1567170 - RNA, 10 nt, Human adenovirus D
guugcaugag

SEQ ID NO: 1567171 - RNA, 20 nt, Human adenovirus D
gucuacuggucgcugccgga

SEQ ID NO: 1567172 - RNA, 15 nt, Human adenovirus D
acgugagcggcgagg

SEQ ID NO: 1567173 - RNA, 18 nt, Human adenovirus D
ucagacgggugcuccggg

SEQ ID NO: 1567174 - RNA, 14 nt, Human adenovirus D
ggggugguccuggg

SEQ ID NO: 1567175 - RNA, 17 nt, Human adenovirus D
cccuucuccagcaacuu

SEQ ID NO: 1567176 - RNA, 19 nt, Human adenovirus D
gguucauguugugcaggac

SEQ ID NO: 1567177 - RNA, 14 nt, Human adenovirus D
agggggcgggucug

SEQ ID NO: 1567178 - RNA, 14 nt, Human adenovirus D
aaggacgauaaagu

SEQ ID NO: 1567179 - RNA, 16 nt, Human adenovirus D
uaguaaagaaacagaa

SEQ ID NO: 1567180 - RNA, 19 nt, Human adenovirus D
augcgcuucuuaccucgcg

SEQ ID NO: 1567181 - RNA, 22 nt, Human adenovirus D
aaaaagucacuuaaguccuggg

SEQ ID NO: 1567182 - RNA, 23 nt, Human adenovirus D
uggagcacagaccuucagggagu

SEQ ID NO: 1567183 - RNA, 13 nt, Human adenovirus D
guucuucacccag

SEQ ID NO: 1567184 - RNA, 15 nt, Human adenovirus D
uagaagugacaauuu

SEQ ID NO: 1567185 - RNA, 22 nt, Human adenovirus D
aucagaauauccccuuccucac

SEQ ID NO: 1567186 - RNA, 15 nt, Human adenovirus D
aucucgauccagcag

SEQ ID NO: 1567187 - RNA, 18 nt, Human adenovirus D
caaccuccaggccaaccu

SEQ ID NO: 1567188 - RNA, 20 nt, Human adenovirus D
gcaccucgguacccuccucc

SEQ ID NO: 1567189 - RNA, 22 nt, Human adenovirus D
acuagcgugagccgcgcgcugg

SEQ ID NO: 1567190 - RNA, 19 nt, Human adenovirus D
cacaguuggcgacccagga

SEQ ID NO: 1567191 - RNA, 23 nt, Human adenovirus D
gacacauguccccuuccuccgca

SEQ ID NO: 1567192 - RNA, 16 nt, Human adenovirus D
cagauauuccagauca

SEQ ID NO: 1567193 - RNA, 12 nt, Human adenovirus D
aguccaccgcuc

SEQ ID NO: 1567194 - RNA, 16 nt, Human adenovirus D
cuagacauggccagca

SEQ ID NO: 1567195 - RNA, 18 nt, Human adenovirus D
ggggcuacauucuggacu

SEQ ID NO: 1567196 - RNA, 17 nt, Human adenovirus D
cuccaacguggagcuga

SEQ ID NO: 1567197 - RNA, 14 nt, Human adenovirus D
cucacccuggggcu

SEQ ID NO: 1567198 - RNA, 21 nt, Human adenovirus D
ccagccgcaggcgcccagcca

SEQ ID NO: 1567199 - RNA, 19 nt, Human adenovirus D
ugaaagcuauaaaaaugaa

SEQ ID NO: 1567200 - RNA, 21 nt, Human adenovirus D
gcguuccccuccgcugugcug

SEQ ID NO: 1567201 - RNA, 11 nt, Human adenovirus D
aagcugggcug

SEQ ID NO: 1567202 - RNA, 18 nt, Human adenovirus D
cgcggcguccuggaccgc

SEQ ID NO: 1567203 - RNA, 12 nt, Human adenovirus D
gggcggaccugc

SEQ ID NO: 1567204 - RNA, 14 nt, Human adenovirus D
ggccccggggcgaa

SEQ ID NO: 1567205 - RNA, 14 nt, Human adenovirus D
uacgcuggccagca

SEQ ID NO: 1567206 - RNA, 17 nt, Human adenovirus D
cccggcauccugcacgc

SEQ ID NO: 1567207 - RNA, 16 nt, Human adenovirus D
acuaggcccagcagca

SEQ ID NO: 1567208 - RNA, 23 nt, Human adenovirus D
cgcaagcucaugcuggccguggu

SEQ ID NO: 1567209 - RNA, 17 nt, Human adenovirus D
cagauacuucagcaugu

SEQ ID NO: 1567210 - RNA, 18 nt, Human adenovirus D
ccuccgucggaagaggag

SEQ ID NO: 1567211 - RNA, 20 nt, Human adenovirus D
uggccggcgcgcccggggcc

SEQ ID NO: 1567212 - RNA, 16 nt, Human adenovirus D
cugagcuuggccgaga

SEQ ID NO: 1567213 - RNA, 16 nt, Human adenovirus D
cguagcagcccugugg

SEQ ID NO: 1567214 - RNA, 15 nt, Human adenovirus D
accuucaaccucacc

SEQ ID NO: 1567215 - RNA, 21 nt, Human adenovirus D
acccugagaacggggugcagu

SEQ ID NO: 1567216 - RNA, 23 nt, Human adenovirus D
cccggcauccugcacgcagcagc

SEQ ID NO: 1567217 - RNA, 15 nt, Human adenovirus D
augguacuaaugaca

SEQ ID NO: 1567218 - RNA, 15 nt, Human adenovirus D
cccaacggcaccugc

SEQ ID NO: 1567219 - RNA, 13 nt, Human adenovirus D
accagacacaucu

SEQ ID NO: 1567220 - RNA, 23 nt, Human adenovirus D
ggcaacgaccggcugcucacgcc

SEQ ID NO: 1567221 - RNA, 23 nt, Human adenovirus D
cuucacagagagccgccugagca

SEQ ID NO: 1567222 - RNA, 14 nt, Human adenovirus D
gcacgucgcccgag

SEQ ID NO: 1567223 - RNA, 20 nt, Human adenovirus D
acccacgugguauacaagcc

SEQ ID NO: 1567224 - RNA, 20 nt, Human adenovirus D
gcccacggugguggagaugg

SEQ ID NO: 1567225 - RNA, 20 nt, Human adenovirus D
uggaucgcgaggacaccagu

SEQ ID NO: 1567226 - RNA, 22 nt, Human adenovirus D
gaagaauuggaaaaguggaaga

SEQ ID NO: 1567227 - RNA, 12 nt, Human adenovirus D
accacaccuuca

SEQ ID NO: 1567228 - RNA, 16 nt, Human adenovirus D
gugcgcgaccugggcu

SEQ ID NO: 1567229 - RNA, 14 nt, Human adenovirus D
agaguaaaaguaaa

SEQ ID NO: 1567230 - RNA, 21 nt, Human adenovirus D
ugcaucaacguuucucggcca

SEQ ID NO: 1567231 - RNA, 15 nt, Human adenovirus D
gcagacggugaagca

SEQ ID NO: 1567232 - RNA, 22 nt, Human adenovirus D
ggacgcuaccgcugcgcagcag

SEQ ID NO: 1567233 - RNA, 14 nt, Human adenovirus D
gcaccacugcaugg

SEQ ID NO: 1567234 - RNA, 11 nt, Human adenovirus D
uccgagcagcg

SEQ ID NO: 1567235 - RNA, 17 nt, Human adenovirus D
caagguccgcaggaguc

SEQ ID NO: 1567236 - RNA, 14 nt, Human adenovirus D
ccuucaaccaccac

SEQ ID NO: 1567237 - RNA, 17 nt, Human adenovirus D
aguccaugcccaacagg

SEQ ID NO: 1567238 - RNA, 15 nt, Human adenovirus D
ucgacgagccaggug

SEQ ID NO: 1567239 - RNA, 15 nt, Human adenovirus D
cacccucagaagaag

SEQ ID NO: 1567240 - RNA, 16 nt, Human adenovirus D
agacugauggccacgg

SEQ ID NO: 1567241 - RNA, 16 nt, Human adenovirus D
gguccccgaggcccuu

SEQ ID NO: 1567242 - RNA, 17 nt, Human adenovirus D
gaccacgguggugcaga

SEQ ID NO: 1567243 - RNA, 13 nt, Human adenovirus D
gaguugguggccg

SEQ ID NO: 1567244 - RNA, 14 nt, Human adenovirus D
ccguccuugccuuc

SEQ ID NO: 1567245 - RNA, 22 nt, Human adenovirus D
gagcagacggggaucagccccg

SEQ ID NO: 1567246 - RNA, 15 nt, Human adenovirus D
caggccgggcugcac

SEQ ID NO: 1567247 - RNA, 20 nt, Human adenovirus D
ggcgagaagcggccgcggcc

SEQ ID NO: 1567248 - RNA, 15 nt, Human adenovirus D
caacaccagacacau

SEQ ID NO: 1567249 - RNA, 21 nt, Human adenovirus D
gaggcggagucuuccaugcgg

SEQ ID NO: 1567250 - RNA, 16 nt, Human adenovirus D
gacuucgcagccaugc

SEQ ID NO: 1567251 - RNA, 14 nt, Human adenovirus D
gcccagagcucgcg

SEQ ID NO: 1567252 - RNA, 22 nt, Human adenovirus D
ccccuucucgggaucgccaggc

SEQ ID NO: 1567253 - RNA, 15 nt, Human adenovirus D
gcugccccaggcggu

SEQ ID NO: 1567254 - RNA, 22 nt, Human adenovirus D
cgaagcgccguggccucuucgc

SEQ ID NO: 1567255 - RNA, 12 nt, Human adenovirus D
uggcccugggcc

SEQ ID NO: 1567256 - RNA, 19 nt, Human adenovirus D
gccuuguagggacagcagc

SEQ ID NO: 1567257 - RNA, 22 nt, Human adenovirus D
acagauuugaauugcaaauuga

SEQ ID NO: 1567258 - RNA, 19 nt, Human adenovirus D
ccucggaguaccugagccg

SEQ ID NO: 1567259 - RNA, 15 nt, Human adenovirus D
ggcugauggugaccg

SEQ ID NO: 1567260 - RNA, 12 nt, Human adenovirus D
augggugugcug

SEQ ID NO: 1567261 - RNA, 18 nt, Human adenovirus D
gcgucccuugaggaggaa

SEQ ID NO: 1567262 - RNA, 14 nt, Human adenovirus D
gacgccccugagcg

SEQ ID NO: 1567263 - RNA, 16 nt, Human adenovirus D
gcgaggaugagagccg

SEQ ID NO: 1567264 - RNA, 21 nt, Human adenovirus D
accaaggcacccaccacaguu

SEQ ID NO: 1567265 - RNA, 20 nt, Human adenovirus D
uauccagccuguacccagag

SEQ ID NO: 1567266 - RNA, 16 nt, Human adenovirus D
gcauggccucgugcuc

SEQ ID NO: 1567267 - RNA, 15 nt, Human adenovirus D
cucugacacaccugg

SEQ ID NO: 1567268 - RNA, 17 nt, Human adenovirus D
gccugcgcccgcgccgc

SEQ ID NO: 1567269 - RNA, 19 nt, Human adenovirus D
ccuccagccuuuccauggc

SEQ ID NO: 1567270 - RNA, 15 nt, Human adenovirus D
ugagcccgucccggg

SEQ ID NO: 1567271 - RNA, 22 nt, Human adenovirus D
cgguacacgggguugcagcacu

SEQ ID NO: 1567272 - RNA, 15 nt, Human adenovirus D
ggcagggugagccgg

SEQ ID NO: 1567273 - RNA, 15 nt, Human adenovirus D
guuugggcacugggg

SEQ ID NO: 1567274 - RNA, 21 nt, Human adenovirus D
ccuccuguuacuguaaagcca

SEQ ID NO: 1567275 - RNA, 23 nt, Human adenovirus D
gagcuggccuuccaccucggugc

SEQ ID NO: 1567276 - RNA, 23 nt, Human adenovirus D
ccgcugugcugguggaaacagac

SEQ ID NO: 1567277 - RNA, 14 nt, Human adenovirus D
ggcugcuggagcug

SEQ ID NO: 1567278 - RNA, 21 nt, Human adenovirus D
acacgccaccgcuuuugacaa

SEQ ID NO: 1567279 - RNA, 17 nt, Human adenovirus D
uccagcggcgcaggggc

SEQ ID NO: 1567280 - RNA, 15 nt, Human adenovirus D
ccuucgugcacuggc

SEQ ID NO: 1567281 - RNA, 21 nt, Human adenovirus D
gcugcuaaacaucgccgagcc

SEQ ID NO: 1567282 - RNA, 15 nt, Human adenovirus D
cgaccccuggcuccc

SEQ ID NO: 1567283 - RNA, 15 nt, Human adenovirus D
caccuuccugcagcu

SEQ ID NO: 1567284 - RNA, 23 nt, Human adenovirus D
ucaccuaugagaugccccagcag

SEQ ID NO: 1567285 - RNA, 16 nt, Human adenovirus D
gcauguacggaggagc

SEQ ID NO: 1567286 - RNA, 15 nt, Human adenovirus D
cuccgcggcggcgcg

SEQ ID NO: 1567287 - RNA, 14 nt, Human adenovirus D
cuuguguccucccc

SEQ ID NO: 1567288 - RNA, 19 nt, Human adenovirus D
aucacucuuuccagcagca

SEQ ID NO: 1567289 - RNA, 23 nt, Human adenovirus D
gaggaguuugugcccucggucua

SEQ ID NO: 1567290 - RNA, 21 nt, Human adenovirus D
cgccucugcgugaagaccacu

SEQ ID NO: 1567291 - RNA, 20 nt, Human adenovirus D
cuccucgaggacggagaggc

SEQ ID NO: 1567292 - RNA, 22 nt, Human adenovirus D
agcugcgagaaggcgcccaggc

SEQ ID NO: 1567293 - RNA, 15 nt, Human adenovirus D
cggccaaccugguga

SEQ ID NO: 1567294 - RNA, 13 nt, Human adenovirus D
cucagcagucucu

SEQ ID NO: 1567295 - RNA, 14 nt, Human adenovirus D
cccaccgcgccgcc

SEQ ID NO: 1567296 - RNA, 16 nt, Human adenovirus D
cgcucgcgcaccugcu

SEQ ID NO: 1567297 - RNA, 13 nt, Human adenovirus D
cacgcccugggug

SEQ ID NO: 1567298 - RNA, 16 nt, Human adenovirus D
gaucaucuccccgcgg

SEQ ID NO: 1567299 - RNA, 15 nt, Human adenovirus D
ggagccauagagggc

SEQ ID NO: 1567300 - RNA, 16 nt, Human adenovirus D
cuuuagccagaccaag

SEQ ID NO: 1567301 - RNA, 14 nt, Human adenovirus D
cggcgcgagcugag

SEQ ID NO: 1567302 - RNA, 21 nt, Human adenovirus D
ccacugcaccccccgcaggca

SEQ ID NO: 1567303 - RNA, 12 nt, Human adenovirus D
ccugcccuucca

SEQ ID NO: 1567304 - RNA, 22 nt, Human adenovirus D
cuggcacauacaaagcugaaag

SEQ ID NO: 1567305 - RNA, 13 nt, Human adenovirus D
ucgucgccccgga

SEQ ID NO: 1567306 - RNA, 20 nt, Human adenovirus D
gcaacuucauguccaugggc

SEQ ID NO: 1567307 - RNA, 14 nt, Human adenovirus D
cgcgcuccacggug

SEQ ID NO: 1567308 - RNA, 15 nt, Human adenovirus D
ccuuucgcugcugcc

SEQ ID NO: 1567309 - RNA, 18 nt, Human adenovirus D
uagguuugaguagugggc

SEQ ID NO: 1567310 - RNA, 18 nt, Human adenovirus D
caggguugagucgcggca

SEQ ID NO: 1567311 - RNA, 22 nt, Human adenovirus D
cgccaccacccacaccgccucc

SEQ ID NO: 1567312 - RNA, 24 nt, Human adenovirus D
acgcgcugucggccgaggaggagc

SEQ ID NO: 1567313 - RNA, 13 nt, Human adenovirus D
uauaaaucuuaca

SEQ ID NO: 1567314 - RNA, 18 nt, Human adenovirus D
gauaaauauggccuggag

SEQ ID NO: 1567315 - RNA, 19 nt, Human adenovirus D
uuuaaaaccucauuugcau

SEQ ID NO: 1567316 - RNA, 16 nt, Human adenovirus D
gcucguuaguccagca

SEQ ID NO: 1567317 - RNA, 16 nt, Human adenovirus D
gcuggacaagcuucuu

SEQ ID NO: 1567318 - RNA, 22 nt, Human adenovirus D
ccgaggagaugcgcgacugccg

SEQ ID NO: 1567319 - RNA, 16 nt, Human adenovirus D
acggugaaccugagcc

SEQ ID NO: 1567320 - RNA, 18 nt, Human adenovirus D
auacagagauucagccau

SEQ ID NO: 1567321 - RNA, 21 nt, Human adenovirus D
cggcacggucuggccggugag

SEQ ID NO: 1567322 - RNA, 17 nt, Human adenovirus D
gccccuggcugggcgcu

SEQ ID NO: 1567323 - RNA, 15 nt, Human adenovirus D
ucaccaaggccauag

SEQ ID NO: 1567324 - RNA, 20 nt, Human adenovirus D
ggccgagaagguggcggcaa

SEQ ID NO: 1567325 - RNA, 13 nt, Human adenovirus D
ccgccgccgcacc

SEQ ID NO: 1567326 - RNA, 15 nt, Human adenovirus D
ggacuuaaccaccca

SEQ ID NO: 1567327 - RNA, 22 nt, Human adenovirus D
ggccgcggccagaugcggagga

SEQ ID NO: 1567328 - RNA, 17 nt, Human adenovirus D
accccagaaagaagugg

SEQ ID NO: 1567329 - RNA, 17 nt, Human adenovirus D
ccgugcucaagcgcagc

SEQ ID NO: 1567330 - RNA, 21 nt, Human adenovirus D
accuucaagaaagucuccauc

SEQ ID NO: 1567331 - RNA, 13 nt, Human adenovirus D
accaccagcccau

SEQ ID NO: 1567332 - RNA, 16 nt, Human adenovirus D
ggaagagauggaagaa

SEQ ID NO: 1567333 - RNA, 17 nt, Human adenovirus D
augcacaucgccgggca

SEQ ID NO: 1567334 - RNA, 20 nt, Human adenovirus D
gaggccauaggccaggcgca

SEQ ID NO: 1567335 - RNA, 18 nt, Human adenovirus D
gcugacauccauggccag

SEQ ID NO: 1567336 - RNA, 18 nt, Human adenovirus D
uguaguuguucagcagca

SEQ ID NO: 1567337 - RNA, 13 nt, Human adenovirus D
gcgagaugucugu

SEQ ID NO: 1567338 - RNA, 13 nt, Human adenovirus D
ccgccauggggcg

SEQ ID NO: 1567339 - RNA, 21 nt, Human adenovirus D
cuucuguacuuugucugcugu

SEQ ID NO: 1567340 - RNA, 13 nt, Human adenovirus D
ugcugacugcgac

SEQ ID NO: 1567341 - RNA, 23 nt, Human adenovirus D
agaaaugggcccuugaacagcau

SEQ ID NO: 1567342 - RNA, 15 nt, Human adenovirus D
cccgaccgcugucuc

SEQ ID NO: 1567343 - RNA, 19 nt, Human adenovirus D
uguacccgaggacuaccac

SEQ ID NO: 1567344 - RNA, 19 nt, Human adenovirus D
cuugacagcaccgccgcag

SEQ ID NO: 1567345 - RNA, 16 nt, Human adenovirus D
acgcgcacacuuugga

SEQ ID NO: 1567346 - RNA, 17 nt, Human adenovirus D
gcagcugguaccugucc

SEQ ID NO: 1567347 - RNA, 17 nt, Human adenovirus D
aagacgcaggccaggag

SEQ ID NO: 1567348 - RNA, 21 nt, Human adenovirus D
gccggcgaacgugccgcgcgg

SEQ ID NO: 1567349 - RNA, 20 nt, Human adenovirus D
guccgcaggaguccaccgcu

SEQ ID NO: 1567350 - RNA, 21 nt, Human adenovirus D
uggcgacgaacucggcgguga

SEQ ID NO: 1567351 - RNA, 13 nt, Human adenovirus D
cccacccccccgg

SEQ ID NO: 1567352 - RNA, 17 nt, Human adenovirus D
uggagaaguuccucugc

SEQ ID NO: 1567353 - RNA, 17 nt, Human adenovirus D
uaacacuccuaaaaccg

SEQ ID NO: 1567354 - RNA, 15 nt, Human adenovirus D
gagacccaggucauc

SEQ ID NO: 1567355 - RNA, 13 nt, Human adenovirus D
gcgccccccgcgg

SEQ ID NO: 1567356 - RNA, 15 nt, Human adenovirus D
cggcggcgcuucccg

SEQ ID NO: 1567357 - RNA, 19 nt, Human adenovirus D
caccgcgucgcugaaagca

SEQ ID NO: 1567358 - RNA, 15 nt, Human adenovirus D
ucgguacccuccucc

SEQ ID NO: 1567359 - RNA, 13 nt, Human adenovirus D
guuauucagcagc

SEQ ID NO: 1567360 - RNA, 14 nt, Human adenovirus D
ggccgcggccagau

SEQ ID NO: 1567361 - RNA, 16 nt, Human adenovirus D
accguaccaugggaaa

SEQ ID NO: 1567362 - RNA, 20 nt, Human adenovirus D
cgccgcuguggagccacugc

SEQ ID NO: 1567363 - RNA, 20 nt, Human adenovirus D
cggacuugauuggccugucc

SEQ ID NO: 1567364 - RNA, 14 nt, Human adenovirus D
ugccgaagaagaac

SEQ ID NO: 1567365 - RNA, 19 nt, Human adenovirus D
cugggcucgcugguggcgc

SEQ ID NO: 1567366 - RNA, 12 nt, Human adenovirus D
ccgccugccagg

SEQ ID NO: 1567367 - RNA, 13 nt, Human adenovirus D
cagucuccuggug

SEQ ID NO: 1567368 - RNA, 19 nt, Human adenovirus D
gaucgacgguggacgggcg

SEQ ID NO: 1567369 - RNA, 18 nt, Human adenovirus D
cggcggcagcggcgguuc

SEQ ID NO: 1567370 - RNA, 19 nt, Human adenovirus D
ugggcuucgaagagccggc

SEQ ID NO: 1567371 - RNA, 22 nt, Human adenovirus D
ucucccacagcucgcgguugag

SEQ ID NO: 1567372 - RNA, 15 nt, Human adenovirus D
gaacugaugaaaaag

SEQ ID NO: 1567373 - RNA, 15 nt, Human adenovirus D
cccaagagcgagaug

SEQ ID NO: 1567374 - RNA, 18 nt, Human adenovirus D
agccgcgguuaugcaggg

SEQ ID NO: 1567375 - RNA, 14 nt, Human adenovirus D
ccgucgccacgguc

SEQ ID NO: 1567376 - RNA, 22 nt, Human adenovirus D
cauggacgagaacccgaggagc

SEQ ID NO: 1567377 - RNA, 19 nt, Human adenovirus D
gacagcuuuuacaugcgca

SEQ ID NO: 1567378 - RNA, 18 nt, Human adenovirus D
caaagcgguugagcuggg

SEQ ID NO: 1567379 - RNA, 13 nt, Human adenovirus D
ccgcuugcuggau

SEQ ID NO: 1567380 - RNA, 17 nt, Human adenovirus D
cuucgagguggacccca

SEQ ID NO: 1567381 - RNA, 18 nt, Human adenovirus D
ucaggugccugccccuca

SEQ ID NO: 1567382 - RNA, 14 nt, Human adenovirus D
ccugcgcugcuucg

SEQ ID NO: 1567383 - RNA, 14 nt, Human adenovirus D
aucgccgagcccga

SEQ ID NO: 1567384 - RNA, 17 nt, Human adenovirus D
agauccugcugcuccac

SEQ ID NO: 1567385 - RNA, 19 nt, Human adenovirus D
ggucugcgaccggacggag

SEQ ID NO: 1567386 - RNA, 14 nt, Human adenovirus D
ucacauacacacua

SEQ ID NO: 1567387 - RNA, 18 nt, Human adenovirus D
gcagccgcggcagccgca

SEQ ID NO: 1567388 - RNA, 17 nt, Human adenovirus D
gaccuugcagagcagcu

SEQ ID NO: 1567389 - RNA, 15 nt, Human adenovirus D
ugacgucauugaaga

SEQ ID NO: 1567390 - RNA, 22 nt, Human adenovirus D
cugauauugcuucccuggaaga

SEQ ID NO: 1567391 - RNA, 22 nt, Human adenovirus D
uggccuggaucuugagguuggc

SEQ ID NO: 1567392 - RNA, 18 nt, Human adenovirus D
acucgcgggcggccauug

SEQ ID NO: 1567393 - RNA, 13 nt, Human adenovirus D
gucccagcagcac

SEQ ID NO: 1567394 - RNA, 23 nt, Human adenovirus D
aaguuccugucuucuuccggcaa

SEQ ID NO: 1567395 - RNA, 23 nt, Human adenovirus D
cucagccucgaacaguccaccca

SEQ ID NO: 1567396 - RNA, 22 nt, Human adenovirus D
cuggagauguggguuggcuugc

SEQ ID NO: 1567397 - RNA, 15 nt, Human adenovirus D
cguggcuucgagcag

SEQ ID NO: 1567398 - RNA, 16 nt, Human adenovirus D
ggacgacgaggacucg

SEQ ID NO: 1567399 - RNA, 22 nt, Human adenovirus D
cgaggccgucuaccugcgcacg

SEQ ID NO: 1567400 - RNA, 13 nt, Human adenovirus D
gagacgcgcgcag

SEQ ID NO: 1567401 - RNA, 15 nt, Human adenovirus D
ccgggucuggugcag

SEQ ID NO: 1567402 - RNA, 19 nt, Human adenovirus D
guaccuucgagcugcaagg

SEQ ID NO: 1567403 - RNA, 20 nt, Human adenovirus D
ccgaguucagcuccaguggg

SEQ ID NO: 1567404 - RNA, 13 nt, Human adenovirus D
cuuuaaucauuug

SEQ ID NO: 1567405 - RNA, 17 nt, Human adenovirus D
cacccagaccgugcagg

SEQ ID NO: 1567406 - RNA, 12 nt, Human adenovirus D
ccugaugaacaa

SEQ ID NO: 1567407 - RNA, 18 nt, Human adenovirus D
ggggcaacauccccgccc

SEQ ID NO: 1567408 - RNA, 20 nt, Human adenovirus D
uacaugcccucucaacauca

SEQ ID NO: 1567409 - RNA, 15 nt, Human adenovirus D
cccugacccagcagg

SEQ ID NO: 1567410 - RNA, 18 nt, Human adenovirus D
ccccucaugaacacacug

SEQ ID NO: 1567411 - RNA, 15 nt, Human adenovirus D
caguugggagcuguc

SEQ ID NO: 1567412 - RNA, 16 nt, Human adenovirus D
gccagcagggugccuc

SEQ ID NO: 1567413 - RNA, 13 nt, Human adenovirus D
aguggaagaagag

SEQ ID NO: 1567414 - RNA, 12 nt, Human adenovirus D
agcgcgagccgg

SEQ ID NO: 1567415 - RNA, 19 nt, Human adenovirus D
gggguagcggucguugucc

SEQ ID NO: 1567416 - RNA, 22 nt, Human adenovirus D
caggagggggccacucccagcg

SEQ ID NO: 1567417 - RNA, 13 nt, Human adenovirus D
aacagacagccag

SEQ ID NO: 1567418 - RNA, 15 nt, Human adenovirus D
gaagaaaacuggcaa

SEQ ID NO: 1567419 - RNA, 15 nt, Human adenovirus D
ccaccucgccgcgca

SEQ ID NO: 1567420 - RNA, 20 nt, Human adenovirus D
cgcaguacucgcagcgcugc

SEQ ID NO: 1567421 - RNA, 20 nt, Human adenovirus D
ccggcaugcccaccacgcgc

SEQ ID NO: 1567422 - RNA, 16 nt, Human adenovirus D
gguggcccugggccug

SEQ ID NO: 1567423 - RNA, 17 nt, Human adenovirus D
ucggcccacgcgcucga

SEQ ID NO: 1567424 - RNA, 21 nt, Human adenovirus D
cgggaccggggaggcaccacc

SEQ ID NO: 1567425 - RNA, 19 nt, Human adenovirus D
gggacgacguggacagcgc

SEQ ID NO: 1567426 - RNA, 19 nt, Human adenovirus D
ggcaaugcuagagugaggc

SEQ ID NO: 1567427 - RNA, 15 nt, Human adenovirus D
gacauuuuaaugaau

SEQ ID NO: 1567428 - RNA, 20 nt, Human adenovirus D
ggugacggccuacgagcaga

SEQ ID NO: 1567429 - RNA, 17 nt, Human adenovirus D
ucccgaggagcacccca

SEQ ID NO: 1567430 - RNA, 19 nt, Human adenovirus D
cugaucugauccuugucca

SEQ ID NO: 1567431 - RNA, 16 nt, Human adenovirus D
cgcccugacccagcag

SEQ ID NO: 1567432 - RNA, 19 nt, Human adenovirus D
cgcucagucauccaacuga

SEQ ID NO: 1567433 - RNA, 21 nt, Human adenovirus D
cagccacaugacccugcaugg

SEQ ID NO: 1567434 - RNA, 22 nt, Human adenovirus D
ccugguuagguucuucacccag

SEQ ID NO: 1567435 - RNA, 18 nt, Human adenovirus D
uaugauaaucugcaugau

SEQ ID NO: 1567436 - RNA, 12 nt, Human adenovirus D
ugagcugggagg

SEQ ID NO: 1567437 - RNA, 21 nt, Human adenovirus D
gcuccgguugugcagcccccu

SEQ ID NO: 1567438 - RNA, 20 nt, Human adenovirus D
gcacgucggcguggcgcucg

SEQ ID NO: 1567439 - RNA, 15 nt, Human adenovirus D
gguccccgaggcccu

SEQ ID NO: 1567440 - RNA, 22 nt, Human adenovirus D
cgcuugcuggaugcggagccgc

SEQ ID NO: 1567441 - RNA, 18 nt, Human adenovirus D
gccgcggcagccgcagcc

SEQ ID NO: 1567442 - RNA, 19 nt, Human adenovirus D
guccaacggcaaacagcau

SEQ ID NO: 1567443 - RNA, 14 nt, Human adenovirus D
gugaacgcgcuggc

SEQ ID NO: 1567444 - RNA, 17 nt, Human adenovirus D
ccccaggcggaccagaa

SEQ ID NO: 1567445 - RNA, 16 nt, Human adenovirus D
cacggaccggucccag

SEQ ID NO: 1567446 - RNA, 20 nt, Human adenovirus D
gcaagccucugacggcgcag

SEQ ID NO: 1567447 - RNA, 20 nt, Human adenovirus D
cgcucuuaucccaugcccuc

SEQ ID NO: 1567448 - RNA, 14 nt, Human adenovirus D
gggcucgagcaugg

SEQ ID NO: 1567449 - RNA, 14 nt, Human adenovirus D
gcagacagggccug

SEQ ID NO: 1567450 - RNA, 19 nt, Human adenovirus D
acaaccagauccucugccg

SEQ ID NO: 1567451 - RNA, 19 nt, Human adenovirus D
aggaauaggcacugaaaau

SEQ ID NO: 1567452 - RNA, 15 nt, Human adenovirus D
ugaaagaacauacau

SEQ ID NO: 1567453 - RNA, 18 nt, Human adenovirus D
cucgucgcuugacagcac

SEQ ID NO: 1567454 - RNA, 21 nt, Human adenovirus D
guauccagccuguacccagag

SEQ ID NO: 1567455 - RNA, 22 nt, Human adenovirus D
acauggugggcuaauauaacuu

SEQ ID NO: 1567456 - RNA, 14 nt, Human adenovirus D
ggaagacccggagc

SEQ ID NO: 1567457 - RNA, 15 nt, Human adenovirus D
ccgaguuguccuggu

SEQ ID NO: 1567458 - RNA, 16 nt, Human adenovirus D
caaggccgugagcgcg

SEQ ID NO: 1567459 - RNA, 15 nt, Human adenovirus D
agaauccacagauca

SEQ ID NO: 1567460 - RNA, 22 nt, Human adenovirus D
agcaagccucugacggcgcagc

SEQ ID NO: 1567461 - RNA, 17 nt, Human adenovirus D
cauacagagauucagcc

SEQ ID NO: 1567462 - RNA, 18 nt, Human adenovirus D
uacauggugggcuaauau

SEQ ID NO: 1567463 - RNA, 19 nt, Human adenovirus D
cuucaaccccuucucggga

SEQ ID NO: 1567464 - RNA, 15 nt, Human adenovirus D
gcugcccgccaccug

SEQ ID NO: 1567465 - RNA, 23 nt, Human adenovirus D
gcugagaccagaccaccugguga

SEQ ID NO: 1567466 - RNA, 23 nt, Human adenovirus D
gagcgacacccccgcgugcagcu

SEQ ID NO: 1567467 - RNA, 23 nt, Human adenovirus D
acuucuuuuugauaauaaaggug

SEQ ID NO: 1567468 - RNA, 18 nt, Human adenovirus D
aucgccaggccucuaccc

SEQ ID NO: 1567469 - RNA, 20 nt, Human adenovirus D
gagcaucguaguucaggagc

SEQ ID NO: 1567470 - RNA, 14 nt, Human adenovirus D
ggagggauugcagg

SEQ ID NO: 1567471 - RNA, 12 nt, Human adenovirus D
ugaacuugcuga

SEQ ID NO: 1567472 - RNA, 20 nt, Human adenovirus D
gcgcagcuguuccugguggu

SEQ ID NO: 1567473 - RNA, 17 nt, Human adenovirus D
gaccaggcggcagagcg

SEQ ID NO: 1567474 - RNA, 16 nt, Human adenovirus D
uuccagacgcggcugu

SEQ ID NO: 1567475 - RNA, 14 nt, Human adenovirus D
caugcccgacccca

SEQ ID NO: 1567476 - RNA, 12 nt, Human adenovirus D
acagaaagcaug

SEQ ID NO: 1567477 - RNA, 15 nt, Human adenovirus D
cggcgggggcggaga

SEQ ID NO: 1567478 - RNA, 19 nt, Human adenovirus D
gccacaugacccugcaugg

SEQ ID NO: 1567479 - RNA, 17 nt, Human adenovirus D
caccucggugcagccgu

SEQ ID NO: 1567480 - RNA, 17 nt, Human adenovirus D
cgcccagugcuuccagc

SEQ ID NO: 1567481 - RNA, 23 nt, Human adenovirus D
augcuuggucuuucuggcuugcu

SEQ ID NO: 1567482 - RNA, 18 nt, Human adenovirus D
uccacgccaagacaaagg

SEQ ID NO: 1567483 - RNA, 13 nt, Human adenovirus D
agauccagguccg

SEQ ID NO: 1567484 - RNA, 15 nt, Human adenovirus D
cuacuggucgcugcc

SEQ ID NO: 1567485 - RNA, 12 nt, Human adenovirus D
aaacauccaugu

SEQ ID NO: 1567486 - RNA, 17 nt, Human adenovirus D
cuccggguucuggagac

SEQ ID NO: 1567487 - RNA, 19 nt, Human adenovirus D
ccucccgcccgacacugca

SEQ ID NO: 1567488 - RNA, 13 nt, Human adenovirus D
gggcagggagcug

SEQ ID NO: 1567489 - RNA, 19 nt, Human adenovirus D
ucgcacucgacgagccagg

SEQ ID NO: 1567490 - RNA, 20 nt, Human adenovirus D
uacagccagcagcuccgggu

SEQ ID NO: 1567491 - RNA, 22 nt, Human adenovirus D
cccgagaccugcgcaaggucga

SEQ ID NO: 1567492 - RNA, 15 nt, Human adenovirus D
uggcgcucgggcagg

SEQ ID NO: 1567493 - RNA, 18 nt, Human adenovirus D
caguagacaaagagcaca

SEQ ID NO: 1567494 - RNA, 22 nt, Human adenovirus D
gccgcuccgugcgaggaugaga

SEQ ID NO: 1567495 - RNA, 19 nt, Human adenovirus D
acuggucuccugccuggga

SEQ ID NO: 1567496 - RNA, 15 nt, Human adenovirus D
gacaugggggcggac

SEQ ID NO: 1567497 - RNA, 18 nt, Human adenovirus D
gcaucagucuccuggugc

SEQ ID NO: 1567498 - RNA, 14 nt, Human adenovirus D
ggcggugcugcugc

SEQ ID NO: 1567499 - RNA, 18 nt, Human adenovirus D
uuuccaugcacucaucca

SEQ ID NO: 1567500 - RNA, 20 nt, Human adenovirus D
caccagcgcgaguagucaau

SEQ ID NO: 1567501 - RNA, 16 nt, Human adenovirus D
uucaaggacaugcagc

SEQ ID NO: 1567502 - RNA, 20 nt, Human adenovirus D
cucuccuuucuucucccaca

SEQ ID NO: 1567503 - RNA, 16 nt, Human adenovirus D
caggaugaacaggagc

SEQ ID NO: 1567504 - RNA, 17 nt, Human adenovirus D
cgcuggaccccauggac

SEQ ID NO: 1567505 - RNA, 21 nt, Human adenovirus D
acuggucaaaaacaaagugac

SEQ ID NO: 1567506 - RNA, 15 nt, Human adenovirus D
gcgcgcucacucuua

SEQ ID NO: 1567507 - RNA, 16 nt, Human adenovirus D
cugcaggccgggcugc

SEQ ID NO: 1567508 - RNA, 15 nt, Human adenovirus D
ugaccaagcugguga

SEQ ID NO: 1567509 - RNA, 15 nt, Human adenovirus D
gcacagaccuucagg

SEQ ID NO: 1567510 - RNA, 15 nt, Human adenovirus D
gugagugauaaagcg

SEQ ID NO: 1567511 - RNA, 22 nt, Human adenovirus D
cuucaagaaagucuccaucaug

SEQ ID NO: 1567512 - RNA, 16 nt, Human adenovirus D
uccacgcauugcauga

SEQ ID NO: 1567513 - RNA, 19 nt, Human adenovirus D
ggcggcgauaugccagacg

SEQ ID NO: 1567514 - RNA, 17 nt, Human adenovirus D
uacaaccaaggcaccca

SEQ ID NO: 1567515 - RNA, 12 nt, Human adenovirus D
acguacuucagc

SEQ ID NO: 1567516 - RNA, 18 nt, Human adenovirus D
gcggagccgcucggccau

SEQ ID NO: 1567517 - RNA, 15 nt, Human adenovirus D
cucugcgugaagacc

SEQ ID NO: 1567518 - RNA, 21 nt, Human adenovirus D
acccgauaucgcgcauccugc

SEQ ID NO: 1567519 - RNA, 20 nt, Human adenovirus D
cgccgaggagaacugcuggc

SEQ ID NO: 1567520 - RNA, 21 nt, Human adenovirus D
aggugagggggucccgcuccc

SEQ ID NO: 1567521 - RNA, 16 nt, Human adenovirus D
agcgcgguguuuucac

SEQ ID NO: 1567522 - RNA, 19 nt, Human adenovirus D
cgaggagcugagaccagac

SEQ ID NO: 1567523 - RNA, 16 nt, Human adenovirus D
gcauccacaaggccgu

SEQ ID NO: 1567524 - RNA, 22 nt, Human adenovirus D
agccgucuggacccgcggccgc

SEQ ID NO: 1567525 - RNA, 18 nt, Human adenovirus D
ucucaauaaacagcacuu

SEQ ID NO: 1567526 - RNA, 16 nt, Human adenovirus D
cuaugaaagcauacag

SEQ ID NO: 1567527 - RNA, 14 nt, Human adenovirus D
aggcagacucaggg

SEQ ID NO: 1567528 - RNA, 22 nt, Human adenovirus D
uugaagauucuggaaauuauga

SEQ ID NO: 1567529 - RNA, 16 nt, Human adenovirus D
accuuccugcagcuca

SEQ ID NO: 1567530 - RNA, 13 nt, Human adenovirus D
acucgggcacggc

SEQ ID NO: 1567531 - RNA, 11 nt, Human adenovirus D
ggggcgguggu

SEQ ID NO: 1567532 - RNA, 15 nt, Human adenovirus D
ugcagcauugucugc

SEQ ID NO: 1567533 - RNA, 14 nt, Human adenovirus D
ugcugccgggcugc

SEQ ID NO: 1567534 - RNA, 16 nt, Human adenovirus D
caugagcugcgagaag

SEQ ID NO: 1567535 - RNA, 19 nt, Human adenovirus D
gcucuuaccaaguccaggg

SEQ ID NO: 1567536 - RNA, 12 nt, Human adenovirus D
gcuggggcagaa

SEQ ID NO: 1567537 - RNA, 22 nt, Human adenovirus D
aggagaacugcuggcccugcug

SEQ ID NO: 1567538 - RNA, 20 nt, Human adenovirus D
ggaaaggaauaggcacugaa

SEQ ID NO: 1567539 - RNA, 17 nt, Human adenovirus D
gcgcacccguccuccuc

SEQ ID NO: 1567540 - RNA, 12 nt, Human adenovirus D
agcgccaggagg

SEQ ID NO: 1567541 - RNA, 18 nt, Human adenovirus D
cgucauguccuuccaggg

SEQ ID NO: 1567542 - RNA, 17 nt, Human adenovirus D
gcuccugagcgagaccc

SEQ ID NO: 1567543 - RNA, 15 nt, Human adenovirus D
aaguacacgccggcc

SEQ ID NO: 1567544 - RNA, 21 nt, Human adenovirus D
cgagcccgcgcgggagccagg

SEQ ID NO: 1567545 - RNA, 16 nt, Human adenovirus D
cgagccgaacgagcag

SEQ ID NO: 1567546 - RNA, 14 nt, Human adenovirus D
cacauacacacuag

SEQ ID NO: 1567547 - RNA, 15 nt, Human adenovirus D
ucccaccccagaaag

SEQ ID NO: 1567548 - RNA, 18 nt, Human adenovirus D
cuccugcucccgggcucc

SEQ ID NO: 1567549 - RNA, 15 nt, Human adenovirus D
gcucaccaccccgga

SEQ ID NO: 1567550 - RNA, 13 nt, Human adenovirus D
cggccaccagucc

SEQ ID NO: 1567551 - RNA, 16 nt, Human adenovirus D
gucaucacuggcggag

SEQ ID NO: 1567552 - RNA, 14 nt, Human adenovirus D
cggcgcugcaaagc

SEQ ID NO: 1567553 - RNA, 13 nt, Human adenovirus D
uaugaggaucuag

SEQ ID NO: 1567554 - RNA, 22 nt, Human adenovirus D
ucaggaccauagggagccugcg

SEQ ID NO: 1567555 - RNA, 15 nt, Human adenovirus D
augggaacaaggccu

SEQ ID NO: 1567556 - RNA, 16 nt, Human adenovirus D
cagacagggccugcaa

SEQ ID NO: 1567557 - RNA, 22 nt, Human adenovirus D
cacaccuggaggcaccaucaca

SEQ ID NO: 1567558 - RNA, 17 nt, Human adenovirus D
caacgugcccaucucca

SEQ ID NO: 1567559 - RNA, 14 nt, Human adenovirus D
gacaacgccaggcu

SEQ ID NO: 1567560 - RNA, 18 nt, Human adenovirus D
gucacggucggcgcgcuc

SEQ ID NO: 1567561 - RNA, 14 nt, Human adenovirus D
cugaucugauccuu

SEQ ID NO: 1567562 - RNA, 13 nt, Human adenovirus D
cggccgccaacau

SEQ ID NO: 1567563 - RNA, 16 nt, Human adenovirus D
ccagaccaccugguga

SEQ ID NO: 1567564 - RNA, 18 nt, Human adenovirus D
acgcgcgaagauggccac

SEQ ID NO: 1567565 - RNA, 16 nt, Human adenovirus D
uaaucauuuaauaaag

SEQ ID NO: 1567566 - RNA, 16 nt, Human adenovirus D
gcucgguugaggcacc

SEQ ID NO: 1567567 - RNA, 15 nt, Human adenovirus D
cagccuugcccccaa

SEQ ID NO: 1567568 - RNA, 15 nt, Human adenovirus D
gcgagggccuggacc

SEQ ID NO: 1567569 - RNA, 15 nt, Human adenovirus D
cgggacgcccuggcc

SEQ ID NO: 1567570 - RNA, 15 nt, Human adenovirus D
ucguacgagagcgug

SEQ ID NO: 1567571 - RNA, 20 nt, Human adenovirus D
agcaaguuuaaggcgcgggu

SEQ ID NO: 1567572 - RNA, 18 nt, Human adenovirus D
guagagcuugggcgcaag

SEQ ID NO: 1567573 - RNA, 22 nt, Human adenovirus D
gcagcauugucugccuggucau

SEQ ID NO: 1567574 - RNA, 14 nt, Human adenovirus D
uuaccgccagagaa

SEQ ID NO: 1567575 - RNA, 16 nt, Human adenovirus D
auggcuuguggccccc

SEQ ID NO: 1567576 - RNA, 20 nt, Human adenovirus D
uucucggccaaucagcagua

SEQ ID NO: 1567577 - RNA, 17 nt, Human adenovirus D
cucauuuuuccagccuu

SEQ ID NO: 1567578 - RNA, 12 nt, Human adenovirus D
ugcagcacugga

SEQ ID NO: 1567579 - RNA, 19 nt, Human adenovirus D
cccucgaaucaggcuggag

SEQ ID NO: 1567580 - RNA, 13 nt, Human adenovirus D
gcugguugaacau

SEQ ID NO: 1567581 - RNA, 19 nt, Human adenovirus D
augaaagucaggagcagcg

SEQ ID NO: 1567582 - RNA, 17 nt, Human adenovirus D
ggcgcacgucugacugc

SEQ ID NO: 1567583 - RNA, 16 nt, Human adenovirus D
cgacgaggccgggcua

SEQ ID NO: 1567584 - RNA, 13 nt, Human adenovirus D
gcagcgcacucuc

SEQ ID NO: 1567585 - RNA, 17 nt, Human adenovirus D
acaugcgcauggcgcuc

SEQ ID NO: 1567586 - RNA, 20 nt, Human adenovirus D
cucgaaucaggcuggagccg

SEQ ID NO: 1567587 - RNA, 19 nt, Human adenovirus D
cgggcgccucccaggacua

SEQ ID NO: 1567588 - RNA, 16 nt, Human adenovirus D
ccugcacgcagcagcg

SEQ ID NO: 1567589 - RNA, 15 nt, Human adenovirus D
caucacaggaggcac

SEQ ID NO: 1567590 - RNA, 12 nt, Human adenovirus D
gcuccguggggc

SEQ ID NO: 1567591 - RNA, 20 nt, Human adenovirus D
cuucaacgacuaccucucgg

SEQ ID NO: 1567592 - RNA, 18 nt, Human adenovirus D
ccacacauggcaagcugc

SEQ ID NO: 1567593 - RNA, 15 nt, Human adenovirus D
cucggccaaucagca

SEQ ID NO: 1567594 - RNA, 19 nt, Human adenovirus D
accacggaccggucccagc

SEQ ID NO: 1567595 - RNA, 22 nt, Human adenovirus D
gacacagcaguccaugcccaac

SEQ ID NO: 1567596 - RNA, 13 nt, Human adenovirus D
acagaaccggagg

SEQ ID NO: 1567597 - RNA, 17 nt, Human adenovirus D
caccaggggguccaccu

SEQ ID NO: 1567598 - RNA, 15 nt, Human adenovirus D
agaauauaaagcaga

SEQ ID NO: 1567599 - RNA, 21 nt, Human adenovirus D
acaguccacccagaccgugca

SEQ ID NO: 1567600 - RNA, 14 nt, Human adenovirus D
cacucuuuccagca

SEQ ID NO: 1567601 - RNA, 21 nt, Human adenovirus D
acuuugguacuuacaaagugu

SEQ ID NO: 1567602 - RNA, 16 nt, Human adenovirus D
agcccaaacuggggcg

SEQ ID NO: 1567603 - RNA, 21 nt, Human adenovirus D
agcaucguaguucaggagcgc

SEQ ID NO: 1567604 - RNA, 21 nt, Human adenovirus D
aguccuuuagacaacagccgc

SEQ ID NO: 1567605 - RNA, 20 nt, Human adenovirus D
cuccuucaacgcgcgcugcc

SEQ ID NO: 1567606 - RNA, 15 nt, Human adenovirus D
agucccuuuuccagg

SEQ ID NO: 1567607 - RNA, 18 nt, Human adenovirus D
ggccccgcgggcaggggc

SEQ ID NO: 1567608 - RNA, 20 nt, Human adenovirus D
cugguugacaaauggagcca

SEQ ID NO: 1567609 - RNA, 14 nt, Human adenovirus D
gcaagaggagacag

SEQ ID NO: 1567610 - RNA, 18 nt, Human adenovirus D
cggcggccaaccugguga

SEQ ID NO: 1567611 - RNA, 21 nt, Human adenovirus D
cugcagcccaaacuggggcga

SEQ ID NO: 1567612 - RNA, 16 nt, Human adenovirus D
guggcccugggccuga

SEQ ID NO: 1567613 - RNA, 12 nt, Human adenovirus D
ugaggcagacgc

SEQ ID NO: 1567614 - RNA, 20 nt, Human adenovirus D
ccugccugggaauccugcac

SEQ ID NO: 1567615 - RNA, 17 nt, Human adenovirus D
acgauccugcaggugga

SEQ ID NO: 1567616 - RNA, 19 nt, Human adenovirus D
ugcuaccucuugcagcugg

SEQ ID NO: 1567617 - RNA, 19 nt, Human adenovirus D
ccaaggcacccaccacagu

SEQ ID NO: 1567618 - RNA, 22 nt, Human adenovirus D
auguaaguuuuauggcugcugg

SEQ ID NO: 1567619 - RNA, 16 nt, Human adenovirus D
accagacccaggcgcg

SEQ ID NO: 1567620 - RNA, 24 nt, Human adenovirus D
cgaccaguugacggucugcaggcc

SEQ ID NO: 1567621 - RNA, 15 nt, Human adenovirus D
gcaagcgcccagagc

SEQ ID NO: 1567622 - RNA, 16 nt, Human adenovirus D
ccgaggaggcgguccc

SEQ ID NO: 1567623 - RNA, 22 nt, Human adenovirus D
gccaccacccacaccgccuccc

SEQ ID NO: 1567624 - RNA, 17 nt, Human adenovirus D
cacagccacagacagag

SEQ ID NO: 1567625 - RNA, 19 nt, Human adenovirus D
aguacgacaugcccgaccc

SEQ ID NO: 1567626 - RNA, 24 nt, Human adenovirus D
ccgugugauuaaaaagcagcacag

SEQ ID NO: 1567627 - RNA, 16 nt, Human adenovirus D
uaagugugacaaucaa

SEQ ID NO: 1567628 - RNA, 17 nt, Human adenovirus D
ggccgcgauguugagcu

SEQ ID NO: 1567629 - RNA, 14 nt, Human adenovirus D
uacaugcccagcag

SEQ ID NO: 1567630 - RNA, 15 nt, Human adenovirus D
gccagcgcgugcugc

SEQ ID NO: 1567631 - RNA, 16 nt, Human adenovirus D
uaauuaagguuacuuu

SEQ ID NO: 1567632 - RNA, 14 nt, Human adenovirus D
ugccuucuccaggg

SEQ ID NO: 1567633 - RNA, 22 nt, Human adenovirus D
cgcagacgagcggccgccgccg

SEQ ID NO: 1567634 - RNA, 20 nt, Human adenovirus D
agcucguguccaacggcaaa

SEQ ID NO: 1567635 - RNA, 17 nt, Human adenovirus D
ccacuuccgcgcuccgu

SEQ ID NO: 1567636 - RNA, 10 nt, Human adenovirus D
aacagcagca

SEQ ID NO: 1567637 - RNA, 17 nt, Human adenovirus D
gaaccgccuggggcaga

SEQ ID NO: 1567638 - RNA, 12 nt, Human adenovirus D
auacaagccagg

SEQ ID NO: 1567639 - RNA, 17 nt, Human adenovirus D
caucgcgaaccaggcag

SEQ ID NO: 1567640 - RNA, 18 nt, Human adenovirus D
guggagggcaugggucag

SEQ ID NO: 1567641 - RNA, 20 nt, Human adenovirus D
gcgcauccccuucuccagca

SEQ ID NO: 1567642 - RNA, 22 nt, Human adenovirus D
ccacgcgcaucaucgcgccacu

SEQ ID NO: 1567643 - RNA, 16 nt, Human adenovirus D
ugaguagugggcgugg

SEQ ID NO: 1567644 - RNA, 15 nt, Human adenovirus D
auaagucacuaggac

SEQ ID NO: 1567645 - RNA, 13 nt, Human adenovirus D
cgacccccuucca

SEQ ID NO: 1567646 - RNA, 21 nt, Human adenovirus D
gcacagacaccgucgccgcac

SEQ ID NO: 1567647 - RNA, 13 nt, Human adenovirus D
ugcuuccacacuu

SEQ ID NO: 1567648 - RNA, 18 nt, Human adenovirus D
gugcaguuggccaugagc

SEQ ID NO: 1567649 - RNA, 17 nt, Human adenovirus D
uugcgucccuggcuccg

SEQ ID NO: 1567650 - RNA, 20 nt, Human adenovirus D
ggccgugagcgcgagccggc

SEQ ID NO: 1567651 - RNA, 21 nt, Human adenovirus D
ccugagauacgaugagaccaa

SEQ ID NO: 1567652 - RNA, 18 nt, Human adenovirus D
agcuucgaguacgaggcc

SEQ ID NO: 1567653 - RNA, 18 nt, Human adenovirus D
aucuccaacguggagcug

SEQ ID NO: 1567654 - RNA, 17 nt, Human adenovirus D
ggaugcgugagggcgga

SEQ ID NO: 1567655 - RNA, 23 nt, Human adenovirus D
ugggaccggugcucugcgcgcgc

SEQ ID NO: 1567656 - RNA, 16 nt, Human adenovirus D
gcagcaguagccccuc

SEQ ID NO: 1567657 - RNA, 23 nt, Human adenovirus D
ccgccugcgcauccccguuccga

SEQ ID NO: 1567658 - RNA, 18 nt, Human adenovirus D
cuccaccgaaggcagcuc

SEQ ID NO: 1567659 - RNA, 20 nt, Human adenovirus D
agcgcccauuccuggagaug

SEQ ID NO: 1567660 - RNA, 17 nt, Human adenovirus D
ccuggagacgggcugcu

SEQ ID NO: 1567661 - RNA, 17 nt, Human adenovirus D
cuaaugacaaacaaaag

SEQ ID NO: 1567662 - RNA, 19 nt, Human adenovirus D
ugaagcccugcuauggcuc

SEQ ID NO: 1567663 - RNA, 19 nt, Human adenovirus D
cgaggugcagaccgacccc

SEQ ID NO: 1567664 - RNA, 21 nt, Human adenovirus D
ggcugcuagagugccacugcc

SEQ ID NO: 1567665 - RNA, 22 nt, Human adenovirus D
uccgcccgcgcccaccaucacc

SEQ ID NO: 1567666 - RNA, 13 nt, Human adenovirus D
agguacaugggca

SEQ ID NO: 1567667 - RNA, 13 nt, Human adenovirus D
gccucuccaucag

SEQ ID NO: 1567668 - RNA, 19 nt, Human adenovirus D
gucguacuucugccagcag

SEQ ID NO: 1567669 - RNA, 15 nt, Human adenovirus D
augcgacccaugagc

SEQ ID NO: 1567670 - RNA, 20 nt, Human adenovirus D
cgcgagcaagggcgaccagc

SEQ ID NO: 1567671 - RNA, 17 nt, Human adenovirus D
cgaucugggaugcugcc

SEQ ID NO: 1567672 - RNA, 20 nt, Human adenovirus D
ccgaggagcugagaccagac

SEQ ID NO: 1567673 - RNA, 21 nt, Human adenovirus D
cuugcugaccaauagacagca

SEQ ID NO: 1567674 - RNA, 23 nt, Human adenovirus D
gaguccuuuagacaacagccgca

SEQ ID NO: 1567675 - RNA, 15 nt, Human adenovirus D
cgauagccgccagga

SEQ ID NO: 1567676 - RNA, 23 nt, Human adenovirus D
gccgaaauuggugcgcuggggcu

SEQ ID NO: 1567677 - RNA, 15 nt, Human adenovirus D
ggugucuuccucucc

SEQ ID NO: 1567678 - RNA, 18 nt, Human adenovirus D
acauggcaagcugccaug

SEQ ID NO: 1567679 - RNA, 13 nt, Human adenovirus D
auacaagccagga

SEQ ID NO: 1567680 - RNA, 18 nt, Human adenovirus D
gacucgcagacgagcggc

SEQ ID NO: 1567681 - RNA, 20 nt, Human adenovirus D
cuuccacgugcccgagggcu

SEQ ID NO: 1567682 - RNA, 16 nt, Human adenovirus D
cugggcauucgcaaga

SEQ ID NO: 1567683 - RNA, 20 nt, Human adenovirus D
cuuagcucccuauuuaaagg

SEQ ID NO: 1567684 - RNA, 15 nt, Human adenovirus D
gcaguuggccaugag

SEQ ID NO: 1567685 - RNA, 16 nt, Human adenovirus D
cucggugcuuagccug

SEQ ID NO: 1567686 - RNA, 23 nt, Human adenovirus D
cgaugcuauugagagagaggaag

SEQ ID NO: 1567687 - RNA, 16 nt, Human adenovirus D
aauuggugcgcugggg

SEQ ID NO: 1567688 - RNA, 15 nt, Human adenovirus D
gguccacgcuggugg

SEQ ID NO: 1567689 - RNA, 12 nt, Human adenovirus D
gaggugagcucu

SEQ ID NO: 1567690 - RNA, 20 nt, Human adenovirus D
cacugccgccgccugcgcug

SEQ ID NO: 1567691 - RNA, 13 nt, Human adenovirus D
agcggccgcggcc

SEQ ID NO: 1567692 - RNA, 15 nt, Human adenovirus D
gcccgugggcugcgg

SEQ ID NO: 1567693 - RNA, 14 nt, Human adenovirus D
ccgucuacugcauc

SEQ ID NO: 1567694 - RNA, 15 nt, Human adenovirus D
acacuacuaauucuc

SEQ ID NO: 1567695 - RNA, 16 nt, Human adenovirus D
ggcagggugagccggc

SEQ ID NO: 1567696 - RNA, 15 nt, Human adenovirus D
gagggcguuggagag

SEQ ID NO: 1567697 - RNA, 19 nt, Human adenovirus D
cuagcaugaccagacccag

SEQ ID NO: 1567698 - RNA, 18 nt, Human adenovirus D
ucaggcgcaaccaggagg

SEQ ID NO: 1567699 - RNA, 21 nt, Human adenovirus D
cgagggcaaugcuagagugag

SEQ ID NO: 1567700 - RNA, 12 nt, Human adenovirus D
ccgccaccugca

SEQ ID NO: 1567701 - RNA, 19 nt, Human adenovirus D
agcucgucuuccaggagcc

SEQ ID NO: 1567702 - RNA, 20 nt, Human adenovirus D
cccgccaaaaaaacacacac

SEQ ID NO: 1567703 - RNA, 20 nt, Human adenovirus D
gcguccccgcccgccgccag

SEQ ID NO: 1567704 - RNA, 12 nt, Human adenovirus D
cgcgccgcggcg

SEQ ID NO: 1567705 - RNA, 22 nt, Human adenovirus D
gcgggccucacaguccagguca

SEQ ID NO: 1567706 - RNA, 20 nt, Human adenovirus D
gguggacuucacagagagcc

SEQ ID NO: 1567707 - RNA, 22 nt, Human adenovirus D
ccagcgaaagagagcucgcguc

SEQ ID NO: 1567708 - RNA, 21 nt, Human adenovirus D
ggggaucaccaguuugggcac

SEQ ID NO: 1567709 - RNA, 15 nt, Human adenovirus D
aucaugguguggaag

SEQ ID NO: 1567710 - RNA, 16 nt, Human adenovirus D
cggaccccgccauaag

SEQ ID NO: 1567711 - RNA, 15 nt, Human adenovirus D
cgcaucauggcccug

SEQ ID NO: 1567712 - RNA, 19 nt, Human adenovirus D
ccacagcucgcgguugagg

SEQ ID NO: 1567713 - RNA, 15 nt, Human adenovirus D
cgagggccugggcuc

SEQ ID NO: 1567714 - RNA, 16 nt, Human adenovirus D
gcaguuggccaugagc

SEQ ID NO: 1567715 - RNA, 16 nt, Human adenovirus D
aggcauauaaaaaugc

SEQ ID NO: 1567716 - RNA, 16 nt, Human adenovirus D
gagccaggugagcucg

SEQ ID NO: 1567717 - RNA, 18 nt, Human adenovirus D
ccccaagggcgcucccaa

SEQ ID NO: 1567718 - RNA, 19 nt, Human adenovirus D
ugacacaccuggaggcacc

SEQ ID NO: 1567719 - RNA, 21 nt, Human adenovirus D
cccagcaauaacaccggcugg

SEQ ID NO: 1567720 - RNA, 15 nt, Human adenovirus D
cuguaccgcagcugg

SEQ ID NO: 1567721 - RNA, 14 nt, Human adenovirus D
ccaccuacuccucu

SEQ ID NO: 1567722 - RNA, 18 nt, Human adenovirus D
auuaauguuaaugucacu

SEQ ID NO: 1567723 - RNA, 16 nt, Human adenovirus D
gcccgagcucugcugc

SEQ ID NO: 1567724 - RNA, 14 nt, Human adenovirus D
cuucugccagcaga

SEQ ID NO: 1567725 - RNA, 21 nt, Human adenovirus D
auauccaguaggaaccagcac

SEQ ID NO: 1567726 - RNA, 16 nt, Human adenovirus D
gaacgggggcagcaca

SEQ ID NO: 1567727 - RNA, 13 nt, Human adenovirus D
gacagcguggugg

SEQ ID NO: 1567728 - RNA, 19 nt, Human adenovirus D
ccaggagccugaugagcuc

SEQ ID NO: 1567729 - RNA, 16 nt, Human adenovirus D
cuuguagggacagcag

SEQ ID NO: 1567730 - RNA, 23 nt, Human adenovirus D
ccagugcaacuuuagccagacca

SEQ ID NO: 1567731 - RNA, 14 nt, Human adenovirus D
ccgccggcucaagc

SEQ ID NO: 1567732 - RNA, 19 nt, Human adenovirus D
ccagcguaagcgcgcggcu

SEQ ID NO: 1567733 - RNA, 22 nt, Human adenovirus D
cgggccaugagggucuggagcu

SEQ ID NO: 1567734 - RNA, 14 nt, Human adenovirus D
cauaucccagggga

SEQ ID NO: 1567735 - RNA, 22 nt, Human adenovirus D
augaccuucgagguggacccca

SEQ ID NO: 1567736 - RNA, 18 nt, Human adenovirus D
cgccccgaggacacccgg

SEQ ID NO: 1567737 - RNA, 17 nt, Human adenovirus D
auacaaagcugaaagcu

SEQ ID NO: 1567738 - RNA, 19 nt, Human adenovirus D
agucugagggccacccuga

SEQ ID NO: 1567739 - RNA, 14 nt, Human adenovirus D
cggggaggagcccg

SEQ ID NO: 1567740 - RNA, 16 nt, Human adenovirus D
ggaaggcuacaacgug

SEQ ID NO: 1567741 - RNA, 20 nt, Human adenovirus D
gagggcgaagggcuggcgag

SEQ ID NO: 1567742 - RNA, 17 nt, Human adenovirus D
agggcgaccagcucugg

SEQ ID NO: 1567743 - RNA, 23 nt, Human adenovirus D
accugccuccaccacccacgccc

SEQ ID NO: 1567744 - RNA, 20 nt, Human adenovirus D
cggucgcgguggggcgguga

SEQ ID NO: 1567745 - RNA, 16 nt, Human adenovirus D
uacccgaccaugcaga

SEQ ID NO: 1567746 - RNA, 14 nt, Human adenovirus D
cgaugggcccgugg

SEQ ID NO: 1567747 - RNA, 20 nt, Human adenovirus D
cacaggugcugcccacccuc

SEQ ID NO: 1567748 - RNA, 16 nt, Human adenovirus D
cagcgaaagagagcuc

SEQ ID NO: 1567749 - RNA, 17 nt, Human adenovirus D
uccagcgaaagagagcu

SEQ ID NO: 1567750 - RNA, 19 nt, Human adenovirus D
aggagcugaucucgcugcc

SEQ ID NO: 1567751 - RNA, 14 nt, Human adenovirus D
cuccgcgaacagca

SEQ ID NO: 1567752 - RNA, 19 nt, Human adenovirus D
cagagagauggcucucacu

SEQ ID NO: 1567753 - RNA, 19 nt, Human adenovirus D
cggcgggccaugcgcaggc

SEQ ID NO: 1567754 - RNA, 19 nt, Human adenovirus D
caccugcagcgccaguccc

SEQ ID NO: 1567755 - RNA, 18 nt, Human adenovirus D
gagcucgaaugcaugcga

SEQ ID NO: 1567756 - RNA, 12 nt, Human adenovirus D
ucgcugcugccg

SEQ ID NO: 1567757 - RNA, 17 nt, Human adenovirus D
caggugcugccccaggc

SEQ ID NO: 1567758 - RNA, 21 nt, Human adenovirus D
cccagccagcaaacgccgccg

SEQ ID NO: 1567759 - RNA, 15 nt, Human adenovirus D
agcgcguaggccgcu

SEQ ID NO: 1567760 - RNA, 15 nt, Human adenovirus D
guuacuguaaagcca

SEQ ID NO: 1567761 - RNA, 20 nt, Human adenovirus D
cuagagugaggcacugcucu

SEQ ID NO: 1567762 - RNA, 18 nt, Human adenovirus D
uggacccgcggccgccca

SEQ ID NO: 1567763 - RNA, 21 nt, Human adenovirus D
uggcgagaggcgagcagcugu

SEQ ID NO: 1567764 - RNA, 23 nt, Human adenovirus D
ggccuacgagcucaaccucuucu

SEQ ID NO: 1567765 - RNA, 21 nt, Human adenovirus D
gacagcgacgagacuggccuc

SEQ ID NO: 1567766 - RNA, 22 nt, Human adenovirus D
ggcggaccugcauuggcagccg

SEQ ID NO: 1567767 - RNA, 21 nt, Human adenovirus D
ugcagaccgcgggccuccucg

SEQ ID NO: 1567768 - RNA, 13 nt, Human adenovirus D
cgcggacggccgc

SEQ ID NO: 1567769 - RNA, 22 nt, Human adenovirus D
agggaugaguugggccugaugc

SEQ ID NO: 1567770 - RNA, 17 nt, Human adenovirus D
ucguagaggcgggugag

SEQ ID NO: 1567771 - RNA, 15 nt, Human adenovirus D
augggacagccagca

SEQ ID NO: 1567772 - RNA, 12 nt, Human adenovirus D
cgagcacagcac

SEQ ID NO: 1567773 - RNA, 18 nt, Human adenovirus D
gacgagaccagaggcaga

SEQ ID NO: 1567774 - RNA, 14 nt, Human adenovirus D
gaggcgggugaggg

SEQ ID NO: 1567775 - RNA, 18 nt, Human adenovirus D
caccugggcacuggagca

SEQ ID NO: 1567776 - RNA, 13 nt, Human adenovirus D
cacugccgccgcc

SEQ ID NO: 1567777 - RNA, 14 nt, Human adenovirus D
gccggcggcgagga

SEQ ID NO: 1567778 - RNA, 22 nt, Human adenovirus D
ugcugcuacaucucggggaacg

SEQ ID NO: 1567779 - RNA, 23 nt, Human adenovirus D
cuccccuuacuuucgcucccacc

SEQ ID NO: 1567780 - RNA, 18 nt, Human adenovirus D
uguacaacgcccugcugg

SEQ ID NO: 1567781 - RNA, 18 nt, Human adenovirus D
gucugcaggccgggcugc

SEQ ID NO: 1567782 - RNA, 13 nt, Human adenovirus D
cgcggcgacagcg

SEQ ID NO: 1567783 - RNA, 16 nt, Human adenovirus D
gguugagcgggcucuu

SEQ ID NO: 1567784 - RNA, 13 nt, Human adenovirus D
gccgcagcucuuc

SEQ ID NO: 1567785 - RNA, 13 nt, Human adenovirus D
cacacagcucaac

SEQ ID NO: 1567786 - RNA, 22 nt, Human adenovirus D
ccccgcgggcaggggcggcaga

SEQ ID NO: 1567787 - RNA, 14 nt, Human adenovirus D
ccucggucagcugg

SEQ ID NO: 1567788 - RNA, 15 nt, Human adenovirus D
cacgguggugcagaa

SEQ ID NO: 1567789 - RNA, 14 nt, Human adenovirus D
gggcaggggcggca

SEQ ID NO: 1567790 - RNA, 14 nt, Human adenovirus D
cgcuggccagcacg

SEQ ID NO: 1567791 - RNA, 15 nt, Human adenovirus D
gacaacgccaggcug

SEQ ID NO: 1567792 - RNA, 16 nt, Human adenovirus D
caccaacgaccagucc

SEQ ID NO: 1567793 - RNA, 15 nt, Human adenovirus D
aaccugcgcgggcug

SEQ ID NO: 1567794 - RNA, 17 nt, Human adenovirus D
caaaagugcuggagggu

SEQ ID NO: 1567795 - RNA, 16 nt, Human adenovirus D
cuuggcgauggaucuc

SEQ ID NO: 1567796 - RNA, 15 nt, Human adenovirus D
agggaacugaaagaa

SEQ ID NO: 1567797 - RNA, 22 nt, Human adenovirus D
guuccagauguugcgcagcggc

SEQ ID NO: 1567798 - RNA, 21 nt, Human adenovirus D
gcaagauuuacaagacgccgu

SEQ ID NO: 1567799 - RNA, 16 nt, Human adenovirus D
cgaggcguucagggag

SEQ ID NO: 1567800 - RNA, 15 nt, Human adenovirus D
gucccuuuuccagga

SEQ ID NO: 1567801 - RNA, 17 nt, Human adenovirus D
agcauacaugcccucuc

SEQ ID NO: 1567802 - RNA, 14 nt, Human adenovirus D
acgcccugcuggag

SEQ ID NO: 1567803 - RNA, 16 nt, Human adenovirus D
cuuugcggcaguuucg

SEQ ID NO: 1567804 - RNA, 12 nt, Human adenovirus D
caggaccugggc

SEQ ID NO: 1567805 - RNA, 15 nt, Human adenovirus D
cccuugaccugccuc

SEQ ID NO: 1567806 - RNA, 12 nt, Human adenovirus D
gacagccagcag

SEQ ID NO: 1567807 - RNA, 16 nt, Human adenovirus D
gccucccaggaggcga

SEQ ID NO: 1567808 - RNA, 17 nt, Human adenovirus D
cggucugcaggccgggc

SEQ ID NO: 1567809 - RNA, 17 nt, Human adenovirus D
acacgguucucucagca

SEQ ID NO: 1567810 - RNA, 19 nt, Human adenovirus D
aggcaccaucacaggaggc

SEQ ID NO: 1567811 - RNA, 21 nt, Human adenovirus D
gccguccuuucgcugcugccg

SEQ ID NO: 1567812 - RNA, 17 nt, Human adenovirus D
uacaaggacuacaaggc

SEQ ID NO: 1567813 - RNA, 15 nt, Human adenovirus D
cuucgagcaguggcu

SEQ ID NO: 1567814 - RNA, 16 nt, Human adenovirus D
cuuaguucagcugcaa

SEQ ID NO: 1567815 - RNA, 13 nt, Human adenovirus D
uucacgcccggcg

SEQ ID NO: 1567816 - RNA, 14 nt, Human adenovirus D
uacacucgcagugc

SEQ ID NO: 1567817 - RNA, 14 nt, Human adenovirus D
ggggaggagcccga

SEQ ID NO: 1567818 - RNA, 14 nt, Human adenovirus D
auggcgaugggccc

SEQ ID NO: 1567819 - RNA, 18 nt, Human adenovirus D
agagucugaaaaacagaa

SEQ ID NO: 1567820 - RNA, 15 nt, Human adenovirus D
agccagaccaagcug

SEQ ID NO: 1567821 - RNA, 18 nt, Human adenovirus D
ggcccaaugcaacaugac

SEQ ID NO: 1567822 - RNA, 17 nt, Human adenovirus D
gcggaguccagcgagug

SEQ ID NO: 1567823 - RNA, 19 nt, Human adenovirus D
ccugaugaacaacgccauc

SEQ ID NO: 1567824 - RNA, 22 nt, Human adenovirus D
ccacccuugaccugccuccacc

SEQ ID NO: 1567825 - RNA, 19 nt, Human adenovirus D
accccuggcucccagccuc

SEQ ID NO: 1567826 - RNA, 19 nt, Human adenovirus D
uuuagguguugcaugaugg

SEQ ID NO: 1567827 - RNA, 24 nt, Human adenovirus D
ucgcacucgacgagccaggugagc

SEQ ID NO: 1567828 - RNA, 18 nt, Human adenovirus D
ggacgacugggaggcugc

SEQ ID NO: 1567829 - RNA, 15 nt, Human adenovirus D
aaccggaggcuggcu

SEQ ID NO: 1567830 - RNA, 20 nt, Human adenovirus D
ccuggugguacagcacagca

SEQ ID NO: 1567831 - RNA, 20 nt, Human adenovirus D
gugcaguuggccaugagcga

SEQ ID NO: 1567832 - RNA, 13 nt, Human adenovirus D
uggcaagcugcca

SEQ ID NO: 1567833 - RNA, 13 nt, Human adenovirus D
cugaaaaacagaa

SEQ ID NO: 1567834 - RNA, 17 nt, Human adenovirus D
agaaccggaggcuggcu

SEQ ID NO: 1567835 - RNA, 19 nt, Human adenovirus D
uggcaagagucugaagccu

SEQ ID NO: 1567836 - RNA, 15 nt, Human adenovirus D
cgcgacccccaggcc

SEQ ID NO: 1567837 - RNA, 17 nt, Human adenovirus D
cgugcgcgugcccgugc

SEQ ID NO: 1567838 - RNA, 13 nt, Human adenovirus D
accggaggcuggc

SEQ ID NO: 1567839 - RNA, 17 nt, Human adenovirus D
accaaguccaggguagc

SEQ ID NO: 1567840 - RNA, 20 nt, Human adenovirus D
acaacuacacagucaacugu

SEQ ID NO: 1567841 - RNA, 18 nt, Human adenovirus D
gcgggaucaucgccugcu

SEQ ID NO: 1567842 - RNA, 20 nt, Human adenovirus D
agcccgugaccugcagcagg

SEQ ID NO: 1567843 - RNA, 15 nt, Human adenovirus D
ccgccgccugcgcug

SEQ ID NO: 1567844 - RNA, 18 nt, Human adenovirus D
ucacccggacguggugcu

SEQ ID NO: 1567845 - RNA, 15 nt, Human adenovirus D
gcgagaaggcgcgcg

SEQ ID NO: 1567846 - RNA, 16 nt, Human adenovirus D
cuacuuuuugggcacc

SEQ ID NO: 1567847 - RNA, 22 nt, Human adenovirus D
gaaucucggccaccagucccuu

SEQ ID NO: 1567848 - RNA, 18 nt, Human adenovirus D
auccaguuaaugcugccu

SEQ ID NO: 1567849 - RNA, 15 nt, Human adenovirus D
cuagcgcccugguag

SEQ ID NO: 1567850 - RNA, 15 nt, Human adenovirus D
cuccucguagagaaa

SEQ ID NO: 1567851 - RNA, 18 nt, Human adenovirus D
cagcgucaaccucuacgc

SEQ ID NO: 1567852 - RNA, 17 nt, Human adenovirus D
cuggagacacugguuug

SEQ ID NO: 1567853 - RNA, 17 nt, Human adenovirus D
ugcuugagaugcagaug

SEQ ID NO: 1567854 - RNA, 20 nt, Human adenovirus D
cgaccgcauccacaaggccg

SEQ ID NO: 1567855 - RNA, 23 nt, Human adenovirus D
uggucaucaccuuccugcagcuc

SEQ ID NO: 1567856 - RNA, 17 nt, Human adenovirus D
uggcucccagccuccac

SEQ ID NO: 1567857 - RNA, 19 nt, Human adenovirus D
auggagcuuaucuugguua

SEQ ID NO: 1567858 - RNA, 15 nt, Human adenovirus D
ccgcgucgcugucca

SEQ ID NO: 1567859 - RNA, 16 nt, Human adenovirus D
cugcacgaccucggag

SEQ ID NO: 1567860 - RNA, 13 nt, Human adenovirus D
aaacaggcaaaga

SEQ ID NO: 1567861 - RNA, 21 nt, Human adenovirus D
gcuucgaguacgaggccaugc

SEQ ID NO: 1567862 - RNA, 14 nt, Human adenovirus D
cgcucguucugccc

SEQ ID NO: 1567863 - RNA, 21 nt, Human adenovirus D
ggcggacugccaccgccgccg

SEQ ID NO: 1567864 - RNA, 22 nt, Human adenovirus D
aacugcuggcccugcuggccga

SEQ ID NO: 1567865 - RNA, 22 nt, Human adenovirus D
ccaguagacaaagagcacagca

SEQ ID NO: 1567866 - RNA, 17 nt, Human adenovirus D
ccgcggccguagcaggc

SEQ ID NO: 1567867 - RNA, 15 nt, Human adenovirus D
cagggaggcgcugcu

SEQ ID NO: 1567868 - RNA, 17 nt, Human adenovirus D
ggccgagaccgugagcu

SEQ ID NO: 1567869 - RNA, 22 nt, Human adenovirus D
agcucgucuuccaggagccuga

SEQ ID NO: 1567870 - RNA, 11 nt, Human adenovirus D
accgccacccg

SEQ ID NO: 1567871 - RNA, 21 nt, Human adenovirus D
ggagccaggggaugaacagug

SEQ ID NO: 1567872 - RNA, 13 nt, Human adenovirus D
gaggccaugcugc

SEQ ID NO: 1567873 - RNA, 14 nt, Human adenovirus D
gcacccaccacagu

SEQ ID NO: 1567874 - RNA, 16 nt, Human adenovirus D
aagaauccacagauca

SEQ ID NO: 1567875 - RNA, 14 nt, Human adenovirus D
accagaaagacuaa

SEQ ID NO: 1567876 - RNA, 15 nt, Human adenovirus D
ggcuccucucgugcu

SEQ ID NO: 1567877 - RNA, 14 nt, Human adenovirus D
ggaagauggaggag

SEQ ID NO: 1567878 - RNA, 17 nt, Human adenovirus D
ggcguucagggaggcgc

SEQ ID NO: 1567879 - RNA, 19 nt, Human adenovirus D
auguccaccugcggggcga

SEQ ID NO: 1567880 - RNA, 23 nt, Human adenovirus D
caaauuguugguguaaauccacu

SEQ ID NO: 1567881 - RNA, 19 nt, Human adenovirus D
cuccugccgcgccaaccgc

SEQ ID NO: 1567882 - RNA, 11 nt, Human adenovirus D
acgcuggccag

SEQ ID NO: 1567883 - RNA, 16 nt, Human adenovirus D
cauuucagaaccauga

SEQ ID NO: 1567884 - RNA, 22 nt, Human adenovirus D
gaccugcgcgucgacggcgccu

SEQ ID NO: 1567885 - RNA, 19 nt, Human adenovirus D
gccucaaugucagcugcaa

SEQ ID NO: 1567886 - RNA, 17 nt, Human adenovirus D
gcgcucgcgcaccugcu

SEQ ID NO: 1567887 - RNA, 15 nt, Human adenovirus D
agaaggugcuggcga

SEQ ID NO: 1567888 - RNA, 19 nt, Human adenovirus D
gucacauccaucuccacca

SEQ ID NO: 1567889 - RNA, 21 nt, Human adenovirus D
ccacugcauggccucgugcuc

SEQ ID NO: 1567890 - RNA, 20 nt, Human adenovirus D
acgcugagcgacgaccuggg

SEQ ID NO: 1567891 - RNA, 16 nt, Human adenovirus D
cggccaaccuggugac

SEQ ID NO: 1567892 - RNA, 17 nt, Human adenovirus D
cugacgagcccgcgcgg

SEQ ID NO: 1567893 - RNA, 21 nt, Human adenovirus D
ucugauuagcauagucacacu

SEQ ID NO: 1567894 - RNA, 14 nt, Human adenovirus D
ugaauggcacuggc

SEQ ID NO: 1567895 - RNA, 20 nt, Human adenovirus D
acacgcuguaccgcagcugg

SEQ ID NO: 1567896 - RNA, 18 nt, Human adenovirus D
cuucagccugggcaacaa

SEQ ID NO: 1567897 - RNA, 18 nt, Human adenovirus D
cuuuuuagcccuuauuug

SEQ ID NO: 1567898 - RNA, 20 nt, Human adenovirus D
agguaauucucauuuuucca

SEQ ID NO: 1567899 - RNA, 18 nt, Human adenovirus D
gcccagaacuggcagagc

SEQ ID NO: 1567900 - RNA, 15 nt, Human adenovirus D
acaaguuuaggaacc

SEQ ID NO: 1567901 - RNA, 15 nt, Human adenovirus D
uguugcauccuucca

SEQ ID NO: 1567902 - RNA, 20 nt, Human adenovirus D
uccaucagcgcccucagcag

SEQ ID NO: 1567903 - RNA, 23 nt, Human adenovirus D
ugcgccgcgcuggggagggccac

SEQ ID NO: 1567904 - RNA, 17 nt, Human adenovirus D
aaaccacauuugaagau

SEQ ID NO: 1567905 - RNA, 14 nt, Human adenovirus D
cacaaucacggcau

SEQ ID NO: 1567906 - RNA, 16 nt, Human adenovirus D
uccgcggccacuuccg

SEQ ID NO: 1567907 - RNA, 20 nt, Human adenovirus D
acagcucgcgguugagggcg

SEQ ID NO: 1567908 - RNA, 18 nt, Human adenovirus D
gccugaugcaccuguggg

SEQ ID NO: 1567909 - RNA, 20 nt, Human adenovirus D
gucgcuugacagcaccgccg

SEQ ID NO: 1567910 - RNA, 17 nt, Human adenovirus D
ccaucuaaacuaaagcc

SEQ ID NO: 1567911 - RNA, 16 nt, Human adenovirus D
cuacagccagcagcuc

SEQ ID NO: 1567912 - RNA, 14 nt, Human adenovirus D
cgagaccagaggca

SEQ ID NO: 1567913 - RNA, 21 nt, Human adenovirus D
guaagcacgagcggcagggcu

SEQ ID NO: 1567914 - RNA, 19 nt, Human adenovirus D
gacuaccugcaucgcgcgg

SEQ ID NO: 1567915 - RNA, 22 nt, Human adenovirus D
cugaagcccgugaccugcagca

SEQ ID NO: 1567916 - RNA, 23 nt, Human adenovirus D
gucgccacggucaccgagccucc

SEQ ID NO: 1567917 - RNA, 15 nt, Human adenovirus D
ugccgcgcgggcagg

SEQ ID NO: 1567918 - RNA, 20 nt, Human adenovirus D
cugcaacccccagcuccuga

SEQ ID NO: 1567919 - RNA, 11 nt, Human adenovirus D
caaauuacuuu

SEQ ID NO: 1567920 - RNA, 15 nt, Human adenovirus D
acucaccaaggccau

SEQ ID NO: 1567921 - RNA, 16 nt, Human adenovirus D
gcuaccuugcacccac

SEQ ID NO: 1567922 - RNA, 20 nt, Human adenovirus D
gcuguggagccacugcuacc

SEQ ID NO: 1567923 - RNA, 15 nt, Human adenovirus D
cugccggugcacucc

SEQ ID NO: 1567924 - RNA, 20 nt, Human adenovirus D
gcugauuacucuaaaugcaa

SEQ ID NO: 1567925 - RNA, 22 nt, Human adenovirus D
auggccuguaccgggaccgagu

SEQ ID NO: 1567926 - RNA, 15 nt, Human adenovirus D
cgcucccaccgcgcc

SEQ ID NO: 1567927 - RNA, 16 nt, Human adenovirus D
accgccgugcgccgcg

SEQ ID NO: 1567928 - RNA, 14 nt, Human adenovirus D
cuugcugggcgagg

SEQ ID NO: 1567929 - RNA, 12 nt, Human adenovirus D
uacucccgcccc

SEQ ID NO: 1567930 - RNA, 20 nt, Human adenovirus D
cagccuuggauuaucucuac

SEQ ID NO: 1567931 - RNA, 14 nt, Human adenovirus D
ugcugccccaggcg

SEQ ID NO: 1567932 - RNA, 20 nt, Human adenovirus D
ccucguuucggggguuggga

SEQ ID NO: 1567933 - RNA, 22 nt, Human adenovirus D
cacgccggcuuguagaggauag

SEQ ID NO: 1567934 - RNA, 13 nt, Human adenovirus D
augcugaucaagu

SEQ ID NO: 1567935 - RNA, 13 nt, Human adenovirus D
agucaggagcagc

SEQ ID NO: 1567936 - RNA, 13 nt, Human adenovirus D
gcgccacuggcca

SEQ ID NO: 1567937 - RNA, 14 nt, Human adenovirus D
cuggaugcggagcc

SEQ ID NO: 1567938 - RNA, 16 nt, Human adenovirus D
gacgaguuggugagcu

SEQ ID NO: 1567939 - RNA, 15 nt, Human adenovirus D
cgggcagggagcugc

SEQ ID NO: 1567940 - RNA, 17 nt, Human adenovirus D
gcgacagcgccacgacc

SEQ ID NO: 1567941 - RNA, 21 nt, Human adenovirus D
ccuccgcgguauauggcuccu

SEQ ID NO: 1567942 - RNA, 15 nt, Human adenovirus D
gguauauuauugaug

SEQ ID NO: 1567943 - RNA, 20 nt, Human adenovirus D
uggagguuuucccggacgag

SEQ ID NO: 1567944 - RNA, 15 nt, Human adenovirus D
cagacuggucaaaaa

SEQ ID NO: 1567945 - RNA, 22 nt, Human adenovirus D
ccgcuccaccgaaggcagcucc

SEQ ID NO: 1567946 - RNA, 14 nt, Human adenovirus D
agcgacgaccuggg

SEQ ID NO: 1567947 - RNA, 19 nt, Human adenovirus D
uccccucgaaucaggcugg

SEQ ID NO: 1567948 - RNA, 13 nt, Human adenovirus D
gccaaucagcagu

SEQ ID NO: 1567949 - RNA, 20 nt, Human adenovirus D
cuguugcauguucuugcaug

SEQ ID NO: 1567950 - RNA, 17 nt, Human adenovirus D
gugcugacgcugagcga

SEQ ID NO: 1567951 - RNA, 15 nt, Human adenovirus D
caccuuacacugacg

SEQ ID NO: 1567952 - RNA, 13 nt, Human adenovirus D
ugaugcaggaggg

SEQ ID NO: 1567953 - RNA, 15 nt, Human adenovirus D
ucgaggacggagagg

SEQ ID NO: 1567954 - RNA, 17 nt, Human adenovirus D
cuggaccggcuggugac

SEQ ID NO: 1567955 - RNA, 18 nt, Human adenovirus D
cggugguggagauggaag

SEQ ID NO: 1567956 - RNA, 13 nt, Human adenovirus D
caccgaaggcagc

SEQ ID NO: 1567957 - RNA, 16 nt, Human adenovirus D
uuaaagacccacagcc

SEQ ID NO: 1567958 - RNA, 14 nt, Human adenovirus D
agcaggagugcagg

SEQ ID NO: 1567959 - RNA, 20 nt, Human adenovirus D
cuucucgccgcgcgugcccc

SEQ ID NO: 1567960 - RNA, 19 nt, Human adenovirus D
gacaucgcuucccugaacu

SEQ ID NO: 1567961 - RNA, 22 nt, Human adenovirus D
cugcgccaaaugcgucccaccc

SEQ ID NO: 1567962 - RNA, 16 nt, Human adenovirus D
uaacaucaccacaggc

SEQ ID NO: 1567963 - RNA, 15 nt, Human adenovirus D
caugaccgcgcgcaa

SEQ ID NO: 1567964 - RNA, 23 nt, Human adenovirus D
ugcgguggauuuuuuccaagacc

SEQ ID NO: 1567965 - RNA, 18 nt, Human adenovirus D
cugggcacuggagcacag

SEQ ID NO: 1567966 - RNA, 18 nt, Human adenovirus D
cccaguuucaaacccuac

SEQ ID NO: 1567967 - RNA, 23 nt, Human adenovirus D
ugcgaaagccccgaguguaucua

SEQ ID NO: 1567968 - RNA, 15 nt, Human adenovirus D
cagacggugaagcag

SEQ ID NO: 1567969 - RNA, 23 nt, Human adenovirus D
acgguggacgggcgcccagugcu

SEQ ID NO: 1567970 - RNA, 16 nt, Human adenovirus D
gaaggcuuucacagcu

SEQ ID NO: 1567971 - RNA, 14 nt, Human adenovirus D
ugggaugcugcccg

SEQ ID NO: 1567972 - RNA, 18 nt, Human adenovirus D
ggagccugaugagcucgg

SEQ ID NO: 1567973 - RNA, 13 nt, Human adenovirus D
cgcccagccagca

SEQ ID NO: 1567974 - RNA, 20 nt, Human adenovirus D
accucgccgcgcaggggcuc

SEQ ID NO: 1567975 - RNA, 13 nt, Human adenovirus D
cgcccgcagcacg

SEQ ID NO: 1567976 - RNA, 19 nt, Human adenovirus D
guggcuagaaaacacccac

SEQ ID NO: 1567977 - RNA, 14 nt, Human adenovirus D
accacuggccccgu

SEQ ID NO: 1567978 - RNA, 17 nt, Human adenovirus D
aacgagggccugggcuc

SEQ ID NO: 1567979 - RNA, 15 nt, Human adenovirus D
cccguucucgcuggu

SEQ ID NO: 1567980 - RNA, 13 nt, Human adenovirus D
gcccugcuggagc

SEQ ID NO: 1567981 - RNA, 16 nt, Human adenovirus D
cuuuaucagccagaac

SEQ ID NO: 1567982 - RNA, 15 nt, Human adenovirus D
ggagcucuugcaggg

SEQ ID NO: 1567983 - RNA, 17 nt, Human adenovirus D
cgcuacgugcccuucca

SEQ ID NO: 1567984 - RNA, 13 nt, Human adenovirus D
agcagcaguagcc

SEQ ID NO: 1567985 - RNA, 16 nt, Human adenovirus D
acgcccugcuggagcg

SEQ ID NO: 1567986 - RNA, 20 nt, Human adenovirus D
gcgcagguggacgagcagac

SEQ ID NO: 1567987 - RNA, 16 nt, Human adenovirus D
cuccuccuccuggaga

SEQ ID NO: 1567988 - RNA, 22 nt, Human adenovirus D
uucccauugaauggcacuggca

SEQ ID NO: 1567989 - RNA, 19 nt, Human adenovirus D
caaacacaccugacacaaa

SEQ ID NO: 1567990 - RNA, 17 nt, Human adenovirus D
ggaugaugaccgagcug

SEQ ID NO: 1567991 - RNA, 13 nt, Human adenovirus D
acuuacuuugcaa

SEQ ID NO: 1567992 - RNA, 19 nt, Human adenovirus D
cccuacgucuacaaggccc

SEQ ID NO: 1567993 - RNA, 22 nt, Human adenovirus D
gcccucgaugaaagucaggagc

SEQ ID NO: 1567994 - RNA, 14 nt, Human adenovirus D
ucagcagucucugc

SEQ ID NO: 1567995 - RNA, 19 nt, Human adenovirus D
acgggcugcuucugccugg

SEQ ID NO: 1567996 - RNA, 15 nt, Human adenovirus D
cgggccuacgagcuc

SEQ ID NO: 1567997 - RNA, 17 nt, Human adenovirus D
ggcagccgcagccgcca

SEQ ID NO: 1567998 - RNA, 15 nt, Human adenovirus D
gagcgacacccccgc

SEQ ID NO: 1567999 - RNA, 23 nt, Human adenovirus D
gcccugagcucgcgccucaaugu

SEQ ID NO: 1568000 - RNA, 18 nt, Human adenovirus D
guacgagagcgugauggc

SEQ ID NO: 1568001 - RNA, 16 nt, Human adenovirus D
cucgucuuccaggagc

SEQ ID NO: 1568002 - RNA, 14 nt, Human adenovirus D
cuguuacuguaaag

SEQ ID NO: 1568003 - RNA, 23 nt, Human adenovirus D
acagccuucagcaucagucuccu

SEQ ID NO: 1568004 - RNA, 17 nt, Human adenovirus D
gucccgcugagcuaccg

SEQ ID NO: 1568005 - RNA, 17 nt, Human adenovirus D
cuaucgcuuccucgcgc

SEQ ID NO: 1568006 - RNA, 11 nt, Human adenovirus D
cagcagcaccu

SEQ ID NO: 1568007 - RNA, 16 nt, Human adenovirus D
cggcgcgcccggggcc

SEQ ID NO: 1568008 - RNA, 22 nt, Human adenovirus D
gaggaaucggaucuuccccacu

SEQ ID NO: 1568009 - RNA, 13 nt, Human adenovirus D
gauccugcugcuc

SEQ ID NO: 1568010 - RNA, 17 nt, Human adenovirus D
auggcggagcgagcugg

SEQ ID NO: 1568011 - RNA, 14 nt, Human adenovirus D
acagcagcgacuga

SEQ ID NO: 1568012 - RNA, 19 nt, Human adenovirus D
gcgcagguggacgagcaga

SEQ ID NO: 1568013 - RNA, 14 nt, Human adenovirus D
ggccggugagacgc

SEQ ID NO: 1568014 - RNA, 14 nt, Human adenovirus D
ccggccgcgagacc

SEQ ID NO: 1568015 - RNA, 14 nt, Human adenovirus D
caccaggaugcagc

SEQ ID NO: 1568016 - RNA, 17 nt, Human adenovirus D
caugcacaucgccgggc

SEQ ID NO: 1568017 - RNA, 12 nt, Human adenovirus D
ccucgcugaaaa

SEQ ID NO: 1568018 - RNA, 24 nt, Human adenovirus D
cggggcgggggugaugagcugcga

SEQ ID NO: 1568019 - RNA, 14 nt, Human adenovirus D
cgacuccucgguca

SEQ ID NO: 1568020 - RNA, 21 nt, Human adenovirus D
gaagcauaauauggugaaggg

SEQ ID NO: 1568021 - RNA, 15 nt, Human adenovirus D
ugcugcugcugcuga

SEQ ID NO: 1568022 - RNA, 18 nt, Human adenovirus D
caaucgggcaacagggga

SEQ ID NO: 1568023 - RNA, 17 nt, Human adenovirus D
aucucccaccaccagcc

SEQ ID NO: 1568024 - RNA, 16 nt, Human adenovirus D
acacggucacugucca

SEQ ID NO: 1568025 - RNA, 22 nt, Human adenovirus D
cccgcaugaacuggcucagugc

SEQ ID NO: 1568026 - RNA, 18 nt, Human adenovirus D
cagcuggccgcccugacc

SEQ ID NO: 1568027 - RNA, 15 nt, Human adenovirus D
ggcuucagagacaac

SEQ ID NO: 1568028 - RNA, 14 nt, Human adenovirus D
cgguugagcuggga

SEQ ID NO: 1568029 - RNA, 14 nt, Human adenovirus D
caccgcgaccgcgg

SEQ ID NO: 1568030 - RNA, 20 nt, Human adenovirus D
ccgacgccccugagcggcug

SEQ ID NO: 1568031 - RNA, 14 nt, Human adenovirus D
accgcauccugauc

SEQ ID NO: 1568032 - RNA, 16 nt, Human adenovirus D
aucacaucagccagga

SEQ ID NO: 1568033 - RNA, 15 nt, Human adenovirus D
gugcgcuggggcugc

SEQ ID NO: 1568034 - RNA, 12 nt, Human adenovirus D
cgugccugcucu

SEQ ID NO: 1568035 - RNA, 21 nt, Human adenovirus D
aggugagcucgggcugcucgg

SEQ ID NO: 1568036 - RNA, 18 nt, Human adenovirus D
gugcagaacccggacagc

SEQ ID NO: 1568037 - RNA, 22 nt, Human adenovirus D
caggguugagucgcggcagaac

SEQ ID NO: 1568038 - RNA, 16 nt, Human adenovirus D
cuuacugaaacucagu

SEQ ID NO: 1568039 - RNA, 15 nt, Human adenovirus D
cgcgcgggagccagg

SEQ ID NO: 1568040 - RNA, 16 nt, Human adenovirus D
ucuuggcgagggucug

SEQ ID NO: 1568041 - RNA, 14 nt, Human adenovirus D
uacgugcccuucca

SEQ ID NO: 1568042 - RNA, 16 nt, Human adenovirus D
cgcgcuccacgguggc

SEQ ID NO: 1568043 - RNA, 13 nt, Human adenovirus D
aucacccagggcg

SEQ ID NO: 1568044 - RNA, 19 nt, Human adenovirus D
gggucuaucuggaccccca

SEQ ID NO: 1568045 - RNA, 14 nt, Human adenovirus D
acgagggccugggc

SEQ ID NO: 1568046 - RNA, 14 nt, Human adenovirus D
gccgcgcaggggcu

SEQ ID NO: 1568047 - RNA, 15 nt, Human adenovirus D
agcugacggccaguc

SEQ ID NO: 1568048 - RNA, 16 nt, Human adenovirus D
ugccuccaccacccac

SEQ ID NO: 1568049 - RNA, 12 nt, Human adenovirus D
caggaugcagcc

SEQ ID NO: 1568050 - RNA, 12 nt, Human adenovirus D
cgcccugagagc

SEQ ID NO: 1568051 - RNA, 14 nt, Human adenovirus D
accgcgccgccauc

SEQ ID NO: 1568052 - RNA, 15 nt, Human adenovirus D
ccugcccuuccagca

SEQ ID NO: 1568053 - RNA, 19 nt, Human adenovirus D
cguacuucagccugggcaa

SEQ ID NO: 1568054 - RNA, 15 nt, Human adenovirus D
gagguugagcuccac

SEQ ID NO: 1568055 - RNA, 13 nt, Human adenovirus D
cuugcacaguugg

SEQ ID NO: 1568056 - RNA, 15 nt, Human adenovirus D
gaguacucauaaaga

SEQ ID NO: 1568057 - RNA, 17 nt, Human adenovirus D
cuggugaagggcacagc

SEQ ID NO: 1568058 - RNA, 14 nt, Human adenovirus D
gggcacagccucuc

SEQ ID NO: 1568059 - RNA, 16 nt, Human adenovirus D
cuaaauuuaagccagu

SEQ ID NO: 1568060 - RNA, 14 nt, Human adenovirus D
acccacgacacagc

SEQ ID NO: 1568061 - RNA, 22 nt, Human adenovirus D
aggcagacgcugaaaggcgggc

SEQ ID NO: 1568062 - RNA, 19 nt, Human adenovirus D
cacccggacguggugcugc

SEQ ID NO: 1568063 - RNA, 19 nt, Human adenovirus D
cacugcagggagccagggg

SEQ ID NO: 1568064 - RNA, 16 nt, Human adenovirus D
caggcgacccuggagg

SEQ ID NO: 1568065 - RNA, 17 nt, Human adenovirus D
cagcagucucugccgcc

SEQ ID NO: 1568066 - RNA, 19 nt, Human adenovirus D
cagaggauggucaucaccc

SEQ ID NO: 1568067 - RNA, 22 nt, Human adenovirus D
gcgcucgaaauccccgggggcc

SEQ ID NO: 1568068 - RNA, 18 nt, Human adenovirus D
gcaugccuucgugcacug

SEQ ID NO: 1568069 - RNA, 21 nt, Human adenovirus D
caaggccauaaaucugcccug

SEQ ID NO: 1568070 - RNA, 18 nt, Human adenovirus D
ggcaggccauggacgaga

SEQ ID NO: 1568071 - RNA, 14 nt, Human adenovirus D
cuaauuacagucac

SEQ ID NO: 1568072 - RNA, 18 nt, Human adenovirus D
guguacuugguggacaac

SEQ ID NO: 1568073 - RNA, 16 nt, Human adenovirus D
uuguagugucagaugg

SEQ ID NO: 1568074 - RNA, 19 nt, Human adenovirus D
gcuugcaagggugcgcuug

SEQ ID NO: 1568075 - RNA, 23 nt, Human adenovirus D
gcgcguggaggaagugcuggaca

SEQ ID NO: 1568076 - RNA, 18 nt, Human adenovirus D
gcagaacuacacggucac

SEQ ID NO: 1568077 - RNA, 13 nt, Human adenovirus D
ggcugcuggaugg

SEQ ID NO: 1568078 - RNA, 11 nt, Human adenovirus D
gggcuucaccg

SEQ ID NO: 1568079 - RNA, 19 nt, Human adenovirus D
acgagcucgccgaggaggc

SEQ ID NO: 1568080 - RNA, 13 nt, Human adenovirus D
ucuacucccagcu

SEQ ID NO: 1568081 - RNA, 13 nt, Human adenovirus D
cuaggcgcagcug

SEQ ID NO: 1568082 - RNA, 12 nt, Human adenovirus D
acgggccgccgg

SEQ ID NO: 1568083 - RNA, 19 nt, Human adenovirus D
gcagagucugccgcccuug

SEQ ID NO: 1568084 - RNA, 23 nt, Human adenovirus D
gauccucgcccaauugcacgcca

SEQ ID NO: 1568085 - RNA, 15 nt, Human adenovirus D
ugcgucugcagcauu

SEQ ID NO: 1568086 - RNA, 12 nt, Human adenovirus D
cgucaggcaggc

SEQ ID NO: 1568087 - RNA, 16 nt, Human adenovirus D
cauaaagauggaugga

SEQ ID NO: 1568088 - RNA, 21 nt, Human adenovirus D
agggaaaagcucaaagaccag

SEQ ID NO: 1568089 - RNA, 15 nt, Human adenovirus D
ccccaaacgccagcc

SEQ ID NO: 1568090 - RNA, 14 nt, Human adenovirus D
gcccugcgcccaga

SEQ ID NO: 1568091 - RNA, 19 nt, Human adenovirus D
agggcagcccuaccccgcc

SEQ ID NO: 1568092 - RNA, 18 nt, Human adenovirus D
agcaagggcgaccagcuc

SEQ ID NO: 1568093 - RNA, 23 nt, Human adenovirus D
gaagacgaaugggaagaagagac

SEQ ID NO: 1568094 - RNA, 16 nt, Human adenovirus D
ccucuacgccaccuuc

SEQ ID NO: 1568095 - RNA, 22 nt, Human adenovirus D
cagcaagccucugacggcgcag

SEQ ID NO: 1568096 - RNA, 15 nt, Human adenovirus D
agcaggaccugggcu

SEQ ID NO: 1568097 - RNA, 18 nt, Human adenovirus D
guguaguuguucagcagc

SEQ ID NO: 1568098 - RNA, 17 nt, Human adenovirus D
uacacagcuagacacca

SEQ ID NO: 1568099 - RNA, 15 nt, Human adenovirus D
cgggucucccccagc

SEQ ID NO: 1568100 - RNA, 13 nt, Human adenovirus D
cgcggcugcugcu

SEQ ID NO: 1568101 - RNA, 22 nt, Human adenovirus D
gcggaggccaucgugcagaacc

SEQ ID NO: 1568102 - RNA, 13 nt, Human adenovirus D
ccaugacagcgac

SEQ ID NO: 1568103 - RNA, 22 nt, Human adenovirus D
gaguuccugauggaugugugga

SEQ ID NO: 1568104 - RNA, 14 nt, Human adenovirus D
cgccgccaggccca

SEQ ID NO: 1568105 - RNA, 18 nt, Human adenovirus D
cuccgggacgcccuggcc

SEQ ID NO: 1568106 - RNA, 14 nt, Human adenovirus D
ugacgcaugcaagg

SEQ ID NO: 1568107 - RNA, 14 nt, Human adenovirus D
cagccgcggcagcc

SEQ ID NO: 1568108 - RNA, 20 nt, Human adenovirus D
cgcagcuacaccucccucac

SEQ ID NO: 1568109 - RNA, 21 nt, Human adenovirus D
aggacucgcagacgagcggcc

SEQ ID NO: 1568110 - RNA, 20 nt, Human adenovirus D
ggcuacgcgcggaaucagaa

SEQ ID NO: 1568111 - RNA, 20 nt, Human adenovirus D
cuacaaggccgucacccugc

SEQ ID NO: 1568112 - RNA, 15 nt, Human adenovirus D
ugaacgccuuccugg

SEQ ID NO: 1568113 - RNA, 17 nt, Human adenovirus D
cuccgcgaacagcagca

SEQ ID NO: 1568114 - RNA, 22 nt, Human adenovirus D
guuacuguaaagccacaaccag

SEQ ID NO: 1568115 - RNA, 16 nt, Human adenovirus D
cuggcgacgcagccgg

SEQ ID NO: 1568116 - RNA, 19 nt, Human adenovirus D
aggaaacuaggcgcagcug

SEQ ID NO: 1568117 - RNA, 23 nt, Human adenovirus D
cggggcucggugcggcugcugca

SEQ ID NO: 1568118 - RNA, 13 nt, Human adenovirus D
uguccaaccccga

SEQ ID NO: 1568119 - RNA, 21 nt, Human adenovirus D
gaccuucaaccucaccaacca

SEQ ID NO: 1568120 - RNA, 17 nt, Human adenovirus D
gccucaaugucagcugc

SEQ ID NO: 1568121 - RNA, 13 nt, Human adenovirus D
aauccuccaggac

SEQ ID NO: 1568122 - RNA, 20 nt, Human adenovirus D
gucugcuccugcacuuucuu

SEQ ID NO: 1568123 - RNA, 17 nt, Human adenovirus D
cgagaggcgagcagcug

SEQ ID NO: 1568124 - RNA, 16 nt, Human adenovirus D
cgagccaggugagcuc

SEQ ID NO: 1568125 - RNA, 17 nt, Human adenovirus D
ccgcucaucggccagac

SEQ ID NO: 1568126 - RNA, 16 nt, Human adenovirus D
ugcagcaggugcugcc

SEQ ID NO: 1568127 - RNA, 20 nt, Human adenovirus D
agaaccauuuuuauuccaaa

SEQ ID NO: 1568128 - RNA, 17 nt, Human adenovirus D
ggcaucuuccuggggca

SEQ ID NO: 1568129 - RNA, 16 nt, Human adenovirus D
ccacaggugcugccca

SEQ ID NO: 1568130 - RNA, 23 nt, Human adenovirus D
gcggggggagaugaugugcaguu

SEQ ID NO: 1568131 - RNA, 20 nt, Human adenovirus D
ugccacucgcgggcggccau

SEQ ID NO: 1568132 - RNA, 17 nt, Human adenovirus D
cccugagccgccagcug

SEQ ID NO: 1568133 - RNA, 20 nt, Human adenovirus D
cgacacguacuucagccugg

SEQ ID NO: 1568134 - RNA, 18 nt, Human adenovirus D
aggccgccuacgguccag

SEQ ID NO: 1568135 - RNA, 15 nt, Human adenovirus D
cgacgagccagguga

SEQ ID NO: 1568136 - RNA, 15 nt, Human adenovirus D
gggugacagaaccag

SEQ ID NO: 1568137 - RNA, 22 nt, Human adenovirus D
aucaagugccacaugcaccugg

SEQ ID NO: 1568138 - RNA, 16 nt, Human adenovirus D
cgcccggcguacgugc

SEQ ID NO: 1568139 - RNA, 13 nt, Human adenovirus D
cacgccaccgcuu

SEQ ID NO: 1568140 - RNA, 15 nt, Human adenovirus D
cccauuccuggagau

SEQ ID NO: 1568141 - RNA, 22 nt, Human adenovirus D
acggcgcagcuguuccuggugg

SEQ ID NO: 1568142 - RNA, 21 nt, Human adenovirus D
acgcgcgaagauggccacccc

SEQ ID NO: 1568143 - RNA, 21 nt, Human adenovirus D
gccucgagcuacaugcccagc

SEQ ID NO: 1568144 - RNA, 11 nt, Human adenovirus D
ccaccccaggc

SEQ ID NO: 1568145 - RNA, 17 nt, Human adenovirus D
gacagagauggacuugg

SEQ ID NO: 1568146 - RNA, 23 nt, Human adenovirus D
gcgcagcguugagcucacccacu

SEQ ID NO: 1568147 - RNA, 23 nt, Human adenovirus D
ugaugcaggauaaauauggccug

SEQ ID NO: 1568148 - RNA, 20 nt, Human adenovirus D
auuaugagcaucaaaaauua

SEQ ID NO: 1568149 - RNA, 13 nt, Human adenovirus D
uuaccgccagaga

SEQ ID NO: 1568150 - RNA, 14 nt, Human adenovirus D
gaaagucaggagca

SEQ ID NO: 1568151 - RNA, 15 nt, Human adenovirus D
gcgaggagguggccc

SEQ ID NO: 1568152 - RNA, 13 nt, Human adenovirus D
aacccaugaaaga

SEQ ID NO: 1568153 - RNA, 22 nt, Human adenovirus D
ccugguacgagcuacagcagga

SEQ ID NO: 1568154 - RNA, 22 nt, Human adenovirus D
gaagggcacagccucucugaag

SEQ ID NO: 1568155 - RNA, 21 nt, Human adenovirus D
caaaguaaaaaaccggucucu

SEQ ID NO: 1568156 - RNA, 17 nt, Human adenovirus D
uccacagaucagacaua

SEQ ID NO: 1568157 - RNA, 23 nt, Human adenovirus D
gagguaguugagggugguggcga

SEQ ID NO: 1568158 - RNA, 12 nt, Human adenovirus D
gcgagacccagg

SEQ ID NO: 1568159 - RNA, 22 nt, Human adenovirus D
guaggaaccagcacacucacuu

SEQ ID NO: 1568160 - RNA, 16 nt, Human adenovirus D
cucccacagcucgcgg

SEQ ID NO: 1568161 - RNA, 24 nt, Human adenovirus D
uggaagaccuacgcucaggaccau

SEQ ID NO: 1568162 - RNA, 12 nt, Human adenovirus D
ccuuccugcagc

SEQ ID NO: 1568163 - RNA, 15 nt, Human adenovirus D
ggcguacgugccugc

SEQ ID NO: 1568164 - RNA, 15 nt, Human adenovirus D
augagagucugaaaa

SEQ ID NO: 1568165 - RNA, 23 nt, Human adenovirus D
gcagacuuccucguuucgggggu

SEQ ID NO: 1568166 - RNA, 22 nt, Human adenovirus D
gacuaucuaugaaagcauacag

SEQ ID NO: 1568167 - RNA, 15 nt, Human adenovirus D
ggccaggaggagacc

SEQ ID NO: 1568168 - RNA, 23 nt, Human adenovirus D
aaaugaagccguccucugaaaag

SEQ ID NO: 1568169 - RNA, 13 nt, Human adenovirus D
ucgcgcaggccgc

SEQ ID NO: 1568170 - RNA, 14 nt, Human adenovirus D
cuacaaggccguca

SEQ ID NO: 1568171 - RNA, 15 nt, Human adenovirus D
gccuucgugcacugg

SEQ ID NO: 1568172 - RNA, 19 nt, Human adenovirus D
cuugugguuuuaacaggga

SEQ ID NO: 1568173 - RNA, 16 nt, Human adenovirus D
agcaucgaggugcaga

SEQ ID NO: 1568174 - RNA, 15 nt, Human adenovirus D
gccuuguaccugccc

SEQ ID NO: 1568175 - RNA, 21 nt, Human adenovirus D
augaaggggacgagcugcuug

SEQ ID NO: 1568176 - RNA, 22 nt, Human adenovirus D
acggagaggcugacgagcccgc

SEQ ID NO: 1568177 - RNA, 22 nt, Human adenovirus D
ugaagaacauccaugugaccuc

SEQ ID NO: 1568178 - RNA, 23 nt, Human adenovirus D
ccacugcuaccucuugcagcugg

SEQ ID NO: 1568179 - RNA, 18 nt, Human adenovirus D
ccuacgucuacaaggccc

SEQ ID NO: 1568180 - RNA, 17 nt, Human adenovirus D
gcgucauggcuggucag

SEQ ID NO: 1568181 - RNA, 13 nt, Human adenovirus D
auaaucaggcaga

SEQ ID NO: 1568182 - RNA, 18 nt, Human adenovirus D
caaggugcugacauccau

SEQ ID NO: 1568183 - RNA, 12 nt, Human adenovirus D
ccugggaggaga

SEQ ID NO: 1568184 - RNA, 16 nt, Human adenovirus D
acuagcgugagccgcg

SEQ ID NO: 1568185 - RNA, 17 nt, Human adenovirus D
gcuccaccgaaggcagc

SEQ ID NO: 1568186 - RNA, 21 nt, Human adenovirus D
uuuucugguugacaaauggag

SEQ ID NO: 1568187 - RNA, 16 nt, Human adenovirus D
guguugcggcccggca

SEQ ID NO: 1568188 - RNA, 21 nt, Human adenovirus D
cuggugguuuucauguucgcc

SEQ ID NO: 1568189 - RNA, 15 nt, Human adenovirus D
cgauccugacgcgcc

SEQ ID NO: 1568190 - RNA, 23 nt, Human adenovirus D
ccucaugaacacacugcccauau

SEQ ID NO: 1568191 - RNA, 13 nt, Human adenovirus D
ggccacggggagc

SEQ ID NO: 1568192 - RNA, 23 nt, Human adenovirus D
agcuagacaccacagugcagaau

SEQ ID NO: 1568193 - RNA, 13 nt, Human adenovirus D
ucacccuggggcu

SEQ ID NO: 1568194 - RNA, 18 nt, Human adenovirus D
ccgcgcgccgcgccgcca

SEQ ID NO: 1568195 - RNA, 18 nt, Human adenovirus D
acccgcggccgcccacgg

SEQ ID NO: 1568196 - RNA, 22 nt, Human adenovirus D
cccggacguggugcugcugccg

SEQ ID NO: 1568197 - RNA, 23 nt, Human adenovirus D
gaaugagagccggagugaugaau

SEQ ID NO: 1568198 - RNA, 19 nt, Human adenovirus D
caaguaggugaagaaaacu

SEQ ID NO: 1568199 - RNA, 14 nt, Human adenovirus D
cagcuccagugggg

SEQ ID NO: 1568200 - RNA, 13 nt, Human adenovirus D
ucgcuggucacau

SEQ ID NO: 1568201 - RNA, 19 nt, Human adenovirus D
cgccagacgcacgggccgc

SEQ ID NO: 1568202 - RNA, 13 nt, Human adenovirus D
uaagaaucacauu

SEQ ID NO: 1568203 - RNA, 22 nt, Human adenovirus D
cuacggcaucucgauccagcag

SEQ ID NO: 1568204 - RNA, 19 nt, Human adenovirus D
cgccgacgcgcuccucgcu

SEQ ID NO: 1568205 - RNA, 14 nt, Human adenovirus D
ugcagguggacgag

SEQ ID NO: 1568206 - RNA, 16 nt, Human adenovirus D
aggcgcccaggccgcu

SEQ ID NO: 1568207 - RNA, 21 nt, Human adenovirus D
cacuagcgugagccgcgcgcu

SEQ ID NO: 1568208 - RNA, 18 nt, Human adenovirus D
cacuuuugcccuuacaug

SEQ ID NO: 1568209 - RNA, 18 nt, Human adenovirus D
uccccgaggcccuugcca

SEQ ID NO: 1568210 - RNA, 18 nt, Human adenovirus D
uacgcguacauccagcau

SEQ ID NO: 1568211 - RNA, 13 nt, Human adenovirus D
ugaacucggggau

SEQ ID NO: 1568212 - RNA, 13 nt, Human adenovirus D
acagcaggagugc

SEQ ID NO: 1568213 - RNA, 21 nt, Human adenovirus D
cggccuuugaugugcggcagc

SEQ ID NO: 1568214 - RNA, 21 nt, Human adenovirus D
cuucuuccccauggcgcacaa

SEQ ID NO: 1568215 - RNA, 20 nt, Human adenovirus D
gcaagucacgcaggugacag

SEQ ID NO: 1568216 - RNA, 21 nt, Human adenovirus D
agguguuggcaaagcgguuga

SEQ ID NO: 1568217 - RNA, 20 nt, Human adenovirus D
uggagcaggguaaagccagc

SEQ ID NO: 1568218 - RNA, 12 nt, Human adenovirus D
ccauggggcgcc

SEQ ID NO: 1568219 - RNA, 22 nt, Human adenovirus D
caccaggccuacuacuccugau

SEQ ID NO: 1568220 - RNA, 22 nt, Human adenovirus D
uggacgcgguucauugacagcg

SEQ ID NO: 1568221 - RNA, 13 nt, Human adenovirus D
aagaaguggccag

SEQ ID NO: 1568222 - RNA, 15 nt, Human adenovirus D
uaaaauucaacugca

SEQ ID NO: 1568223 - RNA, 21 nt, Human adenovirus D
cccucaucacaucagccagga

SEQ ID NO: 1568224 - RNA, 14 nt, Human adenovirus D
aggcccuggagcag

SEQ ID NO: 1568225 - RNA, 14 nt, Human adenovirus D
uagacauggccagc

SEQ ID NO: 1568226 - RNA, 18 nt, Human adenovirus D
agcgggcucuuccuccgu

SEQ ID NO: 1568227 - RNA, 13 nt, Human adenovirus D
aggagcaggagga

SEQ ID NO: 1568228 - RNA, 17 nt, Human adenovirus D
gcgcgaagauggccacc

SEQ ID NO: 1568229 - RNA, 17 nt, Human adenovirus D
acaggcaaugagaggag

SEQ ID NO: 1568230 - RNA, 21 nt, Human adenovirus D
cccggcgcaguacgcgcuguc

SEQ ID NO: 1568231 - RNA, 12 nt, Human adenovirus D
cucggcaacgac

SEQ ID NO: 1568232 - RNA, 16 nt, Human adenovirus D
cccagugcuuccagca

SEQ ID NO: 1568233 - RNA, 23 nt, Human adenovirus D
ucacccggacguggugcugcugc

SEQ ID NO: 1568234 - RNA, 14 nt, Human adenovirus D
gucaacaugauccu

SEQ ID NO: 1568235 - RNA, 20 nt, Human adenovirus D
gaauuuguauggaauaaaga

SEQ ID NO: 1568236 - RNA, 17 nt, Human adenovirus D
ugcgacccaugagcugc

SEQ ID NO: 1568237 - RNA, 18 nt, Human adenovirus D
acccaaaaacugcaugcu

SEQ ID NO: 1568238 - RNA, 15 nt, Human adenovirus D
cccagugcuuccagc

SEQ ID NO: 1568239 - RNA, 12 nt, Human adenovirus D
aacacacugccc

SEQ ID NO: 1568240 - RNA, 16 nt, Human adenovirus D
accaaggaaacucccu

SEQ ID NO: 1568241 - RNA, 18 nt, Human adenovirus D
augugcaguuuggccugg

SEQ ID NO: 1568242 - RNA, 19 nt, Human adenovirus D
cacaugacccugcauggcu

SEQ ID NO: 1568243 - RNA, 23 nt, Human adenovirus D
uucacagcuaagaaaaaaucaga

SEQ ID NO: 1568244 - RNA, 23 nt, Human adenovirus D
gcagcccuaccccgccaacuucc

SEQ ID NO: 1568245 - RNA, 22 nt, Human adenovirus D
caccaguuggacgaguggcugu

SEQ ID NO: 1568246 - RNA, 24 nt, Human adenovirus D
cugccgcugcaaccugugcucucc

SEQ ID NO: 1568247 - RNA, 20 nt, Human adenovirus D
aagaucuccaacguggagcu

SEQ ID NO: 1568248 - RNA, 20 nt, Human adenovirus D
ccacuacucacacuacacag

SEQ ID NO: 1568249 - RNA, 20 nt, Human adenovirus D
cagucagacccaguggcgag

SEQ ID NO: 1568250 - RNA, 16 nt, Human adenovirus D
aagggcaucuucugcc

SEQ ID NO: 1568251 - RNA, 22 nt, Human adenovirus D
ccgcauccacaaggccgugagc

SEQ ID NO: 1568252 - RNA, 20 nt, Human adenovirus D
ggugcugccccaggcggugc

SEQ ID NO: 1568253 - RNA, 17 nt, Human adenovirus D
cacgcgcacacuuugga

SEQ ID NO: 1568254 - RNA, 18 nt, Human adenovirus D
ugaacugccuacaaccaa

SEQ ID NO: 1568255 - RNA, 13 nt, Human adenovirus D
uaaugaagaagca

SEQ ID NO: 1568256 - RNA, 18 nt, Human adenovirus D
gcgggccaugagggucug

SEQ ID NO: 1568257 - RNA, 15 nt, Human adenovirus D
acuugagcuggccuu

SEQ ID NO: 1568258 - RNA, 20 nt, Human adenovirus D
ggcggaacugcuggcccacg

SEQ ID NO: 1568259 - RNA, 15 nt, Human adenovirus D
aacaauaaaaaacuu

SEQ ID NO: 1568260 - RNA, 11 nt, Human adenovirus D
agucaggcagg

SEQ ID NO: 1568261 - RNA, 19 nt, Human adenovirus D
cuggucugcaacccccagc

SEQ ID NO: 1568262 - RNA, 15 nt, Human adenovirus D
cauccccgcgccgcg

SEQ ID NO: 1568263 - RNA, 14 nt, Human adenovirus D
ugaagggcacagcc

SEQ ID NO: 1568264 - RNA, 22 nt, Human adenovirus D
ggcugggcgcuugcaagggugc

SEQ ID NO: 1568265 - RNA, 16 nt, Human adenovirus D
auugcccaacaauaaa

SEQ ID NO: 1568266 - RNA, 18 nt, Human adenovirus D
ccgagcacucgugcugau

SEQ ID NO: 1568267 - RNA, 21 nt, Human adenovirus D
agcagguuucucaacagcugg

SEQ ID NO: 1568268 - RNA, 14 nt, Human adenovirus D
gggcuggcgagacu

SEQ ID NO: 1568269 - RNA, 16 nt, Human adenovirus D
ccagaugcucucccac

SEQ ID NO: 1568270 - RNA, 21 nt, Human adenovirus D
ccuucgugcacuggcccgacc

SEQ ID NO: 1568271 - RNA, 15 nt, Human adenovirus D
cuacgugcccuucca

SEQ ID NO: 1568272 - RNA, 20 nt, Human adenovirus D
caccggcuaccuugcaccca

SEQ ID NO: 1568273 - RNA, 13 nt, Human adenovirus D
cauugucugccug

SEQ ID NO: 1568274 - RNA, 13 nt, Human adenovirus D
aagugugguuuau

SEQ ID NO: 1568275 - RNA, 20 nt, Human adenovirus D
cauggccaacagccacauga

SEQ ID NO: 1568276 - RNA, 14 nt, Human adenovirus D
aggaggggggccac

SEQ ID NO: 1568277 - RNA, 20 nt, Human adenovirus D
cggggcauugcaggccgugc

SEQ ID NO: 1568278 - RNA, 14 nt, Human adenovirus D
cuuugucugcugua

SEQ ID NO: 1568279 - RNA, 13 nt, Human adenovirus D
ccgcgccgcagcc

SEQ ID NO: 1568280 - RNA, 19 nt, Human adenovirus D
uacggaccaccccaggcgg

SEQ ID NO: 1568281 - RNA, 17 nt, Human adenovirus D
guccacgagcgccagcu

SEQ ID NO: 1568282 - RNA, 15 nt, Human adenovirus D
acgagcggcagggcu

SEQ ID NO: 1568283 - RNA, 16 nt, Human adenovirus D
augcacucauccauga

SEQ ID NO: 1568284 - RNA, 20 nt, Human adenovirus D
gggaaccucagccacuccaa

SEQ ID NO: 1568285 - RNA, 20 nt, Human adenovirus D
agcgaucugggaugcugccc

SEQ ID NO: 1568286 - RNA, 16 nt, Human adenovirus D
ugugguagcuuacacc

SEQ ID NO: 1568287 - RNA, 14 nt, Human adenovirus D
cgcggcgaacgagc

SEQ ID NO: 1568288 - RNA, 16 nt, Human adenovirus D
cgagcuggaagcccug

SEQ ID NO: 1568289 - RNA, 16 nt, Human adenovirus D
gagccauugaccacca

SEQ ID NO: 1568290 - RNA, 18 nt, Human adenovirus D
ccugggaggagaggagga

SEQ ID NO: 1568291 - RNA, 23 nt, Human adenovirus D
guccgcuccgcagugggcgcaga

SEQ ID NO: 1568292 - RNA, 15 nt, Human adenovirus D
acgguggcggcgagg

SEQ ID NO: 1568293 - RNA, 15 nt, Human adenovirus D
uacuuugucugcugu

SEQ ID NO: 1568294 - RNA, 16 nt, Human adenovirus D
cgccgcgccagacgca

SEQ ID NO: 1568295 - RNA, 12 nt, Human adenovirus D
gggaggcgcugc

SEQ ID NO: 1568296 - RNA, 20 nt, Human adenovirus D
ccccaggcggugcugcugcc

SEQ ID NO: 1568297 - RNA, 17 nt, Human adenovirus D
ggccauucuggaggcgg

SEQ ID NO: 1568298 - RNA, 16 nt, Human adenovirus D
gccugccaggaugggc

SEQ ID NO: 1568299 - RNA, 21 nt, Human adenovirus D
cuggcgagacugggggcgccu

SEQ ID NO: 1568300 - RNA, 19 nt, Human adenovirus D
ggggcucguuaguccagca

SEQ ID NO: 1568301 - RNA, 13 nt, Human adenovirus D
agcgcccugguag

SEQ ID NO: 1568302 - RNA, 13 nt, Human adenovirus D
ccaggcagugcag

SEQ ID NO: 1568303 - RNA, 11 nt, Human adenovirus D
gguggccccga

SEQ ID NO: 1568304 - RNA, 23 nt, Human adenovirus D
uucacccggacguggugcugcug

SEQ ID NO: 1568305 - RNA, 18 nt, Human adenovirus D
uggccaguguuugagaau

SEQ ID NO: 1568306 - RNA, 21 nt, Human adenovirus D
cauucacauacacacuagaaa

SEQ ID NO: 1568307 - RNA, 22 nt, Human adenovirus D
agcucguaguugagggccucgg

SEQ ID NO: 1568308 - RNA, 16 nt, Human adenovirus D
gcuccaccgaaggcag

SEQ ID NO: 1568309 - RNA, 23 nt, Human adenovirus D
agcuuggcgacgaacucggcggu

SEQ ID NO: 1568310 - RNA, 12 nt, Human adenovirus D
ggugcuccagcc

SEQ ID NO: 1568311 - RNA, 18 nt, Human adenovirus D
gaugcuucaacagcugug

SEQ ID NO: 1568312 - RNA, 21 nt, Human adenovirus D
cccucagcgucgaggagcugu

SEQ ID NO: 1568313 - RNA, 18 nt, Human adenovirus D
uucucaucucgcccagca

SEQ ID NO: 1568314 - RNA, 23 nt, Human adenovirus D
ugcggaucaccguagagggcacc

SEQ ID NO: 1568315 - RNA, 21 nt, Human adenovirus D
gucggcgcgcuccuuggccgc

SEQ ID NO: 1568316 - RNA, 21 nt, Human adenovirus D
gcgagcagaacgggggcagca

SEQ ID NO: 1568317 - RNA, 23 nt, Human adenovirus D
aaauuguugguguaaauccacuc

SEQ ID NO: 1568318 - RNA, 15 nt, Human adenovirus D
gcucuucccuggaga

SEQ ID NO: 1568319 - RNA, 17 nt, Human adenovirus D
ccccuucaaccaccacc

SEQ ID NO: 1568320 - RNA, 12 nt, Human adenovirus D
ccugcucucaca

SEQ ID NO: 1568321 - RNA, 14 nt, Human adenovirus D
ugcagccaguggcc

SEQ ID NO: 1568322 - RNA, 16 nt, Human adenovirus D
guaucuuuauugauuu

SEQ ID NO: 1568323 - RNA, 13 nt, Human adenovirus D
cccaacggcaugc

SEQ ID NO: 1568324 - RNA, 12 nt, Human adenovirus D
gccaggaggcgg

SEQ ID NO: 1568325 - RNA, 12 nt, Human adenovirus D
ccaucauguucg

SEQ ID NO: 1568326 - RNA, 15 nt, Human adenovirus D
cucggggaucaccag

SEQ ID NO: 1568327 - RNA, 13 nt, Human adenovirus D
uguacuucuccca

SEQ ID NO: 1568328 - RNA, 17 nt, Human adenovirus D
gacgcagccggcgaacg

SEQ ID NO: 1568329 - RNA, 17 nt, Human adenovirus D
ccagcaucgaggugcag

SEQ ID NO: 1568330 - RNA, 15 nt, Human adenovirus D
agguggacgagcaga

SEQ ID NO: 1568331 - RNA, 21 nt, Human adenovirus D
ccuggugcgucgagcacagca

SEQ ID NO: 1568332 - RNA, 18 nt, Human adenovirus D
acuuggaugaggaagagg

SEQ ID NO: 1568333 - RNA, 18 nt, Human adenovirus D
augaaagcauacagagau

SEQ ID NO: 1568334 - RNA, 13 nt, Human adenovirus D
cccuuccucacuc

SEQ ID NO: 1568335 - RNA, 20 nt, Human adenovirus D
ccuucucgggaucgccaggc

SEQ ID NO: 1568336 - RNA, 19 nt, Human adenovirus D
gugcuccagccaaagcuca

SEQ ID NO: 1568337 - RNA, 14 nt, Human adenovirus D
aaagggaugucaaa

SEQ ID NO: 1568338 - RNA, 18 nt, Human adenovirus D
ccacguuacgucacuuuu

SEQ ID NO: 1568339 - RNA, 19 nt, Human adenovirus D
cgucccgacgaggccgggc

SEQ ID NO: 1568340 - RNA, 15 nt, Human adenovirus D
agaggcgagcagcug

SEQ ID NO: 1568341 - RNA, 20 nt, Human adenovirus D
ggugcuagacauggccagca

SEQ ID NO: 1568342 - RNA, 13 nt, Human adenovirus D
agggguugagggg

SEQ ID NO: 1568343 - RNA, 13 nt, Human adenovirus D
caccugcggcgcg

SEQ ID NO: 1568344 - RNA, 19 nt, Human adenovirus D
guggucagcgaugagcagc

SEQ ID NO: 1568345 - RNA, 23 nt, Human adenovirus D
gcuaccuugcacccaccaugcgc

SEQ ID NO: 1568346 - RNA, 17 nt, Human adenovirus D
ggccgucacccugcccu

SEQ ID NO: 1568347 - RNA, 14 nt, Human adenovirus D
gcgaggacgcagcg

SEQ ID NO: 1568348 - RNA, 15 nt, Human adenovirus D
ugcgcccgcgccgcg

SEQ ID NO: 1568349 - RNA, 15 nt, Human adenovirus D
agcgugggacuggca

SEQ ID NO: 1568350 - RNA, 16 nt, Human adenovirus D
gcguggcgcucgggca

SEQ ID NO: 1568351 - RNA, 15 nt, Human adenovirus D
agagagucuggugga

SEQ ID NO: 1568352 - RNA, 19 nt, Human adenovirus D
gcugguagggggcgccgcc

SEQ ID NO: 1568353 - RNA, 22 nt, Human adenovirus D
uauccagccuguacccagagcu

SEQ ID NO: 1568354 - RNA, 17 nt, Human adenovirus D
ggcgcccgugggcgacc

SEQ ID NO: 1568355 - RNA, 14 nt, Human adenovirus D
acaccgccuccccg

SEQ ID NO: 1568356 - RNA, 17 nt, Human adenovirus D
ggaacugauaagacaca

SEQ ID NO: 1568357 - RNA, 17 nt, Human adenovirus D
caccccccgcaggcagg

SEQ ID NO: 1568358 - RNA, 14 nt, Human adenovirus D
augcgccaagggca

SEQ ID NO: 1568359 - RNA, 20 nt, Human adenovirus D
acgggcugcuucugccuggu

SEQ ID NO: 1568360 - RNA, 14 nt, Human adenovirus D
ucaguuucccauga

SEQ ID NO: 1568361 - RNA, 21 nt, Human adenovirus D
cacuguuguuuauaaaucuua

SEQ ID NO: 1568362 - RNA, 18 nt, Human adenovirus D
ccgcuacgugcccuucca

SEQ ID NO: 1568363 - RNA, 15 nt, Human adenovirus D
gucuacaaggcccug

SEQ ID NO: 1568364 - RNA, 16 nt, Human adenovirus D
gcgauauuggagucaa

SEQ ID NO: 1568365 - RNA, 16 nt, Human adenovirus D
guucgacguggucaga

SEQ ID NO: 1568366 - RNA, 13 nt, Human adenovirus D
gcuaaagcucuuc

SEQ ID NO: 1568367 - RNA, 15 nt, Human adenovirus D
gagaugcgcgacugc

SEQ ID NO: 1568368 - RNA, 17 nt, Human adenovirus D
aggcuuucacagcuugc

SEQ ID NO: 1568369 - RNA, 19 nt, Human adenovirus D
agcacgcggaucucacggc

SEQ ID NO: 1568370 - RNA, 11 nt, Human adenovirus D
ggcgcccagca

SEQ ID NO: 1568371 - RNA, 17 nt, Human adenovirus D
cgaugccuucuccaggg

SEQ ID NO: 1568372 - RNA, 14 nt, Human adenovirus D
gcaggccgugcugc

SEQ ID NO: 1568373 - RNA, 19 nt, Human adenovirus D
gcagacggugaagcaggag

SEQ ID NO: 1568374 - RNA, 20 nt, Human adenovirus D
ucgcagucuccaacgccugc

SEQ ID NO: 1568375 - RNA, 16 nt, Human adenovirus D
agaggaaggaggacac

SEQ ID NO: 1568376 - RNA, 17 nt, Human adenovirus D
ccacacggccagcaggg

SEQ ID NO: 1568377 - RNA, 21 nt, Human adenovirus D
gcuggcuugguacccgcgacc

SEQ ID NO: 1568378 - RNA, 14 nt, Human adenovirus D
gcuggcccugcugg

SEQ ID NO: 1568379 - RNA, 18 nt, Human adenovirus D
ggccaaccuguggaagag

SEQ ID NO: 1568380 - RNA, 15 nt, Human adenovirus D
acucacccuggggcu

SEQ ID NO: 1568381 - RNA, 17 nt, Human adenovirus D
cccagcucauccgcagc

SEQ ID NO: 1568382 - RNA, 16 nt, Human adenovirus D
cuagcccuuccuggac

SEQ ID NO: 1568383 - RNA, 16 nt, Human adenovirus D
acgcgcucgacaugac

SEQ ID NO: 1568384 - RNA, 15 nt, Human adenovirus D
cgccgacccguggcc

SEQ ID NO: 1568385 - RNA, 17 nt, Human adenovirus D
auggauguggagcccga

SEQ ID NO: 1568386 - RNA, 19 nt, Human adenovirus D
aagggcucggucgggacga

SEQ ID NO: 1568387 - RNA, 14 nt, Human adenovirus D
caacaccagacaca

SEQ ID NO: 1568388 - RNA, 12 nt, Human adenovirus D
accugccuccac

SEQ ID NO: 1568389 - RNA, 15 nt, Human adenovirus D
ccauaaaucugcccu

SEQ ID NO: 1568390 - RNA, 15 nt, Human adenovirus D
auuacugccacugcc

SEQ ID NO: 1568391 - RNA, 17 nt, Human adenovirus D
aaaaucagaagagauga

SEQ ID NO: 1568392 - RNA, 13 nt, Human adenovirus D
gcugggcgaggac

SEQ ID NO: 1568393 - RNA, 20 nt, Human adenovirus D
cuacugcaucuguccaaccc

SEQ ID NO: 1568394 - RNA, 19 nt, Human adenovirus D
cuucaccggcuaccuugca

SEQ ID NO: 1568395 - RNA, 22 nt, Human adenovirus D
gcagggugaccagguccacgcu

SEQ ID NO: 1568396 - RNA, 17 nt, Human adenovirus D
gcugaucaagugccaca

SEQ ID NO: 1568397 - RNA, 15 nt, Human adenovirus D
agcgaugagcagcuu

SEQ ID NO: 1568398 - RNA, 23 nt, Human adenovirus D
cgacgcuuuuucagcgaccccga

SEQ ID NO: 1568399 - RNA, 19 nt, Human adenovirus D
caggcggcggucaccucaa

SEQ ID NO: 1568400 - RNA, 13 nt, Human adenovirus D
ucccaccaccagc

SEQ ID NO: 1568401 - RNA, 16 nt, Human adenovirus D
gguacuugggcugcca

SEQ ID NO: 1568402 - RNA, 13 nt, Human adenovirus D
gcuguccacgagc

SEQ ID NO: 1568403 - RNA, 23 nt, Human adenovirus D
acauggccagcacguacuuugac

SEQ ID NO: 1568404 - RNA, 21 nt, Human adenovirus D
guccuuuagacaacagccgca

SEQ ID NO: 1568405 - RNA, 13 nt, Human adenovirus D
acugcauggccuc

SEQ ID NO: 1568406 - RNA, 15 nt, Human adenovirus D
aguaaagaaacagaa

SEQ ID NO: 1568407 - RNA, 16 nt, Human adenovirus D
cauggcuaccugggag

SEQ ID NO: 1568408 - RNA, 12 nt, Human adenovirus D
ugcccagcagca

SEQ ID NO: 1568409 - RNA, 21 nt, Human adenovirus D
ugcaaacggugaaccugagcc

SEQ ID NO: 1568410 - RNA, 18 nt, Human adenovirus D
gcggccuugcggagcgag

SEQ ID NO: 1568411 - RNA, 12 nt, Human adenovirus D
gggccugggcuc

SEQ ID NO: 1568412 - RNA, 16 nt, Human adenovirus D
cucgcugcugcagccg

SEQ ID NO: 1568413 - RNA, 17 nt, Human adenovirus D
uggaccccauggacaac

SEQ ID NO: 1568414 - RNA, 12 nt, Human adenovirus D
caccaaggccau

SEQ ID NO: 1568415 - RNA, 23 nt, Human adenovirus D
aacaggaugggucugugccucuc

SEQ ID NO: 1568416 - RNA, 17 nt, Human adenovirus D
uugaccugccuccacca

SEQ ID NO: 1568417 - RNA, 19 nt, Human adenovirus D
gucgcccgaguuguccugg

SEQ ID NO: 1568418 - RNA, 20 nt, Human adenovirus D
uggcgccgggccugggcgug

SEQ ID NO: 1568419 - RNA, 17 nt, Human adenovirus D
acgacauccuggaccag

SEQ ID NO: 1568420 - RNA, 21 nt, Human adenovirus D
gugaaggccggcaugcccacc

SEQ ID NO: 1568421 - RNA, 15 nt, Human adenovirus D
gcugaacgccuuccu

SEQ ID NO: 1568422 - RNA, 15 nt, Human adenovirus D
gccgcgagaccggag

SEQ ID NO: 1568423 - RNA, 22 nt, Human adenovirus D
cgggugaccccgacgccccuga

SEQ ID NO: 1568424 - RNA, 21 nt, Human adenovirus D
cggcaaucaacuacucggugc

SEQ ID NO: 1568425 - RNA, 16 nt, Human adenovirus D
cgugcgcgaccugggc

SEQ ID NO: 1568426 - RNA, 15 nt, Human adenovirus D
gccguagagguagcg

SEQ ID NO: 1568427 - RNA, 18 nt, Human adenovirus D
uaaaaacaacaaaaccac

SEQ ID NO: 1568428 - RNA, 19 nt, Human adenovirus D
caccaacgugcccaucucc

SEQ ID NO: 1568429 - RNA, 20 nt, Human adenovirus D
ccuggaucuugagguuggcg

SEQ ID NO: 1568430 - RNA, 12 nt, Human adenovirus D
ggagcaggagga

SEQ ID NO: 1568431 - RNA, 21 nt, Human adenovirus D
ggcaguauaucaggugccugc

SEQ ID NO: 1568432 - RNA, 21 nt, Human adenovirus D
aggacuuggaugaggaagagg

SEQ ID NO: 1568433 - RNA, 17 nt, Human adenovirus D
caggagcgcagccugag

SEQ ID NO: 1568434 - RNA, 21 nt, Human adenovirus D
accuacuccucuuugcccugc

SEQ ID NO: 1568435 - RNA, 19 nt, Human adenovirus D
caagcagguggcgccgggc

SEQ ID NO: 1568436 - RNA, 15 nt, Human adenovirus D
acgcaggccaggagg

SEQ ID NO: 1568437 - RNA, 22 nt, Human adenovirus D
uuaacauccucuucugucucuu

SEQ ID NO: 1568438 - RNA, 12 nt, Human adenovirus D
gccuuaccuggu

SEQ ID NO: 1568439 - RNA, 18 nt, Human adenovirus D
gccuccccgcagaaauca

SEQ ID NO: 1568440 - RNA, 23 nt, Human adenovirus D
gcugaggaaucggaucuucccca

SEQ ID NO: 1568441 - RNA, 21 nt, Human adenovirus D
augagcagcuugcgcgcuggc

SEQ ID NO: 1568442 - RNA, 23 nt, Human adenovirus D
agacgcugaaaggcgggcugccc

SEQ ID NO: 1568443 - RNA, 15 nt, Human adenovirus D
ucccgccgcaggaga

SEQ ID NO: 1568444 - RNA, 13 nt, Human adenovirus D
cgcgcgcuggggc

SEQ ID NO: 1568445 - RNA, 14 nt, Human adenovirus D
gcgcuggggcagaa

SEQ ID NO: 1568446 - RNA, 16 nt, Human adenovirus D
uacacgggguugcagc

SEQ ID NO: 1568447 - RNA, 18 nt, Human adenovirus D
ccaaggcacccaccacag

SEQ ID NO: 1568448 - RNA, 15 nt, Human adenovirus D
cgaugagcagcuugc

SEQ ID NO: 1568449 - RNA, 23 nt, Human adenovirus D
acagcaguacaagcgccaacagc

SEQ ID NO: 1568450 - RNA, 17 nt, Human adenovirus D
ugcgagccgcgcgccgc

SEQ ID NO: 1568451 - RNA, 14 nt, Human adenovirus D
gcggccagcgcugg

SEQ ID NO: 1568452 - RNA, 16 nt, Human adenovirus D
gauguuggcuugcccu

SEQ ID NO: 1568453 - RNA, 21 nt, Human adenovirus D
ccaggaggcggugcgcacgcc

SEQ ID NO: 1568454 - RNA, 16 nt, Human adenovirus D
ucacucuuuccagcag

SEQ ID NO: 1568455 - RNA, 14 nt, Human adenovirus D
cuaggcccagcagc

SEQ ID NO: 1568456 - RNA, 15 nt, Human adenovirus D
ggugagggcgugcuu

SEQ ID NO: 1568457 - RNA, 16 nt, Human adenovirus D
guuccguuugugccuc

SEQ ID NO: 1568458 - RNA, 18 nt, Human adenovirus D
gauucagccauagcucag

SEQ ID NO: 1568459 - RNA, 14 nt, Human adenovirus D
ggaccgccagcgcg

SEQ ID NO: 1568460 - RNA, 13 nt, Human adenovirus D
uggcuugcaugaa

SEQ ID NO: 1568461 - RNA, 16 nt, Human adenovirus D
cugcugccgcucaguc

SEQ ID NO: 1568462 - RNA, 17 nt, Human adenovirus D
ucacucuggccgugggc

SEQ ID NO: 1568463 - RNA, 14 nt, Human adenovirus D
gccgaacgagcaga

SEQ ID NO: 1568464 - RNA, 22 nt, Human adenovirus D
gagaauuuuuguuguacucugu

SEQ ID NO: 1568465 - RNA, 15 nt, Human adenovirus D
ucacaucagccagga

SEQ ID NO: 1568466 - RNA, 13 nt, Human adenovirus D
cccucccucggcu

SEQ ID NO: 1568467 - RNA, 23 nt, Human adenovirus D
uuggaggaagaaaugaggcaggc

SEQ ID NO: 1568468 - RNA, 22 nt, Human adenovirus D
guaucugaggcauauaaaaaug

SEQ ID NO: 1568469 - RNA, 22 nt, Human adenovirus D
uggccccggggcggaguggccu

SEQ ID NO: 1568470 - RNA, 17 nt, Human adenovirus D
cgcaaugcgggccugcg

SEQ ID NO: 1568471 - RNA, 14 nt, Human adenovirus D
gcaauccuccagga

SEQ ID NO: 1568472 - RNA, 14 nt, Human adenovirus D
caacagccgcaggc

SEQ ID NO: 1568473 - RNA, 15 nt, Human adenovirus D
ucagggugcuccagc

SEQ ID NO: 1568474 - RNA, 17 nt, Human adenovirus D
gcagcgcugcacgggcu

SEQ ID NO: 1568475 - RNA, 19 nt, Human adenovirus D
ugcaccagccgcaccgcgg

SEQ ID NO: 1568476 - RNA, 21 nt, Human adenovirus D
gagggcaugggucaggcagcg

SEQ ID NO: 1568477 - RNA, 21 nt, Human adenovirus D
uuacaccgcgucgcugaaagc

SEQ ID NO: 1568478 - RNA, 22 nt, Human adenovirus D
gucuucccucucagaugucaaa

SEQ ID NO: 1568479 - RNA, 13 nt, Human adenovirus D
gcccgccaccugc

SEQ ID NO: 1568480 - RNA, 18 nt, Human adenovirus D
auuuuuguuguacucugu

SEQ ID NO: 1568481 - RNA, 18 nt, Human adenovirus D
ggugaaccugagccaggc

SEQ ID NO: 1568482 - RNA, 16 nt, Human adenovirus D
cgccgagccugaagcc

SEQ ID NO: 1568483 - RNA, 15 nt, Human adenovirus D
cgccuccacccugga

SEQ ID NO: 1568484 - RNA, 14 nt, Human adenovirus D
cgucggaagaggag

SEQ ID NO: 1568485 - RNA, 16 nt, Human adenovirus D
accaauagacagcaga

SEQ ID NO: 1568486 - RNA, 21 nt, Human adenovirus D
cgcgagcugaugcugagccug

SEQ ID NO: 1568487 - RNA, 16 nt, Human adenovirus D
ggaagggaaugcgugg

SEQ ID NO: 1568488 - RNA, 20 nt, Human adenovirus D
ccaugcgaauuccccucauc

SEQ ID NO: 1568489 - RNA, 14 nt, Human adenovirus D
agucugagggccac

SEQ ID NO: 1568490 - RNA, 18 nt, Human adenovirus D
gcacagacaccgucgccg

SEQ ID NO: 1568491 - RNA, 20 nt, Human adenovirus D
ccaccgugugcagacacaug

SEQ ID NO: 1568492 - RNA, 23 nt, Human adenovirus D
ggaugaaccuuuggaccugagcu

SEQ ID NO: 1568493 - RNA, 22 nt, Human adenovirus D
gaagacggcguaguugcgcagg

SEQ ID NO: 1568494 - RNA, 19 nt, Human adenovirus D
cugcaacugcgcguccguc

SEQ ID NO: 1568495 - RNA, 21 nt, Human adenovirus D
gccaccagucccuuuuccagg

SEQ ID NO: 1568496 - RNA, 11 nt, Human adenovirus D
caggagaggca

SEQ ID NO: 1568497 - RNA, 16 nt, Human adenovirus D
uggggcgugcaggcgc

SEQ ID NO: 1568498 - RNA, 22 nt, Human adenovirus D
gcgggacauccaggugaugccg

SEQ ID NO: 1568499 - RNA, 16 nt, Human adenovirus D
cgagcgcaccgucgcc

SEQ ID NO: 1568500 - RNA, 17 nt, Human adenovirus D
aagcaguucacuagccu

SEQ ID NO: 1568501 - RNA, 20 nt, Human adenovirus D
cagggcgcgauccucgccca

SEQ ID NO: 1568502 - RNA, 14 nt, Human adenovirus D
ccaggccaaccugu

SEQ ID NO: 1568503 - RNA, 24 nt, Human adenovirus D
gagaggcauggcaggcagcggccu

SEQ ID NO: 1568504 - RNA, 14 nt, Human adenovirus D
accagaccaccugg

SEQ ID NO: 1568505 - RNA, 14 nt, Human adenovirus D
ugaacugauguuga

SEQ ID NO: 1568506 - RNA, 18 nt, Human adenovirus D
cuggcucccagccuccac

SEQ ID NO: 1568507 - RNA, 14 nt, Human adenovirus D
gcccaguuccauca

SEQ ID NO: 1568508 - RNA, 17 nt, Human adenovirus D
gauacagaguaaaagua

SEQ ID NO: 1568509 - RNA, 20 nt, Human adenovirus D
aacaaucagccccuuccccu

SEQ ID NO: 1568510 - RNA, 21 nt, Human adenovirus D
cgagcucugcugcgccgcgcc

SEQ ID NO: 1568511 - RNA, 13 nt, Human adenovirus D
ggccauggacgag

SEQ ID NO: 1568512 - RNA, 21 nt, Human adenovirus D
ucaccggcuaccuugcaccca

SEQ ID NO: 1568513 - RNA, 20 nt, Human adenovirus D
uggcaaagcgguugagcugg

SEQ ID NO: 1568514 - RNA, 15 nt, Human adenovirus D
caagaacgagggccu

SEQ ID NO: 1568515 - RNA, 12 nt, Human adenovirus D
aaaucuuuaucu

SEQ ID NO: 1568516 - RNA, 17 nt, Human adenovirus D
auauuccagaucacaug

SEQ ID NO: 1568517 - RNA, 21 nt, Human adenovirus D
gacagucugagggccacccug

SEQ ID NO: 1568518 - RNA, 15 nt, Human adenovirus D
aacaucugugcugcc

SEQ ID NO: 1568519 - RNA, 21 nt, Human adenovirus D
caccgucgccucggaccuggc

SEQ ID NO: 1568520 - RNA, 20 nt, Human adenovirus D
aaauacagaugguagcagca

SEQ ID NO: 1568521 - RNA, 23 nt, Human adenovirus D
cagcucaacgacgaguuggugag

SEQ ID NO: 1568522 - RNA, 16 nt, Human adenovirus D
ggaccaccaggacggu

SEQ ID NO: 1568523 - RNA, 19 nt, Human adenovirus D
ccgaagcgccguggccucu

SEQ ID NO: 1568524 - RNA, 19 nt, Human adenovirus D
ucaugccacgaacagccac

SEQ ID NO: 1568525 - RNA, 15 nt, Human adenovirus D
gcccacguccaaaau

SEQ ID NO: 1568526 - RNA, 22 nt, Human adenovirus D
gcaggccgugcugcucgagcgc

SEQ ID NO: 1568527 - RNA, 16 nt, Human adenovirus D
gaugcugcccgccacc

SEQ ID NO: 1568528 - RNA, 13 nt, Human adenovirus D
gccaguggcccug

SEQ ID NO: 1568529 - RNA, 18 nt, Human adenovirus D
gacacguacuucagccug

SEQ ID NO: 1568530 - RNA, 22 nt, Human adenovirus D
ggaggagaccgacgcugggcuc

SEQ ID NO: 1568531 - RNA, 17 nt, Human adenovirus D
cugagccugcgccgggc

SEQ ID NO: 1568532 - RNA, 19 nt, Human adenovirus D
ugagccagagcauguugca

SEQ ID NO: 1568533 - RNA, 18 nt, Human adenovirus D
ccgcgggcaggggcggca

SEQ ID NO: 1568534 - RNA, 15 nt, Human adenovirus D
ccucggaccuggccg

SEQ ID NO: 1568535 - RNA, 22 nt, Human adenovirus D
caaagcuagcacccaaaaacug

SEQ ID NO: 1568536 - RNA, 20 nt, Human adenovirus D
uccugaaccacacggccagc

SEQ ID NO: 1568537 - RNA, 14 nt, Human adenovirus D
ccaccaccagccca

SEQ ID NO: 1568538 - RNA, 23 nt, Human adenovirus D
cacgauguaacaucaccacaggc

SEQ ID NO: 1568539 - RNA, 21 nt, Human adenovirus D
caagauagcccugcgcccaga

SEQ ID NO: 1568540 - RNA, 21 nt, Human adenovirus D
gggaguuugcauagcuugccg

SEQ ID NO: 1568541 - RNA, 18 nt, Human adenovirus D
ugugcucuccgcaccgcu

SEQ ID NO: 1568542 - RNA, 19 nt, Human adenovirus D
gcagaggucuggggcgcuu

SEQ ID NO: 1568543 - RNA, 19 nt, Human adenovirus D
augccaagauagcccugcg

SEQ ID NO: 1568544 - RNA, 15 nt, Human adenovirus D
cccagcgaucccagc

SEQ ID NO: 1568545 - RNA, 16 nt, Human adenovirus D
caugaaagaacauaca

SEQ ID NO: 1568546 - RNA, 12 nt, Human adenovirus D
cgccaccugcaa

SEQ ID NO: 1568547 - RNA, 22 nt, Human adenovirus D
uggcgcacaacaccgccuccac

SEQ ID NO: 1568548 - RNA, 20 nt, Human adenovirus D
cugacaauucagagccaggg

SEQ ID NO: 1568549 - RNA, 16 nt, Human adenovirus D
ugcaccauccccaggu

SEQ ID NO: 1568550 - RNA, 15 nt, Human adenovirus D
uugcgcccugagagc

SEQ ID NO: 1568551 - RNA, 13 nt, Human adenovirus D
agcggggccuggu

SEQ ID NO: 1568552 - RNA, 12 nt, Human adenovirus D
aaggggcgcagg

SEQ ID NO: 1568553 - RNA, 15 nt, Human adenovirus D
gcgcacaacaccgcc

SEQ ID NO: 1568554 - RNA, 14 nt, Human adenovirus D
ggugcuuagccugg

SEQ ID NO: 1568555 - RNA, 14 nt, Human adenovirus D
gaacuuuagaagug

SEQ ID NO: 1568556 - RNA, 23 nt, Human adenovirus D
guugaggcaccuagaccacugcc

SEQ ID NO: 1568557 - RNA, 14 nt, Human adenovirus D
cagcugccauggga

SEQ ID NO: 1568558 - RNA, 15 nt, Human adenovirus D
accagaacuuccagc

SEQ ID NO: 1568559 - RNA, 17 nt, Human adenovirus D
gcagcuguuccuggugg

SEQ ID NO: 1568560 - RNA, 22 nt, Human adenovirus D
gagauagcaguugaccaugagc

SEQ ID NO: 1568561 - RNA, 22 nt, Human adenovirus D
cgccgacgcgcuccucgcucug

SEQ ID NO: 1568562 - RNA, 21 nt, Human adenovirus D
cgcguggaggaagugcuggac

SEQ ID NO: 1568563 - RNA, 19 nt, Human adenovirus D
accgcgucgcugaaagcau

SEQ ID NO: 1568564 - RNA, 12 nt, Human adenovirus D
aauauggccugg

SEQ ID NO: 1568565 - RNA, 16 nt, Human adenovirus D
gaaguaaauuugacac

SEQ ID NO: 1568566 - RNA, 21 nt, Human adenovirus D
caaaacuaauuacagucacua

SEQ ID NO: 1568567 - RNA, 16 nt, Human adenovirus D
cggggaucagccccgc

SEQ ID NO: 1568568 - RNA, 13 nt, Human adenovirus D
aggugagcucugg

SEQ ID NO: 1568569 - RNA, 18 nt, Human adenovirus D
cauccgcgccgcagcccg

SEQ ID NO: 1568570 - RNA, 23 nt, Human adenovirus D
aacgaggcguucagggaggcgcu

SEQ ID NO: 1568571 - RNA, 13 nt, Human adenovirus D
agcuggcccggca

SEQ ID NO: 1568572 - RNA, 21 nt, Human adenovirus D
acccuaaggcucccuugcaac

SEQ ID NO: 1568573 - RNA, 14 nt, Human adenovirus D
gagcuggccuucca

SEQ ID NO: 1568574 - RNA, 20 nt, Human adenovirus D
gaggagaacugcuggcccug

SEQ ID NO: 1568575 - RNA, 22 nt, Human adenovirus D
ccucuccaucagcgcccucagc

SEQ ID NO: 1568576 - RNA, 13 nt, Human adenovirus D
cucuugcagcugg

SEQ ID NO: 1568577 - RNA, 21 nt, Human adenovirus D
cgacgaguuggugagcucuuc

SEQ ID NO: 1568578 - RNA, 15 nt, Human adenovirus D
cucccgccccuucga

SEQ ID NO: 1568579 - RNA, 20 nt, Human adenovirus D
agcauaauauggugaagggc

SEQ ID NO: 1568580 - RNA, 16 nt, Human adenovirus D
cucgguacccuccucc

SEQ ID NO: 1568581 - RNA, 23 nt, Human adenovirus D
ccccauggaugagcccaccgucc

SEQ ID NO: 1568582 - RNA, 18 nt, Human adenovirus D
gcuggaagcccugagccg

SEQ ID NO: 1568583 - RNA, 15 nt, Human adenovirus D
caacgcgcgcugccc

SEQ ID NO: 1568584 - RNA, 12 nt, Human adenovirus D
ccgcgcugggga

SEQ ID NO: 1568585 - RNA, 22 nt, Human adenovirus D
ggccuacuuuuugggcacccac

SEQ ID NO: 1568586 - RNA, 18 nt, Human adenovirus D
gcucccggcggcagcggc

SEQ ID NO: 1568587 - RNA, 18 nt, Human adenovirus D
augccccagcagaagcag

SEQ ID NO: 1568588 - RNA, 23 nt, Human adenovirus D
ccaggauacgcgggaagagcccu

SEQ ID NO: 1568589 - RNA, 15 nt, Human adenovirus D
ugggcucgcuggugg

SEQ ID NO: 1568590 - RNA, 21 nt, Human adenovirus D
caccgcaaugcgggccugcgc

SEQ ID NO: 1568591 - RNA, 13 nt, Human adenovirus D
aauaacaugcuga

SEQ ID NO: 1568592 - RNA, 15 nt, Human adenovirus D
cgcccucagcagucu

SEQ ID NO: 1568593 - RNA, 13 nt, Human adenovirus D
cagccuccaccgc

SEQ ID NO: 1568594 - RNA, 13 nt, Human adenovirus D
cgucccagcagca

SEQ ID NO: 1568595 - RNA, 15 nt, Human adenovirus D
acgaugagaccaagu

SEQ ID NO: 1568596 - RNA, 21 nt, Human adenovirus D
gccgccaucgaacacgccacc

SEQ ID NO: 1568597 - RNA, 20 nt, Human adenovirus D
ggugguguucacgcccggcg

SEQ ID NO: 1568598 - RNA, 19 nt, Human adenovirus D
gagaacugcuggcccugcu

SEQ ID NO: 1568599 - RNA, 17 nt, Human adenovirus D
ggcgggggugaugagcu

SEQ ID NO: 1568600 - RNA, 19 nt, Human adenovirus D
ccauagucaucacccagca

SEQ ID NO: 1568601 - RNA, 17 nt, Human adenovirus D
uaaguguaagagcaaga

SEQ ID NO: 1568602 - RNA, 23 nt, Human adenovirus D
cgccgauuuaaagacccacagcc

SEQ ID NO: 1568603 - RNA, 18 nt, Human adenovirus D
cccagcucauccgcagcu

SEQ ID NO: 1568604 - RNA, 15 nt, Human adenovirus D
agaaagcaguucacu

SEQ ID NO: 1568605 - RNA, 21 nt, Human adenovirus D
gugcugacauccauggccagg

SEQ ID NO: 1568606 - RNA, 23 nt, Human adenovirus D
cagcaacuucauguccaugggcg

SEQ ID NO: 1568607 - RNA, 20 nt, Human adenovirus D
ugccggcgacaagcuggccu

SEQ ID NO: 1568608 - RNA, 19 nt, Human adenovirus D
caggguaaagccagcagca

SEQ ID NO: 1568609 - RNA, 23 nt, Human adenovirus D
gccguguccacgcauugcaugag

SEQ ID NO: 1568610 - RNA, 21 nt, Human adenovirus D
cgggcugcuucugccugguga

SEQ ID NO: 1568611 - RNA, 13 nt, Human adenovirus D
aguucagcuccag

SEQ ID NO: 1568612 - RNA, 21 nt, Human adenovirus D
gaccaaucgcgcccgcagcac

SEQ ID NO: 1568613 - RNA, 17 nt, Human adenovirus D
auagcaggggcgcuggg

SEQ ID NO: 1568614 - RNA, 17 nt, Human adenovirus D
agcaggggcgcugggcg

SEQ ID NO: 1568615 - RNA, 18 nt, Human adenovirus D
uggugggauaacagcgcc

SEQ ID NO: 1568616 - RNA, 18 nt, Human adenovirus D
gaccuugcagagcagcuc

SEQ ID NO: 1568617 - RNA, 22 nt, Human adenovirus D
cggccguccuuucgcugcugcc

SEQ ID NO: 1568618 - RNA, 20 nt, Human adenovirus D
cuggagaagcaucgccaggg

SEQ ID NO: 1568619 - RNA, 20 nt, Human adenovirus D
gaagggcaucuucugccugg

SEQ ID NO: 1568620 - RNA, 17 nt, Human adenovirus D
caucaagcaagaugaua

SEQ ID NO: 1568621 - RNA, 22 nt, Human adenovirus D
acaacugcguguaucucaauaa

SEQ ID NO: 1568622 - RNA, 22 nt, Human adenovirus D
gauacgaggcagaggcacacag

SEQ ID NO: 1568623 - RNA, 20 nt, Human adenovirus D
ucuuccgcaacuuccagccc

SEQ ID NO: 1568624 - RNA, 20 nt, Human adenovirus D
cgcaggcgcccagccagcaa

SEQ ID NO: 1568625 - RNA, 16 nt, Human adenovirus D
cugacggcgcagcugu

SEQ ID NO: 1568626 - RNA, 16 nt, Human adenovirus D
cgagaagaacgcacag

SEQ ID NO: 1568627 - RNA, 17 nt, Human adenovirus D
  misc_feature (8)..(8): n is a, c, g or u
cggccgangggagucgc

SEQ ID NO: 1568628 - RNA, 20 nt, Human adenovirus D
gcccaacucgcggcugcugc

SEQ ID NO: 1568629 - RNA, 16 nt, Human adenovirus D
aacucagucacucuca

SEQ ID NO: 1568630 - RNA, 14 nt, Human adenovirus D
gaagaagagcagca

SEQ ID NO: 1568631 - RNA, 20 nt, Human adenovirus D
ggccugcgucaucacccagg

SEQ ID NO: 1568632 - RNA, 17 nt, Human adenovirus D
caaaacuuaacucugau

SEQ ID NO: 1568633 - RNA, 16 nt, Human adenovirus D
cacgggccgccgggcc

SEQ ID NO: 1568634 - RNA, 16 nt, Human adenovirus D
gcuagacaccacagug

SEQ ID NO: 1568635 - RNA, 23 nt, Human adenovirus D
acaguagcgucucaagagagguu

SEQ ID NO: 1568636 - RNA, 17 nt, Human adenovirus D
acagcgccacgaccggc

SEQ ID NO: 1568637 - RNA, 17 nt, Human adenovirus D
gcccagugcuuccagca

SEQ ID NO: 1568638 - RNA, 16 nt, Human adenovirus D
caaaacucacuuuggu

SEQ ID NO: 1568639 - RNA, 17 nt, Human adenovirus D
gauacuguugcagagag

SEQ ID NO: 1568640 - RNA, 14 nt, Human adenovirus D
cagccuccaccgcu

SEQ ID NO: 1568641 - RNA, 14 nt, Human adenovirus D
uccguccgcuucga

SEQ ID NO: 1568642 - RNA, 12 nt, Human adenovirus D
gacccccaggcc

SEQ ID NO: 1568643 - RNA, 18 nt, Human adenovirus D
gaagcagaaguucaccug

SEQ ID NO: 1568644 - RNA, 16 nt, Human adenovirus D
aacagcauauaccccu

SEQ ID NO: 1568645 - RNA, 16 nt, Human adenovirus D
cucucuuugugucucc

SEQ ID NO: 1568646 - RNA, 16 nt, Human adenovirus D
ggaaccccaccaugaa

SEQ ID NO: 1568647 - RNA, 14 nt, Human adenovirus D
cuccguggggcgcu

SEQ ID NO: 1568648 - RNA, 14 nt, Human adenovirus D
aggcgcccgugggc

SEQ ID NO: 1568649 - RNA, 14 nt, Human adenovirus D
cauacuuauggcuc

SEQ ID NO: 1568650 - RNA, 17 nt, Human adenovirus D
ucaacuguuaagaccac

SEQ ID NO: 1568651 - RNA, 20 nt, Human adenovirus D
ccugagcgagacccagguca

SEQ ID NO: 1568652 - RNA, 18 nt, Human adenovirus D
ggcugcauccacugcucc

SEQ ID NO: 1568653 - RNA, 18 nt, Human adenovirus D
gcgugcccgugcgcaccc

SEQ ID NO: 1568654 - RNA, 15 nt, Human adenovirus D
ggccugaugcaggau

SEQ ID NO: 1568655 - RNA, 19 nt, Human adenovirus D
ccggcauccugcacgcagc

SEQ ID NO: 1568656 - RNA, 14 nt, Human adenovirus D
ggcgaccagcucug

SEQ ID NO: 1568657 - RNA, 16 nt, Human adenovirus D
cuuccucacucccccc

SEQ ID NO: 1568658 - RNA, 15 nt, Human adenovirus D
gugcuaaagcucuuc

SEQ ID NO: 1568659 - RNA, 14 nt, Human adenovirus D
cgggaucgccaggc

SEQ ID NO: 1568660 - RNA, 16 nt, Human adenovirus D
ucgucccggaggaggg

SEQ ID NO: 1568661 - RNA, 16 nt, Human adenovirus D
ccggcgacaagcuggc

SEQ ID NO: 1568662 - RNA, 13 nt, Human adenovirus D
ucaucacccagca

SEQ ID NO: 1568663 - RNA, 12 nt, Human adenovirus D
uauuuccucugu

SEQ ID NO: 1568664 - RNA, 21 nt, Human adenovirus D
ggugaagaugccgggacagag

SEQ ID NO: 1568665 - RNA, 17 nt, Human adenovirus D
acaaagagcacagcagu

SEQ ID NO: 1568666 - RNA, 21 nt, Human adenovirus D
ccgcguccccgcccgccgcca

SEQ ID NO: 1568667 - RNA, 17 nt, Human adenovirus D
aguugagggugguggcg

SEQ ID NO: 1568668 - RNA, 15 nt, Human adenovirus D
accucccucacccac

SEQ ID NO: 1568669 - RNA, 16 nt, Human adenovirus D
gcaggaccaccaggac

SEQ ID NO: 1568670 - RNA, 19 nt, Human adenovirus D
ccagaucucggcgcggcgg

SEQ ID NO: 1568671 - RNA, 16 nt, Human adenovirus D
gcacuggagcacagac

SEQ ID NO: 1568672 - RNA, 16 nt, Human adenovirus D
cuuguuagagaugagg

SEQ ID NO: 1568673 - RNA, 18 nt, Human adenovirus D
cagagggggcgguggcag

SEQ ID NO: 1568674 - RNA, 18 nt, Human adenovirus D
cacgguaagagcccagca

SEQ ID NO: 1568675 - RNA, 20 nt, Human adenovirus D
gcuuguaagcaucgcgcagg

SEQ ID NO: 1568676 - RNA, 19 nt, Human adenovirus D
ccuaugggaacaaggccug

SEQ ID NO: 1568677 - RNA, 16 nt, Human adenovirus D
acgcaggccaggagga

SEQ ID NO: 1568678 - RNA, 22 nt, Human adenovirus D
gagcugagaccagaccaccugg

SEQ ID NO: 1568679 - RNA, 15 nt, Human adenovirus D
ucccgacgaggccgg

SEQ ID NO: 1568680 - RNA, 21 nt, Human adenovirus D
ccagaaggggcaccuuccagc

SEQ ID NO: 1568681 - RNA, 12 nt, Human adenovirus D
ccgggccugggc

SEQ ID NO: 1568682 - RNA, 19 nt, Human adenovirus D
agguuugaguagugggcgu

SEQ ID NO: 1568683 - RNA, 23 nt, Human adenovirus D
gagcugagaccagaccaccuggu

SEQ ID NO: 1568684 - RNA, 23 nt, Human adenovirus D
cuuccaugcgggugaccccgacg

SEQ ID NO: 1568685 - RNA, 14 nt, Human adenovirus D
gccggcggcgcgag

SEQ ID NO: 1568686 - RNA, 15 nt, Human adenovirus D
ccacgaacagccacg

SEQ ID NO: 1568687 - RNA, 16 nt, Human adenovirus D
ugguagggggcgccgc

SEQ ID NO: 1568688 - RNA, 17 nt, Human adenovirus D
cuuguuauugagcccau

SEQ ID NO: 1568689 - RNA, 20 nt, Human adenovirus D
caggacucgcagacgagcgg

SEQ ID NO: 1568690 - RNA, 18 nt, Human adenovirus D
ggaggcacagacgaagaa

SEQ ID NO: 1568691 - RNA, 18 nt, Human adenovirus D
gacuucaugagccagagc

SEQ ID NO: 1568692 - RNA, 18 nt, Human adenovirus D
caggcgccugaguggcgg

SEQ ID NO: 1568693 - RNA, 18 nt, Human adenovirus D
aguggcaacaccugggca

SEQ ID NO: 1568694 - RNA, 12 nt, Human adenovirus D
ggcaccagccag

SEQ ID NO: 1568695 - RNA, 14 nt, Human adenovirus D
uacaagauccugag

SEQ ID NO: 1568696 - RNA, 15 nt, Human adenovirus D
ccugcauuggcagcc

SEQ ID NO: 1568697 - RNA, 12 nt, Human adenovirus D
agcgccagcugu

SEQ ID NO: 1568698 - RNA, 23 nt, Human adenovirus D
caggguagcggggcacaggcaca

SEQ ID NO: 1568699 - RNA, 20 nt, Human adenovirus D
augcagggugaccaggucca

SEQ ID NO: 1568700 - RNA, 17 nt, Human adenovirus D
gaaacaagucaaaagaa

SEQ ID NO: 1568701 - RNA, 20 nt, Human adenovirus D
agcauggcuaccugggagga

SEQ ID NO: 1568702 - RNA, 15 nt, Human adenovirus D
cagaccaagcugcug

SEQ ID NO: 1568703 - RNA, 17 nt, Human adenovirus D
gacucacccuggggcuc

SEQ ID NO: 1568704 - RNA, 16 nt, Human adenovirus D
acaggcacacugacau

SEQ ID NO: 1568705 - RNA, 18 nt, Human adenovirus D
cucgcucgguugaggcac

SEQ ID NO: 1568706 - RNA, 15 nt, Human adenovirus D
agaaaugaggcaggc

SEQ ID NO: 1568707 - RNA, 19 nt, Human adenovirus D
gacacguacuucagccugg

SEQ ID NO: 1568708 - RNA, 22 nt, Human adenovirus D
cauaucccaggggacuggaaac

SEQ ID NO: 1568709 - RNA, 15 nt, Human adenovirus D
uugaggcauucacau

SEQ ID NO: 1568710 - RNA, 15 nt, Human adenovirus D
ccagaacuuccagca

SEQ ID NO: 1568711 - RNA, 13 nt, Human adenovirus D
ggacggccaggcc

SEQ ID NO: 1568712 - RNA, 22 nt, Human adenovirus D
cgaugagaucaacuacaaggac

SEQ ID NO: 1568713 - RNA, 22 nt, Human adenovirus D
agcccagggcgcacuacagccg

SEQ ID NO: 1568714 - RNA, 16 nt, Human adenovirus D
gcccauuccuggagau

SEQ ID NO: 1568715 - RNA, 16 nt, Human adenovirus D
cagucugagggccacc

SEQ ID NO: 1568716 - RNA, 22 nt, Human adenovirus D
cuaaugacagaggcaacagcaa

SEQ ID NO: 1568717 - RNA, 13 nt, Human adenovirus D
cuucgugcacugg

SEQ ID NO: 1568718 - RNA, 20 nt, Human adenovirus D
gcagugucucgaggacgaga

SEQ ID NO: 1568719 - RNA, 18 nt, Human adenovirus D
cucuucgcagaaccauga

SEQ ID NO: 1568720 - RNA, 17 nt, Human adenovirus D
ccaacagccacaugacc

SEQ ID NO: 1568721 - RNA, 17 nt, Human adenovirus D
gagccugcgcccgcgcc

SEQ ID NO: 1568722 - RNA, 22 nt, Human adenovirus D
gcauccuuuaauccgugugcug

SEQ ID NO: 1568723 - RNA, 18 nt, Human adenovirus D
augggaacaaggccugga

SEQ ID NO: 1568724 - RNA, 14 nt, Human adenovirus D
caggucaaaaccca

SEQ ID NO: 1568725 - RNA, 22 nt, Human adenovirus D
acgucaucgacucgguggucgc

SEQ ID NO: 1568726 - RNA, 14 nt, Human adenovirus D
agcgcgcugcggcu

SEQ ID NO: 1568727 - RNA, 14 nt, Human adenovirus D
agaucaucauaaga

SEQ ID NO: 1568728 - RNA, 22 nt, Human adenovirus D
uuaccucaucgccaccaugagc

SEQ ID NO: 1568729 - RNA, 12 nt, Human adenovirus D
cgacccccaggc

SEQ ID NO: 1568730 - RNA, 22 nt, Human adenovirus D
caagcuaaauuuaagccagugg

SEQ ID NO: 1568731 - RNA, 12 nt, Human adenovirus D
cguucaugggca

SEQ ID NO: 1568732 - RNA, 19 nt, Human adenovirus D
cagccuuuccauggccucg

SEQ ID NO: 1568733 - RNA, 15 nt, Human adenovirus D
ucaucaaucaucagg

SEQ ID NO: 1568734 - RNA, 21 nt, Human adenovirus D
uguuggaggaagaaaugaggc

SEQ ID NO: 1568735 - RNA, 19 nt, Human adenovirus D
cccgccauggggcgccgcc

SEQ ID NO: 1568736 - RNA, 14 nt, Human adenovirus D
agccgcaggccaac

SEQ ID NO: 1568737 - RNA, 18 nt, Human adenovirus D
acuccuacaauacucugg

SEQ ID NO: 1568738 - RNA, 22 nt, Human adenovirus D
acuggcugacccaaucaccaua

SEQ ID NO: 1568739 - RNA, 14 nt, Human adenovirus D
augccccagcagaa

SEQ ID NO: 1568740 - RNA, 14 nt, Human adenovirus D
uggccaacagccac

SEQ ID NO: 1568741 - RNA, 19 nt, Human adenovirus D
gcgacgcuuuuucagcgac

SEQ ID NO: 1568742 - RNA, 19 nt, Human adenovirus D
gacgggcuuugacgagcgc

SEQ ID NO: 1568743 - RNA, 13 nt, Human adenovirus D
guugaacccagau

SEQ ID NO: 1568744 - RNA, 14 nt, Human adenovirus D
ggcgcugcaaagcc

SEQ ID NO: 1568745 - RNA, 15 nt, Human adenovirus D
caaucagccccuucc

SEQ ID NO: 1568746 - RNA, 21 nt, Human adenovirus D
uggaagagggcgaagggcugg

SEQ ID NO: 1568747 - RNA, 17 nt, Human adenovirus D
ggccgcagcucuucccg

SEQ ID NO: 1568748 - RNA, 13 nt, Human adenovirus D
aagaucagcugca

SEQ ID NO: 1568749 - RNA, 19 nt, Human adenovirus D
augcagacacuugagcugg

SEQ ID NO: 1568750 - RNA, 17 nt, Human adenovirus D
gcuggcgagacuggggg

SEQ ID NO: 1568751 - RNA, 16 nt, Human adenovirus D
aggacgagaaccugaa

SEQ ID NO: 1568752 - RNA, 19 nt, Human adenovirus D
ccuggucacccucgagcuc

SEQ ID NO: 1568753 - RNA, 14 nt, Human adenovirus D
cagugcccccucca

SEQ ID NO: 1568754 - RNA, 18 nt, Human adenovirus D
aucacaucggacuggguu

SEQ ID NO: 1568755 - RNA, 21 nt, Human adenovirus D
ccgcugucucagccucgaaca

SEQ ID NO: 1568756 - RNA, 12 nt, Human adenovirus D
ugcaagaaggaa

SEQ ID NO: 1568757 - RNA, 18 nt, Human adenovirus D
gcugagcgaccgcgagcu

SEQ ID NO: 1568758 - RNA, 15 nt, Human adenovirus D
ggccagucugaugaa

SEQ ID NO: 1568759 - RNA, 14 nt, Human adenovirus D
ugguccuggucacc

SEQ ID NO: 1568760 - RNA, 18 nt, Human adenovirus D
gcaggugcugccccaggc

SEQ ID NO: 1568761 - RNA, 14 nt, Human adenovirus D
ugaacccagaugag

SEQ ID NO: 1568762 - RNA, 16 nt, Human adenovirus D
gucacuuuugcccuua

SEQ ID NO: 1568763 - RNA, 20 nt, Human adenovirus D
cgcgcuggacaugaccgcgc

SEQ ID NO: 1568764 - RNA, 12 nt, Human adenovirus D
cgugaaggccgg

SEQ ID NO: 1568765 - RNA, 19 nt, Human adenovirus D
aggcgaaacgccccugcaa

SEQ ID NO: 1568766 - RNA, 23 nt, Human adenovirus D
ggucccuucucggaccaacccca

SEQ ID NO: 1568767 - RNA, 21 nt, Human adenovirus D
cagggcacugccggugcacuc

SEQ ID NO: 1568768 - RNA, 17 nt, Human adenovirus D
cucucagcacgguggcc

SEQ ID NO: 1568769 - RNA, 21 nt, Human adenovirus D
accgggaugaugaccgagcug

SEQ ID NO: 1568770 - RNA, 15 nt, Human adenovirus D
gcgcucccggcggca

SEQ ID NO: 1568771 - RNA, 17 nt, Human adenovirus D
guggugcuggaugaugu

SEQ ID NO: 1568772 - RNA, 16 nt, Human adenovirus D
gaggacgagaaccuga

SEQ ID NO: 1568773 - RNA, 17 nt, Human adenovirus D
accucuugcagcuggcc

SEQ ID NO: 1568774 - RNA, 15 nt, Human adenovirus D
cagccgcaggccaac

SEQ ID NO: 1568775 - RNA, 16 nt, Human adenovirus D
guggccccggggcgga

SEQ ID NO: 1568776 - RNA, 18 nt, Human adenovirus D
gagaggcugacgagcccg

SEQ ID NO: 1568777 - RNA, 21 nt, Human adenovirus D
aggucuaaaaaccccgccaaa

SEQ ID NO: 1568778 - RNA, 21 nt, Human adenovirus D
gcuaguguacaacgcccugcu

SEQ ID NO: 1568779 - RNA, 18 nt, Human adenovirus D
cugccccaggcggugcug

SEQ ID NO: 1568780 - RNA, 16 nt, Human adenovirus D
caacaguacuggcaac

SEQ ID NO: 1568781 - RNA, 22 nt, Human adenovirus D
cccgccgcuguggagccacugc

SEQ ID NO: 1568782 - RNA, 21 nt, Human adenovirus D
gauggccacggggagccccuu

SEQ ID NO: 1568783 - RNA, 22 nt, Human adenovirus D
uccgcagcuacaccucccucac

SEQ ID NO: 1568784 - RNA, 20 nt, Human adenovirus D
cugaaacaccugcagcgcca

SEQ ID NO: 1568785 - RNA, 22 nt, Human adenovirus D
ccgugagcucgucuuccaggag

SEQ ID NO: 1568786 - RNA, 19 nt, Human adenovirus D
aucagcaguagccccgccc

SEQ ID NO: 1568787 - RNA, 16 nt, Human adenovirus D
cgcagcggcaggaaau

SEQ ID NO: 1568788 - RNA, 23 nt, Human adenovirus D
cuggaacgagaucggcaccagcc

SEQ ID NO: 1568789 - RNA, 21 nt, Human adenovirus D
uggagcucgucgcgaaagagg

SEQ ID NO: 1568790 - RNA, 15 nt, Human adenovirus D
acacggucacugucc

SEQ ID NO: 1568791 - RNA, 16 nt, Human adenovirus D
ugcgaaaacacuuccg

SEQ ID NO: 1568792 - RNA, 18 nt, Human adenovirus D
ccggcggauagcgcgccg

SEQ ID NO: 1568793 - RNA, 16 nt, Human adenovirus D
gcgcucgcucacccgc

SEQ ID NO: 1568794 - RNA, 12 nt, Human adenovirus D
cgugcacuggcu

SEQ ID NO: 1568795 - RNA, 16 nt, Human adenovirus D
ugcucuaccccauccc

SEQ ID NO: 1568796 - RNA, 18 nt, Human adenovirus D
gaugccuucuccagggug

SEQ ID NO: 1568797 - RNA, 20 nt, Human adenovirus D
gcaagccccggaccccgcca

SEQ ID NO: 1568798 - RNA, 20 nt, Human adenovirus D
uguaggccauccccauccag

SEQ ID NO: 1568799 - RNA, 17 nt, Human adenovirus D
cagcuugcgcgcuggcu

SEQ ID NO: 1568800 - RNA, 23 nt, Human adenovirus D
ggcgcaagcucaugcuggccgug

SEQ ID NO: 1568801 - RNA, 15 nt, Human adenovirus D
cuuuaucagccagaa

SEQ ID NO: 1568802 - RNA, 22 nt, Human adenovirus D
cagcaggguacccacugggugg

SEQ ID NO: 1568803 - RNA, 21 nt, Human adenovirus D
caccacgcuucuuccccagcg

SEQ ID NO: 1568804 - RNA, 15 nt, Human adenovirus D
cgagcugcaaggucc

SEQ ID NO: 1568805 - RNA, 15 nt, Human adenovirus D
ggccaugcugcgccg

SEQ ID NO: 1568806 - RNA, 16 nt, Human adenovirus D
ugaaagcauacagaga

SEQ ID NO: 1568807 - RNA, 17 nt, Human adenovirus D
cagaaccggaggcuggc

SEQ ID NO: 1568808 - RNA, 19 nt, Human adenovirus D
uagggccuuuccccaccua

SEQ ID NO: 1568809 - RNA, 22 nt, Human adenovirus D
ugcagacacuugagcuggccuu

SEQ ID NO: 1568810 - RNA, 22 nt, Human adenovirus D
cgacacccccgcgugcagcugc

SEQ ID NO: 1568811 - RNA, 18 nt, Human adenovirus D
gugacggccuacgagcag

SEQ ID NO: 1568812 - RNA, 19 nt, Human adenovirus D
ugccaucaugaucuacccc

SEQ ID NO: 1568813 - RNA, 15 nt, Human adenovirus D
gcgagccgcgcgccg

SEQ ID NO: 1568814 - RNA, 19 nt, Human adenovirus D
cuagacauggccagcacgu

SEQ ID NO: 1568815 - RNA, 13 nt, Human adenovirus D
gcacaaacgugca

SEQ ID NO: 1568816 - RNA, 16 nt, Human adenovirus D
guggaagaggggcagc

SEQ ID NO: 1568817 - RNA, 20 nt, Human adenovirus D
aguucaggagcgcagccuga

SEQ ID NO: 1568818 - RNA, 15 nt, Human adenovirus D
cgcgaacagcagcag

SEQ ID NO: 1568819 - RNA, 20 nt, Human adenovirus D
cucaggcgcaaccaggagga

SEQ ID NO: 1568820 - RNA, 22 nt, Human adenovirus D
acacuuaguucagcugcaauga

SEQ ID NO: 1568821 - RNA, 19 nt, Human adenovirus D
gcugcuagagugccacugc

SEQ ID NO: 1568822 - RNA, 18 nt, Human adenovirus D
agccggcgaacgugccgc

SEQ ID NO: 1568823 - RNA, 14 nt, Human adenovirus D
gcgaaccaggcagu

SEQ ID NO: 1568824 - RNA, 15 nt, Human adenovirus D
uggagaaugcugcua

SEQ ID NO: 1568825 - RNA, 18 nt, Human adenovirus D
cuacgcguacauccagca

SEQ ID NO: 1568826 - RNA, 19 nt, Human adenovirus D
ggccaagaaggccggggcc

SEQ ID NO: 1568827 - RNA, 15 nt, Human adenovirus D
ucccacagggcacug

SEQ ID NO: 1568828 - RNA, 15 nt, Human adenovirus D
ugaagagggagagga

SEQ ID NO: 1568829 - RNA, 14 nt, Human adenovirus D
agcuugugcggccu

SEQ ID NO: 1568830 - RNA, 16 nt, Human adenovirus D
guuacuguaaagccac

SEQ ID NO: 1568831 - RNA, 14 nt, Human adenovirus D
gcgccucaauguca

SEQ ID NO: 1568832 - RNA, 19 nt, Human adenovirus D
cacuacuaauucucaaagu

SEQ ID NO: 1568833 - RNA, 13 nt, Human adenovirus D
gcaggccaacaga

SEQ ID NO: 1568834 - RNA, 22 nt, Human adenovirus D
gcccugcgauauggaugauggc

SEQ ID NO: 1568835 - RNA, 15 nt, Human adenovirus D
agcgaucugggaugc

SEQ ID NO: 1568836 - RNA, 19 nt, Human adenovirus D
ccggucgacggugagcagc

SEQ ID NO: 1568837 - RNA, 14 nt, Human adenovirus D
ggggcaauaccggg

SEQ ID NO: 1568838 - RNA, 16 nt, Human adenovirus D
gccauggggcgccgcc

SEQ ID NO: 1568839 - RNA, 16 nt, Human adenovirus D
ugaccgaggagcugag

SEQ ID NO: 1568840 - RNA, 15 nt, Human adenovirus D
cggcggcuggcggua

SEQ ID NO: 1568841 - RNA, 17 nt, Human adenovirus D
cuugugcccgcccaggu

SEQ ID NO: 1568842 - RNA, 15 nt, Human adenovirus D
cuaccuugcacccac

SEQ ID NO: 1568843 - RNA, 16 nt, Human adenovirus D
ccucugcaucugauga

SEQ ID NO: 1568844 - RNA, 18 nt, Human adenovirus D
guagcggggcacaggcac

SEQ ID NO: 1568845 - RNA, 16 nt, Human adenovirus D
gcuggcuggucaggcc

SEQ ID NO: 1568846 - RNA, 21 nt, Human adenovirus D
aacugcgcguccgucagcagc

SEQ ID NO: 1568847 - RNA, 15 nt, Human adenovirus D
acacccaacugagca

SEQ ID NO: 1568848 - RNA, 14 nt, Human adenovirus D
gggcgccucccagg

SEQ ID NO: 1568849 - RNA, 21 nt, Human adenovirus D
ggagaucacuagcgugagccg

SEQ ID NO: 1568850 - RNA, 14 nt, Human adenovirus D
gcauggccucgugc

SEQ ID NO: 1568851 - RNA, 21 nt, Human adenovirus D
ugcuuguguccucccccgcaa

SEQ ID NO: 1568852 - RNA, 15 nt, Human adenovirus D
ggcgugcaggcgccc

SEQ ID NO: 1568853 - RNA, 20 nt, Human adenovirus D
gcugaaacaccugcagcgcc

SEQ ID NO: 1568854 - RNA, 12 nt, Human adenovirus D
ccggcagcgggg

SEQ ID NO: 1568855 - RNA, 23 nt, Human adenovirus D
cacagucaacuguuaagaccacu

SEQ ID NO: 1568856 - RNA, 13 nt, Human adenovirus D
ucagcacugcaaa

SEQ ID NO: 1568857 - RNA, 19 nt, Human adenovirus D
uggcggcccuggcuggugg

SEQ ID NO: 1568858 - RNA, 17 nt, Human adenovirus D
gugaugucucacucaag

SEQ ID NO: 1568859 - RNA, 21 nt, Human adenovirus D
gccuugauuuuuccagcccag

SEQ ID NO: 1568860 - RNA, 22 nt, Human adenovirus D
cccguggucagcgaugagcagc

SEQ ID NO: 1568861 - RNA, 18 nt, Human adenovirus D
agaacgagggccugggcu

SEQ ID NO: 1568862 - RNA, 18 nt, Human adenovirus D
cgcgccacuggccacggg

SEQ ID NO: 1568863 - RNA, 16 nt, Human adenovirus D
ccuccgcccugagcuc

SEQ ID NO: 1568864 - RNA, 15 nt, Human adenovirus D
ccucguccucuuccu

SEQ ID NO: 1568865 - RNA, 20 nt, Human adenovirus D
cgugaaggccggcaugccca

SEQ ID NO: 1568866 - RNA, 13 nt, Human adenovirus D
acgagcggccgcc

SEQ ID NO: 1568867 - RNA, 16 nt, Human adenovirus D
gaccugggcugcgggc

SEQ ID NO: 1568868 - RNA, 14 nt, Human adenovirus D
ccgaggaagauccc

SEQ ID NO: 1568869 - RNA, 19 nt, Human adenovirus D
ggcgugcgcgacgacgcgg

SEQ ID NO: 1568870 - RNA, 12 nt, Human adenovirus D
ggcggagggugc

SEQ ID NO: 1568871 - RNA, 15 nt, Human adenovirus D
gaaaucgcaguuggg

SEQ ID NO: 1568872 - RNA, 19 nt, Human adenovirus D
aacuugugguuuuaacagg

SEQ ID NO: 1568873 - RNA, 18 nt, Human adenovirus D
ugaguccgucggccaugg

SEQ ID NO: 1568874 - RNA, 16 nt, Human adenovirus D
gacgagacgcgcgcgg

SEQ ID NO: 1568875 - RNA, 15 nt, Human adenovirus D
accaggcagugcagc

SEQ ID NO: 1568876 - RNA, 21 nt, Human adenovirus D
acagcggcagggugagccggc

SEQ ID NO: 1568877 - RNA, 15 nt, Human adenovirus D
cugcgcgagguugag

SEQ ID NO: 1568878 - RNA, 13 nt, Human adenovirus D
augaggcaggcca

SEQ ID NO: 1568879 - RNA, 13 nt, Human adenovirus D
ugccuuccaaaau

SEQ ID NO: 1568880 - RNA, 14 nt, Human adenovirus D
acuaggaccccagg

SEQ ID NO: 1568881 - RNA, 22 nt, Human adenovirus D
cgcccaggcgccauucggagca

SEQ ID NO: 1568882 - RNA, 18 nt, Human adenovirus D
ccacauccaagugcccca

SEQ ID NO: 1568883 - RNA, 15 nt, Human adenovirus D
uacagagauucagcc

SEQ ID NO: 1568884 - RNA, 14 nt, Human adenovirus D
ucgcuggcugcugg

SEQ ID NO: 1568885 - RNA, 21 nt, Human adenovirus D
cgcccagccagcaaacgccgc

SEQ ID NO: 1568886 - RNA, 21 nt, Human adenovirus D
ggcgcaggcgacccuggaggu

SEQ ID NO: 1568887 - RNA, 19 nt, Human adenovirus D
accucaaaaagcuguggac

SEQ ID NO: 1568888 - RNA, 22 nt, Human adenovirus D
ucacccggacguggugcugcug

SEQ ID NO: 1568889 - RNA, 11 nt, Human adenovirus D
aaagcaugguu

SEQ ID NO: 1568890 - RNA, 12 nt, Human adenovirus D
cagacagccagg

SEQ ID NO: 1568891 - RNA, 21 nt, Human adenovirus D
cacccagaccgugcaggggcc

SEQ ID NO: 1568892 - RNA, 13 nt, Human adenovirus D
accuuccugcagc

SEQ ID NO: 1568893 - RNA, 22 nt, Human adenovirus D
cggcaaucaacuacucggugcu

SEQ ID NO: 1568894 - RNA, 21 nt, Human adenovirus D
auaaaucugcccugauaucca

SEQ ID NO: 1568895 - RNA, 14 nt, Human adenovirus D
gagcuccucgaugc

SEQ ID NO: 1568896 - RNA, 23 nt, Human adenovirus D
gcauccugagauaugugcagcag

SEQ ID NO: 1568897 - RNA, 16 nt, Human adenovirus D
gaaaggcgggcugccc

SEQ ID NO: 1568898 - RNA, 13 nt, Human adenovirus D
gccaggguugaau

SEQ ID NO: 1568899 - RNA, 17 nt, Human adenovirus D
gccgcgccagacgcacg

SEQ ID NO: 1568900 - RNA, 16 nt, Human adenovirus D
agguggacgagccgcc

SEQ ID NO: 1568901 - RNA, 14 nt, Human adenovirus D
gcccaacaggccua

SEQ ID NO: 1568902 - RNA, 12 nt, Human adenovirus D
gcccacggccau

SEQ ID NO: 1568903 - RNA, 13 nt, Human adenovirus D
cugucggccgagg

SEQ ID NO: 1568904 - RNA, 21 nt, Human adenovirus D
cuaggggaagauggaggagca

SEQ ID NO: 1568905 - RNA, 18 nt, Human adenovirus D
acggcaucuuccuggggc

SEQ ID NO: 1568906 - RNA, 23 nt, Human adenovirus D
cugugacaugcaaaaucuuacac

SEQ ID NO: 1568907 - RNA, 16 nt, Human adenovirus D
gacaauucagagccag

SEQ ID NO: 1568908 - RNA, 17 nt, Human adenovirus D
ggacagcaagccucuga

SEQ ID NO: 1568909 - RNA, 13 nt, Human adenovirus D
aggcgcccaggcc

SEQ ID NO: 1568910 - RNA, 15 nt, Human adenovirus D
acuuuaaugcuccaa

SEQ ID NO: 1568911 - RNA, 18 nt, Human adenovirus D
ccggucucugcgcucgcu

SEQ ID NO: 1568912 - RNA, 14 nt, Human adenovirus D
ccucucggccgcca

SEQ ID NO: 1568913 - RNA, 15 nt, Human adenovirus D
gggcagcgagagggc

SEQ ID NO: 1568914 - RNA, 12 nt, Human adenovirus D
agcaauaccacc

SEQ ID NO: 1568915 - RNA, 21 nt, Human adenovirus D
ggcuuugcuggguugcuccuu

SEQ ID NO: 1568916 - RNA, 13 nt, Human adenovirus D
guuggcuugcaug

SEQ ID NO: 1568917 - RNA, 23 nt, Human adenovirus D
accuucuuuuugauacuaacacu

SEQ ID NO: 1568918 - RNA, 18 nt, Human adenovirus D
uagaaacagauccugcug

SEQ ID NO: 1568919 - RNA, 17 nt, Human adenovirus D
ucuuccuccguagccug

SEQ ID NO: 1568920 - RNA, 15 nt, Human adenovirus D
ugacgucauuugcau

SEQ ID NO: 1568921 - RNA, 21 nt, Human adenovirus D
aucggaucuuccccacucuuu

SEQ ID NO: 1568922 - RNA, 21 nt, Human adenovirus D
agggcugcacggaugagcgca

SEQ ID NO: 1568923 - RNA, 23 nt, Human adenovirus D
aggccgggcugcacgaccucgga

SEQ ID NO: 1568924 - RNA, 20 nt, Human adenovirus D
aagaaucacauuaaaggcug

SEQ ID NO: 1568925 - RNA, 17 nt, Human adenovirus D
gccuguccugcaggggc

SEQ ID NO: 1568926 - RNA, 14 nt, Human adenovirus D
cuuucggcgcuugg

SEQ ID NO: 1568927 - RNA, 22 nt, Human adenovirus D
gcuggcuugguacccgcgaccc

SEQ ID NO: 1568928 - RNA, 18 nt, Human adenovirus D
cggucgcgcgaagaggag

SEQ ID NO: 1568929 - RNA, 19 nt, Human adenovirus D
acccagaccgugcaggggc

SEQ ID NO: 1568930 - RNA, 11 nt, Human adenovirus D
gagcaacccaa

SEQ ID NO: 1568931 - RNA, 17 nt, Human adenovirus D
agguuugaguagugggc

SEQ ID NO: 1568932 - RNA, 23 nt, Human adenovirus D
ccccggacgucaccugcggcgcg

SEQ ID NO: 1568933 - RNA, 15 nt, Human adenovirus D
acacacgcccugggu

SEQ ID NO: 1568934 - RNA, 15 nt, Human adenovirus D
cagccaguggcccug

SEQ ID NO: 1568935 - RNA, 22 nt, Human adenovirus D
gucgccgcaccauccgcgccgc

SEQ ID NO: 1568936 - RNA, 18 nt, Human adenovirus D
caugcacccguaaaugac

SEQ ID NO: 1568937 - RNA, 23 nt, Human adenovirus D
gaauauccccuuccucacucccc

SEQ ID NO: 1568938 - RNA, 21 nt, Human adenovirus D
cucaggcgcaaccaggaggag

SEQ ID NO: 1568939 - RNA, 16 nt, Human adenovirus D
agacaaaggaggccac

SEQ ID NO: 1568940 - RNA, 14 nt, Human adenovirus D
agccaguggcccug

SEQ ID NO: 1568941 - RNA, 14 nt, Human adenovirus D
cugucggccgagga

SEQ ID NO: 1568942 - RNA, 18 nt, Human adenovirus D
ccuucuccacggggaggg

SEQ ID NO: 1568943 - RNA, 14 nt, Human adenovirus D
cacacuagaaagca

SEQ ID NO: 1568944 - RNA, 14 nt, Human adenovirus D
agaacgagggccug

SEQ ID NO: 1568945 - RNA, 19 nt, Human adenovirus D
ucacuuugguacuuacaaa

SEQ ID NO: 1568946 - RNA, 18 nt, Human adenovirus D
acucugcucauacugcua

SEQ ID NO: 1568947 - RNA, 17 nt, Human adenovirus D
aggggguuaggcagagc

SEQ ID NO: 1568948 - RNA, 12 nt, Human adenovirus D
cuuuggcaaaga

SEQ ID NO: 1568949 - RNA, 13 nt, Human adenovirus D
ccugggcucgcug

SEQ ID NO: 1568950 - RNA, 14 nt, Human adenovirus D
gucugccuggucau

SEQ ID NO: 1568951 - RNA, 23 nt, Human adenovirus D
cgcgaggccauaggccaggcgca

SEQ ID NO: 1568952 - RNA, 19 nt, Human adenovirus D
cgguggccccgacccacga

SEQ ID NO: 1568953 - RNA, 16 nt, Human adenovirus D
ucagcgaugagcagcu

SEQ ID NO: 1568954 - RNA, 22 nt, Human adenovirus D
aagcgccaggaggcggugcgca

SEQ ID NO: 1568955 - RNA, 18 nt, Human adenovirus D
ggcagcggggccuggugu

SEQ ID NO: 1568956 - RNA, 15 nt, Human adenovirus D
gccaaucgcagucgc

SEQ ID NO: 1568957 - RNA, 22 nt, Human adenovirus D
auaaguuaggguguaaguguga

SEQ ID NO: 1568958 - RNA, 18 nt, Human adenovirus D
guagggguugaggggcgg

SEQ ID NO: 1568959 - RNA, 14 nt, Human adenovirus D
aacgcgcgcugccc

SEQ ID NO: 1568960 - RNA, 19 nt, Human adenovirus D
cgagggucugcgagaggag

SEQ ID NO: 1568961 - RNA, 18 nt, Human adenovirus D
ucgcagacgagcggccgc

SEQ ID NO: 1568962 - RNA, 18 nt, Human adenovirus D
cucgguacccuccuccca

SEQ ID NO: 1568963 - RNA, 13 nt, Human adenovirus D
ccagaucacaugg

SEQ ID NO: 1568964 - RNA, 15 nt, Human adenovirus D
agcgcgagggcgaga

SEQ ID NO: 1568965 - RNA, 17 nt, Human adenovirus D
caugcccaaugugaacg

SEQ ID NO: 1568966 - RNA, 13 nt, Human adenovirus D
uguucagcagcac

SEQ ID NO: 1568967 - RNA, 18 nt, Human adenovirus D
ccggcuaccuugcaccca

SEQ ID NO: 1568968 - RNA, 20 nt, Human adenovirus D
cucgaucuccuccuccugga

SEQ ID NO: 1568969 - RNA, 21 nt, Human adenovirus D
caaaggagccauagagggcgu

SEQ ID NO: 1568970 - RNA, 13 nt, Human adenovirus D
acuggguggcccu

SEQ ID NO: 1568971 - RNA, 18 nt, Human adenovirus D
acgcugaaaggcgggcug

SEQ ID NO: 1568972 - RNA, 19 nt, Human adenovirus D
cugggugacagaaccagau

SEQ ID NO: 1568973 - RNA, 22 nt, Human adenovirus D
ugagcuugaaacgucccaggaa

SEQ ID NO: 1568974 - RNA, 20 nt, Human adenovirus D
ucguaccagaugcggcagua

SEQ ID NO: 1568975 - RNA, 20 nt, Human adenovirus D
gcuccacgguggcggcgagg

SEQ ID NO: 1568976 - RNA, 23 nt, Human adenovirus D
ggccacguugcgguacugguacu

SEQ ID NO: 1568977 - RNA, 21 nt, Human adenovirus D
ggugagccggccgcgcuugcu

SEQ ID NO: 1568978 - RNA, 23 nt, Human adenovirus D
aguacgacaugcccgaccccaac

SEQ ID NO: 1568979 - RNA, 22 nt, Human adenovirus D
ggccuacuacuccugaucagaa

SEQ ID NO: 1568980 - RNA, 13 nt, Human adenovirus D
uuaaaaaccaaaa

SEQ ID NO: 1568981 - RNA, 20 nt, Human adenovirus D
gcgccauugucaacacggcc

SEQ ID NO: 1568982 - RNA, 23 nt, Human adenovirus D
ggccuguccugcaggggcguccc

SEQ ID NO: 1568983 - RNA, 17 nt, Human adenovirus D
cgcgcccggggccaggu

SEQ ID NO: 1568984 - RNA, 21 nt, Human adenovirus D
gcuccguuguacgacaccacu

SEQ ID NO: 1568985 - RNA, 13 nt, Human adenovirus D
gcgccgcgccgcc

SEQ ID NO: 1568986 - RNA, 15 nt, Human adenovirus D
ucggggcauugcagg

SEQ ID NO: 1568987 - RNA, 21 nt, Human adenovirus D
gcaugaaggaagcccagagcu

SEQ ID NO: 1568988 - RNA, 19 nt, Human adenovirus D
gccuccccgcagaaaucag

SEQ ID NO: 1568989 - RNA, 14 nt, Human adenovirus D
cagcgccccgagga

SEQ ID NO: 1568990 - RNA, 12 nt, Human adenovirus D
aauccacacagu

SEQ ID NO: 1568991 - RNA, 16 nt, Human adenovirus D
ccaggccuggcccuga

SEQ ID NO: 1568992 - RNA, 17 nt, Human adenovirus D
cggaguaccugagcccg

SEQ ID NO: 1568993 - RNA, 13 nt, Human adenovirus D
acaagcuggccug

SEQ ID NO: 1568994 - RNA, 14 nt, Human adenovirus D
gccacuacagcuga

SEQ ID NO: 1568995 - RNA, 14 nt, Human adenovirus D
cauccacugcuccu

SEQ ID NO: 1568996 - RNA, 14 nt, Human adenovirus D
guggugucuuccuc

SEQ ID NO: 1568997 - RNA, 21 nt, Human adenovirus D
gucucugguguaguuguucag

SEQ ID NO: 1568998 - RNA, 14 nt, Human adenovirus D
cgcuggggcugcuc

SEQ ID NO: 1568999 - RNA, 22 nt, Human adenovirus D
uuugaggcggcggaugguggcg

SEQ ID NO: 1569000 - RNA, 19 nt, Human adenovirus D
cgcucuugucgcugaucug

SEQ ID NO: 1569001 - RNA, 21 nt, Human adenovirus D
aaccugugcucuccgcaccgc

SEQ ID NO: 1569002 - RNA, 17 nt, Human adenovirus D
gaccgcugucucagccu

SEQ ID NO: 1569003 - RNA, 14 nt, Human adenovirus D
accuuccuugcugg

SEQ ID NO: 1569004 - RNA, 23 nt, Human adenovirus D
ccgcaccgcuccuggucugcaac

SEQ ID NO: 1569005 - RNA, 17 nt, Human adenovirus D
gaucgccgcgacccgcg

SEQ ID NO: 1569006 - RNA, 19 nt, Human adenovirus D
uucaaggacaugcagcugc

SEQ ID NO: 1569007 - RNA, 16 nt, Human adenovirus D
agcugcgcggggccac

SEQ ID NO: 1569008 - RNA, 12 nt, Human adenovirus D
cagugcacgggc

SEQ ID NO: 1569009 - RNA, 22 nt, Human adenovirus D
ucacuccccccuuugucuccuc

SEQ ID NO: 1569010 - RNA, 14 nt, Human adenovirus D
ccucguucauccag

SEQ ID NO: 1569011 - RNA, 22 nt, Human adenovirus D
augaacacacugcccauauaca

SEQ ID NO: 1569012 - RNA, 14 nt, Human adenovirus D
gcggagcuugcccu

SEQ ID NO: 1569013 - RNA, 15 nt, Human adenovirus D
ccuucggcuggaacc

SEQ ID NO: 1569014 - RNA, 19 nt, Human adenovirus D
agaccaugugagccugggu

SEQ ID NO: 1569015 - RNA, 14 nt, Human adenovirus D
ccagcgcggccagc

SEQ ID NO: 1569016 - RNA, 22 nt, Human adenovirus D
gccgccugagcaaccuccuggg

SEQ ID NO: 1569017 - RNA, 20 nt, Human adenovirus D
ggcgaccagcucuggguccc

SEQ ID NO: 1569018 - RNA, 18 nt, Human adenovirus D
cuuaaggaaucuucuuuu

SEQ ID NO: 1569019 - RNA, 15 nt, Human adenovirus D
ggcgacgcaccggga

SEQ ID NO: 1569020 - RNA, 20 nt, Human adenovirus D
gcauguacgccgccaaccgg

SEQ ID NO: 1569021 - RNA, 20 nt, Human adenovirus D
aucacuuacuugaaaucuga

SEQ ID NO: 1569022 - RNA, 14 nt, Human adenovirus D
uaggcccagcagca

SEQ ID NO: 1569023 - RNA, 21 nt, Human adenovirus D
acucuguaggccauccccauc

SEQ ID NO: 1569024 - RNA, 16 nt, Human adenovirus D
gaccuggcggaggcca

SEQ ID NO: 1569025 - RNA, 11 nt, Human adenovirus D
gcgcccgcagc

SEQ ID NO: 1569026 - RNA, 22 nt, Human adenovirus D
gaccagaccaccuggugauggc

SEQ ID NO: 1569027 - RNA, 19 nt, Human adenovirus D
gugucuuccucuccuccuc

SEQ ID NO: 1569028 - RNA, 11 nt, Human adenovirus D
cguagccagaa

SEQ ID NO: 1569029 - RNA, 14 nt, Human adenovirus D
gacgacauccugga

SEQ ID NO: 1569030 - RNA, 14 nt, Human adenovirus D
cagggacaacgagg

SEQ ID NO: 1569031 - RNA, 23 nt, Human adenovirus D
cuggccgcgggcgccucccagga

SEQ ID NO: 1569032 - RNA, 15 nt, Human adenovirus D
ccgcgccagacgcac

SEQ ID NO: 1569033 - RNA, 21 nt, Human adenovirus D
acuccuucuuccgcaacuucc

SEQ ID NO: 1569034 - RNA, 14 nt, Human adenovirus D
aggaugucaacaug

SEQ ID NO: 1569035 - RNA, 15 nt, Human adenovirus D
cguggugcugcugcc

SEQ ID NO: 1569036 - RNA, 17 nt, Human adenovirus D
auuaaaaagcagcacag

SEQ ID NO: 1569037 - RNA, 20 nt, Human adenovirus D
cuccuccuguuacuguaaag

SEQ ID NO: 1569038 - RNA, 23 nt, Human adenovirus D
cuugacagcaccgccgcagccgc

SEQ ID NO: 1569039 - RNA, 13 nt, Human adenovirus D
agcugcgaggaga

SEQ ID NO: 1569040 - RNA, 15 nt, Human adenovirus D
gacgcucuagaggca

SEQ ID NO: 1569041 - RNA, 21 nt, Human adenovirus D
gccagccgcgguuaugcaggg

SEQ ID NO: 1569042 - RNA, 22 nt, Human adenovirus D
guacuacaacaguacuggcaac

SEQ ID NO: 1569043 - RNA, 14 nt, Human adenovirus D
gucugugccucucc

SEQ ID NO: 1569044 - RNA, 19 nt, Human adenovirus D
ccgugcaggggcccgacuc

SEQ ID NO: 1569045 - RNA, 12 nt, Human adenovirus D
cggccgccgccg

SEQ ID NO: 1569046 - RNA, 22 nt, Human adenovirus D
gagucaaguuugacagcagaaa

SEQ ID NO: 1569047 - RNA, 23 nt, Human adenovirus D
cuugagacucauccugcuggugc

SEQ ID NO: 1569048 - RNA, 13 nt, Human adenovirus D
uaaagccagcagc

SEQ ID NO: 1569049 - RNA, 13 nt, Human adenovirus D
gaagcccugguuu

SEQ ID NO: 1569050 - RNA, 22 nt, Human adenovirus D
cagcgcucguacccgcucacca

SEQ ID NO: 1569051 - RNA, 21 nt, Human adenovirus D
ggcggcgcugcaaagccagcc

SEQ ID NO: 1569052 - RNA, 11 nt, Human adenovirus D
agucuccuggu

SEQ ID NO: 1569053 - RNA, 13 nt, Human adenovirus D
agagcuugggcgc

SEQ ID NO: 1569054 - RNA, 15 nt, Human adenovirus D
caauaaacagcacuu

SEQ ID NO: 1569055 - RNA, 19 nt, Human adenovirus D
ucucgguguacaagauccu

SEQ ID NO: 1569056 - RNA, 17 nt, Human adenovirus D
gugcugcugccgagccg

SEQ ID NO: 1569057 - RNA, 13 nt, Human adenovirus D
augaaucgcgggc

SEQ ID NO: 1569058 - RNA, 18 nt, Human adenovirus D
aguauggugaucagccau

SEQ ID NO: 1569059 - RNA, 19 nt, Human adenovirus D
uuccgcaacuuccagccca

SEQ ID NO: 1569060 - RNA, 20 nt, Human adenovirus D
cugcagcauugucugccugg

SEQ ID NO: 1569061 - RNA, 12 nt, Human adenovirus D
ugacucuccuga

SEQ ID NO: 1569062 - RNA, 17 nt, Human adenovirus D
cacugcauggccucgug

SEQ ID NO: 1569063 - RNA, 19 nt, Human adenovirus D
ggcgagaggcgagcagcug

SEQ ID NO: 1569064 - RNA, 21 nt, Human adenovirus D
ucauccuuccaguacucccgg

SEQ ID NO: 1569065 - RNA, 17 nt, Human adenovirus D
ccaagaaacgucccagc

SEQ ID NO: 1569066 - RNA, 19 nt, Human adenovirus D
uagguucuucacccagcaa

SEQ ID NO: 1569067 - RNA, 22 nt, Human adenovirus D
caaauaaacuuuaucagccaga

SEQ ID NO: 1569068 - RNA, 23 nt, Human adenovirus D
ggacgccucggaguaccugagcc

SEQ ID NO: 1569069 - RNA, 11 nt, Human adenovirus D
uuugggcacug

SEQ ID NO: 1569070 - RNA, 23 nt, Human adenovirus D
cuacucggugcuuagccugggca

SEQ ID NO: 1569071 - RNA, 20 nt, Human adenovirus D
uucagcuccaguggggagga

SEQ ID NO: 1569072 - RNA, 22 nt, Human adenovirus D
augaaagcauacagagauucag

SEQ ID NO: 1569073 - RNA, 19 nt, Human adenovirus D
cuguguccgcgcucgguga

SEQ ID NO: 1569074 - RNA, 20 nt, Human adenovirus D
gacucgcagacgagcggccg

SEQ ID NO: 1569075 - RNA, 15 nt, Human adenovirus D
acggagggcagaaac

SEQ ID NO: 1569076 - RNA, 13 nt, Human adenovirus D
cgagcgccagcug

SEQ ID NO: 1569077 - RNA, 19 nt, Human adenovirus D
gcugcgcggggccacgacc

SEQ ID NO: 1569078 - RNA, 14 nt, Human adenovirus D
accugcuacauguu

SEQ ID NO: 1569079 - RNA, 19 nt, Human adenovirus D
cuaucgcucuuaucccaug

SEQ ID NO: 1569080 - RNA, 13 nt, Human adenovirus D
gacauggccagca

SEQ ID NO: 1569081 - RNA, 20 nt, Human adenovirus D
cggaggccaucgugcagaac

SEQ ID NO: 1569082 - RNA, 13 nt, Human adenovirus D
ggugcugcugccg

SEQ ID NO: 1569083 - RNA, 16 nt, Human adenovirus D
cagaaccaugaauaca

SEQ ID NO: 1569084 - RNA, 15 nt, Human adenovirus D
caguagaaggugagg

SEQ ID NO: 1569085 - RNA, 20 nt, Human adenovirus D
caccgccgcagccgcggcag

SEQ ID NO: 1569086 - RNA, 16 nt, Human adenovirus D
augaugaccgagcuga

SEQ ID NO: 1569087 - RNA, 23 nt, Human adenovirus D
ucacaguuauaccaccuccuccu

SEQ ID NO: 1569088 - RNA, 16 nt, Human adenovirus D
ugugguuuaugacuca

SEQ ID NO: 1569089 - RNA, 19 nt, Human adenovirus D
ccaugaaggggcucuugcu

SEQ ID NO: 1569090 - RNA, 15 nt, Human adenovirus D
ugguauccaugcccu

SEQ ID NO: 1569091 - RNA, 17 nt, Human adenovirus D
ucaacaucugugcugcc

SEQ ID NO: 1569092 - RNA, 21 nt, Human adenovirus D
auuguugggaggaaccaugaa

SEQ ID NO: 1569093 - RNA, 13 nt, Human adenovirus D
cccggacagcaag

SEQ ID NO: 1569094 - RNA, 22 nt, Human adenovirus D
acggcuuacaacagccuugccc

SEQ ID NO: 1569095 - RNA, 20 nt, Human adenovirus D
caggcccagaacuggcagag

SEQ ID NO: 1569096 - RNA, 19 nt, Human adenovirus D
aucgugguaaacgggcccu

SEQ ID NO: 1569097 - RNA, 12 nt, Human adenovirus D
aggcccagaacu

SEQ ID NO: 1569098 - RNA, 14 nt, Human adenovirus D
aucagacaugcugc

SEQ ID NO: 1569099 - RNA, 12 nt, Human adenovirus D
gcagcggcagga

SEQ ID NO: 1569100 - RNA, 15 nt, Human adenovirus D
cgucggaagaggagu

SEQ ID NO: 1569101 - RNA, 12 nt, Human adenovirus D
ugccgggacaga

SEQ ID NO: 1569102 - RNA, 19 nt, Human adenovirus D
cccuggccgaccggagcga

SEQ ID NO: 1569103 - RNA, 15 nt, Human adenovirus D
cgggggcagacacac

SEQ ID NO: 1569104 - RNA, 23 nt, Human adenovirus D
gcugaucaacaucuugcagagca

SEQ ID NO: 1569105 - RNA, 19 nt, Human adenovirus D
aauaggcacugaaaauuug

SEQ ID NO: 1569106 - RNA, 21 nt, Human adenovirus D
ccugaaggagcuggacaagcu

SEQ ID NO: 1569107 - RNA, 13 nt, Human adenovirus D
ucauguccaccug

SEQ ID NO: 1569108 - RNA, 13 nt, Human adenovirus D
guucugcccaccg

SEQ ID NO: 1569109 - RNA, 20 nt, Human adenovirus D
gagggcaaugcuagagugag

SEQ ID NO: 1569110 - RNA, 23 nt, Human adenovirus D
cgggccaugagggucuggagcuc

SEQ ID NO: 1569111 - RNA, 19 nt, Human adenovirus D
cgggguuguggacuuccgc

SEQ ID NO: 1569112 - RNA, 13 nt, Human adenovirus D
cugcgcggggcca

SEQ ID NO: 1569113 - RNA, 17 nt, Human adenovirus D
agccgcuaguggaagag

SEQ ID NO: 1569114 - RNA, 20 nt, Human adenovirus D
ccaggucacagucuggugga

SEQ ID NO: 1569115 - RNA, 15 nt, Human adenovirus D
auggcaagcugccau

SEQ ID NO: 1569116 - RNA, 17 nt, Human adenovirus D
ucucccaccaccagccc

SEQ ID NO: 1569117 - RNA, 16 nt, Human adenovirus D
cgagaucggcaccagc

SEQ ID NO: 1569118 - RNA, 24 nt, Human adenovirus D
ccggcgcacgucugacugccgccg

SEQ ID NO: 1569119 - RNA, 15 nt, Human adenovirus D
ccugacccagcaggu

SEQ ID NO: 1569120 - RNA, 22 nt, Human adenovirus D
caucagguuacauuccugcacc

SEQ ID NO: 1569121 - RNA, 22 nt, Human adenovirus D
gggugccagauugggggacgau

SEQ ID NO: 1569122 - RNA, 22 nt, Human adenovirus D
uggggcagaacgacaccgacag

SEQ ID NO: 1569123 - RNA, 19 nt, Human adenovirus D
cagaaguucaccugcaugg

SEQ ID NO: 1569124 - RNA, 21 nt, Human adenovirus D
ccaguagacaaagagcacagc

SEQ ID NO: 1569125 - RNA, 16 nt, Human adenovirus D
gcagguguccgagcuc

SEQ ID NO: 1569126 - RNA, 16 nt, Human adenovirus D
guccucccccgagcgc

SEQ ID NO: 1569127 - RNA, 20 nt, Human adenovirus D
aggaagugcggcggcggcug

SEQ ID NO: 1569128 - RNA, 19 nt, Human adenovirus D
acguguugcauccuuccau

SEQ ID NO: 1569129 - RNA, 17 nt, Human adenovirus D
gcucgcgggccaugagg

SEQ ID NO: 1569130 - RNA, 21 nt, Human adenovirus D
augccuucgugcacuggcccg

SEQ ID NO: 1569131 - RNA, 15 nt, Human adenovirus D
cagacaaacauccau

SEQ ID NO: 1569132 - RNA, 13 nt, Human adenovirus D
cgaggcagaggca

SEQ ID NO: 1569133 - RNA, 19 nt, Human adenovirus D
ucggggcauugcaggccgu

SEQ ID NO: 1569134 - RNA, 17 nt, Human adenovirus D
ccgcggaugcuggcgcg

SEQ ID NO: 1569135 - RNA, 19 nt, Human adenovirus D
agcgggaccggggaggcac

SEQ ID NO: 1569136 - RNA, 22 nt, Human adenovirus D
ccguccuuucgcugcugccgcu

SEQ ID NO: 1569137 - RNA, 15 nt, Human adenovirus D
ccgcgacccccaggc

SEQ ID NO: 1569138 - RNA, 17 nt, Human adenovirus D
gcuugaaacgucccagg

SEQ ID NO: 1569139 - RNA, 14 nt, Human adenovirus D
cugcugcuccacca

SEQ ID NO: 1569140 - RNA, 14 nt, Human adenovirus D
accgacauggaugu

SEQ ID NO: 1569141 - RNA, 19 nt, Human adenovirus D
cacaggaugaacaggagca

SEQ ID NO: 1569142 - RNA, 21 nt, Human adenovirus D
ggcacugcucuucccuggaga

SEQ ID NO: 1569143 - RNA, 13 nt, Human adenovirus D
ccacgguggcggc

SEQ ID NO: 1569144 - RNA, 14 nt, Human adenovirus D
gcaaggugcugaca

SEQ ID NO: 1569145 - RNA, 22 nt, Human adenovirus D
ggcgcacgucugacugccgccg

SEQ ID NO: 1569146 - RNA, 18 nt, Human adenovirus D
cgcgucauggcuggucag

SEQ ID NO: 1569147 - RNA, 20 nt, Human adenovirus D
gccgugcgccgcguccccgc

SEQ ID NO: 1569148 - RNA, 18 nt, Human adenovirus D
augccaagauagcccugc

SEQ ID NO: 1569149 - RNA, 22 nt, Human adenovirus D
cgaccuugcaaaagcgccagga

SEQ ID NO: 1569150 - RNA, 14 nt, Human adenovirus D
gccaacauuacuuc

SEQ ID NO: 1569151 - RNA, 17 nt, Human adenovirus D
uccacgagcgccagcug

SEQ ID NO: 1569152 - RNA, 23 nt, Human adenovirus D
aggcgcgcguccacgccaagaca

SEQ ID NO: 1569153 - RNA, 21 nt, Human adenovirus D
guacuuagaagagcccccucc

SEQ ID NO: 1569154 - RNA, 19 nt, Human adenovirus D
gcacaguuggcgacccagg

SEQ ID NO: 1569155 - RNA, 16 nt, Human adenovirus D
cgacaccaacgaccag

SEQ ID NO: 1569156 - RNA, 16 nt, Human adenovirus D
augccccaggccuggc

SEQ ID NO: 1569157 - RNA, 23 nt, Human adenovirus D
augggccuggccgcgggcgccuc

SEQ ID NO: 1569158 - RNA, 19 nt, Human adenovirus D
cccgagcucugcugcgccg

SEQ ID NO: 1569159 - RNA, 16 nt, Human adenovirus D
auccuuucccuggugg

SEQ ID NO: 1569160 - RNA, 19 nt, Human adenovirus D
gcgccgccaucgaacacgc

SEQ ID NO: 1569161 - RNA, 16 nt, Human adenovirus D
agcgccaacagcagcg

SEQ ID NO: 1569162 - RNA, 12 nt, Human adenovirus D
cagcagcccaua

SEQ ID NO: 1569163 - RNA, 22 nt, Human adenovirus D
ccauagcgugcguucucuuccu

SEQ ID NO: 1569164 - RNA, 15 nt, Human adenovirus D
cacuggcucgccuuc

SEQ ID NO: 1569165 - RNA, 16 nt, Human adenovirus D
cccaaaaacugcaugc

SEQ ID NO: 1569166 - RNA, 19 nt, Human adenovirus D
cauggccucgugcucuggg

SEQ ID NO: 1569167 - RNA, 22 nt, Human adenovirus D
cccgaugacggguugcaggugg

SEQ ID NO: 1569168 - RNA, 17 nt, Human adenovirus D
caacucuuccgccgccg

SEQ ID NO: 1569169 - RNA, 15 nt, Human adenovirus D
cccacagggcacugc

SEQ ID NO: 1569170 - RNA, 22 nt, Human adenovirus D
gcgagugcgggggcagacacac

SEQ ID NO: 1569171 - RNA, 13 nt, Human adenovirus D
gcagcucuucccg

SEQ ID NO: 1569172 - RNA, 18 nt, Human adenovirus D
acuaggaccccagggacc

SEQ ID NO: 1569173 - RNA, 22 nt, Human adenovirus D
uccugagauaugugcagcagag

SEQ ID NO: 1569174 - RNA, 15 nt, Human adenovirus D
cugacacaaaacuaa

SEQ ID NO: 1569175 - RNA, 19 nt, Human adenovirus D
cgcagcggggaggagcccg

SEQ ID NO: 1569176 - RNA, 20 nt, Human adenovirus D
aaagaucacuuacuugaaau

SEQ ID NO: 1569177 - RNA, 15 nt, Human adenovirus D
gggcgucaaccccau

SEQ ID NO: 1569178 - RNA, 13 nt, Human adenovirus D
acgcccgcuccac

SEQ ID NO: 1569179 - RNA, 17 nt, Human adenovirus D
cgucggcgucgcgcgcg

SEQ ID NO: 1569180 - RNA, 15 nt, Human adenovirus D
gucuggcacaucuuu

SEQ ID NO: 1569181 - RNA, 21 nt, Human adenovirus D
cguggccucuucgcccgaccg

SEQ ID NO: 1569182 - RNA, 18 nt, Human adenovirus D
caugaaggggcucuugcu

SEQ ID NO: 1569183 - RNA, 21 nt, Human adenovirus D
cucccaacucugguacuccag

SEQ ID NO: 1569184 - RNA, 15 nt, Human adenovirus D
aucuugcccacgucc

SEQ ID NO: 1569185 - RNA, 23 nt, Human adenovirus D
guccaugggcgccuucaccgacc

SEQ ID NO: 1569186 - RNA, 18 nt, Human adenovirus D
acggugaagcaggagcgc

SEQ ID NO: 1569187 - RNA, 17 nt, Human adenovirus D
gagcacagcaguacaag

SEQ ID NO: 1569188 - RNA, 19 nt, Human adenovirus D
uugagcuuguuuauguuga

SEQ ID NO: 1569189 - RNA, 14 nt, Human adenovirus D
cauccugcuggugc

SEQ ID NO: 1569190 - RNA, 16 nt, Human adenovirus D
ugccuuuaucagcacu

SEQ ID NO: 1569191 - RNA, 18 nt, Human adenovirus D
cgcaggcgcuggaagagg

SEQ ID NO: 1569192 - RNA, 22 nt, Human adenovirus D
caugcgacgcuuuuucagcgac

SEQ ID NO: 1569193 - RNA, 14 nt, Human adenovirus D
cccccagcuccuga

SEQ ID NO: 1569194 - RNA, 20 nt, Human adenovirus D
ccuugcccccaagggcgcuc

SEQ ID NO: 1569195 - RNA, 14 nt, Human adenovirus D
uccuggucacccuc

SEQ ID NO: 1569196 - RNA, 19 nt, Human adenovirus D
aaguguggaagucaaauau

SEQ ID NO: 1569197 - RNA, 15 nt, Human adenovirus D
uccccgcccgccgcc

SEQ ID NO: 1569198 - RNA, 23 nt, Human adenovirus D
gaccgcauccacaaggccgugag

SEQ ID NO: 1569199 - RNA, 17 nt, Human adenovirus D
cauguucaccagcaagu

SEQ ID NO: 1569200 - RNA, 20 nt, Human adenovirus D
ggcaugggucaggcagcggg

SEQ ID NO: 1569201 - RNA, 16 nt, Human adenovirus D
cggaccggucccagcg

SEQ ID NO: 1569202 - RNA, 13 nt, Human adenovirus D
cucuuugcccugc

SEQ ID NO: 1569203 - RNA, 16 nt, Human adenovirus D
caggccuggcccugac

SEQ ID NO: 1569204 - RNA, 16 nt, Human adenovirus D
gcacguacuuugacau

SEQ ID NO: 1569205 - RNA, 16 nt, Human adenovirus D
gcugcuagagugccac

SEQ ID NO: 1569206 - RNA, 11 nt, Human adenovirus D
ccuccacccug

SEQ ID NO: 1569207 - RNA, 19 nt, Human adenovirus D
gccaggauacgcgggaaga

SEQ ID NO: 1569208 - RNA, 14 nt, Human adenovirus D
cucgcuacugcuga

SEQ ID NO: 1569209 - RNA, 16 nt, Human adenovirus D
ccgcgcuugcugggcg

SEQ ID NO: 1569210 - RNA, 17 nt, Human adenovirus D
cuccgguugugcagccc

SEQ ID NO: 1569211 - RNA, 20 nt, Human adenovirus D
gagcucuuaccaaguccagg

SEQ ID NO: 1569212 - RNA, 19 nt, Human adenovirus D
ugcgcguccgucagcagca

SEQ ID NO: 1569213 - RNA, 15 nt, Human adenovirus D
ccggcggcagcggcg

SEQ ID NO: 1569214 - RNA, 19 nt, Human adenovirus D
uccgcacgguaagagccca

SEQ ID NO: 1569215 - RNA, 19 nt, Human adenovirus D
cgccgcuguggagccacug

SEQ ID NO: 1569216 - RNA, 15 nt, Human adenovirus D
cucggugcggcugcu

SEQ ID NO: 1569217 - RNA, 12 nt, Human adenovirus D
cuucgcccugcg

SEQ ID NO: 1569218 - RNA, 14 nt, Human adenovirus D
gcgagaaggcgcgc

SEQ ID NO: 1569219 - RNA, 15 nt, Human adenovirus D
gucuccgucacggug

SEQ ID NO: 1569220 - RNA, 19 nt, Human adenovirus D
cgcuggucacauccaucuc

SEQ ID NO: 1569221 - RNA, 18 nt, Human adenovirus D
ucgcuggcugcuggagcu

SEQ ID NO: 1569222 - RNA, 18 nt, Human adenovirus D
agucaaguuugacagcag

SEQ ID NO: 1569223 - RNA, 18 nt, Human adenovirus D
ggcaucucgauccagcag

SEQ ID NO: 1569224 - RNA, 20 nt, Human adenovirus D
uccaguaggaaccagcacac

SEQ ID NO: 1569225 - RNA, 13 nt, Human adenovirus D
caguaagugcagc

SEQ ID NO: 1569226 - RNA, 18 nt, Human adenovirus D
ggccauaaaucugcccug

SEQ ID NO: 1569227 - RNA, 19 nt, Human adenovirus D
uacacgguucucucagcac

SEQ ID NO: 1569228 - RNA, 23 nt, Human adenovirus D
ccggaccuaugggaacaaggccu

SEQ ID NO: 1569229 - RNA, 19 nt, Human adenovirus D
cagcgacgagacuggccuc

SEQ ID NO: 1569230 - RNA, 17 nt, Human adenovirus D
ggucacacuagcgcccu

SEQ ID NO: 1569231 - RNA, 18 nt, Human adenovirus D
cggcgcgagcugagcgac

SEQ ID NO: 1569232 - RNA, 22 nt, Human adenovirus D
gcuagagugaggcacugcucuu

SEQ ID NO: 1569233 - RNA, 23 nt, Human adenovirus D
cgagccgcgcgccgcgccgccac

SEQ ID NO: 1569234 - RNA, 22 nt, Human adenovirus D
gcagcguugagcucacccacuu

SEQ ID NO: 1569235 - RNA, 15 nt, Human adenovirus D
acgccaggcuggccg

SEQ ID NO: 1569236 - RNA, 20 nt, Human adenovirus D
gccacugccgcugcaaccug

SEQ ID NO: 1569237 - RNA, 23 nt, Human adenovirus D
gcccagcagcauguacggaggag

SEQ ID NO: 1569238 - RNA, 17 nt, Human adenovirus D
ccgugcgcuaccacccc

SEQ ID NO: 1569239 - RNA, 16 nt, Human adenovirus D
guggagcccgagguca

SEQ ID NO: 1569240 - RNA, 23 nt, Human adenovirus D
acaccgccuccacccuggaagcc

SEQ ID NO: 1569241 - RNA, 12 nt, Human adenovirus D
cugcugcuccac

SEQ ID NO: 1569242 - RNA, 23 nt, Human adenovirus D
ugggcccuugaacagcauauacc

SEQ ID NO: 1569243 - RNA, 14 nt, Human adenovirus D
ggccccgcgggcag

SEQ ID NO: 1569244 - RNA, 17 nt, Human adenovirus D
guggccuuguaccugcc

SEQ ID NO: 1569245 - RNA, 15 nt, Human adenovirus D
uccgcauccaagaag

SEQ ID NO: 1569246 - RNA, 18 nt, Human adenovirus D
ucaggagcgcagccugag

SEQ ID NO: 1569247 - RNA, 13 nt, Human adenovirus D
acgaugagaccaa

SEQ ID NO: 1569248 - RNA, 18 nt, Human adenovirus D
uggaagaagagcagcaca

SEQ ID NO: 1569249 - RNA, 15 nt, Human adenovirus D
guucaauggagagaa

SEQ ID NO: 1569250 - RNA, 14 nt, Human adenovirus D
aacucuuaaaucau

SEQ ID NO: 1569251 - RNA, 20 nt, Human adenovirus D
aaggugguggacggccuggc

SEQ ID NO: 1569252 - RNA, 22 nt, Human adenovirus D
gaggacuuaaccacccacgagc

SEQ ID NO: 1569253 - RNA, 13 nt, Human adenovirus D
gaauaaagccucu

SEQ ID NO: 1569254 - RNA, 15 nt, Human adenovirus D
cggcaccagccagcu

SEQ ID NO: 1569255 - RNA, 12 nt, Human adenovirus D
gacaucaugaac

SEQ ID NO: 1569256 - RNA, 19 nt, Human adenovirus D
aucccggccaaggccacca

SEQ ID NO: 1569257 - RNA, 17 nt, Human adenovirus D
ugauuucuacgggugag

SEQ ID NO: 1569258 - RNA, 13 nt, Human adenovirus D
caaagagccgcuc

SEQ ID NO: 1569259 - RNA, 15 nt, Human adenovirus D
ccuccguagccuggc

SEQ ID NO: 1569260 - RNA, 15 nt, Human adenovirus D
caagcagguggcgcc

SEQ ID NO: 1569261 - RNA, 23 nt, Human adenovirus D
guacuacgccagccgcaggcgcc

SEQ ID NO: 1569262 - RNA, 16 nt, Human adenovirus D
auucauaccaucaaug

SEQ ID NO: 1569263 - RNA, 21 nt, Human adenovirus D
guaggccacgugaccaggggu

SEQ ID NO: 1569264 - RNA, 12 nt, Human adenovirus D
auuaaaaaauua

SEQ ID NO: 1569265 - RNA, 16 nt, Human adenovirus D
acgucaccugcggcgc

SEQ ID NO: 1569266 - RNA, 13 nt, Human adenovirus D
gccgcgccagacg

SEQ ID NO: 1569267 - RNA, 18 nt, Human adenovirus D
uggaagagauggaagaag

SEQ ID NO: 1569268 - RNA, 13 nt, Human adenovirus D
caguguuugagaa

SEQ ID NO: 1569269 - RNA, 19 nt, Human adenovirus D
caagcuggugaugccaggg

SEQ ID NO: 1569270 - RNA, 19 nt, Human adenovirus D
auccugaucucugccaugu

SEQ ID NO: 1569271 - RNA, 12 nt, Human adenovirus D
gccgcaggccaa

SEQ ID NO: 1569272 - RNA, 17 nt, Human adenovirus D
ggcaagagucugaagcc

SEQ ID NO: 1569273 - RNA, 20 nt, Human adenovirus D
ccggcggcgcgagcugagcg

SEQ ID NO: 1569274 - RNA, 16 nt, Human adenovirus D
augugccuuaccgcca

SEQ ID NO: 1569275 - RNA, 12 nt, Human adenovirus D
aggccaggagga

SEQ ID NO: 1569276 - RNA, 22 nt, Human adenovirus D
cugcgcugcuucgcccgggaga

SEQ ID NO: 1569277 - RNA, 22 nt, Human adenovirus D
gaagcggugucgcggacgcgcu

SEQ ID NO: 1569278 - RNA, 17 nt, Human adenovirus D
cugcucuucccuggaga

SEQ ID NO: 1569279 - RNA, 15 nt, Human adenovirus D
gacauacaaaaaucg

SEQ ID NO: 1569280 - RNA, 15 nt, Human adenovirus D
cagcucugggucccc

SEQ ID NO: 1569281 - RNA, 18 nt, Human adenovirus D
gcucgcgccucaauguca

SEQ ID NO: 1569282 - RNA, 17 nt, Human adenovirus D
ccaguaggaaccagcac

SEQ ID NO: 1569283 - RNA, 20 nt, Human adenovirus D
cgacgaggauuucgagccga

SEQ ID NO: 1569284 - RNA, 18 nt, Human adenovirus D
gaggcauggcaggcagcg

SEQ ID NO: 1569285 - RNA, 14 nt, Human adenovirus D
aaguaggugaagaa

SEQ ID NO: 1569286 - RNA, 20 nt, Human adenovirus D
gcggccagaugcggaggaga

SEQ ID NO: 1569287 - RNA, 17 nt, Human adenovirus D
agccgcgcgcuggggca

SEQ ID NO: 1569288 - RNA, 15 nt, Human adenovirus D
cggugcccgcuccgc

SEQ ID NO: 1569289 - RNA, 14 nt, Human adenovirus D
acuagcgcccuggu

SEQ ID NO: 1569290 - RNA, 14 nt, Human adenovirus D
cugaaggagcugga

SEQ ID NO: 1569291 - RNA, 22 nt, Human adenovirus D
gucuuucucuuucucugccaca

SEQ ID NO: 1569292 - RNA, 16 nt, Human adenovirus D
cugugcuaaguguggu

SEQ ID NO: 1569293 - RNA, 14 nt, Human adenovirus D
aaggugugguuuau

SEQ ID NO: 1569294 - RNA, 18 nt, Human adenovirus D
gcagaagaagacgaaugg

SEQ ID NO: 1569295 - RNA, 13 nt, Human adenovirus D
cgucccaggaaac

SEQ ID NO: 1569296 - RNA, 21 nt, Human adenovirus D
gaccccuggcucccagccucc

SEQ ID NO: 1569297 - RNA, 22 nt, Human adenovirus D
gagcacgcccgccauggggcgc

SEQ ID NO: 1569298 - RNA, 19 nt, Human adenovirus D
gaaccgccgccggcggcgg

SEQ ID NO: 1569299 - RNA, 22 nt, Human adenovirus D
cccugggcauagucgcgccgcg

SEQ ID NO: 1569300 - RNA, 13 nt, Human adenovirus D
gauagccgccagg

SEQ ID NO: 1569301 - RNA, 16 nt, Human adenovirus D
gggaacggggcagagg

SEQ ID NO: 1569302 - RNA, 13 nt, Human adenovirus D
agccggcggcgcg

SEQ ID NO: 1569303 - RNA, 19 nt, Human adenovirus D
gcaacaggggauguugauc

SEQ ID NO: 1569304 - RNA, 18 nt, Human adenovirus D
cuaaagccaaacacaccu

SEQ ID NO: 1569305 - RNA, 17 nt, Human adenovirus D
cgacagucugagggcca

SEQ ID NO: 1569306 - RNA, 17 nt, Human adenovirus D
ucucggccaaucagcag

SEQ ID NO: 1569307 - RNA, 14 nt, Human adenovirus D
gcagccgccaugac

SEQ ID NO: 1569308 - RNA, 19 nt, Human adenovirus D
cugcagguggacgagccgc

SEQ ID NO: 1569309 - RNA, 22 nt, Human adenovirus D
agggcaucuucugccuggucaa

SEQ ID NO: 1569310 - RNA, 19 nt, Human adenovirus D
caugcgcaggcgccugagu

SEQ ID NO: 1569311 - RNA, 17 nt, Human adenovirus D
uuacuaggcccagcagc

SEQ ID NO: 1569312 - RNA, 14 nt, Human adenovirus D
gcuggagagcgaua

SEQ ID NO: 1569313 - RNA, 23 nt, Human adenovirus D
gcccguggucagcgaugagcagc

SEQ ID NO: 1569314 - RNA, 21 nt, Human adenovirus D
cacgcacgagaaggugcuggc

SEQ ID NO: 1569315 - RNA, 14 nt, Human adenovirus D
aggcgcuggaagag

SEQ ID NO: 1569316 - RNA, 16 nt, Human adenovirus D
caacagccacaugacc

SEQ ID NO: 1569317 - RNA, 22 nt, Human adenovirus D
ccuccuguuacuguaaagccac

SEQ ID NO: 1569318 - RNA, 19 nt, Human adenovirus D
acgcuguaccgcgaggcca

SEQ ID NO: 1569319 - RNA, 18 nt, Human adenovirus D
gcuguaccgcgaggccau

SEQ ID NO: 1569320 - RNA, 19 nt, Human adenovirus D
ccuccccgacccccuucca

SEQ ID NO: 1569321 - RNA, 16 nt, Human adenovirus D
cuaccgcugcgcagca

SEQ ID NO: 1569322 - RNA, 18 nt, Human adenovirus D
cugcuagagugccacugc

SEQ ID NO: 1569323 - RNA, 18 nt, Human adenovirus D
gccgcguaagcaggagca

SEQ ID NO: 1569324 - RNA, 20 nt, Human adenovirus D
cgggacuuggucaccccgcc

SEQ ID NO: 1569325 - RNA, 19 nt, Human adenovirus D
guguugcaugaugggaaug

SEQ ID NO: 1569326 - RNA, 15 nt, Human adenovirus D
gccucguccucuucc

SEQ ID NO: 1569327 - RNA, 16 nt, Human adenovirus D
ggugcgcacgcccgcg

SEQ ID NO: 1569328 - RNA, 15 nt, Human adenovirus D
gucagcugcaaaaag

SEQ ID NO: 1569329 - RNA, 17 nt, Human adenovirus D
ccgcuaccgcuuccacu

SEQ ID NO: 1569330 - RNA, 21 nt, Human adenovirus D
guccuucacucccaaccaggc

SEQ ID NO: 1569331 - RNA, 13 nt, Human adenovirus D
gaugagcugcgag

SEQ ID NO: 1569332 - RNA, 22 nt, Human adenovirus D
accaacggcugcauccacugcu

SEQ ID NO: 1569333 - RNA, 14 nt, Human adenovirus D
auucagagccaggg

SEQ ID NO: 1569334 - RNA, 21 nt, Human adenovirus D
ggagcuugcccuuggaagagc

SEQ ID NO: 1569335 - RNA, 13 nt, Human adenovirus D
uucgcugcugccg

SEQ ID NO: 1569336 - RNA, 22 nt, Human adenovirus D
aggcagcuccgguugugcagcc

SEQ ID NO: 1569337 - RNA, 20 nt, Human adenovirus D
cuccgcacauguugaaaagc

SEQ ID NO: 1569338 - RNA, 17 nt, Human adenovirus D
cucgaagauucuggaga

SEQ ID NO: 1569339 - RNA, 21 nt, Human adenovirus D
agauucaauaagguucugccc

SEQ ID NO: 1569340 - RNA, 13 nt, Human adenovirus D
aucgaggugcaga

SEQ ID NO: 1569341 - RNA, 19 nt, Human adenovirus D
uggccuuaaauaaggaaau

SEQ ID NO: 1569342 - RNA, 17 nt, Human adenovirus D
ugagguuagugccaaua

SEQ ID NO: 1569343 - RNA, 18 nt, Human adenovirus D
ggccacggggagccccuu

SEQ ID NO: 1569344 - RNA, 13 nt, Human adenovirus D
aucagacaugcug

SEQ ID NO: 1569345 - RNA, 16 nt, Human adenovirus D
gcaauaccaccccaug

SEQ ID NO: 1569346 - RNA, 17 nt, Human adenovirus D
cagcagaaaugggcccu

SEQ ID NO: 1569347 - RNA, 23 nt, Human adenovirus D
cgcguguugcggcccggcacggc

SEQ ID NO: 1569348 - RNA, 13 nt, Human adenovirus D
gucaggagcagcg

SEQ ID NO: 1569349 - RNA, 22 nt, Human adenovirus D
caacaccugggcacuggagcac

SEQ ID NO: 1569350 - RNA, 22 nt, Human adenovirus D
ggcggacugccaccgccgccgc

SEQ ID NO: 1569351 - RNA, 12 nt, Human adenovirus D
uuccugaugcag

SEQ ID NO: 1569352 - RNA, 18 nt, Human adenovirus D
cuugcaacuugcaaacaa

SEQ ID NO: 1569353 - RNA, 20 nt, Human adenovirus D
cccaggaauggcacgcucug

SEQ ID NO: 1569354 - RNA, 17 nt, Human adenovirus D
aggccgugaaggccggc

SEQ ID NO: 1569355 - RNA, 21 nt, Human adenovirus D
gcggggaggagcccgaggaga

SEQ ID NO: 1569356 - RNA, 11 nt, Human adenovirus D
uaugccagggu

SEQ ID NO: 1569357 - RNA, 14 nt, Human adenovirus D
ccugacgagccaaa

SEQ ID NO: 1569358 - RNA, 19 nt, Human adenovirus D
augcaucccguccugcgcc

SEQ ID NO: 1569359 - RNA, 13 nt, Human adenovirus D
ggcaccagccagc

SEQ ID NO: 1569360 - RNA, 18 nt, Human adenovirus D
gagcgugauggcgcaggc

SEQ ID NO: 1569361 - RNA, 15 nt, Human adenovirus D
cucgguugaggcacc

SEQ ID NO: 1569362 - RNA, 16 nt, Human adenovirus D
cagcacaaacgugcag

SEQ ID NO: 1569363 - RNA, 16 nt, Human adenovirus D
gccuggucaaacaggc

SEQ ID NO: 1569364 - RNA, 20 nt, Human adenovirus D
uggccuccagccuuuccaug

SEQ ID NO: 1569365 - RNA, 22 nt, Human adenovirus D
cagcagaaauuucaagcugggc

SEQ ID NO: 1569366 - RNA, 16 nt, Human adenovirus D
acguggugcugcugcc

SEQ ID NO: 1569367 - RNA, 20 nt, Human adenovirus D
cgcaguccgccaagcuccuc

SEQ ID NO: 1569368 - RNA, 16 nt, Human adenovirus D
caaucagccccuuccc

SEQ ID NO: 1569369 - RNA, 19 nt, Human adenovirus D
cgcgaggccauaggccagg

SEQ ID NO: 1569370 - RNA, 23 nt, Human adenovirus D
gcggccguccuuucgcugcugcc

SEQ ID NO: 1569371 - RNA, 15 nt, Human adenovirus D
cuggaagccaugcug

SEQ ID NO: 1569372 - RNA, 21 nt, Human adenovirus D
ggccuuaaauaaggaaauguu

SEQ ID NO: 1569373 - RNA, 16 nt, Human adenovirus D
ucaaaguaaaaaaccg

SEQ ID NO: 1569374 - RNA, 13 nt, Human adenovirus D
ggcgcuggaagag

SEQ ID NO: 1569375 - RNA, 21 nt, Human adenovirus D
gccccugagcggcugcacgag

SEQ ID NO: 1569376 - RNA, 19 nt, Human adenovirus D
agccggagugaugaauaug

SEQ ID NO: 1569377 - RNA, 16 nt, Human adenovirus D
gccuuguaccugcccg

SEQ ID NO: 1569378 - RNA, 17 nt, Human adenovirus D
gcuugcgcgcuggcuug

SEQ ID NO: 1569379 - RNA, 23 nt, Human adenovirus D
ugucacuagaggugguaaaauua

SEQ ID NO: 1569380 - RNA, 21 nt, Human adenovirus D
acucgugcgaggggccaagaa

SEQ ID NO: 1569381 - RNA, 13 nt, Human adenovirus D
accgaggugcccc

SEQ ID NO: 1569382 - RNA, 13 nt, Human adenovirus D
augaacaggagca

SEQ ID NO: 1569383 - RNA, 17 nt, Human adenovirus D
ggaggcgguccccgccc

SEQ ID NO: 1569384 - RNA, 20 nt, Human adenovirus D
gcgccucaaugucagcugca

SEQ ID NO: 1569385 - RNA, 18 nt, Human adenovirus D
acuuguaugugccuuacc

SEQ ID NO: 1569386 - RNA, 16 nt, Human adenovirus D
cacaguuggcgaccca

SEQ ID NO: 1569387 - RNA, 18 nt, Human adenovirus D
uccacgguggcggcgagg

SEQ ID NO: 1569388 - RNA, 16 nt, Human adenovirus D
gcuauaaaucuuuucu

SEQ ID NO: 1569389 - RNA, 15 nt, Human adenovirus D
gcaggcgacccugga

SEQ ID NO: 1569390 - RNA, 19 nt, Human adenovirus D
acagcuagacaccacagug

SEQ ID NO: 1569391 - RNA, 12 nt, Human adenovirus D
aucgcccaggcg

SEQ ID NO: 1569392 - RNA, 21 nt, Human adenovirus D
ucgagcauggcuaccugggag

SEQ ID NO: 1569393 - RNA, 23 nt, Human adenovirus D
agcuggaagcccugagccgccag

SEQ ID NO: 1569394 - RNA, 21 nt, Human adenovirus D
gaguucgcuccgcggcggcgc

SEQ ID NO: 1569395 - RNA, 20 nt, Human adenovirus D
uggagcacagaccuucaggg

SEQ ID NO: 1569396 - RNA, 13 nt, Human adenovirus D
ggccuguccugca

SEQ ID NO: 1569397 - RNA, 17 nt, Human adenovirus D
ucagcagucucugccgc

SEQ ID NO: 1569398 - RNA, 18 nt, Human adenovirus D
gaccugcgcgucgacggc

SEQ ID NO: 1569399 - RNA, 17 nt, Human adenovirus D
guguccgcgcucgguga

SEQ ID NO: 1569400 - RNA, 22 nt, Human adenovirus D
cauggccagcacguacuuugac

SEQ ID NO: 1569401 - RNA, 15 nt, Human adenovirus D
ccggcacggcggugg

SEQ ID NO: 1569402 - RNA, 19 nt, Human adenovirus D
caaaguuuuucaggggcuu

SEQ ID NO: 1569403 - RNA, 22 nt, Human adenovirus D
ccccgagaauuucaugaccagc

SEQ ID NO: 1569404 - RNA, 23 nt, Human adenovirus D
caaggccauccgucccgacgagg

SEQ ID NO: 1569405 - RNA, 20 nt, Human adenovirus D
cacaaaaaugaagcccugcu

SEQ ID NO: 1569406 - RNA, 22 nt, Human adenovirus D
gcucccacagugcccccuccac

SEQ ID NO: 1569407 - RNA, 18 nt, Human adenovirus D
uggccgcccugacccagc

SEQ ID NO: 1569408 - RNA, 14 nt, Human adenovirus D
gcgucgaggagcug

SEQ ID NO: 1569409 - RNA, 19 nt, Human adenovirus D
acuaaacuuuaugagggag

SEQ ID NO: 1569410 - RNA, 21 nt, Human adenovirus D
caucgugcgcgaccugggcug

SEQ ID NO: 1569411 - RNA, 11 nt, Human adenovirus D
ggcggagggug

SEQ ID NO: 1569412 - RNA, 19 nt, Human adenovirus D
gaagcccagagcucgcggg

SEQ ID NO: 1569413 - RNA, 21 nt, Human adenovirus D
cagcaagccucugacggcgca

SEQ ID NO: 1569414 - RNA, 17 nt, Human adenovirus D
ggguccugucacucaaa

SEQ ID NO: 1569415 - RNA, 21 nt, Human adenovirus D
agcugccaugggaggaagcaa

SEQ ID NO: 1569416 - RNA, 13 nt, Human adenovirus D
gccagcacguacu

SEQ ID NO: 1569417 - RNA, 21 nt, Human adenovirus D
acuacuuccgcgugacgcacu

SEQ ID NO: 1569418 - RNA, 16 nt, Human adenovirus D
cguuccaucagcacgu

SEQ ID NO: 1569419 - RNA, 16 nt, Human adenovirus D
gauggccuguaccggg

SEQ ID NO: 1569420 - RNA, 17 nt, Human adenovirus D
acaaagcugaaagcuau

SEQ ID NO: 1569421 - RNA, 14 nt, Human adenovirus D
agcuaauggacuac

SEQ ID NO: 1569422 - RNA, 22 nt, Human adenovirus D
ugggcgcuugcaagggugcgcu

SEQ ID NO: 1569423 - RNA, 20 nt, Human adenovirus D
gggguucauguugugcagga

SEQ ID NO: 1569424 - RNA, 16 nt, Human adenovirus D
augaccauagaccuga

SEQ ID NO: 1569425 - RNA, 14 nt, Human adenovirus D
gcgcaggcgcugga

SEQ ID NO: 1569426 - RNA, 12 nt, Human adenovirus D
acgaccugggcg

SEQ ID NO: 1569427 - RNA, 17 nt, Human adenovirus D
cugggcucgagcauggc

SEQ ID NO: 1569428 - RNA, 14 nt, Human adenovirus D
uauggucugcuccu

SEQ ID NO: 1569429 - RNA, 13 nt, Human adenovirus D
ccagccuccaccg

SEQ ID NO: 1569430 - RNA, 19 nt, Human adenovirus D
aagauggaggagcagccgc

SEQ ID NO: 1569431 - RNA, 21 nt, Human adenovirus D
agcagaggaagagggucacac

SEQ ID NO: 1569432 - RNA, 17 nt, Human adenovirus D
ggcuucaccggcuaccu

SEQ ID NO: 1569433 - RNA, 22 nt, Human adenovirus D
acuuaacucugauucaugugaa

SEQ ID NO: 1569434 - RNA, 13 nt, Human adenovirus D
cagcuggcccggc

SEQ ID NO: 1569435 - RNA, 22 nt, Human adenovirus D
gaaccucaaguaggugaagaaa

SEQ ID NO: 1569436 - RNA, 15 nt, Human adenovirus D
gaacuggcagagcac

SEQ ID NO: 1569437 - RNA, 17 nt, Human adenovirus D
ucggcggcguggcccuu

SEQ ID NO: 1569438 - RNA, 13 nt, Human adenovirus D
cuucgagcagugg

SEQ ID NO: 1569439 - RNA, 14 nt, Human adenovirus D
ggcgcaaccaggag

SEQ ID NO: 1569440 - RNA, 14 nt, Human adenovirus D
aauuuuuauuuccu

SEQ ID NO: 1569441 - RNA, 21 nt, Human adenovirus D
gcuccagccaaagcucauguu

SEQ ID NO: 1569442 - RNA, 16 nt, Human adenovirus D
caauguuacgcugccc

SEQ ID NO: 1569443 - RNA, 22 nt, Human adenovirus D
cuggacccuccgucggaagagg

SEQ ID NO: 1569444 - RNA, 23 nt, Human adenovirus D
agaccaugaccauagaccugaug

SEQ ID NO: 1569445 - RNA, 21 nt, Human adenovirus D
augccccacaucgaggcccuc

SEQ ID NO: 1569446 - RNA, 15 nt, Human adenovirus D
cacguggcggcggcc

SEQ ID NO: 1569447 - RNA, 20 nt, Human adenovirus D
cagcauguacggaggagcca

SEQ ID NO: 1569448 - RNA, 13 nt, Human adenovirus D
gacgguguagccc

SEQ ID NO: 1569449 - RNA, 14 nt, Human adenovirus D
caauguaacuaaac

SEQ ID NO: 1569450 - RNA, 19 nt, Human adenovirus D
ucaaacccuacucgggcac

SEQ ID NO: 1569451 - RNA, 12 nt, Human adenovirus D
guggccucuucg

SEQ ID NO: 1569452 - RNA, 14 nt, Human adenovirus D
aucagaaacacaga

SEQ ID NO: 1569453 - RNA, 13 nt, Human adenovirus D
accugcgcgggcu

SEQ ID NO: 1569454 - RNA, 17 nt, Human adenovirus D
gcccuugcgcgagcaga

SEQ ID NO: 1569455 - RNA, 18 nt, Human adenovirus D
augcaccuguggagggca

SEQ ID NO: 1569456 - RNA, 15 nt, Human adenovirus D
acgacauccuggacc

SEQ ID NO: 1569457 - RNA, 16 nt, Human adenovirus D
gacugauggccacggg

SEQ ID NO: 1569458 - RNA, 16 nt, Human adenovirus D
acaagucaaaagaaaa

SEQ ID NO: 1569459 - RNA, 14 nt, Human adenovirus D
ggcgggcagggagc

SEQ ID NO: 1569460 - RNA, 16 nt, Human adenovirus D
gggcguugcgggccga

SEQ ID NO: 1569461 - RNA, 21 nt, Human adenovirus D
cagucuccaacgccugcgcca

SEQ ID NO: 1569462 - RNA, 19 nt, Human adenovirus D
ccgcaacucguaccugggu

SEQ ID NO: 1569463 - RNA, 20 nt, Human adenovirus D
ucacauuaaaggcuggcccu

SEQ ID NO: 1569464 - RNA, 18 nt, Human adenovirus D
agaaacgucccagcagca

SEQ ID NO: 1569465 - RNA, 21 nt, Human adenovirus D
ugcaaacaauaaaaaacuuga

SEQ ID NO: 1569466 - RNA, 16 nt, Human adenovirus D
gcgcgaguucgcuccg

SEQ ID NO: 1569467 - RNA, 15 nt, Human adenovirus D
aaucaagacaaaauu

SEQ ID NO: 1569468 - RNA, 14 nt, Human adenovirus D
aguggggcggcaaa

SEQ ID NO: 1569469 - RNA, 14 nt, Human adenovirus D
ccgucagcagcagg

SEQ ID NO: 1569470 - RNA, 14 nt, Human adenovirus D
gcaggcgcuggaag

SEQ ID NO: 1569471 - RNA, 23 nt, Human adenovirus D
agcccaacggcaccugcgagccc

SEQ ID NO: 1569472 - RNA, 13 nt, Human adenovirus D
cggagcuggcucc

SEQ ID NO: 1569473 - RNA, 21 nt, Human adenovirus D
cacgcugguggccaccucgcc

SEQ ID NO: 1569474 - RNA, 19 nt, Human adenovirus D
gacgagguguacggcgacg

SEQ ID NO: 1569475 - RNA, 16 nt, Human adenovirus D
gaaagcuauaaaaaug

SEQ ID NO: 1569476 - RNA, 16 nt, Human adenovirus D
cugugccucuccauca

SEQ ID NO: 1569477 - RNA, 19 nt, Human adenovirus D
guacgaggccaugcugcgc

SEQ ID NO: 1569478 - RNA, 17 nt, Human adenovirus D
cgcgaagauggccaccc

SEQ ID NO: 1569479 - RNA, 13 nt, Human adenovirus D
uggagggcugucc

SEQ ID NO: 1569480 - RNA, 13 nt, Human adenovirus D
gaucgcgaggaca

SEQ ID NO: 1569481 - RNA, 11 nt, Human adenovirus D
ccagaauucaa

SEQ ID NO: 1569482 - RNA, 16 nt, Human adenovirus D
ccaggcagugcagcgc

SEQ ID NO: 1569483 - RNA, 12 nt, Human adenovirus D
gcuggcccugcu

SEQ ID NO: 1569484 - RNA, 12 nt, Human adenovirus D
ugggaugcugcc

SEQ ID NO: 1569485 - RNA, 17 nt, Human adenovirus D
cgaguuggaggagaugg

SEQ ID NO: 1569486 - RNA, 14 nt, Human adenovirus D
agccggcggcgcga

SEQ ID NO: 1569487 - RNA, 17 nt, Human adenovirus D
uccugcugcuccaccac

SEQ ID NO: 1569488 - RNA, 23 nt, Human adenovirus D
uccaguuacgggagcgagccccc

SEQ ID NO: 1569489 - RNA, 18 nt, Human adenovirus D
gccugggcucgcuggugg

SEQ ID NO: 1569490 - RNA, 15 nt, Human adenovirus D
acgcgccggggccgc

SEQ ID NO: 1569491 - RNA, 22 nt, Human adenovirus D
uugaugcgcuucuuaccucgcg

SEQ ID NO: 1569492 - RNA, 16 nt, Human adenovirus D
accaggacgguguagc

SEQ ID NO: 1569493 - RNA, 13 nt, Human adenovirus D
aggaggagacuga

SEQ ID NO: 1569494 - RNA, 19 nt, Human adenovirus D
gcgauguugccacccagau

SEQ ID NO: 1569495 - RNA, 16 nt, Human adenovirus D
guaaugaaacccgcca

SEQ ID NO: 1569496 - RNA, 14 nt, Human adenovirus D
gcacagcagggaca

SEQ ID NO: 1569497 - RNA, 23 nt, Human adenovirus D
gccaagaaacgucccagcagcac

SEQ ID NO: 1569498 - RNA, 16 nt, Human adenovirus D
ggacgacguggacagc

SEQ ID NO: 1569499 - RNA, 22 nt, Human adenovirus D
gcguggcccuuggcgcggagcu

SEQ ID NO: 1569500 - RNA, 17 nt, Human adenovirus D
agaacauguucuacgcc

SEQ ID NO: 1569501 - RNA, 20 nt, Human adenovirus D
cauagcuuccguugcgcugc

SEQ ID NO: 1569502 - RNA, 19 nt, Human adenovirus D
gcaaagcgguugagcuggg

SEQ ID NO: 1569503 - RNA, 15 nt, Human adenovirus D
ugaaagcauacagag

SEQ ID NO: 1569504 - RNA, 20 nt, Human adenovirus D
gcuggcugaaucccacuccc

SEQ ID NO: 1569505 - RNA, 15 nt, Human adenovirus D
cuccggguucuggag

SEQ ID NO: 1569506 - RNA, 21 nt, Human adenovirus D
gaccaggcggcagagcgggcg

SEQ ID NO: 1569507 - RNA, 18 nt, Human adenovirus D
ggacgggcgcccagugcu

SEQ ID NO: 1569508 - RNA, 19 nt, Human adenovirus D
ugggcuauaauaagcagag

SEQ ID NO: 1569509 - RNA, 16 nt, Human adenovirus D
cagcauguacggagga

SEQ ID NO: 1569510 - RNA, 18 nt, Human adenovirus D
ugcugauugcucuggccu

SEQ ID NO: 1569511 - RNA, 22 nt, Human adenovirus D
accugcauuggcagccgagccg

SEQ ID NO: 1569512 - RNA, 23 nt, Human adenovirus D
cgccaagacaaaggaggccacgu

SEQ ID NO: 1569513 - RNA, 22 nt, Human adenovirus D
gaagcccugagccgccagcugg

SEQ ID NO: 1569514 - RNA, 23 nt, Human adenovirus D
gccgcugcaaccugugcucuccg

SEQ ID NO: 1569515 - RNA, 21 nt, Human adenovirus D
cagccgucuggacccgcggcc

SEQ ID NO: 1569516 - RNA, 17 nt, Human adenovirus D
ccucgcgucuccaugag

SEQ ID NO: 1569517 - RNA, 23 nt, Human adenovirus D
gaugauguccuugaggaggagac

SEQ ID NO: 1569518 - RNA, 19 nt, Human adenovirus D
cuggagacgggcugcuucu

SEQ ID NO: 1569519 - RNA, 14 nt, Human adenovirus D
ggccgaggaggagc

SEQ ID NO: 1569520 - RNA, 21 nt, Human adenovirus D
aggugcugccccaggcggugc

SEQ ID NO: 1569521 - RNA, 20 nt, Human adenovirus D
agauagugcuuacucuauaa

SEQ ID NO: 1569522 - RNA, 14 nt, Human adenovirus D
ucuccauccccucg

SEQ ID NO: 1569523 - RNA, 16 nt, Human adenovirus D
aucuacaagagagaug

SEQ ID NO: 1569524 - RNA, 14 nt, Human adenovirus D
gcaggccaggagga

SEQ ID NO: 1569525 - RNA, 14 nt, Human adenovirus D
acaugacccugcau

SEQ ID NO: 1569526 - RNA, 19 nt, Human adenovirus D
agccacagccacagacaga

SEQ ID NO: 1569527 - RNA, 18 nt, Human adenovirus D
acauccucuucugucucu

SEQ ID NO: 1569528 - RNA, 22 nt, Human adenovirus D
ggcacugcucuucccuggagac

SEQ ID NO: 1569529 - RNA, 13 nt, Human adenovirus D
ccuucgagcugca

SEQ ID NO: 1569530 - RNA, 16 nt, Human adenovirus D
acgagacgcgcgcggc

SEQ ID NO: 1569531 - RNA, 12 nt, Human adenovirus D
ccccuggcuccc

SEQ ID NO: 1569532 - RNA, 21 nt, Human adenovirus D
cugacauccauggccagggga

SEQ ID NO: 1569533 - RNA, 12 nt, Human adenovirus D
cacagugcagaa

SEQ ID NO: 1569534 - RNA, 20 nt, Human adenovirus D
acaguagucaucaaaugcga

SEQ ID NO: 1569535 - RNA, 14 nt, Human adenovirus D
acggcgggcugacg

SEQ ID NO: 1569536 - RNA, 20 nt, Human adenovirus D
ucucccaggcuuucaucucg

SEQ ID NO: 1569537 - RNA, 22 nt, Human adenovirus D
gagaucaacuacaaggacuaca

SEQ ID NO: 1569538 - RNA, 20 nt, Human adenovirus D
ccacgaugugaccacggacc

SEQ ID NO: 1569539 - RNA, 16 nt, Human adenovirus D
aucucgcugccgcugg

SEQ ID NO: 1569540 - RNA, 16 nt, Human adenovirus D
ggcccagaacuggcag

SEQ ID NO: 1569541 - RNA, 18 nt, Human adenovirus D
agacgcaggccaggagga

SEQ ID NO: 1569542 - RNA, 21 nt, Human adenovirus D
ugcacaguauugugggccugg

SEQ ID NO: 1569543 - RNA, 22 nt, Human adenovirus D
ugugaccacggaccggucccag

SEQ ID NO: 1569544 - RNA, 14 nt, Human adenovirus D
cgccugcuugcaag

SEQ ID NO: 1569545 - RNA, 14 nt, Human adenovirus D
acuggguggcccuu

SEQ ID NO: 1569546 - RNA, 20 nt, Human adenovirus D
cgcgguaacguuccaucagc

SEQ ID NO: 1569547 - RNA, 16 nt, Human adenovirus D
aaugucaggucugcug

SEQ ID NO: 1569548 - RNA, 15 nt, Human adenovirus D
gacaacagccgcagg

SEQ ID NO: 1569549 - RNA, 20 nt, Human adenovirus D
ucgaucaucuccccgcggcg

SEQ ID NO: 1569550 - RNA, 15 nt, Human adenovirus D
gcgccgacgcgcucc

SEQ ID NO: 1569551 - RNA, 17 nt, Human adenovirus D
cgaugaaagucaggagc

SEQ ID NO: 1569552 - RNA, 23 nt, Human adenovirus D
gcgcugcccguucucgcugguca

SEQ ID NO: 1569553 - RNA, 21 nt, Human adenovirus D
cuacggcaucucgauccagca

SEQ ID NO: 1569554 - RNA, 14 nt, Human adenovirus D
gcucgcgcccguag

SEQ ID NO: 1569555 - RNA, 20 nt, Human adenovirus D
ccucgaugaugccgcagugg

SEQ ID NO: 1569556 - RNA, 18 nt, Human adenovirus D
ugagacucauccugcugg

SEQ ID NO: 1569557 - RNA, 16 nt, Human adenovirus D
ucgcccgggagagcug

SEQ ID NO: 1569558 - RNA, 21 nt, Human adenovirus D
cuucuuccggcaaaaaucaca

SEQ ID NO: 1569559 - RNA, 14 nt, Human adenovirus D
cucgucuuccagga

SEQ ID NO: 1569560 - RNA, 23 nt, Human adenovirus D
auguucucacaguaagugcagca

SEQ ID NO: 1569561 - RNA, 20 nt, Human adenovirus D
gccaucaagaaccugcuccu

SEQ ID NO: 1569562 - RNA, 23 nt, Human adenovirus D
cgggccaugaugcgagccgcgcg

SEQ ID NO: 1569563 - RNA, 17 nt, Human adenovirus D
cuagacuucauggcuug

SEQ ID NO: 1569564 - RNA, 18 nt, Human adenovirus D
auguuauucagcagccca

SEQ ID NO: 1569565 - RNA, 17 nt, Human adenovirus D
caugagcggcuccagcg

SEQ ID NO: 1569566 - RNA, 22 nt, Human adenovirus D
cggcaaaauggcgugcuggaga

SEQ ID NO: 1569567 - RNA, 12 nt, Human adenovirus D
ccccaggccugg

SEQ ID NO: 1569568 - RNA, 12 nt, Human adenovirus D
caagucaaaaga

SEQ ID NO: 1569569 - RNA, 20 nt, Human adenovirus D
auccuccaggacuaucuaug

SEQ ID NO: 1569570 - RNA, 20 nt, Human adenovirus D
acgacugcgacuguagggca

SEQ ID NO: 1569571 - RNA, 18 nt, Human adenovirus D
uccgcagugggcgcagac

SEQ ID NO: 1569572 - RNA, 22 nt, Human adenovirus D
cugguggaaacagacagccagg

SEQ ID NO: 1569573 - RNA, 13 nt, Human adenovirus D
ggccaaggccacc

SEQ ID NO: 1569574 - RNA, 21 nt, Human adenovirus D
cuucccggugcccgcuccgcc

SEQ ID NO: 1569575 - RNA, 15 nt, Human adenovirus D
agaccuuccaggaga

SEQ ID NO: 1569576 - RNA, 20 nt, Human adenovirus D
gcagccugagcuuggccgag

SEQ ID NO: 1569577 - RNA, 20 nt, Human adenovirus D
accaccuggugauggccugu

SEQ ID NO: 1569578 - RNA, 12 nt, Human adenovirus D
acaaggcgcgcu

SEQ ID NO: 1569579 - RNA, 21 nt, Human adenovirus D
cgcgcccuucaccgacagugg

SEQ ID NO: 1569580 - RNA, 18 nt, Human adenovirus D
cugcgcguccgucagcag

SEQ ID NO: 1569581 - RNA, 20 nt, Human adenovirus D
caugacccugcauggcugcg

SEQ ID NO: 1569582 - RNA, 14 nt, Human adenovirus D
agagagaggaagga

SEQ ID NO: 1569583 - RNA, 14 nt, Human adenovirus D
cucuucgcccgacc

SEQ ID NO: 1569584 - RNA, 19 nt, Human adenovirus D
gcacgguaagagcccagca

SEQ ID NO: 1569585 - RNA, 19 nt, Human adenovirus D
cucggccaaucagcaguag

SEQ ID NO: 1569586 - RNA, 17 nt, Human adenovirus D
cacaggugcugcccacc

SEQ ID NO: 1569587 - RNA, 15 nt, Human adenovirus D
cccagcaagucagca

SEQ ID NO: 1569588 - RNA, 16 nt, Human adenovirus D
gccuuaccgccagaga

SEQ ID NO: 1569589 - RNA, 19 nt, Human adenovirus D
ccgacgcgcuccucgcucu

SEQ ID NO: 1569590 - RNA, 15 nt, Human adenovirus D
cugcuguaaagccag

SEQ ID NO: 1569591 - RNA, 22 nt, Human adenovirus D
aggagcugaucucgcugccgcu

SEQ ID NO: 1569592 - RNA, 22 nt, Human adenovirus D
gugcgucgagcacagcaccgca

SEQ ID NO: 1569593 - RNA, 21 nt, Human adenovirus D
aguggcaacaccugggcacug

SEQ ID NO: 1569594 - RNA, 13 nt, Human adenovirus D
cagcgagaggagc

SEQ ID NO: 1569595 - RNA, 14 nt, Human adenovirus D
aagaacauccaugu

SEQ ID NO: 1569596 - RNA, 17 nt, Human adenovirus D
cagccgucuggacccgc

SEQ ID NO: 1569597 - RNA, 20 nt, Human adenovirus D
uuccaccucggugcagccgu

SEQ ID NO: 1569598 - RNA, 14 nt, Human adenovirus D
ccuacgguccagag

SEQ ID NO: 1569599 - RNA, 13 nt, Human adenovirus D
ccgcugugcuggu

SEQ ID NO: 1569600 - RNA, 19 nt, Human adenovirus D
gagaaccgccuggggcaga

SEQ ID NO: 1569601 - RNA, 22 nt, Human adenovirus D
gacagugcuccacucgacccug

SEQ ID NO: 1569602 - RNA, 14 nt, Human adenovirus D
gcugcugccgagcc

SEQ ID NO: 1569603 - RNA, 14 nt, Human adenovirus D
gcgagaagcggccg

SEQ ID NO: 1569604 - RNA, 17 nt, Human adenovirus D
gcacucauccaugauga

SEQ ID NO: 1569605 - RNA, 19 nt, Human adenovirus D
ccgagggucgcuggcugcu

SEQ ID NO: 1569606 - RNA, 23 nt, Human adenovirus D
gaggcgggugagggcgugcuuga

SEQ ID NO: 1569607 - RNA, 17 nt, Human adenovirus D
uggcucagcugccaugg

SEQ ID NO: 1569608 - RNA, 21 nt, Human adenovirus D
acguggugcugcugccgggcu

SEQ ID NO: 1569609 - RNA, 13 nt, Human adenovirus D
caccagccagcug

SEQ ID NO: 1569610 - RNA, 16 nt, Human adenovirus D
cugcaagugcacagac

SEQ ID NO: 1569611 - RNA, 16 nt, Human adenovirus D
gaggacuaccacgccc

SEQ ID NO: 1569612 - RNA, 16 nt, Human adenovirus D
accugaccuugcagag

SEQ ID NO: 1569613 - RNA, 18 nt, Human adenovirus D
uaugacacgcgcacacuu

SEQ ID NO: 1569614 - RNA, 17 nt, Human adenovirus D
uccggugaugccuucca

SEQ ID NO: 1569615 - RNA, 17 nt, Human adenovirus D
caaccuccaggccaacc

SEQ ID NO: 1569616 - RNA, 15 nt, Human adenovirus D
aguggcccuggaugu

SEQ ID NO: 1569617 - RNA, 21 nt, Human adenovirus D
aggucagcagcaagagcucaa

SEQ ID NO: 1569618 - RNA, 13 nt, Human adenovirus D
cccaacaauaaaa

SEQ ID NO: 1569619 - RNA, 20 nt, Human adenovirus D
cacugaaaaugucaaccuug

SEQ ID NO: 1569620 - RNA, 22 nt, Human adenovirus D
ccagcaugccgaagaagaacag

SEQ ID NO: 1569621 - RNA, 15 nt, Human adenovirus D
gggcguagagcuugg

SEQ ID NO: 1569622 - RNA, 16 nt, Human adenovirus D
ugaaaaaauugaggac

SEQ ID NO: 1569623 - RNA, 21 nt, Human adenovirus D
ugcugccgcucagucauccaa

SEQ ID NO: 1569624 - RNA, 12 nt, Human adenovirus D
cauguccaccug

SEQ ID NO: 1569625 - RNA, 20 nt, Human adenovirus D
gugcugcugaaacaccugca

SEQ ID NO: 1569626 - RNA, 17 nt, Human adenovirus D
guaccagucgggcccgg

SEQ ID NO: 1569627 - RNA, 17 nt, Human adenovirus D
cucguuaguccagcaga

SEQ ID NO: 1569628 - RNA, 17 nt, Human adenovirus D
guaagugcaguuggcca

SEQ ID NO: 1569629 - RNA, 18 nt, Human adenovirus D
acccuacucgggcacggc

SEQ ID NO: 1569630 - RNA, 18 nt, Human adenovirus D
gccaaccuggugacggcc

SEQ ID NO: 1569631 - RNA, 14 nt, Human adenovirus D
cagcaucgccucac

SEQ ID NO: 1569632 - RNA, 15 nt, Human adenovirus D
cucgcuacugcugau

SEQ ID NO: 1569633 - RNA, 21 nt, Human adenovirus D
agcccccuuuuuucuuuuugc

SEQ ID NO: 1569634 - RNA, 12 nt, Human adenovirus D
ucugcgagagga

SEQ ID NO: 1569635 - RNA, 21 nt, Human adenovirus D
cgaggagcugagaccagacca

SEQ ID NO: 1569636 - RNA, 22 nt, Human adenovirus D
cgagcuacaugcccagcagcag

SEQ ID NO: 1569637 - RNA, 19 nt, Human adenovirus D
accuaugggaacaaggccu

SEQ ID NO: 1569638 - RNA, 20 nt, Human adenovirus D
caaaacuaauuacagucacu

SEQ ID NO: 1569639 - RNA, 13 nt, Human adenovirus D
cagaccgugcagg

SEQ ID NO: 1569640 - RNA, 14 nt, Human adenovirus D
ggucgcgguggggc

SEQ ID NO: 1569641 - RNA, 20 nt, Human adenovirus D
aaaaacccucgaccagcauc

SEQ ID NO: 1569642 - RNA, 17 nt, Human adenovirus D
cauacaaagcugaaagc

SEQ ID NO: 1569643 - RNA, 12 nt, Human adenovirus D
ccacuccgcaca

SEQ ID NO: 1569644 - RNA, 21 nt, Human adenovirus D
aggcaccaucacaggaggcac

SEQ ID NO: 1569645 - RNA, 22 nt, Human adenovirus D
cgggcggacggaucgcccaggc

SEQ ID NO: 1569646 - RNA, 13 nt, Human adenovirus D
cuacaugcccagc

SEQ ID NO: 1569647 - RNA, 17 nt, Human adenovirus D
cagaugguagcagcaga

SEQ ID NO: 1569648 - RNA, 19 nt, Human adenovirus D
gcauagucacacuuaguuc

SEQ ID NO: 1569649 - RNA, 15 nt, Human adenovirus D
agcaaacgccgccgc

SEQ ID NO: 1569650 - RNA, 19 nt, Human adenovirus D
gcgacccaugagcugcgag

SEQ ID NO: 1569651 - RNA, 18 nt, Human adenovirus D
agcugcgcgagggccugg

SEQ ID NO: 1569652 - RNA, 21 nt, Human adenovirus D
gccaaacacaccugacacaaa

SEQ ID NO: 1569653 - RNA, 12 nt, Human adenovirus D
gugaggcacugc

SEQ ID NO: 1569654 - RNA, 20 nt, Human adenovirus D
accuugcagagcagcucuuc

SEQ ID NO: 1569655 - RNA, 16 nt, Human adenovirus D
aagcugaggauggcaa

SEQ ID NO: 1569656 - RNA, 15 nt, Human adenovirus D
cgcgcuggcggagaa

SEQ ID NO: 1569657 - RNA, 13 nt, Human adenovirus D
cugacgacccgca

SEQ ID NO: 1569658 - RNA, 23 nt, Human adenovirus D
cagcccagggcgcacuacagccg

SEQ ID NO: 1569659 - RNA, 14 nt, Human adenovirus D
ggcgcccagccagc

SEQ ID NO: 1569660 - RNA, 23 nt, Human adenovirus D
ucuugcaugccuucgugcacugg

SEQ ID NO: 1569661 - RNA, 21 nt, Human adenovirus D
gugaagcccugguuucaucau

SEQ ID NO: 1569662 - RNA, 13 nt, Human adenovirus D
cgagccaggugag

SEQ ID NO: 1569663 - RNA, 22 nt, Human adenovirus D
ccccugcaagugcacagaccca

SEQ ID NO: 1569664 - RNA, 15 nt, Human adenovirus D
cugaaacaccugcag

SEQ ID NO: 1569665 - RNA, 13 nt, Human adenovirus D
ggaugcagccagu

SEQ ID NO: 1569666 - RNA, 18 nt, Human adenovirus D
cagaauucaaccacaccu

SEQ ID NO: 1569667 - RNA, 15 nt, Human adenovirus D
caccuucaagaaagu

SEQ ID NO: 1569668 - RNA, 20 nt, Human adenovirus D
ccgcacuggcuuccgccgcc

SEQ ID NO: 1569669 - RNA, 14 nt, Human adenovirus D
aauucagagccagg

SEQ ID NO: 1569670 - RNA, 14 nt, Human adenovirus D
ucaagugccacaug

SEQ ID NO: 1569671 - RNA, 24 nt, Human adenovirus D
cggcggucaccucaacgcccaggc

SEQ ID NO: 1569672 - RNA, 12 nt, Human adenovirus D
cuaccugggagg

SEQ ID NO: 1569673 - RNA, 16 nt, Human adenovirus D
caccgcauccugaucu

SEQ ID NO: 1569674 - RNA, 20 nt, Human adenovirus D
cccggcaacgaccggcugcu

SEQ ID NO: 1569675 - RNA, 20 nt, Human adenovirus D
gccucgagcuacaugcccag

SEQ ID NO: 1569676 - RNA, 21 nt, Human adenovirus D
gccugcgucaucacccagggc

SEQ ID NO: 1569677 - RNA, 23 nt, Human adenovirus D
gcacgcggccguucaugggcacc

SEQ ID NO: 1569678 - RNA, 16 nt, Human adenovirus D
cauccaccagugcaag

SEQ ID NO: 1569679 - RNA, 20 nt, Human adenovirus D
ugagcgcgagccggcggcgc

SEQ ID NO: 1569680 - RNA, 12 nt, Human adenovirus D
caccuuccagcc

SEQ ID NO: 1569681 - RNA, 16 nt, Human adenovirus D
gguggggcggugaucu

SEQ ID NO: 1569682 - RNA, 19 nt, Human adenovirus D
ggugcagucguggacgcug

SEQ ID NO: 1569683 - RNA, 13 nt, Human adenovirus D
ucagagccagggc

SEQ ID NO: 1569684 - RNA, 20 nt, Human adenovirus D
gcuacagcaggagugcaggg

SEQ ID NO: 1569685 - RNA, 19 nt, Human adenovirus D
cacgaucccgggcauagcu

SEQ ID NO: 1569686 - RNA, 20 nt, Human adenovirus D
ggcccagaacuggcagagca

SEQ ID NO: 1569687 - RNA, 13 nt, Human adenovirus D
ugacacgcgcaca

SEQ ID NO: 1569688 - RNA, 18 nt, Human adenovirus D
cagccuccaccgcuaccg

SEQ ID NO: 1569689 - RNA, 20 nt, Human adenovirus D
cagaaguucaccugcauggu

SEQ ID NO: 1569690 - RNA, 15 nt, Human adenovirus D
gggaacaaggccugg

SEQ ID NO: 1569691 - RNA, 19 nt, Human adenovirus D
ucggccgaggaggagcgca

SEQ ID NO: 1569692 - RNA, 18 nt, Human adenovirus D
gcacuggggucucgggga

SEQ ID NO: 1569693 - RNA, 19 nt, Human adenovirus D
gcaggaguccaccgcuccg

SEQ ID NO: 1569694 - RNA, 19 nt, Human adenovirus D
aacauccaccagugcaaga

SEQ ID NO: 1569695 - RNA, 11 nt, Human adenovirus D
uagaaacagau

SEQ ID NO: 1569696 - RNA, 18 nt, Human adenovirus D
cuggaccucgagauggac

SEQ ID NO: 1569697 - RNA, 19 nt, Human adenovirus D
cagacagccaggucaaaac

SEQ ID NO: 1569698 - RNA, 16 nt, Human adenovirus D
acaaucagccccuucc

SEQ ID NO: 1569699 - RNA, 16 nt, Human adenovirus D
gcugguggccaccucg

SEQ ID NO: 1569700 - RNA, 17 nt, Human adenovirus D
ucgaggacgugagcggc

SEQ ID NO: 1569701 - RNA, 14 nt, Human adenovirus D
uacaauacucuggg

SEQ ID NO: 1569702 - RNA, 19 nt, Human adenovirus D
cgcuccucgcucuggggcc

SEQ ID NO: 1569703 - RNA, 14 nt, Human adenovirus D
aggggcggcagagg

SEQ ID NO: 1569704 - RNA, 13 nt, Human adenovirus D
ccgcggaguccag

SEQ ID NO: 1569705 - RNA, 20 nt, Human adenovirus D
ugaaccacacggccagcagg

SEQ ID NO: 1569706 - RNA, 18 nt, Human adenovirus D
cagccgcguaagcaggag

SEQ ID NO: 1569707 - RNA, 19 nt, Human adenovirus D
acggggugguggacaucgc

SEQ ID NO: 1569708 - RNA, 12 nt, Human adenovirus D
caaggaggugaa

SEQ ID NO: 1569709 - RNA, 17 nt, Human adenovirus D
gugcgcgaccugggcug

SEQ ID NO: 1569710 - RNA, 16 nt, Human adenovirus D
cugaaggagcuggaca

SEQ ID NO: 1569711 - RNA, 22 nt, Human adenovirus D
gacugcgacuguagggcacgag

SEQ ID NO: 1569712 - RNA, 21 nt, Human adenovirus D
caccguuccaugcagacacuu

SEQ ID NO: 1569713 - RNA, 15 nt, Human adenovirus D
cgucgagcacagcac

SEQ ID NO: 1569714 - RNA, 20 nt, Human adenovirus D
ucacugaaggaaaaaucacu

SEQ ID NO: 1569715 - RNA, 16 nt, Human adenovirus D
uacaacagccuugccc

SEQ ID NO: 1569716 - RNA, 20 nt, Human adenovirus D
ggaggccgugaaggccggca

SEQ ID NO: 1569717 - RNA, 21 nt, Human adenovirus D
agcaggggcgcugggcguggu

SEQ ID NO: 1569718 - RNA, 22 nt, Human adenovirus D
cagagcucuuaagaaagacaca

SEQ ID NO: 1569719 - RNA, 13 nt, Human adenovirus D
cugccacucgcgg

SEQ ID NO: 1569720 - RNA, 16 nt, Human adenovirus D
cagcucaucgacuggu

SEQ ID NO: 1569721 - RNA, 20 nt, Human adenovirus D
cccgccgcuaucugcucuuc

SEQ ID NO: 1569722 - RNA, 19 nt, Human adenovirus D
acggccuuguagggacagc

SEQ ID NO: 1569723 - RNA, 16 nt, Human adenovirus D
gcaucgaggugcagac

SEQ ID NO: 1569724 - RNA, 18 nt, Human adenovirus D
cgccugaggcagacgcug

SEQ ID NO: 1569725 - RNA, 22 nt, Human adenovirus D
gcucguguccaacggcaaacag

SEQ ID NO: 1569726 - RNA, 14 nt, Human adenovirus D
cagcgcgugcugcg

SEQ ID NO: 1569727 - RNA, 22 nt, Human adenovirus D
ccuccgguggcgaccgccgugc

SEQ ID NO: 1569728 - RNA, 15 nt, Human adenovirus D
gagccugcgcccgcg

SEQ ID NO: 1569729 - RNA, 17 nt, Human adenovirus D
cuugaacuacuggcuuc

SEQ ID NO: 1569730 - RNA, 15 nt, Human adenovirus D
guuugcccgcgccac

SEQ ID NO: 1569731 - RNA, 17 nt, Human adenovirus D
cggugggucggagcccc

SEQ ID NO: 1569732 - RNA, 18 nt, Human adenovirus D
uggcgaugugcucgguga

SEQ ID NO: 1569733 - RNA, 19 nt, Human adenovirus D
cuggcggagaacaaggcca

SEQ ID NO: 1569734 - RNA, 21 nt, Human adenovirus D
cauucucgaagauucuggaga

SEQ ID NO: 1569735 - RNA, 20 nt, Human adenovirus D
accccaucccggccaaggcc

SEQ ID NO: 1569736 - RNA, 20 nt, Human adenovirus D
cagcccaacggcaccugcga

SEQ ID NO: 1569737 - RNA, 18 nt, Human adenovirus D
acuuugucugcuguaaag

SEQ ID NO: 1569738 - RNA, 18 nt, Human adenovirus D
gacagcgugguggcgacg

SEQ ID NO: 1569739 - RNA, 21 nt, Human adenovirus D
gcagacacauguccccuuccu

SEQ ID NO: 1569740 - RNA, 12 nt, Human adenovirus D
uuacgucacuuu

SEQ ID NO: 1569741 - RNA, 12 nt, Human adenovirus D
cgcuggccagca

SEQ ID NO: 1569742 - RNA, 15 nt, Human adenovirus D
aaccccacaggauga

SEQ ID NO: 1569743 - RNA, 12 nt, Human adenovirus D
cccccgagcgcc

SEQ ID NO: 1569744 - RNA, 17 nt, Human adenovirus D
ggccauaaaucugcccu

SEQ ID NO: 1569745 - RNA, 19 nt, Human adenovirus D
cggcgccuccguccgcuuc

SEQ ID NO: 1569746 - RNA, 14 nt, Human adenovirus D
uggcgagggucugc

SEQ ID NO: 1569747 - RNA, 15 nt, Human adenovirus D
gcggggccuggugug

SEQ ID NO: 1569748 - RNA, 14 nt, Human adenovirus D
gcagggagcugcgc

SEQ ID NO: 1569749 - RNA, 12 nt, Human adenovirus D
caccccaggcgg

SEQ ID NO: 1569750 - RNA, 14 nt, Human adenovirus D
cguggcgcagcgcg

SEQ ID NO: 1569751 - RNA, 11 nt, Human adenovirus D
cacccuggugu

SEQ ID NO: 1569752 - RNA, 17 nt, Human adenovirus D
ggcaaagcgguugagcu

SEQ ID NO: 1569753 - RNA, 19 nt, Human adenovirus D
aggucuaaaaaccccgcca

SEQ ID NO: 1569754 - RNA, 14 nt, Human adenovirus D
cagacggugaagca

SEQ ID NO: 1569755 - RNA, 20 nt, Human adenovirus D
acgagcagaccuuccaggag

SEQ ID NO: 1569756 - RNA, 13 nt, Human adenovirus D
cggcgcgagcuga

SEQ ID NO: 1569757 - RNA, 21 nt, Human adenovirus D
gguauucccucucgagagcgg

SEQ ID NO: 1569758 - RNA, 14 nt, Human adenovirus D
cugggugacagaac

SEQ ID NO: 1569759 - RNA, 20 nt, Human adenovirus D
aaaaaucacucuuuccagca

SEQ ID NO: 1569760 - RNA, 19 nt, Human adenovirus D
gacgguaagcacgagcggc

SEQ ID NO: 1569761 - RNA, 22 nt, Human adenovirus D
cacgagcgccaggucggcgacg

SEQ ID NO: 1569762 - RNA, 20 nt, Human adenovirus D
cugaacgacucgcugcugca

SEQ ID NO: 1569763 - RNA, 20 nt, Human adenovirus D
aaaagcguccgcuccgcagu

SEQ ID NO: 1569764 - RNA, 17 nt, Human adenovirus D
gaguggcggcccuggcu

SEQ ID NO: 1569765 - RNA, 13 nt, Human adenovirus D
cggcuuuaacaau

SEQ ID NO: 1569766 - RNA, 16 nt, Human adenovirus D
ccagcgaucccagcgu

SEQ ID NO: 1569767 - RNA, 13 nt, Human adenovirus D
uguggagccacug

SEQ ID NO: 1569768 - RNA, 13 nt, Human adenovirus D
ucagccccuuccc

SEQ ID NO: 1569769 - RNA, 15 nt, Human adenovirus D
cagaccaccugguga

SEQ ID NO: 1569770 - RNA, 21 nt, Human adenovirus D
gcacgagaaccgccuggggca

SEQ ID NO: 1569771 - RNA, 16 nt, Human adenovirus D
cgccuuggaggccgcc

SEQ ID NO: 1569772 - RNA, 19 nt, Human adenovirus D
cggagaggcugacgagccc

SEQ ID NO: 1569773 - RNA, 23 nt, Human adenovirus D
cagccuuggauuaucucuacaaa

SEQ ID NO: 1569774 - RNA, 14 nt, Human adenovirus D
gcaguccaaccugg

SEQ ID NO: 1569775 - RNA, 14 nt, Human adenovirus D
ggcggcggccaacc

SEQ ID NO: 1569776 - RNA, 21 nt, Human adenovirus D
gcgguucaagaacgagggccu

SEQ ID NO: 1569777 - RNA, 19 nt, Human adenovirus D
cgaugguggcgcgcaccuc

SEQ ID NO: 1569778 - RNA, 21 nt, Human adenovirus D
gcgagaacauguacccgacca

SEQ ID NO: 1569779 - RNA, 14 nt, Human adenovirus D
ggcggcgcugcaaa

SEQ ID NO: 1569780 - RNA, 14 nt, Human adenovirus D
ggcccgacuccgcc

SEQ ID NO: 1569781 - RNA, 14 nt, Human adenovirus D
caucgugcagaacc

SEQ ID NO: 1569782 - RNA, 22 nt, Human adenovirus D
gauagcagcguguuggacuugg

SEQ ID NO: 1569783 - RNA, 17 nt, Human adenovirus D
augggcccgugggcugc

SEQ ID NO: 1569784 - RNA, 16 nt, Human adenovirus D
gaccggugcucugcgc

SEQ ID NO: 1569785 - RNA, 23 nt, Human adenovirus D
ucaucugcagggcgcccagcaug

SEQ ID NO: 1569786 - RNA, 19 nt, Human adenovirus D
cugcaggcgucgcagcgcc

SEQ ID NO: 1569787 - RNA, 23 nt, Human adenovirus D
acaaugauggauacuugguagca

SEQ ID NO: 1569788 - RNA, 16 nt, Human adenovirus D
gaccuaccaaugaaaa

SEQ ID NO: 1569789 - RNA, 15 nt, Human adenovirus D
ugaccaauagacagc

SEQ ID NO: 1569790 - RNA, 18 nt, Human adenovirus D
gcgggcaugaccucggca

SEQ ID NO: 1569791 - RNA, 18 nt, Human adenovirus D
gcacggcuuacaacagcc

SEQ ID NO: 1569792 - RNA, 22 nt, Human adenovirus D
cuuucugcccgcgcucaucccc

SEQ ID NO: 1569793 - RNA, 23 nt, Human adenovirus D
ccagguccacgcugguggccacc

SEQ ID NO: 1569794 - RNA, 21 nt, Human adenovirus D
agccaggucaaaacccacucu

SEQ ID NO: 1569795 - RNA, 12 nt, Human adenovirus D
augaacugcucg

SEQ ID NO: 1569796 - RNA, 16 nt, Human adenovirus D
gagcgccugaggcaga

SEQ ID NO: 1569797 - RNA, 17 nt, Human adenovirus D
cggccccgcgggcaggg

SEQ ID NO: 1569798 - RNA, 24 nt, Human adenovirus D
cagcauguacggaggagccaagaa

SEQ ID NO: 1569799 - RNA, 17 nt, Human adenovirus D
gcuaccugggaggagag

SEQ ID NO: 1569800 - RNA, 17 nt, Human adenovirus D
ccugagccgccagcugg

SEQ ID NO: 1569801 - RNA, 23 nt, Human adenovirus D
ugacaacccgccugccaggaugg

SEQ ID NO: 1569802 - RNA, 18 nt, Human adenovirus D
acggaccaccccaggcgg

SEQ ID NO: 1569803 - RNA, 23 nt, Human adenovirus D
gguggauagcuaugauccagaug

SEQ ID NO: 1569804 - RNA, 16 nt, Human adenovirus D
ggcugcuggagcugau

SEQ ID NO: 1569805 - RNA, 16 nt, Human adenovirus D
uguaaccuugcaagag

SEQ ID NO: 1569806 - RNA, 16 nt, Human adenovirus D
guuucucaacagcugg

SEQ ID NO: 1569807 - RNA, 16 nt, Human adenovirus D
gcaugaccucggcacu

SEQ ID NO: 1569808 - RNA, 16 nt, Human adenovirus D
caugacccugcauggc

SEQ ID NO: 1569809 - RNA, 15 nt, Human adenovirus D
uguucagcagcaccu

SEQ ID NO: 1569810 - RNA, 17 nt, Human adenovirus D
gccaggggaugaacagu

SEQ ID NO: 1569811 - RNA, 23 nt, Human adenovirus D
caguugcuuguaccacaaaaacg

SEQ ID NO: 1569812 - RNA, 16 nt, Human adenovirus D
gcucccaccgcgccgc

SEQ ID NO: 1569813 - RNA, 17 nt, Human adenovirus D
gaaaucaguuucccaug

SEQ ID NO: 1569814 - RNA, 17 nt, Human adenovirus D
gacccugagaacggggu

SEQ ID NO: 1569815 - RNA, 17 nt, Human adenovirus D
ggacuauccuugcagac

SEQ ID NO: 1569816 - RNA, 16 nt, Human adenovirus D
gucuagaaccccacag

SEQ ID NO: 1569817 - RNA, 14 nt, Human adenovirus D
ccugagccgccagc

SEQ ID NO: 1569818 - RNA, 20 nt, Human adenovirus D
cccucgcgcaacugggccgc

SEQ ID NO: 1569819 - RNA, 19 nt, Human adenovirus D
gugaccugcagcaggugcu

SEQ ID NO: 1569820 - RNA, 19 nt, Human adenovirus D
ccccaggcggugcugcugc

SEQ ID NO: 1569821 - RNA, 19 nt, Human adenovirus D
aagauguuaaagugggcgu

SEQ ID NO: 1569822 - RNA, 16 nt, Human adenovirus D
ugauguccuugaggag

SEQ ID NO: 1569823 - RNA, 14 nt, Human adenovirus D
guucuucgaggacc

SEQ ID NO: 1569824 - RNA, 22 nt, Human adenovirus D
acagccuucagcaucagucucc

SEQ ID NO: 1569825 - RNA, 16 nt, Human adenovirus D
agcaggagcaggagga

SEQ ID NO: 1569826 - RNA, 14 nt, Human adenovirus D
cgcuugacagcacc

SEQ ID NO: 1569827 - RNA, 16 nt, Human adenovirus D
ugccggaccucaugca

SEQ ID NO: 1569828 - RNA, 13 nt, Human adenovirus D
ugcaggauccagc

SEQ ID NO: 1569829 - RNA, 18 nt, Human adenovirus D
uacaagcgccaacagcag

SEQ ID NO: 1569830 - RNA, 18 nt, Human adenovirus D
acugacuacccacugacu

SEQ ID NO: 1569831 - RNA, 22 nt, Human adenovirus D
cuuugucugcuguaaagccaga

SEQ ID NO: 1569832 - RNA, 17 nt, Human adenovirus D
agcggcgcaagcucaug

SEQ ID NO: 1569833 - RNA, 18 nt, Human adenovirus D
uagucaaucucccaccac

SEQ ID NO: 1569834 - RNA, 17 nt, Human adenovirus D
ccagaggcagacucagg

SEQ ID NO: 1569835 - RNA, 15 nt, Human adenovirus D
gcaucucccaggcuu

SEQ ID NO: 1569836 - RNA, 15 nt, Human adenovirus D
cugauggccacgggg

SEQ ID NO: 1569837 - RNA, 13 nt, Human adenovirus D
aggagaccugcac

SEQ ID NO: 1569838 - RNA, 14 nt, Human adenovirus D
gagccggcucgucu

SEQ ID NO: 1569839 - RNA, 12 nt, Human adenovirus D
gacagggccugc

SEQ ID NO: 1569840 - RNA, 18 nt, Human adenovirus D
ucuggcgguaccagggga

SEQ ID NO: 1569841 - RNA, 17 nt, Human adenovirus D
acccagagcuuagcaag

SEQ ID NO: 1569842 - RNA, 14 nt, Human adenovirus D
uccugcgaaagccc

SEQ ID NO: 1569843 - RNA, 20 nt, Human adenovirus D
gcaggggcaucucgcugaug

SEQ ID NO: 1569844 - RNA, 11 nt, Human adenovirus D
ccccuccugcg

SEQ ID NO: 1569845 - RNA, 16 nt, Human adenovirus D
agcggcgcaggggcau

SEQ ID NO: 1569846 - RNA, 12 nt, Human adenovirus D
ucccccagcaug

SEQ ID NO: 1569847 - RNA, 13 nt, Human adenovirus D
gagagucuggugg

SEQ ID NO: 1569848 - RNA, 18 nt, Human adenovirus D
cacugcagggagccaggg

SEQ ID NO: 1569849 - RNA, 15 nt, Human adenovirus D
uacaaagcugaaagc

SEQ ID NO: 1569850 - RNA, 24 nt, Human adenovirus D
ucgagacgucccagagcucgguga

SEQ ID NO: 1569851 - RNA, 19 nt, Human adenovirus D
aggaauugguauaagugua

SEQ ID NO: 1569852 - RNA, 17 nt, Human adenovirus D
cgauaucgcgcauccug

SEQ ID NO: 1569853 - RNA, 21 nt, Human adenovirus D
uggggugcuguucauggccaa

SEQ ID NO: 1569854 - RNA, 14 nt, Human adenovirus D
ugcugccgagccgc

SEQ ID NO: 1569855 - RNA, 19 nt, Human adenovirus D
ggccggcaugcccaccacg

SEQ ID NO: 1569856 - RNA, 14 nt, Human adenovirus D
gaccucggcacuca

SEQ ID NO: 1569857 - RNA, 18 nt, Human adenovirus D
uggccuuguaccugcccg

SEQ ID NO: 1569858 - RNA, 14 nt, Human adenovirus D
ccgcgugcagcugc

SEQ ID NO: 1569859 - RNA, 14 nt, Human adenovirus D
ggcgucgcagcgcc

SEQ ID NO: 1569860 - RNA, 17 nt, Human adenovirus D
agaaaaguccuguaaau

SEQ ID NO: 1569861 - RNA, 13 nt, Human adenovirus D
acgggcccugcga

SEQ ID NO: 1569862 - RNA, 12 nt, Human adenovirus D
uacaaagugugg

SEQ ID NO: 1569863 - RNA, 14 nt, Human adenovirus D
agggaaugcgugga

SEQ ID NO: 1569864 - RNA, 16 nt, Human adenovirus D
gcgacacacuuccauu

SEQ ID NO: 1569865 - RNA, 18 nt, Human adenovirus D
ucucagcacgguggccuu

SEQ ID NO: 1569866 - RNA, 21 nt, Human adenovirus D
gccggccgcgcuugcugggcg

SEQ ID NO: 1569867 - RNA, 18 nt, Human adenovirus D
cucacucucuuccgcguc

SEQ ID NO: 1569868 - RNA, 21 nt, Human adenovirus D
cuuccuccguagccuggcgga

SEQ ID NO: 1569869 - RNA, 16 nt, Human adenovirus D
cucggucaggagcaag

SEQ ID NO: 1569870 - RNA, 18 nt, Human adenovirus D
ugggccacuacagcugac

SEQ ID NO: 1569871 - RNA, 18 nt, Human adenovirus D
cgaggccaugcugcgccg

SEQ ID NO: 1569872 - RNA, 19 nt, Human adenovirus D
cgcggcggcgauaugccag

SEQ ID NO: 1569873 - RNA, 16 nt, Human adenovirus D
agagggagaggagcga

SEQ ID NO: 1569874 - RNA, 14 nt, Human adenovirus D
uggaugugcccaag

SEQ ID NO: 1569875 - RNA, 20 nt, Human adenovirus D
cuggauuuccugccaccagu

SEQ ID NO: 1569876 - RNA, 15 nt, Human adenovirus D
gaggacacccggccc

SEQ ID NO: 1569877 - RNA, 20 nt, Human adenovirus D
cccagagcucgcgggccaug

SEQ ID NO: 1569878 - RNA, 13 nt, Human adenovirus D
ccgucgccgcacc

SEQ ID NO: 1569879 - RNA, 21 nt, Human adenovirus D
ccauugucaacacggccggcc

SEQ ID NO: 1569880 - RNA, 22 nt, Human adenovirus D
ccggagauuuacggaccacccc

SEQ ID NO: 1569881 - RNA, 14 nt, Human adenovirus D
ugaccaacuggucu

SEQ ID NO: 1569882 - RNA, 14 nt, Human adenovirus D
cggaucgcccaggc

SEQ ID NO: 1569883 - RNA, 14 nt, Human adenovirus D
gauggaggagcagc

SEQ ID NO: 1569884 - RNA, 23 nt, Human adenovirus D
gcaccacgcuucuuccccagcgg

SEQ ID NO: 1569885 - RNA, 16 nt, Human adenovirus D
agggccuggaccgcca

SEQ ID NO: 1569886 - RNA, 21 nt, Human adenovirus D
cggcgcuuggugggcagagga

SEQ ID NO: 1569887 - RNA, 18 nt, Human adenovirus D
caccaugcgccaagggca

SEQ ID NO: 1569888 - RNA, 19 nt, Human adenovirus D
cacagugcccccuccacuu

SEQ ID NO: 1569889 - RNA, 22 nt, Human adenovirus D
uuuccccaccuacuccucuuug

SEQ ID NO: 1569890 - RNA, 23 nt, Human adenovirus D
cacgccgagccugaagcccguga

SEQ ID NO: 1569891 - RNA, 17 nt, Human adenovirus D
ugacauccauggccagg

SEQ ID NO: 1569892 - RNA, 21 nt, Human adenovirus D
gggagacggucgacgaagcgc

SEQ ID NO: 1569893 - RNA, 20 nt, Human adenovirus D
ucaccauguuauucagcagc

SEQ ID NO: 1569894 - RNA, 14 nt, Human adenovirus D
accgacgcugggcu

SEQ ID NO: 1569895 - RNA, 17 nt, Human adenovirus D
cuauaaaaacaacaaaa

SEQ ID NO: 1569896 - RNA, 13 nt, Human adenovirus D
acauccaugugac

SEQ ID NO: 1569897 - RNA, 16 nt, Human adenovirus D
cacaggcacacugaca

SEQ ID NO: 1569898 - RNA, 17 nt, Human adenovirus D
agccccggaccccgcca

SEQ ID NO: 1569899 - RNA, 16 nt, Human adenovirus D
acccugcccgagggca

SEQ ID NO: 1569900 - RNA, 14 nt, Human adenovirus D
caccgagccuccca

SEQ ID NO: 1569901 - RNA, 17 nt, Human adenovirus D
auuuaauaaagaucacu

SEQ ID NO: 1569902 - RNA, 11 nt, Human adenovirus D
cauacaaucau

SEQ ID NO: 1569903 - RNA, 18 nt, Human adenovirus D
acaaguacacgccggcca

SEQ ID NO: 1569904 - RNA, 15 nt, Human adenovirus D
guacacgguucucuc

SEQ ID NO: 1569905 - RNA, 15 nt, Human adenovirus D
ucgcucuuaucccau

SEQ ID NO: 1569906 - RNA, 20 nt, Human adenovirus D
aucaagugccacaugcaccu

SEQ ID NO: 1569907 - RNA, 15 nt, Human adenovirus D
aggcaggacucgcag

SEQ ID NO: 1569908 - RNA, 14 nt, Human adenovirus D
caggccgugcugcu

SEQ ID NO: 1569909 - RNA, 17 nt, Human adenovirus D
ucgcaagcgcccagagc

SEQ ID NO: 1569910 - RNA, 15 nt, Human adenovirus D
cuuggugggcagagg

SEQ ID NO: 1569911 - RNA, 18 nt, Human adenovirus D
guggccuuguaccugccc

SEQ ID NO: 1569912 - RNA, 17 nt, Human adenovirus D
gccgcccugacccagca

SEQ ID NO: 1569913 - RNA, 12 nt, Human adenovirus D
cagccagcagaa

SEQ ID NO: 1569914 - RNA, 17 nt, Human adenovirus D
ccagccgcaggcgccca

SEQ ID NO: 1569915 - RNA, 17 nt, Human adenovirus D
gcaucccguccugcgcc

SEQ ID NO: 1569916 - RNA, 22 nt, Human adenovirus D
gcagaaauuucaagcugggcug

SEQ ID NO: 1569917 - RNA, 20 nt, Human adenovirus D
caacgcaucauggcccugac

SEQ ID NO: 1569918 - RNA, 14 nt, Human adenovirus D
gaugguagcagcag

SEQ ID NO: 1569919 - RNA, 14 nt, Human adenovirus D
caccaucugagcuc

SEQ ID NO: 1569920 - RNA, 14 nt, Human adenovirus D
ccugagagcgcugg

SEQ ID NO: 1569921 - RNA, 17 nt, Human adenovirus D
ucgccgaggagaacugc

SEQ ID NO: 1569922 - RNA, 13 nt, Human adenovirus D
agcgccaggaggc

SEQ ID NO: 1569923 - RNA, 19 nt, Human adenovirus D
ggcgguagagcggccagcg

SEQ ID NO: 1569924 - RNA, 18 nt, Human adenovirus D
augaaguucaauggagag

SEQ ID NO: 1569925 - RNA, 17 nt, Human adenovirus D
uccccgacccccuucca

SEQ ID NO: 1569926 - RNA, 15 nt, Human adenovirus D
caucgcgcaggccgc

SEQ ID NO: 1569927 - RNA, 19 nt, Human adenovirus D
gugaagaugccgggacaga

SEQ ID NO: 1569928 - RNA, 21 nt, Human adenovirus D
ugccccaaaaguucuuugcca

SEQ ID NO: 1569929 - RNA, 12 nt, Human adenovirus D
agcauguggaac

SEQ ID NO: 1569930 - RNA, 19 nt, Human adenovirus D
cggcccggcacggcggugg

SEQ ID NO: 1569931 - RNA, 19 nt, Human adenovirus D
cgcuuggugggcagaggag

SEQ ID NO: 1569932 - RNA, 22 nt, Human adenovirus D
gcaccgucgccucggaccuggc

SEQ ID NO: 1569933 - RNA, 16 nt, Human adenovirus D
cagcaucgaggugcag

SEQ ID NO: 1569934 - RNA, 19 nt, Human adenovirus D
aagaaacgucccagcagca

SEQ ID NO: 1569935 - RNA, 16 nt, Human adenovirus D
guaacuaaacuuuaug

SEQ ID NO: 1569936 - RNA, 19 nt, Human adenovirus D
ggauugcagggcguagagc

SEQ ID NO: 1569937 - RNA, 21 nt, Human adenovirus D
augcgucccacccccccggcg

SEQ ID NO: 1569938 - RNA, 21 nt, Human adenovirus D
augcugcccgccaccugcaac

SEQ ID NO: 1569939 - RNA, 17 nt, Human adenovirus D
ccccguugggcagcgag

SEQ ID NO: 1569940 - RNA, 13 nt, Human adenovirus D
agggcgcgguggg

SEQ ID NO: 1569941 - RNA, 20 nt, Human adenovirus D
gaaaugaggcaggccaugga

SEQ ID NO: 1569942 - RNA, 15 nt, Human adenovirus D
ucuuuauucuugugg

SEQ ID NO: 1569943 - RNA, 21 nt, Human adenovirus D
ugggguacuuuacgcuggcca

SEQ ID NO: 1569944 - RNA, 21 nt, Human adenovirus D
cgcccaacucgcggcugcugc

SEQ ID NO: 1569945 - RNA, 21 nt, Human adenovirus D
uuggccuguccugcaggggcg

SEQ ID NO: 1569946 - RNA, 12 nt, Human adenovirus D
ccguagccuggc

SEQ ID NO: 1569947 - RNA, 13 nt, Human adenovirus D
ccccuggcugggc

SEQ ID NO: 1569948 - RNA, 14 nt, Human adenovirus D
cagggaacugauaa

SEQ ID NO: 1569949 - RNA, 16 nt, Human adenovirus D
gagcaggaccugggcu

SEQ ID NO: 1569950 - RNA, 14 nt, Human adenovirus D
acucgcggcugcug

SEQ ID NO: 1569951 - RNA, 13 nt, Human adenovirus D
cuccuccuggaga

SEQ ID NO: 1569952 - RNA, 12 nt, Human adenovirus D
uuaguccagcag

SEQ ID NO: 1569953 - RNA, 14 nt, Human adenovirus D
cuccaaagcuagca

SEQ ID NO: 1569954 - RNA, 15 nt, Human adenovirus D
ucaaccccuucaacc

SEQ ID NO: 1569955 - RNA, 17 nt, Human adenovirus D
gcaaccaggaggagcuc

SEQ ID NO: 1569956 - RNA, 20 nt, Human adenovirus D
acaucgccgggcaggacgcc

SEQ ID NO: 1569957 - RNA, 16 nt, Human adenovirus D
aagauggaggagcagc

SEQ ID NO: 1569958 - RNA, 22 nt, Human adenovirus D
ccugaaccgccgccggcggcgg

SEQ ID NO: 1569959 - RNA, 17 nt, Human adenovirus D
cucgcagugcacgggca

SEQ ID NO: 1569960 - RNA, 15 nt, Human adenovirus D
ggaagaagagcagca

SEQ ID NO: 1569961 - RNA, 22 nt, Human adenovirus D
cugguguaguuguucagcagca

SEQ ID NO: 1569962 - RNA, 15 nt, Human adenovirus D
ugccuggugaagggc

SEQ ID NO: 1569963 - RNA, 19 nt, Human adenovirus D
cugagauacgaugagacca

SEQ ID NO: 1569964 - RNA, 18 nt, Human adenovirus D
cauggcgcacaacaccgc

SEQ ID NO: 1569965 - RNA, 19 nt, Human adenovirus D
gcggacggaucgcccaggc

SEQ ID NO: 1569966 - RNA, 21 nt, Human adenovirus D
ugggaugcugcccgccaccug

SEQ ID NO: 1569967 - RNA, 20 nt, Human adenovirus D
aaaucgagcaggaccugggc

SEQ ID NO: 1569968 - RNA, 16 nt, Human adenovirus D
cggaguggccucucgc

SEQ ID NO: 1569969 - RNA, 13 nt, Human adenovirus D
ccuggagcagcgg

SEQ ID NO: 1569970 - RNA, 19 nt, Human adenovirus D
cugcaccccccgcaggcag

SEQ ID NO: 1569971 - RNA, 17 nt, Human adenovirus D
ccgcgguauauggcucc

SEQ ID NO: 1569972 - RNA, 23 nt, Human adenovirus D
cgaggagaacugcuggcccugcu

SEQ ID NO: 1569973 - RNA, 18 nt, Human adenovirus D
caacaggccuaacuacau

SEQ ID NO: 1569974 - RNA, 14 nt, Human adenovirus D
gcugcgcggggcca

SEQ ID NO: 1569975 - RNA, 20 nt, Human adenovirus D
auggaacccaaaguaugaca

SEQ ID NO: 1569976 - RNA, 20 nt, Human adenovirus D
ccuccaguuuguggaggagu

SEQ ID NO: 1569977 - RNA, 14 nt, Human adenovirus D
uccucuccuccucc

SEQ ID NO: 1569978 - RNA, 22 nt, Human adenovirus D
uacucccagcucauccgcagcu

SEQ ID NO: 1569979 - RNA, 17 nt, Human adenovirus D
ccagcagaagguggugg

SEQ ID NO: 1569980 - RNA, 20 nt, Human adenovirus D
cuuccuggcgacgcagccgg

SEQ ID NO: 1569981 - RNA, 17 nt, Human adenovirus D
gggcaucuucugccugg

SEQ ID NO: 1569982 - RNA, 16 nt, Human adenovirus D
gugccagauuggggga

SEQ ID NO: 1569983 - RNA, 19 nt, Human adenovirus D
cacccccgccgaggcuagc

SEQ ID NO: 1569984 - RNA, 18 nt, Human adenovirus D
uccuggacgggagcaauc

SEQ ID NO: 1569985 - RNA, 20 nt, Human adenovirus D
caucgcgaaccaggcagugc

SEQ ID NO: 1569986 - RNA, 23 nt, Human adenovirus D
cuggacgggagcaauccuccagg

SEQ ID NO: 1569987 - RNA, 20 nt, Human adenovirus D
caggcgaaacgccccugcaa

SEQ ID NO: 1569988 - RNA, 20 nt, Human adenovirus D
aguaccugagccgcgagaag

SEQ ID NO: 1569989 - RNA, 12 nt, Human adenovirus D
ccacgacacagc

SEQ ID NO: 1569990 - RNA, 16 nt, Human adenovirus D
caggcagcggccugaa

SEQ ID NO: 1569991 - RNA, 16 nt, Human adenovirus D
cggccauucuggaggc

SEQ ID NO: 1569992 - RNA, 19 nt, Human adenovirus D
cagcaacccuuccuggucg

SEQ ID NO: 1569993 - RNA, 12 nt, Human adenovirus D
gaucauugagag

SEQ ID NO: 1569994 - RNA, 12 nt, Human adenovirus D
auccacugcucc

SEQ ID NO: 1569995 - RNA, 20 nt, Human adenovirus D
ggcgacaacgccaggcuggc

SEQ ID NO: 1569996 - RNA, 17 nt, Human adenovirus D
ugggccguuggaagaug

SEQ ID NO: 1569997 - RNA, 15 nt, Human adenovirus D
ugagcagcuugcuga

SEQ ID NO: 1569998 - RNA, 17 nt, Human adenovirus D
cccugugaccaagcugg

SEQ ID NO: 1569999 - RNA, 22 nt, Human adenovirus D
uaaaaauauuagaugacaaaag

SEQ ID NO: 1570000 - RNA, 16 nt, Human adenovirus D
agcuacaugcccagca

SEQ ID NO: 1570001 - RNA, 16 nt, Human adenovirus D
cccgugaccugcagca

SEQ ID NO: 1570002 - RNA, 21 nt, Human adenovirus D
gugcaaugucaggucugcugg

SEQ ID NO: 1570003 - RNA, 21 nt, Human adenovirus D
caggcggcagagcgggcgggc

SEQ ID NO: 1570004 - RNA, 21 nt, Human adenovirus D
ugaccugccuccaccacccac

SEQ ID NO: 1570005 - RNA, 16 nt, Human adenovirus D
aacgcccugcuggagc

SEQ ID NO: 1570006 - RNA, 14 nt, Human adenovirus D
cggcaaaaaucaca

SEQ ID NO: 1570007 - RNA, 18 nt, Human adenovirus D
gauuucaucaaucaucag

SEQ ID NO: 1570008 - RNA, 16 nt, Human adenovirus D
caggcgcccagccagc

SEQ ID NO: 1570009 - RNA, 14 nt, Human adenovirus D
cacgguaagagccc

SEQ ID NO: 1570010 - RNA, 12 nt, Human adenovirus D
gcaggaccuggg

SEQ ID NO: 1570011 - RNA, 17 nt, Human adenovirus D
ucccaggcuuucaucuc

SEQ ID NO: 1570012 - RNA, 17 nt, Human adenovirus D
gaucccacagggcacug

SEQ ID NO: 1570013 - RNA, 17 nt, Human adenovirus D
gucugcuguaaagccag

SEQ ID NO: 1570014 - RNA, 19 nt, Human adenovirus D
ggcgugcagaccguggaca

SEQ ID NO: 1570015 - RNA, 23 nt, Human adenovirus D
gguguaccagucgggcccggacu

SEQ ID NO: 1570016 - RNA, 14 nt, Human adenovirus D
cucaacgcccaggc

SEQ ID NO: 1570017 - RNA, 18 nt, Human adenovirus D
accgcaaugcgggccugc

SEQ ID NO: 1570018 - RNA, 20 nt, Human adenovirus D
cuucuacagccagcagcucc

SEQ ID NO: 1570019 - RNA, 15 nt, Human adenovirus D
cucauuuuuccagcc

SEQ ID NO: 1570020 - RNA, 17 nt, Human adenovirus D
cccgggggccucguccu

SEQ ID NO: 1570021 - RNA, 17 nt, Human adenovirus D
cgcuaccgcuccaugcu

SEQ ID NO: 1570022 - RNA, 21 nt, Human adenovirus D
gcccagcgagaggagcucuug

SEQ ID NO: 1570023 - RNA, 18 nt, Human adenovirus D
gagcugaugcugagccug

SEQ ID NO: 1570024 - RNA, 15 nt, Human adenovirus D
cagggaacugaaaga

SEQ ID NO: 1570025 - RNA, 18 nt, Human adenovirus D
ucgcaagcgcccagagcg

SEQ ID NO: 1570026 - RNA, 20 nt, Human adenovirus D
ggaggacuuaaccacccacg

SEQ ID NO: 1570027 - RNA, 16 nt, Human adenovirus D
uucuuuggcuuuugug

SEQ ID NO: 1570028 - RNA, 22 nt, Human adenovirus D
auaaagaucacuuacuugaaau

SEQ ID NO: 1570029 - RNA, 14 nt, Human adenovirus D
agacauggccagca

SEQ ID NO: 1570030 - RNA, 15 nt, Human adenovirus D
cagacgaagaauaua

SEQ ID NO: 1570031 - RNA, 23 nt, Human adenovirus D
gaaacagcagaggaagaggguca

SEQ ID NO: 1570032 - RNA, 14 nt, Human adenovirus D
ggccgcagcucuuc

SEQ ID NO: 1570033 - RNA, 16 nt, Human adenovirus D
gaacaguggcaaugca

SEQ ID NO: 1570034 - RNA, 21 nt, Human adenovirus D
cugggguauuacuaggcccag

SEQ ID NO: 1570035 - RNA, 21 nt, Human adenovirus D
cggucaccucaacgcccaggc

SEQ ID NO: 1570036 - RNA, 20 nt, Human adenovirus D
cagccaguggcccuggaugu

SEQ ID NO: 1570037 - RNA, 22 nt, Human adenovirus D
cgacuucaugagccagagcaug

SEQ ID NO: 1570038 - RNA, 20 nt, Human adenovirus D
ggcugcuucugccuggugaa

SEQ ID NO: 1570039 - RNA, 19 nt, Human adenovirus D
ucugaaagaaacagcagag

SEQ ID NO: 1570040 - RNA, 16 nt, Human adenovirus D
aggcgcccagccagca

SEQ ID NO: 1570041 - RNA, 16 nt, Human adenovirus D
gaggcucgguuguuga

SEQ ID NO: 1570042 - RNA, 12 nt, Human adenovirus D
ugccggccccuc

SEQ ID NO: 1570043 - RNA, 22 nt, Human adenovirus D
uggugcaguuugcccgcgccac

SEQ ID NO: 1570044 - RNA, 13 nt, Human adenovirus D
uaaggagaaggau

SEQ ID NO: 1570045 - RNA, 12 nt, Human adenovirus D
cccggacagcaa

SEQ ID NO: 1570046 - RNA, 18 nt, Human adenovirus D
ccaaaugcgucccacccc

SEQ ID NO: 1570047 - RNA, 19 nt, Human adenovirus D
cugcccguucucgcugguc

SEQ ID NO: 1570048 - RNA, 16 nt, Human adenovirus D
cccacugacuuagcuc

SEQ ID NO: 1570049 - RNA, 20 nt, Human adenovirus D
ggcgccggcgcuagccagcc

SEQ ID NO: 1570050 - RNA, 20 nt, Human adenovirus D
guaggccauccccauccagu

SEQ ID NO: 1570051 - RNA, 18 nt, Human adenovirus D
cuuggugggcagaggagg

SEQ ID NO: 1570052 - RNA, 21 nt, Human adenovirus D
cgcagcgugaagacgccgccg

SEQ ID NO: 1570053 - RNA, 19 nt, Human adenovirus D
ccugaucucugccauguuc

SEQ ID NO: 1570054 - RNA, 17 nt, Human adenovirus D
cuugguaugagguugua

SEQ ID NO: 1570055 - RNA, 12 nt, Human adenovirus D
accugggcggcg

SEQ ID NO: 1570056 - RNA, 15 nt, Human adenovirus D
uguagggacagcagc

SEQ ID NO: 1570057 - RNA, 15 nt, Human adenovirus D
gaacacacugcccau

SEQ ID NO: 1570058 - RNA, 19 nt, Human adenovirus D
cacuggcccgaccgaccca

SEQ ID NO: 1570059 - RNA, 20 nt, Human adenovirus D
uagaagaccauaguaaagaa

SEQ ID NO: 1570060 - RNA, 17 nt, Human adenovirus D
gcuaccuugcacccacc

SEQ ID NO: 1570061 - RNA, 22 nt, Human adenovirus D
accugcgcaaggucgaggagac

SEQ ID NO: 1570062 - RNA, 14 nt, Human adenovirus D
gaugugcggcagcu

SEQ ID NO: 1570063 - RNA, 15 nt, Human adenovirus D
ggcuccgcggcacgg

SEQ ID NO: 1570064 - RNA, 20 nt, Human adenovirus D
cuggucaguugcaccacgcu

SEQ ID NO: 1570065 - RNA, 15 nt, Human adenovirus D
gugaggaucauaucc

SEQ ID NO: 1570066 - RNA, 15 nt, Human adenovirus D
caacagccacaugac

SEQ ID NO: 1570067 - RNA, 17 nt, Human adenovirus D
cugucuuaccagcucuu

SEQ ID NO: 1570068 - RNA, 20 nt, Human adenovirus D
gcgcgccgcgccgccacugc

SEQ ID NO: 1570069 - RNA, 16 nt, Human adenovirus D
gucacucucauuucag

SEQ ID NO: 1570070 - RNA, 15 nt, Human adenovirus D
cgugaacgcgcuggc

SEQ ID NO: 1570071 - RNA, 21 nt, Human adenovirus D
cccagagcuuagcaaggugcu

SEQ ID NO: 1570072 - RNA, 18 nt, Human adenovirus D
gagaaccgccuggggcag

SEQ ID NO: 1570073 - RNA, 20 nt, Human adenovirus D
cgugcgcuaccaccccagca

SEQ ID NO: 1570074 - RNA, 17 nt, Human adenovirus D
acggucugcaggccggg

SEQ ID NO: 1570075 - RNA, 23 nt, Human adenovirus D
gcagguuucucaacagcugggac

SEQ ID NO: 1570076 - RNA, 13 nt, Human adenovirus D
ccggaaacgccac

SEQ ID NO: 1570077 - RNA, 11 nt, Human adenovirus D
ggcggcagagc

SEQ ID NO: 1570078 - RNA, 14 nt, Human adenovirus D
cuuuaaugcuccaa

SEQ ID NO: 1570079 - RNA, 15 nt, Human adenovirus D
gcagugucuggagcg

SEQ ID NO: 1570080 - RNA, 21 nt, Human adenovirus D
caauaauggaagcauuacuau

SEQ ID NO: 1570081 - RNA, 23 nt, Human adenovirus D
aggcuaccugaccuugcagagca

SEQ ID NO: 1570082 - RNA, 18 nt, Human adenovirus D
guuagguucuucacccag

SEQ ID NO: 1570083 - RNA, 21 nt, Human adenovirus D
gcuggcggagaacaaggccau

SEQ ID NO: 1570084 - RNA, 19 nt, Human adenovirus D
gcaguccgccaagcuccuc

SEQ ID NO: 1570085 - RNA, 19 nt, Human adenovirus D
gucaccgagccucccagga

SEQ ID NO: 1570086 - RNA, 20 nt, Human adenovirus D
ggcgacgacgacauccugga

SEQ ID NO: 1570087 - RNA, 22 nt, Human adenovirus D
ucuucuuguaacuuuuagucag

SEQ ID NO: 1570088 - RNA, 17 nt, Human adenovirus D
uuuacaugcgcauggcg

SEQ ID NO: 1570089 - RNA, 14 nt, Human adenovirus D
cgucuacaaggccc

SEQ ID NO: 1570090 - RNA, 15 nt, Human adenovirus D
ccuccgucggaagag

SEQ ID NO: 1570091 - RNA, 22 nt, Human adenovirus D
ccagagaacgcgcgaagauggc

SEQ ID NO: 1570092 - RNA, 13 nt, Human adenovirus D
cccguccuccucg

SEQ ID NO: 1570093 - RNA, 15 nt, Human adenovirus D
acucuuaaagacuaa

SEQ ID NO: 1570094 - RNA, 14 nt, Human adenovirus D
ccagaacuuccagc

SEQ ID NO: 1570095 - RNA, 13 nt, Human adenovirus D
cagagcucgguga

SEQ ID NO: 1570096 - RNA, 14 nt, Human adenovirus D
aaucgcgggcggcc

SEQ ID NO: 1570097 - RNA, 14 nt, Human adenovirus D
caaagagcacagca

SEQ ID NO: 1570098 - RNA, 14 nt, Human adenovirus D
ccaacguggagcug

SEQ ID NO: 1570099 - RNA, 21 nt, Human adenovirus D
ccgaggacuaccacgcccaug

SEQ ID NO: 1570100 - RNA, 16 nt, Human adenovirus D
acuugggcugccacuu

SEQ ID NO: 1570101 - RNA, 19 nt, Human adenovirus D
caguccaugcccaacaggc

SEQ ID NO: 1570102 - RNA, 16 nt, Human adenovirus D
cccacaucgaggcccu

SEQ ID NO: 1570103 - RNA, 19 nt, Human adenovirus D
acagcaucgccucaccuau

SEQ ID NO: 1570104 - RNA, 19 nt, Human adenovirus D
ggccacucccagcgccgcg

SEQ ID NO: 1570105 - RNA, 19 nt, Human adenovirus D
agggcgcucccaaucccag

SEQ ID NO: 1570106 - RNA, 12 nt, Human adenovirus D
caguggcccugg

SEQ ID NO: 1570107 - RNA, 13 nt, Human adenovirus D
ggucgcugccgga

SEQ ID NO: 1570108 - RNA, 18 nt, Human adenovirus D
acuggcuuccgccgccgg

SEQ ID NO: 1570109 - RNA, 16 nt, Human adenovirus D
gccggcgaaccgagca

SEQ ID NO: 1570110 - RNA, 15 nt, Human adenovirus D
guggaaacagacagc

SEQ ID NO: 1570111 - RNA, 21 nt, Human adenovirus D
uauuuaaaggcaccuuacacu

SEQ ID NO: 1570112 - RNA, 20 nt, Human adenovirus D
aaaaucuuacacuguuguuu

SEQ ID NO: 1570113 - RNA, 18 nt, Human adenovirus D
ccaagaaacgucccagca

SEQ ID NO: 1570114 - RNA, 14 nt, Human adenovirus D
gccuucgugcacug

SEQ ID NO: 1570115 - RNA, 14 nt, Human adenovirus D
cagcacacucacuu

SEQ ID NO: 1570116 - RNA, 20 nt, Human adenovirus D
gccccucaugaacacacugc

SEQ ID NO: 1570117 - RNA, 12 nt, Human adenovirus D
ccgcgcgccgcg

SEQ ID NO: 1570118 - RNA, 22 nt, Human adenovirus D
guuccuggugguacagcacagc

SEQ ID NO: 1570119 - RNA, 16 nt, Human adenovirus D
gccgggcgcugguagg

SEQ ID NO: 1570120 - RNA, 15 nt, Human adenovirus D
uugaaaaggcagcug

SEQ ID NO: 1570121 - RNA, 21 nt, Human adenovirus D
ccacaaugugguagcuuacac

SEQ ID NO: 1570122 - RNA, 15 nt, Human adenovirus D
gucaggcaggauuca

SEQ ID NO: 1570123 - RNA, 18 nt, Human adenovirus D
gccagccuuacucagguu

SEQ ID NO: 1570124 - RNA, 20 nt, Human adenovirus D
auugcaggauugauaaggag

SEQ ID NO: 1570125 - RNA, 17 nt, Human adenovirus D
gcagguggacgagccgc

SEQ ID NO: 1570126 - RNA, 16 nt, Human adenovirus D
ccaccgcuaccgcuuc

SEQ ID NO: 1570127 - RNA, 17 nt, Human adenovirus D
ugcuucaauaauggaag

SEQ ID NO: 1570128 - RNA, 14 nt, Human adenovirus D
cucaacagcuggga

SEQ ID NO: 1570129 - RNA, 18 nt, Human adenovirus D
uguacgacaccacucgcg

SEQ ID NO: 1570130 - RNA, 21 nt, Human adenovirus D
cagcaacccuuccuggucgag

SEQ ID NO: 1570131 - RNA, 13 nt, Human adenovirus D
uguacacugaaaa

SEQ ID NO: 1570132 - RNA, 19 nt, Human adenovirus D
aaaaccaguuuucccccgu

SEQ ID NO: 1570133 - RNA, 16 nt, Human adenovirus D
guucuacccagcaagu

SEQ ID NO: 1570134 - RNA, 14 nt, Human adenovirus D
ccucgaccaugacc

SEQ ID NO: 1570135 - RNA, 21 nt, Human adenovirus D
cgguggucccuucucggacca

SEQ ID NO: 1570136 - RNA, 17 nt, Human adenovirus D
cgaaguuccccucgcag

SEQ ID NO: 1570137 - RNA, 19 nt, Human adenovirus D
acagaaccagauacuucag

SEQ ID NO: 1570138 - RNA, 15 nt, Human adenovirus D
gagcaggaccugggc

SEQ ID NO: 1570139 - RNA, 14 nt, Human adenovirus D
ugcagacucugcuc

SEQ ID NO: 1570140 - RNA, 17 nt, Human adenovirus D
aacauuacuucuggcac

SEQ ID NO: 1570141 - RNA, 20 nt, Human adenovirus D
agcaguccaugcccaacagg

SEQ ID NO: 1570142 - RNA, 13 nt, Human adenovirus D
caccucggugcag

SEQ ID NO: 1570143 - RNA, 18 nt, Human adenovirus D
auguccuuccagggucuc

SEQ ID NO: 1570144 - RNA, 18 nt, Human adenovirus D
agcacugcaaauuuaacu

SEQ ID NO: 1570145 - RNA, 18 nt, Human adenovirus D
ccccuuugucuccuccga

SEQ ID NO: 1570146 - RNA, 21 nt, Human adenovirus D
acuacagcugacaauucagag

SEQ ID NO: 1570147 - RNA, 18 nt, Human adenovirus D
ggaguaccugagcccggg

SEQ ID NO: 1570148 - RNA, 14 nt, Human adenovirus D
cgagcucugcugcg

SEQ ID NO: 1570149 - RNA, 13 nt, Human adenovirus D
cuuucacuuuggu

SEQ ID NO: 1570150 - RNA, 16 nt, Human adenovirus D
ggccguuggaagaugu

SEQ ID NO: 1570151 - RNA, 14 nt, Human adenovirus D
ccagacgcacgggc

SEQ ID NO: 1570152 - RNA, 17 nt, Human adenovirus D
gcuagaaaacacccaca

SEQ ID NO: 1570153 - RNA, 19 nt, Human adenovirus D
agcccugagccgccagcug

SEQ ID NO: 1570154 - RNA, 23 nt, Human adenovirus D
aggggucuaucuggacccccaga

SEQ ID NO: 1570155 - RNA, 14 nt, Human adenovirus D
agagugccacugcc

SEQ ID NO: 1570156 - RNA, 22 nt, Human adenovirus D
cuggaagcccugagccgccagc

SEQ ID NO: 1570157 - RNA, 18 nt, Human adenovirus D
ucagcgcccucagcaguc

SEQ ID NO: 1570158 - RNA, 17 nt, Human adenovirus D
gaguuggugagcucuuc

SEQ ID NO: 1570159 - RNA, 20 nt, Human adenovirus D
cuccugccugggaauccugc

SEQ ID NO: 1570160 - RNA, 19 nt, Human adenovirus D
gugaagaccacuggccccg

SEQ ID NO: 1570161 - RNA, 19 nt, Human adenovirus D
gccuuuagguguugcauga

SEQ ID NO: 1570162 - RNA, 15 nt, Human adenovirus D
cuucaacaucugugc

SEQ ID NO: 1570163 - RNA, 19 nt, Human adenovirus D
auugcccaacaauaaaaga

SEQ ID NO: 1570164 - RNA, 13 nt, Human adenovirus D
ggcacuggagcac

SEQ ID NO: 1570165 - RNA, 21 nt, Human adenovirus D
cucgagcgcccauuccuggag

SEQ ID NO: 1570166 - RNA, 14 nt, Human adenovirus D
cuggacgagagcaa

SEQ ID NO: 1570167 - RNA, 14 nt, Human adenovirus D
auccgcgccgcagc

SEQ ID NO: 1570168 - RNA, 12 nt, Human adenovirus D
gucauccuucca

SEQ ID NO: 1570169 - RNA, 16 nt, Human adenovirus D
gcccgcgugcgccgcg

SEQ ID NO: 1570170 - RNA, 17 nt, Human adenovirus D
ccugcaccugcgucugc

SEQ ID NO: 1570171 - RNA, 17 nt, Human adenovirus D
ggccgaaaaccccgccg

SEQ ID NO: 1570172 - RNA, 15 nt, Human adenovirus D
gccgcuguggagcca

SEQ ID NO: 1570173 - RNA, 15 nt, Human adenovirus D
ggaggaccagguccu

SEQ ID NO: 1570174 - RNA, 14 nt, Human adenovirus D
gcuguccacgggga

SEQ ID NO: 1570175 - RNA, 15 nt, Human adenovirus D
aaaagcucccacagu

SEQ ID NO: 1570176 - RNA, 15 nt, Human adenovirus D
gcgagccggcggcgc

SEQ ID NO: 1570177 - RNA, 22 nt, Human adenovirus D
gcugagccugcgccgggcgcug

SEQ ID NO: 1570178 - RNA, 23 nt, Human adenovirus D
gaagcccgugaccugcagcaggu

SEQ ID NO: 1570179 - RNA, 22 nt, Human adenovirus D
gagcccguagcugcgcggggcc

SEQ ID NO: 1570180 - RNA, 17 nt, Human adenovirus D
gcucggugacgaagaag

SEQ ID NO: 1570181 - RNA, 14 nt, Human adenovirus D
augcaccuguggag

SEQ ID NO: 1570182 - RNA, 15 nt, Human adenovirus D
ggugaaccugagcca

SEQ ID NO: 1570183 - RNA, 16 nt, Human adenovirus D
ggcccgggacggaggc

SEQ ID NO: 1570184 - RNA, 13 nt, Human adenovirus D
gcaacgccuuccc

SEQ ID NO: 1570185 - RNA, 18 nt, Human adenovirus D
uucuagaaacgaggagga

SEQ ID NO: 1570186 - RNA, 22 nt, Human adenovirus D
gggcaucucgcugaugucgccg

SEQ ID NO: 1570187 - RNA, 23 nt, Human adenovirus D
cccccaggcccuggagcagcggc

SEQ ID NO: 1570188 - RNA, 18 nt, Human adenovirus D
ugacagcgacgagacugg

SEQ ID NO: 1570189 - RNA, 19 nt, Human adenovirus D
gagcagguuucucaacagc

SEQ ID NO: 1570190 - RNA, 16 nt, Human adenovirus D
cgugcagcugcagaag

SEQ ID NO: 1570191 - RNA, 16 nt, Human adenovirus D
cgggccccggggcgaa

SEQ ID NO: 1570192 - RNA, 14 nt, Human adenovirus D
ugcagggagccagg

SEQ ID NO: 1570193 - RNA, 23 nt, Human adenovirus D
caagacgcaggccaggaggagac

SEQ ID NO: 1570194 - RNA, 10 nt, Human adenovirus D
gaacuuucuc

SEQ ID NO: 1570195 - RNA, 18 nt, Human adenovirus D
cgugcuugagaugcagau

SEQ ID NO: 1570196 - RNA, 18 nt, Human adenovirus D
ccucuucuauuucuuccu

SEQ ID NO: 1570197 - RNA, 14 nt, Human adenovirus D
agcgcgugcugcgc

SEQ ID NO: 1570198 - RNA, 18 nt, Human adenovirus D
cggggccacgaccgugcc

SEQ ID NO: 1570199 - RNA, 14 nt, Human adenovirus D
agcuauaaaaauga

SEQ ID NO: 1570200 - RNA, 21 nt, Human adenovirus D
ccaagauagcccugcgcccag

SEQ ID NO: 1570201 - RNA, 17 nt, Human adenovirus D
cucgcgcccguagucug

SEQ ID NO: 1570202 - RNA, 15 nt, Human adenovirus D
caccgcuccuggucu

SEQ ID NO: 1570203 - RNA, 18 nt, Human adenovirus D
ucgcgcaacugggccgcu

SEQ ID NO: 1570204 - RNA, 14 nt, Human adenovirus D
gagcuacaugccca

SEQ ID NO: 1570205 - RNA, 12 nt, Human adenovirus D
agcuggcuccgu

SEQ ID NO: 1570206 - RNA, 21 nt, Human adenovirus D
cauccccgcccugcuggaugu

SEQ ID NO: 1570207 - RNA, 23 nt, Human adenovirus D
ggucucgcacucgacgagccagg

SEQ ID NO: 1570208 - RNA, 12 nt, Human adenovirus D
cagcggcgcagg

SEQ ID NO: 1570209 - RNA, 17 nt, Human adenovirus D
cgcggccgcccacggug

SEQ ID NO: 1570210 - RNA, 22 nt, Human adenovirus D
cgaugggcccgugggcugcggc

SEQ ID NO: 1570211 - RNA, 17 nt, Human adenovirus D
cgagcaugaggcggugg

SEQ ID NO: 1570212 - RNA, 12 nt, Human adenovirus D
ccacucgcgggc

SEQ ID NO: 1570213 - RNA, 15 nt, Human adenovirus D
cagcuguuccuggug

SEQ ID NO: 1570214 - RNA, 16 nt, Human adenovirus D
ccauggggcgccgccc

SEQ ID NO: 1570215 - RNA, 17 nt, Human adenovirus D
gucacuuaaguccuggg

SEQ ID NO: 1570216 - RNA, 22 nt, Human adenovirus D
gcugcccguucucgcuggucac

SEQ ID NO: 1570217 - RNA, 17 nt, Human adenovirus D
cuucaccgaccuggguc

SEQ ID NO: 1570218 - RNA, 17 nt, Human adenovirus D
gcgacccccaggcccug

SEQ ID NO: 1570219 - RNA, 13 nt, Human adenovirus D
gaaggugauuggc

SEQ ID NO: 1570220 - RNA, 21 nt, Human adenovirus D
ugcccgacuucaugagccaga

SEQ ID NO: 1570221 - RNA, 15 nt, Human adenovirus D
gccauccccauccag

SEQ ID NO: 1570222 - RNA, 12 nt, Human adenovirus D
gccugaggcaga

SEQ ID NO: 1570223 - RNA, 17 nt, Human adenovirus D
gccgcgguuaugcaggg

SEQ ID NO: 1570224 - RNA, 20 nt, Human adenovirus D
cccacgccgagccugaagcc

SEQ ID NO: 1570225 - RNA, 15 nt, Human adenovirus D
ccgagaccugcgcaa

SEQ ID NO: 1570226 - RNA, 15 nt, Human adenovirus D
uaaguggcaacaccu

SEQ ID NO: 1570227 - RNA, 22 nt, Human adenovirus D
uugcaugccuucgugcacuggc

SEQ ID NO: 1570228 - RNA, 20 nt, Human adenovirus D
cacccgccgccgucugcccc

SEQ ID NO: 1570229 - RNA, 22 nt, Human adenovirus D
agcagaaauuucaagcugggcu

SEQ ID NO: 1570230 - RNA, 23 nt, Human adenovirus D
caucgugcagaacccggacagca

SEQ ID NO: 1570231 - RNA, 20 nt, Human adenovirus D
uagacaaagagcacagcagu

SEQ ID NO: 1570232 - RNA, 13 nt, Human adenovirus D
cggagugaugaau

SEQ ID NO: 1570233 - RNA, 20 nt, Human adenovirus D
cggcguggcgcucgggcagg

SEQ ID NO: 1570234 - RNA, 18 nt, Human adenovirus D
aaacgaagaucagcugca

SEQ ID NO: 1570235 - RNA, 16 nt, Human adenovirus D
ucuucaaccgcuuccc

SEQ ID NO: 1570236 - RNA, 22 nt, Human adenovirus D
guggacuuccgcguaccugcgc

SEQ ID NO: 1570237 - RNA, 15 nt, Human adenovirus D
cucccucguacgaga

SEQ ID NO: 1570238 - RNA, 17 nt, Human adenovirus D
aggacgcagcgugaaga

SEQ ID NO: 1570239 - RNA, 21 nt, Human adenovirus D
uggacccuccgucggaagagg

SEQ ID NO: 1570240 - RNA, 19 nt, Human adenovirus D
cugggcaacggccgcuacg

SEQ ID NO: 1570241 - RNA, 14 nt, Human adenovirus D
ggagaggcauggca

SEQ ID NO: 1570242 - RNA, 19 nt, Human adenovirus D
gcgaaggugucccugacca

SEQ ID NO: 1570243 - RNA, 14 nt, Human adenovirus D
cagcgcuggguggc

SEQ ID NO: 1570244 - RNA, 17 nt, Human adenovirus D
acaguuggcgacccagg

SEQ ID NO: 1570245 - RNA, 22 nt, Human adenovirus D
cagacucugcucauacugcuau

SEQ ID NO: 1570246 - RNA, 22 nt, Human adenovirus D
gcuggcugaaucccacucccac

SEQ ID NO: 1570247 - RNA, 15 nt, Human adenovirus D
cugaccuugcagagc

SEQ ID NO: 1570248 - RNA, 14 nt, Human adenovirus D
aggucugcugguag

SEQ ID NO: 1570249 - RNA, 15 nt, Human adenovirus D
cgaccgcgagcugau

SEQ ID NO: 1570250 - RNA, 14 nt, Human adenovirus D
cgucuacucccagc

SEQ ID NO: 1570251 - RNA, 19 nt, Human adenovirus D
aucucuagcaugaccagac

SEQ ID NO: 1570252 - RNA, 18 nt, Human adenovirus D
acuacauggacaagauau

SEQ ID NO: 1570253 - RNA, 20 nt, Human adenovirus D
ccggucucugcgcucgcuca

SEQ ID NO: 1570254 - RNA, 16 nt, Human adenovirus D
aucagguauccagccu

SEQ ID NO: 1570255 - RNA, 22 nt, Human adenovirus D
uccgcacgguaagagcccagca

SEQ ID NO: 1570256 - RNA, 19 nt, Human adenovirus D
cuuuuaggugaagcaauac

SEQ ID NO: 1570257 - RNA, 18 nt, Human adenovirus D
cccuugaacagcauauac

SEQ ID NO: 1570258 - RNA, 18 nt, Human adenovirus D
uguuuuugcgaaaacacu

SEQ ID NO: 1570259 - RNA, 13 nt, Human adenovirus D
agaucgccgcgac

SEQ ID NO: 1570260 - RNA, 20 nt, Human adenovirus D
uggugcugaaacgggcacgg

SEQ ID NO: 1570261 - RNA, 16 nt, Human adenovirus D
acuugacuuccggguu

SEQ ID NO: 1570262 - RNA, 20 nt, Human adenovirus D
ugagagucugaaaaacagaa

SEQ ID NO: 1570263 - RNA, 18 nt, Human adenovirus D
aacugcuggcccugcugg

SEQ ID NO: 1570264 - RNA, 17 nt, Human adenovirus D
cuugcugacgcccaacu

SEQ ID NO: 1570265 - RNA, 22 nt, Human adenovirus D
ugagcucuuaccaaguccaggg

SEQ ID NO: 1570266 - RNA, 17 nt, Human adenovirus D
cuacaaggcccugggca

SEQ ID NO: 1570267 - RNA, 17 nt, Human adenovirus D
aagucacuuaaguccug

SEQ ID NO: 1570268 - RNA, 22 nt, Human adenovirus D
ggugggcaaaaagaaacaaguc

SEQ ID NO: 1570269 - RNA, 15 nt, Human adenovirus D
aguugcgcaggcgcu

SEQ ID NO: 1570270 - RNA, 19 nt, Human adenovirus D
cuugauuuuuccagcccag

SEQ ID NO: 1570271 - RNA, 18 nt, Human adenovirus D
accagacccaggcgcgga

SEQ ID NO: 1570272 - RNA, 15 nt, Human adenovirus D
cauguucgacuccuc

SEQ ID NO: 1570273 - RNA, 23 nt, Human adenovirus D
caaauucauuuuugaagucaugu

SEQ ID NO: 1570274 - RNA, 13 nt, Human adenovirus D
accagucgggccc

SEQ ID NO: 1570275 - RNA, 20 nt, Human adenovirus D
uagagugccacugccgcugc

SEQ ID NO: 1570276 - RNA, 20 nt, Human adenovirus D
cauuuaauaaagaucacuua

SEQ ID NO: 1570277 - RNA, 15 nt, Human adenovirus D
cuacaugcccagcag

SEQ ID NO: 1570278 - RNA, 20 nt, Human adenovirus D
cagcccauaauucagggugc

SEQ ID NO: 1570279 - RNA, 15 nt, Human adenovirus D
ccggccaaggccacc

SEQ ID NO: 1570280 - RNA, 19 nt, Human adenovirus D
aggcggcggucaccucaac

SEQ ID NO: 1570281 - RNA, 13 nt, Human adenovirus D
accgacgcugggc

SEQ ID NO: 1570282 - RNA, 21 nt, Human adenovirus D
ucgcagcgcugcacgggcugu

SEQ ID NO: 1570283 - RNA, 18 nt, Human adenovirus D
auggccucgugcucuggg

SEQ ID NO: 1570284 - RNA, 16 nt, Human adenovirus D
ccugcauuggcagccg

SEQ ID NO: 1570285 - RNA, 23 nt, Human adenovirus D
aaggauucaaaacucacuuuggu

SEQ ID NO: 1570286 - RNA, 13 nt, Human adenovirus D
auaguaaagaaac

SEQ ID NO: 1570287 - RNA, 16 nt, Human adenovirus D
ggucccgcucccagcg

SEQ ID NO: 1570288 - RNA, 19 nt, Human adenovirus D
uccaacguggagcugacca

SEQ ID NO: 1570289 - RNA, 18 nt, Human adenovirus D
aguugggccuccaggaau

SEQ ID NO: 1570290 - RNA, 23 nt, Human adenovirus D
ucuccaucauguucgacuccucg

SEQ ID NO: 1570291 - RNA, 13 nt, Human adenovirus D
uggugauggccug

SEQ ID NO: 1570292 - RNA, 14 nt, Human adenovirus D
acaucagccaggac

SEQ ID NO: 1570293 - RNA, 15 nt, Human adenovirus D
gccgcgcgcuggggc

SEQ ID NO: 1570294 - RNA, 13 nt, Human adenovirus D
aagauacagagua

SEQ ID NO: 1570295 - RNA, 21 nt, Human adenovirus D
cguucgcgaggacgcagcgug

SEQ ID NO: 1570296 - RNA, 14 nt, Human adenovirus D
gacucgcugcugca

SEQ ID NO: 1570297 - RNA, 21 nt, Human adenovirus D
gugcaacuuuagccagaccaa

SEQ ID NO: 1570298 - RNA, 15 nt, Human adenovirus D
cgaacuuucuccaca

SEQ ID NO: 1570299 - RNA, 13 nt, Human adenovirus D
gugcagcagagcg

SEQ ID NO: 1570300 - RNA, 13 nt, Human adenovirus D
gaugcugagccug

SEQ ID NO: 1570301 - RNA, 17 nt, Human adenovirus D
cccagcguaagcgcgcg

SEQ ID NO: 1570302 - RNA, 20 nt, Human adenovirus D
cccggggcggaguggccucu

SEQ ID NO: 1570303 - RNA, 17 nt, Human adenovirus D
ggacguggugcugcugc

SEQ ID NO: 1570304 - RNA, 23 nt, Human adenovirus D
cuuggagcaggguaaagccagca

SEQ ID NO: 1570305 - RNA, 22 nt, Human adenovirus D
gagaugucugugaagcagugug

SEQ ID NO: 1570306 - RNA, 18 nt, Human adenovirus D
ggagguagcaccacugca

SEQ ID NO: 1570307 - RNA, 18 nt, Human adenovirus D
caccgccuccacccugga

SEQ ID NO: 1570308 - RNA, 18 nt, Human adenovirus D
gcagcaggagcgugccgc

SEQ ID NO: 1570309 - RNA, 13 nt, Human adenovirus D
guugggcagcgag

SEQ ID NO: 1570310 - RNA, 15 nt, Human adenovirus D
gcagcagcaguagcc

SEQ ID NO: 1570311 - RNA, 13 nt, Human adenovirus D
cccgcgugcgccg

SEQ ID NO: 1570312 - RNA, 15 nt, Human adenovirus D
uguccuugaggagga

SEQ ID NO: 1570313 - RNA, 20 nt, Human adenovirus D
ccggccgcgcuugcugggcg

SEQ ID NO: 1570314 - RNA, 21 nt, Human adenovirus D
ugcagaacaacgauuucaccc

SEQ ID NO: 1570315 - RNA, 23 nt, Human adenovirus D
gagggaugcaugcggggggagau

SEQ ID NO: 1570316 - RNA, 14 nt, Human adenovirus D
gcuucuacagccag

SEQ ID NO: 1570317 - RNA, 18 nt, Human adenovirus D
ggcacggcacgcggccgu

SEQ ID NO: 1570318 - RNA, 20 nt, Human adenovirus D
caucauccaaggccaucugc

SEQ ID NO: 1570319 - RNA, 14 nt, Human adenovirus D
ucagccaggacucu

SEQ ID NO: 1570320 - RNA, 23 nt, Human adenovirus D
cuuaaaucauuuaaaauaaaacu

SEQ ID NO: 1570321 - RNA, 16 nt, Human adenovirus D
ggccacucccagcgcc

SEQ ID NO: 1570322 - RNA, 16 nt, Human adenovirus D
ccccauggcgcacaac

SEQ ID NO: 1570323 - RNA, 16 nt, Human adenovirus D
cgcggacgcgcucccg

SEQ ID NO: 1570324 - RNA, 22 nt, Human adenovirus D
aggggccaagaaggccggggcc

SEQ ID NO: 1570325 - RNA, 15 nt, Human adenovirus D
ggaugcaugcggggg

SEQ ID NO: 1570326 - RNA, 17 nt, Human adenovirus D
guccgccaagcuccucg

SEQ ID NO: 1570327 - RNA, 21 nt, Human adenovirus D
cucaucugcagggcgcccagc

SEQ ID NO: 1570328 - RNA, 15 nt, Human adenovirus D
uauuagaugacaaaa

SEQ ID NO: 1570329 - RNA, 15 nt, Human adenovirus D
cuugcaacuugcaaa

SEQ ID NO: 1570330 - RNA, 12 nt, Human adenovirus D
accaccugguga

SEQ ID NO: 1570331 - RNA, 17 nt, Human adenovirus D
cuaugggaacaaggccu

SEQ ID NO: 1570332 - RNA, 16 nt, Human adenovirus D
ugcgccgaagcgccgu

SEQ ID NO: 1570333 - RNA, 15 nt, Human adenovirus D
gugaggguguccugg

SEQ ID NO: 1570334 - RNA, 22 nt, Human adenovirus D
auggccuccagccuuuccaugg

SEQ ID NO: 1570335 - RNA, 17 nt, Human adenovirus D
aggacuacaaggccguc

SEQ ID NO: 1570336 - RNA, 20 nt, Human adenovirus D
cguccgcaguacucgcagcg

SEQ ID NO: 1570337 - RNA, 19 nt, Human adenovirus D
gaacaaaacccaugaaaga

SEQ ID NO: 1570338 - RNA, 21 nt, Human adenovirus D
ccacugcuccugcgaaagccc

SEQ ID NO: 1570339 - RNA, 16 nt, Human adenovirus D
gcaagacgcaggccag

SEQ ID NO: 1570340 - RNA, 17 nt, Human adenovirus D
cugaaggaaaaaucacu

SEQ ID NO: 1570341 - RNA, 19 nt, Human adenovirus D
cuuuagguguugcaugaug

SEQ ID NO: 1570342 - RNA, 21 nt, Human adenovirus D
ugcaacaugaccaaggacugg

SEQ ID NO: 1570343 - RNA, 14 nt, Human adenovirus D
caagagcgagaugu

SEQ ID NO: 1570344 - RNA, 19 nt, Human adenovirus D
cgcgcgcgaggagguggcc

SEQ ID NO: 1570345 - RNA, 15 nt, Human adenovirus D
uccaguacucccgga

SEQ ID NO: 1570346 - RNA, 16 nt, Human adenovirus D
guccccgcccgccgcc

SEQ ID NO: 1570347 - RNA, 15 nt, Human adenovirus D
cucggucaggagcaa

SEQ ID NO: 1570348 - RNA, 14 nt, Human adenovirus D
cuaggcgcagcugc

SEQ ID NO: 1570349 - RNA, 20 nt, Human adenovirus D
acucugguacuccagucucc

SEQ ID NO: 1570350 - RNA, 12 nt, Human adenovirus D
cccgcacccggc

SEQ ID NO: 1570351 - RNA, 21 nt, Human adenovirus D
cacccgguacuacgccagccg

SEQ ID NO: 1570352 - RNA, 13 nt, Human adenovirus D
cagucugaugaau

SEQ ID NO: 1570353 - RNA, 16 nt, Human adenovirus D
gaggacgaguaccuga

SEQ ID NO: 1570354 - RNA, 16 nt, Human adenovirus D
aguucacuagccucca

SEQ ID NO: 1570355 - RNA, 18 nt, Human adenovirus D
ggaaacagacagccaggu

SEQ ID NO: 1570356 - RNA, 19 nt, Human adenovirus D
caucaucgcgccacuggcc

SEQ ID NO: 1570357 - RNA, 13 nt, Human adenovirus D
gcuguaaagccag

SEQ ID NO: 1570358 - RNA, 17 nt, Human adenovirus D
gcaguacucgcagcgcu

SEQ ID NO: 1570359 - RNA, 14 nt, Human adenovirus D
uggccacggggagc

SEQ ID NO: 1570360 - RNA, 16 nt, Human adenovirus D
acaacgccaggcuggc

SEQ ID NO: 1570361 - RNA, 14 nt, Human adenovirus D
cgagcgccagcugu

SEQ ID NO: 1570362 - RNA, 19 nt, Human adenovirus D
aaggugcugacauccaugg

SEQ ID NO: 1570363 - RNA, 17 nt, Human adenovirus D
guaccaugggaaaugca

SEQ ID NO: 1570364 - RNA, 17 nt, Human adenovirus D
gcucggccaugccccag

SEQ ID NO: 1570365 - RNA, 17 nt, Human adenovirus D
cucaucacaucagccag

SEQ ID NO: 1570366 - RNA, 20 nt, Human adenovirus D
ccugcgcaaggucgaggaga

SEQ ID NO: 1570367 - RNA, 13 nt, Human adenovirus D
gcagcacauaauc

SEQ ID NO: 1570368 - RNA, 22 nt, Human adenovirus D
cccagcaacccuuccuggucga

SEQ ID NO: 1570369 - RNA, 18 nt, Human adenovirus D
cuacacggucacugucca

SEQ ID NO: 1570370 - RNA, 20 nt, Human adenovirus D
cccgagggucgcuggcugcu

SEQ ID NO: 1570371 - RNA, 14 nt, Human adenovirus D
ucuauuuucaaggu

SEQ ID NO: 1570372 - RNA, 14 nt, Human adenovirus D
acucaccaaggcca

SEQ ID NO: 1570373 - RNA, 16 nt, Human adenovirus D
cggccguagcaggcgc

SEQ ID NO: 1570374 - RNA, 14 nt, Human adenovirus D
cgcgcccgcagcac

SEQ ID NO: 1570375 - RNA, 24 nt, Human adenovirus D
gcaggguaaagccagcagcacaug

SEQ ID NO: 1570376 - RNA, 12 nt, Human adenovirus D
cccccagcuccu

SEQ ID NO: 1570377 - RNA, 16 nt, Human adenovirus D
uccugaagaacaucca

SEQ ID NO: 1570378 - RNA, 19 nt, Human adenovirus D
ccaguuucaaacccuacuc

SEQ ID NO: 1570379 - RNA, 21 nt, Human adenovirus D
caacagaaccggaggcuggcu

SEQ ID NO: 1570380 - RNA, 22 nt, Human adenovirus D
uccccucaucacaucagccagg

SEQ ID NO: 1570381 - RNA, 22 nt, Human adenovirus D
gccuccgcgguauauggcuccu

SEQ ID NO: 1570382 - RNA, 20 nt, Human adenovirus D
cuccucuuugcccugcucac

SEQ ID NO: 1570383 - RNA, 17 nt, Human adenovirus D
cugagauaugugcagca

SEQ ID NO: 1570384 - RNA, 19 nt, Human adenovirus D
ugggcacccacgacacagc

SEQ ID NO: 1570385 - RNA, 22 nt, Human adenovirus D
acgcggaucucacggccugcgu

SEQ ID NO: 1570386 - RNA, 18 nt, Human adenovirus D
cguccgucagcagcagga

SEQ ID NO: 1570387 - RNA, 22 nt, Human adenovirus D
agaaccugaaggagcuggacaa

SEQ ID NO: 1570388 - RNA, 21 nt, Human adenovirus D
gcggaguccagcgagugaccg

SEQ ID NO: 1570389 - RNA, 14 nt, Human adenovirus D
ccggccaaggccac

SEQ ID NO: 1570390 - RNA, 13 nt, Human adenovirus D
gagcagacgguga

SEQ ID NO: 1570391 - RNA, 15 nt, Human adenovirus D
guucuggagacacug

SEQ ID NO: 1570392 - RNA, 14 nt, Human adenovirus D
gacuacaaggccgu

SEQ ID NO: 1570393 - RNA, 13 nt, Human adenovirus D
guacccgaggacu

SEQ ID NO: 1570394 - RNA, 21 nt, Human adenovirus D
gcugaucaacaucuugcagag

SEQ ID NO: 1570395 - RNA, 21 nt, Human adenovirus D
ucuuccgcaacuuccagccca

SEQ ID NO: 1570396 - RNA, 21 nt, Human adenovirus D
aaaucacucuuuccagcagca

SEQ ID NO: 1570397 - RNA, 23 nt, Human adenovirus D
ugcggccguccuuucgcugcugc

SEQ ID NO: 1570398 - RNA, 19 nt, Human adenovirus D
gagaugcgacccaugagcu

SEQ ID NO: 1570399 - RNA, 19 nt, Human adenovirus D
uuccaucaucgccgaggag

SEQ ID NO: 1570400 - RNA, 16 nt, Human adenovirus D
gacucacccuggggcu

SEQ ID NO: 1570401 - RNA, 21 nt, Human adenovirus D
gcgggccaugcgcaggcgccu

SEQ ID NO: 1570402 - RNA, 19 nt, Human adenovirus D
ggccaugagggucuggagc

SEQ ID NO: 1570403 - RNA, 16 nt, Human adenovirus D
ucccggccaaggccac

SEQ ID NO: 1570404 - RNA, 13 nt, Human adenovirus D
cgcguggaggaag

SEQ ID NO: 1570405 - RNA, 15 nt, Human adenovirus D
gcgaggucauucgag

SEQ ID NO: 1570406 - RNA, 17 nt, Human adenovirus D
cuguauuaccuuccuug

SEQ ID NO: 1570407 - RNA, 17 nt, Human adenovirus D
uagccagaccaagcugc

SEQ ID NO: 1570408 - RNA, 16 nt, Human adenovirus D
acuccgcgaccuccuc

SEQ ID NO: 1570409 - RNA, 18 nt, Human adenovirus D
ucagaauauccccuuccu

SEQ ID NO: 1570410 - RNA, 20 nt, Human adenovirus D
gcuaguguacaacgcccugc

SEQ ID NO: 1570411 - RNA, 16 nt, Human adenovirus D
accaggcagugcagcg

SEQ ID NO: 1570412 - RNA, 19 nt, Human adenovirus D
gagcugaugcugagccugc

SEQ ID NO: 1570413 - RNA, 12 nt, Human adenovirus D
gcggcugcugca

SEQ ID NO: 1570414 - RNA, 19 nt, Human adenovirus D
aguuuccugacgagccaaa

SEQ ID NO: 1570415 - RNA, 14 nt, Human adenovirus D
gucugaagcgccgc

SEQ ID NO: 1570416 - RNA, 13 nt, Human adenovirus D
augggaaugagag

SEQ ID NO: 1570417 - RNA, 13 nt, Human adenovirus D
ggggccagguccu

SEQ ID NO: 1570418 - RNA, 15 nt, Human adenovirus D
gcgucccuggcuccg

SEQ ID NO: 1570419 - RNA, 19 nt, Human adenovirus D
acaguauugugggccuggg

SEQ ID NO: 1570420 - RNA, 14 nt, Human adenovirus D
agggccucggcggc

SEQ ID NO: 1570421 - RNA, 13 nt, Human adenovirus D
cuugacagcaccg

SEQ ID NO: 1570422 - RNA, 22 nt, Human adenovirus D
cggguguaaugaaacccgccac

SEQ ID NO: 1570423 - RNA, 21 nt, Human adenovirus D
gccaggggaugaacaguggca

SEQ ID NO: 1570424 - RNA, 16 nt, Human adenovirus D
aggcgcgcccacccgg

SEQ ID NO: 1570425 - RNA, 21 nt, Human adenovirus D
uuaauaugggagagaacaaaa

SEQ ID NO: 1570426 - RNA, 18 nt, Human adenovirus D
uccuucaacgacuaccuc

SEQ ID NO: 1570427 - RNA, 20 nt, Human adenovirus D
ggcagguggucgaugagauc

SEQ ID NO: 1570428 - RNA, 15 nt, Human adenovirus D
agaagaacaggagcc

SEQ ID NO: 1570429 - RNA, 14 nt, Human adenovirus D
caguuugggcacug

SEQ ID NO: 1570430 - RNA, 18 nt, Human adenovirus D
cccaggcccuggagcagc

SEQ ID NO: 1570431 - RNA, 21 nt, Human adenovirus D
ucuugcuagauucucugggug

SEQ ID NO: 1570432 - RNA, 18 nt, Human adenovirus D
caagcuugguggcaaagg

SEQ ID NO: 1570433 - RNA, 22 nt, Human adenovirus D
gcugccccaggcggugcugcug

SEQ ID NO: 1570434 - RNA, 18 nt, Human adenovirus D
ccagccuguacccagagc

SEQ ID NO: 1570435 - RNA, 15 nt, Human adenovirus D
gcagagcagcucuuc

SEQ ID NO: 1570436 - RNA, 16 nt, Human adenovirus D
cugaagaacauccaug

SEQ ID NO: 1570437 - RNA, 11 nt, Human adenovirus D
acaugacaugg

SEQ ID NO: 1570438 - RNA, 12 nt, Human adenovirus D
ggcugcuggagc

SEQ ID NO: 1570439 - RNA, 17 nt, Human adenovirus D
cucaauaaacagcacuu

SEQ ID NO: 1570440 - RNA, 17 nt, Human adenovirus D
uugcgcgagcagaacgg

SEQ ID NO: 1570441 - RNA, 13 nt, Human adenovirus D
cgcgcgggcagga

SEQ ID NO: 1570442 - RNA, 12 nt, Human adenovirus D
aauaagucacua

SEQ ID NO: 1570443 - RNA, 16 nt, Human adenovirus D
gcagcgcauccugcaa

SEQ ID NO: 1570444 - RNA, 14 nt, Human adenovirus D
acaugaccaaggac

SEQ ID NO: 1570445 - RNA, 14 nt, Human adenovirus D
ccugcuggagcgcg

SEQ ID NO: 1570446 - RNA, 22 nt, Human adenovirus D
uccagauggaaaggucacuugg

SEQ ID NO: 1570447 - RNA, 20 nt, Human adenovirus D
ccguuuaucaauaagcuaau

SEQ ID NO: 1570448 - RNA, 22 nt, Human adenovirus D
caauaagguucugcccuccgcc

SEQ ID NO: 1570449 - RNA, 21 nt, Human adenovirus D
ugcauggccucgugcucuggg

SEQ ID NO: 1570450 - RNA, 13 nt, Human adenovirus D
gcagguggcgccg

SEQ ID NO: 1570451 - RNA, 15 nt, Human adenovirus D
gucgccucggaccug

SEQ ID NO: 1570452 - RNA, 11 nt, Human adenovirus D
aguccagcaga

SEQ ID NO: 1570453 - RNA, 20 nt, Human adenovirus D
cccucaggcgcaaccaggag

SEQ ID NO: 1570454 - RNA, 13 nt, Human adenovirus D
caccuuccagccg

SEQ ID NO: 1570455 - RNA, 15 nt, Human adenovirus D
cucgcggcugcugcu

SEQ ID NO: 1570456 - RNA, 15 nt, Human adenovirus D
gcgacaacgccaggc

SEQ ID NO: 1570457 - RNA, 18 nt, Human adenovirus D
cggcagcggggccuggug

SEQ ID NO: 1570458 - RNA, 13 nt, Human adenovirus D
ggcgugcagaccg

SEQ ID NO: 1570459 - RNA, 18 nt, Human adenovirus D
guacuaaugacagaggca

SEQ ID NO: 1570460 - RNA, 14 nt, Human adenovirus D
gcaccauccccagg

SEQ ID NO: 1570461 - RNA, 19 nt, Human adenovirus D
ggccucuucgcccgaccgc

SEQ ID NO: 1570462 - RNA, 14 nt, Human adenovirus D
gccugaggcagacg

SEQ ID NO: 1570463 - RNA, 14 nt, Human adenovirus D
gccuggggcagaca

SEQ ID NO: 1570464 - RNA, 16 nt, Human adenovirus D
  misc_feature (7)..(7): n is a, c, g or u
ggccgangggagucgc

SEQ ID NO: 1570465 - RNA, 15 nt, Human adenovirus D
aggaggaccaggucc

SEQ ID NO: 1570466 - RNA, 16 nt, Human adenovirus D
gccuccaccacccacg

SEQ ID NO: 1570467 - RNA, 16 nt, Human adenovirus D
ggcacggcacgcggcc

SEQ ID NO: 1570468 - RNA, 20 nt, Human adenovirus D
ucagcuaaucaugccccaca

SEQ ID NO: 1570469 - RNA, 21 nt, Human adenovirus D
cacaguauugugggccuggga

SEQ ID NO: 1570470 - RNA, 15 nt, Human adenovirus D
cagcgccgcgcugga

SEQ ID NO: 1570471 - RNA, 22 nt, Human adenovirus D
cuggaagagguaguugagggug

SEQ ID NO: 1570472 - RNA, 19 nt, Human adenovirus D
uaaaaaugcaguugaauuu

SEQ ID NO: 1570473 - RNA, 15 nt, Human adenovirus D
cggucaggagcaagc

SEQ ID NO: 1570474 - RNA, 13 nt, Human adenovirus D
gcucccacagugc

SEQ ID NO: 1570475 - RNA, 22 nt, Human adenovirus D
acucccagcgccgcgcuggaca

SEQ ID NO: 1570476 - RNA, 16 nt, Human adenovirus D
ccugggaggagaggag

SEQ ID NO: 1570477 - RNA, 15 nt, Human adenovirus D
ggagcccacccgcug

SEQ ID NO: 1570478 - RNA, 19 nt, Human adenovirus D
cgaggaggagcgcauccug

SEQ ID NO: 1570479 - RNA, 15 nt, Human adenovirus D
ggagcggucuggacc

SEQ ID NO: 1570480 - RNA, 19 nt, Human adenovirus D
gccaauaacgggauagaga

SEQ ID NO: 1570481 - RNA, 16 nt, Human adenovirus D
ccuacucgggcacggc

SEQ ID NO: 1570482 - RNA, 21 nt, Human adenovirus D
acggaccggucccagcgucug

SEQ ID NO: 1570483 - RNA, 17 nt, Human adenovirus D
ggaccaaccccacgcac

SEQ ID NO: 1570484 - RNA, 13 nt, Human adenovirus D
cgcccgcgccgcg

SEQ ID NO: 1570485 - RNA, 16 nt, Human adenovirus D
ugaccuugcagagcag

SEQ ID NO: 1570486 - RNA, 13 nt, Human adenovirus D
caggagcacgagc

SEQ ID NO: 1570487 - RNA, 19 nt, Human adenovirus D
ugugggaccuggcggaggc

SEQ ID NO: 1570488 - RNA, 16 nt, Human adenovirus D
cagcaauaacaccggc

SEQ ID NO: 1570489 - RNA, 23 nt, Human adenovirus D
ggcgacgacgcgcucggcgagga

SEQ ID NO: 1570490 - RNA, 18 nt, Human adenovirus D
cauaagaaucacauuaaa

SEQ ID NO: 1570491 - RNA, 14 nt, Human adenovirus D
gcauggcaggcagc

SEQ ID NO: 1570492 - RNA, 17 nt, Human adenovirus D
acaucaauuuugcgucc

SEQ ID NO: 1570493 - RNA, 22 nt, Human adenovirus D
acgcugagcgacgaccugggcg

SEQ ID NO: 1570494 - RNA, 15 nt, Human adenovirus D
cuuugacacaccugg

SEQ ID NO: 1570495 - RNA, 21 nt, Human adenovirus D
cacugcaccccccgcaggcag

SEQ ID NO: 1570496 - RNA, 18 nt, Human adenovirus D
gaguggccucucgcucca

SEQ ID NO: 1570497 - RNA, 23 nt, Human adenovirus D
cagggaugaguugggccugaugc

SEQ ID NO: 1570498 - RNA, 20 nt, Human adenovirus D
gaggccgccuacgguccaga

SEQ ID NO: 1570499 - RNA, 15 nt, Human adenovirus D
ccaagcgggccucac

SEQ ID NO: 1570500 - RNA, 20 nt, Human adenovirus D
uuuuauggcugcuggauggg

SEQ ID NO: 1570501 - RNA, 23 nt, Human adenovirus D
cgcauguacaacaugcugacugc

SEQ ID NO: 1570502 - RNA, 14 nt, Human adenovirus D
gaccaccaccugga

SEQ ID NO: 1570503 - RNA, 15 nt, Human adenovirus D
agcccaaacuggggc

SEQ ID NO: 1570504 - RNA, 15 nt, Human adenovirus D
gcaggcagcggccug

SEQ ID NO: 1570505 - RNA, 13 nt, Human adenovirus D
acaaagcugaaag

SEQ ID NO: 1570506 - RNA, 16 nt, Human adenovirus D
aguacauguucaccag

SEQ ID NO: 1570507 - RNA, 22 nt, Human adenovirus D
ugcagcguguucaaaacaacaa

SEQ ID NO: 1570508 - RNA, 15 nt, Human adenovirus D
aauuaugcuccuggg

SEQ ID NO: 1570509 - RNA, 19 nt, Human adenovirus D
ggagcugaucucgcugccg

SEQ ID NO: 1570510 - RNA, 20 nt, Human adenovirus D
gaucccagcguaagcgcgcg

SEQ ID NO: 1570511 - RNA, 19 nt, Human adenovirus D
uguucaaaacaacaagauu

SEQ ID NO: 1570512 - RNA, 16 nt, Human adenovirus D
gcgcacguggcggcgg

SEQ ID NO: 1570513 - RNA, 17 nt, Human adenovirus D
cuuccuccguagccugg

SEQ ID NO: 1570514 - RNA, 21 nt, Human adenovirus D
cacgagcaagacgcaggccag

SEQ ID NO: 1570515 - RNA, 10 nt, Human adenovirus D
aaaacacaca

SEQ ID NO: 1570516 - RNA, 14 nt, Human adenovirus D
ggcggugguagccg

SEQ ID NO: 1570517 - RNA, 22 nt, Human adenovirus D
uacacucgcagugcacgggcau

SEQ ID NO: 1570518 - RNA, 13 nt, Human adenovirus D
cgccacaggugcu

SEQ ID NO: 1570519 - RNA, 19 nt, Human adenovirus D
ccugggcugcgggccuacu

SEQ ID NO: 1570520 - RNA, 20 nt, Human adenovirus D
gcccagagcucgcgggccau

SEQ ID NO: 1570521 - RNA, 17 nt, Human adenovirus D
gaaucgcgggcggccuu

SEQ ID NO: 1570522 - RNA, 16 nt, Human adenovirus D
cgcgcgcgguaggccc

SEQ ID NO: 1570523 - RNA, 13 nt, Human adenovirus D
aaagcgccaggag

SEQ ID NO: 1570524 - RNA, 20 nt, Human adenovirus D
gcgaagauggggccccgcca

SEQ ID NO: 1570525 - RNA, 19 nt, Human adenovirus D
aggcgggacagaggaggga

SEQ ID NO: 1570526 - RNA, 23 nt, Human adenovirus D
agugaucgcgggcuuuguaacuc

SEQ ID NO: 1570527 - RNA, 16 nt, Human adenovirus D
ccgggucucccccagc

SEQ ID NO: 1570528 - RNA, 16 nt, Human adenovirus D
cuggaccggcugguga

SEQ ID NO: 1570529 - RNA, 12 nt, Human adenovirus D
gacccaggcgcg

SEQ ID NO: 1570530 - RNA, 19 nt, Human adenovirus D
ggccugaaccgccgccggc

SEQ ID NO: 1570531 - RNA, 22 nt, Human adenovirus D
cugccuggugaagggcacagcc

SEQ ID NO: 1570532 - RNA, 17 nt, Human adenovirus D
agacugcuaucaggaga

SEQ ID NO: 1570533 - RNA, 13 nt, Human adenovirus D
ccuggcucccagc

SEQ ID NO: 1570534 - RNA, 19 nt, Human adenovirus D
ucgccacaggugcugccca

SEQ ID NO: 1570535 - RNA, 13 nt, Human adenovirus D
cgcccggggccag

SEQ ID NO: 1570536 - RNA, 21 nt, Human adenovirus D
cguggacgcugcucaccaccc

SEQ ID NO: 1570537 - RNA, 21 nt, Human adenovirus D
cauggcgcaguaguccagcgu

SEQ ID NO: 1570538 - RNA, 13 nt, Human adenovirus D
guaccgcagcugg

SEQ ID NO: 1570539 - RNA, 17 nt, Human adenovirus D
cuagagugaggcacugc

SEQ ID NO: 1570540 - RNA, 19 nt, Human adenovirus D
ccagcaucgaggugcagac

SEQ ID NO: 1570541 - RNA, 15 nt, Human adenovirus D
aacaauaugugcgca

SEQ ID NO: 1570542 - RNA, 15 nt, Human adenovirus D
aggcgcuggaagagg

SEQ ID NO: 1570543 - RNA, 14 nt, Human adenovirus D
gucgaggagaccug

SEQ ID NO: 1570544 - RNA, 17 nt, Human adenovirus D
uaaugguccugcaagag

SEQ ID NO: 1570545 - RNA, 14 nt, Human adenovirus D
agcucaugcuggcc

SEQ ID NO: 1570546 - RNA, 21 nt, Human adenovirus D
agccaguggaagaggggcagc

SEQ ID NO: 1570547 - RNA, 13 nt, Human adenovirus D
cugagcucgcucg

SEQ ID NO: 1570548 - RNA, 12 nt, Human adenovirus D
ccaaaaucagaa

SEQ ID NO: 1570549 - RNA, 13 nt, Human adenovirus D
cgagcgcaccguc

SEQ ID NO: 1570550 - RNA, 20 nt, Human adenovirus D
uuagucauguguaaauaaag

SEQ ID NO: 1570551 - RNA, 18 nt, Human adenovirus D
cccuccacuuucauaauc

SEQ ID NO: 1570552 - RNA, 18 nt, Human adenovirus D
ccugcuggccgagcugga

SEQ ID NO: 1570553 - RNA, 21 nt, Human adenovirus D
cgcuacugcugauuacucuaa

SEQ ID NO: 1570554 - RNA, 15 nt, Human adenovirus D
cacaucgaggcccuc

SEQ ID NO: 1570555 - RNA, 22 nt, Human adenovirus D
aggaggacuuaaccacccacga

SEQ ID NO: 1570556 - RNA, 18 nt, Human adenovirus D
cccugcccuuccagcaca

SEQ ID NO: 1570557 - RNA, 23 nt, Human adenovirus D
gccccgccaaccggcugaugccc

SEQ ID NO: 1570558 - RNA, 14 nt, Human adenovirus D
cuuccguugcgcug

SEQ ID NO: 1570559 - RNA, 18 nt, Human adenovirus D
cucggugcggcugcugca

SEQ ID NO: 1570560 - RNA, 14 nt, Human adenovirus D
gcccaggccgcucu

SEQ ID NO: 1570561 - RNA, 21 nt, Human adenovirus D
gcggaccugcauuggcagccg

SEQ ID NO: 1570562 - RNA, 18 nt, Human adenovirus D
agccgcgcgccgcgccgc

SEQ ID NO: 1570563 - RNA, 19 nt, Human adenovirus D
caaaagcguccgcuccgca

SEQ ID NO: 1570564 - RNA, 18 nt, Human adenovirus D
cauggccucgugcucugg

SEQ ID NO: 1570565 - RNA, 16 nt, Human adenovirus D
ugccgguuucgggcgg

SEQ ID NO: 1570566 - RNA, 19 nt, Human adenovirus D
gcagaagaucccggcgcag

SEQ ID NO: 1570567 - RNA, 18 nt, Human adenovirus D
gucccucauccuccggga

SEQ ID NO: 1570568 - RNA, 11 nt, Human adenovirus D
gcgaacagcag

SEQ ID NO: 1570569 - RNA, 22 nt, Human adenovirus D
cauugauacccuggacaaggcc

SEQ ID NO: 1570570 - RNA, 14 nt, Human adenovirus D
auuuaauuggcaaa

SEQ ID NO: 1570571 - RNA, 22 nt, Human adenovirus D
cggcgaugacugaccaccaccu

SEQ ID NO: 1570572 - RNA, 19 nt, Human adenovirus D
guccuucacucccaaccag

SEQ ID NO: 1570573 - RNA, 14 nt, Human adenovirus D
gcgucuccaugagu

SEQ ID NO: 1570574 - RNA, 11 nt, Human adenovirus D
ccugagcgaga

SEQ ID NO: 1570575 - RNA, 15 nt, Human adenovirus D
agcccgauagccgcc

SEQ ID NO: 1570576 - RNA, 20 nt, Human adenovirus D
cugccaacauuacuucuggc

SEQ ID NO: 1570577 - RNA, 14 nt, Human adenovirus D
ucgauccagcagac

SEQ ID NO: 1570578 - RNA, 13 nt, Human adenovirus D
ggggcauugcagg

SEQ ID NO: 1570579 - RNA, 12 nt, Human adenovirus D
uuaaugcugccu

SEQ ID NO: 1570580 - RNA, 16 nt, Human adenovirus D
guaguggcucgcgccc

SEQ ID NO: 1570581 - RNA, 14 nt, Human adenovirus D
ugacggcgggcuga

SEQ ID NO: 1570582 - RNA, 17 nt, Human adenovirus D
ugucaaagcgcaucuac

SEQ ID NO: 1570583 - RNA, 15 nt, Human adenovirus D
gcagacagggccugc

SEQ ID NO: 1570584 - RNA, 18 nt, Human adenovirus D
uauggugaucagccauga

SEQ ID NO: 1570585 - RNA, 17 nt, Human adenovirus D
cuucuauggaggcagag

SEQ ID NO: 1570586 - RNA, 17 nt, Human adenovirus D
cuggucacccucgagcu

SEQ ID NO: 1570587 - RNA, 19 nt, Human adenovirus D
cgggccugggcgugcagac

SEQ ID NO: 1570588 - RNA, 15 nt, Human adenovirus D
ggugcuaaagcucuu

SEQ ID NO: 1570589 - RNA, 15 nt, Human adenovirus D
agaucggcaccagcc

SEQ ID NO: 1570590 - RNA, 13 nt, Human adenovirus D
gacccacagccag

SEQ ID NO: 1570591 - RNA, 20 nt, Human adenovirus D
gcccucgaugaaagucagga

SEQ ID NO: 1570592 - RNA, 17 nt, Human adenovirus D
caacgucaaccccuuca

SEQ ID NO: 1570593 - RNA, 14 nt, Human adenovirus D
cucaaaaagcugug

SEQ ID NO: 1570594 - RNA, 21 nt, Human adenovirus D
ugcgcguaggagucuugcagc

SEQ ID NO: 1570595 - RNA, 22 nt, Human adenovirus D
uggagcagugucuggagcgggc

SEQ ID NO: 1570596 - RNA, 16 nt, Human adenovirus D
ucucuucuuguaacuu

SEQ ID NO: 1570597 - RNA, 19 nt, Human adenovirus D
ugcucgucagggggguccg

SEQ ID NO: 1570598 - RNA, 17 nt, Human adenovirus D
gcaugaccagacccagg

SEQ ID NO: 1570599 - RNA, 18 nt, Human adenovirus D
uccaagcgggccucacag

SEQ ID NO: 1570600 - RNA, 12 nt, Human adenovirus D
uaaaaacccugg

SEQ ID NO: 1570601 - RNA, 14 nt, Human adenovirus D
acucggagcuggcu

SEQ ID NO: 1570602 - RNA, 18 nt, Human adenovirus D
cauggacgggaaccccac

SEQ ID NO: 1570603 - RNA, 22 nt, Human adenovirus D
cucaaagaccagaacuuccagc

SEQ ID NO: 1570604 - RNA, 21 nt, Human adenovirus D
ugguccagauggaaaggucac

SEQ ID NO: 1570605 - RNA, 13 nt, Human adenovirus D
ccgagccugaagc

SEQ ID NO: 1570606 - RNA, 12 nt, Human adenovirus D
cugaaagcaugg

SEQ ID NO: 1570607 - RNA, 22 nt, Human adenovirus D
agguuucucaacagcugggacu

SEQ ID NO: 1570608 - RNA, 14 nt, Human adenovirus D
agggucuggagcuc

SEQ ID NO: 1570609 - RNA, 14 nt, Human adenovirus D
ucagcugcagcgca

SEQ ID NO: 1570610 - RNA, 16 nt, Human adenovirus D
agcauauaccccuccu

SEQ ID NO: 1570611 - RNA, 17 nt, Human adenovirus D
acgugcccaucuccauc

SEQ ID NO: 1570612 - RNA, 17 nt, Human adenovirus D
gagcaggaccugggcuu

SEQ ID NO: 1570613 - RNA, 21 nt, Human adenovirus D
augcaggauaaauauggccug

SEQ ID NO: 1570614 - RNA, 23 nt, Human adenovirus D
gcucaccaucugagcucuuacca

SEQ ID NO: 1570615 - RNA, 20 nt, Human adenovirus D
aggaggcccaucuacaggcc

SEQ ID NO: 1570616 - RNA, 22 nt, Human adenovirus D
cugcacgagaaccgccuggggc

SEQ ID NO: 1570617 - RNA, 13 nt, Human adenovirus D
cuuuaucugcugg

SEQ ID NO: 1570618 - RNA, 19 nt, Human adenovirus D
ugaaccacacggccagcag

SEQ ID NO: 1570619 - RNA, 18 nt, Human adenovirus D
gccgccggggcucggugc

SEQ ID NO: 1570620 - RNA, 14 nt, Human adenovirus D
ugcaaccugugcuc

SEQ ID NO: 1570621 - RNA, 16 nt, Human adenovirus D
cggugguaggccccug

SEQ ID NO: 1570622 - RNA, 19 nt, Human adenovirus D
uucccuggaagagugccca

SEQ ID NO: 1570623 - RNA, 17 nt, Human adenovirus D
cuaccugggagucucua

SEQ ID NO: 1570624 - RNA, 17 nt, Human adenovirus D
gcaucgaggugcagacc

SEQ ID NO: 1570625 - RNA, 17 nt, Human adenovirus D
ggggcucguuaguccag

SEQ ID NO: 1570626 - RNA, 16 nt, Human adenovirus D
ccacgaccggcagcgg

SEQ ID NO: 1570627 - RNA, 17 nt, Human adenovirus D
cagcgcuggguggccgg

SEQ ID NO: 1570628 - RNA, 23 nt, Human adenovirus D
uggccaacagccacaugacccug

SEQ ID NO: 1570629 - RNA, 14 nt, Human adenovirus D
gcauggcuaccugg

SEQ ID NO: 1570630 - RNA, 23 nt, Human adenovirus D
cugcaacccccagcuccugagcg

SEQ ID NO: 1570631 - RNA, 20 nt, Human adenovirus D
cucguacccgcucaccaucu

SEQ ID NO: 1570632 - RNA, 16 nt, Human adenovirus D
ccagcuggccgcccug

SEQ ID NO: 1570633 - RNA, 21 nt, Human adenovirus D
uacauagaccacgcuacaaau

SEQ ID NO: 1570634 - RNA, 13 nt, Human adenovirus D
ucacccucgagcu

SEQ ID NO: 1570635 - RNA, 16 nt, Human adenovirus D
cgcccugcuggagcgc

SEQ ID NO: 1570636 - RNA, 19 nt, Human adenovirus D
ccgcgugacgcacuggccg

SEQ ID NO: 1570637 - RNA, 12 nt, Human adenovirus D
cgcgggaagagc

SEQ ID NO: 1570638 - RNA, 13 nt, Human adenovirus D
gagcgccagcugu

SEQ ID NO: 1570639 - RNA, 15 nt, Human adenovirus D
cucuucuuccaugac

SEQ ID NO: 1570640 - RNA, 14 nt, Human adenovirus D
aaugcuccaaagcu

SEQ ID NO: 1570641 - RNA, 23 nt, Human adenovirus D
gacagagauggacuuggaagagg

SEQ ID NO: 1570642 - RNA, 20 nt, Human adenovirus D
gcagcccuucuccacgggga

SEQ ID NO: 1570643 - RNA, 17 nt, Human adenovirus D
gcgauccucgcccaauu

SEQ ID NO: 1570644 - RNA, 23 nt, Human adenovirus D
ucgcgccucaaugucagcugcaa

SEQ ID NO: 1570645 - RNA, 20 nt, Human adenovirus D
auguggaacucugcggugga

SEQ ID NO: 1570646 - RNA, 21 nt, Human adenovirus D
ucaaacagcaaagcaucuuua

SEQ ID NO: 1570647 - RNA, 18 nt, Human adenovirus D
ucacauccaucuccacca

SEQ ID NO: 1570648 - RNA, 22 nt, Human adenovirus D
guaggcccugguccaccucucc

SEQ ID NO: 1570649 - RNA, 14 nt, Human adenovirus D
ccgagaccgugagc

SEQ ID NO: 1570650 - RNA, 19 nt, Human adenovirus D
uucucaucucgcccagcaa

SEQ ID NO: 1570651 - RNA, 19 nt, Human adenovirus D
agcuccgguugugcagccc

SEQ ID NO: 1570652 - RNA, 20 nt, Human adenovirus D
gugaagguuaguugcagacc

SEQ ID NO: 1570653 - RNA, 18 nt, Human adenovirus D
acugcucuucccuggaga

SEQ ID NO: 1570654 - RNA, 15 nt, Human adenovirus D
cgucccgacgaggcc

SEQ ID NO: 1570655 - RNA, 19 nt, Human adenovirus D
gugacucggcugagcucgc

SEQ ID NO: 1570656 - RNA, 15 nt, Human adenovirus D
ccgcaacuuccagcc

SEQ ID NO: 1570657 - RNA, 22 nt, Human adenovirus D
ucucuagcaugaccagacccag

SEQ ID NO: 1570658 - RNA, 19 nt, Human adenovirus D
cucgccgucuacucccagc

SEQ ID NO: 1570659 - RNA, 17 nt, Human adenovirus D
uugagcccaucaagcaa

SEQ ID NO: 1570660 - RNA, 14 nt, Human adenovirus D
cgcaggcgacccug

SEQ ID NO: 1570661 - RNA, 16 nt, Human adenovirus D
cguuacucggagcugg

SEQ ID NO: 1570662 - RNA, 22 nt, Human adenovirus D
cugcugcugaucgcgcccuuca

SEQ ID NO: 1570663 - RNA, 17 nt, Human adenovirus D
ccucaugaacacacugc

SEQ ID NO: 1570664 - RNA, 13 nt, Human adenovirus D
cugggggcggugg

SEQ ID NO: 1570665 - RNA, 19 nt, Human adenovirus D
cagaacccggacagcaagc

SEQ ID NO: 1570666 - RNA, 23 nt, Human adenovirus D
cgaccgcauccacaaggccguga

SEQ ID NO: 1570667 - RNA, 19 nt, Human adenovirus D
gcugggacccugugaccaa

SEQ ID NO: 1570668 - RNA, 21 nt, Human adenovirus D
ccagcaucgaggugcagaccg

SEQ ID NO: 1570669 - RNA, 15 nt, Human adenovirus D
ggcagcggggccugg

SEQ ID NO: 1570670 - RNA, 20 nt, Human adenovirus D
aggauaaauauggccuggag

SEQ ID NO: 1570671 - RNA, 18 nt, Human adenovirus D
uguagagggaaccuacca

SEQ ID NO: 1570672 - RNA, 22 nt, Human adenovirus D
ggaacucgucgcuugacagcac

SEQ ID NO: 1570673 - RNA, 11 nt, Human adenovirus D
acaaggccugg

SEQ ID NO: 1570674 - RNA, 21 nt, Human adenovirus D
aacuacuggcuucuacagcca

SEQ ID NO: 1570675 - RNA, 19 nt, Human adenovirus D
acgguccagaggacuugga

SEQ ID NO: 1570676 - RNA, 15 nt, Human adenovirus D
aacucagucacucuc

SEQ ID NO: 1570677 - RNA, 16 nt, Human adenovirus D
cggcuguagaccacgu

SEQ ID NO: 1570678 - RNA, 15 nt, Human adenovirus D
aucacuggcggaggc

SEQ ID NO: 1570679 - RNA, 22 nt, Human adenovirus D
gggaaaggaauaggcacugaaa

SEQ ID NO: 1570680 - RNA, 20 nt, Human adenovirus D
acgacgacauccuggaccag

SEQ ID NO: 1570681 - RNA, 23 nt, Human adenovirus D
gcauuacuauuacugccacugcc

SEQ ID NO: 1570682 - RNA, 19 nt, Human adenovirus D
caguauggugaucagccau

SEQ ID NO: 1570683 - RNA, 17 nt, Human adenovirus D
gaacugauaagacacau

SEQ ID NO: 1570684 - RNA, 13 nt, Human adenovirus D
cccuucuccagca

SEQ ID NO: 1570685 - RNA, 24 nt, Human adenovirus D
cagcacaugguaauccacggacag

SEQ ID NO: 1570686 - RNA, 21 nt, Human adenovirus D
gccagcuggccgcccugaccc

SEQ ID NO: 1570687 - RNA, 20 nt, Human adenovirus D
aaaucacucuuuccagcagc

SEQ ID NO: 1570688 - RNA, 17 nt, Human adenovirus D
uggcuugguacccgcga

SEQ ID NO: 1570689 - RNA, 14 nt, Human adenovirus D
cacaucagccagga

SEQ ID NO: 1570690 - RNA, 16 nt, Human adenovirus D
ucaucucgcccagcaa

SEQ ID NO: 1570691 - RNA, 19 nt, Human adenovirus D
auugauuuuuacaccagcg

SEQ ID NO: 1570692 - RNA, 16 nt, Human adenovirus D
cgcgcuugcugggcga

SEQ ID NO: 1570693 - RNA, 17 nt, Human adenovirus D
ccugacacaaaacuaau

SEQ ID NO: 1570694 - RNA, 18 nt, Human adenovirus D
acggacuugauuggccug

SEQ ID NO: 1570695 - RNA, 20 nt, Human adenovirus D
cacgcguguugcggcccggc

SEQ ID NO: 1570696 - RNA, 15 nt, Human adenovirus D
cguccgcaggcggga

SEQ ID NO: 1570697 - RNA, 16 nt, Human adenovirus D
cugcggcgcggagcaa

SEQ ID NO: 1570698 - RNA, 18 nt, Human adenovirus D
aggcuagcacgcagacga

SEQ ID NO: 1570699 - RNA, 20 nt, Human adenovirus D
accuuggcuuugcuggguug

SEQ ID NO: 1570700 - RNA, 21 nt, Human adenovirus D
uguggagggcaugggucaggc

SEQ ID NO: 1570701 - RNA, 15 nt, Human adenovirus D
guccaugggcgccuu

SEQ ID NO: 1570702 - RNA, 12 nt, Human adenovirus D
cuucuacagcca

SEQ ID NO: 1570703 - RNA, 17 nt, Human adenovirus D
cugcuucugccugguga

SEQ ID NO: 1570704 - RNA, 13 nt, Human adenovirus D
ccugagcccgggu

SEQ ID NO: 1570705 - RNA, 21 nt, Human adenovirus D
gacucaggggguugcgcacgu

SEQ ID NO: 1570706 - RNA, 16 nt, Human adenovirus D
ggcggugcugcugccg

SEQ ID NO: 1570707 - RNA, 23 nt, Human adenovirus D
caggcccagaacuggcagagcac

SEQ ID NO: 1570708 - RNA, 15 nt, Human adenovirus D
cacuacagccggggu

SEQ ID NO: 1570709 - RNA, 16 nt, Human adenovirus D
agaccgugcaggggcc

SEQ ID NO: 1570710 - RNA, 14 nt, Human adenovirus D
ugcgguacacgggg

SEQ ID NO: 1570711 - RNA, 16 nt, Human adenovirus D
ugcuggaugcggagcc

SEQ ID NO: 1570712 - RNA, 15 nt, Human adenovirus D
cuugcaaacaauaaa

SEQ ID NO: 1570713 - RNA, 24 nt, Human adenovirus D
ggcgauaugccagacgcaagagcc

SEQ ID NO: 1570714 - RNA, 17 nt, Human adenovirus D
uauuacuaggcccagca

SEQ ID NO: 1570715 - RNA, 22 nt, Human adenovirus D
uaaucaccauguuauucagcag

SEQ ID NO: 1570716 - RNA, 21 nt, Human adenovirus D
gcaagagcucaaaguaaaaaa

SEQ ID NO: 1570717 - RNA, 18 nt, Human adenovirus D
cuccaacguggagcugac

SEQ ID NO: 1570718 - RNA, 17 nt, Human adenovirus D
acuguugcagagagaug

SEQ ID NO: 1570719 - RNA, 19 nt, Human adenovirus D
gcagcucaucgacuggugc

SEQ ID NO: 1570720 - RNA, 19 nt, Human adenovirus D
agaugccccagcagaagca

SEQ ID NO: 1570721 - RNA, 18 nt, Human adenovirus D
gcggcggaugguggcgag

SEQ ID NO: 1570722 - RNA, 15 nt, Human adenovirus D
gcaccccccgcaggc

SEQ ID NO: 1570723 - RNA, 17 nt, Human adenovirus D
agagucugaaaaacaga

SEQ ID NO: 1570724 - RNA, 21 nt, Human adenovirus D
ccgugcgcuaccaccccagca

SEQ ID NO: 1570725 - RNA, 20 nt, Human adenovirus D
gcauggccucgugcucuggg

SEQ ID NO: 1570726 - RNA, 13 nt, Human adenovirus D
ggccagcacgcuc

SEQ ID NO: 1570727 - RNA, 18 nt, Human adenovirus D
gaagacgagggcgcgcag

SEQ ID NO: 1570728 - RNA, 17 nt, Human adenovirus D
agccgugaucccacagg

SEQ ID NO: 1570729 - RNA, 18 nt, Human adenovirus D
ucccaugauucaguacuu

SEQ ID NO: 1570730 - RNA, 15 nt, Human adenovirus D
cucugccgccggggc

SEQ ID NO: 1570731 - RNA, 18 nt, Human adenovirus D
accguagagggcaccacc

SEQ ID NO: 1570732 - RNA, 16 nt, Human adenovirus D
cccgaguuguccuggu

SEQ ID NO: 1570733 - RNA, 18 nt, Human adenovirus D
ugcgcgaguucgcuccgc

SEQ ID NO: 1570734 - RNA, 16 nt, Human adenovirus D
guggugguggcggggc

SEQ ID NO: 1570735 - RNA, 22 nt, Human adenovirus D
gggggguccgcaucgaugguga

SEQ ID NO: 1570736 - RNA, 21 nt, Human adenovirus D
augaccccgaugacggguugc

SEQ ID NO: 1570737 - RNA, 19 nt, Human adenovirus D
guuccgaauuaccgaggaa

SEQ ID NO: 1570738 - RNA, 16 nt, Human adenovirus D
ggcggagggugccaga

SEQ ID NO: 1570739 - RNA, 15 nt, Human adenovirus D
gcgugaagacgccgc

SEQ ID NO: 1570740 - RNA, 18 nt, Human adenovirus D
cacaguaagugcagcaca

SEQ ID NO: 1570741 - RNA, 16 nt, Human adenovirus D
cgacaugcccgacccc

SEQ ID NO: 1570742 - RNA, 12 nt, Human adenovirus D
cucugugcccag

SEQ ID NO: 1570743 - RNA, 22 nt, Human adenovirus D
caucauaagacauuuuaaugaa

SEQ ID NO: 1570744 - RNA, 18 nt, Human adenovirus D
cauuaacgggguggugga

SEQ ID NO: 1570745 - RNA, 15 nt, Human adenovirus D
cugacuacccacuga

SEQ ID NO: 1570746 - RNA, 18 nt, Human adenovirus D
cagggcgaaggugucccu

SEQ ID NO: 1570747 - RNA, 20 nt, Human adenovirus D
gucccccgccgcuguggagc

SEQ ID NO: 1570748 - RNA, 16 nt, Human adenovirus D
ccaugugaccucccac

SEQ ID NO: 1570749 - RNA, 18 nt, Human adenovirus D
gccgugggcgacaaccgg

SEQ ID NO: 1570750 - RNA, 18 nt, Human adenovirus D
uagaagagcccccucccc

SEQ ID NO: 1570751 - RNA, 21 nt, Human adenovirus D
acaucauaauuaugcuccugg

SEQ ID NO: 1570752 - RNA, 16 nt, Human adenovirus D
ucaugcaacuuggaag

SEQ ID NO: 1570753 - RNA, 13 nt, Human adenovirus D
cuccgcagugggc

SEQ ID NO: 1570754 - RNA, 11 nt, Human adenovirus D
cuggagcagcg

SEQ ID NO: 1570755 - RNA, 21 nt, Human adenovirus D
uucaaggccauaaaucugccc

SEQ ID NO: 1570756 - RNA, 15 nt, Human adenovirus D
aucagcugcagcgca

SEQ ID NO: 1570757 - RNA, 14 nt, Human adenovirus D
uuccugguccacaa

SEQ ID NO: 1570758 - RNA, 14 nt, Human adenovirus D
cuacaugcccagca

SEQ ID NO: 1570759 - RNA, 16 nt, Human adenovirus D
gcccugguccaccucu

SEQ ID NO: 1570760 - RNA, 21 nt, Human adenovirus D
uacaacaucggcuaccagggc

SEQ ID NO: 1570761 - RNA, 20 nt, Human adenovirus D
uccugagcgagacccagguc

SEQ ID NO: 1570762 - RNA, 15 nt, Human adenovirus D
cuggagacgggcugc

SEQ ID NO: 1570763 - RNA, 21 nt, Human adenovirus D
cccaggacgagaccagaggca

SEQ ID NO: 1570764 - RNA, 18 nt, Human adenovirus D
cuuugaaccugaaagaca

SEQ ID NO: 1570765 - RNA, 12 nt, Human adenovirus D
cacgcccgcucc

SEQ ID NO: 1570766 - RNA, 16 nt, Human adenovirus D
cauggccaacagccac

SEQ ID NO: 1570767 - RNA, 22 nt, Human adenovirus D
gcaggugacagcguuccccucc

SEQ ID NO: 1570768 - RNA, 18 nt, Human adenovirus D
uaugaccaugcagacucu

SEQ ID NO: 1570769 - RNA, 19 nt, Human adenovirus D
gacuccucggucagcuggc

SEQ ID NO: 1570770 - RNA, 23 nt, Human adenovirus D
cucugggggcgguggugguggcg

SEQ ID NO: 1570771 - RNA, 21 nt, Human adenovirus D
gcaacauccccgcccugcugg

SEQ ID NO: 1570772 - RNA, 22 nt, Human adenovirus D
uggcucuaaaaaauaugcaagg

SEQ ID NO: 1570773 - RNA, 14 nt, Human adenovirus D
uauggccuggagca

SEQ ID NO: 1570774 - RNA, 19 nt, Human adenovirus D
gugcuggaggguugaaaga

SEQ ID NO: 1570775 - RNA, 15 nt, Human adenovirus D
gacugaccaccaccu

SEQ ID NO: 1570776 - RNA, 21 nt, Human adenovirus D
augauccagcggcgcaggggc

SEQ ID NO: 1570777 - RNA, 21 nt, Human adenovirus D
caugccgaagaagaacaggag

SEQ ID NO: 1570778 - RNA, 15 nt, Human adenovirus D
auggcugcuggaugg

SEQ ID NO: 1570779 - RNA, 16 nt, Human adenovirus D
cgcgaagaggagcuga

SEQ ID NO: 1570780 - RNA, 12 nt, Human adenovirus D
cagucacucuca

SEQ ID NO: 1570781 - RNA, 22 nt, Human adenovirus D
ggcgaccggucgacggugagca

SEQ ID NO: 1570782 - RNA, 11 nt, Human adenovirus D
ccagcagcagg

SEQ ID NO: 1570783 - RNA, 14 nt, Human adenovirus D
caaaaauuaucuuu

SEQ ID NO: 1570784 - RNA, 16 nt, Human adenovirus D
guaaagccagaaagaa

SEQ ID NO: 1570785 - RNA, 14 nt, Human adenovirus D
gcuucacucuggcc

SEQ ID NO: 1570786 - RNA, 21 nt, Human adenovirus D
gaccuugcagagcagcucuuc

SEQ ID NO: 1570787 - RNA, 21 nt, Human adenovirus D
cgguggauuuuuuccaagacc

SEQ ID NO: 1570788 - RNA, 15 nt, Human adenovirus D
acagcacagcaggga

SEQ ID NO: 1570789 - RNA, 18 nt, Human adenovirus D
gaagaccauaguaaagaa

SEQ ID NO: 1570790 - RNA, 20 nt, Human adenovirus D
cuauaauccacacaguuucc

SEQ ID NO: 1570791 - RNA, 20 nt, Human adenovirus D
gaaacgucccagcagcaccc

SEQ ID NO: 1570792 - RNA, 12 nt, Human adenovirus D
caaacaaaagcc

SEQ ID NO: 1570793 - RNA, 17 nt, Human adenovirus D
cgcagcgcugcacgggc

SEQ ID NO: 1570794 - RNA, 15 nt, Human adenovirus D
gcgcccugagagcgc

SEQ ID NO: 1570795 - RNA, 15 nt, Human adenovirus D
gcaagggcgaccagc

SEQ ID NO: 1570796 - RNA, 13 nt, Human adenovirus D
aagcuggccugcg

SEQ ID NO: 1570797 - RNA, 18 nt, Human adenovirus D
acagcuagacaccacagu

SEQ ID NO: 1570798 - RNA, 17 nt, Human adenovirus D
gcugccaugggaggaag

SEQ ID NO: 1570799 - RNA, 21 nt, Human adenovirus D
cgcuggcggagaacaaggcca

SEQ ID NO: 1570800 - RNA, 22 nt, Human adenovirus D
gagcagacggugaagcaggagc

SEQ ID NO: 1570801 - RNA, 15 nt, Human adenovirus D
cgucaggcaggcaug

SEQ ID NO: 1570802 - RNA, 19 nt, Human adenovirus D
gcgcucgcgcaccugcuac

SEQ ID NO: 1570803 - RNA, 13 nt, Human adenovirus D
acccgaggagcgg

SEQ ID NO: 1570804 - RNA, 13 nt, Human adenovirus D
cgcgcgcugcccg

SEQ ID NO: 1570805 - RNA, 13 nt, Human adenovirus D
gaguaccugagcc

SEQ ID NO: 1570806 - RNA, 12 nt, Human adenovirus D
gaacgggggcag

SEQ ID NO: 1570807 - RNA, 23 nt, Human adenovirus D
ccagcaaauuccucgaccaugac

SEQ ID NO: 1570808 - RNA, 13 nt, Human adenovirus D
aguugguggccgu

SEQ ID NO: 1570809 - RNA, 14 nt, Human adenovirus D
cgucccagcagcac

SEQ ID NO: 1570810 - RNA, 13 nt, Human adenovirus D
ugcuaaagcucuu

SEQ ID NO: 1570811 - RNA, 19 nt, Human adenovirus D
ccacacauggcaagcugcc

SEQ ID NO: 1570812 - RNA, 19 nt, Human adenovirus D
ggacccugugaccaagcug

SEQ ID NO: 1570813 - RNA, 18 nt, Human adenovirus D
ugcauuggggauaaaguu

SEQ ID NO: 1570814 - RNA, 23 nt, Human adenovirus D
gacagccaggucaaaacccacuc

SEQ ID NO: 1570815 - RNA, 16 nt, Human adenovirus D
ucggugcggcugcugc

SEQ ID NO: 1570816 - RNA, 19 nt, Human adenovirus D
gcccuguggacgcuguuag

SEQ ID NO: 1570817 - RNA, 16 nt, Human adenovirus D
aggaggaugugcugcu

SEQ ID NO: 1570818 - RNA, 16 nt, Human adenovirus D
gcccuccgcccugagc

SEQ ID NO: 1570819 - RNA, 16 nt, Human adenovirus D
accaggaugcagccag

SEQ ID NO: 1570820 - RNA, 13 nt, Human adenovirus D
aggcaaagcucaa

SEQ ID NO: 1570821 - RNA, 21 nt, Human adenovirus D
accgcuccaugcuucugggca

SEQ ID NO: 1570822 - RNA, 14 nt, Human adenovirus D
uuuacaugcacugg

SEQ ID NO: 1570823 - RNA, 14 nt, Human adenovirus D
gugagcgcgagccg

SEQ ID NO: 1570824 - RNA, 22 nt, Human adenovirus D
gagcuuuuacaacgaccucgcc

SEQ ID NO: 1570825 - RNA, 17 nt, Human adenovirus D
ccgcgcucggugacaaa

SEQ ID NO: 1570826 - RNA, 21 nt, Human adenovirus D
gagcagcuugcgcgcuggcuu

SEQ ID NO: 1570827 - RNA, 13 nt, Human adenovirus D
acagagagccgcc

SEQ ID NO: 1570828 - RNA, 13 nt, Human adenovirus D
gcggaggagacga

SEQ ID NO: 1570829 - RNA, 21 nt, Human adenovirus D
gcgaggccauaggccaggcgc

SEQ ID NO: 1570830 - RNA, 14 nt, Human adenovirus D
gcugccggaccuca

SEQ ID NO: 1570831 - RNA, 21 nt, Human adenovirus D
ugaaaugaagccguccucuga

SEQ ID NO: 1570832 - RNA, 14 nt, Human adenovirus D
caacgccaggcugg

SEQ ID NO: 1570833 - RNA, 19 nt, Human adenovirus D
ggcgugcacuggcucgccu

SEQ ID NO: 1570834 - RNA, 21 nt, Human adenovirus D
gcugccgucgucccggaggag

SEQ ID NO: 1570835 - RNA, 20 nt, Human adenovirus D
acuuacuugaaaucugaaag

SEQ ID NO: 1570836 - RNA, 19 nt, Human adenovirus D
gcugcugaaacaccugcag

SEQ ID NO: 1570837 - RNA, 19 nt, Human adenovirus D
acaaucagccccuuccccu

SEQ ID NO: 1570838 - RNA, 21 nt, Human adenovirus D
acgccucggaguaccugagcc

SEQ ID NO: 1570839 - RNA, 23 nt, Human adenovirus D
ugcugccccaggcggugcugcug

SEQ ID NO: 1570840 - RNA, 13 nt, Human adenovirus D
cgcgagggccugg

SEQ ID NO: 1570841 - RNA, 15 nt, Human adenovirus D
uaggaccccagggac

SEQ ID NO: 1570842 - RNA, 14 nt, Human adenovirus D
ugugaccaagcugg

SEQ ID NO: 1570843 - RNA, 12 nt, Human adenovirus D
guccuggucacc

SEQ ID NO: 1570844 - RNA, 18 nt, Human adenovirus D
cucaugcccuuccgcgcc

SEQ ID NO: 1570845 - RNA, 18 nt, Human adenovirus D
gacuaucuaugaaagcau

SEQ ID NO: 1570846 - RNA, 22 nt, Human adenovirus D
uccccucgcgcaacugggccgc

SEQ ID NO: 1570847 - RNA, 19 nt, Human adenovirus D
gacuuccgcguaccugcgc

SEQ ID NO: 1570848 - RNA, 14 nt, Human adenovirus D
cguggugcugcugc

SEQ ID NO: 1570849 - RNA, 18 nt, Human adenovirus D
ugccuucgugcacuggcc

SEQ ID NO: 1570850 - RNA, 16 nt, Human adenovirus D
ccaggggguccaccuu

SEQ ID NO: 1570851 - RNA, 11 nt, Human adenovirus D
uguccggggcg

SEQ ID NO: 1570852 - RNA, 18 nt, Human adenovirus D
uggcuccuacggagggca

SEQ ID NO: 1570853 - RNA, 14 nt, Human adenovirus D
agugacaauuuaac

SEQ ID NO: 1570854 - RNA, 19 nt, Human adenovirus D
uggcaacaccugggcacug

SEQ ID NO: 1570855 - RNA, 22 nt, Human adenovirus D
uuauaaucgccagggaacugaa

SEQ ID NO: 1570856 - RNA, 17 nt, Human adenovirus D
guaguucaggagcgcag

SEQ ID NO: 1570857 - RNA, 16 nt, Human adenovirus D
gccgagcuggaagccc

SEQ ID NO: 1570858 - RNA, 23 nt, Human adenovirus D
ggcgaaguugaaaaacugggcgu

SEQ ID NO: 1570859 - RNA, 15 nt, Human adenovirus D
ugggacagccagcag

SEQ ID NO: 1570860 - RNA, 19 nt, Human adenovirus D
caaaaacagacuggucaaa

SEQ ID NO: 1570861 - RNA, 19 nt, Human adenovirus D
cauucuggacuucgcagcc

SEQ ID NO: 1570862 - RNA, 15 nt, Human adenovirus D
cgccuuggaggccgc

SEQ ID NO: 1570863 - RNA, 19 nt, Human adenovirus D
ggccgccuuuagguguugc

SEQ ID NO: 1570864 - RNA, 23 nt, Human adenovirus D
accacugccgccgccugcgcugc

SEQ ID NO: 1570865 - RNA, 13 nt, Human adenovirus D
acaggccgcagcu

SEQ ID NO: 1570866 - RNA, 12 nt, Human adenovirus D
cuccacgugccg

SEQ ID NO: 1570867 - RNA, 22 nt, Human adenovirus D
gagauccagguccgggggcagg

SEQ ID NO: 1570868 - RNA, 17 nt, Human adenovirus D
uggaacccaaaguauga

SEQ ID NO: 1570869 - RNA, 22 nt, Human adenovirus D
acccacgugguauacaagccag

SEQ ID NO: 1570870 - RNA, 18 nt, Human adenovirus D
cgagaagcggccgcggcc

SEQ ID NO: 1570871 - RNA, 17 nt, Human adenovirus D
cagaaagaaguggccag

SEQ ID NO: 1570872 - RNA, 20 nt, Human adenovirus D
gcacguuucgucaggcaggc

SEQ ID NO: 1570873 - RNA, 20 nt, Human adenovirus D
cucucggccauucuggaggc

SEQ ID NO: 1570874 - RNA, 20 nt, Human adenovirus D
cggcagggugagccggccgc

SEQ ID NO: 1570875 - RNA, 14 nt, Human adenovirus D
ccggcaacgaccgg

SEQ ID NO: 1570876 - RNA, 16 nt, Human adenovirus D
gguccugcaagaggag

SEQ ID NO: 1570877 - RNA, 20 nt, Human adenovirus D
gccuucuauggaggcagagc

SEQ ID NO: 1570878 - RNA, 22 nt, Human adenovirus D
cugaugaaucgcaagcgcccag

SEQ ID NO: 1570879 - RNA, 21 nt, Human adenovirus D
cggcaccugcgagcccaaccc

SEQ ID NO: 1570880 - RNA, 17 nt, Human adenovirus D
ucuguccaaccccgaag

SEQ ID NO: 1570881 - RNA, 16 nt, Human adenovirus D
aguggccucucgcucc

SEQ ID NO: 1570882 - RNA, 14 nt, Human adenovirus D
ggggcggcagaggc

SEQ ID NO: 1570883 - RNA, 21 nt, Human adenovirus D
gacuccgcgaccuccucccca

SEQ ID NO: 1570884 - RNA, 22 nt, Human adenovirus D
agcucccacagugcccccucca

SEQ ID NO: 1570885 - RNA, 16 nt, Human adenovirus D
ggcauggcaggcagcg

SEQ ID NO: 1570886 - RNA, 19 nt, Human adenovirus D
ccugggcauagucgcgccg

SEQ ID NO: 1570887 - RNA, 13 nt, Human adenovirus D
cuuccgcgccaag

SEQ ID NO: 1570888 - RNA, 14 nt, Human adenovirus D
uggaucgaaaucaa

SEQ ID NO: 1570889 - RNA, 21 nt, Human adenovirus D
acccucaggcgcaaccaggag

SEQ ID NO: 1570890 - RNA, 22 nt, Human adenovirus D
ugugauuaaaaagcagcacagu

SEQ ID NO: 1570891 - RNA, 16 nt, Human adenovirus D
ucguacuucugccagc

SEQ ID NO: 1570892 - RNA, 23 nt, Human adenovirus D
gcggacggaucgcccaggcgcca

SEQ ID NO: 1570893 - RNA, 19 nt, Human adenovirus D
guugucugugggaucuuua

SEQ ID NO: 1570894 - RNA, 20 nt, Human adenovirus D
cggcgcgcccggggccaggu

SEQ ID NO: 1570895 - RNA, 18 nt, Human adenovirus D
cugacgggggugcccaac

SEQ ID NO: 1570896 - RNA, 22 nt, Human adenovirus D
gcgguacacgggguugcagcac

SEQ ID NO: 1570897 - RNA, 14 nt, Human adenovirus D
cugcucucucuucu

SEQ ID NO: 1570898 - RNA, 19 nt, Human adenovirus D
cguccuuucgcugcugccg

SEQ ID NO: 1570899 - RNA, 20 nt, Human adenovirus D
ccgccauggggcgccgcccg

SEQ ID NO: 1570900 - RNA, 17 nt, Human adenovirus D
cuaucuaugaaagcaua

SEQ ID NO: 1570901 - RNA, 13 nt, Human adenovirus D
ccccaggcggugc

SEQ ID NO: 1570902 - RNA, 15 nt, Human adenovirus D
augccagacgcaaga

SEQ ID NO: 1570903 - RNA, 20 nt, Human adenovirus D
gccgcgggcgccucccagga

SEQ ID NO: 1570904 - RNA, 22 nt, Human adenovirus D
acgacacagcgauucccgggcu

SEQ ID NO: 1570905 - RNA, 18 nt, Human adenovirus D
gcgaccccguucgcgagg

SEQ ID NO: 1570906 - RNA, 21 nt, Human adenovirus D
gucauagcaggggcgcugggc

SEQ ID NO: 1570907 - RNA, 14 nt, Human adenovirus D
acauagaccacgcu

SEQ ID NO: 1570908 - RNA, 16 nt, Human adenovirus D
gccaucgugcagaacc

SEQ ID NO: 1570909 - RNA, 16 nt, Human adenovirus D
cugauggccacgggga

SEQ ID NO: 1570910 - RNA, 21 nt, Human adenovirus D
gguggauagcuaugauccaga

SEQ ID NO: 1570911 - RNA, 16 nt, Human adenovirus D
gugcaggaccaccagg

SEQ ID NO: 1570912 - RNA, 15 nt, Human adenovirus D
ugacauacaucuuuu

SEQ ID NO: 1570913 - RNA, 18 nt, Human adenovirus D
gagaucggcaccagccag

SEQ ID NO: 1570914 - RNA, 14 nt, Human adenovirus D
uccaacguggagcu

SEQ ID NO: 1570915 - RNA, 20 nt, Human adenovirus D
ggcgaacgugccgcgcgggc

SEQ ID NO: 1570916 - RNA, 20 nt, Human adenovirus D
ccauugguugaacccagaug

SEQ ID NO: 1570917 - RNA, 16 nt, Human adenovirus D
caacaucaccauugaa

SEQ ID NO: 1570918 - RNA, 22 nt, Human adenovirus D
gaucaucuccccgcggcggcga

SEQ ID NO: 1570919 - RNA, 15 nt, Human adenovirus D
agcgucgaggagcug

SEQ ID NO: 1570920 - RNA, 15 nt, Human adenovirus D
acgcccuugugcccg

SEQ ID NO: 1570921 - RNA, 18 nt, Human adenovirus D
gguucauguugugcagga

SEQ ID NO: 1570922 - RNA, 16 nt, Human adenovirus D
cuuccagcccaugagc

SEQ ID NO: 1570923 - RNA, 18 nt, Human adenovirus D
gcaguagccccucugugc

SEQ ID NO: 1570924 - RNA, 19 nt, Human adenovirus D
gccguagagguagcgggac

SEQ ID NO: 1570925 - RNA, 16 nt, Human adenovirus D
gggcguccagcgcggc

SEQ ID NO: 1570926 - RNA, 12 nt, Human adenovirus D
aggaccugggcu

SEQ ID NO: 1570927 - RNA, 20 nt, Human adenovirus D
agcacuggauugcaauuuug

SEQ ID NO: 1570928 - RNA, 14 nt, Human adenovirus D
gccgccgccgugcg

SEQ ID NO: 1570929 - RNA, 20 nt, Human adenovirus D
gucugcaacccccagcuccu

SEQ ID NO: 1570930 - RNA, 13 nt, Human adenovirus D
acuuuucuguugc

SEQ ID NO: 1570931 - RNA, 21 nt, Human adenovirus D
aaaagcagcacaguaaguucc

SEQ ID NO: 1570932 - RNA, 18 nt, Human adenovirus D
ugcugaccaauagacagc

SEQ ID NO: 1570933 - RNA, 20 nt, Human adenovirus D
accgccuccccgcagaaauc

SEQ ID NO: 1570934 - RNA, 18 nt, Human adenovirus D
cgcguaagcaggagcagg

SEQ ID NO: 1570935 - RNA, 12 nt, Human adenovirus D
ugcacccaccau

SEQ ID NO: 1570936 - RNA, 17 nt, Human adenovirus D
augcgugagggcggagg

SEQ ID NO: 1570937 - RNA, 19 nt, Human adenovirus D
cgcggugggucggagcccc

SEQ ID NO: 1570938 - RNA, 17 nt, Human adenovirus D
ccugggcacuggagcac

SEQ ID NO: 1570939 - RNA, 14 nt, Human adenovirus D
cccggcggcagcgg

SEQ ID NO: 1570940 - RNA, 17 nt, Human adenovirus D
cgccgcgccgccacugc

SEQ ID NO: 1570941 - RNA, 15 nt, Human adenovirus D
cagcagaggaagagg

SEQ ID NO: 1570942 - RNA, 15 nt, Human adenovirus D
gcuggcccacggcca

SEQ ID NO: 1570943 - RNA, 13 nt, Human adenovirus D
cguggcgcagcgc

SEQ ID NO: 1570944 - RNA, 18 nt, Human adenovirus D
acaucgccgagcccgagg

SEQ ID NO: 1570945 - RNA, 23 nt, Human adenovirus D
ucgcccgaccgcugucucagccu

SEQ ID NO: 1570946 - RNA, 12 nt, Human adenovirus D
guacgagagcgu

SEQ ID NO: 1570947 - RNA, 17 nt, Human adenovirus D
uccugcaccauccccag

SEQ ID NO: 1570948 - RNA, 15 nt, Human adenovirus D
ccaacgccugcgcca

SEQ ID NO: 1570949 - RNA, 15 nt, Human adenovirus D
caaccaaggcaccca

SEQ ID NO: 1570950 - RNA, 22 nt, Human adenovirus D
cggacggaguguuccaacuagc

SEQ ID NO: 1570951 - RNA, 15 nt, Human adenovirus D
gcagugucucgagga

SEQ ID NO: 1570952 - RNA, 19 nt, Human adenovirus D
guguaccagucgggcccgg

SEQ ID NO: 1570953 - RNA, 16 nt, Human adenovirus D
gucaugugugauauca

SEQ ID NO: 1570954 - RNA, 21 nt, Human adenovirus D
cgaccugggcguguaccgcaa

SEQ ID NO: 1570955 - RNA, 23 nt, Human adenovirus D
cauccaagcgggccucacagucc

SEQ ID NO: 1570956 - RNA, 16 nt, Human adenovirus D
ccgucggaagaggagu

SEQ ID NO: 1570957 - RNA, 15 nt, Human adenovirus D
ccugggcucgcuggu

SEQ ID NO: 1570958 - RNA, 14 nt, Human adenovirus D
gcaugcggggggag

SEQ ID NO: 1570959 - RNA, 20 nt, Human adenovirus D
caagcuggugaugccagggg

SEQ ID NO: 1570960 - RNA, 22 nt, Human adenovirus D
acccguccaugcgaauuccccu

SEQ ID NO: 1570961 - RNA, 23 nt, Human adenovirus D
ccguccaugcgaauuccccucau

SEQ ID NO: 1570962 - RNA, 14 nt, Human adenovirus D
auuaugacauagau

SEQ ID NO: 1570963 - RNA, 17 nt, Human adenovirus D
gaggaccaaucgcgccc

SEQ ID NO: 1570964 - RNA, 17 nt, Human adenovirus D
ccaggcccagaacuggc

SEQ ID NO: 1570965 - RNA, 12 nt, Human adenovirus D
cgcccaggcgcc

SEQ ID NO: 1570966 - RNA, 18 nt, Human adenovirus D
gcacguuucgucaggcag

SEQ ID NO: 1570967 - RNA, 13 nt, Human adenovirus D
ucgcggcugcugc

SEQ ID NO: 1570968 - RNA, 21 nt, Human adenovirus D
cgugcugcucucucuucuugu

SEQ ID NO: 1570969 - RNA, 21 nt, Human adenovirus D
acgacauccuggaccaggcgg

SEQ ID NO: 1570970 - RNA, 12 nt, Human adenovirus D
ggcggaggcgga

SEQ ID NO: 1570971 - RNA, 21 nt, Human adenovirus D
cgcgcugucggccgaggagga

SEQ ID NO: 1570972 - RNA, 15 nt, Human adenovirus D
ccagaugcucuccca

SEQ ID NO: 1570973 - RNA, 22 nt, Human adenovirus D
ugcugaccaauagacagcagaa

SEQ ID NO: 1570974 - RNA, 19 nt, Human adenovirus D
ggcgauguugccacccaga

SEQ ID NO: 1570975 - RNA, 16 nt, Human adenovirus D
acuacugaacagacag

SEQ ID NO: 1570976 - RNA, 22 nt, Human adenovirus D
ccgcagcuacaccucccucacc

SEQ ID NO: 1570977 - RNA, 14 nt, Human adenovirus D
cccacagccagccg

SEQ ID NO: 1570978 - RNA, 17 nt, Human adenovirus D
uggacaacaccagacac

SEQ ID NO: 1570979 - RNA, 15 nt, Human adenovirus D
cagcuccagugggga

SEQ ID NO: 1570980 - RNA, 20 nt, Human adenovirus D
caagaaacgucccagcagca

SEQ ID NO: 1570981 - RNA, 18 nt, Human adenovirus D
gcgccgcggcgacagcgc

SEQ ID NO: 1570982 - RNA, 20 nt, Human adenovirus D
ccgcaggcgcccagccagca

SEQ ID NO: 1570983 - RNA, 14 nt, Human adenovirus D
ggaggcaccaccua

SEQ ID NO: 1570984 - RNA, 17 nt, Human adenovirus D
acauggaaccuagcaug

SEQ ID NO: 1570985 - RNA, 16 nt, Human adenovirus D
cgauguugccacccag

SEQ ID NO: 1570986 - RNA, 17 nt, Human adenovirus D
cgcgaggacaccaguac

SEQ ID NO: 1570987 - RNA, 23 nt, Human adenovirus D
cgaggauuucgagccgaacgagc

SEQ ID NO: 1570988 - RNA, 16 nt, Human adenovirus D
aagacgaaugggaaga

SEQ ID NO: 1570989 - RNA, 15 nt, Human adenovirus D
auaugaccaugcaga

SEQ ID NO: 1570990 - RNA, 16 nt, Human adenovirus D
uaacaccggcuggggu

SEQ ID NO: 1570991 - RNA, 17 nt, Human adenovirus D
ugagaacggggugcagu

SEQ ID NO: 1570992 - RNA, 19 nt, Human adenovirus D
cgcgguucauugacagcgu

SEQ ID NO: 1570993 - RNA, 21 nt, Human adenovirus D
gugauacgaggcagaggcaca

SEQ ID NO: 1570994 - RNA, 15 nt, Human adenovirus D
aagaccgugaauauc

SEQ ID NO: 1570995 - RNA, 15 nt, Human adenovirus D
ugcccagcagcagca

SEQ ID NO: 1570996 - RNA, 15 nt, Human adenovirus D
cugacggcgcagcug

SEQ ID NO: 1570997 - RNA, 12 nt, Human adenovirus D
ucaagaaccugc

SEQ ID NO: 1570998 - RNA, 21 nt, Human adenovirus D
agauguaaccuugcaagaggc

SEQ ID NO: 1570999 - RNA, 16 nt, Human adenovirus D
ugccauguucucacag

SEQ ID NO: 1571000 - RNA, 15 nt, Human adenovirus D
cacgccgagccugaa

SEQ ID NO: 1571001 - RNA, 19 nt, Human adenovirus D
guuccccuccgcugugcug

SEQ ID NO: 1571002 - RNA, 14 nt, Human adenovirus D
gcugacgcugagcg

SEQ ID NO: 1571003 - RNA, 17 nt, Human adenovirus D
cggagaacaaggccauc

SEQ ID NO: 1571004 - RNA, 15 nt, Human adenovirus D
ccugaaccgccgccg

SEQ ID NO: 1571005 - RNA, 22 nt, Human adenovirus D
gugccucccgcccgacacugca

SEQ ID NO: 1571006 - RNA, 18 nt, Human adenovirus D
uauuacuaggcccagcag

SEQ ID NO: 1571007 - RNA, 23 nt, Human adenovirus D
acugcuaucaggagaaaauugau

SEQ ID NO: 1571008 - RNA, 18 nt, Human adenovirus D
cgcgacccccaggcccug

SEQ ID NO: 1571009 - RNA, 15 nt, Human adenovirus D
cugggcugggacccu

SEQ ID NO: 1571010 - RNA, 12 nt, Human adenovirus D
gguaauucucau

SEQ ID NO: 1571011 - RNA, 14 nt, Human adenovirus D
gccuucagcaucag

SEQ ID NO: 1571012 - RNA, 17 nt, Human adenovirus D
ugcgcgaccugggcugc

SEQ ID NO: 1571013 - RNA, 16 nt, Human adenovirus D
ucaccaguuugggcac

SEQ ID NO: 1571014 - RNA, 17 nt, Human adenovirus D
cgucugaaaaccaagga

SEQ ID NO: 1571015 - RNA, 18 nt, Human adenovirus D
aggcgcgcguccacgcca

SEQ ID NO: 1571016 - RNA, 15 nt, Human adenovirus D
ggaccaggcggcaga

SEQ ID NO: 1571017 - RNA, 19 nt, Human adenovirus D
cugacauccauggccaggg

SEQ ID NO: 1571018 - RNA, 17 nt, Human adenovirus D
uaaagaauaugccaggg

SEQ ID NO: 1571019 - RNA, 20 nt, Human adenovirus D
ucaucgccugcuugcaagac

SEQ ID NO: 1571020 - RNA, 24 nt, Human adenovirus D
gagacccaggucaucgguaccuuc

SEQ ID NO: 1571021 - RNA, 13 nt, Human adenovirus D
cuuauccacaaac

SEQ ID NO: 1571022 - RNA, 20 nt, Human adenovirus D
cgccauaagggcggcgcugc

SEQ ID NO: 1571023 - RNA, 14 nt, Human adenovirus D
cacgcauugcauga

SEQ ID NO: 1571024 - RNA, 15 nt, Human adenovirus D
ccaggcuggccgugc

SEQ ID NO: 1571025 - RNA, 23 nt, Human adenovirus D
gcucgaucuccuccuccuggaga

SEQ ID NO: 1571026 - RNA, 18 nt, Human adenovirus D
aggccgugcugcucgagc

SEQ ID NO: 1571027 - RNA, 14 nt, Human adenovirus D
cgcuggcugcugga

SEQ ID NO: 1571028 - RNA, 14 nt, Human adenovirus D
acucuggccguggg

SEQ ID NO: 1571029 - RNA, 14 nt, Human adenovirus D
ggacaugcagcugc

SEQ ID NO: 1571030 - RNA, 17 nt, Human adenovirus D
cgccaaccgcacccgcg

SEQ ID NO: 1571031 - RNA, 14 nt, Human adenovirus D
ccaacgugcccauc

SEQ ID NO: 1571032 - RNA, 23 nt, Human adenovirus D
uggccccgugacuuugaaccuga

SEQ ID NO: 1571033 - RNA, 19 nt, Human adenovirus D
ccuggcuccgcggcacggc

SEQ ID NO: 1571034 - RNA, 22 nt, Human adenovirus D
gaggaagaucccgccgcaggag

SEQ ID NO: 1571035 - RNA, 17 nt, Human adenovirus D
cagacucugcucauacu

SEQ ID NO: 1571036 - RNA, 22 nt, Human adenovirus D
ggauguaaguuuuauggcugcu

SEQ ID NO: 1571037 - RNA, 11 nt, Human adenovirus D
cucgcuccaca

SEQ ID NO: 1571038 - RNA, 12 nt, Human adenovirus D
gaugccaggggu

SEQ ID NO: 1571039 - RNA, 14 nt, Human adenovirus D
ggaagugcuggaca

SEQ ID NO: 1571040 - RNA, 22 nt, Human adenovirus D
caggagccgcuaguggaagaga

SEQ ID NO: 1571041 - RNA, 19 nt, Human adenovirus D
cuguaccucauccacgaga

SEQ ID NO: 1571042 - RNA, 14 nt, Human adenovirus D
gcaggagugcaggg

SEQ ID NO: 1571043 - RNA, 22 nt, Human adenovirus D
ggcguggcccuuggcgcggagc

SEQ ID NO: 1571044 - RNA, 14 nt, Human adenovirus D
cccgcccugcugga

SEQ ID NO: 1571045 - RNA, 17 nt, Human adenovirus D
gccagccacagccacag

SEQ ID NO: 1571046 - RNA, 21 nt, Human adenovirus D
ccauucggagcacgcccgcca

SEQ ID NO: 1571047 - RNA, 14 nt, Human adenovirus D
cuuuuccaggaaag

SEQ ID NO: 1571048 - RNA, 17 nt, Human adenovirus D
auaauaaagguguacuu

SEQ ID NO: 1571049 - RNA, 15 nt, Human adenovirus D
gccucggaccuggcc

SEQ ID NO: 1571050 - RNA, 19 nt, Human adenovirus D
cgggcuguggggcgugcag

SEQ ID NO: 1571051 - RNA, 15 nt, Human adenovirus D
gacugggaggcugcg

SEQ ID NO: 1571052 - RNA, 20 nt, Human adenovirus D
cggcgucauugacggcgggc

SEQ ID NO: 1571053 - RNA, 19 nt, Human adenovirus D
uugagacucauccugcugg

SEQ ID NO: 1571054 - RNA, 17 nt, Human adenovirus D
ugcaagaggcgacccau

SEQ ID NO: 1571055 - RNA, 13 nt, Human adenovirus D
cuuagccugggca

SEQ ID NO: 1571056 - RNA, 23 nt, Human adenovirus D
agcaugagcggcuccagcgaaag

SEQ ID NO: 1571057 - RNA, 22 nt, Human adenovirus D
gagcucgucuuccaggagccug

SEQ ID NO: 1571058 - RNA, 18 nt, Human adenovirus D
cgucaccugcggcgcgga

SEQ ID NO: 1571059 - RNA, 20 nt, Human adenovirus D
gaucagucagugaagcccug

SEQ ID NO: 1571060 - RNA, 14 nt, Human adenovirus D
guggagccacugcu

SEQ ID NO: 1571061 - RNA, 11 nt, Human adenovirus D
aggaaccccac

SEQ ID NO: 1571062 - RNA, 17 nt, Human adenovirus D
cccacuacaacaucggc

SEQ ID NO: 1571063 - RNA, 20 nt, Human adenovirus D
cagugcaacuuuagccagac

SEQ ID NO: 1571064 - RNA, 23 nt, Human adenovirus D
ucaccuuggcuuugcuggguugc

SEQ ID NO: 1571065 - RNA, 12 nt, Human adenovirus D
aggcagaggcac

SEQ ID NO: 1571066 - RNA, 20 nt, Human adenovirus D
cugacgacccgcaaccccga

SEQ ID NO: 1571067 - RNA, 20 nt, Human adenovirus D
ccggcgcacgucugacugcc

SEQ ID NO: 1571068 - RNA, 22 nt, Human adenovirus D
ugccacucgcgggcggccauug

SEQ ID NO: 1571069 - RNA, 16 nt, Human adenovirus D
acugaccaccaccugg

SEQ ID NO: 1571070 - RNA, 22 nt, Human adenovirus D
guggacgcgguucauugacagc

SEQ ID NO: 1571071 - RNA, 12 nt, Human adenovirus D
cgcuucuucccc

SEQ ID NO: 1571072 - RNA, 16 nt, Human adenovirus D
gcucgcucguucugcc

SEQ ID NO: 1571073 - RNA, 22 nt, Human adenovirus D
uggagaucgccgcgacccgcgc

SEQ ID NO: 1571074 - RNA, 19 nt, Human adenovirus D
acgcacgggccgccgggcc

SEQ ID NO: 1571075 - RNA, 21 nt, Human adenovirus D
cugcacgagaaccgccugggg

SEQ ID NO: 1571076 - RNA, 22 nt, Human adenovirus D
gucaaccuugaaaccccagaca

SEQ ID NO: 1571077 - RNA, 19 nt, Human adenovirus D
ggcggacaucgcuucccug

SEQ ID NO: 1571078 - RNA, 15 nt, Human adenovirus D
gggugaugcggaaag

SEQ ID NO: 1571079 - RNA, 15 nt, Human adenovirus D
cgcaggaggccaucu

SEQ ID NO: 1571080 - RNA, 22 nt, Human adenovirus D
cauccacgagauacacagcgcg

SEQ ID NO: 1571081 - RNA, 14 nt, Human adenovirus D
gagauaugugcagc

SEQ ID NO: 1571082 - RNA, 15 nt, Human adenovirus D
augcacccgcugcgg

SEQ ID NO: 1571083 - RNA, 15 nt, Human adenovirus D
cugaugaaaaagcug

SEQ ID NO: 1571084 - RNA, 21 nt, Human adenovirus D
gagggugccagauugggggac

SEQ ID NO: 1571085 - RNA, 16 nt, Human adenovirus D
guaauggggcgggucc

SEQ ID NO: 1571086 - RNA, 16 nt, Human adenovirus D
ccagccguaccagugc

SEQ ID NO: 1571087 - RNA, 20 nt, Human adenovirus D
cuacaaucgccacaggugcu

SEQ ID NO: 1571088 - RNA, 17 nt, Human adenovirus D
ucagcaguagccccgcc

SEQ ID NO: 1571089 - RNA, 14 nt, Human adenovirus D
uggaaacagacagc

SEQ ID NO: 1571090 - RNA, 17 nt, Human adenovirus D
caaccucuacgccaccu

SEQ ID NO: 1571091 - RNA, 17 nt, Human adenovirus D
aagaacgagggccuggg

SEQ ID NO: 1571092 - RNA, 23 nt, Human adenovirus D
gcucaucugcagggcgcccagca

SEQ ID NO: 1571093 - RNA, 17 nt, Human adenovirus D
gagaccgacgcugggcu

SEQ ID NO: 1571094 - RNA, 17 nt, Human adenovirus D
guccagcgcggccagcg

SEQ ID NO: 1571095 - RNA, 14 nt, Human adenovirus D
cagacgagcggccg

SEQ ID NO: 1571096 - RNA, 19 nt, Human adenovirus D
cagccgcguaagcaggagc

SEQ ID NO: 1571097 - RNA, 13 nt, Human adenovirus D
ucccagcgccgcg

SEQ ID NO: 1571098 - RNA, 19 nt, Human adenovirus D
ccgcguaauuggcccucca

SEQ ID NO: 1571099 - RNA, 18 nt, Human adenovirus D
gcgcgggagccaggucca

SEQ ID NO: 1571100 - RNA, 13 nt, Human adenovirus D
cgcccgcgcccac

SEQ ID NO: 1571101 - RNA, 22 nt, Human adenovirus D
ggcaaucaacuacucggugcuu

SEQ ID NO: 1571102 - RNA, 14 nt, Human adenovirus D
gacuccgucacggg

SEQ ID NO: 1571103 - RNA, 12 nt, Human adenovirus D
ugcgcgggcugu

SEQ ID NO: 1571104 - RNA, 12 nt, Human adenovirus D
uuacuucaucau

SEQ ID NO: 1571105 - RNA, 23 nt, Human adenovirus D
cgcucgaucaucuccccgcggcg

SEQ ID NO: 1571106 - RNA, 12 nt, Human adenovirus D
gagugaagaggg

SEQ ID NO: 1571107 - RNA, 20 nt, Human adenovirus D
gauacuuucggcgcuuggug

SEQ ID NO: 1571108 - RNA, 22 nt, Human adenovirus D
ggccgaaaaccccgccggguag

SEQ ID NO: 1571109 - RNA, 16 nt, Human adenovirus D
uccaugaucuuuauga

SEQ ID NO: 1571110 - RNA, 14 nt, Human adenovirus D
auuggugcgcuggg

SEQ ID NO: 1571111 - RNA, 21 nt, Human adenovirus D
ggcgccauucggagcacgccc

SEQ ID NO: 1571112 - RNA, 20 nt, Human adenovirus D
aucaccaguuugggcacugg

SEQ ID NO: 1571113 - RNA, 22 nt, Human adenovirus D
acuuccucguuucggggguugg

SEQ ID NO: 1571114 - RNA, 19 nt, Human adenovirus D
ucugcaacccccagcuccu

SEQ ID NO: 1571115 - RNA, 22 nt, Human adenovirus D
gagaacugcuggcccugcuggc

SEQ ID NO: 1571116 - RNA, 19 nt, Human adenovirus D
aacgacgaguuggugagcu

SEQ ID NO: 1571117 - RNA, 13 nt, Human adenovirus D
ccacgguggugga

SEQ ID NO: 1571118 - RNA, 22 nt, Human adenovirus D
cgccggcggcgggccaugcgca

SEQ ID NO: 1571119 - RNA, 21 nt, Human adenovirus D
acugcgcguccgucagcagca

SEQ ID NO: 1571120 - RNA, 18 nt, Human adenovirus D
guccuuucgcugcugccg

SEQ ID NO: 1571121 - RNA, 19 nt, Human adenovirus D
gcaccccccgcaggcagga

SEQ ID NO: 1571122 - RNA, 18 nt, Human adenovirus D
gccgaggagaacugcugg

SEQ ID NO: 1571123 - RNA, 21 nt, Human adenovirus D
gcugagcgacgaccugggcgu

SEQ ID NO: 1571124 - RNA, 18 nt, Human adenovirus D
ggcagcggugguggaggc

SEQ ID NO: 1571125 - RNA, 17 nt, Human adenovirus D
caccugcgucugcagca

SEQ ID NO: 1571126 - RNA, 21 nt, Human adenovirus D
ccaugggcgccuucaccgacc

SEQ ID NO: 1571127 - RNA, 13 nt, Human adenovirus D
gcguccgcaggcg

SEQ ID NO: 1571128 - RNA, 18 nt, Human adenovirus D
uggauuaucucuacaaau

SEQ ID NO: 1571129 - RNA, 21 nt, Human adenovirus D
caccauccgcgccgcagcccg

SEQ ID NO: 1571130 - RNA, 21 nt, Human adenovirus D
uaccagucgggcccggacuac

SEQ ID NO: 1571131 - RNA, 23 nt, Human adenovirus D
aacagacuggucaaaaacaaagu

SEQ ID NO: 1571132 - RNA, 18 nt, Human adenovirus D
cguaguugcgcaggcgcu

SEQ ID NO: 1571133 - RNA, 14 nt, Human adenovirus D
cgcuccgcugaaac

SEQ ID NO: 1571134 - RNA, 18 nt, Human adenovirus D
aggacgagaccagaggca

SEQ ID NO: 1571135 - RNA, 17 nt, Human adenovirus D
uaaaaaccccgccaaaa

SEQ ID NO: 1571136 - RNA, 21 nt, Human adenovirus D
cauggcccugacgacccgcaa

SEQ ID NO: 1571137 - RNA, 19 nt, Human adenovirus D
cgcuuccucgcgcgccacu

SEQ ID NO: 1571138 - RNA, 17 nt, Human adenovirus D
ccgcguccgcggccacu

SEQ ID NO: 1571139 - RNA, 16 nt, Human adenovirus D
gcuggccgagcuggaa

SEQ ID NO: 1571140 - RNA, 22 nt, Human adenovirus D
cccuggagacgggcugcuucug

SEQ ID NO: 1571141 - RNA, 13 nt, Human adenovirus D
gccgcgcugggga

SEQ ID NO: 1571142 - RNA, 12 nt, Human adenovirus D
cagccgcaggcc

SEQ ID NO: 1571143 - RNA, 17 nt, Human adenovirus D
aaugggcccuugaacag

SEQ ID NO: 1571144 - RNA, 14 nt, Human adenovirus D
cagacucugcucau

SEQ ID NO: 1571145 - RNA, 19 nt, Human adenovirus D
gcggcgaacuuucuccaca

SEQ ID NO: 1571146 - RNA, 22 nt, Human adenovirus D
ucaacccgggucucccccagca

SEQ ID NO: 1571147 - RNA, 18 nt, Human adenovirus D
cugaaggagcuggacaag

SEQ ID NO: 1571148 - RNA, 19 nt, Human adenovirus D
accaacuggucuccugccu

SEQ ID NO: 1571149 - RNA, 13 nt, Human adenovirus D
gggcggagagcga

SEQ ID NO: 1571150 - RNA, 14 nt, Human adenovirus D
ccacugcuccugcg

SEQ ID NO: 1571151 - RNA, 16 nt, Human adenovirus D
guacauccagcauaag

SEQ ID NO: 1571152 - RNA, 15 nt, Human adenovirus D
aggugauuggcuugu

SEQ ID NO: 1571153 - RNA, 15 nt, Human adenovirus D
cuuguugggccuugg

SEQ ID NO: 1571154 - RNA, 16 nt, Human adenovirus D
cuaggcccagcagcau

SEQ ID NO: 1571155 - RNA, 16 nt, Human adenovirus D
cuuaccaaguccaggg

SEQ ID NO: 1571156 - RNA, 11 nt, Human adenovirus D
ucauggcccug

SEQ ID NO: 1571157 - RNA, 18 nt, Human adenovirus D
ccgagcugacggccaguc

SEQ ID NO: 1571158 - RNA, 15 nt, Human adenovirus D
ucagacaugcugcua

SEQ ID NO: 1571159 - RNA, 15 nt, Human adenovirus D
gcuccagccaaagcu

SEQ ID NO: 1571160 - RNA, 13 nt, Human adenovirus D
cagaugcggagga

SEQ ID NO: 1571161 - RNA, 23 nt, Human adenovirus D
gaggaccagguccuugggucccg

SEQ ID NO: 1571162 - RNA, 17 nt, Human adenovirus D
cccuggcucccagccuc

SEQ ID NO: 1571163 - RNA, 18 nt, Human adenovirus D
ggccugggcgugcagacc

SEQ ID NO: 1571164 - RNA, 14 nt, Human adenovirus D
ggcgcuugcaaggg

SEQ ID NO: 1571165 - RNA, 16 nt, Human adenovirus D
acaucugugcugccuu

SEQ ID NO: 1571166 - RNA, 18 nt, Human adenovirus D
uggcgagaggcgagcagc

SEQ ID NO: 1571167 - RNA, 17 nt, Human adenovirus D
cgcgaaccaggcagugc

SEQ ID NO: 1571168 - RNA, 16 nt, Human adenovirus D
agucugaagcgccgcc

SEQ ID NO: 1571169 - RNA, 17 nt, Human adenovirus D
ucagguuuggauauuca

SEQ ID NO: 1571170 - RNA, 15 nt, Human adenovirus D
acagcaccgccgcag

SEQ ID NO: 1571171 - RNA, 20 nt, Human adenovirus D
gugaagaugccgggacagag

SEQ ID NO: 1571172 - RNA, 23 nt, Human adenovirus D
acauccuggaccaggcggcagag

SEQ ID NO: 1571173 - RNA, 12 nt, Human adenovirus D
agcgcagccuga

SEQ ID NO: 1571174 - RNA, 20 nt, Human adenovirus D
gcuggcggagaacaaggcca

SEQ ID NO: 1571175 - RNA, 17 nt, Human adenovirus D
cugccgccgccugcgcu

SEQ ID NO: 1571176 - RNA, 16 nt, Human adenovirus D
uucgaguacgaggcca

SEQ ID NO: 1571177 - RNA, 19 nt, Human adenovirus D
ggcucuaaaaaauaugcaa

SEQ ID NO: 1571178 - RNA, 11 nt, Human adenovirus D
gugcagcugca

SEQ ID NO: 1571179 - RNA, 20 nt, Human adenovirus D
ggcugaaucccacucccaca

SEQ ID NO: 1571180 - RNA, 12 nt, Human adenovirus D
ugggcugggacc

SEQ ID NO: 1571181 - RNA, 21 nt, Human adenovirus D
caacgacgguauugaaauacc

SEQ ID NO: 1571182 - RNA, 21 nt, Human adenovirus D
gcauaauauggugaagggcug

SEQ ID NO: 1571183 - RNA, 17 nt, Human adenovirus D
caguguguguuugagaa

SEQ ID NO: 1571184 - RNA, 23 nt, Human adenovirus D
caccauguuauucagcagcccau

SEQ ID NO: 1571185 - RNA, 15 nt, Human adenovirus D
caaaacucacuuugg

SEQ ID NO: 1571186 - RNA, 12 nt, Human adenovirus D
cuaccugggagu

SEQ ID NO: 1571187 - RNA, 14 nt, Human adenovirus D
agugccacaugcac

SEQ ID NO: 1571188 - RNA, 21 nt, Human adenovirus D
aggggauguugaucagucagu

SEQ ID NO: 1571189 - RNA, 18 nt, Human adenovirus D
cgacgaacucggcgguga

SEQ ID NO: 1571190 - RNA, 13 nt, Human adenovirus D
auaccaucaaugc

SEQ ID NO: 1571191 - RNA, 18 nt, Human adenovirus D
gcuaagaaaaaaucagag

SEQ ID NO: 1571192 - RNA, 19 nt, Human adenovirus D
agaaccaugaauacaguga

SEQ ID NO: 1571193 - RNA, 22 nt, Human adenovirus D
gugcgcccggcguacgugccug

SEQ ID NO: 1571194 - RNA, 18 nt, Human adenovirus D
ggugucgcggagauccag

SEQ ID NO: 1571195 - RNA, 13 nt, Human adenovirus D
cugaccaccaccu

SEQ ID NO: 1571196 - RNA, 11 nt, Human adenovirus D
gacccccuucc

SEQ ID NO: 1571197 - RNA, 18 nt, Human adenovirus D
ccccccgcggaugcuggc

SEQ ID NO: 1571198 - RNA, 18 nt, Human adenovirus D
cugcauccacugcuccug

SEQ ID NO: 1571199 - RNA, 18 nt, Human adenovirus D
ccaaaauggcuuacaugu

SEQ ID NO: 1571200 - RNA, 13 nt, Human adenovirus D
augggugugcugg

SEQ ID NO: 1571201 - RNA, 20 nt, Human adenovirus D
caaacguaacuuuaguuggu

SEQ ID NO: 1571202 - RNA, 23 nt, Human adenovirus D
caaaggucuaaaaaccccgccaa

SEQ ID NO: 1571203 - RNA, 20 nt, Human adenovirus D
caaguacacgccggccaaug

SEQ ID NO: 1571204 - RNA, 17 nt, Human adenovirus D
caaggccauagcgugcg

SEQ ID NO: 1571205 - RNA, 14 nt, Human adenovirus D
ccccaggcggugcu

SEQ ID NO: 1571206 - RNA, 14 nt, Human adenovirus D
aaaccuuaguuggg

SEQ ID NO: 1571207 - RNA, 13 nt, Human adenovirus D
gcgccacuggcca

SEQ ID NO: 1571208 - RNA, 23 nt, Human adenovirus D
uccacggggaccacguccucucg

SEQ ID NO: 1571209 - RNA, 17 nt, Human adenovirus D
ucgcgccacuggccacg

SEQ ID NO: 1571210 - RNA, 17 nt, Human adenovirus D
gcgaggggcuccucucg

SEQ ID NO: 1571211 - RNA, 16 nt, Human adenovirus D
gcgauaugccagacgc

SEQ ID NO: 1571212 - RNA, 15 nt, Human adenovirus D
gcgaggacaccagua

SEQ ID NO: 1571213 - RNA, 19 nt, Human adenovirus D
cagaacccggacagcaagc

SEQ ID NO: 1571214 - RNA, 15 nt, Human adenovirus D
cagaacuggcagagc

SEQ ID NO: 1571215 - RNA, 12 nt, Human adenovirus D
cagacagccagg

SEQ ID NO: 1571216 - RNA, 19 nt, Human adenovirus D
cagcaggagcgugccgcca

SEQ ID NO: 1571217 - RNA, 18 nt, Human adenovirus D
cagcaguacaagcgccaa

SEQ ID NO: 1571218 - RNA, 19 nt, Human adenovirus D
cagcaucgaggugcagacc

SEQ ID NO: 1571219 - RNA, 16 nt, Human adenovirus D
cagccgcagccgccau

SEQ ID NO: 1571220 - RNA, 14 nt, Human adenovirus D
cagccagcaaacgc

SEQ ID NO: 1571221 - RNA, 22 nt, Human adenovirus D
ccgaucauugagagugcggugg

SEQ ID NO: 1571222 - RNA, 21 nt, Human adenovirus D
cguuagccgugcgucgugacg

SEQ ID NO: 1571223 - RNA, 17 nt, Human adenovirus D
cgcgagccggcggcgcg

SEQ ID NO: 1571224 - RNA, 20 nt, Human adenovirus D
cgcgagcgagggcgcggugg

SEQ ID NO: 1571225 - RNA, 18 nt, Human adenovirus D
acgggagcgagcccccuu

SEQ ID NO: 1571226 - RNA, 22 nt, Human adenovirus D
cacccguaaaugacucuccuga

SEQ ID NO: 1571227 - RNA, 15 nt, Human adenovirus D
agacccacagccagc

SEQ ID NO: 1571228 - RNA, 19 nt, Human adenovirus D
agaaaauugauaugcccuc

SEQ ID NO: 1571229 - RNA, 20 nt, Human adenovirus D
cacgaccgugccgcggugcg

SEQ ID NO: 1571230 - RNA, 15 nt, Human adenovirus D
cgccaggcuggccgu

SEQ ID NO: 1571231 - RNA, 19 nt, Human adenovirus D
cgaguacauguucaccagc

SEQ ID NO: 1571232 - RNA, 22 nt, Human adenovirus D
cgagcacagcaccgcauccuga

SEQ ID NO: 1571233 - RNA, 20 nt, Human adenovirus D
cgagggccuggaccgccagc

SEQ ID NO: 1571234 - RNA, 16 nt, Human adenovirus D
cgagaucggcaccagc

SEQ ID NO: 1571235 - RNA, 20 nt, Human adenovirus D
cgaccacagcaacuuccuga

SEQ ID NO: 1571236 - RNA, 20 nt, Human adenovirus D
cgacucgcugcugcagccgc

SEQ ID NO: 1571237 - RNA, 23 nt, Human adenovirus D
agcuggaagcccugagccgccag

SEQ ID NO: 1571238 - RNA, 16 nt, Human adenovirus D
aguagaguuugugcgc

SEQ ID NO: 1571239 - RNA, 13 nt, Human adenovirus D
aggugcugacgcu

SEQ ID NO: 1571240 - RNA, 13 nt, Human adenovirus D
aggugcuggcgau

SEQ ID NO: 1571241 - RNA, 17 nt, Human adenovirus D
agguggacgagccgccu

SEQ ID NO: 1571242 - RNA, 20 nt, Human adenovirus D
caguauugugggccugggag

SEQ ID NO: 1571243 - RNA, 12 nt, Human adenovirus D
caguuaguuggu

SEQ ID NO: 1571244 - RNA, 14 nt, Human adenovirus D
gcggcccggcacgg

SEQ ID NO: 1571245 - RNA, 14 nt, Human adenovirus D
gcggccgcccacgg

SEQ ID NO: 1571246 - RNA, 15 nt, Human adenovirus D
gcggaugcuggcgcg

SEQ ID NO: 1571247 - RNA, 23 nt, Human adenovirus D
gcgaccgcggccguagcaggcgc

SEQ ID NO: 1571248 - RNA, 20 nt, Human adenovirus D
gcgaagccguggcgcagcgc

SEQ ID NO: 1571249 - RNA, 14 nt, Human adenovirus D
gccguacaccaggc

SEQ ID NO: 1571250 - RNA, 15 nt, Human adenovirus D
gccgugcgcaccacc

SEQ ID NO: 1571251 - RNA, 14 nt, Human adenovirus D
gcccugcuggccga

SEQ ID NO: 1571252 - RNA, 20 nt, Human adenovirus D
gccgcgccaaccgcacccgc

SEQ ID NO: 1571253 - RNA, 15 nt, Human adenovirus D
ggacgaugguuuccc

SEQ ID NO: 1571254 - RNA, 16 nt, Human adenovirus D
gcuagcacgcagacga

SEQ ID NO: 1571255 - RNA, 15 nt, Human adenovirus D
gcucaugcuggccgu

SEQ ID NO: 1571256 - RNA, 16 nt, Human adenovirus D
gcucccaaucccaguc

SEQ ID NO: 1571257 - RNA, 15 nt, Human adenovirus D
guccgucggccaugg

SEQ ID NO: 1571258 - RNA, 21 nt, Human adenovirus D
guacccgcgacccccaggccc

SEQ ID NO: 1571259 - RNA, 20 nt, Human adenovirus D
gucgccucggaccuggccga

SEQ ID NO: 1571260 - RNA, 15 nt, Human adenovirus D
gcaucgcgcaggccg

SEQ ID NO: 1571261 - RNA, 17 nt, Human adenovirus D
gcagugggcgcagacgg

SEQ ID NO: 1571262 - RNA, 19 nt, Human adenovirus D
gcagccugagcuuggccga

SEQ ID NO: 1571263 - RNA, 15 nt, Human adenovirus D
gcagcgugaagacgc

SEQ ID NO: 1571264 - RNA, 20 nt, Human adenovirus D
gcagcacaucaagcagaugc

SEQ ID NO: 1571265 - RNA, 19 nt, Human adenovirus D
gcagcacuggaacaccauc

SEQ ID NO: 1571266 - RNA, 23 nt, Human adenovirus D
gcagaacaacgauuucacccccg

SEQ ID NO: 1571267 - RNA, 24 nt, Human adenovirus D
gcagaagaucccggcgcaguacgc

SEQ ID NO: 1571268 - RNA, 14 nt, Human adenovirus D
gcacgcagcagcgc

SEQ ID NO: 1571269 - RNA, 17 nt, Human adenovirus D
gaccugccuccaccacc

SEQ ID NO: 1571270 - RNA, 14 nt, Human adenovirus D
gacgagacuggccu

SEQ ID NO: 1571271 - RNA, 14 nt, Human adenovirus D
gacgcacuggccga

SEQ ID NO: 1571272 - RNA, 21 nt, Human adenovirus D
gcacgagcaagacgcaggcca

SEQ ID NO: 1571273 - RNA, 15 nt, Human adenovirus D
cagagcgggcgggcg

SEQ ID NO: 1571274 - RNA, 18 nt, Human adenovirus D
cagcaccgccgcagccgc

SEQ ID NO: 1571275 - RNA, 22 nt, Human adenovirus D
cacgugcgagggguagcggucg

SEQ ID NO: 1571276 - RNA, 13 nt, Human adenovirus D
cacaucagccagg

SEQ ID NO: 1571277 - RNA, 23 nt, Human adenovirus D
gaugguggcgcgcaccucgcgcu

SEQ ID NO: 1571278 - RNA, 19 nt, Human adenovirus D
gaggagaacugcuggcccu

SEQ ID NO: 1571279 - RNA, 21 nt, Human adenovirus D
gaggcacgucggcguggcgcu

SEQ ID NO: 1571280 - RNA, 14 nt, Human adenovirus D
cuagcccuuccugg

SEQ ID NO: 1571281 - RNA, 20 nt, Human adenovirus D
gcacaaacgugcaguccaac

SEQ ID NO: 1571282 - RNA, 17 nt, Human adenovirus D
gcgccgcgccagacgca

SEQ ID NO: 1571283 - RNA, 17 nt, Human adenovirus D
gcgccugaggcagacgc

SEQ ID NO: 1571284 - RNA, 15 nt, Human adenovirus D
gcgcccucagcaguc

SEQ ID NO: 1571285 - RNA, 21 nt, Human adenovirus D
ggcggcgauaugccagacgca

SEQ ID NO: 1571286 - RNA, 21 nt, Human adenovirus D
ggcgcucaaggugcugacgcu

SEQ ID NO: 1571287 - RNA, 14 nt, Human adenovirus D
cgccuuccuggcga

SEQ ID NO: 1571288 - RNA, 13 nt, Human adenovirus D
ccgcccgcgugcg

SEQ ID NO: 1571289 - RNA, 13 nt, Human adenovirus D
ccgccgccgugcg

SEQ ID NO: 1571290 - RNA, 14 nt, Human adenovirus D
gagcggccagcgcu

SEQ ID NO: 1571291 - RNA, 20 nt, Human adenovirus D
gagcgccugaggcagacgcu

SEQ ID NO: 1571292 - RNA, 23 nt, Human adenovirus D
gaugcugcccgccaccugcaacg

SEQ ID NO: 1571293 - RNA, 18 nt, Human adenovirus D
gagccugcgccgggcgcu

SEQ ID NO: 1571294 - RNA, 22 nt, Human adenovirus D
gagcccaacccgcgucucaacu

SEQ ID NO: 1571295 - RNA, 16 nt, Human adenovirus D
cgcguccgucagcagc

SEQ ID NO: 1571296 - RNA, 18 nt, Human adenovirus D
cggacauauggaauuucu

SEQ ID NO: 1571297 - RNA, 23 nt, Human adenovirus D
cggaccugcauuggcagccgagc

SEQ ID NO: 1571298 - RNA, 11 nt, Human adenovirus D
ccuucgcaguc

SEQ ID NO: 1571299 - RNA, 13 nt, Human adenovirus D
cgaccgccgugcg

SEQ ID NO: 1571300 - RNA, 19 nt, Human adenovirus D
cgaccggaucggagaaucu

SEQ ID NO: 1571301 - RNA, 20 nt, Human adenovirus D
ccugacgacccgcaaccccg

SEQ ID NO: 1571302 - RNA, 14 nt, Human adenovirus D
caggaggcggugcg

SEQ ID NO: 1571303 - RNA, 20 nt, Human adenovirus D
accgcuccuggucugcaacc

SEQ ID NO: 1571304 - RNA, 15 nt, Human adenovirus D
aggcggugcugcugc

SEQ ID NO: 1571305 - RNA, 23 nt, Human adenovirus D
aggccgcucucguuccagacgcg

SEQ ID NO: 1571306 - RNA, 17 nt, Human adenovirus D
acgagcggucgcggugg

SEQ ID NO: 1571307 - RNA, 14 nt, Human adenovirus D
aucccaugcccucg

SEQ ID NO: 1571308 - RNA, 13 nt, Human adenovirus D
auccgugugcugu

SEQ ID NO: 1571309 - RNA, 16 nt, Human adenovirus D
caacaucuugcagagc

SEQ ID NO: 1571310 - RNA, 16 nt, Human adenovirus D
caagagccggcgggcg

SEQ ID NO: 1571311 - RNA, 15 nt, Human adenovirus D
cacacaguuuccuga

SEQ ID NO: 1571312 - RNA, 18 nt, Human adenovirus D
caaucucccaccaccagc

SEQ ID NO: 1571313 - RNA, 15 nt, Human adenovirus D
caggcagugcagcgc

SEQ ID NO: 1571314 - RNA, 16 nt, Human adenovirus D
gccuacgagcagacgg

SEQ ID NO: 1571315 - RNA, 19 nt, Human adenovirus D
gccgauugggaagaacugg

SEQ ID NO: 1571316 - RNA, 17 nt, Human adenovirus D
gccgcaccgccacccgc

SEQ ID NO: 1571317 - RNA, 16 nt, Human adenovirus D
gccgccagcuggccgc

SEQ ID NO: 1571318 - RNA, 19 nt, Human adenovirus D
gccgccaggcccagaacug

SEQ ID NO: 1571319 - RNA, 18 nt, Human adenovirus D
gcccuuuuugccggccga

SEQ ID NO: 1571320 - RNA, 17 nt, Human adenovirus D
gccgaacgagcagacgg

SEQ ID NO: 1571321 - RNA, 21 nt, Human adenovirus D
gcgggcaggggcggcagaggc

SEQ ID NO: 1571322 - RNA, 15 nt, Human adenovirus D
gcgggccucacaguc

SEQ ID NO: 1571323 - RNA, 14 nt, Human adenovirus D
gcuggccagcacgc

SEQ ID NO: 1571324 - RNA, 19 nt, Human adenovirus D
gucggcacggucuggccgg

SEQ ID NO: 1571325 - RNA, 17 nt, Human adenovirus D
guagguguaggccacgu

SEQ ID NO: 1571326 - RNA, 22 nt, Human adenovirus D
cgucacuuuugcccuuacaugu

SEQ ID NO: 1571327 - RNA, 15 nt, Human adenovirus D
cggggaucagccccg

SEQ ID NO: 1571328 - RNA, 23 nt, Human adenovirus D
gacggcguaguugcgcaggcgcu

SEQ ID NO: 1571329 - RNA, 16 nt, Human adenovirus D
gacggccuggccucgg

SEQ ID NO: 1571330 - RNA, 22 nt, Human adenovirus D
gaccaugacuuucaagaacugg

SEQ ID NO: 1571331 - RNA, 18 nt, Human adenovirus D
gaagaucagcugcagcgc

SEQ ID NO: 1571332 - RNA, 17 nt, Human adenovirus D
gaagaauuuggagacgc

SEQ ID NO: 1571333 - RNA, 20 nt, Human adenovirus D
gccaucaacauccaccagug

SEQ ID NO: 1571334 - RNA, 21 nt, Human adenovirus D
gccccagaugggccuggccgc

SEQ ID NO: 1571335 - RNA, 13 nt, Human adenovirus D
gugcugcugccga

SEQ ID NO: 1571336 - RNA, 20 nt, Human adenovirus D
uaguguacaacgcccugcug

SEQ ID NO: 1571337 - RNA, 15 nt, Human adenovirus D
cucggaccaacccca

SEQ ID NO: 1571338 - RNA, 19 nt, Human adenovirus D
gagauaugugcagcagagc

SEQ ID NO: 1571339 - RNA, 22 nt, Human adenovirus D
gaguccuuuagacaacagccgc

SEQ ID NO: 1571340 - RNA, 22 nt, Human adenovirus D
gagugccacugccgcugcaacc

SEQ ID NO: 1571341 - RNA, 21 nt, Human adenovirus D
gcacaucgccgggcaggacgc

SEQ ID NO: 1571342 - RNA, 17 nt, Human adenovirus D
gcaccaccuacaccguc

SEQ ID NO: 1571343 - RNA, 21 nt, Human adenovirus D
gcaccauccgcgccgcagccc

SEQ ID NO: 1571344 - RNA, 20 nt, Human adenovirus D
gagcagcgcauccugcaacu

SEQ ID NO: 1571345 - RNA, 13 nt, Human adenovirus D
gagggccugggcu

SEQ ID NO: 1571346 - RNA, 14 nt, Human adenovirus D
gagggucuggagcu

SEQ ID NO: 1571347 - RNA, 17 nt, Human adenovirus D
gagggucgcuggcugcu

SEQ ID NO: 1571348 - RNA, 17 nt, Human adenovirus D
gagcacgagcaagacgc

SEQ ID NO: 1571349 - RNA, 21 nt, Human adenovirus D
gcaccugugggaccuggcgga

SEQ ID NO: 1571350 - RNA, 17 nt, Human adenovirus D
ccggagcgacacccccg

SEQ ID NO: 1571351 - RNA, 20 nt, Human adenovirus D
ggccggcaugcccaccacgc

SEQ ID NO: 1571352 - RNA, 21 nt, Human adenovirus D
ggcuggucaguugcaccacgc

SEQ ID NO: 1571353 - RNA, 13 nt, Human adenovirus D
gggaucaccaguu

SEQ ID NO: 1571354 - RNA, 15 nt, Human adenovirus D
gggcaccaccgaguc

SEQ ID NO: 1571355 - RNA, 20 nt, Human adenovirus D
gcgcagacggucucgcacuc

SEQ ID NO: 1571356 - RNA, 21 nt, Human adenovirus D
gcgcagguggacgagcagacc

SEQ ID NO: 1571357 - RNA, 23 nt, Human adenovirus D
ggucacauccaucuccaccacgu

SEQ ID NO: 1571358 - RNA, 23 nt, Human adenovirus D
ggucacggauacaacucgcaguc

SEQ ID NO: 1571359 - RNA, 23 nt, Human adenovirus D
gggugggccccuggcugggcgcu

SEQ ID NO: 1571360 - RNA, 17 nt, Human adenovirus D
ucgcugccgcuggacga

SEQ ID NO: 1571361 - RNA, 13 nt, Human adenovirus D
uggaggccgccua

SEQ ID NO: 1571362 - RNA, 14 nt, Human adenovirus D
ggucggagccccuu

SEQ ID NO: 1571363 - RNA, 18 nt, Human adenovirus D
ggugagccggccgcgcuu

SEQ ID NO: 1571364 - RNA, 16 nt, Human adenovirus D
gguuacacucgcagug

SEQ ID NO: 1571365 - RNA, 14 nt, Human adenovirus D
gucagcuggcccgg

SEQ ID NO: 1571366 - RNA, 14 nt, Human adenovirus D
guccagcuggccgg

SEQ ID NO: 1571367 - RNA, 13 nt, Human adenovirus D
guccccgaggccc

SEQ ID NO: 1571368 - RNA, 17 nt, Human adenovirus D
gcuucuuaccucgcguc

SEQ ID NO: 1571369 - RNA, 14 nt, Human adenovirus D
gcgcugucggccga

SEQ ID NO: 1571370 - RNA, 18 nt, Human adenovirus D
gcgcuucacucuggccgu

SEQ ID NO: 1571371 - RNA, 15 nt, Human adenovirus D
gcgcuugcugggcga

SEQ ID NO: 1571372 - RNA, 23 nt, Human adenovirus D
gcggauaucuugaaaucgcaguu

SEQ ID NO: 1571373 - RNA, 14 nt, Human adenovirus D
gcggcggccaucgg

SEQ ID NO: 1571374 - RNA, 21 nt, Human adenovirus D
gcggcuggaguuucacccguc

SEQ ID NO: 1571375 - RNA, 20 nt, Human adenovirus D
gcguccgcaguacucgcagc

SEQ ID NO: 1571376 - RNA, 20 nt, Human adenovirus D
gcgucuagccaaucgcaguc

SEQ ID NO: 1571377 - RNA, 20 nt, Human adenovirus D
gcucguacccgcucaccauc

SEQ ID NO: 1571378 - RNA, 20 nt, Human adenovirus D
uaaagccaaacacaccugac

SEQ ID NO: 1571379 - RNA, 17 nt, Human adenovirus D
ucaaccuccaggccaac

SEQ ID NO: 1571380 - RNA, 20 nt, Human adenovirus D
ucaacguuucucggccaauc

SEQ ID NO: 1571381 - RNA, 18 nt, Human adenovirus D
cgggacuuggucaccccg

SEQ ID NO: 1571382 - RNA, 22 nt, Human adenovirus D
cgggagcgguggggucaacccg

SEQ ID NO: 1571383 - RNA, 14 nt, Human adenovirus D
gacgcccuggccga

SEQ ID NO: 1571384 - RNA, 23 nt, Human adenovirus D
gaagugcggcggcggcuggcggu

SEQ ID NO: 1571385 - RNA, 21 nt, Human adenovirus D
gacggccuacgagcagacggu

SEQ ID NO: 1571386 - RNA, 15 nt, Human adenovirus D
gacugauggccacgg

SEQ ID NO: 1571387 - RNA, 22 nt, Human adenovirus D
gaagggcgagaagcggccgcgg

SEQ ID NO: 1571388 - RNA, 16 nt, Human adenovirus D
gaaacaccugcagcgc

SEQ ID NO: 1571389 - RNA, 21 nt, Human adenovirus D
gcaggcaggacucgcagacga

SEQ ID NO: 1571390 - RNA, 16 nt, Human adenovirus D
gcaggcgucgcagcgc

SEQ ID NO: 1571391 - RNA, 22 nt, Human adenovirus D
gccaagacaaaggaggccacgu

SEQ ID NO: 1571392 - RNA, 18 nt, Human adenovirus D
gagaccagaggcagacuc

SEQ ID NO: 1571393 - RNA, 12 nt, Human adenovirus D
gagaccugcacu

SEQ ID NO: 1571394 - RNA, 14 nt, Human adenovirus D
gagagcgcuggcgu

SEQ ID NO: 1571395 - RNA, 20 nt, Human adenovirus D
gcagcucuucccgcugaacu

SEQ ID NO: 1571396 - RNA, 15 nt, Human adenovirus D
gcagcuugcugacgc

SEQ ID NO: 1571397 - RNA, 20 nt, Human adenovirus D
acaagucggcggacaucgcu

SEQ ID NO: 1571398 - RNA, 18 nt, Human adenovirus D
acgaacucggcggugacg

SEQ ID NO: 1571399 - RNA, 16 nt, Human adenovirus D
agcauacaugcccucu

SEQ ID NO: 1571400 - RNA, 20 nt, Human adenovirus D
agcgccagucccucauccuc

SEQ ID NO: 1571401 - RNA, 21 nt, Human adenovirus D
aggcagcuccgguugugcagc

SEQ ID NO: 1571402 - RNA, 15 nt, Human adenovirus D
aggccaacagacucu

SEQ ID NO: 1571403 - RNA, 20 nt, Human adenovirus D
aggagaggaggaugugcugc

SEQ ID NO: 1571404 - RNA, 13 nt, Human adenovirus D
cauaucagccagu

SEQ ID NO: 1571405 - RNA, 14 nt, Human adenovirus D
ccaccugcggggcg

SEQ ID NO: 1571406 - RNA, 17 nt, Human
cuaauuuauucuaaauu

SEQ ID NO: 1571407 - RNA, 21 nt, Human
ccaggagggaggcaggggagg

SEQ ID NO: 1571408 - RNA, 19 nt, Human
ccaggggccggccaguggc

SEQ ID NO: 1571409 - RNA, 15 nt, Human
ccaggagggaggcag

SEQ ID NO: 1571410 - RNA, 22 nt, Human
ccaggagggaggcaggggaggg

SEQ ID NO: 1571411 - RNA, 21 nt, Human
ccucaggagccgaagcccagg

SEQ ID NO: 1571412 - RNA, 12 nt, Human
ccucaggagccg

SEQ ID NO: 1571413 - RNA, 19 nt, Human
ccucaggagccgaagccca

SEQ ID NO: 1571414 - RNA, 22 nt, Human
ccucaggagccgaagcccaggg

SEQ ID NO: 1571415 - RNA, 16 nt, Human
ccugcagccugcagga

SEQ ID NO: 1571416 - RNA, 22 nt, Human
cagugcaguuugguguguccuc

SEQ ID NO: 1571417 - RNA, 20 nt, Human
cagaauaaucaaauacauuu

SEQ ID NO: 1571418 - RNA, 23 nt, Human
cuggagugugaggguccugcagc

SEQ ID NO: 1571419 - RNA, 17 nt, Human
cuggugcccuggaugcc

SEQ ID NO: 1571420 - RNA, 20 nt, Human
cuggugcccuggaugcccag

SEQ ID NO: 1571421 - RNA, 21 nt, Human
cuggugcccuggaugcccagg

SEQ ID NO: 1571422 - RNA, 16 nt, Human
gauacuugaauaacca

SEQ ID NO: 1571423 - RNA, 20 nt, Human
ggagugugaggguccugcag

SEQ ID NO: 1571424 - RNA, 11 nt, Human
aaaaaguuugu

SEQ ID NO: 1571425 - RNA, 18 nt, Human
aaaaaguuugucuuaguu

SEQ ID NO: 1571426 - RNA, 14 nt, Human
ggccuuccccagca

SEQ ID NO: 1571427 - RNA, 13 nt, Human
ggccuuccccagc

SEQ ID NO: 1571428 - RNA, 14 nt, Human
aaagugguacuuga

SEQ ID NO: 1571429 - RNA, 20 nt, Human
aaagugguacuugaucauuu

SEQ ID NO: 1571430 - RNA, 23 nt, Human
aaagugguacuugaucauuuuua

SEQ ID NO: 1571431 - RNA, 13 nt, Human
guaauccuaaauu

SEQ ID NO: 1571432 - RNA, 18 nt, Human
ggguccugcagccugcag

SEQ ID NO: 1571433 - RNA, 23 nt, Human
ggguccugcagccugcaggaccu

SEQ ID NO: 1571434 - RNA, 19 nt, Human
ggguccugcagccugcagg

SEQ ID NO: 1571435 - RNA, 14 nt, Human
ggggccaugccucc

SEQ ID NO: 1571436 - RNA, 17 nt, Human
ggggccaugccuccuca

SEQ ID NO: 1571437 - RNA, 19 nt, Human
ggggccaugccuccucagg

SEQ ID NO: 1571438 - RNA, 23 nt, Human
ggggccaugccuccucaggagcc

SEQ ID NO: 1571439 - RNA, 17 nt, Human
gggccggccaguggccu

SEQ ID NO: 1571440 - RNA, 14 nt, Human
gcggcggucccagc

SEQ ID NO: 1571441 - RNA, 16 nt, Human
gcggcggucccagcuc

SEQ ID NO: 1571442 - RNA, 17 nt, Human
gcggcggucccagcucc

SEQ ID NO: 1571443 - RNA, 21 nt, Human
uuuuguuugguuauaucgaaa

SEQ ID NO: 1571444 - RNA, 13 nt, Human
uuuuguuugguua

SEQ ID NO: 1571445 - RNA, 16 nt, Human
uuuuguuugguuauau

SEQ ID NO: 1571446 - RNA, 15 nt, Human
uuuugauauaugaaa

SEQ ID NO: 1571447 - RNA, 24 nt, Human
auuacuuacguauguuuguacuug

SEQ ID NO: 1571448 - RNA, 14 nt, Human
augaaaugacuucu

SEQ ID NO: 1571449 - RNA, 22 nt, Human
uuugaaaacucuguguuuggaa

SEQ ID NO: 1571450 - RNA, 23 nt, Human
auauauuuauggccgggcagggu

SEQ ID NO: 1571451 - RNA, 19 nt, Human
aucaauucuguauuccaga

SEQ ID NO: 1571452 - RNA, 13 nt, Human
agugguuuagaaa

SEQ ID NO: 1571453 - RNA, 16 nt, Human
aguuugguguguccuc

SEQ ID NO: 1571454 - RNA, 19 nt, Human
auaccaaguugauacuuga

SEQ ID NO: 1571455 - RNA, 22 nt, Human
auaaaccuugucuaugaaauga

SEQ ID NO: 1571456 - RNA, 24 nt, Human
agggugccguguccccugacaggg

SEQ ID NO: 1571457 - RNA, 15 nt, Human
agggugccguguccc

SEQ ID NO: 1571458 - RNA, 21 nt, Human
agucucaugccuugagaucug

SEQ ID NO: 1571459 - RNA, 14 nt, Human
agccgaagcccagg

SEQ ID NO: 1571460 - RNA, 13 nt, Human
agcccaggggccg

SEQ ID NO: 1571461 - RNA, 12 nt, Human
uggccgggcagg

SEQ ID NO: 1571462 - RNA, 13 nt, Human
uggccgggcaggg

SEQ ID NO: 1571463 - RNA, 22 nt, Human
aggagggaggcaggggaggggu

SEQ ID NO: 1571464 - RNA, 16 nt, Human
ugacagggccagugca

SEQ ID NO: 1571465 - RNA, 19 nt, Human
ugacagggccagugcaguu

SEQ ID NO: 1571466 - RNA, 19 nt, Human
ugaaauuuccuaauuuauu

SEQ ID NO: 1571467 - RNA, 20 nt, Human
acuugaucauuuuuaccauu

SEQ ID NO: 1571468 - RNA, 20 nt, Human
ucugcgucgguccuggugcc

SEQ ID NO: 1571469 - RNA, 17 nt, Human
uccugcagccugcagga

SEQ ID NO: 1571470 - RNA, 21 nt, Human
uccucaggagccgaagcccag

SEQ ID NO: 1571471 - RNA, 22 nt, Human
uccucaggagccgaagcccagg

SEQ ID NO: 1571472 - RNA, 15 nt, Human
acuaauuuuacuucu

SEQ ID NO: 1571473 - RNA, 10 nt, Human
ucccagcucc

SEQ ID NO: 1571474 - RNA, 21 nt, Human
uaagcaaguuaaguguccucc

SEQ ID NO: 1571475 - RNA, 21 nt, Human
aauuaguacagaaauauccau

SEQ ID NO: 1571476 - RNA, 12 nt, Human
acaggaccccag

SEQ ID NO: 1571477 - RNA, 13 nt, Human
acaggaccccagc

SEQ ID NO: 1571478 - RNA, 14 nt, Human
acaggaccccagcu

SEQ ID NO: 1571479 - RNA, 15 nt, Human
acaggaccccagcuc

SEQ ID NO: 1571480 - RNA, 16 nt, Human
acaggaccccagcucu

SEQ ID NO: 1571481 - RNA, 17 nt, Human
acaggaccccagcucug

SEQ ID NO: 1571482 - RNA, 19 nt, Human
acaggaccccagcucugcg

SEQ ID NO: 1571483 - RNA, 18 nt, Human
acaggaccccagcucugc

SEQ ID NO: 1571484 - RNA, 16 nt, Human
acaggcuuagggacag

SEQ ID NO: 1571485 - RNA, 15 nt, Human
uaguucccaggugau

SEQ ID NO: 1571486 - RNA, 19 nt, Human
uagggacaggaccccagcu

SEQ ID NO: 1571487 - RNA, 20 nt, Human
uagggacaggaccccagcuc

SEQ ID NO: 1571488 - RNA, 22 nt, Human
uagggacaggaccccagcucug

SEQ ID NO: 1571489 - RNA, 21 nt, Human
uagggacaggaccccagcucu

SEQ ID NO: 1571490 - RNA, 14 nt, Human
aagaaacaacagaa

SEQ ID NO: 1571491 - RNA, 14 nt, Human
guccccugacaggg

SEQ ID NO: 1571492 - RNA, 16 nt, Human
gucgcugugccacagg

SEQ ID NO: 1571493 - RNA, 13 nt, Human
aaaaauuuuuguu

SEQ ID NO: 1571494 - RNA, 14 nt, Human
aaaaauuuuuguuu

SEQ ID NO: 1571495 - RNA, 14 nt, Human
aggaccucgugcca

SEQ ID NO: 1571496 - RNA, 13 nt, Human
aggaccccagcuc

SEQ ID NO: 1571497 - RNA, 14 nt, Human
aggaccccagcucu

SEQ ID NO: 1571498 - RNA, 16 nt, Human
aggaccccagcucugc

SEQ ID NO: 1571499 - RNA, 17 nt, Human
aggaccccagcucugcg

SEQ ID NO: 1571500 - RNA, 15 nt, Human
agcaugcaccacggg

SEQ ID NO: 1571501 - RNA, 13 nt, Human
agacggggcugga

SEQ ID NO: 1571502 - RNA, 15 nt, Human
accccgagggcugag

SEQ ID NO: 1571503 - RNA, 21 nt, Human
uuauaucgaaauaguuacagg

SEQ ID NO: 1571504 - RNA, 23 nt, Human
uuauguuguuguuguuuuuggau

SEQ ID NO: 1571505 - RNA, 19 nt, Human
uuauuagaaaaauauuaua

SEQ ID NO: 1571506 - RNA, 17 nt, Human
ugccacaggcuuaggga

SEQ ID NO: 1571507 - RNA, 21 nt, Human
ugccacaggcuuagggacagg

SEQ ID NO: 1571508 - RNA, 20 nt, Human
ugccacaggcuuagggacag

SEQ ID NO: 1571509 - RNA, 21 nt, Human
ugccguguccccugacagggc

SEQ ID NO: 1571510 - RNA, 16 nt, Human
ugcccuggaugcccag

SEQ ID NO: 1571511 - RNA, 18 nt, Human
ugcccuggaugcccagga

SEQ ID NO: 1571512 - RNA, 22 nt, Human
ucgugccaccccgagggcugag

SEQ ID NO: 1571513 - RNA, 22 nt, Human
uauuccagacuugggaggaugu

SEQ ID NO: 1571514 - RNA, 23 nt, Human
ucaggagccgaagcccaggggcc

SEQ ID NO: 1571515 - RNA, 22 nt, Human
ggcuuagggacaggaccccagc

SEQ ID NO: 1571516 - RNA, 17 nt, Human
ggcucccaugucaagag

SEQ ID NO: 1571517 - RNA, 14 nt, Human
ggcggucccagcuc

SEQ ID NO: 1571518 - RNA, 15 nt, Human
ggcggucccagcucc

SEQ ID NO: 1571519 - RNA, 21 nt, Human
gccuggucccacgagggugcc

SEQ ID NO: 1571520 - RNA, 12 nt, Human
gcaggggagggg

SEQ ID NO: 1571521 - RNA, 17 nt, Human
gcacuaaaguuaguaaa

SEQ ID NO: 1571522 - RNA, 13 nt, Human
gagucgcugugcc

SEQ ID NO: 1571523 - RNA, 14 nt, Human
gauagacugcuaca

SEQ ID NO: 1571524 - RNA, 19 nt, Human
gagccuggucccacgaggg

SEQ ID NO: 1571525 - RNA, 23 nt, Human
gagccuggucccacgagggugcc

SEQ ID NO: 1571526 - RNA, 18 nt, Human
gaaccugaagaacuauuu

SEQ ID NO: 1571527 - RNA, 18 nt, Human
gaacuuacuugcauacca

SEQ ID NO: 1571528 - RNA, 16 nt, Human
gaaucuguauauauuu

SEQ ID NO: 1571529 - RNA, 18 nt, Human
cugcgucgguccuggugc

SEQ ID NO: 1571530 - RNA, 17 nt, Human
cugcgucgguccuggug

SEQ ID NO: 1571531 - RNA, 14 nt, Human
cugaagaacuauuu

SEQ ID NO: 1571532 - RNA, 12 nt, Human
cuccucaggagc

SEQ ID NO: 1571533 - RNA, 13 nt, Human
cuccucaggagcc

SEQ ID NO: 1571534 - RNA, 22 nt, Human
ccuggugcccuggaugcccagg

SEQ ID NO: 1571535 - RNA, 21 nt, Human
ccuggugcccuggaugcccag

SEQ ID NO: 1571536 - RNA, 12 nt, Human
ccuggugcccug

SEQ ID NO: 1571537 - RNA, 18 nt, Human
ccuggugcccuggaugcc

SEQ ID NO: 1571538 - RNA, 20 nt, Human
ccuggugcccuggaugccca

SEQ ID NO: 1571539 - RNA, 20 nt, Human
ccuggucccacgagggugcc

SEQ ID NO: 1571540 - RNA, 13 nt, Human
ccgccuuaccagg

SEQ ID NO: 1571541 - RNA, 17 nt, Human
ccguguccccugacagg

SEQ ID NO: 1571542 - RNA, 19 nt, Human
ccguguccccugacagggc

SEQ ID NO: 1571543 - RNA, 23 nt, Human
cccgagggcugagccugguccca

SEQ ID NO: 1571544 - RNA, 18 nt, Human
cccggguugggucaccag

SEQ ID NO: 1571545 - RNA, 17 nt, Human
ccaucugaaagugguac

SEQ ID NO: 1571546 - RNA, 18 nt, Human
ccauuauuuuuaggaugu

SEQ ID NO: 1571547 - RNA, 18 nt, Human
ccagcaugcaccacgggc

SEQ ID NO: 1571548 - RNA, 20 nt, Human
ccagcaugcaccacgggccc

SEQ ID NO: 1571549 - RNA, 23 nt, Human
ccaccccgagggcugagccuggu

SEQ ID NO: 1571550 - RNA, 19 nt, Human
cauucauaaaccuugucua

SEQ ID NO: 1571551 - RNA, 14 nt, Human
cauuuuuaccauua

SEQ ID NO: 1571552 - RNA, 17 nt, Human
caggggccggccagugg

SEQ ID NO: 1571553 - RNA, 22 nt, Human
caggggccggccaguggccuuc

SEQ ID NO: 1571554 - RNA, 13 nt, Human
caggggaggggug

SEQ ID NO: 1571555 - RNA, 16 nt, Human
cagggccagugcaguu

SEQ ID NO: 1571556 - RNA, 16 nt, Human
caggcuuagggacagg

SEQ ID NO: 1571557 - RNA, 17 nt, Human
caggcuuagggacagga

SEQ ID NO: 1571558 - RNA, 17 nt, Human
caggagccgaagcccag

SEQ ID NO: 1571559 - RNA, 18 nt, Human
caggagccgaagcccagg

SEQ ID NO: 1571560 - RNA, 21 nt, Human
caggagccgaagcccaggggc

SEQ ID NO: 1571561 - RNA, 19 nt, Human
caggagaagaaccugaaga

SEQ ID NO: 1571562 - RNA, 19 nt, Human
caggaaucuguauauauuu

SEQ ID NO: 1571563 - RNA, 18 nt, Human
caggaccucgugccaccc

SEQ ID NO: 1571564 - RNA, 17 nt, Human
cagcaugcaccacgggc

SEQ ID NO: 1571565 - RNA, 19 nt, Human
cagacggggcuggagugug

SEQ ID NO: 1571566 - RNA, 13 nt, Human
cagacggggcugg

SEQ ID NO: 1571567 - RNA, 19 nt, Human
cguguccccugacagggcc

SEQ ID NO: 1571568 - RNA, 16 nt, Human
cguguccccugacagg

SEQ ID NO: 1571569 - RNA, 18 nt, Human
cguguccccugacagggc

SEQ ID NO: 1571570 - RNA, 14 nt, Human
ccuggaugcccagg

SEQ ID NO: 1571571 - RNA, 15 nt, Human
ccgaagcccaggggc

SEQ ID NO: 1571572 - RNA, 16 nt, Human
ccgaagcccaggggcc

SEQ ID NO: 1571573 - RNA, 17 nt, Human
ccgaagcccaggggccg

SEQ ID NO: 1571574 - RNA, 16 nt, Human
ccccugacagggccag

SEQ ID NO: 1571575 - RNA, 19 nt, Human
ccccgagggcugagccugg

SEQ ID NO: 1571576 - RNA, 21 nt, Human
ccccgagggcugagccugguc

SEQ ID NO: 1571577 - RNA, 14 nt, Human
ccccgagggcugag

SEQ ID NO: 1571578 - RNA, 19 nt, Human
cacaggcuuagggacagga

SEQ ID NO: 1571579 - RNA, 22 nt, Human
cacaggcuuagggacaggaccc

SEQ ID NO: 1571580 - RNA, 18 nt, Human
cacaggcuuagggacagg

SEQ ID NO: 1571581 - RNA, 14 nt, Human
caugcaccacgggc

SEQ ID NO: 1571582 - RNA, 19 nt, Human
caugucaagagucgcugug

SEQ ID NO: 1571583 - RNA, 21 nt, Human
caugucaagagucgcugugcc

SEQ ID NO: 1571584 - RNA, 16 nt, Human
ccacgagggugccgug

SEQ ID NO: 1571585 - RNA, 16 nt, Human
caggguguggggccau

SEQ ID NO: 1571586 - RNA, 17 nt, Human
caggguguggggccaug

SEQ ID NO: 1571587 - RNA, 22 nt, Human
caggguguggggccaugccucc

SEQ ID NO: 1571588 - RNA, 15 nt, Human
caggagggaggcagg

SEQ ID NO: 1571589 - RNA, 21 nt, Human
caggagggaggcaggggaggg

SEQ ID NO: 1571590 - RNA, 18 nt, Human
caggaccccagcucugcg

SEQ ID NO: 1571591 - RNA, 16 nt, Human
caggaccccagcucug

SEQ ID NO: 1571592 - RNA, 17 nt, Human
caggaccccagcucugc

SEQ ID NO: 1571593 - RNA, 15 nt, Human
caggaccccagcucu

SEQ ID NO: 1571594 - RNA, 15 nt, Human
aaauauuauaacuca

SEQ ID NO: 1571595 - RNA, 15 nt, Human
gguccugcagccugc

SEQ ID NO: 1571596 - RNA, 16 nt, Human
gguccugcagccugca

SEQ ID NO: 1571597 - RNA, 16 nt, Human
ggggccggccaguggc

SEQ ID NO: 1571598 - RNA, 14 nt, Human
ggacaggaccccag

SEQ ID NO: 1571599 - RNA, 15 nt, Human
ggacaggaccccagc

SEQ ID NO: 1571600 - RNA, 16 nt, Human
ggacaggaccccagcu

SEQ ID NO: 1571601 - RNA, 17 nt, Human
ggacaggaccccagcuc

SEQ ID NO: 1571602 - RNA, 21 nt, Human
ggacaggaccccagcucugcg

SEQ ID NO: 1571603 - RNA, 18 nt, Human
ggacaggaccccagcucu

SEQ ID NO: 1571604 - RNA, 20 nt, Human
ggacaggaccccagcucugc

SEQ ID NO: 1571605 - RNA, 23 nt, Human
cuuagggacaggaccccagcucu

SEQ ID NO: 1571606 - RNA, 21 nt, Human
cuuagggacaggaccccagcu

SEQ ID NO: 1571607 - RNA, 22 nt, Human
cuuagggacaggaccccagcuc

SEQ ID NO: 1571608 - RNA, 18 nt, Human
cuuagggacaggacccca

SEQ ID NO: 1571609 - RNA, 20 nt, Human
cuuagggacaggaccccagc

SEQ ID NO: 1571610 - RNA, 22 nt, Human
auugguuuuccaaucauuugac

SEQ ID NO: 1571611 - RNA, 14 nt, Human
augguguuacauau

SEQ ID NO: 1571612 - RNA, 18 nt, Human
uuugugaaggugauuuau

SEQ ID NO: 1571613 - RNA, 19 nt, Human
auguagcgcuuugaauaug

SEQ ID NO: 1571614 - RNA, 21 nt, Human
auguagcgcuuugaauaugaa

SEQ ID NO: 1571615 - RNA, 13 nt, Human
augccuccucagg

SEQ ID NO: 1571616 - RNA, 15 nt, Human
augccuccucaggag

SEQ ID NO: 1571617 - RNA, 14 nt, Human
augccuccucagga

SEQ ID NO: 1571618 - RNA, 18 nt, Human
augccuccucaggagccg

SEQ ID NO: 1571619 - RNA, 16 nt, Human
auauuuuuuaucauaa

SEQ ID NO: 1571620 - RNA, 18 nt, Human
auccuaaauuuacccucu

SEQ ID NO: 1571621 - RNA, 13 nt, Human
uugauuauaaagu

SEQ ID NO: 1571622 - RNA, 22 nt, Human
uugacacuuauagauugaaauu

SEQ ID NO: 1571623 - RNA, 17 nt, Human
auaaucaaauacauuuu

SEQ ID NO: 1571624 - RNA, 19 nt, Human
auaacucauuuguuguuug

SEQ ID NO: 1571625 - RNA, 21 nt, Human
aguuuugugaaggugauuuau

SEQ ID NO: 1571626 - RNA, 12 nt, Human
aguuuaccaucu

SEQ ID NO: 1571627 - RNA, 16 nt, Human
aguuuaccaucugaaa

SEQ ID NO: 1571628 - RNA, 19 nt, Human
agugugaggguccugcagc

SEQ ID NO: 1571629 - RNA, 15 nt, Human
uguccccugacaggg

SEQ ID NO: 1571630 - RNA, 16 nt, Human
uguccccugacagggc

SEQ ID NO: 1571631 - RNA, 18 nt, Human
uguccccugacagggcca

SEQ ID NO: 1571632 - RNA, 18 nt, Human
agucgcugugccacaggc

SEQ ID NO: 1571633 - RNA, 16 nt, Human
agggcugagccugguc

SEQ ID NO: 1571634 - RNA, 17 nt, Human
agggcugagccuggucc

SEQ ID NO: 1571635 - RNA, 23 nt, Human
agcucugcgucgguccuggugcc

SEQ ID NO: 1571636 - RNA, 22 nt, Human
agcucugcgucgguccuggugc

SEQ ID NO: 1571637 - RNA, 21 nt, Human
ugcaguuugguguguccuccg

SEQ ID NO: 1571638 - RNA, 20 nt, Human
agccugcaggaccucgugcc

SEQ ID NO: 1571639 - RNA, 21 nt, Human
agccugcaggaccucgugcca

SEQ ID NO: 1571640 - RNA, 22 nt, Human
ucuggucuaaauuguguuacua

SEQ ID NO: 1571641 - RNA, 14 nt, Human
ugaauauaaucccu

SEQ ID NO: 1571642 - RNA, 15 nt, Human
agagucgcugugcca

SEQ ID NO: 1571643 - RNA, 19 nt, Human
agagucgcugugccacagg

SEQ ID NO: 1571644 - RNA, 14 nt, Human
agagucgcugugcc

SEQ ID NO: 1571645 - RNA, 23 nt, Human
ugaggguccugcagccugcagga

SEQ ID NO: 1571646 - RNA, 21 nt, Human
ugaggguccugcagccugcag

SEQ ID NO: 1571647 - RNA, 22 nt, Human
ugaggguccugcagccugcagg

SEQ ID NO: 1571648 - RNA, 14 nt, Human
ugaggguccugcag

SEQ ID NO: 1571649 - RNA, 15 nt, Human
ugaggguccugcagc

SEQ ID NO: 1571650 - RNA, 18 nt, Human
ugaggguccugcagccug

SEQ ID NO: 1571651 - RNA, 19 nt, Human
ugaggguccugcagccugc

SEQ ID NO: 1571652 - RNA, 11 nt, Human
ugagccugguc

SEQ ID NO: 1571653 - RNA, 13 nt, Human
uccugcagccugc

SEQ ID NO: 1571654 - RNA, 18 nt, Human
accgacguugccaucaaa

SEQ ID NO: 1571655 - RNA, 18 nt, Human
ucauuugacuaagagucu

SEQ ID NO: 1571656 - RNA, 13 nt, Human
uauuucauuuauu

SEQ ID NO: 1571657 - RNA, 16 nt, Human
uauggccgggcagggu

SEQ ID NO: 1571658 - RNA, 19 nt, Human
uauagauugaaauuuccua

SEQ ID NO: 1571659 - RNA, 17 nt, Human
aauuuaucaguaccuaa

SEQ ID NO: 1571660 - RNA, 19 nt, Human
aauuuacccucuugaauau

SEQ ID NO: 1571661 - RNA, 22 nt, Human
aauuuacccucuugaauauaau

SEQ ID NO: 1571662 - RNA, 14 nt, Human
guugggucaccaga

SEQ ID NO: 1571663 - RNA, 21 nt, Human
guugggucaccagacggggcu

SEQ ID NO: 1571664 - RNA, 12 nt, Human
aaggagcaucua

SEQ ID NO: 1571665 - RNA, 24 nt, Human
guuuuuggaugguguuacauauua

SEQ ID NO: 1571666 - RNA, 19 nt, Human
aaguuagaacauuugcugu

SEQ ID NO: 1571667 - RNA, 14 nt, Human
aaguuuaccaucug

SEQ ID NO: 1571668 - RNA, 17 nt, Human
gugugaggguccugcag

SEQ ID NO: 1571669 - RNA, 21 nt, Human
aagauguagcgcuuugaauau

SEQ ID NO: 1571670 - RNA, 16 nt, Human
aagaaaaguuuaccau

SEQ ID NO: 1571671 - RNA, 10 nt, Human
guccugcagc

SEQ ID NO: 1571672 - RNA, 18 nt, Human
guccugcagccugcagga

SEQ ID NO: 1571673 - RNA, 14 nt, Human
guccugcagccugc

SEQ ID NO: 1571674 - RNA, 18 nt, Human
aguggccuuccccagcau

SEQ ID NO: 1571675 - RNA, 19 nt, Human
aguggccuuccccagcaug

SEQ ID NO: 1571676 - RNA, 17 nt, Human
agggacaggaccccagc

SEQ ID NO: 1571677 - RNA, 18 nt, Human
agggacaggaccccagcu

SEQ ID NO: 1571678 - RNA, 13 nt, Human
agggacaggaccc

SEQ ID NO: 1571679 - RNA, 16 nt, Human
agggacaggaccccag

SEQ ID NO: 1571680 - RNA, 22 nt, Human
aauauuauaacucauuuguugu

SEQ ID NO: 1571681 - RNA, 15 nt, Human
caccccgagggcuga

SEQ ID NO: 1571682 - RNA, 13 nt, Human
caaauacauuuua

SEQ ID NO: 1571683 - RNA, 18 nt, Human
uucuaagucauucauaaa

SEQ ID NO: 1571684 - RNA, 13 nt, Human
uuguuugguuaua

SEQ ID NO: 1571685 - RNA, 14 nt, Human
uuuaccaucugaaa

SEQ ID NO: 1571686 - RNA, 13 nt, Human
uuuaccaucugaa

SEQ ID NO: 1571687 - RNA, 21 nt, Human
uuuacccucuugaauauaauc

SEQ ID NO: 1571688 - RNA, 13 nt, Human
uuuccuaauuuau

SEQ ID NO: 1571689 - RNA, 16 nt, Human
uuauggccgggcaggg

SEQ ID NO: 1571690 - RNA, 20 nt, Human
uuauugguuuuccaaucauu

SEQ ID NO: 1571691 - RNA, 20 nt, Human
ugggucaccagacggggcug

SEQ ID NO: 1571692 - RNA, 19 nt, Human
ugggucaccagacggggcu

SEQ ID NO: 1571693 - RNA, 16 nt, Human
ugccuccucaggagcc

SEQ ID NO: 1571694 - RNA, 12 nt, Human
ugccuccucagg

SEQ ID NO: 1571695 - RNA, 13 nt, Human
ugccuccucagga

SEQ ID NO: 1571696 - RNA, 16 nt, Human
ucuaucagauuaaguu

SEQ ID NO: 1571697 - RNA, 19 nt, Human
uccgccuuaccaggagaag

SEQ ID NO: 1571698 - RNA, 21 nt, Human
uccccagcaugcaccacgggc

SEQ ID NO: 1571699 - RNA, 19 nt, Human
uccccagcaugcaccacgg

SEQ ID NO: 1571700 - RNA, 20 nt, Human
uccccagcaugcaccacggg

SEQ ID NO: 1571701 - RNA, 14 nt, Human
uauuauauguucua

SEQ ID NO: 1571702 - RNA, 17 nt, Human
uauuauauguucuagaa

SEQ ID NO: 1571703 - RNA, 15 nt, Human
ucaccagacggggcu

SEQ ID NO: 1571704 - RNA, 19 nt, Human
ucaccagacggggcuggag

SEQ ID NO: 1571705 - RNA, 19 nt, Human
gugcccuggaugcccagga

SEQ ID NO: 1571706 - RNA, 18 nt, Human
gugcccuggaugcccagg

SEQ ID NO: 1571707 - RNA, 15 nt, Human
gucccagcucccugg

SEQ ID NO: 1571708 - RNA, 11 nt, Human
guccuggugcc

SEQ ID NO: 1571709 - RNA, 12 nt, Human
guccuggugccc

SEQ ID NO: 1571710 - RNA, 20 nt, Human
guccuggugcccuggaugcc

SEQ ID NO: 1571711 - RNA, 23 nt, Human
guccuggugcccuggaugcccag

SEQ ID NO: 1571712 - RNA, 18 nt, Human
guccuccgccuuaccagg

SEQ ID NO: 1571713 - RNA, 11 nt, Human
gucccagcucc

SEQ ID NO: 1571714 - RNA, 19 nt, Human
ggggugcggcggucccagc

SEQ ID NO: 1571715 - RNA, 21 nt, Human
gggcccggguugggucaccag

SEQ ID NO: 1571716 - RNA, 22 nt, Human
gggcccggguugggucaccaga

SEQ ID NO: 1571717 - RNA, 15 nt, Human
gggcugagccugguc

SEQ ID NO: 1571718 - RNA, 23 nt, Human
gggcugagccuggucccacgagg

SEQ ID NO: 1571719 - RNA, 13 nt, Human
gggcugagccugg

SEQ ID NO: 1571720 - RNA, 20 nt, Human
ggucccagcucccuggcucc

SEQ ID NO: 1571721 - RNA, 12 nt, Human
ggucccagcucc

SEQ ID NO: 1571722 - RNA, 14 nt, Human
ggucccagcucccu

SEQ ID NO: 1571723 - RNA, 15 nt, Human
ggucccagcucccug

SEQ ID NO: 1571724 - RNA, 15 nt, Human
ggugcccuggaugcc

SEQ ID NO: 1571725 - RNA, 18 nt, Human
ggugcccuggaugcccag

SEQ ID NO: 1571726 - RNA, 19 nt, Human
ggugcccuggaugcccagg

SEQ ID NO: 1571727 - RNA, 20 nt, Human
ggugcccuggaugcccagga

SEQ ID NO: 1571728 - RNA, 19 nt, Human
ggugcggcggucccagcuc

SEQ ID NO: 1571729 - RNA, 21 nt, Human
gguuuuccaaucauuugacua

SEQ ID NO: 1571730 - RNA, 23 nt, Human
guacaguugcuguugugugauca

SEQ ID NO: 1571731 - RNA, 22 nt, Human
gcuuagggacaggaccccagcu

SEQ ID NO: 1571732 - RNA, 23 nt, Human
gcuuagggacaggaccccagcuc

SEQ ID NO: 1571733 - RNA, 21 nt, Human
gcucugcgucgguccuggugc

SEQ ID NO: 1571734 - RNA, 20 nt, Human
gcucugcgucgguccuggug

SEQ ID NO: 1571735 - RNA, 20 nt, Human
gcccuggaugcccaggaauc

SEQ ID NO: 1571736 - RNA, 13 nt, Human
gaggguccugcag

SEQ ID NO: 1571737 - RNA, 17 nt, Human
gaggguccugcagccug

SEQ ID NO: 1571738 - RNA, 21 nt, Human
gaggguccugcagccugcagg

SEQ ID NO: 1571739 - RNA, 18 nt, Human
gaggguccugcagccugc

SEQ ID NO: 1571740 - RNA, 23 nt, Human
gagggugccguguccccugacag

SEQ ID NO: 1571741 - RNA, 19 nt, Human
gaggggugcggcgguccca

SEQ ID NO: 1571742 - RNA, 22 nt, Human
gaggggugcggcggucccagcu

SEQ ID NO: 1571743 - RNA, 19 nt, Human
gacaggaccccagcucugc

SEQ ID NO: 1571744 - RNA, 14 nt, Human
gacaggaccccagc

SEQ ID NO: 1571745 - RNA, 15 nt, Human
gacaggaccccagcu

SEQ ID NO: 1571746 - RNA, 16 nt, Human
gacaggaccccagcuc

SEQ ID NO: 1571747 - RNA, 17 nt, Human
gacaggaccccagcucu

SEQ ID NO: 1571748 - RNA, 18 nt, Human
gacaggaccccagcucug

SEQ ID NO: 1571749 - RNA, 20 nt, Human
gacaggaccccagcucugcg

SEQ ID NO: 1571750 - RNA, 13 nt, Human
cugugccacaggc

SEQ ID NO: 1571751 - RNA, 22 nt, Human
cuguauauauuuauggccgggc

SEQ ID NO: 1571752 - RNA, 23 nt, Human
cucaggagccgaagcccaggggc

SEQ ID NO: 1571753 - RNA, 21 nt, Human
cucaggagccgaagcccaggg

SEQ ID NO: 1571754 - RNA, 14 nt, Human
cuaaauuuuaagug

SEQ ID NO: 1571755 - RNA, 11 nt, Human
cuaaaaacaua

SEQ ID NO: 1571756 - RNA, 15 nt, Human
cgcugugccacaggc

SEQ ID NO: 1571757 - RNA, 13 nt, Human
cggaauauauuuu

SEQ ID NO: 1571758 - RNA, 16 nt, Human
cgaagcccaggggccg

SEQ ID NO: 1571759 - RNA, 15 nt, Human
ccgggcagggugugg

SEQ ID NO: 1571760 - RNA, 23 nt, Human
ccagugcaguuugguguguccuc

SEQ ID NO: 1571761 - RNA, 17 nt, Human
ccaguggccuuccccag

SEQ ID NO: 1571762 - RNA, 19 nt, Human
ccaguggccuuccccagca

SEQ ID NO: 1571763 - RNA, 22 nt, Human
accaucugaaagugguacuuga

SEQ ID NO: 1571764 - RNA, 17 nt, Human
acagggccagugcaguu

SEQ ID NO: 1571765 - RNA, 21 nt, Human
aacuuacuugcauaccaaguu

SEQ ID NO: 1571766 - RNA, 23 nt, Human
aggcuuagggacaggaccccagc

SEQ ID NO: 1571767 - RNA, 16 nt, Human
aggguccugcagccug

SEQ ID NO: 1571768 - RNA, 17 nt, Human
aggguccugcagccugc

SEQ ID NO: 1571769 - RNA, 19 nt, Human
aggguccugcagccugcag

SEQ ID NO: 1571770 - RNA, 21 nt, Human
aggguccugcagccugcagga

SEQ ID NO: 1571771 - RNA, 13 nt, Human
agggacuuagcaa

SEQ ID NO: 1571772 - RNA, 17 nt, Human
aguggccuuccccagca

SEQ ID NO: 1571773 - RNA, 23 nt, Human
aguugauacuugaauaaccaucu

SEQ ID NO: 1571774 - RNA, 19 nt, Human
cucugcgucgguccuggug

SEQ ID NO: 1571775 - RNA, 20 nt, Human
cucugcgucgguccuggugc

SEQ ID NO: 1571776 - RNA, 21 nt, Human
cucugcgucgguccuggugcc

SEQ ID NO: 1571777 - RNA, 22 nt, Human
cucugcgucgguccuggugccc

SEQ ID NO: 1571778 - RNA, 17 nt, Human
cuccgccuuaccaggag

SEQ ID NO: 1571779 - RNA, 15 nt, Human
cggcggucccagcuc

SEQ ID NO: 1571780 - RNA, 16 nt, Human
cggcggucccagcucc

SEQ ID NO: 1571781 - RNA, 19 nt, Human
cggcggucccagcucccug

SEQ ID NO: 1571782 - RNA, 22 nt, Human
ccaugucaagagucgcugugcc

SEQ ID NO: 1571783 - RNA, 19 nt, Human
ccugcagccugcaggaccu

SEQ ID NO: 1571784 - RNA, 17 nt, Human
ccugcaggaccucgugc

SEQ ID NO: 1571785 - RNA, 18 nt, Human
ccugcaggaccucgugcc

SEQ ID NO: 1571786 - RNA, 12 nt, Human
cagccugcagga

SEQ ID NO: 1571787 - RNA, 21 nt, Human
cagccugcaggaccucgugcc

SEQ ID NO: 1571788 - RNA, 17 nt, Human
ggccaugccuccucagg

SEQ ID NO: 1571789 - RNA, 18 nt, Human
ggccaugccuccucagga

SEQ ID NO: 1571790 - RNA, 21 nt, Human
ggccaugccuccucaggagcc

SEQ ID NO: 1571791 - RNA, 22 nt, Human
ggccagugcaguuugguguguc

SEQ ID NO: 1571792 - RNA, 19 nt, Human
ggccaguggccuuccccag

SEQ ID NO: 1571793 - RNA, 22 nt, Human
ggccaguggccuuccccagcau

SEQ ID NO: 1571794 - RNA, 15 nt, Human
gggacaggaccccag

SEQ ID NO: 1571795 - RNA, 17 nt, Human
gggacaggaccccagcu

SEQ ID NO: 1571796 - RNA, 19 nt, Human
gggacaggaccccagcucu

SEQ ID NO: 1571797 - RNA, 21 nt, Human
gggacaggaccccagcucugc

SEQ ID NO: 1571798 - RNA, 22 nt, Human
gggacaggaccccagcucugcg

SEQ ID NO: 1571799 - RNA, 13 nt, Human
gggccaugccucc

SEQ ID NO: 1571800 - RNA, 23 nt, Human
gggccaugccuccucaggagccg

SEQ ID NO: 1571801 - RNA, 22 nt, Human
gggccaugccuccucaggagcc

SEQ ID NO: 1571802 - RNA, 14 nt, Human
gguccuggugcccu

SEQ ID NO: 1571803 - RNA, 24 nt, Human
gguccuggugcccuggaugcccag

SEQ ID NO: 1571804 - RNA, 12 nt, Human
gguccuggugcc

SEQ ID NO: 1571805 - RNA, 13 nt, Human
gguccuggugccc

SEQ ID NO: 1571806 - RNA, 15 nt, Human
gcuggagugugaggg

SEQ ID NO: 1571807 - RNA, 21 nt, Human
gcuggagugugaggguccugc

SEQ ID NO: 1571808 - RNA, 13 nt, Human
gcugugccacagg

SEQ ID NO: 1571809 - RNA, 14 nt, Human
gcugugccacaggc

SEQ ID NO: 1571810 - RNA, 15 nt, Human
gcugugccacaggcu

SEQ ID NO: 1571811 - RNA, 20 nt, Human
gcugugccacaggcuuaggg

SEQ ID NO: 1571812 - RNA, 19 nt, Human
gcugugccacaggcuuagg

SEQ ID NO: 1571813 - RNA, 21 nt, Human
gccaguggccuuccccagcau

SEQ ID NO: 1571814 - RNA, 17 nt, Human
cuucuaagucauucaua

SEQ ID NO: 1571815 - RNA, 22 nt, Human
uuggaugguguuacauauuaua

SEQ ID NO: 1571816 - RNA, 14 nt, Human
auggccgggcaggg

SEQ ID NO: 1571817 - RNA, 16 nt, Human
uuuaagcaaguuaagu

SEQ ID NO: 1571818 - RNA, 17 nt, Human
uuuaagcaaguuaagug

SEQ ID NO: 1571819 - RNA, 14 nt, Human
uuccuuuuuuugau

SEQ ID NO: 1571820 - RNA, 13 nt, Human
uugaaauuuccua

SEQ ID NO: 1571821 - RNA, 18 nt, Human
uuaguuuugugaagguga

SEQ ID NO: 1571822 - RNA, 20 nt, Human
auaguucccaggugauauuu

SEQ ID NO: 1571823 - RNA, 21 nt, Human
uuagggacaggaccccagcuc

SEQ ID NO: 1571824 - RNA, 22 nt, Human
uuagggacaggaccccagcucu

SEQ ID NO: 1571825 - RNA, 20 nt, Human
auaaucccuggaugauauuu

SEQ ID NO: 1571826 - RNA, 21 nt, Human
auaaucccuggaugauauuuu

SEQ ID NO: 1571827 - RNA, 16 nt, Human
auaaccaucugaaagu

SEQ ID NO: 1571828 - RNA, 16 nt, Human
uuacaggcacuaaagu

SEQ ID NO: 1571829 - RNA, 15 nt, Human
aguuagaacauuugc

SEQ ID NO: 1571830 - RNA, 17 nt, Human
ugucaagagucgcugug

SEQ ID NO: 1571831 - RNA, 19 nt, Human
ugucaagagucgcugugcc

SEQ ID NO: 1571832 - RNA, 22 nt, Human
aggguguggggccaugccuccu

SEQ ID NO: 1571833 - RNA, 23 nt, Human
aggguguggggccaugccuccuc

SEQ ID NO: 1571834 - RNA, 13 nt, Human
uggccuuccccag

SEQ ID NO: 1571835 - RNA, 23 nt, Human
uggccuuccccagcaugcaccac

SEQ ID NO: 1571836 - RNA, 15 nt, Human
uggccuuccccagca

SEQ ID NO: 1571837 - RNA, 18 nt, Human
ugcggcggucccagcucc

SEQ ID NO: 1571838 - RNA, 13 nt, Human
ugcggcgguccca

SEQ ID NO: 1571839 - RNA, 14 nt, Human
ugcggcggucccag

SEQ ID NO: 1571840 - RNA, 17 nt, Human
ugcggcggucccagcuc

SEQ ID NO: 1571841 - RNA, 22 nt, Human
agccuggucccacgagggugcc

SEQ ID NO: 1571842 - RNA, 18 nt, Human
ugcagccugcaggaccuc

SEQ ID NO: 1571843 - RNA, 17 nt, Human
ugcagccugcaggaccu

SEQ ID NO: 1571844 - RNA, 14 nt, Human
ugaguagucucaug

SEQ ID NO: 1571845 - RNA, 17 nt, Human
ugauauuuuuuaucaua

SEQ ID NO: 1571846 - RNA, 19 nt, Human
ugauauuuuuuaucauaaa

SEQ ID NO: 1571847 - RNA, 17 nt, Human
ugaucaaacaugucucu

SEQ ID NO: 1571848 - RNA, 17 nt, Human
agccacauauugagaug

SEQ ID NO: 1571849 - RNA, 20 nt, Human
ugaccccaggagggaggcag

SEQ ID NO: 1571850 - RNA, 22 nt, Human
ugaccccaggagggaggcaggg

SEQ ID NO: 1571851 - RNA, 12 nt, Human
agauuuuguugg

SEQ ID NO: 1571852 - RNA, 20 nt, Human
ugaaaaagcuggauuuucuu

SEQ ID NO: 1571853 - RNA, 17 nt, Human
agaauaaucaaauacau

SEQ ID NO: 1571854 - RNA, 20 nt, Human
agaaauuacuaauuuuacuu

SEQ ID NO: 1571855 - RNA, 16 nt, Human
ucgcugugccacaggc

SEQ ID NO: 1571856 - RNA, 11 nt, Human
accccagcucu

SEQ ID NO: 1571857 - RNA, 12 nt, Human
uccccugacagg

SEQ ID NO: 1571858 - RNA, 15 nt, Human
uccccugacagggcc

SEQ ID NO: 1571859 - RNA, 14 nt, Human
acgagggugccgug

SEQ ID NO: 1571860 - RNA, 17 nt, Human
uagaaacauguaauccu

SEQ ID NO: 1571861 - RNA, 15 nt, Human
uauaacucauuuguu

SEQ ID NO: 1571862 - RNA, 20 nt, Human
aauuacuuacguauguuugu

SEQ ID NO: 1571863 - RNA, 18 nt, Human
uaccauuauuuuuaggau

SEQ ID NO: 1571864 - RNA, 15 nt, Human
aagcccaggggccgg

SEQ ID NO: 1571865 - RNA, 22 nt, Human
guggggccaugccuccucagga

SEQ ID NO: 1571866 - RNA, 21 nt, Human
guggggccaugccuccucagg

SEQ ID NO: 1571867 - RNA, 17 nt, Human
guggccuuccccagcau

SEQ ID NO: 1571868 - RNA, 18 nt, Human
guggccuuccccagcaug

SEQ ID NO: 1571869 - RNA, 21 nt, Human
guggccuuccccagcaugcac

SEQ ID NO: 1571870 - RNA, 19 nt, Human
guggccuuccccagcaugc

SEQ ID NO: 1571871 - RNA, 14 nt, Human
guguauuucauuua

SEQ ID NO: 1571872 - RNA, 21 nt, Human
guguggggccaugccuccuca

SEQ ID NO: 1571873 - RNA, 23 nt, Human
guguggggccaugccuccucagg

SEQ ID NO: 1571874 - RNA, 11 nt, Human
aaauuguguua

SEQ ID NO: 1571875 - RNA, 24 nt, Human
gugaggguccugcagccugcagga

SEQ ID NO: 1571876 - RNA, 23 nt, Human
gugaggguccugcagccugcagg

SEQ ID NO: 1571877 - RNA, 14 nt, Human
gugaggguccugca

SEQ ID NO: 1571878 - RNA, 15 nt, Human
gugaggguccugcag

SEQ ID NO: 1571879 - RNA, 18 nt, Human
gugccaccccgagggcug

SEQ ID NO: 1571880 - RNA, 19 nt, Human
caagagucgcugugccaca

SEQ ID NO: 1571881 - RNA, 22 nt, Human
caagagucgcugugccacaggc

SEQ ID NO: 1571882 - RNA, 15 nt, Human
uuaagcaaguuaagu

SEQ ID NO: 1571883 - RNA, 21 nt, Human
uuaagagguugauuauaaagu

SEQ ID NO: 1571884 - RNA, 13 nt, Human
uuaaauauuuagu

SEQ ID NO: 1571885 - RNA, 21 nt, Human
uguccuccgccuuaccaggag

SEQ ID NO: 1571886 - RNA, 17 nt, Human
ugcuaaaggagcaucua

SEQ ID NO: 1571887 - RNA, 16 nt, Human
ugcgucgguccuggug

SEQ ID NO: 1571888 - RNA, 18 nt, Human
uccuccgccuuaccagga

SEQ ID NO: 1571889 - RNA, 18 nt, Human
ucccacgagggugccgug

SEQ ID NO: 1571890 - RNA, 18 nt, Human
uccagcaaaucaagcuga

SEQ ID NO: 1571891 - RNA, 20 nt, Human
uacagcuccuuugaaaacuc

SEQ ID NO: 1571892 - RNA, 14 nt, Human
uacagcuccuuuga

SEQ ID NO: 1571893 - RNA, 18 nt, Human
uaagucauucauaaaccu

SEQ ID NO: 1571894 - RNA, 22 nt, Human
uaagugguucuuugguuccagu

SEQ ID NO: 1571895 - RNA, 15 nt, Human
uaaaguuaguaaaga

SEQ ID NO: 1571896 - RNA, 21 nt, Human
uaaagaaaaguuuaccaucug

SEQ ID NO: 1571897 - RNA, 20 nt, Human
guuacauauuauauguucua

SEQ ID NO: 1571898 - RNA, 18 nt, Human
guguccccugacagggcc

SEQ ID NO: 1571899 - RNA, 23 nt, Human
guguuacuagccucaaaauacau

SEQ ID NO: 1571900 - RNA, 18 nt, Human
guggugaccccaggaggg

SEQ ID NO: 1571901 - RNA, 16 nt, Human
guggugaccccaggag

SEQ ID NO: 1571902 - RNA, 14 nt, Human
gugguacuugauca

SEQ ID NO: 1571903 - RNA, 21 nt, Human
gugcaguuugguguguccucc

SEQ ID NO: 1571904 - RNA, 18 nt, Human
gugcggcggucccagcuc

SEQ ID NO: 1571905 - RNA, 19 nt, Human
gugcggcggucccagcucc

SEQ ID NO: 1571906 - RNA, 22 nt, Human
gugcggcggucccagcucccug

SEQ ID NO: 1571907 - RNA, 14 nt, Human
gugauauuuuucuu

SEQ ID NO: 1571908 - RNA, 15 nt, Human
gucgguccuggugcc

SEQ ID NO: 1571909 - RNA, 17 nt, Human
gucgguccuggugcccu

SEQ ID NO: 1571910 - RNA, 18 nt, Human
gucgguccuggugcccug

SEQ ID NO: 1571911 - RNA, 17 nt, Human
gucgcugugccacaggc

SEQ ID NO: 1571912 - RNA, 17 nt, Human
gucaccagacggggcug

SEQ ID NO: 1571913 - RNA, 16 nt, Human
gucaccagacggggcu

SEQ ID NO: 1571914 - RNA, 15 nt, Human
guauguuuguacuug

SEQ ID NO: 1571915 - RNA, 13 nt, Human
uuugaauaugaaa

SEQ ID NO: 1571916 - RNA, 13 nt, Human
uuuuuugauauau

SEQ ID NO: 1571917 - RNA, 15 nt, Human
uuuucuaaauuuauc

SEQ ID NO: 1571918 - RNA, 18 nt, Human
uuuuggaugguguuacau

SEQ ID NO: 1571919 - RNA, 15 nt, Human
gcgucgguccuggug

SEQ ID NO: 1571920 - RNA, 12 nt, Human
gccuccucagga

SEQ ID NO: 1571921 - RNA, 13 nt, Human
gccgaagcccagg

SEQ ID NO: 1571922 - RNA, 18 nt, Human
gccguguccccugacagg

SEQ ID NO: 1571923 - RNA, 15 nt, Human
gccaugccuccucag

SEQ ID NO: 1571924 - RNA, 14 nt, Human
gagccgaagcccag

SEQ ID NO: 1571925 - RNA, 15 nt, Human
gagccgaagcccagg

SEQ ID NO: 1571926 - RNA, 12 nt, Human
gaccccagcucu

SEQ ID NO: 1571927 - RNA, 14 nt, Human
gaccccagcucugc

SEQ ID NO: 1571928 - RNA, 20 nt, Human
gacaugggugaacuuacuug

SEQ ID NO: 1571929 - RNA, 20 nt, Human
gaaauuacuaauuuuacuuc

SEQ ID NO: 1571930 - RNA, 20 nt, Human
gaaauuuccuaauuuauucu

SEQ ID NO: 1571931 - RNA, 19 nt, Human
gaaauuacuaauuuuacuu

SEQ ID NO: 1571932 - RNA, 14 nt, Human
cuggucccacgagg

SEQ ID NO: 1571933 - RNA, 17 nt, Human
cuggucccacgagggug

SEQ ID NO: 1571934 - RNA, 19 nt, Human
cuggucccacgagggugcc

SEQ ID NO: 1571935 - RNA, 12 nt, Human
cugagccugguc

SEQ ID NO: 1571936 - RNA, 17 nt, Human
cugacagggccagugca

SEQ ID NO: 1571937 - RNA, 12 nt, Human
cugacagggcca

SEQ ID NO: 1571938 - RNA, 15 nt, Human
cgugccaccccgagg

SEQ ID NO: 1571939 - RNA, 22 nt, Human
cgugccaccccgagggcugagc

SEQ ID NO: 1571940 - RNA, 19 nt, Human
cgugccaccccgagggcug

SEQ ID NO: 1571941 - RNA, 13 nt, Human
cgguccuggugcc

SEQ ID NO: 1571942 - RNA, 13 nt, Human
cggucccagcucc

SEQ ID NO: 1571943 - RNA, 12 nt, Human
cggucccagcuc

SEQ ID NO: 1571944 - RNA, 22 nt, Human
cggccaguggccuuccccagca

SEQ ID NO: 1571945 - RNA, 18 nt, Human
caguggccuuccccagca

SEQ ID NO: 1571946 - RNA, 17 nt, Human
caguggccuuccccagc

SEQ ID NO: 1571947 - RNA, 19 nt, Human
caguggccuuccccagcau

SEQ ID NO: 1571948 - RNA, 19 nt, Human
cauagaaaacacuacagug

SEQ ID NO: 1571949 - RNA, 15 nt, Human
caugccuccucagga

SEQ ID NO: 1571950 - RNA, 17 nt, Human
ccagugcuuuauguugu

SEQ ID NO: 1571951 - RNA, 22 nt, Human
ccagcucugcgucgguccuggu

SEQ ID NO: 1571952 - RNA, 11 nt, Human
cccagcucugc

SEQ ID NO: 1571953 - RNA, 12 nt, Human
cccagcucugcg

SEQ ID NO: 1571954 - RNA, 17 nt, Human
cccacgagggugccgug

SEQ ID NO: 1571955 - RNA, 16 nt, Human
ccaugccuccucagga

SEQ ID NO: 1571956 - RNA, 15 nt, Human
ccaugccuccucagg

SEQ ID NO: 1571957 - RNA, 21 nt, Human
agggacaggaccccagcucug

SEQ ID NO: 1571958 - RNA, 20 nt, Human
agggacaggaccccagcucu

SEQ ID NO: 1571959 - RNA, 13 nt, Human
agcaucuaucaga

SEQ ID NO: 1571960 - RNA, 19 nt, Human
accacgggcccggguuggg

SEQ ID NO: 1571961 - RNA, 15 nt, Human
aagagucgcugugcc

SEQ ID NO: 1571962 - RNA, 22 nt, Human
aagagucgcugugccacaggcu

SEQ ID NO: 1571963 - RNA, 21 nt, Human
cucgugccaccccgagggcug

SEQ ID NO: 1571964 - RNA, 14 nt, Human
cuaagucauucaua

SEQ ID NO: 1571965 - RNA, 12 nt, Human
ccuuccccagca

SEQ ID NO: 1571966 - RNA, 13 nt, Human
ccuuccccagcau

SEQ ID NO: 1571967 - RNA, 18 nt, Human
ccagacuugggaggaugu

SEQ ID NO: 1571968 - RNA, 15 nt, Human
ccagaucaaggaugu

SEQ ID NO: 1571969 - RNA, 15 nt, Human
ccagacggggcugga

SEQ ID NO: 1571970 - RNA, 23 nt, Human
cccagcaugcaccacgggcccgg

SEQ ID NO: 1571971 - RNA, 19 nt, Human
cccagcaugcaccacgggc

SEQ ID NO: 1571972 - RNA, 15 nt, Human
cccuggaugcccagg

SEQ ID NO: 1571973 - RNA, 16 nt, Human
cccuggaugcccagga

SEQ ID NO: 1571974 - RNA, 13 nt, Human
cccugacagggcc

SEQ ID NO: 1571975 - RNA, 16 nt, Human
cccugacagggccagu

SEQ ID NO: 1571976 - RNA, 14 nt, Human
cauuuguuguuuga

SEQ ID NO: 1571977 - RNA, 17 nt, Human
caggaccucgugccacc

SEQ ID NO: 1571978 - RNA, 12 nt, Human
caggaccccagc

SEQ ID NO: 1571979 - RNA, 13 nt, Human
caggaccccagcu

SEQ ID NO: 1571980 - RNA, 14 nt, Human
caggaccccagcuc

SEQ ID NO: 1571981 - RNA, 17 nt, Human
gccggccaguggccuuc

SEQ ID NO: 1571982 - RNA, 15 nt, Human
gccuccucaggagcc

SEQ ID NO: 1571983 - RNA, 16 nt, Human
gccaccccgagggcug

SEQ ID NO: 1571984 - RNA, 23 nt, Human
gccaccccgagggcugagccugg

SEQ ID NO: 1571985 - RNA, 17 nt, Human
gccaccccgagggcuga

SEQ ID NO: 1571986 - RNA, 12 nt, Human
ggaccccagcuc

SEQ ID NO: 1571987 - RNA, 15 nt, Human
ggaccccagcucugc

SEQ ID NO: 1571988 - RNA, 13 nt, Human
ggaccccagcucu

SEQ ID NO: 1571989 - RNA, 17 nt, Human
aaaagcuggauuuucuu

SEQ ID NO: 1571990 - RNA, 18 nt, Human
gaccucgugccaccccga

SEQ ID NO: 1571991 - RNA, 20 nt, Human
gagggcugagccugguccca

SEQ ID NO: 1571992 - RNA, 20 nt, Human
cuuauuagaaaaauauuaua

SEQ ID NO: 1571993 - RNA, 14 nt, Human
cuggaugauauuuu

SEQ ID NO: 1571994 - RNA, 16 nt, Human
cuggaugcccaggaau

SEQ ID NO: 1571995 - RNA, 13 nt, Human
cuggaugcccagg

SEQ ID NO: 1571996 - RNA, 14 nt, Human
cuggaugcccagga

SEQ ID NO: 1571997 - RNA, 15 nt, Human
cuggaugcccaggaa

SEQ ID NO: 1571998 - RNA, 11 nt, Human
cuggugcccug

SEQ ID NO: 1571999 - RNA, 12 nt, Human
cugcagccugca

SEQ ID NO: 1572000 - RNA, 14 nt, Human
cugcagccugcagg

SEQ ID NO: 1572001 - RNA, 19 nt, Human
cugcagccugcaggaccuc

SEQ ID NO: 1572002 - RNA, 15 nt, Human
cugcagccugcagga

SEQ ID NO: 1572003 - RNA, 18 nt, Human
uuuuccaaucauuugacu

SEQ ID NO: 1572004 - RNA, 21 nt, Human
uuugacacuuauagauugaaa

SEQ ID NO: 1572005 - RNA, 16 nt, Human
auuauaacucauuugu

SEQ ID NO: 1572006 - RNA, 13 nt, Human
auuauaaaguuuu

SEQ ID NO: 1572007 - RNA, 16 nt, Human
auuauaaaguuuucua

SEQ ID NO: 1572008 - RNA, 12 nt, Human
uuuuugauauau

SEQ ID NO: 1572009 - RNA, 23 nt, Human
uuuaggauguguauuucauuuau

SEQ ID NO: 1572010 - RNA, 20 nt, Human
uuuacuucuaagucauucau

SEQ ID NO: 1572011 - RNA, 12 nt, Human
ugugccacaggc

SEQ ID NO: 1572012 - RNA, 16 nt, Human
ugugccacaggcuuag

SEQ ID NO: 1572013 - RNA, 19 nt, Human
agucucaugccuugagauc

SEQ ID NO: 1572014 - RNA, 14 nt, Human
uguaguaucucaua

SEQ ID NO: 1572015 - RNA, 19 nt, Human
uggugcccuggaugcccag

SEQ ID NO: 1572016 - RNA, 18 nt, Human
aggugauauuuuucuuau

SEQ ID NO: 1572017 - RNA, 22 nt, Human
aggggugcggcggucccagcuc

SEQ ID NO: 1572018 - RNA, 20 nt, Human
aggggugcggcggucccagc

SEQ ID NO: 1572019 - RNA, 21 nt, Human
aggggugcggcggucccagcu

SEQ ID NO: 1572020 - RNA, 23 nt, Human
aggggugcggcggucccagcucc

SEQ ID NO: 1572021 - RNA, 14 nt, Human
uggggccaugccuc

SEQ ID NO: 1572022 - RNA, 19 nt, Human
uggggccaugccuccucag

SEQ ID NO: 1572023 - RNA, 21 nt, Human
uggggccaugccuccucagga

SEQ ID NO: 1572024 - RNA, 20 nt, Human
uggggccaugccuccucagg

SEQ ID NO: 1572025 - RNA, 13 nt, Human
agggaggcagggg

SEQ ID NO: 1572026 - RNA, 21 nt, Human
uggagugugaggguccugcag

SEQ ID NO: 1572027 - RNA, 16 nt, Human
aggagccgaagcccag

SEQ ID NO: 1572028 - RNA, 18 nt, Human
aggagccgaagcccaggg

SEQ ID NO: 1572029 - RNA, 15 nt, Human
agagucuccauuuaa

SEQ ID NO: 1572030 - RNA, 20 nt, Human
acuugaauaaccaucugaaa

SEQ ID NO: 1572031 - RNA, 19 nt, Human
acuugaauaaccaucugaa

SEQ ID NO: 1572032 - RNA, 15 nt, Human
acuuauagauugaaa

SEQ ID NO: 1572033 - RNA, 13 nt, Human
ucgguccuggugc

SEQ ID NO: 1572034 - RNA, 16 nt, Human
ucgguccuggugcccu

SEQ ID NO: 1572035 - RNA, 20 nt, Human
acgggcccggguugggucac

SEQ ID NO: 1572036 - RNA, 21 nt, Human
acgggcccggguugggucacc

SEQ ID NO: 1572037 - RNA, 16 nt, Human
acgggcccggguuggg

SEQ ID NO: 1572038 - RNA, 17 nt, Human
acgggcccggguugggu

SEQ ID NO: 1572039 - RNA, 19 nt, Human
accucgugccaccccgagg

SEQ ID NO: 1572040 - RNA, 23 nt, Human
accucgugccaccccgagggcug

SEQ ID NO: 1572041 - RNA, 18 nt, Human
acaguugcuguuguguga

SEQ ID NO: 1572042 - RNA, 14 nt, Human
accagacggggcug

SEQ ID NO: 1572043 - RNA, 15 nt, Human
accagacggggcugg

SEQ ID NO: 1572044 - RNA, 21 nt, Human
accagacggggcuggagugug

SEQ ID NO: 1572045 - RNA, 16 nt, Human
accagacggggcugga

SEQ ID NO: 1572046 - RNA, 12 nt, Human
accauuauuuuu

SEQ ID NO: 1572047 - RNA, 18 nt, Human
uaguuuugugaaggugau

SEQ ID NO: 1572048 - RNA, 22 nt, Human
gugccguguccccugacagggc

SEQ ID NO: 1572049 - RNA, 23 nt, Human
gugccguguccccugacagggcc

SEQ ID NO: 1572050 - RNA, 16 nt, Human
aacauuugcugucagc

SEQ ID NO: 1572051 - RNA, 17 nt, Human
caccagacggggcugga

SEQ ID NO: 1572052 - RNA, 16 nt, Human
caccagacggggcugg

SEQ ID NO: 1572053 - RNA, 14 nt, Human
uuugauauaugaaa

SEQ ID NO: 1572054 - RNA, 22 nt, Human
uuccccagcaugcaccacgggc

SEQ ID NO: 1572055 - RNA, 17 nt, Human
ugugaggguccugcagc

SEQ ID NO: 1572056 - RNA, 23 nt, Human
uguggggccaugccuccucagga

SEQ ID NO: 1572057 - RNA, 15 nt, Human
uguuguuuuuggaug

SEQ ID NO: 1572058 - RNA, 14 nt, Human
uguguaguuccagc

SEQ ID NO: 1572059 - RNA, 19 nt, Human
uggaugauauuuuuuauca

SEQ ID NO: 1572060 - RNA, 14 nt, Human
uggaugcccaggaa

SEQ ID NO: 1572061 - RNA, 13 nt, Human
uggaugcccagga

SEQ ID NO: 1572062 - RNA, 21 nt, Human
ugggucaccagacggggcugg

SEQ ID NO: 1572063 - RNA, 17 nt, Human
ugccaccccgagggcug

SEQ ID NO: 1572064 - RNA, 18 nt, Human
ugccaccccgagggcuga

SEQ ID NO: 1572065 - RNA, 12 nt, Human
uccuggugcccu

SEQ ID NO: 1572066 - RNA, 13 nt, Human
uccuggugcccug

SEQ ID NO: 1572067 - RNA, 22 nt, Human
uccuggugcccuggaugcccag

SEQ ID NO: 1572068 - RNA, 14 nt, Human
guuuucuaaauuua

SEQ ID NO: 1572069 - RNA, 16 nt, Human
uaagagguugauuaua

SEQ ID NO: 1572070 - RNA, 16 nt, Human
uacagaaauauccaug

SEQ ID NO: 1572071 - RNA, 18 nt, Human
uacuugaauaaccaucug

SEQ ID NO: 1572072 - RNA, 20 nt, Human
uacuugaauaaccaucugaa

SEQ ID NO: 1572073 - RNA, 22 nt, Human
ggggugcggcggucccagcucc

SEQ ID NO: 1572074 - RNA, 20 nt, Human
ggggugcggcggucccagcu

SEQ ID NO: 1572075 - RNA, 21 nt, Human
gggugcggcggucccagcucc

SEQ ID NO: 1572076 - RNA, 19 nt, Human
ggucaccagacggggcugg

SEQ ID NO: 1572077 - RNA, 11 nt, Human
ggcugagccug

SEQ ID NO: 1572078 - RNA, 22 nt, Human
ggagccgaagcccaggggccgg

SEQ ID NO: 1572079 - RNA, 15 nt, Human
ggagccgaagcccag

SEQ ID NO: 1572080 - RNA, 17 nt, Human
ggagccgaagcccaggg

SEQ ID NO: 1572081 - RNA, 19 nt, Human
ggagccgaagcccaggggc

SEQ ID NO: 1572082 - RNA, 13 nt, Human
ggaccucgugcca

SEQ ID NO: 1572083 - RNA, 17 nt, Human
gccgggcaggguguggg

SEQ ID NO: 1572084 - RNA, 13 nt, Human
gccugcaggaccu

SEQ ID NO: 1572085 - RNA, 17 nt, Human
gccugcaggaccucgug

SEQ ID NO: 1572086 - RNA, 18 nt, Human
gccugcaggaccucgugc

SEQ ID NO: 1572087 - RNA, 23 nt, Human
gccugcaggaccucgugccaccc

SEQ ID NO: 1572088 - RNA, 13 nt, Human
gcggucccagcuc

SEQ ID NO: 1572089 - RNA, 14 nt, Human
gcggucccagcucc

SEQ ID NO: 1572090 - RNA, 18 nt, Human
gcggucccagcucccugg

SEQ ID NO: 1572091 - RNA, 22 nt, Human
gcggucccagcucccuggcucc

SEQ ID NO: 1572092 - RNA, 15 nt, Human
gcaggaccucgugcc

SEQ ID NO: 1572093 - RNA, 16 nt, Human
gcagccugcaggaccu

SEQ ID NO: 1572094 - RNA, 13 nt, Human
gcagccugcagga

SEQ ID NO: 1572095 - RNA, 15 nt, Human
gcaccacgggcccgg

SEQ ID NO: 1572096 - RNA, 14 nt, Human
gcaugcaccacggg

SEQ ID NO: 1572097 - RNA, 15 nt, Human
gcaugcaccacgggc

SEQ ID NO: 1572098 - RNA, 19 nt, Human
gcaagcucuuuuauaugcu

SEQ ID NO: 1572099 - RNA, 16 nt, Human
gaagcccaggggccgg

SEQ ID NO: 1572100 - RNA, 19 nt, Human
gaauaaucaaauacauuuu

SEQ ID NO: 1572101 - RNA, 16 nt, Human
gaaggugauuuauucu

SEQ ID NO: 1572102 - RNA, 18 nt, Human
gacagggccagugcaguu

SEQ ID NO: 1572103 - RNA, 24 nt, Human
cuuacuugcauaccaaguugauac

SEQ ID NO: 1572104 - RNA, 15 nt, Human
cgucgguccuggugc

SEQ ID NO: 1572105 - RNA, 21 nt, Human
cgggcaggguguggggccaug

SEQ ID NO: 1572106 - RNA, 16 nt, Human
ccugaagaacuauuuu

SEQ ID NO: 1572107 - RNA, 13 nt, Human
ccgagggcugagc

SEQ ID NO: 1572108 - RNA, 16 nt, Human
ccgagggcugagccug

SEQ ID NO: 1572109 - RNA, 22 nt, Human
ccgagggcugagccugguccca

SEQ ID NO: 1572110 - RNA, 18 nt, Human
ccccaggagggaggcagg

SEQ ID NO: 1572111 - RNA, 19 nt, Human
ccccaggagggaggcaggg

SEQ ID NO: 1572112 - RNA, 9 nt, Human
cccagcucc

SEQ ID NO: 1572113 - RNA, 16 nt, Human
cccaggugauauuuuu

SEQ ID NO: 1572114 - RNA, 12 nt, Human
cccaggggccgg

SEQ ID NO: 1572115 - RNA, 15 nt, Human
ccacaggcuuaggga

SEQ ID NO: 1572116 - RNA, 18 nt, Human
ccacaggcuuagggacag

SEQ ID NO: 1572117 - RNA, 19 nt, Human
ccacaggcuuagggacagg

SEQ ID NO: 1572118 - RNA, 21 nt, Human
ccacaggcuuagggacaggac

SEQ ID NO: 1572119 - RNA, 20 nt, Human
ccuuuuuuugauauaugaaa

SEQ ID NO: 1572120 - RNA, 17 nt, Human
cccagcaugcaccacgg

SEQ ID NO: 1572121 - RNA, 19 nt, Human
cuugaauaaccaucugaaa

SEQ ID NO: 1572122 - RNA, 21 nt, Human
ccucaggagccgaagcccagg

SEQ ID NO: 1572123 - RNA, 17 nt, Human
ccaaauuaguacagaaa

SEQ ID NO: 1572124 - RNA, 21 nt, Human adenovirus E
ccucaggcggcagugguggcg

SEQ ID NO: 1572125 - RNA, 11 nt, Human adenovirus E
ggugugccccg

SEQ ID NO: 1572126 - RNA, 19 nt, Human adenovirus E
aacgugcagaccaaccugg

SEQ ID NO: 1572127 - RNA, 21 nt, Human adenovirus E
agcggcucgacuccguggccu

SEQ ID NO: 1572128 - RNA, 17 nt, Human adenovirus E
ccaagaagaggcagcag

SEQ ID NO: 1572129 - RNA, 13 nt, Human adenovirus E
cacagacugaacg

SEQ ID NO: 1572130 - RNA, 14 nt, Human adenovirus E
acccggacgugcag

SEQ ID NO: 1572131 - RNA, 17 nt, Human adenovirus E
uuagcgcucuaguuuuu

SEQ ID NO: 1572132 - RNA, 14 nt, Human adenovirus E
ucgacgccaucagc

SEQ ID NO: 1572133 - RNA, 17 nt, Human adenovirus E
aucguggugcaggagcg

SEQ ID NO: 1572134 - RNA, 19 nt, Human adenovirus E
accugugggaccugcugga

SEQ ID NO: 1572135 - RNA, 15 nt, Human adenovirus E
cggagcacccccgcc

SEQ ID NO: 1572136 - RNA, 19 nt, Human adenovirus E
augguguacuaugccuucu

SEQ ID NO: 1572137 - RNA, 15 nt, Human adenovirus E
acagcugaggauugu

SEQ ID NO: 1572138 - RNA, 14 nt, Human adenovirus E
acgcacuaccacca

SEQ ID NO: 1572139 - RNA, 18 nt, Human adenovirus E
gucuccacguuccacaca

SEQ ID NO: 1572140 - RNA, 21 nt, Human adenovirus E
ggucgaguuggaaggcgacaa

SEQ ID NO: 1572141 - RNA, 16 nt, Human adenovirus E
ccacagccggcgcuuc

SEQ ID NO: 1572142 - RNA, 13 nt, Human adenovirus E
ccacaccacagcu

SEQ ID NO: 1572143 - RNA, 17 nt, Human adenovirus E
cgggguuucuucuuggg

SEQ ID NO: 1572144 - RNA, 23 nt, Human adenovirus E
ccagcaccaggcaggccacgggg

SEQ ID NO: 1572145 - RNA, 14 nt, Human adenovirus E
uuggcauuguuuuu

SEQ ID NO: 1572146 - RNA, 20 nt, Human adenovirus E
ucauccuggccguguugcuc

SEQ ID NO: 1572147 - RNA, 13 nt, Human adenovirus E
ugccugcgccgcu

SEQ ID NO: 1572148 - RNA, 14 nt, Human adenovirus E
agggacucccucag

SEQ ID NO: 1572149 - RNA, 18 nt, Human adenovirus E
ugagguacaugggcauga

SEQ ID NO: 1572150 - RNA, 14 nt, Human adenovirus E
aauuuuuaagaaaa

SEQ ID NO: 1572151 - RNA, 15 nt, Human adenovirus E
ggcagugguggcggg

SEQ ID NO: 1572152 - RNA, 16 nt, Human adenovirus E
uggaagaagcagccgc

SEQ ID NO: 1572153 - RNA, 23 nt, Human adenovirus E
cgcaugcggaucucgcucagguc

SEQ ID NO: 1572154 - RNA, 19 nt, Human adenovirus E
aguucgccccccggcggcg

SEQ ID NO: 1572155 - RNA, 13 nt, Human adenovirus E
cugcggcgcggcc

SEQ ID NO: 1572156 - RNA, 20 nt, Human adenovirus E
uagcuuuauuaaagauguga

SEQ ID NO: 1572157 - RNA, 19 nt, Human adenovirus E
gccgagacgaugggcaggc

SEQ ID NO: 1572158 - RNA, 20 nt, Human adenovirus E
gagcuccucguaggugagcu

SEQ ID NO: 1572159 - RNA, 12 nt, Human adenovirus E
uucgaccccguc

SEQ ID NO: 1572160 - RNA, 14 nt, Human adenovirus E
aggacgccgaggcu

SEQ ID NO: 1572161 - RNA, 17 nt, Human adenovirus E
agcaccaggcaggccac

SEQ ID NO: 1572162 - RNA, 20 nt, Human adenovirus E
caggagcggcgaggagcccg

SEQ ID NO: 1572163 - RNA, 14 nt, Human adenovirus E
acggcuccccgcgc

SEQ ID NO: 1572164 - RNA, 13 nt, Human adenovirus E
ccccauagccagc

SEQ ID NO: 1572165 - RNA, 21 nt, Human adenovirus E
  misc_feature (7)..(7): n is a, c, g or u
ccaaccnuacuuuuuccaccc

SEQ ID NO: 1572166 - RNA, 22 nt, Human adenovirus E
gaccuggugaacauucugcaga

SEQ ID NO: 1572167 - RNA, 22 nt, Human adenovirus E
uggaagacguaugcgcaggagc

SEQ ID NO: 1572168 - RNA, 14 nt, Human adenovirus E
gggcgugccccagg

SEQ ID NO: 1572169 - RNA, 16 nt, Human adenovirus E
caacaucuccuucacc

SEQ ID NO: 1572170 - RNA, 16 nt, Human adenovirus E
aggugacccugggccu

SEQ ID NO: 1572171 - RNA, 16 nt, Human adenovirus E
cgaggaggaggcagag

SEQ ID NO: 1572172 - RNA, 15 nt, Human adenovirus E
cagcugcaccacgcu

SEQ ID NO: 1572173 - RNA, 17 nt, Human adenovirus E
ggcgcugcagagccagc

SEQ ID NO: 1572174 - RNA, 19 nt, Human adenovirus E
ucgagggucuccuggauga

SEQ ID NO: 1572175 - RNA, 14 nt, Human adenovirus E
aggagauggaggaa

SEQ ID NO: 1572176 - RNA, 22 nt, Human adenovirus E
gcggagacccugcgcaaggucg

SEQ ID NO: 1572177 - RNA, 18 nt, Human adenovirus E
caagaacagccagagcag

SEQ ID NO: 1572178 - RNA, 18 nt, Human adenovirus E
agggggcgauccuggccc

SEQ ID NO: 1572179 - RNA, 20 nt, Human adenovirus E
ucgagagccacaccacagcu

SEQ ID NO: 1572180 - RNA, 13 nt, Human adenovirus E
cggacuuccgugu

SEQ ID NO: 1572181 - RNA, 20 nt, Human adenovirus E
guagcuccauugcagggccu

SEQ ID NO: 1572182 - RNA, 15 nt, Human adenovirus E
cggcggcggcgaugc

SEQ ID NO: 1572183 - RNA, 14 nt, Human adenovirus E
aggcguggaacagc

SEQ ID NO: 1572184 - RNA, 15 nt, Human adenovirus E
ggcccggcaggccac

SEQ ID NO: 1572185 - RNA, 19 nt, Human adenovirus E
accacagggccagcaccgc

SEQ ID NO: 1572186 - RNA, 17 nt, Human adenovirus E
ccgcuacaacagcacca

SEQ ID NO: 1572187 - RNA, 13 nt, Human adenovirus E
cucccagagcugg

SEQ ID NO: 1572188 - RNA, 16 nt, Human adenovirus E
gcgucgccggcggcgc

SEQ ID NO: 1572189 - RNA, 21 nt, Human adenovirus E
cgcuguccacgagcgccagcu

SEQ ID NO: 1572190 - RNA, 12 nt, Human adenovirus E
aagccacccuga

SEQ ID NO: 1572191 - RNA, 15 nt, Human adenovirus E
gaugaggcgugcgua

SEQ ID NO: 1572192 - RNA, 16 nt, Human adenovirus E
cucacuaccaauaaca

SEQ ID NO: 1572193 - RNA, 22 nt, Human adenovirus E
agcgaaccccgcagaacagggc

SEQ ID NO: 1572194 - RNA, 23 nt, Human adenovirus E
gagcgccucggccgcguggccuu

SEQ ID NO: 1572195 - RNA, 15 nt, Human adenovirus E
gcugacguccugcag

SEQ ID NO: 1572196 - RNA, 17 nt, Human adenovirus E
agcugauggugcccaag

SEQ ID NO: 1572197 - RNA, 13 nt, Human adenovirus E
acaccuggcagac

SEQ ID NO: 1572198 - RNA, 16 nt, Human adenovirus E
uauguuggagcaacau

SEQ ID NO: 1572199 - RNA, 19 nt, Human adenovirus E
gcccgguuccacgcggggc

SEQ ID NO: 1572200 - RNA, 17 nt, Human adenovirus E
gaagaucgcggagaugg

SEQ ID NO: 1572201 - RNA, 20 nt, Human adenovirus E
gaucaucgccuugugcaugg

SEQ ID NO: 1572202 - RNA, 16 nt, Human adenovirus E
ggcagcccagccgccg

SEQ ID NO: 1572203 - RNA, 18 nt, Human adenovirus E
cgaccucauuuuccccga

SEQ ID NO: 1572204 - RNA, 17 nt, Human adenovirus E
gagcgugaugcagcagg

SEQ ID NO: 1572205 - RNA, 21 nt, Human adenovirus E
ccgugcggugagcgccagcag

SEQ ID NO: 1572206 - RNA, 17 nt, Human adenovirus E
cggccuuguaggcgcag

SEQ ID NO: 1572207 - RNA, 18 nt, Human adenovirus E
aucuccaacguggagcug

SEQ ID NO: 1572208 - RNA, 22 nt, Human adenovirus E
caggccgucuacucgcagcagc

SEQ ID NO: 1572209 - RNA, 14 nt, Human adenovirus E
cagcccuuccagga

SEQ ID NO: 1572210 - RNA, 19 nt, Human adenovirus E
cagaacgugcugcacacca

SEQ ID NO: 1572211 - RNA, 22 nt, Human adenovirus E
gccgggguucuacacgggcgag

SEQ ID NO: 1572212 - RNA, 14 nt, Human adenovirus E
accgcucccuggcc

SEQ ID NO: 1572213 - RNA, 16 nt, Human adenovirus E
ucacccgccccgcccc

SEQ ID NO: 1572214 - RNA, 17 nt, Human adenovirus E
cgccgaacacucgugcu

SEQ ID NO: 1572215 - RNA, 23 nt, Human adenovirus E
augugaauguuacugaggggggc

SEQ ID NO: 1572216 - RNA, 14 nt, Human adenovirus E
ccgcggugcuccuc

SEQ ID NO: 1572217 - RNA, 22 nt, Human adenovirus E
acccagccagaugaugcaauuu

SEQ ID NO: 1572218 - RNA, 19 nt, Human adenovirus E
cguaagcagugcucaggug

SEQ ID NO: 1572219 - RNA, 18 nt, Human adenovirus E
cgccagcuccuccucggc

SEQ ID NO: 1572220 - RNA, 19 nt, Human adenovirus E
ugcccuucaucaacccccc

SEQ ID NO: 1572221 - RNA, 21 nt, Human adenovirus E
cccugcgguggugaaggagga

SEQ ID NO: 1572222 - RNA, 24 nt, Human adenovirus E
cgcaccgaggugccccucagcgug

SEQ ID NO: 1572223 - RNA, 22 nt, Human adenovirus E
cuaugagaaaagcaaggaggau

SEQ ID NO: 1572224 - RNA, 23 nt, Human adenovirus E
gccccgcagcagucgcugccgcc

SEQ ID NO: 1572225 - RNA, 23 nt, Human adenovirus E
gcggcgcgagcugagcgaccagg

SEQ ID NO: 1572226 - RNA, 19 nt, Human adenovirus E
cucagucucaaguccagca

SEQ ID NO: 1572227 - RNA, 17 nt, Human adenovirus E
aggcguccgcgccgcag

SEQ ID NO: 1572228 - RNA, 21 nt, Human adenovirus E
ccucggcguuggccaucccga

SEQ ID NO: 1572229 - RNA, 18 nt, Human adenovirus E
ccugaacgccugcugggc

SEQ ID NO: 1572230 - RNA, 14 nt, Human adenovirus E
acgagcagcuggcc

SEQ ID NO: 1572231 - RNA, 12 nt, Human adenovirus E
cguaggugagcu

SEQ ID NO: 1572232 - RNA, 22 nt, Human adenovirus E
ccauccuggaggccguggugcc

SEQ ID NO: 1572233 - RNA, 20 nt, Human adenovirus E
cucgaccgcaccgaggugcc

SEQ ID NO: 1572234 - RNA, 16 nt, Human adenovirus E
ccaccguggugcagaa

SEQ ID NO: 1572235 - RNA, 12 nt, Human adenovirus E
cacaggcagcaa

SEQ ID NO: 1572236 - RNA, 23 nt, Human adenovirus E
acauggaauacaccacccucucc

SEQ ID NO: 1572237 - RNA, 13 nt, Human adenovirus E
cacacgcccagca

SEQ ID NO: 1572238 - RNA, 15 nt, Human adenovirus E
caacuccuccuccag

SEQ ID NO: 1572239 - RNA, 16 nt, Human adenovirus E
ggcacgacaggcagcg

SEQ ID NO: 1572240 - RNA, 15 nt, Human adenovirus E
agucgguccacagcu

SEQ ID NO: 1572241 - RNA, 15 nt, Human adenovirus E
cucaggcagaggagg

SEQ ID NO: 1572242 - RNA, 18 nt, Human adenovirus E
cauggagacucagccauc

SEQ ID NO: 1572243 - RNA, 20 nt, Human adenovirus E
guccacugucgagagccaca

SEQ ID NO: 1572244 - RNA, 20 nt, Human adenovirus E
cuccaagucugugccacccu

SEQ ID NO: 1572245 - RNA, 19 nt, Human adenovirus E
gugugccgcgguccuccuc

SEQ ID NO: 1572246 - RNA, 16 nt, Human adenovirus E
cugggaccccgugacc

SEQ ID NO: 1572247 - RNA, 18 nt, Human adenovirus E
cccgcgccgacgcccuuu

SEQ ID NO: 1572248 - RNA, 23 nt, Human adenovirus E
gaacuccauggcuugcagggucc

SEQ ID NO: 1572249 - RNA, 18 nt, Human adenovirus E
gugcagcagaagcguggg

SEQ ID NO: 1572250 - RNA, 20 nt, Human adenovirus E
gaggaucgcggcgaacgagc

SEQ ID NO: 1572251 - RNA, 21 nt, Human adenovirus E
gcacucccgcaucugcaccuc

SEQ ID NO: 1572252 - RNA, 13 nt, Human adenovirus E
uauuuuuccucca

SEQ ID NO: 1572253 - RNA, 15 nt, Human adenovirus E
uccagcgcagccagg

SEQ ID NO: 1572254 - RNA, 18 nt, Human adenovirus E
gaucccgaauaccacagc

SEQ ID NO: 1572255 - RNA, 13 nt, Human adenovirus E
cucuuccucuucu

SEQ ID NO: 1572256 - RNA, 18 nt, Human adenovirus E
accgucaccuccacagcc

SEQ ID NO: 1572257 - RNA, 23 nt, Human adenovirus E
ccgaaggcaacuucucggugacc

SEQ ID NO: 1572258 - RNA, 14 nt, Human adenovirus E
cagcacucaggcag

SEQ ID NO: 1572259 - RNA, 23 nt, Human adenovirus E
cgguggugucgcaucaggccccg

SEQ ID NO: 1572260 - RNA, 21 nt, Human adenovirus E
cucgggucggucagggagaug

SEQ ID NO: 1572261 - RNA, 14 nt, Human adenovirus E
cugcugcugcuggu

SEQ ID NO: 1572262 - RNA, 14 nt, Human adenovirus E
cuagaacagucagc

SEQ ID NO: 1572263 - RNA, 14 nt, Human adenovirus E
cggcgaggagcccg

SEQ ID NO: 1572264 - RNA, 21 nt, Human adenovirus E
cacaccaacaugcccaacgug

SEQ ID NO: 1572265 - RNA, 20 nt, Human adenovirus E
caggagcgcgggcugccgcu

SEQ ID NO: 1572266 - RNA, 13 nt, Human adenovirus E
gcccggcgagcgc

SEQ ID NO: 1572267 - RNA, 17 nt, Human adenovirus E
uagacagauggaagaca

SEQ ID NO: 1572268 - RNA, 19 nt, Human adenovirus E
ugguccuggugaccgugga

SEQ ID NO: 1572269 - RNA, 17 nt, Human adenovirus E
aggcggucccagagcuc

SEQ ID NO: 1572270 - RNA, 15 nt, Human adenovirus E
ucuucuuccuccucc

SEQ ID NO: 1572271 - RNA, 13 nt, Human adenovirus E
cacacacacagau

SEQ ID NO: 1572272 - RNA, 16 nt, Human adenovirus E
aggcggcggcaggacc

SEQ ID NO: 1572273 - RNA, 16 nt, Human adenovirus E
ggccauccuggaggcc

SEQ ID NO: 1572274 - RNA, 19 nt, Human adenovirus E
cguccucgcuguccuggcu

SEQ ID NO: 1572275 - RNA, 17 nt, Human adenovirus E
aggagcuuggcgaugga

SEQ ID NO: 1572276 - RNA, 18 nt, Human adenovirus E
accacagcaacuuccuga

SEQ ID NO: 1572277 - RNA, 23 nt, Human adenovirus E
aggcacuacaaugcucagucuca

SEQ ID NO: 1572278 - RNA, 20 nt, Human adenovirus E
gcccgguuccacgcggggcg

SEQ ID NO: 1572279 - RNA, 9 nt, Human adenovirus E
ccagcagca

SEQ ID NO: 1572280 - RNA, 13 nt, Human adenovirus E
gcaccggagcacc

SEQ ID NO: 1572281 - RNA, 17 nt, Human adenovirus E
uguuccugguggugcag

SEQ ID NO: 1572282 - RNA, 14 nt, Human adenovirus E
cggucggggaccgc

SEQ ID NO: 1572283 - RNA, 16 nt, Human adenovirus E
cuuccauucggggaag

SEQ ID NO: 1572284 - RNA, 23 nt, Human adenovirus E
cugaaucuaauacuaccacccac

SEQ ID NO: 1572285 - RNA, 16 nt, Human adenovirus E
cgcaaucaggcagcac

SEQ ID NO: 1572286 - RNA, 17 nt, Human adenovirus E
gggugacaaagagcugu

SEQ ID NO: 1572287 - RNA, 22 nt, Human adenovirus E
guggccaccucgccgcgcaggg

SEQ ID NO: 1572288 - RNA, 22 nt, Human adenovirus E
gguguugcuuucgauuguggga

SEQ ID NO: 1572289 - RNA, 20 nt, Human adenovirus E
cccacggcccucagcaucag

SEQ ID NO: 1572290 - RNA, 23 nt, Human adenovirus E
ugcugaaaaagggccgcgggguc

SEQ ID NO: 1572291 - RNA, 19 nt, Human adenovirus E
ccccagaugggccuggccg

SEQ ID NO: 1572292 - RNA, 20 nt, Human adenovirus E
caaccacgugcgcacccuga

SEQ ID NO: 1572293 - RNA, 19 nt, Human adenovirus E
cgagcagcuggcccggugg

SEQ ID NO: 1572294 - RNA, 15 nt, Human adenovirus E
aucccagcuggauca

SEQ ID NO: 1572295 - RNA, 18 nt, Human adenovirus E
cgagagcgugaugcagca

SEQ ID NO: 1572296 - RNA, 22 nt, Human adenovirus E
gaaugagcagagucaggcuggg

SEQ ID NO: 1572297 - RNA, 12 nt, Human adenovirus E
auuacacagaca

SEQ ID NO: 1572298 - RNA, 16 nt, Human adenovirus E
uccugcacaggcagca

SEQ ID NO: 1572299 - RNA, 16 nt, Human adenovirus E
ccggcggcgcacgggc

SEQ ID NO: 1572300 - RNA, 13 nt, Human adenovirus E
accacuacagccu

SEQ ID NO: 1572301 - RNA, 14 nt, Human adenovirus E
gagggucuccugga

SEQ ID NO: 1572302 - RNA, 12 nt, Human adenovirus E
uuaccucugcuc

SEQ ID NO: 1572303 - RNA, 22 nt, Human adenovirus E
cgcgcgccgggcggcaggggcg

SEQ ID NO: 1572304 - RNA, 23 nt, Human adenovirus E
cgagguguaccaguccgggccgg

SEQ ID NO: 1572305 - RNA, 21 nt, Human adenovirus E
caaggccgagcugucggccug

SEQ ID NO: 1572306 - RNA, 21 nt, Human adenovirus E
cgaguugaaccucuucucgcc

SEQ ID NO: 1572307 - RNA, 22 nt, Human adenovirus E
caucauaguugugguccugggu

SEQ ID NO: 1572308 - RNA, 15 nt, Human adenovirus E
ggcguacaugccgca

SEQ ID NO: 1572309 - RNA, 16 nt, Human adenovirus E
uagaaagccuggugga

SEQ ID NO: 1572310 - RNA, 14 nt, Human adenovirus E
gcacuaccucuuca

SEQ ID NO: 1572311 - RNA, 14 nt, Human adenovirus E
ccugcaugccaacc

SEQ ID NO: 1572312 - RNA, 16 nt, Human adenovirus E
uggcagacgggcaugg

SEQ ID NO: 1572313 - RNA, 13 nt, Human adenovirus E
ucuccccccgcac

SEQ ID NO: 1572314 - RNA, 21 nt, Human adenovirus E
gagcuugggggcgaggaagac

SEQ ID NO: 1572315 - RNA, 19 nt, Human adenovirus E
guacaggagccauaauggc

SEQ ID NO: 1572316 - RNA, 14 nt, Human adenovirus E
caggaacugaaagu

SEQ ID NO: 1572317 - RNA, 18 nt, Human adenovirus E
cgucaaggaugcgcugcu

SEQ ID NO: 1572318 - RNA, 12 nt, Human adenovirus E
gccgcccaggac

SEQ ID NO: 1572319 - RNA, 22 nt, Human adenovirus E
guggcagcggccgaggcggcug

SEQ ID NO: 1572320 - RNA, 22 nt, Human adenovirus E
gcccccgcgguaccuggcgccu

SEQ ID NO: 1572321 - RNA, 13 nt, Human adenovirus E
uuccuccacccuc

SEQ ID NO: 1572322 - RNA, 13 nt, Human adenovirus E
aucagcgccccgc

SEQ ID NO: 1572323 - RNA, 15 nt, Human adenovirus E
cugaacgggggcgcc

SEQ ID NO: 1572324 - RNA, 16 nt, Human adenovirus E
gcugcugguggccccc

SEQ ID NO: 1572325 - RNA, 17 nt, Human adenovirus E
agggcgaaagugucccu

SEQ ID NO: 1572326 - RNA, 17 nt, Human adenovirus E
aaugcaaauuccaagaa

SEQ ID NO: 1572327 - RNA, 20 nt, Human adenovirus E
gcaaggaggaugcagcagcu

SEQ ID NO: 1572328 - RNA, 12 nt, Human adenovirus E
cugcccuggaga

SEQ ID NO: 1572329 - RNA, 12 nt, Human adenovirus E
ggggcgggggag

SEQ ID NO: 1572330 - RNA, 17 nt, Human adenovirus E
caggaaauuccccagcc

SEQ ID NO: 1572331 - RNA, 16 nt, Human adenovirus E
gaggagcuggcagugc

SEQ ID NO: 1572332 - RNA, 18 nt, Human adenovirus E
accacaauuacucacacc

SEQ ID NO: 1572333 - RNA, 15 nt, Human adenovirus E
cagcguggaggagcu

SEQ ID NO: 1572334 - RNA, 17 nt, Human adenovirus E
cagcaguuugggcagcg

SEQ ID NO: 1572335 - RNA, 20 nt, Human adenovirus E
ugagccgcgcccugggccag

SEQ ID NO: 1572336 - RNA, 13 nt, Human adenovirus E
ucaugcccgccuc

SEQ ID NO: 1572337 - RNA, 13 nt, Human adenovirus E
ccagcgcgugacc

SEQ ID NO: 1572338 - RNA, 16 nt, Human adenovirus E
acccaacauacuuuua

SEQ ID NO: 1572339 - RNA, 15 nt, Human adenovirus E
acgcucugcaaggag

SEQ ID NO: 1572340 - RNA, 18 nt, Human adenovirus E
gccagaucguccagggca

SEQ ID NO: 1572341 - RNA, 20 nt, Human adenovirus E
ggccucgacucccaccugcu

SEQ ID NO: 1572342 - RNA, 20 nt, Human adenovirus E
gaccaccguggugcagaaca

SEQ ID NO: 1572343 - RNA, 23 nt, Human adenovirus E
cgcgaggccaucggccaggcgca

SEQ ID NO: 1572344 - RNA, 20 nt, Human adenovirus E
auacucaccaaggccauggc

SEQ ID NO: 1572345 - RNA, 19 nt, Human adenovirus E
cagcagagucgggggcagg

SEQ ID NO: 1572346 - RNA, 20 nt, Human adenovirus E
cuccagugccuucucuagca

SEQ ID NO: 1572347 - RNA, 20 nt, Human adenovirus E
gacaugcuuuuggucuccac

SEQ ID NO: 1572348 - RNA, 19 nt, Human adenovirus E
aaugagcagagucaggcug

SEQ ID NO: 1572349 - RNA, 23 nt, Human adenovirus E
agcccgaggucaaggugcggccc

SEQ ID NO: 1572350 - RNA, 19 nt, Human adenovirus E
uccugcguuacgugcagca

SEQ ID NO: 1572351 - RNA, 22 nt, Human adenovirus E
caggagaugcaauugaaagcaa

SEQ ID NO: 1572352 - RNA, 14 nt, Human adenovirus E
agaaagcaagcagc

SEQ ID NO: 1572353 - RNA, 13 nt, Human adenovirus E
uccacccaccaca

SEQ ID NO: 1572354 - RNA, 20 nt, Human adenovirus E
cagcguggaggagcucagcc

SEQ ID NO: 1572355 - RNA, 17 nt, Human adenovirus E
ugcggggggagaugagg

SEQ ID NO: 1572356 - RNA, 18 nt, Human adenovirus E
gagagacguucccggugg

SEQ ID NO: 1572357 - RNA, 19 nt, Human adenovirus E
gcaggggcggcaggggcac

SEQ ID NO: 1572358 - RNA, 19 nt, Human adenovirus E
cucgagugccacugccgcu

SEQ ID NO: 1572359 - RNA, 16 nt, Human adenovirus E
uagagcuugggggcga

SEQ ID NO: 1572360 - RNA, 22 nt, Human adenovirus E
ccuggcgccuacggaggggcgg

SEQ ID NO: 1572361 - RNA, 22 nt, Human adenovirus E
cgggccuuggaggcggcggcag

SEQ ID NO: 1572362 - RNA, 16 nt, Human adenovirus E
ugagcgaccaggagcu

SEQ ID NO: 1572363 - RNA, 20 nt, Human adenovirus E
ggcgcgagcgggucggagag

SEQ ID NO: 1572364 - RNA, 14 nt, Human adenovirus E
gccgcaccgcuccc

SEQ ID NO: 1572365 - RNA, 17 nt, Human adenovirus E
cuccgcggccggccauu

SEQ ID NO: 1572366 - RNA, 22 nt, Human adenovirus E
ggccugguguacaacgcgcugc

SEQ ID NO: 1572367 - RNA, 14 nt, Human adenovirus E
cgucaccugcggcg

SEQ ID NO: 1572368 - RNA, 12 nt, Human adenovirus E
cggucagggaga

SEQ ID NO: 1572369 - RNA, 16 nt, Human adenovirus E
cugcgcaacggccugc

SEQ ID NO: 1572370 - RNA, 15 nt, Human adenovirus E
ccacggcccucagca

SEQ ID NO: 1572371 - RNA, 13 nt, Human adenovirus E
cgcgcccugggcc

SEQ ID NO: 1572372 - RNA, 18 nt, Human adenovirus E
gccgagacgaugggcagg

SEQ ID NO: 1572373 - RNA, 18 nt, Human adenovirus E
cgcuccggaauccugccc

SEQ ID NO: 1572374 - RNA, 14 nt, Human adenovirus E
cacagaaccaccag

SEQ ID NO: 1572375 - RNA, 15 nt, Human adenovirus E
gcccccgcuggaggc

SEQ ID NO: 1572376 - RNA, 13 nt, Human adenovirus E
gccguggcccagc

SEQ ID NO: 1572377 - RNA, 13 nt, Human adenovirus E
agcuggagugccu

SEQ ID NO: 1572378 - RNA, 21 nt, Human adenovirus E
ugcuacagaaagcacagacug

SEQ ID NO: 1572379 - RNA, 16 nt, Human adenovirus E
agcuugcccucggccu

SEQ ID NO: 1572380 - RNA, 17 nt, Human adenovirus E
ggcgaguaccuggaaga

SEQ ID NO: 1572381 - RNA, 18 nt, Human adenovirus E
gcgcuguccggccgcgag

SEQ ID NO: 1572382 - RNA, 20 nt, Human adenovirus E
acguggccgcggccaaccug

SEQ ID NO: 1572383 - RNA, 20 nt, Human adenovirus E
caauaucacgaaaucauaug

SEQ ID NO: 1572384 - RNA, 19 nt, Human adenovirus E
gaacagcagucaggcagag

SEQ ID NO: 1572385 - RNA, 21 nt, Human adenovirus E
gucccccguugggcagggaga

SEQ ID NO: 1572386 - RNA, 15 nt, Human adenovirus E
cagcaaccugcuggg

SEQ ID NO: 1572387 - RNA, 16 nt, Human adenovirus E
uacacaugaucagcgg

SEQ ID NO: 1572388 - RNA, 17 nt, Human adenovirus E
ugggugcgcgacgccgc

SEQ ID NO: 1572389 - RNA, 16 nt, Human adenovirus E
uccaagaccccauagc

SEQ ID NO: 1572390 - RNA, 21 nt, Human adenovirus E
gcccacuuagcauuaccacac

SEQ ID NO: 1572391 - RNA, 22 nt, Human adenovirus E
gcucgcgcagagcgcccuccac

SEQ ID NO: 1572392 - RNA, 15 nt, Human adenovirus E
gucgccgcaccgccg

SEQ ID NO: 1572393 - RNA, 15 nt, Human adenovirus E
uccuagaacagucag

SEQ ID NO: 1572394 - RNA, 21 nt, Human adenovirus E
aaccugacacaccaccacagc

SEQ ID NO: 1572395 - RNA, 21 nt, Human adenovirus E
ugaagcacaaaauucucaggu

SEQ ID NO: 1572396 - RNA, 17 nt, Human adenovirus E
agcgggggggaggacgc

SEQ ID NO: 1572397 - RNA, 20 nt, Human adenovirus E
aaaagcgcccgaggaagcaa

SEQ ID NO: 1572398 - RNA, 15 nt, Human adenovirus E
ugcuaguccccagag

SEQ ID NO: 1572399 - RNA, 23 nt, Human adenovirus E
  misc_feature (7)..(7): n is a, c, g or u
cagaagnuggaagacgugcugga

SEQ ID NO: 1572400 - RNA, 16 nt, Human adenovirus E
caguacgugcaacaca

SEQ ID NO: 1572401 - RNA, 15 nt, Human adenovirus E
acaggcagcaaagcc

SEQ ID NO: 1572402 - RNA, 15 nt, Human adenovirus E
cccgucucucagcca

SEQ ID NO: 1572403 - RNA, 16 nt, Human adenovirus E
aagccagccaugauaa

SEQ ID NO: 1572404 - RNA, 20 nt, Human adenovirus E
auggcaugcgaguuggagga

SEQ ID NO: 1572405 - RNA, 16 nt, Human adenovirus E
gaagucugcccgcagg

SEQ ID NO: 1572406 - RNA, 20 nt, Human adenovirus E
cgcuguugagacccgagcgg

SEQ ID NO: 1572407 - RNA, 18 nt, Human adenovirus E
gaggugacccugggccug

SEQ ID NO: 1572408 - RNA, 14 nt, Human adenovirus E
agaacagccagagc

SEQ ID NO: 1572409 - RNA, 20 nt, Human adenovirus E
ucuccaccauuaaauauacu

SEQ ID NO: 1572410 - RNA, 13 nt, Human adenovirus E
caucaggccccgc

SEQ ID NO: 1572411 - RNA, 15 nt, Human adenovirus E
cucgcacuccacgag

SEQ ID NO: 1572412 - RNA, 17 nt, Human adenovirus E
cugaaacacaaaauaaa

SEQ ID NO: 1572413 - RNA, 20 nt, Human adenovirus E
gugcgcuucuuguaggcggg

SEQ ID NO: 1572414 - RNA, 17 nt, Human adenovirus E
ucauguacgccagcaac

SEQ ID NO: 1572415 - RNA, 17 nt, Human adenovirus E
gaguccaaccugggauc

SEQ ID NO: 1572416 - RNA, 21 nt, Human adenovirus E
cgucuggugcggcgggcgcag

SEQ ID NO: 1572417 - RNA, 23 nt, Human adenovirus E
cagcgccccgcauccccaaauuc

SEQ ID NO: 1572418 - RNA, 19 nt, Human adenovirus E
gcgccgcagugggcgcaga

SEQ ID NO: 1572419 - RNA, 22 nt, Human adenovirus E
gccugcaagaucuccaacgugg

SEQ ID NO: 1572420 - RNA, 13 nt, Human adenovirus E
ccgccccgccgcc

SEQ ID NO: 1572421 - RNA, 21 nt, Human adenovirus E
gggauggguaagcgcggaggc

SEQ ID NO: 1572422 - RNA, 13 nt, Human adenovirus E
ugacccugggccu

SEQ ID NO: 1572423 - RNA, 15 nt, Human adenovirus E
cagcaaggcguggaa

SEQ ID NO: 1572424 - RNA, 21 nt, Human adenovirus E
ggcaggccacggggucuccgg

SEQ ID NO: 1572425 - RNA, 16 nt, Human adenovirus E
caagagauggaggaau

SEQ ID NO: 1572426 - RNA, 11 nt, Human adenovirus E
ggcggcggcgc

SEQ ID NO: 1572427 - RNA, 22 nt, Human adenovirus E
gagcucugcaagcuccugcaga

SEQ ID NO: 1572428 - RNA, 21 nt, Human adenovirus E
cucgccaucugcccccaccgc

SEQ ID NO: 1572429 - RNA, 14 nt, Human adenovirus E
uaaguacucuuuca

SEQ ID NO: 1572430 - RNA, 22 nt, Human adenovirus E
ggcgcaaguacggcgcggccag

SEQ ID NO: 1572431 - RNA, 14 nt, Human adenovirus E
uagagccucgggaa

SEQ ID NO: 1572432 - RNA, 18 nt, Human adenovirus E
cagcacucaggcagagga

SEQ ID NO: 1572433 - RNA, 16 nt, Human adenovirus E
gcacaaaauucucagg

SEQ ID NO: 1572434 - RNA, 20 nt, Human adenovirus E
gccucuguuaaauuuuugcu

SEQ ID NO: 1572435 - RNA, 13 nt, Human adenovirus E
ccgcugaacgaag

SEQ ID NO: 1572436 - RNA, 14 nt, Human adenovirus E
gccaggugaggucg

SEQ ID NO: 1572437 - RNA, 17 nt, Human adenovirus E
aauaauacuuucauuuu

SEQ ID NO: 1572438 - RNA, 17 nt, Human adenovirus E
cgcgcccugggccagga

SEQ ID NO: 1572439 - RNA, 22 nt, Human adenovirus E
cgacccccggucccccacccag

SEQ ID NO: 1572440 - RNA, 20 nt, Human adenovirus E
cucgaucaugugcuccuucu

SEQ ID NO: 1572441 - RNA, 12 nt, Human adenovirus E
agcagaaggggg

SEQ ID NO: 1572442 - RNA, 18 nt, Human adenovirus E
ggucucccgcaagacccc

SEQ ID NO: 1572443 - RNA, 19 nt, Human adenovirus E
gaacagccagagcaggaag

SEQ ID NO: 1572444 - RNA, 20 nt, Human adenovirus E
gggggccacgagccggggca

SEQ ID NO: 1572445 - RNA, 17 nt, Human adenovirus E
cagcgcccugcgccuga

SEQ ID NO: 1572446 - RNA, 20 nt, Human adenovirus E
ccuggcuccgcgacacggca

SEQ ID NO: 1572447 - RNA, 21 nt, Human adenovirus E
agcuccaguguaagccccaca

SEQ ID NO: 1572448 - RNA, 16 nt, Human adenovirus E
ggccaacgccagucca

SEQ ID NO: 1572449 - RNA, 15 nt, Human adenovirus E
cgaaguccuccccag

SEQ ID NO: 1572450 - RNA, 17 nt, Human adenovirus E
cauggaccaggugcuca

SEQ ID NO: 1572451 - RNA, 14 nt, Human adenovirus E
cccauagccagccg

SEQ ID NO: 1572452 - RNA, 15 nt, Human adenovirus E
gguuccaccgcgagu

SEQ ID NO: 1572453 - RNA, 23 nt, Human adenovirus E
cgucuggugcggcgggcgcagca

SEQ ID NO: 1572454 - RNA, 14 nt, Human adenovirus E
cguggccuggaggc

SEQ ID NO: 1572455 - RNA, 15 nt, Human adenovirus E
cgauacgggugaugg

SEQ ID NO: 1572456 - RNA, 18 nt, Human adenovirus E
aucguggugcaggagcgc

SEQ ID NO: 1572457 - RNA, 22 nt, Human adenovirus E
gacgacccgggcaaccuggaag

SEQ ID NO: 1572458 - RNA, 15 nt, Human adenovirus E
gggcagggagagggc

SEQ ID NO: 1572459 - RNA, 15 nt, Human adenovirus E
cacaccaccacagca

SEQ ID NO: 1572460 - RNA, 14 nt, Human adenovirus E
ucaaggacaaagug

SEQ ID NO: 1572461 - RNA, 15 nt, Human adenovirus E
cccggccacuacccg

SEQ ID NO: 1572462 - RNA, 15 nt, Human adenovirus E
cagggauaggagcuc

SEQ ID NO: 1572463 - RNA, 16 nt, Human adenovirus E
ccccgccaugcgcgcg

SEQ ID NO: 1572464 - RNA, 23 nt, Human adenovirus E
gcaccucggcccgguuguugaug

SEQ ID NO: 1572465 - RNA, 19 nt, Human adenovirus E
cucgcugaacuaccagaac

SEQ ID NO: 1572466 - RNA, 15 nt, Human adenovirus E
acggcccucagcauc

SEQ ID NO: 1572467 - RNA, 21 nt, Human adenovirus E
caagaaugaacacuguauccc

SEQ ID NO: 1572468 - RNA, 15 nt, Human adenovirus E
acggucgagcugacc

SEQ ID NO: 1572469 - RNA, 16 nt, Human adenovirus E
cauuacacagacaacc

SEQ ID NO: 1572470 - RNA, 13 nt, Human adenovirus E
ucaggcagcaccg

SEQ ID NO: 1572471 - RNA, 20 nt, Human adenovirus E
cccaugaucaagcccagcac

SEQ ID NO: 1572472 - RNA, 19 nt, Human adenovirus E
gguuagaguuuggaagcag

SEQ ID NO: 1572473 - RNA, 13 nt, Human adenovirus E
cucaccaaggcca

SEQ ID NO: 1572474 - RNA, 19 nt, Human adenovirus E
cgagugccacugccgcugc

SEQ ID NO: 1572475 - RNA, 18 nt, Human adenovirus E
ggccgucuacucgcagca

SEQ ID NO: 1572476 - RNA, 11 nt, Human adenovirus E
acccagccaga

SEQ ID NO: 1572477 - RNA, 15 nt, Human adenovirus E
aaguccagcaaagcg

SEQ ID NO: 1572478 - RNA, 12 nt, Human adenovirus E
aauaccacagcg

SEQ ID NO: 1572479 - RNA, 19 nt, Human adenovirus E
aucaugccugauggcucug

SEQ ID NO: 1572480 - RNA, 13 nt, Human adenovirus E
gucaggccguccu

SEQ ID NO: 1572481 - RNA, 23 nt, Human adenovirus E
cugcuggaggccaucgugcagaa

SEQ ID NO: 1572482 - RNA, 23 nt, Human adenovirus E
cgcggcuucaggcgccagcgccg

SEQ ID NO: 1572483 - RNA, 22 nt, Human adenovirus E
gacgccuuugugcccgcccagg

SEQ ID NO: 1572484 - RNA, 16 nt, Human adenovirus E
cugacggcgcagcugu

SEQ ID NO: 1572485 - RNA, 19 nt, Human adenovirus E
gaccgagcuccagcuccag

SEQ ID NO: 1572486 - RNA, 22 nt, Human adenovirus E
cucggacgauuggacccaggcc

SEQ ID NO: 1572487 - RNA, 19 nt, Human adenovirus E
cgugaucgaggacgucagc

SEQ ID NO: 1572488 - RNA, 21 nt, Human adenovirus E
cagcugggacuugccgcagcc

SEQ ID NO: 1572489 - RNA, 23 nt, Human adenovirus E
gcggccagccugcugaugcccaa

SEQ ID NO: 1572490 - RNA, 13 nt, Human adenovirus E
ggcgagggccugc

SEQ ID NO: 1572491 - RNA, 13 nt, Human adenovirus E
agugucuggagga

SEQ ID NO: 1572492 - RNA, 18 nt, Human adenovirus E
gguucauguugugcagga

SEQ ID NO: 1572493 - RNA, 23 nt, Human adenovirus E
ccgugcggugagcgccagcaggc

SEQ ID NO: 1572494 - RNA, 19 nt, Human adenovirus E
gggucuaccucgaccccca

SEQ ID NO: 1572495 - RNA, 14 nt, Human adenovirus E
acauaaagcuuacc

SEQ ID NO: 1572496 - RNA, 17 nt, Human adenovirus E
gccgccgggccuuggag

SEQ ID NO: 1572497 - RNA, 21 nt, Human adenovirus E
ucucaguuuuuccaacaacac

SEQ ID NO: 1572498 - RNA, 16 nt, Human adenovirus E
ggcgacgagcucggcg

SEQ ID NO: 1572499 - RNA, 12 nt, Human adenovirus E
gcucgccacauc

SEQ ID NO: 1572500 - RNA, 15 nt, Human adenovirus E
cgaggugccccucag

SEQ ID NO: 1572501 - RNA, 23 nt, Human adenovirus E
cugggcauucgcaagaggcagcc

SEQ ID NO: 1572502 - RNA, 15 nt, Human adenovirus E
ccacaccacagcuac

SEQ ID NO: 1572503 - RNA, 15 nt, Human adenovirus E
ugaaacccuccgggc

SEQ ID NO: 1572504 - RNA, 14 nt, Human adenovirus E
guggagccacugcu

SEQ ID NO: 1572505 - RNA, 21 nt, Human adenovirus E
gcgagcugagcgaccaggagc

SEQ ID NO: 1572506 - RNA, 22 nt, Human adenovirus E
cugcaggugguaguugagggag

SEQ ID NO: 1572507 - RNA, 20 nt, Human adenovirus E
gagcgcucgcgguggggcgg

SEQ ID NO: 1572508 - RNA, 19 nt, Human adenovirus E
cccgucuccugccgcgcca

SEQ ID NO: 1572509 - RNA, 19 nt, Human adenovirus E
aucugggccuggucggcgu

SEQ ID NO: 1572510 - RNA, 21 nt, Human adenovirus E
ggaggccagcacccagaccau

SEQ ID NO: 1572511 - RNA, 16 nt, Human adenovirus E
uggcgggcggcgccac

SEQ ID NO: 1572512 - RNA, 18 nt, Human adenovirus E
gugauccggggcagaagc

SEQ ID NO: 1572513 - RNA, 13 nt, Human adenovirus E
cugacccugagcg

SEQ ID NO: 1572514 - RNA, 18 nt, Human adenovirus E
gccgcggcggugcccgag

SEQ ID NO: 1572515 - RNA, 14 nt, Human adenovirus E
cauucuacacuaaa

SEQ ID NO: 1572516 - RNA, 15 nt, Human adenovirus E
ccucgacccccagac

SEQ ID NO: 1572517 - RNA, 22 nt, Human adenovirus E
cagcugcgcgccuucaccucgc

SEQ ID NO: 1572518 - RNA, 14 nt, Human adenovirus E
gucugccugcuuau

SEQ ID NO: 1572519 - RNA, 11 nt, Human adenovirus E
accguggagcu

SEQ ID NO: 1572520 - RNA, 19 nt, Human adenovirus E
acgcgcccgcgcuugcugg

SEQ ID NO: 1572521 - RNA, 22 nt, Human adenovirus E
ggcgggggagaugagcugggcc

SEQ ID NO: 1572522 - RNA, 15 nt, Human adenovirus E
aacuuuuaauccaaa

SEQ ID NO: 1572523 - RNA, 19 nt, Human adenovirus E
cgaggaggaggcagaggag

SEQ ID NO: 1572524 - RNA, 20 nt, Human adenovirus E
aacccaccccacccagugag

SEQ ID NO: 1572525 - RNA, 21 nt, Human adenovirus E
cagcgcacucucgaggacgcc

SEQ ID NO: 1572526 - RNA, 21 nt, Human adenovirus E
ggccugcgucgccggcggcgc

SEQ ID NO: 1572527 - RNA, 22 nt, Human adenovirus E
guuccgcaccgaaggaagaggc

SEQ ID NO: 1572528 - RNA, 16 nt, Human adenovirus E
ugauuuaccccugcuu

SEQ ID NO: 1572529 - RNA, 13 nt, Human adenovirus E
ugauccuccacca

SEQ ID NO: 1572530 - RNA, 15 nt, Human adenovirus E
acugaaagucaagaa

SEQ ID NO: 1572531 - RNA, 17 nt, Human adenovirus E
ucagccaaucagcgccc

SEQ ID NO: 1572532 - RNA, 17 nt, Human adenovirus E
caucguggugcaggagc

SEQ ID NO: 1572533 - RNA, 23 nt, Human adenovirus E
agcggugugccgcgguccuccuc

SEQ ID NO: 1572534 - RNA, 23 nt, Human adenovirus E
cuugcgcaaguucgugcccgagg

SEQ ID NO: 1572535 - RNA, 17 nt, Human adenovirus E
cugcacgccgcaccgcu

SEQ ID NO: 1572536 - RNA, 16 nt, Human adenovirus E
cccugaaagugcugac

SEQ ID NO: 1572537 - RNA, 19 nt, Human adenovirus E
ucgccgcgcgugcccccca

SEQ ID NO: 1572538 - RNA, 13 nt, Human adenovirus E
caacaaaugccag

SEQ ID NO: 1572539 - RNA, 12 nt, Human adenovirus E
gcacggauacca

SEQ ID NO: 1572540 - RNA, 23 nt, Human adenovirus E
caagcagaaccuguucagagaca

SEQ ID NO: 1572541 - RNA, 13 nt, Human adenovirus E
ugucaugaugcag

SEQ ID NO: 1572542 - RNA, 13 nt, Human adenovirus E
gccgcggccgccg

SEQ ID NO: 1572543 - RNA, 16 nt, Human adenovirus E
gucuggugcggcgggc

SEQ ID NO: 1572544 - RNA, 18 nt, Human adenovirus E
guggcggugcaggccucu

SEQ ID NO: 1572545 - RNA, 21 nt, Human adenovirus E
gcuccugguucaccugcagca

SEQ ID NO: 1572546 - RNA, 18 nt, Human adenovirus E
caaggccauggcgaccag

SEQ ID NO: 1572547 - RNA, 17 nt, Human adenovirus E
gggccagacccagccag

SEQ ID NO: 1572548 - RNA, 14 nt, Human adenovirus E
agccuuuagacagc

SEQ ID NO: 1572549 - RNA, 20 nt, Human adenovirus E
cuccugguccugugaugugu

SEQ ID NO: 1572550 - RNA, 13 nt, Human adenovirus E
caucuccaacacg

SEQ ID NO: 1572551 - RNA, 23 nt, Human adenovirus E
gcuccugcagaagaacucaaggg

SEQ ID NO: 1572552 - RNA, 13 nt, Human adenovirus E
ccgcgcccaccga

SEQ ID NO: 1572553 - RNA, 14 nt, Human adenovirus E
augguacugaucug

SEQ ID NO: 1572554 - RNA, 22 nt, Human adenovirus E
cuaucucuuccucuucuugguc

SEQ ID NO: 1572555 - RNA, 17 nt, Human adenovirus E
ucauccucgaacgcucc

SEQ ID NO: 1572556 - RNA, 17 nt, Human adenovirus E
ggcgcuaaucaccgcua

SEQ ID NO: 1572557 - RNA, 20 nt, Human adenovirus E
cgguguucuuuuaacagaac

SEQ ID NO: 1572558 - RNA, 12 nt, Human adenovirus E
cccggcggcgcg

SEQ ID NO: 1572559 - RNA, 17 nt, Human adenovirus E
gagcagaccuaccagga

SEQ ID NO: 1572560 - RNA, 23 nt, Human adenovirus E
acgcacuaccaccacuacagccu

SEQ ID NO: 1572561 - RNA, 19 nt, Human adenovirus E
ugcagaaccccaccagcaa

SEQ ID NO: 1572562 - RNA, 15 nt, Human adenovirus E
cgccagacgccgcac

SEQ ID NO: 1572563 - RNA, 13 nt, Human adenovirus E
ggcuugcagaccg

SEQ ID NO: 1572564 - RNA, 12 nt, Human adenovirus E
cuacaagacccc

SEQ ID NO: 1572565 - RNA, 22 nt, Human adenovirus E
caccgcaacaacagcccccucc

SEQ ID NO: 1572566 - RNA, 20 nt, Human adenovirus E
uccagauaacuggacagaaa

SEQ ID NO: 1572567 - RNA, 16 nt, Human adenovirus E
gagacccgagcgggag

SEQ ID NO: 1572568 - RNA, 16 nt, Human adenovirus E
gcggccuugcgcaggg

SEQ ID NO: 1572569 - RNA, 14 nt, Human adenovirus E
acugcuaccugcug

SEQ ID NO: 1572570 - RNA, 16 nt, Human adenovirus E
gagaacagcagucagg

SEQ ID NO: 1572571 - RNA, 20 nt, Human adenovirus E
gccaacgugccccggggcca

SEQ ID NO: 1572572 - RNA, 22 nt, Human adenovirus E
ggugcaggagcgcgggcugccg

SEQ ID NO: 1572573 - RNA, 20 nt, Human adenovirus E
gcccggcgagcgcuccggca

SEQ ID NO: 1572574 - RNA, 19 nt, Human adenovirus E
augguagaauucaaggaca

SEQ ID NO: 1572575 - RNA, 17 nt, Human adenovirus E
gcuaguaccaaugagca

SEQ ID NO: 1572576 - RNA, 20 nt, Human adenovirus E
cggcagcggccaucgccagc

SEQ ID NO: 1572577 - RNA, 19 nt, Human adenovirus E
agcugagcgaccaggagcu

SEQ ID NO: 1572578 - RNA, 12 nt, Human adenovirus E
cagcaucaucug

SEQ ID NO: 1572579 - RNA, 20 nt, Human adenovirus E
gcuaccgccaaaaaucagac

SEQ ID NO: 1572580 - RNA, 13 nt, Human adenovirus E
ugacggugccggc

SEQ ID NO: 1572581 - RNA, 16 nt, Human adenovirus E
gaacuuuuugcugacc

SEQ ID NO: 1572582 - RNA, 16 nt, Human adenovirus E
cagaguuuggaagagc

SEQ ID NO: 1572583 - RNA, 22 nt, Human adenovirus E
ggcucgacuccguggccuggag

SEQ ID NO: 1572584 - RNA, 22 nt, Human adenovirus E
gcugcuggagcgcguggcccgc

SEQ ID NO: 1572585 - RNA, 23 nt, Human adenovirus E
cucaggggguccggguccaggga

SEQ ID NO: 1572586 - RNA, 15 nt, Human adenovirus E
cgccaguccagacug

SEQ ID NO: 1572587 - RNA, 16 nt, Human adenovirus E
gccgcuggcuccugga

SEQ ID NO: 1572588 - RNA, 17 nt, Human adenovirus E
cacagcgcccuggucga

SEQ ID NO: 1572589 - RNA, 15 nt, Human adenovirus E
acgaagcccugcagg

SEQ ID NO: 1572590 - RNA, 19 nt, Human adenovirus E
caucgcuauucgccccaga

SEQ ID NO: 1572591 - RNA, 20 nt, Human adenovirus E
uccagagauccacggccagg

SEQ ID NO: 1572592 - RNA, 21 nt, Human adenovirus E
guuacugacgccagacgccgc

SEQ ID NO: 1572593 - RNA, 20 nt, Human adenovirus E
cggccgucccagacaugcaa

SEQ ID NO: 1572594 - RNA, 16 nt, Human adenovirus E
gaagcaacugcagccg

SEQ ID NO: 1572595 - RNA, 19 nt, Human adenovirus E
ucaacaauagcacucaacc

SEQ ID NO: 1572596 - RNA, 22 nt, Human adenovirus E
cugcgccgcuucuucgccgacg

SEQ ID NO: 1572597 - RNA, 15 nt, Human adenovirus E
gcagagucaggcugg

SEQ ID NO: 1572598 - RNA, 20 nt, Human adenovirus E
gacccagccagaugaugcaa

SEQ ID NO: 1572599 - RNA, 12 nt, Human adenovirus E
ccccgugccagc

SEQ ID NO: 1572600 - RNA, 12 nt, Human adenovirus E
aggagcgcgggc

SEQ ID NO: 1572601 - RNA, 14 nt, Human adenovirus E
gcgcgucggccagg

SEQ ID NO: 1572602 - RNA, 16 nt, Human adenovirus E
gcccugggccaggacg

SEQ ID NO: 1572603 - RNA, 17 nt, Human adenovirus E
ccacagggccagcaccg

SEQ ID NO: 1572604 - RNA, 23 nt, Human adenovirus E
cuggcuguuccagggcuccccga

SEQ ID NO: 1572605 - RNA, 13 nt, Human adenovirus E
caggcagcaaagc

SEQ ID NO: 1572606 - RNA, 21 nt, Human adenovirus E
aaucaucugcauguucauuuu

SEQ ID NO: 1572607 - RNA, 17 nt, Human adenovirus E
ggugggguagcagcgcc

SEQ ID NO: 1572608 - RNA, 15 nt, Human adenovirus E
gacguagaggggcuc

SEQ ID NO: 1572609 - RNA, 15 nt, Human adenovirus E
ggucuucgcggugcc

SEQ ID NO: 1572610 - RNA, 14 nt, Human adenovirus E
cuugcagguccaag

SEQ ID NO: 1572611 - RNA, 17 nt, Human adenovirus E
cgcugcgcccccagcgg

SEQ ID NO: 1572612 - RNA, 19 nt, Human adenovirus E
uggcaccucucgcccccgc

SEQ ID NO: 1572613 - RNA, 20 nt, Human adenovirus E
guguacaacgcgcugcugga

SEQ ID NO: 1572614 - RNA, 17 nt, Human adenovirus E
ccaggcggucccagagc

SEQ ID NO: 1572615 - RNA, 17 nt, Human adenovirus E
gccagcacccagaccau

SEQ ID NO: 1572616 - RNA, 14 nt, Human adenovirus E
gagcagaccuacca

SEQ ID NO: 1572617 - RNA, 23 nt, Human adenovirus E
caugguguacuaugccuucugcu

SEQ ID NO: 1572618 - RNA, 15 nt, Human adenovirus E
gucugugccacccuc

SEQ ID NO: 1572619 - RNA, 13 nt, Human adenovirus E
cgaagaccccggc

SEQ ID NO: 1572620 - RNA, 21 nt, Human adenovirus E
caccacagcgcccuggucgag

SEQ ID NO: 1572621 - RNA, 18 nt, Human adenovirus E
cgcgcucccuggggcgcc

SEQ ID NO: 1572622 - RNA, 17 nt, Human adenovirus E
agucgaagaccccggcg

SEQ ID NO: 1572623 - RNA, 16 nt, Human adenovirus E
acagcaccacagggca

SEQ ID NO: 1572624 - RNA, 23 nt, Human adenovirus E
cucgcgguggggcggccagcuga

SEQ ID NO: 1572625 - RNA, 19 nt, Human adenovirus E
uccgcgacacggcacgcgg

SEQ ID NO: 1572626 - RNA, 12 nt, Human adenovirus E
gucgggggcagg

SEQ ID NO: 1572627 - RNA, 12 nt, Human adenovirus E
cccaggacaugg

SEQ ID NO: 1572628 - RNA, 16 nt, Human adenovirus E
gcaggggcgcagggca

SEQ ID NO: 1572629 - RNA, 15 nt, Human adenovirus E
ccacuacuaucucuu

SEQ ID NO: 1572630 - RNA, 15 nt, Human adenovirus E
uggcgcgugaagacc

SEQ ID NO: 1572631 - RNA, 14 nt, Human adenovirus E
gcggucauggacca

SEQ ID NO: 1572632 - RNA, 15 nt, Human adenovirus E
uccuuugacgaggaa

SEQ ID NO: 1572633 - RNA, 17 nt, Human adenovirus E
cguugcggugugccccg

SEQ ID NO: 1572634 - RNA, 13 nt, Human adenovirus E
gcccccaccgccg

SEQ ID NO: 1572635 - RNA, 14 nt, Human adenovirus E
gcaucccagcugga

SEQ ID NO: 1572636 - RNA, 21 nt, Human adenovirus E
gcggcgaacgagccggcgcaa

SEQ ID NO: 1572637 - RNA, 16 nt, Human adenovirus E
gugcgacugggcuuuu

SEQ ID NO: 1572638 - RNA, 13 nt, Human adenovirus E
agcaugaagggga

SEQ ID NO: 1572639 - RNA, 18 nt, Human adenovirus E
acuuugagcugcccgagg

SEQ ID NO: 1572640 - RNA, 15 nt, Human adenovirus E
agcaaagcccccgau

SEQ ID NO: 1572641 - RNA, 19 nt, Human adenovirus E
ggagaugacugacccacug

SEQ ID NO: 1572642 - RNA, 15 nt, Human adenovirus E
cugacgucgcccagc

SEQ ID NO: 1572643 - RNA, 18 nt, Human adenovirus E
cacucaggcagaggagga

SEQ ID NO: 1572644 - RNA, 12 nt, Human adenovirus E
gcucuccacguc

SEQ ID NO: 1572645 - RNA, 21 nt, Human adenovirus E
ugcucgagugccacugccgcu

SEQ ID NO: 1572646 - RNA, 18 nt, Human adenovirus E
ccaacaaaugccagcuga

SEQ ID NO: 1572647 - RNA, 16 nt, Human adenovirus E
cagcagucaggcagag

SEQ ID NO: 1572648 - RNA, 15 nt, Human adenovirus E
accccauagccagcc

SEQ ID NO: 1572649 - RNA, 17 nt, Human adenovirus E
agcuccagcuccagugu

SEQ ID NO: 1572650 - RNA, 16 nt, Human adenovirus E
agcuggaucaugauca

SEQ ID NO: 1572651 - RNA, 16 nt, Human adenovirus E
aaagcuccgcuugccg

SEQ ID NO: 1572652 - RNA, 18 nt, Human adenovirus E
cugggacagcacucaggc

SEQ ID NO: 1572653 - RNA, 13 nt, Human adenovirus E
gccaucggcuccu

SEQ ID NO: 1572654 - RNA, 17 nt, Human adenovirus E
aacuggugcuugaaguc

SEQ ID NO: 1572655 - RNA, 19 nt, Human adenovirus E
ccgcagcagcgagcugggc

SEQ ID NO: 1572656 - RNA, 17 nt, Human adenovirus E
cucggcgaugguggcgc

SEQ ID NO: 1572657 - RNA, 22 nt, Human adenovirus E
cagucucaaguccagcaaagcg

SEQ ID NO: 1572658 - RNA, 12 nt, Human adenovirus E
uagacagcagcc

SEQ ID NO: 1572659 - RNA, 24 nt, Human adenovirus E
acugucuuccggaucgcuguccac

SEQ ID NO: 1572660 - RNA, 20 nt, Human adenovirus E
gcuccugguucaccugcagc

SEQ ID NO: 1572661 - RNA, 17 nt, Human adenovirus E
cucuugcaggacagcga

SEQ ID NO: 1572662 - RNA, 13 nt, Human adenovirus E
ggcaucagcugga

SEQ ID NO: 1572663 - RNA, 17 nt, Human adenovirus E
gcggcgacgaggccggc

SEQ ID NO: 1572664 - RNA, 18 nt, Human adenovirus E
ugugguagucaaauacug

SEQ ID NO: 1572665 - RNA, 20 nt, Human adenovirus E
uggacucugacgcuccuggu

SEQ ID NO: 1572666 - RNA, 16 nt, Human adenovirus E
uggggcgugcaggccc

SEQ ID NO: 1572667 - RNA, 13 nt, Human adenovirus E
gaggaagacuggg

SEQ ID NO: 1572668 - RNA, 14 nt, Human adenovirus E
acggggugcuggag

SEQ ID NO: 1572669 - RNA, 13 nt, Human adenovirus E
cgcagggcauggu

SEQ ID NO: 1572670 - RNA, 12 nt, Human adenovirus E
gacccacugcug

SEQ ID NO: 1572671 - RNA, 20 nt, Human adenovirus E
cagaugugggacgaugagga

SEQ ID NO: 1572672 - RNA, 13 nt, Human adenovirus E
gcaugcaauggca

SEQ ID NO: 1572673 - RNA, 16 nt, Human adenovirus E
agguuguucaacaguc

SEQ ID NO: 1572674 - RNA, 19 nt, Human adenovirus E
cucagcgccgggcccgcga

SEQ ID NO: 1572675 - RNA, 17 nt, Human adenovirus E
caaagcauguugcaaaa

SEQ ID NO: 1572676 - RNA, 15 nt, Human adenovirus E
aaugucauuuucaua

SEQ ID NO: 1572677 - RNA, 23 nt, Human adenovirus E
ucccaagaucuucgagggucugg

SEQ ID NO: 1572678 - RNA, 18 nt, Human adenovirus E
cgugccccggggccagga

SEQ ID NO: 1572679 - RNA, 17 nt, Human adenovirus E
ugcaggagcgcgggcug

SEQ ID NO: 1572680 - RNA, 18 nt, Human adenovirus E
augcuuacccaauccaag

SEQ ID NO: 1572681 - RNA, 17 nt, Human adenovirus E
ccgcacccgcgccgacg

SEQ ID NO: 1572682 - RNA, 19 nt, Human adenovirus E
cugacgccagacgccgcac

SEQ ID NO: 1572683 - RNA, 19 nt, Human adenovirus E
aagcccccgaucccuccag

SEQ ID NO: 1572684 - RNA, 16 nt, Human adenovirus E
cuggccaucgugaacg

SEQ ID NO: 1572685 - RNA, 21 nt, Human adenovirus E
acuucaaccccuucuccggcu

SEQ ID NO: 1572686 - RNA, 20 nt, Human adenovirus E
ggcucucggccauccuggag

SEQ ID NO: 1572687 - RNA, 15 nt, Human adenovirus E
ggcgguggggcggca

SEQ ID NO: 1572688 - RNA, 20 nt, Human adenovirus E
cuuagcuuugacaguacagg

SEQ ID NO: 1572689 - RNA, 17 nt, Human adenovirus E
accuggcagacgggcau

SEQ ID NO: 1572690 - RNA, 18 nt, Human adenovirus E
gaagcagagaaugagcag

SEQ ID NO: 1572691 - RNA, 20 nt, Human adenovirus E
uggggcaguuucuugagcuc

SEQ ID NO: 1572692 - RNA, 13 nt, Human adenovirus E
gacgacagcagcg

SEQ ID NO: 1572693 - RNA, 16 nt, Human adenovirus E
cuuuaccgacaaaaau

SEQ ID NO: 1572694 - RNA, 15 nt, Human adenovirus E
cgacucccaccugcu

SEQ ID NO: 1572695 - RNA, 15 nt, Human adenovirus E
aggucaaccaaccuc

SEQ ID NO: 1572696 - RNA, 18 nt, Human adenovirus E
ugcaggggcggcaggggc

SEQ ID NO: 1572697 - RNA, 15 nt, Human adenovirus E
gucuggaggagcaga

SEQ ID NO: 1572698 - RNA, 12 nt, Human adenovirus E
gcggaacagcau

SEQ ID NO: 1572699 - RNA, 17 nt, Human adenovirus E
acuaccucuucaggcac

SEQ ID NO: 1572700 - RNA, 20 nt, Human adenovirus E
gacaaaaaucagacccacug

SEQ ID NO: 1572701 - RNA, 16 nt, Human adenovirus E
augaccaucgaccuga

SEQ ID NO: 1572702 - RNA, 23 nt, Human adenovirus E
cagcucaacgacgaaguggugag

SEQ ID NO: 1572703 - RNA, 13 nt, Human adenovirus E
ggccgaccucauu

SEQ ID NO: 1572704 - RNA, 22 nt, Human adenovirus E
cuuuuggucuccacguuccaca

SEQ ID NO: 1572705 - RNA, 20 nt, Human adenovirus E
cgugagguaaauccaagcca

SEQ ID NO: 1572706 - RNA, 15 nt, Human adenovirus E
ugcagcucacuacca

SEQ ID NO: 1572707 - RNA, 22 nt, Human adenovirus E
accucccgguaccacaucaccc

SEQ ID NO: 1572708 - RNA, 17 nt, Human adenovirus E
gugcuguguugcugguu

SEQ ID NO: 1572709 - RNA, 12 nt, Human adenovirus E
ccaggugguggc

SEQ ID NO: 1572710 - RNA, 14 nt, Human adenovirus E
gcgcggccagccug

SEQ ID NO: 1572711 - RNA, 17 nt, Human adenovirus E
uccacuaacaucucuuc

SEQ ID NO: 1572712 - RNA, 12 nt, Human adenovirus E
guuguuggccag

SEQ ID NO: 1572713 - RNA, 18 nt, Human adenovirus E
gcgcgccgggcggcaggg

SEQ ID NO: 1572714 - RNA, 14 nt, Human adenovirus E
gaccuaccaggaga

SEQ ID NO: 1572715 - RNA, 23 nt, Human adenovirus E
caggcagaggaggaggagaugga

SEQ ID NO: 1572716 - RNA, 14 nt, Human adenovirus E
agccacaguacaga

SEQ ID NO: 1572717 - RNA, 19 nt, Human adenovirus E
ugaucgaggacgucagcgg

SEQ ID NO: 1572718 - RNA, 20 nt, Human adenovirus E
gaaucgcggacggcccuuga

SEQ ID NO: 1572719 - RNA, 14 nt, Human adenovirus E
cgucaucaaaacac

SEQ ID NO: 1572720 - RNA, 20 nt, Human adenovirus E
ccgccgugagcggggcugga

SEQ ID NO: 1572721 - RNA, 12 nt, Human adenovirus E
cacacugguggc

SEQ ID NO: 1572722 - RNA, 20 nt, Human adenovirus E
gacuccgcgcaaggaccuga

SEQ ID NO: 1572723 - RNA, 21 nt, Human adenovirus E
uggggcaguuucuugagcucc

SEQ ID NO: 1572724 - RNA, 13 nt, Human adenovirus E
agggccgcuggcu

SEQ ID NO: 1572725 - RNA, 22 nt, Human adenovirus E
gcgugccccccaagcgccagcc

SEQ ID NO: 1572726 - RNA, 23 nt, Human adenovirus E
ugcccauauuagacuaugaggcc

SEQ ID NO: 1572727 - RNA, 21 nt, Human adenovirus E
uaguugugguccugggugagg

SEQ ID NO: 1572728 - RNA, 21 nt, Human adenovirus E
cagcacuggaacaccaucagg

SEQ ID NO: 1572729 - RNA, 20 nt, Human adenovirus E
aagcggccacagugcucgca

SEQ ID NO: 1572730 - RNA, 15 nt, Human adenovirus E
uucaccugcagcaga

SEQ ID NO: 1572731 - RNA, 19 nt, Human adenovirus E
cgccaaccucgccaucugc

SEQ ID NO: 1572732 - RNA, 19 nt, Human adenovirus E
agaucaaaccgcagcagag

SEQ ID NO: 1572733 - RNA, 17 nt, Human adenovirus E
gcaggaccaccagcacg

SEQ ID NO: 1572734 - RNA, 22 nt, Human adenovirus E
gcagguccagaccucggcgcga

SEQ ID NO: 1572735 - RNA, 14 nt, Human adenovirus E
ucccaacaaaugcc

SEQ ID NO: 1572736 - RNA, 18 nt, Human adenovirus E
uccucucgagccgcaccu

SEQ ID NO: 1572737 - RNA, 13 nt, Human adenovirus E
gucaaccacugcg

SEQ ID NO: 1572738 - RNA, 21 nt, Human adenovirus E
ggccagaucguccagggcagc

SEQ ID NO: 1572739 - RNA, 15 nt, Human adenovirus E
aaaucagacccacug

SEQ ID NO: 1572740 - RNA, 16 nt, Human adenovirus E
acgagcagcuggcccg

SEQ ID NO: 1572741 - RNA, 15 nt, Human adenovirus E
cuuaacauggaucac

SEQ ID NO: 1572742 - RNA, 21 nt, Human adenovirus E
caccacagcuaccuccagugc

SEQ ID NO: 1572743 - RNA, 22 nt, Human adenovirus E
aggcgcgcgcagucguggaugc

SEQ ID NO: 1572744 - RNA, 17 nt, Human adenovirus E
cugccgcugcgcagcag

SEQ ID NO: 1572745 - RNA, 15 nt, Human adenovirus E
ucgcuguccacgagc

SEQ ID NO: 1572746 - RNA, 14 nt, Human adenovirus E
ggaggcgcucgcca

SEQ ID NO: 1572747 - RNA, 14 nt, Human adenovirus E
aggccugggcggcc

SEQ ID NO: 1572748 - RNA, 22 nt, Human adenovirus E
gaagaggaucuugcccgcgcgg

SEQ ID NO: 1572749 - RNA, 20 nt, Human adenovirus E
ggcugcaaacuuccuccaca

SEQ ID NO: 1572750 - RNA, 17 nt, Human adenovirus E
cgaggguucagccgcca

SEQ ID NO: 1572751 - RNA, 15 nt, Human adenovirus E
aaaaacgucacccgc

SEQ ID NO: 1572752 - RNA, 13 nt, Human adenovirus E
caacaggagaugc

SEQ ID NO: 1572753 - RNA, 15 nt, Human adenovirus E
cucgcgccugcugcu

SEQ ID NO: 1572754 - RNA, 12 nt, Human adenovirus E
aaauuuuugcuu

SEQ ID NO: 1572755 - RNA, 13 nt, Human adenovirus E
agagcgacaucgg

SEQ ID NO: 1572756 - RNA, 23 nt, Human adenovirus E
cggaauccugcccgccaccugcu

SEQ ID NO: 1572757 - RNA, 12 nt, Human adenovirus E
uccggggcagaa

SEQ ID NO: 1572758 - RNA, 21 nt, Human adenovirus E
gcgugcacgaagcccugcagg

SEQ ID NO: 1572759 - RNA, 21 nt, Human adenovirus E
ccgcagcaguggcagcggccg

SEQ ID NO: 1572760 - RNA, 16 nt, Human adenovirus E
ggaccccauccaggug

SEQ ID NO: 1572761 - RNA, 14 nt, Human adenovirus E
cggcgcgagcugag

SEQ ID NO: 1572762 - RNA, 16 nt, Human adenovirus E
gcacgacaggcagcgg

SEQ ID NO: 1572763 - RNA, 20 nt, Human adenovirus E
ccacgccccgcaaucaccuc

SEQ ID NO: 1572764 - RNA, 18 nt, Human adenovirus E
gccacagcgacccaugcu

SEQ ID NO: 1572765 - RNA, 14 nt, Human adenovirus E
cccugcgccugaug

SEQ ID NO: 1572766 - RNA, 21 nt, Human adenovirus E
gcagucauaaucaucugcaug

SEQ ID NO: 1572767 - RNA, 24 nt, Human adenovirus E
ugcagcugauggugcccaagcgcc

SEQ ID NO: 1572768 - RNA, 14 nt, Human adenovirus E
uacaaaucuguuga

SEQ ID NO: 1572769 - RNA, 15 nt, Human adenovirus E
uccgaggccacgcgg

SEQ ID NO: 1572770 - RNA, 16 nt, Human adenovirus E
gggcgagaucgagggc

SEQ ID NO: 1572771 - RNA, 20 nt, Human adenovirus E
ggcucgacuccguggccugg

SEQ ID NO: 1572772 - RNA, 14 nt, Human adenovirus E
cagcgccuccaaac

SEQ ID NO: 1572773 - RNA, 18 nt, Human adenovirus E
cauccccgcgcuccugga

SEQ ID NO: 1572774 - RNA, 21 nt, Human adenovirus E
gaagucguuggagaugcggcc

SEQ ID NO: 1572775 - RNA, 13 nt, Human adenovirus E
cugucggccugcg

SEQ ID NO: 1572776 - RNA, 14 nt, Human adenovirus E
ggaggagcucagcc

SEQ ID NO: 1572777 - RNA, 14 nt, Human adenovirus E
cgcaccugccccua

SEQ ID NO: 1572778 - RNA, 21 nt, Human adenovirus E
ugcagcggcagaucaacagcc

SEQ ID NO: 1572779 - RNA, 15 nt, Human adenovirus E
ccgccuaccgcagcu

SEQ ID NO: 1572780 - RNA, 13 nt, Human adenovirus E
caucgccgcggcg

SEQ ID NO: 1572781 - RNA, 15 nt, Human adenovirus E
gcccgcggagcacga

SEQ ID NO: 1572782 - RNA, 23 nt, Human adenovirus E
uugacggccuuguaggcgcagca

SEQ ID NO: 1572783 - RNA, 13 nt, Human adenovirus E
cguguggcagcag

SEQ ID NO: 1572784 - RNA, 20 nt, Human adenovirus E
gccggcgcaaacccgggagc

SEQ ID NO: 1572785 - RNA, 13 nt, Human adenovirus E
cggcgcgagcuga

SEQ ID NO: 1572786 - RNA, 21 nt, Human adenovirus E
aagagaaggccgaucccugcu

SEQ ID NO: 1572787 - RNA, 19 nt, Human adenovirus E
accaugaagauccuaggcc

SEQ ID NO: 1572788 - RNA, 15 nt, Human adenovirus E
aggaugcagcagcug

SEQ ID NO: 1572789 - RNA, 16 nt, Human adenovirus E
ugcgucaucacccagg

SEQ ID NO: 1572790 - RNA, 18 nt, Human adenovirus E
guuuaaaauuugaagaug

SEQ ID NO: 1572791 - RNA, 17 nt, Human adenovirus E
ccagggacucccucagc

SEQ ID NO: 1572792 - RNA, 16 nt, Human adenovirus E
cgagggcaugcaagac

SEQ ID NO: 1572793 - RNA, 19 nt, Human adenovirus E
cauggcuugcagggucccg

SEQ ID NO: 1572794 - RNA, 14 nt, Human adenovirus E
accucgcccugcuc

SEQ ID NO: 1572795 - RNA, 23 nt, Human adenovirus E
caggcgcacgggacgcagggcca

SEQ ID NO: 1572796 - RNA, 20 nt, Human adenovirus E
cggcagaugcgcccccacca

SEQ ID NO: 1572797 - RNA, 19 nt, Human adenovirus E
caggaaauuccccagccca

SEQ ID NO: 1572798 - RNA, 24 nt, Human adenovirus E
acccgcguucugcgcgcgggaguu

SEQ ID NO: 1572799 - RNA, 14 nt, Human adenovirus E
cagucccccgagga

SEQ ID NO: 1572800 - RNA, 20 nt, Human adenovirus E
gcucugcaagcuccugcaga

SEQ ID NO: 1572801 - RNA, 16 nt, Human adenovirus E
augccaccucagcuca

SEQ ID NO: 1572802 - RNA, 14 nt, Human adenovirus E
uuuccuccacccuc

SEQ ID NO: 1572803 - RNA, 17 nt, Human adenovirus E
cgccugcaucucgugcu

SEQ ID NO: 1572804 - RNA, 21 nt, Human adenovirus E
aagagcagaacuuccagcaga

SEQ ID NO: 1572805 - RNA, 16 nt, Human adenovirus E
gcugacguccugcagg

SEQ ID NO: 1572806 - RNA, 18 nt, Human adenovirus E
cggagcuguccagggucc

SEQ ID NO: 1572807 - RNA, 16 nt, Human adenovirus E
ggcucugaaccugccc

SEQ ID NO: 1572808 - RNA, 12 nt, Human adenovirus E
auaaaguucaag

SEQ ID NO: 1572809 - RNA, 22 nt, Human adenovirus E
cagcagcacacaacaggcgcaa

SEQ ID NO: 1572810 - RNA, 15 nt, Human adenovirus E
uacugaucugauacu

SEQ ID NO: 1572811 - RNA, 13 nt, Human adenovirus E
agaggugggcuug

SEQ ID NO: 1572812 - RNA, 22 nt, Human adenovirus E
agcugaaguaugaaugggugga

SEQ ID NO: 1572813 - RNA, 19 nt, Human adenovirus E
aucacacacgcccagcaca

SEQ ID NO: 1572814 - RNA, 13 nt, Human adenovirus E
gcaguggcagcgg

SEQ ID NO: 1572815 - RNA, 23 nt, Human adenovirus E
ucaucuuagcgcuagcagccgcg

SEQ ID NO: 1572816 - RNA, 22 nt, Human adenovirus E
ccaaggccgccgccccucucag

SEQ ID NO: 1572817 - RNA, 20 nt, Human adenovirus E
aggcguccgcgccgcagugg

SEQ ID NO: 1572818 - RNA, 23 nt, Human adenovirus E
cccaggccgaaguccagcugacu

SEQ ID NO: 1572819 - RNA, 15 nt, Human adenovirus E
cucugacgcuccugg

SEQ ID NO: 1572820 - RNA, 18 nt, Human adenovirus E
cccagccccgccaccucc

SEQ ID NO: 1572821 - RNA, 22 nt, Human adenovirus E
uacgauauguggccccccacga

SEQ ID NO: 1572822 - RNA, 20 nt, Human adenovirus E
ggaauuucagugggaagugg

SEQ ID NO: 1572823 - RNA, 22 nt, Human adenovirus E
ugagccgcgcccugggccagga

SEQ ID NO: 1572824 - RNA, 15 nt, Human adenovirus E
cugcgcggggaggcc

SEQ ID NO: 1572825 - RNA, 17 nt, Human adenovirus E
ggccgagcugucggccu

SEQ ID NO: 1572826 - RNA, 13 nt, Human adenovirus E
ggagggaagaaca

SEQ ID NO: 1572827 - RNA, 17 nt, Human adenovirus E
uggagugccugcgccgc

SEQ ID NO: 1572828 - RNA, 13 nt, Human adenovirus E
cugcaacccccag

SEQ ID NO: 1572829 - RNA, 13 nt, Human adenovirus E
ccaaccgcacccg

SEQ ID NO: 1572830 - RNA, 16 nt, Human adenovirus E
ucaguuuuuccaacaa

SEQ ID NO: 1572831 - RNA, 16 nt, Human adenovirus E
ccuagccgccuccacc

SEQ ID NO: 1572832 - RNA, 18 nt, Human adenovirus E
auuuuccccgagcgccuc

SEQ ID NO: 1572833 - RNA, 16 nt, Human adenovirus E
aaugcuaccgccaaaa

SEQ ID NO: 1572834 - RNA, 18 nt, Human adenovirus E
agcgaagagaccccgggu

SEQ ID NO: 1572835 - RNA, 22 nt, Human adenovirus E
ugcgagggggcgaggagccccg

SEQ ID NO: 1572836 - RNA, 22 nt, Human adenovirus E
gggaucagcaguuugggcagcg

SEQ ID NO: 1572837 - RNA, 19 nt, Human adenovirus E
agcgaucccauuugagcug

SEQ ID NO: 1572838 - RNA, 23 nt, Human adenovirus E
agccguuccgcaccgaaggaaga

SEQ ID NO: 1572839 - RNA, 20 nt, Human adenovirus E
gaccgaggugccccagagcg

SEQ ID NO: 1572840 - RNA, 14 nt, Human adenovirus E
cuuaccgagcagca

SEQ ID NO: 1572841 - RNA, 17 nt, Human adenovirus E
cuccccgggaccuauca

SEQ ID NO: 1572842 - RNA, 16 nt, Human adenovirus E
gauggccacgggcagc

SEQ ID NO: 1572843 - RNA, 22 nt, Human adenovirus E
ucgacuccguggccuggaggcu

SEQ ID NO: 1572844 - RNA, 15 nt, Human adenovirus E
gagccacaccacagc

SEQ ID NO: 1572845 - RNA, 16 nt, Human adenovirus E
cugugucgucaccgcc

SEQ ID NO: 1572846 - RNA, 14 nt, Human adenovirus E
ccuagccgccucca

SEQ ID NO: 1572847 - RNA, 14 nt, Human adenovirus E
ugggccugaugcac

SEQ ID NO: 1572848 - RNA, 15 nt, Human adenovirus E
cagaaaaugaugcaa

SEQ ID NO: 1572849 - RNA, 23 nt, Human adenovirus E
gccaaccggcucucggccauccu

SEQ ID NO: 1572850 - RNA, 21 nt, Human adenovirus E
cugcuccgcgcugcccucgga

SEQ ID NO: 1572851 - RNA, 20 nt, Human adenovirus E
gcagcucacuaccaauaaca

SEQ ID NO: 1572852 - RNA, 13 nt, Human adenovirus E
ccgcgaggccauc

SEQ ID NO: 1572853 - RNA, 17 nt, Human adenovirus E
caagcuccugcagaaga

SEQ ID NO: 1572854 - RNA, 20 nt, Human adenovirus E
cugccgcgccaaccgcaccc

SEQ ID NO: 1572855 - RNA, 13 nt, Human adenovirus E
ggccgaccgcgau

SEQ ID NO: 1572856 - RNA, 20 nt, Human adenovirus E
gggcgaaagugucccugacc

SEQ ID NO: 1572857 - RNA, 13 nt, Human adenovirus E
gacucccaccugc

SEQ ID NO: 1572858 - RNA, 15 nt, Human adenovirus E
cagcgcagccagggu

SEQ ID NO: 1572859 - RNA, 13 nt, Human adenovirus E
ccggaugcagggg

SEQ ID NO: 1572860 - RNA, 13 nt, Human adenovirus E
ggucugccuuccc

SEQ ID NO: 1572861 - RNA, 20 nt, Human adenovirus E
ggaggaagacugggagaaca

SEQ ID NO: 1572862 - RNA, 18 nt, Human adenovirus E
gcccgugcugcucgagcg

SEQ ID NO: 1572863 - RNA, 17 nt, Human adenovirus E
cuggcuccuggaccugg

SEQ ID NO: 1572864 - RNA, 18 nt, Human adenovirus E
cgaggccaucggccaggc

SEQ ID NO: 1572865 - RNA, 15 nt, Human adenovirus E
cgcugguggcggugu

SEQ ID NO: 1572866 - RNA, 20 nt, Human adenovirus E
gccccaguacgcgcucagca

SEQ ID NO: 1572867 - RNA, 20 nt, Human adenovirus E
agcugccgcccguggaggau

SEQ ID NO: 1572868 - RNA, 15 nt, Human adenovirus E
cgggaguuccuccac

SEQ ID NO: 1572869 - RNA, 22 nt, Human adenovirus E
ggagccuuguugcgcagggcca

SEQ ID NO: 1572870 - RNA, 19 nt, Human adenovirus E
agaacagcagucaggcaga

SEQ ID NO: 1572871 - RNA, 17 nt, Human adenovirus E
cucgcguccguguggca

SEQ ID NO: 1572872 - RNA, 19 nt, Human adenovirus E
cugggauccaugguggcgc

SEQ ID NO: 1572873 - RNA, 22 nt, Human adenovirus E
auccaugguggcgcugaacgcc

SEQ ID NO: 1572874 - RNA, 18 nt, Human adenovirus E
ccgguuguaccuggugga

SEQ ID NO: 1572875 - RNA, 20 nt, Human adenovirus E
gucucuucgggggcagaggc

SEQ ID NO: 1572876 - RNA, 20 nt, Human adenovirus E
gacuacuucuuccagaccag

SEQ ID NO: 1572877 - RNA, 18 nt, Human adenovirus E
uggacaagaugagccgcu

SEQ ID NO: 1572878 - RNA, 14 nt, Human adenovirus E
caaagagcuguccg

SEQ ID NO: 1572879 - RNA, 19 nt, Human adenovirus E
caugggcgcggaccugcac

SEQ ID NO: 1572880 - RNA, 16 nt, Human adenovirus E
cugggaguugcgcgcc

SEQ ID NO: 1572881 - RNA, 18 nt, Human adenovirus E
cgacgagcucggcgguga

SEQ ID NO: 1572882 - RNA, 12 nt, Human adenovirus E
ccgcggugcucc

SEQ ID NO: 1572883 - RNA, 16 nt, Human adenovirus E
ggcgacgaggccggcc

SEQ ID NO: 1572884 - RNA, 17 nt, Human adenovirus E
cacgcggggcgggagcu

SEQ ID NO: 1572885 - RNA, 18 nt, Human adenovirus E
cagcgaaccccgcagaac

SEQ ID NO: 1572886 - RNA, 13 nt, Human adenovirus E
ccccacccaguga

SEQ ID NO: 1572887 - RNA, 14 nt, Human adenovirus E
ccggacgugcagcc

SEQ ID NO: 1572888 - RNA, 16 nt, Human adenovirus E
cauccgcccaaggccg

SEQ ID NO: 1572889 - RNA, 11 nt, Human adenovirus E
aagaagcagcc

SEQ ID NO: 1572890 - RNA, 15 nt, Human adenovirus E
cagguguccagcugg

SEQ ID NO: 1572891 - RNA, 16 nt, Human adenovirus E
ccuccaccaacgccac

SEQ ID NO: 1572892 - RNA, 14 nt, Human adenovirus E
cucgcucugguggc

SEQ ID NO: 1572893 - RNA, 13 nt, Human adenovirus E
cggggaucagccc

SEQ ID NO: 1572894 - RNA, 20 nt, Human adenovirus E
caaguacggcgcggccagcc

SEQ ID NO: 1572895 - RNA, 19 nt, Human adenovirus E
caaggaugcgcugcucgac

SEQ ID NO: 1572896 - RNA, 16 nt, Human adenovirus E
aucugcccccaccgcc

SEQ ID NO: 1572897 - RNA, 15 nt, Human adenovirus E
auguucagggcggcc

SEQ ID NO: 1572898 - RNA, 19 nt, Human adenovirus E
ccggcauugcuuccguggc

SEQ ID NO: 1572899 - RNA, 15 nt, Human adenovirus E
uagaggaaccccgcc

SEQ ID NO: 1572900 - RNA, 21 nt, Human adenovirus E
accuguucagagacaggagcg

SEQ ID NO: 1572901 - RNA, 13 nt, Human adenovirus E
ccagaugaugcaa

SEQ ID NO: 1572902 - RNA, 16 nt, Human adenovirus E
gggauagaaagccugg

SEQ ID NO: 1572903 - RNA, 15 nt, Human adenovirus E
gagaccgagcuccag

SEQ ID NO: 1572904 - RNA, 14 nt, Human adenovirus E
caacuuggaaggga

SEQ ID NO: 1572905 - RNA, 20 nt, Human adenovirus E
uccacugucgagagccacac

SEQ ID NO: 1572906 - RNA, 19 nt, Human adenovirus E
ucacuuuguggacaacacc

SEQ ID NO: 1572907 - RNA, 18 nt, Human adenovirus E
ggccagaucguccagggc

SEQ ID NO: 1572908 - RNA, 21 nt, Human adenovirus E
gacccggacgugcagcccgag

SEQ ID NO: 1572909 - RNA, 16 nt, Human adenovirus E
gagcaggaagcagaga

SEQ ID NO: 1572910 - RNA, 17 nt, Human adenovirus E
cgguggcacgacaggca

SEQ ID NO: 1572911 - RNA, 22 nt, Human adenovirus E
caaugguacugaugacagcaac

SEQ ID NO: 1572912 - RNA, 16 nt, Human adenovirus E
gugcagccacagcgcg

SEQ ID NO: 1572913 - RNA, 19 nt, Human adenovirus E
cauguuuucugccaacacc

SEQ ID NO: 1572914 - RNA, 16 nt, Human adenovirus E
ccagcaccagcaccau

SEQ ID NO: 1572915 - RNA, 22 nt, Human adenovirus E
cuaugugacgcccgcggagcac

SEQ ID NO: 1572916 - RNA, 15 nt, Human adenovirus E
gaggccgagccacag

SEQ ID NO: 1572917 - RNA, 22 nt, Human adenovirus E
  misc_feature (7)..(7): n is a, c, g or u
uuagaancggcggcgaagacgc

SEQ ID NO: 1572918 - RNA, 20 nt, Human adenovirus E
uugucaaugccaccucagcu

SEQ ID NO: 1572919 - RNA, 23 nt, Human adenovirus E
ccagcagcuagaaaauccacagc

SEQ ID NO: 1572920 - RNA, 21 nt, Human adenovirus E
ccucauuuuccccgagcgccu

SEQ ID NO: 1572921 - RNA, 17 nt, Human adenovirus E
gucgagggucuccugga

SEQ ID NO: 1572922 - RNA, 17 nt, Human adenovirus E
accugcaucugcugcug

SEQ ID NO: 1572923 - RNA, 17 nt, Human adenovirus E
ucgggucggucagggag

SEQ ID NO: 1572924 - RNA, 14 nt, Human adenovirus E
gagggucugggcag

SEQ ID NO: 1572925 - RNA, 19 nt, Human adenovirus E
ggcgugcgcuccuggacgc

SEQ ID NO: 1572926 - RNA, 15 nt, Human adenovirus E
cgaggccguggccca

SEQ ID NO: 1572927 - RNA, 16 nt, Human adenovirus E
ccgagcagcagcacac

SEQ ID NO: 1572928 - RNA, 23 nt, Human adenovirus E
gaugaugauauucuggagcaggc

SEQ ID NO: 1572929 - RNA, 18 nt, Human adenovirus E
accacucgccgcucgccg

SEQ ID NO: 1572930 - RNA, 23 nt, Human adenovirus E
gauggugaagaugccgggcagga

SEQ ID NO: 1572931 - RNA, 15 nt, Human adenovirus E
gcugggucugcgacc

SEQ ID NO: 1572932 - RNA, 15 nt, Human adenovirus E
agccugcugaugccc

SEQ ID NO: 1572933 - RNA, 21 nt, Human adenovirus E
ugcugggcauucgcaagaggc

SEQ ID NO: 1572934 - RNA, 19 nt, Human adenovirus E
gagaugcggcccaugagcu

SEQ ID NO: 1572935 - RNA, 23 nt, Human adenovirus E
agcagauugacaagcggaauauc

SEQ ID NO: 1572936 - RNA, 17 nt, Human adenovirus E
agcaguuugggcagcgg

SEQ ID NO: 1572937 - RNA, 16 nt, Human adenovirus E
gccacagaaguuucau

SEQ ID NO: 1572938 - RNA, 22 nt, Human adenovirus E
gcaaaacuaacacuuugcuuga

SEQ ID NO: 1572939 - RNA, 18 nt, Human adenovirus E
gacggucaacuccuccuc

SEQ ID NO: 1572940 - RNA, 14 nt, Human adenovirus E
uaaaaguccacggc

SEQ ID NO: 1572941 - RNA, 21 nt, Human adenovirus E
auuuuugccaugcgucaaaug

SEQ ID NO: 1572942 - RNA, 11 nt, Human adenovirus E
caagcgccgca

SEQ ID NO: 1572943 - RNA, 12 nt, Human adenovirus E
uguucaacaguc

SEQ ID NO: 1572944 - RNA, 12 nt, Human adenovirus E
uaaaggccaaag

SEQ ID NO: 1572945 - RNA, 18 nt, Human adenovirus E
acaccuggaccacugccg

SEQ ID NO: 1572946 - RNA, 16 nt, Human adenovirus E
cacgcugcgcccccag

SEQ ID NO: 1572947 - RNA, 24 nt, Human adenovirus E
guacccucgaucccgggggcguag

SEQ ID NO: 1572948 - RNA, 16 nt, Human adenovirus E
caccuggaccacugcc

SEQ ID NO: 1572949 - RNA, 12 nt, Human adenovirus E
guugggcaggga

SEQ ID NO: 1572950 - RNA, 15 nt, Human adenovirus E
ucccauacuccaccu

SEQ ID NO: 1572951 - RNA, 22 nt, Human adenovirus E
caacaaaagaaaaauccuccag

SEQ ID NO: 1572952 - RNA, 14 nt, Human adenovirus E
cguucucuccagca

SEQ ID NO: 1572953 - RNA, 22 nt, Human adenovirus E
ggacgacccgggcaaccuggaa

SEQ ID NO: 1572954 - RNA, 17 nt, Human adenovirus E
gaggcagcagcagcaga

SEQ ID NO: 1572955 - RNA, 16 nt, Human adenovirus E
guccucgcuguccugg

SEQ ID NO: 1572956 - RNA, 17 nt, Human adenovirus E
gaggacagccugcaaga

SEQ ID NO: 1572957 - RNA, 16 nt, Human adenovirus E
cuggaggccguggugc

SEQ ID NO: 1572958 - RNA, 14 nt, Human adenovirus E
gcgccauugguggc

SEQ ID NO: 1572959 - RNA, 15 nt, Human adenovirus E
agcuggagggcgaga

SEQ ID NO: 1572960 - RNA, 15 nt, Human adenovirus E
ccgagaagcuggcgg

SEQ ID NO: 1572961 - RNA, 24 nt, Human adenovirus E
caacgugcagaccaaccuggaccg

SEQ ID NO: 1572962 - RNA, 16 nt, Human adenovirus E
cagcaagcgguugggg

SEQ ID NO: 1572963 - RNA, 24 nt, Human adenovirus E
cgcggccagggggucgcucucguc

SEQ ID NO: 1572964 - RNA, 21 nt, Human adenovirus E
ugaugucauacuugagcuguc

SEQ ID NO: 1572965 - RNA, 15 nt, Human adenovirus E
cacagggcaggcgcu

SEQ ID NO: 1572966 - RNA, 22 nt, Human adenovirus E
ucgagggggaacccguccugau

SEQ ID NO: 1572967 - RNA, 16 nt, Human adenovirus E
cgucgccgcaccgccg

SEQ ID NO: 1572968 - RNA, 17 nt, Human adenovirus E
guggaucuuuuccagga

SEQ ID NO: 1572969 - RNA, 19 nt, Human adenovirus E
uuccacgguggcuuccagc

SEQ ID NO: 1572970 - RNA, 14 nt, Human adenovirus E
caaacuuccuccac

SEQ ID NO: 1572971 - RNA, 19 nt, Human adenovirus E
auggacucugacgcuccug

SEQ ID NO: 1572972 - RNA, 19 nt, Human adenovirus E
cagccccgauuaugcaggg

SEQ ID NO: 1572973 - RNA, 15 nt, Human adenovirus E
gggagaugagcuggg

SEQ ID NO: 1572974 - RNA, 12 nt, Human adenovirus E
ucgugcgagggg

SEQ ID NO: 1572975 - RNA, 20 nt, Human adenovirus E
cggugcugacggcuccccgc

SEQ ID NO: 1572976 - RNA, 20 nt, Human adenovirus E
acuuccuccgcggccggcca

SEQ ID NO: 1572977 - RNA, 15 nt, Human adenovirus E
gacgauguggacagc

SEQ ID NO: 1572978 - RNA, 18 nt, Human adenovirus E
gugaccuugcagcaggug

SEQ ID NO: 1572979 - RNA, 12 nt, Human adenovirus E
ccauuacuggca

SEQ ID NO: 1572980 - RNA, 18 nt, Human adenovirus E
ccugcuccgcgcugcccu

SEQ ID NO: 1572981 - RNA, 11 nt, Human adenovirus E
ucugccuccuc

SEQ ID NO: 1572982 - RNA, 20 nt, Human adenovirus E
gcccaacccgcgccucaacu

SEQ ID NO: 1572983 - RNA, 16 nt, Human adenovirus E
gcgcaucgcccggcgg

SEQ ID NO: 1572984 - RNA, 18 nt, Human adenovirus E
uggcgaugugcucgguga

SEQ ID NO: 1572985 - RNA, 18 nt, Human adenovirus E
cgggggagaugagcuggg

SEQ ID NO: 1572986 - RNA, 19 nt, Human adenovirus E
uggacaacaccugauccau

SEQ ID NO: 1572987 - RNA, 14 nt, Human adenovirus E
aacucguaccuggg

SEQ ID NO: 1572988 - RNA, 23 nt, Human adenovirus E
cugcaguacgugcaacacagaac

SEQ ID NO: 1572989 - RNA, 13 nt, Human adenovirus E
aaaaccagcagcu

SEQ ID NO: 1572990 - RNA, 15 nt, Human adenovirus E
cugggacagcacuca

SEQ ID NO: 1572991 - RNA, 13 nt, Human adenovirus E
gaggacccaccgc

SEQ ID NO: 1572992 - RNA, 19 nt, Human adenovirus E
aggcuccuuacgugccccc

SEQ ID NO: 1572993 - RNA, 21 nt, Human adenovirus E
uccccaaauucaaacaccuca

SEQ ID NO: 1572994 - RNA, 13 nt, Human adenovirus E
gaagcguucaggg

SEQ ID NO: 1572995 - RNA, 20 nt, Human adenovirus E
gugcagcagaagcgugggcc

SEQ ID NO: 1572996 - RNA, 21 nt, Human adenovirus E
cccugcgcggggaggcccggc

SEQ ID NO: 1572997 - RNA, 19 nt, Human adenovirus E
caagaauucuugcugaaaa

SEQ ID NO: 1572998 - RNA, 14 nt, Human adenovirus E
uagucauacagcuc

SEQ ID NO: 1572999 - RNA, 12 nt, Human adenovirus E
acgugagccgcg

SEQ ID NO: 1573000 - RNA, 18 nt, Human adenovirus E
acacuguaucccacccug

SEQ ID NO: 1573001 - RNA, 23 nt, Human adenovirus E
ugcaccgugcggugagcgccagc

SEQ ID NO: 1573002 - RNA, 23 nt, Human adenovirus E
caccggugugcgcgugcccgugc

SEQ ID NO: 1573003 - RNA, 16 nt, Human adenovirus E
caagcgccgcagcagu

SEQ ID NO: 1573004 - RNA, 21 nt, Human adenovirus E
augucguagacguagaggggc

SEQ ID NO: 1573005 - RNA, 17 nt, Human adenovirus E
uaccacaucacccucug

SEQ ID NO: 1573006 - RNA, 18 nt, Human adenovirus E
cuguuccugaugcaggag

SEQ ID NO: 1573007 - RNA, 12 nt, Human adenovirus E
ggcgcggccagc

SEQ ID NO: 1573008 - RNA, 20 nt, Human adenovirus E
gcccugcgcgucggccaggu

SEQ ID NO: 1573009 - RNA, 18 nt, Human adenovirus E
gggcccagguuggugcga

SEQ ID NO: 1573010 - RNA, 18 nt, Human adenovirus E
acuaccuccaccugagcg

SEQ ID NO: 1573011 - RNA, 16 nt, Human adenovirus E
gccugcgucaucaccc

SEQ ID NO: 1573012 - RNA, 16 nt, Human adenovirus E
ugcaaacuuccuccac

SEQ ID NO: 1573013 - RNA, 20 nt, Human adenovirus E
cggaggcgacgggcucucgc

SEQ ID NO: 1573014 - RNA, 22 nt, Human adenovirus E
uggaccuggccaaccaggccgu

SEQ ID NO: 1573015 - RNA, 16 nt, Human adenovirus E
gcagaccgagcccaug

SEQ ID NO: 1573016 - RNA, 16 nt, Human adenovirus E
gagccggcggcggcgc

SEQ ID NO: 1573017 - RNA, 15 nt, Human adenovirus E
ugcaguggcgcgggc

SEQ ID NO: 1573018 - RNA, 14 nt, Human adenovirus E
gaccugcacuggca

SEQ ID NO: 1573019 - RNA, 17 nt, Human adenovirus E
gaaccccaccacccaga

SEQ ID NO: 1573020 - RNA, 22 nt, Human adenovirus E
cggugugccccgguucgaggcc

SEQ ID NO: 1573021 - RNA, 18 nt, Human adenovirus E
caguuacaccugcccugg

SEQ ID NO: 1573022 - RNA, 20 nt, Human adenovirus E
acagcaccaacgugcagacc

SEQ ID NO: 1573023 - RNA, 17 nt, Human adenovirus E
cuaccugauaucgccuc

SEQ ID NO: 1573024 - RNA, 17 nt, Human adenovirus E
uggaucuggccuuagcu

SEQ ID NO: 1573025 - RNA, 23 nt, Human adenovirus E
gcugaacgccuuccucagcaccc

SEQ ID NO: 1573026 - RNA, 21 nt, Human adenovirus E
cauguggagcuaccagcccca

SEQ ID NO: 1573027 - RNA, 18 nt, Human adenovirus E
aacgcucgguguugaaau

SEQ ID NO: 1573028 - RNA, 13 nt, Human adenovirus E
gcccgaggccgcc

SEQ ID NO: 1573029 - RNA, 14 nt, Human adenovirus E
ggucucgccgcgcc

SEQ ID NO: 1573030 - RNA, 18 nt, Human adenovirus E
gcaucucgauccagcaga

SEQ ID NO: 1573031 - RNA, 20 nt, Human adenovirus E
cgacgugaucgaccaggugg

SEQ ID NO: 1573032 - RNA, 15 nt, Human adenovirus E
ucgccgcgcaggggc

SEQ ID NO: 1573033 - RNA, 19 nt, Human adenovirus E
cccagcgaaggcgaggguu

SEQ ID NO: 1573034 - RNA, 17 nt, Human adenovirus E
cagcuggcccgguggcu

SEQ ID NO: 1573035 - RNA, 12 nt, Human adenovirus E
ucuccgaaauuu

SEQ ID NO: 1573036 - RNA, 16 nt, Human adenovirus E
gacggugucgagccug

SEQ ID NO: 1573037 - RNA, 19 nt, Human adenovirus E
ucguggcgccugcaucucg

SEQ ID NO: 1573038 - RNA, 19 nt, Human adenovirus E
gcauucguuacucggagcu

SEQ ID NO: 1573039 - RNA, 21 nt, Human adenovirus E
ugcagacggaucccuggaugc

SEQ ID NO: 1573040 - RNA, 19 nt, Human adenovirus E
gucgcagggggccacgagc

SEQ ID NO: 1573041 - RNA, 23 nt, Human adenovirus E
ccacuuagcauuaccacacagac

SEQ ID NO: 1573042 - RNA, 16 nt, Human adenovirus E
gcaacaacagcccccu

SEQ ID NO: 1573043 - RNA, 21 nt, Human adenovirus E
agcagaccgugaaggaggaga

SEQ ID NO: 1573044 - RNA, 19 nt, Human adenovirus E
ucagagcgagccagucucg

SEQ ID NO: 1573045 - RNA, 15 nt, Human adenovirus E
cccgaauaccacagc

SEQ ID NO: 1573046 - RNA, 12 nt, Human adenovirus E
cagcgugguggc

SEQ ID NO: 1573047 - RNA, 17 nt, Human adenovirus E
cgcuguggagccacugc

SEQ ID NO: 1573048 - RNA, 15 nt, Human adenovirus E
cgaggccggccuggu

SEQ ID NO: 1573049 - RNA, 21 nt, Human adenovirus E
ccgaggaagaaaaccgcgccg

SEQ ID NO: 1573050 - RNA, 15 nt, Human adenovirus E
gagcucagccgcgcc

SEQ ID NO: 1573051 - RNA, 15 nt, Human adenovirus E
cuccagcuccagugu

SEQ ID NO: 1573052 - RNA, 17 nt, Human adenovirus E
gcagcguguuggacuug

SEQ ID NO: 1573053 - RNA, 14 nt, Human adenovirus E
gcaggcggcgcgag

SEQ ID NO: 1573054 - RNA, 19 nt, Human adenovirus E
agcgcucgcgguggggcgg

SEQ ID NO: 1573055 - RNA, 20 nt, Human adenovirus E
gcgucucgggacccugccau

SEQ ID NO: 1573056 - RNA, 13 nt, Human adenovirus E
uggagccauagca

SEQ ID NO: 1573057 - RNA, 23 nt, Human adenovirus E
auggcaugcgaguuggaggagau

SEQ ID NO: 1573058 - RNA, 15 nt, Human adenovirus E
ccucggaccuggccg

SEQ ID NO: 1573059 - RNA, 17 nt, Human adenovirus E
ccccgaucccuccaggu

SEQ ID NO: 1573060 - RNA, 18 nt, Human adenovirus E
ugagaaaagcaaggagga

SEQ ID NO: 1573061 - RNA, 17 nt, Human adenovirus E
ccgggcggcaggggcgg

SEQ ID NO: 1573062 - RNA, 21 nt, Human adenovirus E
agcccgugaccuugcagcagg

SEQ ID NO: 1573063 - RNA, 22 nt, Human adenovirus E
gcagcagaggaggcagcaaagu

SEQ ID NO: 1573064 - RNA, 18 nt, Human adenovirus E
guacuaugccuucugcua

SEQ ID NO: 1573065 - RNA, 19 nt, Human adenovirus E
gccagaucguccagggcag

SEQ ID NO: 1573066 - RNA, 15 nt, Human adenovirus E
agggacucccucagc

SEQ ID NO: 1573067 - RNA, 17 nt, Human adenovirus E
cggaucucgcucagguc

SEQ ID NO: 1573068 - RNA, 13 nt, Human adenovirus E
ccaccccugccgc

SEQ ID NO: 1573069 - RNA, 14 nt, Human adenovirus E
gugggcguggggca

SEQ ID NO: 1573070 - RNA, 15 nt, Human adenovirus E
ucagcgccccgcauc

SEQ ID NO: 1573071 - RNA, 15 nt, Human adenovirus E
ggcgggagcugcggc

SEQ ID NO: 1573072 - RNA, 22 nt, Human adenovirus E
ccucaagcccgugaccuugcag

SEQ ID NO: 1573073 - RNA, 20 nt, Human adenovirus E
agucucaaguccagcaaagc

SEQ ID NO: 1573074 - RNA, 15 nt, Human adenovirus E
ggcagaacgugcugc

SEQ ID NO: 1573075 - RNA, 17 nt, Human adenovirus E
ugguucaccugcagcag

SEQ ID NO: 1573076 - RNA, 14 nt, Human adenovirus E
gaacgcucugcaag

SEQ ID NO: 1573077 - RNA, 14 nt, Human adenovirus E
gugccugcgccgcu

SEQ ID NO: 1573078 - RNA, 21 nt, Human adenovirus E
ugggaaugcgcgugcacgaag

SEQ ID NO: 1573079 - RNA, 12 nt, Human adenovirus E
gaguuuggaaga

SEQ ID NO: 1573080 - RNA, 23 nt, Human adenovirus E
agcccaugaucaagcccagcacc

SEQ ID NO: 1573081 - RNA, 19 nt, Human adenovirus E
caggucaucgcgccugaga

SEQ ID NO: 1573082 - RNA, 21 nt, Human adenovirus E
cugcugaauaucaccgagccc

SEQ ID NO: 1573083 - RNA, 17 nt, Human adenovirus E
uggaagaagcagccgcc

SEQ ID NO: 1573084 - RNA, 16 nt, Human adenovirus E
cccgaggcccuggcca

SEQ ID NO: 1573085 - RNA, 16 nt, Human adenovirus E
caguuagucucuccac

SEQ ID NO: 1573086 - RNA, 23 nt, Human adenovirus E
cuggaggccaucgugcagaaccc

SEQ ID NO: 1573087 - RNA, 19 nt, Human adenovirus E
cuaccgaggucaggggcga

SEQ ID NO: 1573088 - RNA, 21 nt, Human adenovirus E
ccuggaggccguggugcccuc

SEQ ID NO: 1573089 - RNA, 23 nt, Human adenovirus E
gguuccaccgcgaguccaaccug

SEQ ID NO: 1573090 - RNA, 20 nt, Human adenovirus E
accgcagcuugcccucggcc

SEQ ID NO: 1573091 - RNA, 18 nt, Human adenovirus E
cuuagcgcuagcagccgc

SEQ ID NO: 1573092 - RNA, 20 nt, Human adenovirus E
cugaaccugacacaccacca

SEQ ID NO: 1573093 - RNA, 14 nt, Human adenovirus E
ccacagcgacccau

SEQ ID NO: 1573094 - RNA, 20 nt, Human adenovirus E
ggggcaguuucuugagcucc

SEQ ID NO: 1573095 - RNA, 15 nt, Human adenovirus E
caccaacgccauccu

SEQ ID NO: 1573096 - RNA, 23 nt, Human adenovirus E
ggcagcaccgggugauccuccac

SEQ ID NO: 1573097 - RNA, 18 nt, Human adenovirus E
gggcaauccucgcacaga

SEQ ID NO: 1573098 - RNA, 15 nt, Human adenovirus E
caggggcgcagggca

SEQ ID NO: 1573099 - RNA, 15 nt, Human adenovirus E
uggugcccaagcgcc

SEQ ID NO: 1573100 - RNA, 18 nt, Human adenovirus E
uccagaaaaagccacaga

SEQ ID NO: 1573101 - RNA, 17 nt, Human adenovirus E
cagcgccggcaggaccc

SEQ ID NO: 1573102 - RNA, 16 nt, Human adenovirus E
ccuggugaccguggag

SEQ ID NO: 1573103 - RNA, 12 nt, Human adenovirus E
gucuaccucgac

SEQ ID NO: 1573104 - RNA, 18 nt, Human adenovirus E
augcgggcggcgcugcag

SEQ ID NO: 1573105 - RNA, 19 nt, Human adenovirus E
gcuccacgcaacaccccgu

SEQ ID NO: 1573106 - RNA, 21 nt, Human adenovirus E
aauuacuuggcgguggggcgg

SEQ ID NO: 1573107 - RNA, 15 nt, Human adenovirus E
acccucaucuccuuu

SEQ ID NO: 1573108 - RNA, 19 nt, Human adenovirus E
cgacuccguggccuggagg

SEQ ID NO: 1573109 - RNA, 15 nt, Human adenovirus E
agcgcaccaccgccu

SEQ ID NO: 1573110 - RNA, 16 nt, Human adenovirus E
ugggucugcgaccuga

SEQ ID NO: 1573111 - RNA, 20 nt, Human adenovirus E
ugacccugggccugaugcac

SEQ ID NO: 1573112 - RNA, 17 nt, Human adenovirus E
cguacugcggcagaugc

SEQ ID NO: 1573113 - RNA, 18 nt, Human adenovirus E
aaugccgcggugcuccuc

SEQ ID NO: 1573114 - RNA, 18 nt, Human adenovirus E
ggagaugacugacccacu

SEQ ID NO: 1573115 - RNA, 19 nt, Human adenovirus E
ugcgagccgauggggaaga

SEQ ID NO: 1573116 - RNA, 17 nt, Human adenovirus E
cgcugcucgaccgcacc

SEQ ID NO: 1573117 - RNA, 15 nt, Human adenovirus E
ccgacgacagcagcg

SEQ ID NO: 1573118 - RNA, 21 nt, Human adenovirus E
ccucugguugaacaugcagcc

SEQ ID NO: 1573119 - RNA, 14 nt, Human adenovirus E
cgaguacaauaaca

SEQ ID NO: 1573120 - RNA, 14 nt, Human adenovirus E
ccugguccgggcgc

SEQ ID NO: 1573121 - RNA, 16 nt, Human adenovirus E
gguccaggccagcacg

SEQ ID NO: 1573122 - RNA, 14 nt, Human adenovirus E
ccucagcacccagc

SEQ ID NO: 1573123 - RNA, 20 nt, Human adenovirus E
cgcggggcgggagcugcggc

SEQ ID NO: 1573124 - RNA, 20 nt, Human adenovirus E
gaggaagacugggacagcac

SEQ ID NO: 1573125 - RNA, 17 nt, Human adenovirus E
ccucuucucgccgcgcg

SEQ ID NO: 1573126 - RNA, 15 nt, Human adenovirus E
ucaucaaguuucaau

SEQ ID NO: 1573127 - RNA, 17 nt, Human adenovirus E
gaggccaucggccaggc

SEQ ID NO: 1573128 - RNA, 15 nt, Human adenovirus E
ccugcugcgccuggc

SEQ ID NO: 1573129 - RNA, 19 nt, Human adenovirus E
guugaaaaacugggaguug

SEQ ID NO: 1573130 - RNA, 19 nt, Human adenovirus E
caagagucagagaaaggcu

SEQ ID NO: 1573131 - RNA, 14 nt, Human adenovirus E
ucagcgccccgcau

SEQ ID NO: 1573132 - RNA, 16 nt, Human adenovirus E
agccgcgcccugggcc

SEQ ID NO: 1573133 - RNA, 15 nt, Human adenovirus E
ggcgcggaggaagga

SEQ ID NO: 1573134 - RNA, 18 nt, Human adenovirus E
ugcaggccucucagcgcc

SEQ ID NO: 1573135 - RNA, 17 nt, Human adenovirus E
ccgucaccuccacagcc

SEQ ID NO: 1573136 - RNA, 17 nt, Human adenovirus E
cgcguaguugcagaggc

SEQ ID NO: 1573137 - RNA, 13 nt, Human adenovirus E
ugcaagcgccgca

SEQ ID NO: 1573138 - RNA, 16 nt, Human adenovirus E
gagagccgccucagca

SEQ ID NO: 1573139 - RNA, 20 nt, Human adenovirus E
ccucguagaggaaccccgcc

SEQ ID NO: 1573140 - RNA, 23 nt, Human adenovirus E
cggcucucggccauccuggaggc

SEQ ID NO: 1573141 - RNA, 12 nt, Human adenovirus E
gucuaccucuac

SEQ ID NO: 1573142 - RNA, 22 nt, Human adenovirus E
ccgcaucugcaccucacagcuc

SEQ ID NO: 1573143 - RNA, 23 nt, Human adenovirus E
cacggguucgugcgccaggccug

SEQ ID NO: 1573144 - RNA, 12 nt, Human adenovirus E
ugggcagggaga

SEQ ID NO: 1573145 - RNA, 15 nt, Human adenovirus E
augacugacccacug

SEQ ID NO: 1573146 - RNA, 18 nt, Human adenovirus E
gcuggaccacggcaaccc

SEQ ID NO: 1573147 - RNA, 22 nt, Human adenovirus E
cgaccaccguggaaugggccag

SEQ ID NO: 1573148 - RNA, 21 nt, Human adenovirus E
ggaccgaaagagggugcugag

SEQ ID NO: 1573149 - RNA, 21 nt, Human adenovirus E
acggcgcggccagccugcuga

SEQ ID NO: 1573150 - RNA, 19 nt, Human adenovirus E
gacaaaaaucagacccacu

SEQ ID NO: 1573151 - RNA, 18 nt, Human adenovirus E
gccaccucgccgcgcagg

SEQ ID NO: 1573152 - RNA, 16 nt, Human adenovirus E
aucuguugagcuggga

SEQ ID NO: 1573153 - RNA, 20 nt, Human adenovirus E
cgcgcgcgaggaggugaccc

SEQ ID NO: 1573154 - RNA, 22 nt, Human adenovirus E
ccagggauaggagcuccuggag

SEQ ID NO: 1573155 - RNA, 10 nt, Human adenovirus E
gccaggcgca

SEQ ID NO: 1573156 - RNA, 15 nt, Human adenovirus E
ggaagacgugcugga

SEQ ID NO: 1573157 - RNA, 20 nt, Human adenovirus E
ccggguccagggacucccuc

SEQ ID NO: 1573158 - RNA, 12 nt, Human adenovirus E
cgcaccaccgcc

SEQ ID NO: 1573159 - RNA, 19 nt, Human adenovirus E
caucaauuuuucgucccug

SEQ ID NO: 1573160 - RNA, 18 nt, Human adenovirus E
cagaggagggacuugagg

SEQ ID NO: 1573161 - RNA, 17 nt, Human adenovirus E
guggaagaagcagccgc

SEQ ID NO: 1573162 - RNA, 19 nt, Human adenovirus E
ccaagaauucuugcugaaa

SEQ ID NO: 1573163 - RNA, 21 nt, Human adenovirus E
ggaagacguaugcgcaggagc

SEQ ID NO: 1573164 - RNA, 15 nt, Human adenovirus E
  misc_feature (6)..(6): n is a, c, g or u
cauuanuccagcaga

SEQ ID NO: 1573165 - RNA, 15 nt, Human adenovirus E
cauugucaaugccac

SEQ ID NO: 1573166 - RNA, 14 nt, Human adenovirus E
agccgaaacucauc

SEQ ID NO: 1573167 - RNA, 19 nt, Human adenovirus E
cguaugcgcaggagcacag

SEQ ID NO: 1573168 - RNA, 22 nt, Human adenovirus E
cacgccucgucaggccguccug

SEQ ID NO: 1573169 - RNA, 15 nt, Human adenovirus E
cuggacgcugcucac

SEQ ID NO: 1573170 - RNA, 12 nt, Human adenovirus E
gagucagagaaa

SEQ ID NO: 1573171 - RNA, 17 nt, Human adenovirus E
ugcugcccgacggccau

SEQ ID NO: 1573172 - RNA, 14 nt, Human adenovirus E
gaguauggcaccag

SEQ ID NO: 1573173 - RNA, 22 nt, Human adenovirus E
uucgcccuagccgccuccaccc

SEQ ID NO: 1573174 - RNA, 17 nt, Human adenovirus E
gauauucugcuccuggu

SEQ ID NO: 1573175 - RNA, 23 nt, Human adenovirus E
cagcaugaaggggacgagcugcu

SEQ ID NO: 1573176 - RNA, 23 nt, Human adenovirus E
gcgaucccugagcuccucccuca

SEQ ID NO: 1573177 - RNA, 23 nt, Human adenovirus E
cagacgcgcggcuucaggcgcca

SEQ ID NO: 1573178 - RNA, 14 nt, Human adenovirus E
aaccugacacacca

SEQ ID NO: 1573179 - RNA, 16 nt, Human adenovirus E
gaaguaccucaccugg

SEQ ID NO: 1573180 - RNA, 14 nt, Human adenovirus E
cagcggcggcagca

SEQ ID NO: 1573181 - RNA, 23 nt, Human adenovirus E
ggggccgggaccgagggggagag

SEQ ID NO: 1573182 - RNA, 15 nt, Human adenovirus E
ggguccaggccagca

SEQ ID NO: 1573183 - RNA, 21 nt, Human adenovirus E
cgaggagccccgggcccaggu

SEQ ID NO: 1573184 - RNA, 17 nt, Human adenovirus E
guugcgcagggccaggc

SEQ ID NO: 1573185 - RNA, 12 nt, Human adenovirus E
uggacugaggau

SEQ ID NO: 1573186 - RNA, 14 nt, Human adenovirus E
cuggcgugagcgac

SEQ ID NO: 1573187 - RNA, 12 nt, Human adenovirus E
cccgugcagcca

SEQ ID NO: 1573188 - RNA, 15 nt, Human adenovirus E
uaggaccaccaggaa

SEQ ID NO: 1573189 - RNA, 18 nt, Human adenovirus E
ccugugggaccugcugga

SEQ ID NO: 1573190 - RNA, 21 nt, Human adenovirus E
caaccaccccugccgcccugg

SEQ ID NO: 1573191 - RNA, 13 nt, Human adenovirus E
caggcagaggagg

SEQ ID NO: 1573192 - RNA, 20 nt, Human adenovirus E
gaugaugucauacuugagcu

SEQ ID NO: 1573193 - RNA, 19 nt, Human adenovirus E
cugaauaucaccgagcccg

SEQ ID NO: 1573194 - RNA, 19 nt, Human adenovirus E
agagcucugcaagcuccug

SEQ ID NO: 1573195 - RNA, 20 nt, Human adenovirus E
ucaaguggugcccccuccag

SEQ ID NO: 1573196 - RNA, 22 nt, Human adenovirus E
ccuuuagacagcagccccaggc

SEQ ID NO: 1573197 - RNA, 15 nt, Human adenovirus E
cucuucuacuuccuc

SEQ ID NO: 1573198 - RNA, 12 nt, Human adenovirus E
cccccggaacau

SEQ ID NO: 1573199 - RNA, 16 nt, Human adenovirus E
caggcucauccggcug

SEQ ID NO: 1573200 - RNA, 20 nt, Human adenovirus E
uccggggcagaagcacacag

SEQ ID NO: 1573201 - RNA, 16 nt, Human adenovirus E
cggcgacgaggccggc

SEQ ID NO: 1573202 - RNA, 15 nt, Human adenovirus E
cccgccccagcagca

SEQ ID NO: 1573203 - RNA, 20 nt, Human adenovirus E
cggaggaaggaaguccagag

SEQ ID NO: 1573204 - RNA, 14 nt, Human adenovirus E
acggaggccagcac

SEQ ID NO: 1573205 - RNA, 17 nt, Human adenovirus E
gaacgccugcugggccu

SEQ ID NO: 1573206 - RNA, 23 nt, Human adenovirus E
ggguggucuccgucacggugaag

SEQ ID NO: 1573207 - RNA, 22 nt, Human adenovirus E
acgugccccggggccaggagga

SEQ ID NO: 1573208 - RNA, 16 nt, Human adenovirus E
ucccaagaucuucgag

SEQ ID NO: 1573209 - RNA, 17 nt, Human adenovirus E
gacuccguggccuggag

SEQ ID NO: 1573210 - RNA, 22 nt, Human adenovirus E
ggguaaaucguucucuccagca

SEQ ID NO: 1573211 - RNA, 19 nt, Human adenovirus E
cgagcagaccuaccaggag

SEQ ID NO: 1573212 - RNA, 18 nt, Human adenovirus E
ucucagaccgugcagcag

SEQ ID NO: 1573213 - RNA, 17 nt, Human adenovirus E
accucgauuccucggga

SEQ ID NO: 1573214 - RNA, 21 nt, Human adenovirus E
gcagucaggcagaggaggagg

SEQ ID NO: 1573215 - RNA, 16 nt, Human adenovirus E
cggaucuucagccagc

SEQ ID NO: 1573216 - RNA, 23 nt, Human adenovirus E
ccuggaugccaucggcuccuagu

SEQ ID NO: 1573217 - RNA, 16 nt, Human adenovirus E
cugcccgccaccugcu

SEQ ID NO: 1573218 - RNA, 17 nt, Human adenovirus E
cgccaucgucuccugcu

SEQ ID NO: 1573219 - RNA, 14 nt, Human adenovirus E
uccacccucccagg

SEQ ID NO: 1573220 - RNA, 23 nt, Human adenovirus E
cugguguacaacgcgcugcugga

SEQ ID NO: 1573221 - RNA, 22 nt, Human adenovirus E
uaugcaauucugacaaugagga

SEQ ID NO: 1573222 - RNA, 15 nt, Human adenovirus E
gcggacgcgcgccgg

SEQ ID NO: 1573223 - RNA, 18 nt, Human adenovirus E
acgauguggacagcagcg

SEQ ID NO: 1573224 - RNA, 13 nt, Human adenovirus E
agcgccggcagga

SEQ ID NO: 1573225 - RNA, 15 nt, Human adenovirus E
ucagccagcguccga

SEQ ID NO: 1573226 - RNA, 15 nt, Human adenovirus E
gccguuccgcaccga

SEQ ID NO: 1573227 - RNA, 19 nt, Human adenovirus E
cuucgagggucugggcagc

SEQ ID NO: 1573228 - RNA, 17 nt, Human adenovirus E
ccgcgguaccuggcgcc

SEQ ID NO: 1573229 - RNA, 22 nt, Human adenovirus E
cuaacaaccaaacuaaccucca

SEQ ID NO: 1573230 - RNA, 12 nt, Human adenovirus E
ggcuugcagacc

SEQ ID NO: 1573231 - RNA, 12 nt, Human adenovirus E
acgccgcaccgc

SEQ ID NO: 1573232 - RNA, 16 nt, Human adenovirus E
aucgcccaggcaauuu

SEQ ID NO: 1573233 - RNA, 18 nt, Human adenovirus E
agggggucaucuugcagg

SEQ ID NO: 1573234 - RNA, 21 nt, Human adenovirus E
cgccaccugcuccgcgcugcc

SEQ ID NO: 1573235 - RNA, 15 nt, Human adenovirus E
cgcccaaggccgagc

SEQ ID NO: 1573236 - RNA, 20 nt, Human adenovirus E
gugaggucaucauaggccau

SEQ ID NO: 1573237 - RNA, 21 nt, Human adenovirus E
gccguccggcauuaacuccuc

SEQ ID NO: 1573238 - RNA, 18 nt, Human adenovirus E
accgccucggaccuggcc

SEQ ID NO: 1573239 - RNA, 14 nt, Human adenovirus E
gcuggaccacggca

SEQ ID NO: 1573240 - RNA, 13 nt, Human adenovirus E
cagaaguuucaug

SEQ ID NO: 1573241 - RNA, 19 nt, Human adenovirus E
caaguccuggcgggggcac

SEQ ID NO: 1573242 - RNA, 14 nt, Human adenovirus E
ccgcgcgugcagau

SEQ ID NO: 1573243 - RNA, 19 nt, Human adenovirus E
gugguccugggugagguca

SEQ ID NO: 1573244 - RNA, 19 nt, Human adenovirus E
acgucaccugcggcgugga

SEQ ID NO: 1573245 - RNA, 12 nt, Human adenovirus E
guggccuggagg

SEQ ID NO: 1573246 - RNA, 14 nt, Human adenovirus E
gcugaccaaccugg

SEQ ID NO: 1573247 - RNA, 21 nt, Human adenovirus E
gcgugccccccaagcgccagc

SEQ ID NO: 1573248 - RNA, 20 nt, Human adenovirus E
cagcagucaggcagaggagg

SEQ ID NO: 1573249 - RNA, 17 nt, Human adenovirus E
auucuuaucugccuccu

SEQ ID NO: 1573250 - RNA, 17 nt, Human adenovirus E
cauguuuucugccaaca

SEQ ID NO: 1573251 - RNA, 19 nt, Human adenovirus E
cccaugaucaagcccagca

SEQ ID NO: 1573252 - RNA, 16 nt, Human adenovirus E
acucgcagaaaaugau

SEQ ID NO: 1573253 - RNA, 18 nt, Human adenovirus E
ccacagcgucgcuccccg

SEQ ID NO: 1573254 - RNA, 19 nt, Human adenovirus E
uggagcgacaucggcacca

SEQ ID NO: 1573255 - RNA, 17 nt, Human adenovirus E
cuccuccaagucugugc

SEQ ID NO: 1573256 - RNA, 21 nt, Human adenovirus E
gcaugguguacuaugccuucu

SEQ ID NO: 1573257 - RNA, 22 nt, Human adenovirus E
gccuuagcuuugacaguacagg

SEQ ID NO: 1573258 - RNA, 16 nt, Human adenovirus E
acucagguguccagcu

SEQ ID NO: 1573259 - RNA, 19 nt, Human adenovirus E
gcgauguugagcugcacgu

SEQ ID NO: 1573260 - RNA, 16 nt, Human adenovirus E
aucacccucaagcugg

SEQ ID NO: 1573261 - RNA, 15 nt, Human adenovirus E
cagaacacgcugccc

SEQ ID NO: 1573262 - RNA, 18 nt, Human adenovirus E
accggguucgacgagcgc

SEQ ID NO: 1573263 - RNA, 17 nt, Human adenovirus E
gagggugccggacuggg

SEQ ID NO: 1573264 - RNA, 15 nt, Human adenovirus E
caggggcggcagggg

SEQ ID NO: 1573265 - RNA, 17 nt, Human adenovirus E
ugcuaccuauaccuccc

SEQ ID NO: 1573266 - RNA, 13 nt, Human adenovirus E
ggagaaccugcac

SEQ ID NO: 1573267 - RNA, 23 nt, Human adenovirus E
gauggcggcggcggcgaugcagc

SEQ ID NO: 1573268 - RNA, 15 nt, Human adenovirus E
gcccggguccaggcc

SEQ ID NO: 1573269 - RNA, 17 nt, Human adenovirus E
cggggccgggaccgagg

SEQ ID NO: 1573270 - RNA, 17 nt, Human adenovirus E
ggcgacuaccuccaccu

SEQ ID NO: 1573271 - RNA, 18 nt, Human adenovirus E
gcacaaaauucucaggug

SEQ ID NO: 1573272 - RNA, 21 nt, Human adenovirus E
agccgcgcccugggccaggac

SEQ ID NO: 1573273 - RNA, 13 nt, Human adenovirus E
cccacuccccuga

SEQ ID NO: 1573274 - RNA, 16 nt, Human adenovirus E
aggaacuggugcuuga

SEQ ID NO: 1573275 - RNA, 15 nt, Human adenovirus E
cugcacaccacccug

SEQ ID NO: 1573276 - RNA, 20 nt, Human adenovirus E
cagacggcggcaugcaaugg

SEQ ID NO: 1573277 - RNA, 14 nt, Human adenovirus E
cgggggucccggcc

SEQ ID NO: 1573278 - RNA, 23 nt, Human adenovirus E
gaggagcucagccgcgccuacga

SEQ ID NO: 1573279 - RNA, 23 nt, Human adenovirus E
augcuccaggucaucgcgccuga

SEQ ID NO: 1573280 - RNA, 12 nt, Human adenovirus E
gacucccaccug

SEQ ID NO: 1573281 - RNA, 14 nt, Human adenovirus E
ucuucgagggggaa

SEQ ID NO: 1573282 - RNA, 16 nt, Human adenovirus E
ccucugacccugccgc

SEQ ID NO: 1573283 - RNA, 13 nt, Human adenovirus E
guccgggcgcugc

SEQ ID NO: 1573284 - RNA, 16 nt, Human adenovirus E
gaucccugagcuccuc

SEQ ID NO: 1573285 - RNA, 15 nt, Human adenovirus E
cugcuucgcucggga

SEQ ID NO: 1573286 - RNA, 14 nt, Human adenovirus E
ggagcugaggaacc

SEQ ID NO: 1573287 - RNA, 23 nt, Human adenovirus E
ucucgauccagcagaccuccucg

SEQ ID NO: 1573288 - RNA, 19 nt, Human adenovirus E
ucgagggucugggcagcga

SEQ ID NO: 1573289 - RNA, 21 nt, Human adenovirus E
gcgcgaggaggugacccuggg

SEQ ID NO: 1573290 - RNA, 14 nt, Human adenovirus E
cgaaguccagcuga

SEQ ID NO: 1573291 - RNA, 17 nt, Human adenovirus E
gugccggacugggggac

SEQ ID NO: 1573292 - RNA, 19 nt, Human adenovirus E
caguggcagcggccgaggc

SEQ ID NO: 1573293 - RNA, 21 nt, Human adenovirus E
cucaggcuccucugauaagca

SEQ ID NO: 1573294 - RNA, 15 nt, Human adenovirus E
gcagaaaaaggcggg

SEQ ID NO: 1573295 - RNA, 18 nt, Human adenovirus E
guccgcgucagggugguc

SEQ ID NO: 1573296 - RNA, 17 nt, Human adenovirus E
cagcagucaggcagagg

SEQ ID NO: 1573297 - RNA, 13 nt, Human adenovirus E
gaguccagcgcgu

SEQ ID NO: 1573298 - RNA, 20 nt, Human adenovirus E
cuaccgucaccuccacagcc

SEQ ID NO: 1573299 - RNA, 17 nt, Human adenovirus E
ucuaauacuaccaccca

SEQ ID NO: 1573300 - RNA, 16 nt, Human adenovirus E
cauagcaggggcgcag

SEQ ID NO: 1573301 - RNA, 21 nt, Human adenovirus E
accaccggucucgaucauuga

SEQ ID NO: 1573302 - RNA, 22 nt, Human adenovirus E
gccgcaccgcucccuggccugc

SEQ ID NO: 1573303 - RNA, 21 nt, Human adenovirus E
cagccacagcgcgcacccggu

SEQ ID NO: 1573304 - RNA, 14 nt, Human adenovirus E
guuacgugcagcag

SEQ ID NO: 1573305 - RNA, 17 nt, Human adenovirus E
cccagccccgccaccuc

SEQ ID NO: 1573306 - RNA, 13 nt, Human adenovirus E
cugaaaacaccac

SEQ ID NO: 1573307 - RNA, 18 nt, Human adenovirus E
acuuccucaaacgcccaa

SEQ ID NO: 1573308 - RNA, 15 nt, Human adenovirus E
ccuccagaacacgcu

SEQ ID NO: 1573309 - RNA, 14 nt, Human adenovirus E
gucccccacccagu

SEQ ID NO: 1573310 - RNA, 19 nt, Human adenovirus E
cagucuggaggaagacgag

SEQ ID NO: 1573311 - RNA, 20 nt, Human adenovirus E
gcaugaaggggacgagcugc

SEQ ID NO: 1573312 - RNA, 23 nt, Human adenovirus E
gaucagccccgcgcgcgcgcacg

SEQ ID NO: 1573313 - RNA, 17 nt, Human adenovirus E
cgucaaggaugcgcugc

SEQ ID NO: 1573314 - RNA, 14 nt, Human adenovirus E
ggccuuggaggcgg

SEQ ID NO: 1573315 - RNA, 22 nt, Human adenovirus E
gccugcucgagugccacugccg

SEQ ID NO: 1573316 - RNA, 21 nt, Human adenovirus E
cggagauguuggagauggcga

SEQ ID NO: 1573317 - RNA, 16 nt, Human adenovirus E
ggcggcgcugcagagc

SEQ ID NO: 1573318 - RNA, 20 nt, Human adenovirus E
cacagaucugcaucucccag

SEQ ID NO: 1573319 - RNA, 21 nt, Human adenovirus E
gccagccccgauuaugcaggg

SEQ ID NO: 1573320 - RNA, 20 nt, Human adenovirus E
gcggcgauguugagcugcac

SEQ ID NO: 1573321 - RNA, 16 nt, Human adenovirus E
guggaauuugagcugc

SEQ ID NO: 1573322 - RNA, 14 nt, Human adenovirus E
guuccggagcagcu

SEQ ID NO: 1573323 - RNA, 21 nt, Human adenovirus E
ccccuccagaacacgcugccc

SEQ ID NO: 1573324 - RNA, 15 nt, Human adenovirus E
aaucaucauguuaca

SEQ ID NO: 1573325 - RNA, 20 nt, Human adenovirus E
caccgccgacgagaagcagc

SEQ ID NO: 1573326 - RNA, 23 nt, Human adenovirus E
acgugccccggggccaggaggac

SEQ ID NO: 1573327 - RNA, 14 nt, Human adenovirus E
aggaugcgagccga

SEQ ID NO: 1573328 - RNA, 20 nt, Human adenovirus E
ccggucccccacccaguccc

SEQ ID NO: 1573329 - RNA, 21 nt, Human adenovirus E
caaaagaaaaauccuccaggu

SEQ ID NO: 1573330 - RNA, 21 nt, Human adenovirus E
ggcaucucgauccagcagacc

SEQ ID NO: 1573331 - RNA, 13 nt, Human adenovirus E
aaaagcuuaucca

SEQ ID NO: 1573332 - RNA, 20 nt, Human adenovirus E
cagcaccgccccgcccgcca

SEQ ID NO: 1573333 - RNA, 17 nt, Human adenovirus E
cgaguuggaggagaugg

SEQ ID NO: 1573334 - RNA, 20 nt, Human adenovirus E
agcccaugaucaagcccagc

SEQ ID NO: 1573335 - RNA, 18 nt, Human adenovirus E
agaucguccagggcagcu

SEQ ID NO: 1573336 - RNA, 16 nt, Human adenovirus E
ggaaagguuggggcac

SEQ ID NO: 1573337 - RNA, 19 nt, Human adenovirus E
gcuguaguggugugcaugu

SEQ ID NO: 1573338 - RNA, 10 nt, Human adenovirus E
gauggugguc

SEQ ID NO: 1573339 - RNA, 15 nt, Human adenovirus E
cauuuuuccagccuu

SEQ ID NO: 1573340 - RNA, 14 nt, Human adenovirus E
gaagaaucgccagg

SEQ ID NO: 1573341 - RNA, 14 nt, Human adenovirus E
cugcuugcauuuca

SEQ ID NO: 1573342 - RNA, 19 nt, Human adenovirus E
cgggcacucccgcaucugc

SEQ ID NO: 1573343 - RNA, 19 nt, Human adenovirus E
ucaucaaguuucaaugugg

SEQ ID NO: 1573344 - RNA, 13 nt, Human adenovirus E
cagucccacugcu

SEQ ID NO: 1573345 - RNA, 23 nt, Human adenovirus E
gccuggaccgaaagagggugcug

SEQ ID NO: 1573346 - RNA, 16 nt, Human adenovirus E
ccgcuggaccacggca

SEQ ID NO: 1573347 - RNA, 14 nt, Human adenovirus E
cccucaaaggccgc

SEQ ID NO: 1573348 - RNA, 16 nt, Human adenovirus E
ccugcucguccucacu

SEQ ID NO: 1573349 - RNA, 15 nt, Human adenovirus E
cguccucggcgcugu

SEQ ID NO: 1573350 - RNA, 12 nt, Human adenovirus E
cucccucgguga

SEQ ID NO: 1573351 - RNA, 17 nt, Human adenovirus E
aucagcgccccgcaucc

SEQ ID NO: 1573352 - RNA, 13 nt, Human adenovirus E
uggaaacauaaag

SEQ ID NO: 1573353 - RNA, 16 nt, Human adenovirus E
caccggcggcggcgcg

SEQ ID NO: 1573354 - RNA, 20 nt, Human adenovirus E
ccucacagaucugcaucucc

SEQ ID NO: 1573355 - RNA, 15 nt, Human adenovirus E
caugcaagagaugga

SEQ ID NO: 1573356 - RNA, 19 nt, Human adenovirus E
cgcgccgcagugggcgcag

SEQ ID NO: 1573357 - RNA, 17 nt, Human adenovirus E
agcaggggcgcagggca

SEQ ID NO: 1573358 - RNA, 23 nt, Human adenovirus E
ccugggccugaugcaccuguggg

SEQ ID NO: 1573359 - RNA, 13 nt, Human adenovirus E
ccaccucagcuca

SEQ ID NO: 1573360 - RNA, 16 nt, Human adenovirus E
gccaacgccaguccag

SEQ ID NO: 1573361 - RNA, 17 nt, Human adenovirus E
gcgcggaccugcacugg

SEQ ID NO: 1573362 - RNA, 12 nt, Human adenovirus E
cggccgccguga

SEQ ID NO: 1573363 - RNA, 23 nt, Human adenovirus E
cuacacugacguaaaggccaaag

SEQ ID NO: 1573364 - RNA, 17 nt, Human adenovirus E
gaccgacgugcgcgagg

SEQ ID NO: 1573365 - RNA, 15 nt, Human adenovirus E
cggcggcagcaggug

SEQ ID NO: 1573366 - RNA, 12 nt, Human adenovirus E
gaggccagcacc

SEQ ID NO: 1573367 - RNA, 22 nt, Human adenovirus E
cgagggccugcucgagugccac

SEQ ID NO: 1573368 - RNA, 16 nt, Human adenovirus E
gcgagggggagcgcga

SEQ ID NO: 1573369 - RNA, 13 nt, Human adenovirus E
gucgcccagcgcc

SEQ ID NO: 1573370 - RNA, 13 nt, Human adenovirus E
augggcaccugga

SEQ ID NO: 1573371 - RNA, 19 nt, Human adenovirus E
aggcagaggaggacagccu

SEQ ID NO: 1573372 - RNA, 14 nt, Human adenovirus E
gauggcuggcagag

SEQ ID NO: 1573373 - RNA, 20 nt, Human adenovirus E
ccacccucuccccccgcaca

SEQ ID NO: 1573374 - RNA, 16 nt, Human adenovirus E
gggcccggaugcaggg

SEQ ID NO: 1573375 - RNA, 20 nt, Human adenovirus E
gggagcugcggcgcggccug

SEQ ID NO: 1573376 - RNA, 23 nt, Human adenovirus E
ucccggaggaggggggccaccuc

SEQ ID NO: 1573377 - RNA, 17 nt, Human adenovirus E
aguugagcgugguggcg

SEQ ID NO: 1573378 - RNA, 18 nt, Human adenovirus E
gcagucauaaucaucugc

SEQ ID NO: 1573379 - RNA, 19 nt, Human adenovirus E
cccccgggaguuccuccac

SEQ ID NO: 1573380 - RNA, 21 nt, Human adenovirus E
cgguggggccguagaugaccc

SEQ ID NO: 1573381 - RNA, 13 nt, Human adenovirus E
gugccgcgguccu

SEQ ID NO: 1573382 - RNA, 21 nt, Human adenovirus E
cgcgacggugucgagccugcu

SEQ ID NO: 1573383 - RNA, 18 nt, Human adenovirus E
ugcggaaccacagggcca

SEQ ID NO: 1573384 - RNA, 13 nt, Human adenovirus E
cgcugcagagcca

SEQ ID NO: 1573385 - RNA, 16 nt, Human adenovirus E
caccaacgccauccug

SEQ ID NO: 1573386 - RNA, 22 nt, Human adenovirus E
cuauucuuaucugccuccucca

SEQ ID NO: 1573387 - RNA, 15 nt, Human adenovirus E
ccgcaccgaggugcc

SEQ ID NO: 1573388 - RNA, 18 nt, Human adenovirus E
ucaaccccuucuccggcu

SEQ ID NO: 1573389 - RNA, 17 nt, Human adenovirus E
caccuccgacgcggccg

SEQ ID NO: 1573390 - RNA, 15 nt, Human adenovirus E
ugggguagcagcgcc

SEQ ID NO: 1573391 - RNA, 17 nt, Human adenovirus E
ucuuucauauccucucc

SEQ ID NO: 1573392 - RNA, 13 nt, Human adenovirus E
gucccuggcuccg

SEQ ID NO: 1573393 - RNA, 17 nt, Human adenovirus E
cccggcggcgcgugcag

SEQ ID NO: 1573394 - RNA, 19 nt, Human adenovirus E
cacagaucaaaccgcagca

SEQ ID NO: 1573395 - RNA, 16 nt, Human adenovirus E
ccauaggaccaccagg

SEQ ID NO: 1573396 - RNA, 22 nt, Human adenovirus E
ucauaguugugguccuggguga

SEQ ID NO: 1573397 - RNA, 21 nt, Human adenovirus E
cauagcuuaccgagcagcagc

SEQ ID NO: 1573398 - RNA, 15 nt, Human adenovirus E
gccgcuuccgcugcu

SEQ ID NO: 1573399 - RNA, 17 nt, Human adenovirus E
cugcucccagagcugga

SEQ ID NO: 1573400 - RNA, 18 nt, Human adenovirus E
gauccugcggaaccacag

SEQ ID NO: 1573401 - RNA, 22 nt, Human adenovirus E
gaacccguccugaucugcacgg

SEQ ID NO: 1573402 - RNA, 18 nt, Human adenovirus E
cgaggugccccagagcga

SEQ ID NO: 1573403 - RNA, 11 nt, Human adenovirus E
acagcagcccc

SEQ ID NO: 1573404 - RNA, 13 nt, Human adenovirus E
gugccccagggca

SEQ ID NO: 1573405 - RNA, 19 nt, Human adenovirus E
ggaccuggccaaccaggcc

SEQ ID NO: 1573406 - RNA, 16 nt, Human adenovirus E
gcacuggcagcccagc

SEQ ID NO: 1573407 - RNA, 20 nt, Human adenovirus E
gauacaccaagaacagccag

SEQ ID NO: 1573408 - RNA, 15 nt, Human adenovirus E
ucucgauccagcaga

SEQ ID NO: 1573409 - RNA, 16 nt, Human adenovirus E
cccagccccgccaccu

SEQ ID NO: 1573410 - RNA, 22 nt, Human adenovirus E
ccuggugaacauucugcagagc

SEQ ID NO: 1573411 - RNA, 19 nt, Human adenovirus E
caugacggcgacuaccucc

SEQ ID NO: 1573412 - RNA, 20 nt, Human adenovirus E
gcucaccgccacgccccgca

SEQ ID NO: 1573413 - RNA, 21 nt, Human adenovirus E
cccgugcgcgugcgcgggcac

SEQ ID NO: 1573414 - RNA, 15 nt, Human adenovirus E
ggggacgagcugcuu

SEQ ID NO: 1573415 - RNA, 19 nt, Human adenovirus E
gcaccacagggcaggcgcu

SEQ ID NO: 1573416 - RNA, 16 nt, Human adenovirus E
cuaccuggccuaccac

SEQ ID NO: 1573417 - RNA, 12 nt, Human adenovirus E
cccgcagcaguc

SEQ ID NO: 1573418 - RNA, 13 nt, Human adenovirus E
caucuccgaggac

SEQ ID NO: 1573419 - RNA, 16 nt, Human adenovirus E
uugccgaaggacccca

SEQ ID NO: 1573420 - RNA, 21 nt, Human adenovirus E
  misc_feature (8)..(8): n is a, c, g or u
aguccugnugagcggcccugc

SEQ ID NO: 1573421 - RNA, 17 nt, Human adenovirus E
gugucccugaccaugac

SEQ ID NO: 1573422 - RNA, 19 nt, Human adenovirus E
cuccugccgcgccaaccgc

SEQ ID NO: 1573423 - RNA, 18 nt, Human adenovirus E
gaagcaguaguacagaaa

SEQ ID NO: 1573424 - RNA, 17 nt, Human adenovirus E
cucuucuuccuccucca

SEQ ID NO: 1573425 - RNA, 16 nt, Human adenovirus E
auggaacuacagcagg

SEQ ID NO: 1573426 - RNA, 18 nt, Human adenovirus E
uccagggacucccucagc

SEQ ID NO: 1573427 - RNA, 22 nt, Human adenovirus E
acgggugaaugacauccgcgcc

SEQ ID NO: 1573428 - RNA, 17 nt, Human adenovirus E
ugaaggggacgagcugc

SEQ ID NO: 1573429 - RNA, 12 nt, Human adenovirus E
accgagcuccag

SEQ ID NO: 1573430 - RNA, 16 nt, Human adenovirus E
gcgaccagcgugcguu

SEQ ID NO: 1573431 - RNA, 15 nt, Human adenovirus E
cgccagggcuugcag

SEQ ID NO: 1573432 - RNA, 18 nt, Human adenovirus E
ccgugaccuugcagcagg

SEQ ID NO: 1573433 - RNA, 18 nt, Human adenovirus E
gugucgagccugcugacg

SEQ ID NO: 1573434 - RNA, 18 nt, Human adenovirus E
cacugucgagagccacac

SEQ ID NO: 1573435 - RNA, 17 nt, Human adenovirus E
cuuccucagcacccagc

SEQ ID NO: 1573436 - RNA, 16 nt, Human adenovirus E
ugauaucuuccagaua

SEQ ID NO: 1573437 - RNA, 19 nt, Human adenovirus E
ucauccucgaacgcuccgg

SEQ ID NO: 1573438 - RNA, 13 nt, Human adenovirus E
uccgucaagcugc

SEQ ID NO: 1573439 - RNA, 13 nt, Human adenovirus E
gagauggaggaag

SEQ ID NO: 1573440 - RNA, 12 nt, Human adenovirus E
cgggcggcaggg

SEQ ID NO: 1573441 - RNA, 17 nt, Human adenovirus E
accucauuuuccccgag

SEQ ID NO: 1573442 - RNA, 17 nt, Human adenovirus E
acccccgccgcggcgcc

SEQ ID NO: 1573443 - RNA, 14 nt, Human adenovirus E
uccaguucguggag

SEQ ID NO: 1573444 - RNA, 20 nt, Human adenovirus E
guuauuuuaaugaaucagau

SEQ ID NO: 1573445 - RNA, 17 nt, Human adenovirus E
cuggaagaagcagaaga

SEQ ID NO: 1573446 - RNA, 14 nt, Human adenovirus E
cgccaggccugcaa

SEQ ID NO: 1573447 - RNA, 17 nt, Human adenovirus E
ggucucccgcaagaccc

SEQ ID NO: 1573448 - RNA, 17 nt, Human adenovirus E
cacccgugcagccacag

SEQ ID NO: 1573449 - RNA, 14 nt, Human adenovirus E
gcaucagcuggaag

SEQ ID NO: 1573450 - RNA, 23 nt, Human adenovirus E
ggcauuaccccuacacaugauca

SEQ ID NO: 1573451 - RNA, 16 nt, Human adenovirus E
gcagccccggaugauc

SEQ ID NO: 1573452 - RNA, 19 nt, Human adenovirus E
ugcauguucauuuuugcuu

SEQ ID NO: 1573453 - RNA, 15 nt, Human adenovirus E
acaacaagcauggag

SEQ ID NO: 1573454 - RNA, 15 nt, Human adenovirus E
cguggugcaggagcg

SEQ ID NO: 1573455 - RNA, 12 nt, Human adenovirus E
cacaccuggcag

SEQ ID NO: 1573456 - RNA, 20 nt, Human adenovirus E
cagggauaggagcuccugga

SEQ ID NO: 1573457 - RNA, 20 nt, Human adenovirus E
guucagggaggcgcugcuga

SEQ ID NO: 1573458 - RNA, 22 nt, Human adenovirus E
ccucugggugaaggccacggga

SEQ ID NO: 1573459 - RNA, 15 nt, Human adenovirus E
ggcgacuaccuccac

SEQ ID NO: 1573460 - RNA, 16 nt, Human adenovirus E
ucagcgcacucucgag

SEQ ID NO: 1573461 - RNA, 19 nt, Human adenovirus E
agcgaccaggagcugaugc

SEQ ID NO: 1573462 - RNA, 13 nt, Human adenovirus E
ucuguugagcugg

SEQ ID NO: 1573463 - RNA, 24 nt, Human adenovirus E
ugcauguucauuuuugcuugcugc

SEQ ID NO: 1573464 - RNA, 14 nt, Human adenovirus E
cacaggcagcaaag

SEQ ID NO: 1573465 - RNA, 12 nt, Human adenovirus E
ugagggacgagg

SEQ ID NO: 1573466 - RNA, 20 nt, Human adenovirus E
gcaggggcggcucggggccc

SEQ ID NO: 1573467 - RNA, 15 nt, Human adenovirus E
acaacgcgcugcugg

SEQ ID NO: 1573468 - RNA, 23 nt, Human adenovirus E
cauucuacacuaaaaaaauacug

SEQ ID NO: 1573469 - RNA, 23 nt, Human adenovirus E
gccugcaagacagucuggaggaa

SEQ ID NO: 1573470 - RNA, 20 nt, Human adenovirus E
acccggugauaucuuccaga

SEQ ID NO: 1573471 - RNA, 20 nt, Human adenovirus E
cggggcuguggaccucggcc

SEQ ID NO: 1573472 - RNA, 22 nt, Human adenovirus E
cucugcacgccgcaccgcuccc

SEQ ID NO: 1573473 - RNA, 20 nt, Human adenovirus E
gcagaccuaccaggagauca

SEQ ID NO: 1573474 - RNA, 15 nt, Human adenovirus E
gggcagaagcacaca

SEQ ID NO: 1573475 - RNA, 13 nt, Human adenovirus E
agcaugagcacca

SEQ ID NO: 1573476 - RNA, 22 nt, Human adenovirus E
ccuggucggcguucauccccgg

SEQ ID NO: 1573477 - RNA, 19 nt, Human adenovirus E
cauaaucaucugcauguuc

SEQ ID NO: 1573478 - RNA, 22 nt, Human adenovirus E
ugaagcccacggccgccagcuc

SEQ ID NO: 1573479 - RNA, 20 nt, Human adenovirus E
gagcaucguggugcaggagc

SEQ ID NO: 1573480 - RNA, 17 nt, Human adenovirus E
cgagcccaacccgcgcc

SEQ ID NO: 1573481 - RNA, 16 nt, Human adenovirus E
cuucaacaaguacugc

SEQ ID NO: 1573482 - RNA, 22 nt, Human adenovirus E
agaugccuuucaagagccccuc

SEQ ID NO: 1573483 - RNA, 19 nt, Human adenovirus E
ucgucaaggaugcgcugcu

SEQ ID NO: 1573484 - RNA, 21 nt, Human adenovirus E
uaaccgccccgccgcccagcc

SEQ ID NO: 1573485 - RNA, 13 nt, Human adenovirus E
accguggugcaga

SEQ ID NO: 1573486 - RNA, 16 nt, Human adenovirus E
gaggaugcagcagcug

SEQ ID NO: 1573487 - RNA, 20 nt, Human adenovirus E
cugcgccaccacccccagua

SEQ ID NO: 1573488 - RNA, 17 nt, Human adenovirus E
agcuccucccucagcaa

SEQ ID NO: 1573489 - RNA, 13 nt, Human adenovirus E
ggcgcgggcggaa

SEQ ID NO: 1573490 - RNA, 19 nt, Human adenovirus E
cuucgcgauguugaugugu

SEQ ID NO: 1573491 - RNA, 17 nt, Human adenovirus E
ugcaagaguuccaggcg

SEQ ID NO: 1573492 - RNA, 14 nt, Human adenovirus E
cuggccaaccaggc

SEQ ID NO: 1573493 - RNA, 18 nt, Human adenovirus E
ccuggagcgacaucggca

SEQ ID NO: 1573494 - RNA, 18 nt, Human adenovirus E
augaauacacccccggaa

SEQ ID NO: 1573495 - RNA, 13 nt, Human adenovirus E
gcacgacaggcag

SEQ ID NO: 1573496 - RNA, 15 nt, Human adenovirus E
gagccacugcuaccu

SEQ ID NO: 1573497 - RNA, 19 nt, Human adenovirus E
agcgccggcaggacccgga

SEQ ID NO: 1573498 - RNA, 17 nt, Human adenovirus E
ugcucgaucuccuccuc

SEQ ID NO: 1573499 - RNA, 16 nt, Human adenovirus E
caccuccacagccccu

SEQ ID NO: 1573500 - RNA, 12 nt, Human adenovirus E
cggcggccuggg

SEQ ID NO: 1573501 - RNA, 14 nt, Human adenovirus E
gggacgcagggcca

SEQ ID NO: 1573502 - RNA, 23 nt, Human adenovirus E
guauggcaccagacgaugggcgu

SEQ ID NO: 1573503 - RNA, 14 nt, Human adenovirus E
cagugucuggagga

SEQ ID NO: 1573504 - RNA, 16 nt, Human adenovirus E
cauuugagcuggaggg

SEQ ID NO: 1573505 - RNA, 11 nt, Human adenovirus E
ucccacugcua

SEQ ID NO: 1573506 - RNA, 20 nt, Human adenovirus E
accucgacccccagaccggu

SEQ ID NO: 1573507 - RNA, 13 nt, Human adenovirus E
gcuguaguggugu

SEQ ID NO: 1573508 - RNA, 23 nt, Human adenovirus E
cggaacugguacuuggccagcca

SEQ ID NO: 1573509 - RNA, 22 nt, Human adenovirus E
gaagcccacggccgccagcucc

SEQ ID NO: 1573510 - RNA, 14 nt, Human adenovirus E
augaugcccacggc

SEQ ID NO: 1573511 - RNA, 12 nt, Human adenovirus E
cacgcuccagcc

SEQ ID NO: 1573512 - RNA, 14 nt, Human adenovirus E
cgugggcggcggcc

SEQ ID NO: 1573513 - RNA, 20 nt, Human adenovirus E
caaacucaugauggccgugg

SEQ ID NO: 1573514 - RNA, 20 nt, Human adenovirus E
ggcgccuucaauuggagcag

SEQ ID NO: 1573515 - RNA, 16 nt, Human adenovirus E
acuaccuggccuacca

SEQ ID NO: 1573516 - RNA, 14 nt, Human adenovirus E
cggucaccuuccgc

SEQ ID NO: 1573517 - RNA, 15 nt, Human adenovirus E
cuguugaugugaugg

SEQ ID NO: 1573518 - RNA, 13 nt, Human adenovirus E
cuccuccucggcc

SEQ ID NO: 1573519 - RNA, 18 nt, Human adenovirus E
ucugacgccucuggguga

SEQ ID NO: 1573520 - RNA, 12 nt, Human adenovirus E
uuuuuccuccac

SEQ ID NO: 1573521 - RNA, 14 nt, Human adenovirus E
guggagcuggagug

SEQ ID NO: 1573522 - RNA, 18 nt, Human adenovirus E
gcagcagcacacaacagg

SEQ ID NO: 1573523 - RNA, 20 nt, Human adenovirus E
gcacgaggaggagcuggcag

SEQ ID NO: 1573524 - RNA, 13 nt, Human adenovirus E
ggacguccagagc

SEQ ID NO: 1573525 - RNA, 23 nt, Human adenovirus E
uucgccuccuacgugcucuuugc

SEQ ID NO: 1573526 - RNA, 19 nt, Human adenovirus E
cgcgugcacgaagcccugc

SEQ ID NO: 1573527 - RNA, 15 nt, Human adenovirus E
agcugucggccugcg

SEQ ID NO: 1573528 - RNA, 18 nt, Human adenovirus E
gaauccccacuggcuccc

SEQ ID NO: 1573529 - RNA, 21 nt, Human adenovirus E
cuggggguauaggcagggaga

SEQ ID NO: 1573530 - RNA, 14 nt, Human adenovirus E
acugaauuuuuguc

SEQ ID NO: 1573531 - RNA, 15 nt, Human adenovirus E
gucguccccggagag

SEQ ID NO: 1573532 - RNA, 14 nt, Human adenovirus E
uaaguguugaauuu

SEQ ID NO: 1573533 - RNA, 13 nt, Human adenovirus E
gagacgaugggca

SEQ ID NO: 1573534 - RNA, 15 nt, Human adenovirus E
ggugcgacugggcuu

SEQ ID NO: 1573535 - RNA, 23 nt, Human adenovirus E
gucugcccgcaggcgggacagag

SEQ ID NO: 1573536 - RNA, 21 nt, Human adenovirus E
uggacguuuagagccucggga

SEQ ID NO: 1573537 - RNA, 23 nt, Human adenovirus E
gcggcacccgcgcgugcagauga

SEQ ID NO: 1573538 - RNA, 17 nt, Human adenovirus E
caaaaaguuugagguau

SEQ ID NO: 1573539 - RNA, 13 nt, Human adenovirus E
gcuccgcgcugcc

SEQ ID NO: 1573540 - RNA, 18 nt, Human adenovirus E
guaccaguccgggccgga

SEQ ID NO: 1573541 - RNA, 13 nt, Human adenovirus E
gauguugaagugg

SEQ ID NO: 1573542 - RNA, 13 nt, Human adenovirus E
cagucucuggagc

SEQ ID NO: 1573543 - RNA, 17 nt, Human adenovirus E
cagaaggggggcagggg

SEQ ID NO: 1573544 - RNA, 17 nt, Human adenovirus E
gguggggcggccagcug

SEQ ID NO: 1573545 - RNA, 18 nt, Human adenovirus E
gcuggcagagccccuucc

SEQ ID NO: 1573546 - RNA, 14 nt, Human adenovirus E
gcgugaugcagcag

SEQ ID NO: 1573547 - RNA, 17 nt, Human adenovirus E
ugagcuccucccucagc

SEQ ID NO: 1573548 - RNA, 22 nt, Human adenovirus E
uaugauugaaaaccaucacaga

SEQ ID NO: 1573549 - RNA, 20 nt, Human adenovirus E
gaucggguuggucauccugg

SEQ ID NO: 1573550 - RNA, 16 nt, Human adenovirus E
uacccggaggguccuc

SEQ ID NO: 1573551 - RNA, 19 nt, Human adenovirus E
cccagcagcaacuuccagc

SEQ ID NO: 1573552 - RNA, 20 nt, Human adenovirus E
gccgaacucgcgccugcugc

SEQ ID NO: 1573553 - RNA, 21 nt, Human adenovirus E
gugcaggagcgcgggcugccg

SEQ ID NO: 1573554 - RNA, 17 nt, Human adenovirus E
gcagaccuaccaggaga

SEQ ID NO: 1573555 - RNA, 20 nt, Human adenovirus E
cagggucucaaagcuccgcu

SEQ ID NO: 1573556 - RNA, 21 nt, Human adenovirus E
ccugugggaccugcuggaggc

SEQ ID NO: 1573557 - RNA, 13 nt, Human adenovirus E
gcgggaggcaggu

SEQ ID NO: 1573558 - RNA, 18 nt, Human adenovirus E
caagaagaggcagcagca

SEQ ID NO: 1573559 - RNA, 13 nt, Human adenovirus E
cucagcaccgagg

SEQ ID NO: 1573560 - RNA, 18 nt, Human adenovirus E
acaccgccuaccgcagcu

SEQ ID NO: 1573561 - RNA, 23 nt, Human adenovirus E
cccagucauagcaggggcgcagg

SEQ ID NO: 1573562 - RNA, 17 nt, Human adenovirus E
gcaucuggcccggcagg

SEQ ID NO: 1573563 - RNA, 18 nt, Human adenovirus E
cccgcgcugauccccauc

SEQ ID NO: 1573564 - RNA, 19 nt, Human adenovirus E
cgugcagaaccccaccagc

SEQ ID NO: 1573565 - RNA, 22 nt, Human adenovirus E
acagaguuaugaucaccagcug

SEQ ID NO: 1573566 - RNA, 19 nt, Human adenovirus E
uggccgccggugccgccca

SEQ ID NO: 1573567 - RNA, 14 nt, Human adenovirus E
cagggacucccuca

SEQ ID NO: 1573568 - RNA, 19 nt, Human adenovirus E
ggagccuuguugcgcaggg

SEQ ID NO: 1573569 - RNA, 14 nt, Human adenovirus E
aagcccggguccag

SEQ ID NO: 1573570 - RNA, 22 nt, Human adenovirus E
uaccaggaaauuccccagccca

SEQ ID NO: 1573571 - RNA, 15 nt, Human adenovirus E
accugcaucugcugc

SEQ ID NO: 1573572 - RNA, 22 nt, Human adenovirus E
cggugugccgcgguccuccucg

SEQ ID NO: 1573573 - RNA, 12 nt, Human adenovirus E
ggcuggcagagc

SEQ ID NO: 1573574 - RNA, 22 nt, Human adenovirus E
accgcccagaucccgccugggg

SEQ ID NO: 1573575 - RNA, 13 nt, Human adenovirus E
ccgagcagcagca

SEQ ID NO: 1573576 - RNA, 19 nt, Human adenovirus E
gcacucaacccaccccacc

SEQ ID NO: 1573577 - RNA, 20 nt, Human adenovirus E
gccccuacgucuacaaggcc

SEQ ID NO: 1573578 - RNA, 16 nt, Human adenovirus E
ucgcagaaaaugaugc

SEQ ID NO: 1573579 - RNA, 17 nt, Human adenovirus E
cgcagggggccacgagc

SEQ ID NO: 1573580 - RNA, 13 nt, Human adenovirus E
ccgccagcuccuc

SEQ ID NO: 1573581 - RNA, 14 nt, Human adenovirus E
ugcaucucuucagc

SEQ ID NO: 1573582 - RNA, 14 nt, Human adenovirus E
cagcagccccaggc

SEQ ID NO: 1573583 - RNA, 17 nt, Human adenovirus E
ugggccuuuggaagaug

SEQ ID NO: 1573584 - RNA, 13 nt, Human adenovirus E
cagcucaacagcu

SEQ ID NO: 1573585 - RNA, 16 nt, Human adenovirus E
ucucaucaaguuucaa

SEQ ID NO: 1573586 - RNA, 16 nt, Human adenovirus E
gggcccagguuggugc

SEQ ID NO: 1573587 - RNA, 17 nt, Human adenovirus E
augcgucgccaccacca

SEQ ID NO: 1573588 - RNA, 16 nt, Human adenovirus E
ccugcuggaggccauc

SEQ ID NO: 1573589 - RNA, 20 nt, Human adenovirus E
gcacgagaagguccuggcca

SEQ ID NO: 1573590 - RNA, 22 nt, Human adenovirus E
ccgccuaccugauaucgccucc

SEQ ID NO: 1573591 - RNA, 17 nt, Human adenovirus E
ucgcuauucgccccaga

SEQ ID NO: 1573592 - RNA, 13 nt, Human adenovirus E
caccugcagcaga

SEQ ID NO: 1573593 - RNA, 15 nt, Human adenovirus E
cagggaggcgcugcu

SEQ ID NO: 1573594 - RNA, 18 nt, Human adenovirus E
cugcucgagugccacugc

SEQ ID NO: 1573595 - RNA, 14 nt, Human adenovirus E
ccacuacagccuag

SEQ ID NO: 1573596 - RNA, 22 nt, Human adenovirus E
caucgucaaggaugcgcugcuc

SEQ ID NO: 1573597 - RNA, 19 nt, Human adenovirus E
aacaguauccgcagcagcg

SEQ ID NO: 1573598 - RNA, 15 nt, Human adenovirus E
ucgcccgucucucag

SEQ ID NO: 1573599 - RNA, 15 nt, Human adenovirus E
gcgccaucagcaagc

SEQ ID NO: 1573600 - RNA, 22 nt, Human adenovirus E
cacagcggcggcagcaggugga

SEQ ID NO: 1573601 - RNA, 11 nt, Human adenovirus E
guccaggccag

SEQ ID NO: 1573602 - RNA, 15 nt, Human adenovirus E
gcgcugcccucggac

SEQ ID NO: 1573603 - RNA, 16 nt, Human adenovirus E
ccggcucccccggcca

SEQ ID NO: 1573604 - RNA, 12 nt, Human adenovirus E
ggcgcgcaggcc

SEQ ID NO: 1573605 - RNA, 17 nt, Human adenovirus E
uccacgagcgccagcug

SEQ ID NO: 1573606 - RNA, 18 nt, Human adenovirus E
gggcacgcacccgggcuu

SEQ ID NO: 1573607 - RNA, 16 nt, Human adenovirus E
gccgucgccgcaccgc

SEQ ID NO: 1573608 - RNA, 15 nt, Human adenovirus E
ggcuggcggugcuca

SEQ ID NO: 1573609 - RNA, 19 nt, Human adenovirus E
cagagcgcccuccaccggc

SEQ ID NO: 1573610 - RNA, 20 nt, Human adenovirus E
gguggacuucaccgagagcc

SEQ ID NO: 1573611 - RNA, 14 nt, Human adenovirus E
cguaggccugggcg

SEQ ID NO: 1573612 - RNA, 14 nt, Human adenovirus E
acuccccugaagca

SEQ ID NO: 1573613 - RNA, 18 nt, Human adenovirus E
agcucggcgaugguggcg

SEQ ID NO: 1573614 - RNA, 18 nt, Human adenovirus E
gagccaggugaggucggg

SEQ ID NO: 1573615 - RNA, 19 nt, Human adenovirus E
cugggucccggcgcccgcc

SEQ ID NO: 1573616 - RNA, 20 nt, Human adenovirus E
aucaaaacacgacuuucaaa

SEQ ID NO: 1573617 - RNA, 18 nt, Human adenovirus E
ucagcaucaucugggccu

SEQ ID NO: 1573618 - RNA, 14 nt, Human adenovirus E
cagcaauaacugua

SEQ ID NO: 1573619 - RNA, 15 nt, Human adenovirus E
uaccgagcagcagca

SEQ ID NO: 1573620 - RNA, 10 nt, Human adenovirus E
cgcccagccc

SEQ ID NO: 1573621 - RNA, 15 nt, Human adenovirus E
ucgacgagcgcacca

SEQ ID NO: 1573622 - RNA, 15 nt, Human adenovirus E
uaggacguccagagc

SEQ ID NO: 1573623 - RNA, 15 nt, Human adenovirus E
ggucccggccggggg

SEQ ID NO: 1573624 - RNA, 14 nt, Human adenovirus E
ggccaaccaggccg

SEQ ID NO: 1573625 - RNA, 19 nt, Human adenovirus E
gacggcgcagcuguuccug

SEQ ID NO: 1573626 - RNA, 16 nt, Human adenovirus E
ccagacgcgcggcuuc

SEQ ID NO: 1573627 - RNA, 15 nt, Human adenovirus E
agcucgacgagccgg

SEQ ID NO: 1573628 - RNA, 18 nt, Human adenovirus E
ugagccgcgcccugggcc

SEQ ID NO: 1573629 - RNA, 15 nt, Human adenovirus E
gaucaccagcuggcc

SEQ ID NO: 1573630 - RNA, 18 nt, Human adenovirus E
ggaucuucagccagcguc

SEQ ID NO: 1573631 - RNA, 15 nt, Human adenovirus E
gcaagacccggucac

SEQ ID NO: 1573632 - RNA, 14 nt, Human adenovirus E
cgcgcuccacggug

SEQ ID NO: 1573633 - RNA, 24 nt, Human adenovirus E
cacagcaaccucaggcacacgcac

SEQ ID NO: 1573634 - RNA, 12 nt, Human adenovirus E
cuacuuccuccu

SEQ ID NO: 1573635 - RNA, 18 nt, Human adenovirus E
agagacagcugccguccu

SEQ ID NO: 1573636 - RNA, 13 nt, Human adenovirus E
ucgcgccugcugc

SEQ ID NO: 1573637 - RNA, 20 nt, Human adenovirus E
cuaccaauaacauuuuugcc

SEQ ID NO: 1573638 - RNA, 14 nt, Human adenovirus E
guggaccucggccu

SEQ ID NO: 1573639 - RNA, 20 nt, Human adenovirus E
ugcagcgaagagaccccggg

SEQ ID NO: 1573640 - RNA, 20 nt, Human adenovirus E
gcccagccccgccaccuccg

SEQ ID NO: 1573641 - RNA, 23 nt, Human adenovirus E
auccaucgagauugaccugggcu

SEQ ID NO: 1573642 - RNA, 19 nt, Human adenovirus E
cgccugcugggccuuggcu

SEQ ID NO: 1573643 - RNA, 17 nt, Human adenovirus E
aggugacccugggccug

SEQ ID NO: 1573644 - RNA, 13 nt, Human adenovirus E
gcccguggaggau

SEQ ID NO: 1573645 - RNA, 14 nt, Human adenovirus E
guacugcggcagau

SEQ ID NO: 1573646 - RNA, 22 nt, Human adenovirus E
agaucuucgagggucugggcag

SEQ ID NO: 1573647 - RNA, 17 nt, Human adenovirus E
cgcagcagcgagcuggg

SEQ ID NO: 1573648 - RNA, 21 nt, Human adenovirus E
cugacuaacucagguguccag

SEQ ID NO: 1573649 - RNA, 22 nt, Human adenovirus E
ucauccaugaugauggcgaugg

SEQ ID NO: 1573650 - RNA, 19 nt, Human adenovirus E
cuggacaaaauaccaccuc

SEQ ID NO: 1573651 - RNA, 23 nt, Human adenovirus E
cucccgccugaaccugacacacc

SEQ ID NO: 1573652 - RNA, 14 nt, Human adenovirus E
agcaguaguacaga

SEQ ID NO: 1573653 - RNA, 16 nt, Human adenovirus E
cagaggaggaggugga

SEQ ID NO: 1573654 - RNA, 17 nt, Human adenovirus E
aguuucuugagcuccuc

SEQ ID NO: 1573655 - RNA, 17 nt, Human adenovirus E
aggagcuccuggagcga

SEQ ID NO: 1573656 - RNA, 17 nt, Human adenovirus E
guagguauucccucucg

SEQ ID NO: 1573657 - RNA, 17 nt, Human adenovirus E
ccgagucgcggaugaag

SEQ ID NO: 1573658 - RNA, 14 nt, Human adenovirus E
ccuucaccaccugc

SEQ ID NO: 1573659 - RNA, 14 nt, Human adenovirus E
aacccuuccucccc

SEQ ID NO: 1573660 - RNA, 13 nt, Human adenovirus E
ucucgauccagca

SEQ ID NO: 1573661 - RNA, 17 nt, Human adenovirus E
agcagagaaugagcaga

SEQ ID NO: 1573662 - RNA, 20 nt, Human adenovirus E
cugaacaguauccgcagcag

SEQ ID NO: 1573663 - RNA, 18 nt, Human adenovirus E
cgagcaaggacagacccu

SEQ ID NO: 1573664 - RNA, 22 nt, Human adenovirus E
cgggggcguaggcguccgcgcc

SEQ ID NO: 1573665 - RNA, 22 nt, Human adenovirus E
cugaccggggccgggaccgagg

SEQ ID NO: 1573666 - RNA, 14 nt, Human adenovirus E
cugcacuggcagcc

SEQ ID NO: 1573667 - RNA, 20 nt, Human adenovirus E
cgugggcggcggccugggca

SEQ ID NO: 1573668 - RNA, 23 nt, Human adenovirus E
cggcauugcuuccguggcggugc

SEQ ID NO: 1573669 - RNA, 23 nt, Human adenovirus E
aggaggagauggaggaagacugg

SEQ ID NO: 1573670 - RNA, 21 nt, Human adenovirus E
cgccucagcaaccugcugggc

SEQ ID NO: 1573671 - RNA, 15 nt, Human adenovirus E
ugcgggcggcgcugc

SEQ ID NO: 1573672 - RNA, 14 nt, Human adenovirus E
ccgcccguggagga

SEQ ID NO: 1573673 - RNA, 20 nt, Human adenovirus E
cgauguaggugggguagcag

SEQ ID NO: 1573674 - RNA, 15 nt, Human adenovirus E
cagccgaaacucauc

SEQ ID NO: 1573675 - RNA, 19 nt, Human adenovirus E
ugcuagugaaggucagcgg

SEQ ID NO: 1573676 - RNA, 15 nt, Human adenovirus E
gacgcugcucaccac

SEQ ID NO: 1573677 - RNA, 12 nt, Human adenovirus E
ccacccagaccg

SEQ ID NO: 1573678 - RNA, 16 nt, Human adenovirus E
guagaagagguggacg

SEQ ID NO: 1573679 - RNA, 16 nt, Human adenovirus E
gcccgugaggcgcgcg

SEQ ID NO: 1573680 - RNA, 20 nt, Human adenovirus E
cucaaugguacugaugacag

SEQ ID NO: 1573681 - RNA, 16 nt, Human adenovirus E
cuucagcgcgcgcugc

SEQ ID NO: 1573682 - RNA, 21 nt, Human adenovirus E
cgcaccaguuccgccaggagg

SEQ ID NO: 1573683 - RNA, 20 nt, Human adenovirus E
gggcgccgagcuccugcccg

SEQ ID NO: 1573684 - RNA, 18 nt, Human adenovirus E
cucaggcugacgcugcgc

SEQ ID NO: 1573685 - RNA, 22 nt, Human adenovirus E
gcagggugaugagguccacacu

SEQ ID NO: 1573686 - RNA, 12 nt, Human adenovirus E
ugcgcagggcca

SEQ ID NO: 1573687 - RNA, 15 nt, Human adenovirus E
gagcgcgggcugccg

SEQ ID NO: 1573688 - RNA, 24 nt, Human adenovirus E
gagcccgaggagaugcgcgcggcc

SEQ ID NO: 1573689 - RNA, 15 nt, Human adenovirus E
ccgucggccaugggc

SEQ ID NO: 1573690 - RNA, 21 nt, Human adenovirus E
gcuuaccgagcagcagcacac

SEQ ID NO: 1573691 - RNA, 12 nt, Human adenovirus E
cgggggcggugc

SEQ ID NO: 1573692 - RNA, 23 nt, Human adenovirus E
cggccagcugaaaaccaucaugc

SEQ ID NO: 1573693 - RNA, 18 nt, Human adenovirus E
cgacgagcgcaccaccgc

SEQ ID NO: 1573694 - RNA, 19 nt, Human adenovirus E
cauggaauacaccacccuc

SEQ ID NO: 1573695 - RNA, 17 nt, Human adenovirus E
ugcagggcgcccagcag

SEQ ID NO: 1573696 - RNA, 16 nt, Human adenovirus E
aggacguccagagcgc

SEQ ID NO: 1573697 - RNA, 19 nt, Human adenovirus E
ggcgugccccagggcaugg

SEQ ID NO: 1573698 - RNA, 15 nt, Human adenovirus E
accugacacaccacc

SEQ ID NO: 1573699 - RNA, 21 nt, Human adenovirus E
aacccguucgcucaccugcgc

SEQ ID NO: 1573700 - RNA, 15 nt, Human adenovirus E
ucacaccuuccaccu

SEQ ID NO: 1573701 - RNA, 23 nt, Human adenovirus E
acgcccgcggagcacgaggagga

SEQ ID NO: 1573702 - RNA, 16 nt, Human adenovirus E
cagccugcugaugccc

SEQ ID NO: 1573703 - RNA, 13 nt, Human adenovirus E
uaccuuuggaagu

SEQ ID NO: 1573704 - RNA, 19 nt, Human adenovirus E
ugacacuacagaaacugaa

SEQ ID NO: 1573705 - RNA, 19 nt, Human adenovirus E
cacuuccgcgcucccuggg

SEQ ID NO: 1573706 - RNA, 17 nt, Human adenovirus E
cuacaaugcucagucuc

SEQ ID NO: 1573707 - RNA, 15 nt, Human adenovirus E
ugcccgaggcccugg

SEQ ID NO: 1573708 - RNA, 11 nt, Human adenovirus E
cagcacaggca

SEQ ID NO: 1573709 - RNA, 14 nt, Human adenovirus E
ugacagcaacagua

SEQ ID NO: 1573710 - RNA, 19 nt, Human adenovirus E
uccagagauccacggccag

SEQ ID NO: 1573711 - RNA, 21 nt, Human adenovirus E
cgcgcucagcaccgaggagga

SEQ ID NO: 1573712 - RNA, 22 nt, Human adenovirus E
gcuggccuuggaagagggcgag

SEQ ID NO: 1573713 - RNA, 23 nt, Human adenovirus E
ccccggagaguuucaugaccagc

SEQ ID NO: 1573714 - RNA, 15 nt, Human adenovirus E
uggcacgacaggcag

SEQ ID NO: 1573715 - RNA, 16 nt, Human adenovirus E
agaccggugaggagcu

SEQ ID NO: 1573716 - RNA, 20 nt, Human adenovirus E
gccuucaccaccugcaucug

SEQ ID NO: 1573717 - RNA, 15 nt, Human adenovirus E
gcaagaggcagcccu

SEQ ID NO: 1573718 - RNA, 19 nt, Human adenovirus E
cuauguuggcacagcacag

SEQ ID NO: 1573719 - RNA, 23 nt, Human adenovirus E
cgccaacgugccccggggccagg

SEQ ID NO: 1573720 - RNA, 12 nt, Human adenovirus E
acguccugcagg

SEQ ID NO: 1573721 - RNA, 13 nt, Human adenovirus E
agcgcguggcccg

SEQ ID NO: 1573722 - RNA, 19 nt, Human adenovirus E
ccguugggcagggagaggg

SEQ ID NO: 1573723 - RNA, 14 nt, Human adenovirus E
cccagcgccgcgcu

SEQ ID NO: 1573724 - RNA, 22 nt, Human adenovirus E
accacccgguuguaccuggugg

SEQ ID NO: 1573725 - RNA, 19 nt, Human adenovirus E
aggagauggugggccuuug

SEQ ID NO: 1573726 - RNA, 14 nt, Human adenovirus E
guaccagauccuca

SEQ ID NO: 1573727 - RNA, 17 nt, Human adenovirus E
gaacaugcagccccgga

SEQ ID NO: 1573728 - RNA, 15 nt, Human adenovirus E
cugacggcgcagcug

SEQ ID NO: 1573729 - RNA, 12 nt, Human adenovirus E
guugcgcagggc

SEQ ID NO: 1573730 - RNA, 19 nt, Human adenovirus E
cgcccagccccgccaccuc

SEQ ID NO: 1573731 - RNA, 13 nt, Human adenovirus E
gaaccccaccacc

SEQ ID NO: 1573732 - RNA, 15 nt, Human adenovirus E
gccugcaucucgugc

SEQ ID NO: 1573733 - RNA, 15 nt, Human adenovirus E
agcccagcaccagca

SEQ ID NO: 1573734 - RNA, 13 nt, Human adenovirus E
ggccaggcgcacg

SEQ ID NO: 1573735 - RNA, 16 nt, Human adenovirus E
cagaccgagcccauga

SEQ ID NO: 1573736 - RNA, 14 nt, Human adenovirus E
ggaaggugauuggc

SEQ ID NO: 1573737 - RNA, 13 nt, Human adenovirus E
acugaugacagca

SEQ ID NO: 1573738 - RNA, 17 nt, Human adenovirus E
uggccgugguccuggug

SEQ ID NO: 1573739 - RNA, 19 nt, Human adenovirus E
gcaucaggccccgcagcag

SEQ ID NO: 1573740 - RNA, 23 nt, Human adenovirus E
  misc_feature (9)..(9): n is a, c, g or u
ugccaaccnuacuuuuuccaccc

SEQ ID NO: 1573741 - RNA, 21 nt, Human adenovirus E
cauagucugcagcgggcccug

SEQ ID NO: 1573742 - RNA, 16 nt, Human adenovirus E
cugaauaucaccgagc

SEQ ID NO: 1573743 - RNA, 14 nt, Human adenovirus E
caagcgccgcagca

SEQ ID NO: 1573744 - RNA, 18 nt, Human adenovirus E
caucaggccccgcagcag

SEQ ID NO: 1573745 - RNA, 19 nt, Human adenovirus E
ugcugaaaacaccaccugg

SEQ ID NO: 1573746 - RNA, 11 nt, Human adenovirus E
acaaaaaugaa

SEQ ID NO: 1573747 - RNA, 15 nt, Human adenovirus E
cagcccgccaacgug

SEQ ID NO: 1573748 - RNA, 14 nt, Human adenovirus E
cgugcacgcagcag

SEQ ID NO: 1573749 - RNA, 18 nt, Human adenovirus E
cagguucuacgaggacca

SEQ ID NO: 1573750 - RNA, 13 nt, Human adenovirus E
ggcccuggccacc

SEQ ID NO: 1573751 - RNA, 14 nt, Human adenovirus E
gcaccgccgcugca

SEQ ID NO: 1573752 - RNA, 16 nt, Human adenovirus E
gauaggagcuccugga

SEQ ID NO: 1573753 - RNA, 15 nt, Human adenovirus E
agaucaacagccgcc

SEQ ID NO: 1573754 - RNA, 16 nt, Human adenovirus E
aaguggagcugccgcc

SEQ ID NO: 1573755 - RNA, 17 nt, Human adenovirus E
guggcagcggccgaggc

SEQ ID NO: 1573756 - RNA, 13 nt, Human adenovirus E
acaguauccgcag

SEQ ID NO: 1573757 - RNA, 21 nt, Human adenovirus E
cguuccugcucucacagauca

SEQ ID NO: 1573758 - RNA, 17 nt, Human adenovirus E
ggacgauuggacccagg

SEQ ID NO: 1573759 - RNA, 15 nt, Human adenovirus E
cacaucguaggugag

SEQ ID NO: 1573760 - RNA, 18 nt, Human adenovirus E
acgucgagguccucggcg

SEQ ID NO: 1573761 - RNA, 18 nt, Human adenovirus E
accugcugcgccuggcca

SEQ ID NO: 1573762 - RNA, 21 nt, Human adenovirus E
agcgcgggucucggucuccuc

SEQ ID NO: 1573763 - RNA, 22 nt, Human adenovirus E
cuccugccgcgccaaccgcacc

SEQ ID NO: 1573764 - RNA, 16 nt, Human adenovirus E
cgcucgcgguggggcg

SEQ ID NO: 1573765 - RNA, 15 nt, Human adenovirus E
uaccugcgccaccac

SEQ ID NO: 1573766 - RNA, 14 nt, Human adenovirus E
agggucugggcagc

SEQ ID NO: 1573767 - RNA, 16 nt, Human adenovirus E
ggcauuguuuuuugca

SEQ ID NO: 1573768 - RNA, 21 nt, Human adenovirus E
gugccccucagcguggaggag

SEQ ID NO: 1573769 - RNA, 14 nt, Human adenovirus E
agcggccaucgcca

SEQ ID NO: 1573770 - RNA, 17 nt, Human adenovirus E
gaccccauagccagccg

SEQ ID NO: 1573771 - RNA, 20 nt, Human adenovirus E
ccgggccuuggaggcggcgg

SEQ ID NO: 1573772 - RNA, 14 nt, Human adenovirus E
agcgcgcgcugccc

SEQ ID NO: 1573773 - RNA, 21 nt, Human adenovirus E
aguugcagggcgcccagcagg

SEQ ID NO: 1573774 - RNA, 19 nt, Human adenovirus E
ugcccaacgugaacgaguu

SEQ ID NO: 1573775 - RNA, 19 nt, Human adenovirus E
gucuaccucuaccucugcc

SEQ ID NO: 1573776 - RNA, 23 nt, Human adenovirus E
agcacccccgccaugcgcgcggc

SEQ ID NO: 1573777 - RNA, 13 nt, Human adenovirus E
ucggcgggggaga

SEQ ID NO: 1573778 - RNA, 15 nt, Human adenovirus E
cugcaacccccagcu

SEQ ID NO: 1573779 - RNA, 20 nt, Human adenovirus E
ugggccuguuccugaugcag

SEQ ID NO: 1573780 - RNA, 12 nt, Human adenovirus E
gucccacugcua

SEQ ID NO: 1573781 - RNA, 14 nt, Human adenovirus E
ggccugggcggccu

SEQ ID NO: 1573782 - RNA, 20 nt, Human adenovirus E
caaucccauccgcccaaggc

SEQ ID NO: 1573783 - RNA, 14 nt, Human adenovirus E
gaaguccgugcgcu

SEQ ID NO: 1573784 - RNA, 17 nt, Human adenovirus E
agggucucaaagcuccg

SEQ ID NO: 1573785 - RNA, 13 nt, Human adenovirus E
gaugcgcgcggcc

SEQ ID NO: 1573786 - RNA, 19 nt, Human adenovirus E
gacgccgccaccggugugc

SEQ ID NO: 1573787 - RNA, 16 nt, Human adenovirus E
ugcaagaguuccaggc

SEQ ID NO: 1573788 - RNA, 20 nt, Human adenovirus E
cuuuugguucucugcuaccu

SEQ ID NO: 1573789 - RNA, 23 nt, Human adenovirus E
agacagcugccguccucccggag

SEQ ID NO: 1573790 - RNA, 18 nt, Human adenovirus E
gcagggagagggcgcuga

SEQ ID NO: 1573791 - RNA, 17 nt, Human adenovirus E
caacuccuccuccagaa

SEQ ID NO: 1573792 - RNA, 13 nt, Human adenovirus E
ugaugcaggaggg

SEQ ID NO: 1573793 - RNA, 15 nt, Human adenovirus E
agggggccaccccca

SEQ ID NO: 1573794 - RNA, 19 nt, Human adenovirus E
gcggcgguacaccucgccc

SEQ ID NO: 1573795 - RNA, 24 nt, Human adenovirus E
cccggcgucgugcacgcagcagcg

SEQ ID NO: 1573796 - RNA, 18 nt, Human adenovirus E
cgaggaggagcuggcagu

SEQ ID NO: 1573797 - RNA, 15 nt, Human adenovirus E
ucucaucaaguuuca

SEQ ID NO: 1573798 - RNA, 12 nt, Human adenovirus E
ccagauccucag

SEQ ID NO: 1573799 - RNA, 14 nt, Human adenovirus E
gcggugccucuucc

SEQ ID NO: 1573800 - RNA, 18 nt, Human adenovirus E
ggccuuguaggcgcagca

SEQ ID NO: 1573801 - RNA, 14 nt, Human adenovirus E
cgugcguacccgga

SEQ ID NO: 1573802 - RNA, 14 nt, Human adenovirus E
cgugcucgggggug

SEQ ID NO: 1573803 - RNA, 17 nt, Human adenovirus E
ccugcugcgccuggcca

SEQ ID NO: 1573804 - RNA, 21 nt, Human adenovirus E
gcucaucaagcaucuggcccg

SEQ ID NO: 1573805 - RNA, 12 nt, Human adenovirus E
gcuccgcuugcc

SEQ ID NO: 1573806 - RNA, 22 nt, Human adenovirus E
cccuucuccggcucccccggcc

SEQ ID NO: 1573807 - RNA, 22 nt, Human adenovirus E
caccaaggccgccgccccucuc

SEQ ID NO: 1573808 - RNA, 21 nt, Human adenovirus E
cucgcgguggggcggccagcu

SEQ ID NO: 1573809 - RNA, 17 nt, Human adenovirus E
cccggcaggccaccauc

SEQ ID NO: 1573810 - RNA, 17 nt, Human adenovirus E
agaccgagcuccagcuc

SEQ ID NO: 1573811 - RNA, 18 nt, Human adenovirus E
gcacucccgcaucugcac

SEQ ID NO: 1573812 - RNA, 18 nt, Human adenovirus E
gacagcacucaggcagag

SEQ ID NO: 1573813 - RNA, 18 nt, Human adenovirus E
gcaaacccgggagcugag

SEQ ID NO: 1573814 - RNA, 17 nt, Human adenovirus E
gguaaauccaagccagc

SEQ ID NO: 1573815 - RNA, 14 nt, Human adenovirus E
ugcacaccaacaug

SEQ ID NO: 1573816 - RNA, 17 nt, Human adenovirus E
acuuggccagccacuug

SEQ ID NO: 1573817 - RNA, 15 nt, Human adenovirus E
uacagguggcagaug

SEQ ID NO: 1573818 - RNA, 14 nt, Human adenovirus E
cugcacaggcagca

SEQ ID NO: 1573819 - RNA, 20 nt, Human adenovirus E
cuaaaccccauuacuggcac

SEQ ID NO: 1573820 - RNA, 22 nt, Human adenovirus E
gucccaugguggcgcagcugac

SEQ ID NO: 1573821 - RNA, 17 nt, Human adenovirus E
ugcacgagaaccgccug

SEQ ID NO: 1573822 - RNA, 19 nt, Human adenovirus E
ccucagcguggaggagcuc

SEQ ID NO: 1573823 - RNA, 23 nt, Human adenovirus E
caccgcuaucgugugccugagca

SEQ ID NO: 1573824 - RNA, 15 nt, Human adenovirus E
cuccucccucagcaa

SEQ ID NO: 1573825 - RNA, 21 nt, Human adenovirus E
accaccuggacaaaauaccac

SEQ ID NO: 1573826 - RNA, 18 nt, Human adenovirus E
ucagccaucgccaaccuc

SEQ ID NO: 1573827 - RNA, 15 nt, Human adenovirus E
cuccacagccccuac

SEQ ID NO: 1573828 - RNA, 23 nt, Human adenovirus E
caacgcgcggcuggcggugcuca

SEQ ID NO: 1573829 - RNA, 13 nt, Human adenovirus E
gaccgagcuccag

SEQ ID NO: 1573830 - RNA, 22 nt, Human adenovirus E
gcaagcggugcguuccagcaug

SEQ ID NO: 1573831 - RNA, 20 nt, Human adenovirus E
ugcaacaacaacagccaccu

SEQ ID NO: 1573832 - RNA, 13 nt, Human adenovirus E
cgggcacucccgc

SEQ ID NO: 1573833 - RNA, 14 nt, Human adenovirus E
ggaggagcagaacc

SEQ ID NO: 1573834 - RNA, 17 nt, Human adenovirus E
gcauagauggcacucca

SEQ ID NO: 1573835 - RNA, 14 nt, Human adenovirus E
ccucuaccucugcc

SEQ ID NO: 1573836 - RNA, 13 nt, Human adenovirus E
guguugaugaugc

SEQ ID NO: 1573837 - RNA, 15 nt, Human adenovirus E
cugcgagcccaaccc

SEQ ID NO: 1573838 - RNA, 19 nt, Human adenovirus E
acggcgacuaccuccaccu

SEQ ID NO: 1573839 - RNA, 14 nt, Human adenovirus E
agaucacccugcuc

SEQ ID NO: 1573840 - RNA, 22 nt, Human adenovirus E
cauguggcgguucaccaccucc

SEQ ID NO: 1573841 - RNA, 13 nt, Human adenovirus E
caccacuacagca

SEQ ID NO: 1573842 - RNA, 21 nt, Human adenovirus E
agaugcaauugaaagcaacau

SEQ ID NO: 1573843 - RNA, 18 nt, Human adenovirus E
caggcuuugagcucggag

SEQ ID NO: 1573844 - RNA, 16 nt, Human adenovirus E
gacguccuggaucuga

SEQ ID NO: 1573845 - RNA, 21 nt, Human adenovirus E
ugucuuucguccucgcugucc

SEQ ID NO: 1573846 - RNA, 14 nt, Human adenovirus E
cggcggugacuagg

SEQ ID NO: 1573847 - RNA, 20 nt, Human adenovirus E
gcuccgcuugccguccuucu

SEQ ID NO: 1573848 - RNA, 14 nt, Human adenovirus E
ccccaagcgccagc

SEQ ID NO: 1573849 - RNA, 20 nt, Human adenovirus E
cagccaacugaacgggggcg

SEQ ID NO: 1573850 - RNA, 23 nt, Human adenovirus E
augcaagcggugcguuccagcau

SEQ ID NO: 1573851 - RNA, 21 nt, Human adenovirus E
gaccguacuacuuccgcgaga

SEQ ID NO: 1573852 - RNA, 14 nt, Human adenovirus E
guggcggugcaggc

SEQ ID NO: 1573853 - RNA, 14 nt, Human adenovirus E
ccaagagccggcgg

SEQ ID NO: 1573854 - RNA, 23 nt, Human adenovirus E
cucaucaagcaucuggcccggca

SEQ ID NO: 1573855 - RNA, 13 nt, Human adenovirus E
gcucccucgguga

SEQ ID NO: 1573856 - RNA, 20 nt, Human adenovirus E
cuaugaggccgagccacagc

SEQ ID NO: 1573857 - RNA, 22 nt, Human adenovirus E
uacuuccaagaagaggcagcag

SEQ ID NO: 1573858 - RNA, 18 nt, Human adenovirus E
caccacccuccaccgcaa

SEQ ID NO: 1573859 - RNA, 15 nt, Human adenovirus E
cagagacaggagcgg

SEQ ID NO: 1573860 - RNA, 14 nt, Human adenovirus E
gcgagggggcgagg

SEQ ID NO: 1573861 - RNA, 16 nt, Human adenovirus E
ccacagcgcgcacccg

SEQ ID NO: 1573862 - RNA, 16 nt, Human adenovirus E
cccugcgcggggaggc

SEQ ID NO: 1573863 - RNA, 22 nt, Human adenovirus E
ucaagcgcgcgucgcccaucuc

SEQ ID NO: 1573864 - RNA, 18 nt, Human adenovirus E
gcgcccgcgcuugcuggg

SEQ ID NO: 1573865 - RNA, 20 nt, Human adenovirus E
cgaggaggaggcagaggagg

SEQ ID NO: 1573866 - RNA, 18 nt, Human adenovirus E
uggcagaucacccugcuc

SEQ ID NO: 1573867 - RNA, 16 nt, Human adenovirus E
caggggguccagcaug

SEQ ID NO: 1573868 - RNA, 19 nt, Human adenovirus E
ucagcaucaucugggccug

SEQ ID NO: 1573869 - RNA, 16 nt, Human adenovirus E
cugggcauucgcaaga

SEQ ID NO: 1573870 - RNA, 13 nt, Human adenovirus E
cagccugcaagac

SEQ ID NO: 1573871 - RNA, 14 nt, Human adenovirus E
ccgccgcccagccc

SEQ ID NO: 1573872 - RNA, 16 nt, Human adenovirus E
cgggcacucccgcauc

SEQ ID NO: 1573873 - RNA, 24 nt, Human adenovirus E
ggcagcagugucuggaggagcaga

SEQ ID NO: 1573874 - RNA, 14 nt, Human adenovirus E
gucgccgcaccgcc

SEQ ID NO: 1573875 - RNA, 23 nt, Human adenovirus E
ccggagacgcgcggccacggcgg

SEQ ID NO: 1573876 - RNA, 13 nt, Human adenovirus E
cgcagggccaggc

SEQ ID NO: 1573877 - RNA, 22 nt, Human adenovirus E
cgcuggcuccuggaccugguga

SEQ ID NO: 1573878 - RNA, 15 nt, Human adenovirus E
acucaggcagaggag

SEQ ID NO: 1573879 - RNA, 19 nt, Human adenovirus E
cagcgcgcacccggugcac

SEQ ID NO: 1573880 - RNA, 20 nt, Human adenovirus E
cgcaacucguaccugggcua

SEQ ID NO: 1573881 - RNA, 21 nt, Human adenovirus E
gaccuaccaggagaucaccca

SEQ ID NO: 1573882 - RNA, 18 nt, Human adenovirus E
ucgaaucaggcuggagcc

SEQ ID NO: 1573883 - RNA, 15 nt, Human adenovirus E
ccucggcgcuguccg

SEQ ID NO: 1573884 - RNA, 15 nt, Human adenovirus E
ccgcuguggagccac

SEQ ID NO: 1573885 - RNA, 13 nt, Human adenovirus E
aaguccuccccag

SEQ ID NO: 1573886 - RNA, 14 nt, Human adenovirus E
uccucccucagcaa

SEQ ID NO: 1573887 - RNA, 20 nt, Human adenovirus E
aggaucuugcccgcgcgggg

SEQ ID NO: 1573888 - RNA, 21 nt, Human adenovirus E
gcccuggccaccuaccacauc

SEQ ID NO: 1573889 - RNA, 17 nt, Human adenovirus E
acaagaugagccgcugg

SEQ ID NO: 1573890 - RNA, 18 nt, Human adenovirus E
gucugggcagcgacgaga

SEQ ID NO: 1573891 - RNA, 22 nt, Human adenovirus E
gcgcgggugauggucucccgca

SEQ ID NO: 1573892 - RNA, 13 nt, Human adenovirus E
ucagcacccagcc

SEQ ID NO: 1573893 - RNA, 18 nt, Human adenovirus E
gcgaguuggaggagaugg

SEQ ID NO: 1573894 - RNA, 13 nt, Human adenovirus E
cgagaagcagcag

SEQ ID NO: 1573895 - RNA, 14 nt, Human adenovirus E
gcugcagagccagc

SEQ ID NO: 1573896 - RNA, 17 nt, Human adenovirus E
cggcccaugagcugcga

SEQ ID NO: 1573897 - RNA, 16 nt, Human adenovirus E
cgaggccacgcggcgg

SEQ ID NO: 1573898 - RNA, 14 nt, Human adenovirus E
agaagcagcagcag

SEQ ID NO: 1573899 - RNA, 17 nt, Human adenovirus E
cagaacggggugcugga

SEQ ID NO: 1573900 - RNA, 15 nt, Human adenovirus E
acagggcaggcgcug

SEQ ID NO: 1573901 - RNA, 11 nt, Human adenovirus E
agaccgagccc

SEQ ID NO: 1573902 - RNA, 14 nt, Human adenovirus E
ccacgcgcacaucc

SEQ ID NO: 1573903 - RNA, 21 nt, Human adenovirus E
gcaaggcguggaacagcacca

SEQ ID NO: 1573904 - RNA, 14 nt, Human adenovirus E
cacacgcacuacca

SEQ ID NO: 1573905 - RNA, 22 nt, Human adenovirus E
ggagucgguccacagcuuccgc

SEQ ID NO: 1573906 - RNA, 18 nt, Human adenovirus E
cuacagccuaggccacaa

SEQ ID NO: 1573907 - RNA, 14 nt, Human adenovirus E
guauccggugcacu

SEQ ID NO: 1573908 - RNA, 21 nt, Human adenovirus E
  misc_feature (9)..(9): n is a, c, g or u
gcggccgancgccugggcgag

SEQ ID NO: 1573909 - RNA, 17 nt, Human adenovirus E
cgcgcccgcccagucgc

SEQ ID NO: 1573910 - RNA, 19 nt, Human adenovirus E
ccugcucgagugccacugc

SEQ ID NO: 1573911 - RNA, 19 nt, Human adenovirus E
caacagcccccuccacagc

SEQ ID NO: 1573912 - RNA, 14 nt, Human adenovirus E
guccucgcggggcc

SEQ ID NO: 1573913 - RNA, 20 nt, Human adenovirus E
ccacgagccggggcagcgcc

SEQ ID NO: 1573914 - RNA, 22 nt, Human adenovirus E
gcucugcaagcuccugcagaag

SEQ ID NO: 1573915 - RNA, 16 nt, Human adenovirus E
cggcgucgugcacgca

SEQ ID NO: 1573916 - RNA, 20 nt, Human adenovirus E
acugggagaacagcagucag

SEQ ID NO: 1573917 - RNA, 18 nt, Human adenovirus E
acacacagaucaaaccgc

SEQ ID NO: 1573918 - RNA, 19 nt, Human adenovirus E
guugauuuuaacacagagu

SEQ ID NO: 1573919 - RNA, 20 nt, Human adenovirus E
caggacagcgaaccccgcag

SEQ ID NO: 1573920 - RNA, 17 nt, Human adenovirus E
cucaacccaccccaccc

SEQ ID NO: 1573921 - RNA, 16 nt, Human adenovirus E
cacgaggaggagcugg

SEQ ID NO: 1573922 - RNA, 21 nt, Human adenovirus E
uaccucugccacaccuggcag

SEQ ID NO: 1573923 - RNA, 23 nt, Human adenovirus E
cuaguugcgggugggcuuuuggu

SEQ ID NO: 1573924 - RNA, 17 nt, Human adenovirus E
uccccgucuccugccgc

SEQ ID NO: 1573925 - RNA, 22 nt, Human adenovirus E
cuccgccgacgacagcagcgug

SEQ ID NO: 1573926 - RNA, 18 nt, Human adenovirus E
ggugaccguggagcugga

SEQ ID NO: 1573927 - RNA, 20 nt, Human adenovirus E
cggcgcgcuccacgguggcc

SEQ ID NO: 1573928 - RNA, 20 nt, Human adenovirus E
acgccuaugagaaaagcaag

SEQ ID NO: 1573929 - RNA, 16 nt, Human adenovirus E
gauguggacagcagcg

SEQ ID NO: 1573930 - RNA, 14 nt, Human adenovirus E
uagcccagaucuac

SEQ ID NO: 1573931 - RNA, 23 nt, Human adenovirus E
auaaucacacacgcccagcacac

SEQ ID NO: 1573932 - RNA, 19 nt, Human adenovirus E
caggacccgguagaggugg

SEQ ID NO: 1573933 - RNA, 12 nt, Human adenovirus E
cggcggcagcag

SEQ ID NO: 1573934 - RNA, 21 nt, Human adenovirus E
guacugcggcagaugcgcccc

SEQ ID NO: 1573935 - RNA, 18 nt, Human adenovirus E
cgacaggaugcaccgugc

SEQ ID NO: 1573936 - RNA, 18 nt, Human adenovirus E
caugaauuggcucagcgc

SEQ ID NO: 1573937 - RNA, 22 nt, Human adenovirus E
acuuccucaaacgcccaaaacu

SEQ ID NO: 1573938 - RNA, 22 nt, Human adenovirus E
gaggaggugacccugggccuga

SEQ ID NO: 1573939 - RNA, 12 nt, Human adenovirus E
caagaugagccg

SEQ ID NO: 1573940 - RNA, 12 nt, Human adenovirus E
gagaaaagcaag

SEQ ID NO: 1573941 - RNA, 23 nt, Human adenovirus E
gguaaaucguucucuccagcacc

SEQ ID NO: 1573942 - RNA, 17 nt, Human adenovirus E
caccaccugcaucugcu

SEQ ID NO: 1573943 - RNA, 18 nt, Human adenovirus E
gcaugaccaccugggcga

SEQ ID NO: 1573944 - RNA, 20 nt, Human adenovirus E
augugcuccuucuggaucau

SEQ ID NO: 1573945 - RNA, 20 nt, Human adenovirus E
ccagcaccauggaggugcag

SEQ ID NO: 1573946 - RNA, 16 nt, Human adenovirus E
ccacuaugcagcucac

SEQ ID NO: 1573947 - RNA, 17 nt, Human adenovirus E
acgugcagaccaaccug

SEQ ID NO: 1573948 - RNA, 20 nt, Human adenovirus E
cggguccaccuuuuccaggg

SEQ ID NO: 1573949 - RNA, 14 nt, Human adenovirus E
ggugcguuccagca

SEQ ID NO: 1573950 - RNA, 15 nt, Human adenovirus E
cauguuuucugccaa

SEQ ID NO: 1573951 - RNA, 15 nt, Human adenovirus E
ccagucucauugccg

SEQ ID NO: 1573952 - RNA, 23 nt, Human adenovirus E
auacagcucgugcgagggggcga

SEQ ID NO: 1573953 - RNA, 15 nt, Human adenovirus E
cggagauguuggaga

SEQ ID NO: 1573954 - RNA, 20 nt, Human adenovirus E
gcgucuaccucuaccucugc

SEQ ID NO: 1573955 - RNA, 16 nt, Human adenovirus E
agcccaacccgcgccu

SEQ ID NO: 1573956 - RNA, 14 nt, Human adenovirus E
ucaugaccagcaug

SEQ ID NO: 1573957 - RNA, 15 nt, Human adenovirus E
ggccauccuggaggc

SEQ ID NO: 1573958 - RNA, 22 nt, Human adenovirus E
agcagcuagaaaauccacagcg

SEQ ID NO: 1573959 - RNA, 19 nt, Human adenovirus E
cagagcucggugaugugcu

SEQ ID NO: 1573960 - RNA, 23 nt, Human adenovirus E
gcggccguucaugggcaccugga

SEQ ID NO: 1573961 - RNA, 18 nt, Human adenovirus E
agcaugagcaccacagcg

SEQ ID NO: 1573962 - RNA, 16 nt, Human adenovirus E
uuugguucucugcuac

SEQ ID NO: 1573963 - RNA, 21 nt, Human adenovirus E
aggaaucuucucuucucuuuu

SEQ ID NO: 1573964 - RNA, 12 nt, Human adenovirus E
aucacgguuauc

SEQ ID NO: 1573965 - RNA, 21 nt, Human adenovirus E
gcaccauggaggugcagacgg

SEQ ID NO: 1573966 - RNA, 20 nt, Human adenovirus E
gucgagcgcgagcaaggaca

SEQ ID NO: 1573967 - RNA, 17 nt, Human adenovirus E
cauugucaaugccaccu

SEQ ID NO: 1573968 - RNA, 15 nt, Human adenovirus E
cgugcagcagaucua

SEQ ID NO: 1573969 - RNA, 16 nt, Human adenovirus E
gggcuggcgcgccugg

SEQ ID NO: 1573970 - RNA, 18 nt, Human adenovirus E
ccaaacuaaccuccacca

SEQ ID NO: 1573971 - RNA, 20 nt, Human adenovirus E
gagccgcgcccugggccagg

SEQ ID NO: 1573972 - RNA, 16 nt, Human adenovirus E
gucaggcagaggagga

SEQ ID NO: 1573973 - RNA, 16 nt, Human adenovirus E
cgagcgccccuugugg

SEQ ID NO: 1573974 - RNA, 15 nt, Human adenovirus E
gggcggcggccuggg

SEQ ID NO: 1573975 - RNA, 18 nt, Human adenovirus E
ugcgcaacggccugcccg

SEQ ID NO: 1573976 - RNA, 14 nt, Human adenovirus E
agacccggcaccac

SEQ ID NO: 1573977 - RNA, 15 nt, Human adenovirus E
gcgaccaggagcuga

SEQ ID NO: 1573978 - RNA, 20 nt, Human adenovirus E
gcgugccccagggcauggga

SEQ ID NO: 1573979 - RNA, 18 nt, Human adenovirus E
accacccucuccccccgc

SEQ ID NO: 1573980 - RNA, 17 nt, Human adenovirus E
cuccguggccuggaggc

SEQ ID NO: 1573981 - RNA, 21 nt, Human adenovirus E
caagcccgugaccuugcagca

SEQ ID NO: 1573982 - RNA, 19 nt, Human adenovirus E
ucaccaccugcaucugcug

SEQ ID NO: 1573983 - RNA, 15 nt, Human adenovirus E
gcggcgaugcagccc

SEQ ID NO: 1573984 - RNA, 19 nt, Human adenovirus E
ugcccuucucgcugaacag

SEQ ID NO: 1573985 - RNA, 21 nt, Human adenovirus E
ucuccuucagcgcgcgcugcc

SEQ ID NO: 1573986 - RNA, 18 nt, Human adenovirus E
cugccuuggcaguacagu

SEQ ID NO: 1573987 - RNA, 18 nt, Human adenovirus E
caaaucuguugagcuggg

SEQ ID NO: 1573988 - RNA, 12 nt, Human adenovirus E
aaaauccacagc

SEQ ID NO: 1573989 - RNA, 21 nt, Human adenovirus E
ccgcguaauuggcccgccgcc

SEQ ID NO: 1573990 - RNA, 16 nt, Human adenovirus E
gcucugaaccugcccc

SEQ ID NO: 1573991 - RNA, 18 nt, Human adenovirus E
ccgagcugucggccugcg

SEQ ID NO: 1573992 - RNA, 21 nt, Human adenovirus E
acccggcgcuaccugcucuuc

SEQ ID NO: 1573993 - RNA, 13 nt, Human adenovirus E
cgccaguccagac

SEQ ID NO: 1573994 - RNA, 16 nt, Human adenovirus E
cccucuccccccgcac

SEQ ID NO: 1573995 - RNA, 19 nt, Human adenovirus E
agugcgucucgggacccug

SEQ ID NO: 1573996 - RNA, 19 nt, Human adenovirus E
ucguccacauccaggaagg

SEQ ID NO: 1573997 - RNA, 20 nt, Human adenovirus E
ggccuaguugcgggugggcu

SEQ ID NO: 1573998 - RNA, 15 nt, Human adenovirus E
gcgcccucaaaggcc

SEQ ID NO: 1573999 - RNA, 18 nt, Human adenovirus E
aacccaccacgccuagaa

SEQ ID NO: 1574000 - RNA, 19 nt, Human adenovirus E
gggcggcagaacggggugc

SEQ ID NO: 1574001 - RNA, 12 nt, Human adenovirus E
gugacccugggc

SEQ ID NO: 1574002 - RNA, 12 nt, Human adenovirus E
cggaggugagcu

SEQ ID NO: 1574003 - RNA, 22 nt, Human adenovirus E
acccucuccccccgcacagccu

SEQ ID NO: 1574004 - RNA, 15 nt, Human adenovirus E
cagaacgaccacagc

SEQ ID NO: 1574005 - RNA, 15 nt, Human adenovirus E
gaauacacccccgga

SEQ ID NO: 1574006 - RNA, 14 nt, Human adenovirus E
gcucggggcccgga

SEQ ID NO: 1574007 - RNA, 16 nt, Human adenovirus E
ccacagcgacccaugc

SEQ ID NO: 1574008 - RNA, 10 nt, Human adenovirus E
cagggagaua

SEQ ID NO: 1574009 - RNA, 15 nt, Human adenovirus E
ucgaucuccuccucu

SEQ ID NO: 1574010 - RNA, 14 nt, Human adenovirus E
gaccucggcacuca

SEQ ID NO: 1574011 - RNA, 19 nt, Human adenovirus E
cgcggagauggcaccucuc

SEQ ID NO: 1574012 - RNA, 16 nt, Human adenovirus E
accgugucaugaugca

SEQ ID NO: 1574013 - RNA, 16 nt, Human adenovirus E
caggcuggagccgcag

SEQ ID NO: 1574014 - RNA, 22 nt, Human adenovirus E
ggcgaggggcuggcgcgccugg

SEQ ID NO: 1574015 - RNA, 17 nt, Human adenovirus E
caacucguaccugggcu

SEQ ID NO: 1574016 - RNA, 21 nt, Human adenovirus E
  misc_feature (10)..(10): n is a, c, g or u
uaaaucagcnuaccaccacua

SEQ ID NO: 1574017 - RNA, 14 nt, Human adenovirus E
cugcacaccacccu

SEQ ID NO: 1574018 - RNA, 11 nt, Human adenovirus E
ccguggcucug

SEQ ID NO: 1574019 - RNA, 15 nt, Human adenovirus E
accacccagaccggu

SEQ ID NO: 1574020 - RNA, 15 nt, Human adenovirus E
gcgcacauccagaaa

SEQ ID NO: 1574021 - RNA, 19 nt, Human adenovirus E
cagggauacaaguccuggc

SEQ ID NO: 1574022 - RNA, 14 nt, Human adenovirus E
gguccgcaaaugca

SEQ ID NO: 1574023 - RNA, 14 nt, Human adenovirus E
ccguccucccggag

SEQ ID NO: 1574024 - RNA, 22 nt, Human adenovirus E
cggagccuuguugcgcagggcc

SEQ ID NO: 1574025 - RNA, 10 nt, Human adenovirus E
aggccgccgc

SEQ ID NO: 1574026 - RNA, 21 nt, Human adenovirus E
agggcgagaucgagggcgagc

SEQ ID NO: 1574027 - RNA, 14 nt, Human adenovirus E
ucaccaaggccaug

SEQ ID NO: 1574028 - RNA, 9 nt, Human adenovirus E
uuugccaga

SEQ ID NO: 1574029 - RNA, 20 nt, Human adenovirus E
ucuaccucugccacaccugg

SEQ ID NO: 1574030 - RNA, 12 nt, Human adenovirus E
ucugugccaccc

SEQ ID NO: 1574031 - RNA, 19 nt, Human adenovirus E
uccaagaagaggcagcagc

SEQ ID NO: 1574032 - RNA, 13 nt, Human adenovirus E
aaccagcagcuag

SEQ ID NO: 1574033 - RNA, 16 nt, Human adenovirus E
ccagggcgcgcgggag

SEQ ID NO: 1574034 - RNA, 17 nt, Human adenovirus E
ucaggcagaggaggagg

SEQ ID NO: 1574035 - RNA, 19 nt, Human adenovirus E
cagcagaaaaccagcagcu

SEQ ID NO: 1574036 - RNA, 15 nt, Human adenovirus E
cgcacguggacgagc

SEQ ID NO: 1574037 - RNA, 18 nt, Human adenovirus E
gccccggggccaggagga

SEQ ID NO: 1574038 - RNA, 15 nt, Human adenovirus E
cugauggccacgggc

SEQ ID NO: 1574039 - RNA, 15 nt, Human adenovirus E
cgugcacgcagcagc

SEQ ID NO: 1574040 - RNA, 14 nt, Human adenovirus E
gcagcugggacuug

SEQ ID NO: 1574041 - RNA, 22 nt, Human adenovirus E
cgcgcaccaguuccgccaggag

SEQ ID NO: 1574042 - RNA, 13 nt, Human adenovirus E
cggcaggccacca

SEQ ID NO: 1574043 - RNA, 18 nt, Human adenovirus E
agaacaggagcuacaacg

SEQ ID NO: 1574044 - RNA, 22 nt, Human adenovirus E
accgccucggaccuggccgacc

SEQ ID NO: 1574045 - RNA, 15 nt, Human adenovirus E
ccugaccaccguggu

SEQ ID NO: 1574046 - RNA, 13 nt, Human adenovirus E
cagccccggauga

SEQ ID NO: 1574047 - RNA, 21 nt, Human adenovirus E
gcuaccugcugcgccuggcca

SEQ ID NO: 1574048 - RNA, 16 nt, Human adenovirus E
ugaccuugcagcaggu

SEQ ID NO: 1574049 - RNA, 14 nt, Human adenovirus E
gcgaguaccuggaa

SEQ ID NO: 1574050 - RNA, 24 nt, Human adenovirus E
gcacguacucgcgcgccacgcacu

SEQ ID NO: 1574051 - RNA, 21 nt, Human adenovirus E
ccgcagaagcaagcuccagcu

SEQ ID NO: 1574052 - RNA, 22 nt, Human adenovirus E
ccuauuccuaaaguuagcuuua

SEQ ID NO: 1574053 - RNA, 17 nt, Human adenovirus E
aggacgucagcggcgag

SEQ ID NO: 1574054 - RNA, 15 nt, Human adenovirus E
ccaucuccgcuccgg

SEQ ID NO: 1574055 - RNA, 18 nt, Human adenovirus E
agccagccaugauaaaga

SEQ ID NO: 1574056 - RNA, 18 nt, Human adenovirus E
ugcggugugccccgguuc

SEQ ID NO: 1574057 - RNA, 12 nt, Human adenovirus E
gcaucuggcccg

SEQ ID NO: 1574058 - RNA, 18 nt, Human adenovirus E
gagaaccgccuggggcag

SEQ ID NO: 1574059 - RNA, 20 nt, Human adenovirus E
ucagauguaucuacugaacu

SEQ ID NO: 1574060 - RNA, 19 nt, Human adenovirus E
ugucucuucgggggcagag

SEQ ID NO: 1574061 - RNA, 18 nt, Human adenovirus E
ggccagcacccagaccau

SEQ ID NO: 1574062 - RNA, 14 nt, Human adenovirus E
ggugcccaagcgcc

SEQ ID NO: 1574063 - RNA, 22 nt, Human adenovirus E
uggcggcgauguugagcugcac

SEQ ID NO: 1574064 - RNA, 20 nt, Human adenovirus E
gcagaucaauggcccucaca

SEQ ID NO: 1574065 - RNA, 14 nt, Human adenovirus E
ugucaguguaucua

SEQ ID NO: 1574066 - RNA, 20 nt, Human adenovirus E
ccgugagcggggcuggacag

SEQ ID NO: 1574067 - RNA, 14 nt, Human adenovirus E
cacaugucccccuc

SEQ ID NO: 1574068 - RNA, 14 nt, Human adenovirus E
agcccagcaccagc

SEQ ID NO: 1574069 - RNA, 14 nt, Human adenovirus E
aucaccgagcccga

SEQ ID NO: 1574070 - RNA, 15 nt, Human adenovirus E
ugccauucgcgcacg

SEQ ID NO: 1574071 - RNA, 16 nt, Human adenovirus E
cagcaccaacgugcag

SEQ ID NO: 1574072 - RNA, 22 nt, Human adenovirus E
ugcacgccgcaccgcucccugg

SEQ ID NO: 1574073 - RNA, 14 nt, Human adenovirus E
uccagcaccaggca

SEQ ID NO: 1574074 - RNA, 20 nt, Human adenovirus E
agagucgggggcaggagcag

SEQ ID NO: 1574075 - RNA, 12 nt, Human adenovirus E
agcuugguggcg

SEQ ID NO: 1574076 - RNA, 18 nt, Human adenovirus E
ugccacaccuggcagacg

SEQ ID NO: 1574077 - RNA, 18 nt, Human adenovirus E
gaccagcaugaaggggac

SEQ ID NO: 1574078 - RNA, 14 nt, Human adenovirus E
acucaaaaaaauac

SEQ ID NO: 1574079 - RNA, 19 nt, Human adenovirus E
gccaucuuccagcagaguc

SEQ ID NO: 1574080 - RNA, 20 nt, Human adenovirus E
accaacgccauccugaaucc

SEQ ID NO: 1574081 - RNA, 21 nt, Human adenovirus E
gcgguacaccucgcccugcuc

SEQ ID NO: 1574082 - RNA, 17 nt, Human adenovirus E
ccggcggcgcucugacu

SEQ ID NO: 1574083 - RNA, 17 nt, Human adenovirus E
cgugcagaaccccacca

SEQ ID NO: 1574084 - RNA, 16 nt, Human adenovirus E
ggggagaugaggugca

SEQ ID NO: 1574085 - RNA, 16 nt, Human adenovirus E
agaccgugcagcagau

SEQ ID NO: 1574086 - RNA, 14 nt, Human adenovirus E
ccauggaggugcag

SEQ ID NO: 1574087 - RNA, 23 nt, Human adenovirus E
cagugcgcuuuucacaagaagag

SEQ ID NO: 1574088 - RNA, 19 nt, Human adenovirus E
agcugcggcgcggccugga

SEQ ID NO: 1574089 - RNA, 13 nt, Human adenovirus E
aucgcccaagaau

SEQ ID NO: 1574090 - RNA, 22 nt, Human adenovirus E
guccucccggaggaggggggcc

SEQ ID NO: 1574091 - RNA, 15 nt, Human adenovirus E
agccagaugaugcaa

SEQ ID NO: 1574092 - RNA, 23 nt, Human adenovirus E
gugguccuggugaccguggagcu

SEQ ID NO: 1574093 - RNA, 17 nt, Human adenovirus E
cgcccgcccgcgcccac

SEQ ID NO: 1574094 - RNA, 15 nt, Human adenovirus E
cuuuagacagcagcc

SEQ ID NO: 1574095 - RNA, 15 nt, Human adenovirus E
ggacagcacucaggc

SEQ ID NO: 1574096 - RNA, 22 nt, Human adenovirus E
ugcgggcggcgcugcagagcca

SEQ ID NO: 1574097 - RNA, 17 nt, Human adenovirus E
uuaccacuaugcagcuc

SEQ ID NO: 1574098 - RNA, 20 nt, Human adenovirus E
cagcuggccuuggaagaggg

SEQ ID NO: 1574099 - RNA, 14 nt, Human adenovirus E
ccaccucagcucaa

SEQ ID NO: 1574100 - RNA, 13 nt, Human adenovirus E
gacgagcgcacca

SEQ ID NO: 1574101 - RNA, 18 nt, Human adenovirus E
ucgaaggcgggcaugacc

SEQ ID NO: 1574102 - RNA, 23 nt, Human adenovirus E
cgaggaucuguaccccaccaugc

SEQ ID NO: 1574103 - RNA, 22 nt, Human adenovirus E
cgcaccgcucccuggccugcaa

SEQ ID NO: 1574104 - RNA, 13 nt, Human adenovirus E
gugcagcccgagg

SEQ ID NO: 1574105 - RNA, 17 nt, Human adenovirus E
gcaucgcccggcggcac

SEQ ID NO: 1574106 - RNA, 19 nt, Human adenovirus E
acucgcagaaaaugaugca

SEQ ID NO: 1574107 - RNA, 20 nt, Human adenovirus E
gguagcuccauugcagggcc

SEQ ID NO: 1574108 - RNA, 16 nt, Human adenovirus E
ggccaucgccagcaug

SEQ ID NO: 1574109 - RNA, 18 nt, Human adenovirus E
gggcgugccccagggcau

SEQ ID NO: 1574110 - RNA, 15 nt, Human adenovirus E
ugagccgcuggaaga

SEQ ID NO: 1574111 - RNA, 19 nt, Human adenovirus E
cagagucgggggcaggagc

SEQ ID NO: 1574112 - RNA, 19 nt, Human adenovirus E
agccuuguugcgcagggcc

SEQ ID NO: 1574113 - RNA, 14 nt, Human adenovirus E
cucuauguuuaauu

SEQ ID NO: 1574114 - RNA, 19 nt, Human adenovirus E
ugggcauagucgcgccgcg

SEQ ID NO: 1574115 - RNA, 17 nt, Human adenovirus E
ugcccacggcccucagc

SEQ ID NO: 1574116 - RNA, 22 nt, Human adenovirus E
caagucuauguuggcacagcac

SEQ ID NO: 1574117 - RNA, 19 nt, Human adenovirus E
uuuaccgacaaaaaucaga

SEQ ID NO: 1574118 - RNA, 16 nt, Human adenovirus E
gggggcguaguucccc

SEQ ID NO: 1574119 - RNA, 17 nt, Human adenovirus E
uaccaccacuacagccu

SEQ ID NO: 1574120 - RNA, 13 nt, Human adenovirus E
ucaggcuccucug

SEQ ID NO: 1574121 - RNA, 16 nt, Human adenovirus E
  misc_feature (7)..(7): n is a, c, g or u
ucauuanuccagcaga

SEQ ID NO: 1574122 - RNA, 16 nt, Human adenovirus E
ccacgugcgcacccug

SEQ ID NO: 1574123 - RNA, 20 nt, Human adenovirus E
cgcccggcggcaccggagca

SEQ ID NO: 1574124 - RNA, 23 nt, Human adenovirus E
cacccucugguugaacaugcagc

SEQ ID NO: 1574125 - RNA, 21 nt, Human adenovirus E
cugaaccugccccccaaaguc

SEQ ID NO: 1574126 - RNA, 13 nt, Human adenovirus E
gcaaccccacgcc

SEQ ID NO: 1574127 - RNA, 19 nt, Human adenovirus E
gacggugucgagccugcug

SEQ ID NO: 1574128 - RNA, 17 nt, Human adenovirus E
cuuccguggcggugcag

SEQ ID NO: 1574129 - RNA, 19 nt, Human adenovirus E
gcagggugaugagguccac

SEQ ID NO: 1574130 - RNA, 16 nt, Human adenovirus E
gcaugagcaccacagc

SEQ ID NO: 1574131 - RNA, 22 nt, Human adenovirus E
cgccgguggcacgacaggcagc

SEQ ID NO: 1574132 - RNA, 18 nt, Human adenovirus E
ccgacgagaagcagcagc

SEQ ID NO: 1574133 - RNA, 16 nt, Human adenovirus E
cagggccaggcgcacg

SEQ ID NO: 1574134 - RNA, 23 nt, Human adenovirus E
cgacugggcuuuucggcgcggua

SEQ ID NO: 1574135 - RNA, 14 nt, Human adenovirus E
cucgcgcuucugcu

SEQ ID NO: 1574136 - RNA, 13 nt, Human adenovirus E
uaccuccaccuga

SEQ ID NO: 1574137 - RNA, 17 nt, Human adenovirus E
uaccccaccaugcagcu

SEQ ID NO: 1574138 - RNA, 19 nt, Human adenovirus E
accgccccgccgcccagcc

SEQ ID NO: 1574139 - RNA, 21 nt, Human adenovirus E
accacccucuccccccgcaca

SEQ ID NO: 1574140 - RNA, 19 nt, Human adenovirus E
guacaugggcaucuugcac

SEQ ID NO: 1574141 - RNA, 15 nt, Human adenovirus E
gcaagaguuccaggc

SEQ ID NO: 1574142 - RNA, 19 nt, Human adenovirus E
gcccgugaccuugcagcag

SEQ ID NO: 1574143 - RNA, 16 nt, Human adenovirus E
uucaugaccagcauga

SEQ ID NO: 1574144 - RNA, 14 nt, Human adenovirus E
cgagcugggcagga

SEQ ID NO: 1574145 - RNA, 18 nt, Human adenovirus E
aguuccuccacuuccucu

SEQ ID NO: 1574146 - RNA, 18 nt, Human adenovirus E
gcacaggcagcaaagccc

SEQ ID NO: 1574147 - RNA, 15 nt, Human adenovirus E
cagccagagcaggaa

SEQ ID NO: 1574148 - RNA, 19 nt, Human adenovirus E
ucagacaugcaucccagcu

SEQ ID NO: 1574149 - RNA, 13 nt, Human adenovirus E
uccacgagccagg

SEQ ID NO: 1574150 - RNA, 22 nt, Human adenovirus E
ggaagacgaggaggaggcagag

SEQ ID NO: 1574151 - RNA, 18 nt, Human adenovirus E
acgaagcccugcaggaag

SEQ ID NO: 1574152 - RNA, 20 nt, Human adenovirus E
cuacuacuuccaagaagagg

SEQ ID NO: 1574153 - RNA, 18 nt, Human adenovirus E
cugcucgaucuccuccuc

SEQ ID NO: 1574154 - RNA, 15 nt, Human adenovirus E
ccguugggcagggag

SEQ ID NO: 1574155 - RNA, 17 nt, Human adenovirus E
caugcgcaugacccuga

SEQ ID NO: 1574156 - RNA, 20 nt, Human adenovirus E
gguacacgggguugcagcac

SEQ ID NO: 1574157 - RNA, 14 nt, Human adenovirus E
gcgcaacggccugc

SEQ ID NO: 1574158 - RNA, 21 nt, Human adenovirus E
gcagaccgugaaccugagcca

SEQ ID NO: 1574159 - RNA, 22 nt, Human adenovirus E
ccguucaugggcaccuggagcg

SEQ ID NO: 1574160 - RNA, 15 nt, Human adenovirus E
gacguaugcgcagga

SEQ ID NO: 1574161 - RNA, 20 nt, Human adenovirus E
aacuacccgguggugggcgc

SEQ ID NO: 1574162 - RNA, 20 nt, Human adenovirus E
cgcggccguucaugggcacc

SEQ ID NO: 1574163 - RNA, 17 nt, Human adenovirus E
cgccgggccuuggaggc

SEQ ID NO: 1574164 - RNA, 14 nt, Human adenovirus E
cucuugcaggacag

SEQ ID NO: 1574165 - RNA, 16 nt, Human adenovirus E
augggcgcggaccugc

SEQ ID NO: 1574166 - RNA, 16 nt, Human adenovirus E
cgugagccgcgcccug

SEQ ID NO: 1574167 - RNA, 21 nt, Human adenovirus E
gagaugcgcgcggcccgguuc

SEQ ID NO: 1574168 - RNA, 15 nt, Human adenovirus E
cucgaaggcgggcau

SEQ ID NO: 1574169 - RNA, 19 nt, Human adenovirus E
gcugggacuugccgcagcc

SEQ ID NO: 1574170 - RNA, 20 nt, Human adenovirus E
ucgcccugcucgggcaucag

SEQ ID NO: 1574171 - RNA, 21 nt, Human adenovirus E
caccugauccaucaccaaacu

SEQ ID NO: 1574172 - RNA, 13 nt, Human adenovirus E
gaggcgcugcuga

SEQ ID NO: 1574173 - RNA, 20 nt, Human adenovirus E
caguugcuuucggacauuuu

SEQ ID NO: 1574174 - RNA, 15 nt, Human adenovirus E
gcgugccccagggca

SEQ ID NO: 1574175 - RNA, 15 nt, Human adenovirus E
gacagcacucaggca

SEQ ID NO: 1574176 - RNA, 13 nt, Human adenovirus E
cgucccuggcucc

SEQ ID NO: 1574177 - RNA, 19 nt, Human adenovirus E
gaaagagggugcugaggga

SEQ ID NO: 1574178 - RNA, 12 nt, Human adenovirus E
aggcccuggcca

SEQ ID NO: 1574179 - RNA, 14 nt, Human adenovirus E
gcaccucggcccgg

SEQ ID NO: 1574180 - RNA, 13 nt, Human adenovirus E
ggcggcuggggcg

SEQ ID NO: 1574181 - RNA, 15 nt, Human adenovirus E
cggucguccccggag

SEQ ID NO: 1574182 - RNA, 13 nt, Human adenovirus E
gucggggaaggag

SEQ ID NO: 1574183 - RNA, 15 nt, Human adenovirus E
cggcgcacgggcaga

SEQ ID NO: 1574184 - RNA, 13 nt, Human adenovirus E
ugauucaacaguu

SEQ ID NO: 1574185 - RNA, 16 nt, Human adenovirus E
cugcagcgggcccuga

SEQ ID NO: 1574186 - RNA, 13 nt, Human adenovirus E
uccgaggacgagg

SEQ ID NO: 1574187 - RNA, 14 nt, Human adenovirus E
acucgcagcagcug

SEQ ID NO: 1574188 - RNA, 17 nt, Human adenovirus E
gauggcaccucucgccc

SEQ ID NO: 1574189 - RNA, 21 nt, Human adenovirus E
gccagcugaguuuucagcccg

SEQ ID NO: 1574190 - RNA, 18 nt, Human adenovirus E
uucuagaaacgaggagga

SEQ ID NO: 1574191 - RNA, 14 nt, Human adenovirus E
ggcagaggaggaca

SEQ ID NO: 1574192 - RNA, 15 nt, Human adenovirus E
uccaccuuuuccagg

SEQ ID NO: 1574193 - RNA, 20 nt, Human adenovirus E
gcucgcaacgcugcacggga

SEQ ID NO: 1574194 - RNA, 13 nt, Human adenovirus E
gcagcgggcccug

SEQ ID NO: 1574195 - RNA, 18 nt, Human adenovirus E
ccguggaaugggccagac

SEQ ID NO: 1574196 - RNA, 20 nt, Human adenovirus E
ugccaucacaccuuccaccu

SEQ ID NO: 1574197 - RNA, 21 nt, Human adenovirus E
gccagcaugucccgcccgcgg

SEQ ID NO: 1574198 - RNA, 19 nt, Human adenovirus E
caucucuucagcacucuca

SEQ ID NO: 1574199 - RNA, 18 nt, Human adenovirus E
gcgacuaccuccaccuga

SEQ ID NO: 1574200 - RNA, 13 nt, Human adenovirus E
cguaggccugggc

SEQ ID NO: 1574201 - RNA, 16 nt, Human adenovirus E
gccaggguccgguccu

SEQ ID NO: 1574202 - RNA, 20 nt, Human adenovirus E
cucggccauccuggaggccg

SEQ ID NO: 1574203 - RNA, 18 nt, Human adenovirus E
ucuacaaggcccugggca

SEQ ID NO: 1574204 - RNA, 13 nt, Human adenovirus E
ggggcgggggaga

SEQ ID NO: 1574205 - RNA, 15 nt, Human adenovirus E
cccggcaggccacca

SEQ ID NO: 1574206 - RNA, 18 nt, Human adenovirus E
guagagcuugggggcgag

SEQ ID NO: 1574207 - RNA, 15 nt, Human adenovirus E
gugggcguggggcag

SEQ ID NO: 1574208 - RNA, 18 nt, Human adenovirus E
ucugggugaucuuggccc

SEQ ID NO: 1574209 - RNA, 21 nt, Human adenovirus E
aggugacccugggccugaugc

SEQ ID NO: 1574210 - RNA, 17 nt, Human adenovirus E
caguauccgcagcagcg

SEQ ID NO: 1574211 - RNA, 19 nt, Human adenovirus E
gcaaccuggaagccacccu

SEQ ID NO: 1574212 - RNA, 20 nt, Human adenovirus E
ccugcggaaccacagggcca

SEQ ID NO: 1574213 - RNA, 12 nt, Human adenovirus E
cagaacagggca

SEQ ID NO: 1574214 - RNA, 12 nt, Human adenovirus E
uaacuggacaga

SEQ ID NO: 1574215 - RNA, 15 nt, Human adenovirus E
gaggguucagccgcc

SEQ ID NO: 1574216 - RNA, 21 nt, Human adenovirus E
aaagcccccgaucccuccagg

SEQ ID NO: 1574217 - RNA, 13 nt, Human adenovirus E
guaucccacccug

SEQ ID NO: 1574218 - RNA, 18 nt, Human adenovirus E
gagcaugagcaccacagc

SEQ ID NO: 1574219 - RNA, 17 nt, Human adenovirus E
gaucccugagcuccucc

SEQ ID NO: 1574220 - RNA, 12 nt, Human adenovirus E
ccacggagccca

SEQ ID NO: 1574221 - RNA, 12 nt, Human adenovirus E
ggccuuggaaga

SEQ ID NO: 1574222 - RNA, 17 nt, Human adenovirus E
gcaccaacccuccagga

SEQ ID NO: 1574223 - RNA, 14 nt, Human adenovirus E
guuuccacagcucg

SEQ ID NO: 1574224 - RNA, 14 nt, Human adenovirus E
acuccguggcucug

SEQ ID NO: 1574225 - RNA, 15 nt, Human adenovirus E
gaggagaaccugcac

SEQ ID NO: 1574226 - RNA, 19 nt, Human adenovirus E
gacagcgugguggcggacg

SEQ ID NO: 1574227 - RNA, 24 nt, Human adenovirus E
guacucgcgcgccacgcacuucca

SEQ ID NO: 1574228 - RNA, 14 nt, Human adenovirus E
caucguugaagagg

SEQ ID NO: 1574229 - RNA, 12 nt, Human adenovirus E
ccucuauguuua

SEQ ID NO: 1574230 - RNA, 22 nt, Human adenovirus E
ccaucgugaacgcgcuggugga

SEQ ID NO: 1574231 - RNA, 14 nt, Human adenovirus E
cugaacgaaggcuu

SEQ ID NO: 1574232 - RNA, 15 nt, Human adenovirus E
gaugcaccuguggga

SEQ ID NO: 1574233 - RNA, 16 nt, Human adenovirus E
uagcauuaccacacag

SEQ ID NO: 1574234 - RNA, 12 nt, Human adenovirus E
gggcaggcgcug

SEQ ID NO: 1574235 - RNA, 17 nt, Human adenovirus E
gcgccacccugugucgu

SEQ ID NO: 1574236 - RNA, 14 nt, Human adenovirus E
cauucugcagagca

SEQ ID NO: 1574237 - RNA, 16 nt, Human adenovirus E
ccuuguaggcgcagca

SEQ ID NO: 1574238 - RNA, 16 nt, Human adenovirus E
augugucccagcggcg

SEQ ID NO: 1574239 - RNA, 14 nt, Human adenovirus E
cuuugaggaggaga

SEQ ID NO: 1574240 - RNA, 21 nt, Human adenovirus E
acccgcagaagcaagcuccag

SEQ ID NO: 1574241 - RNA, 15 nt, Human adenovirus E
acaaaugccagcuga

SEQ ID NO: 1574242 - RNA, 18 nt, Human adenovirus E
cauguggagcuaccagcc

SEQ ID NO: 1574243 - RNA, 23 nt, Human adenovirus E
cugcgggguggacuucaccgaga

SEQ ID NO: 1574244 - RNA, 22 nt, Human adenovirus E
agcaugguuaguuagcugaucu

SEQ ID NO: 1574245 - RNA, 15 nt, Human adenovirus E
ugcgaguuggaggag

SEQ ID NO: 1574246 - RNA, 18 nt, Human adenovirus E
cugggugaaggccacggg

SEQ ID NO: 1574247 - RNA, 17 nt, Human adenovirus E
gugcaguggcgcgggcg

SEQ ID NO: 1574248 - RNA, 14 nt, Human adenovirus E
agcgccgcagcagu

SEQ ID NO: 1574249 - RNA, 18 nt, Human adenovirus E
cgagcccgagggccgcug

SEQ ID NO: 1574250 - RNA, 20 nt, Human adenovirus E
ggccaggcgcacguggacga

SEQ ID NO: 1574251 - RNA, 19 nt, Human adenovirus E
cggcgcuucugcccccgcc

SEQ ID NO: 1574252 - RNA, 19 nt, Human adenovirus E
ccacagcuaccuccagugc

SEQ ID NO: 1574253 - RNA, 13 nt, Human adenovirus E
gggcgcggaccug

SEQ ID NO: 1574254 - RNA, 18 nt, Human adenovirus E
ccuucccaccccacucug

SEQ ID NO: 1574255 - RNA, 17 nt, Human adenovirus E
agaccgugaaccugagc

SEQ ID NO: 1574256 - RNA, 18 nt, Human adenovirus E
guacgugcaacacagaac

SEQ ID NO: 1574257 - RNA, 15 nt, Human adenovirus E
ccacagggccagcac

SEQ ID NO: 1574258 - RNA, 21 nt, Human adenovirus E
ucccuggccugcaacccccag

SEQ ID NO: 1574259 - RNA, 14 nt, Human adenovirus E
ggugaggaagagcc

SEQ ID NO: 1574260 - RNA, 22 nt, Human adenovirus E
ucgcuguugagacccgagcggg

SEQ ID NO: 1574261 - RNA, 16 nt, Human adenovirus E
ccgcgagggugcugcc

SEQ ID NO: 1574262 - RNA, 15 nt, Human adenovirus E
acuacagccuaggcc

SEQ ID NO: 1574263 - RNA, 17 nt, Human adenovirus E
ccguggagcuggagugc

SEQ ID NO: 1574264 - RNA, 14 nt, Human adenovirus E
gugccccagggcau

SEQ ID NO: 1574265 - RNA, 20 nt, Human adenovirus E
ucacuuuguggacaacaccu

SEQ ID NO: 1574266 - RNA, 23 nt, Human adenovirus E
guuccugugggacgauguggaca

SEQ ID NO: 1574267 - RNA, 20 nt, Human adenovirus E
aagcguucagggaggcgcug

SEQ ID NO: 1574268 - RNA, 18 nt, Human adenovirus E
agauggugggccuuugga

SEQ ID NO: 1574269 - RNA, 23 nt, Human adenovirus E
gagcuugggggcgaggaagacgg

SEQ ID NO: 1574270 - RNA, 18 nt, Human adenovirus E
gcaggccugcgggggcaa

SEQ ID NO: 1574271 - RNA, 22 nt, Human adenovirus E
agggggcgaggagccccgggcc

SEQ ID NO: 1574272 - RNA, 15 nt, Human adenovirus E
auuuggaggaagacu

SEQ ID NO: 1574273 - RNA, 19 nt, Human adenovirus E
ucaccccggggcuguggac

SEQ ID NO: 1574274 - RNA, 18 nt, Human adenovirus E
ggcgagggccugcucgag

SEQ ID NO: 1574275 - RNA, 17 nt, Human adenovirus E
cgcgguugagaaggaac

SEQ ID NO: 1574276 - RNA, 19 nt, Human adenovirus E
acgcccuuuucaaccuggg

SEQ ID NO: 1574277 - RNA, 20 nt, Human adenovirus E
ccacgugcgcacccugaucg

SEQ ID NO: 1574278 - RNA, 16 nt, Human adenovirus E
cgagccugcugacgcc

SEQ ID NO: 1574279 - RNA, 15 nt, Human adenovirus E
cagcgacgagcagcu

SEQ ID NO: 1574280 - RNA, 12 nt, Human adenovirus E
agccccaggcca

SEQ ID NO: 1574281 - RNA, 21 nt, Human adenovirus E
uaccauugucaaugccaccuc

SEQ ID NO: 1574282 - RNA, 18 nt, Human adenovirus E
gcagacaacgcaccgacc

SEQ ID NO: 1574283 - RNA, 21 nt, Human adenovirus E
gcaggccggagcuguccaggg

SEQ ID NO: 1574284 - RNA, 17 nt, Human adenovirus E
uggaccucgauuccucg

SEQ ID NO: 1574285 - RNA, 21 nt, Human adenovirus E
cugcccccgccccagcagcaa

SEQ ID NO: 1574286 - RNA, 20 nt, Human adenovirus E
agagcgugaugcagcaggcg

SEQ ID NO: 1574287 - RNA, 23 nt, Human adenovirus E
cgcuguccgagaagcuggcggcc

SEQ ID NO: 1574288 - RNA, 19 nt, Human adenovirus E
cgccagacgccgcaccugc

SEQ ID NO: 1574289 - RNA, 19 nt, Human adenovirus E
gaggaaccccgcccacucc

SEQ ID NO: 1574290 - RNA, 15 nt, Human adenovirus E
gcugauggaaguggc

SEQ ID NO: 1574291 - RNA, 16 nt, Human adenovirus E
uggucuccaugagcuc

SEQ ID NO: 1574292 - RNA, 19 nt, Human adenovirus E
cguguucuccccccgaccg

SEQ ID NO: 1574293 - RNA, 18 nt, Human adenovirus E
gcaagaccaccacucgcc

SEQ ID NO: 1574294 - RNA, 14 nt, Human adenovirus E
uguaucccacccug

SEQ ID NO: 1574295 - RNA, 23 nt, Human adenovirus E
ccaacguggagcugaccaaccug

SEQ ID NO: 1574296 - RNA, 15 nt, Human adenovirus E
gugggaccugcugga

SEQ ID NO: 1574297 - RNA, 20 nt, Human adenovirus E
caucucuucuacuuccuccu

SEQ ID NO: 1574298 - RNA, 22 nt, Human adenovirus E
caagggcccagcgaaggcgagg

SEQ ID NO: 1574299 - RNA, 16 nt, Human adenovirus E
ccacaucacccucugg

SEQ ID NO: 1574300 - RNA, 23 nt, Human adenovirus E
gcuggaagacguaugcgcaggag

SEQ ID NO: 1574301 - RNA, 17 nt, Human adenovirus E
cuccuucagcgcgcgcu

SEQ ID NO: 1574302 - RNA, 16 nt, Human adenovirus E
cgagcccgagggccgc

SEQ ID NO: 1574303 - RNA, 13 nt, Human adenovirus E
gcgagggugcgcu

SEQ ID NO: 1574304 - RNA, 20 nt, Human adenovirus E
gcuccacgguggccgcgaag

SEQ ID NO: 1574305 - RNA, 21 nt, Human adenovirus E
uguggagccacugcuaccugc

SEQ ID NO: 1574306 - RNA, 17 nt, Human adenovirus E
cgugcagcggcagauca

SEQ ID NO: 1574307 - RNA, 20 nt, Human adenovirus E
ccaagaacagccagagcagg

SEQ ID NO: 1574308 - RNA, 12 nt, Human adenovirus E
ugaccugggcua

SEQ ID NO: 1574309 - RNA, 20 nt, Human adenovirus E
cagcagucgcugccgccgcc

SEQ ID NO: 1574310 - RNA, 14 nt, Human adenovirus E
cacggcccucagca

SEQ ID NO: 1574311 - RNA, 15 nt, Human adenovirus E
gagcuguaccugagu

SEQ ID NO: 1574312 - RNA, 18 nt, Human adenovirus E
ccagacgcgcggcuucag

SEQ ID NO: 1574313 - RNA, 14 nt, Human adenovirus E
cggguuccuguggg

SEQ ID NO: 1574314 - RNA, 17 nt, Human adenovirus E
caacaaaugccagcuga

SEQ ID NO: 1574315 - RNA, 14 nt, Human adenovirus E
ugagcggggcugga

SEQ ID NO: 1574316 - RNA, 19 nt, Human adenovirus E
acagcuaccuccagugccu

SEQ ID NO: 1574317 - RNA, 16 nt, Human adenovirus E
gugaccgaggugcccc

SEQ ID NO: 1574318 - RNA, 11 nt, Human adenovirus E
cugggccagga

SEQ ID NO: 1574319 - RNA, 21 nt, Human adenovirus E
cagcagcacacaacaggcgca

SEQ ID NO: 1574320 - RNA, 16 nt, Human adenovirus E
gauccacgggaucuga

SEQ ID NO: 1574321 - RNA, 18 nt, Human adenovirus E
ggccaaagucuaaaaaua

SEQ ID NO: 1574322 - RNA, 21 nt, Human adenovirus E
ccgccgcuguggagccacugc

SEQ ID NO: 1574323 - RNA, 22 nt, Human adenovirus E
gaaccugaaagagcucugcaag

SEQ ID NO: 1574324 - RNA, 22 nt, Human adenovirus E
gggcgucgcagggggccacgag

SEQ ID NO: 1574325 - RNA, 13 nt, Human adenovirus E
ggaccgaggggga

SEQ ID NO: 1574326 - RNA, 13 nt, Human adenovirus E
cucucgaggacgc

SEQ ID NO: 1574327 - RNA, 22 nt, Human adenovirus E
gcccgaggagaugcgcgcggcc

SEQ ID NO: 1574328 - RNA, 20 nt, Human adenovirus E
agacgaggaggaggcagagg

SEQ ID NO: 1574329 - RNA, 16 nt, Human adenovirus E
cuugggcggcagcggc

SEQ ID NO: 1574330 - RNA, 17 nt, Human adenovirus E
uggaucagguuuaggac

SEQ ID NO: 1574331 - RNA, 16 nt, Human adenovirus E
ggccgcggccaaccug

SEQ ID NO: 1574332 - RNA, 22 nt, Human adenovirus E
augauucgacaagaugaauaca

SEQ ID NO: 1574333 - RNA, 13 nt, Human adenovirus E
gggccuggccgcc

SEQ ID NO: 1574334 - RNA, 18 nt, Human adenovirus E
uccaagucugugccaccc

SEQ ID NO: 1574335 - RNA, 15 nt, Human adenovirus E
gaccugggcggcgag

SEQ ID NO: 1574336 - RNA, 22 nt, Human adenovirus E
uguccacccgcucucugcucaa

SEQ ID NO: 1574337 - RNA, 18 nt, Human adenovirus E
aggcgggacagaggaggg

SEQ ID NO: 1574338 - RNA, 16 nt, Human adenovirus E
gguucaccugcagcag

SEQ ID NO: 1574339 - RNA, 13 nt, Human adenovirus E
acaaaaaugaaca

SEQ ID NO: 1574340 - RNA, 17 nt, Human adenovirus E
ggaggccaucgugcaga

SEQ ID NO: 1574341 - RNA, 15 nt, Human adenovirus E
cgcugcgcccccagc

SEQ ID NO: 1574342 - RNA, 12 nt, Human adenovirus E
gcgcgcugcccg

SEQ ID NO: 1574343 - RNA, 18 nt, Human adenovirus E
agcugaccuagcucggcu

SEQ ID NO: 1574344 - RNA, 20 nt, Human adenovirus E
  misc_feature (7)..(7): n is a, c, g or u
gcagccnuucuccacgggga

SEQ ID NO: 1574345 - RNA, 19 nt, Human adenovirus E
caguuuuuccaacaacacc

SEQ ID NO: 1574346 - RNA, 13 nt, Human adenovirus E
cgacaccuggacc

SEQ ID NO: 1574347 - RNA, 20 nt, Human adenovirus E
acaaaaaggaagaagaaagu

SEQ ID NO: 1574348 - RNA, 19 nt, Human adenovirus E
uccagggacucccucagca

SEQ ID NO: 1574349 - RNA, 16 nt, Human adenovirus E
accgcacccgcgccga

SEQ ID NO: 1574350 - RNA, 15 nt, Human adenovirus E
gucccgucgaccccc

SEQ ID NO: 1574351 - RNA, 18 nt, Human adenovirus E
uaucgccuccuuggaaga

SEQ ID NO: 1574352 - RNA, 21 nt, Human adenovirus E
gggacagaugugggacgauga

SEQ ID NO: 1574353 - RNA, 23 nt, Human adenovirus E
cccgcuguguugguggaaaauaa

SEQ ID NO: 1574354 - RNA, 15 nt, Human adenovirus E
gcgccggcaggaccc

SEQ ID NO: 1574355 - RNA, 15 nt, Human adenovirus E
cacgaagcccugcag

SEQ ID NO: 1574356 - RNA, 18 nt, Human adenovirus E
acgugcgcgaggccgugg

SEQ ID NO: 1574357 - RNA, 21 nt, Human adenovirus E
gccgcuccgucaagcugcugc

SEQ ID NO: 1574358 - RNA, 18 nt, Human adenovirus E
augcauagucugcagcgg

SEQ ID NO: 1574359 - RNA, 23 nt, Human adenovirus E
agagcucgcgcagagcgcccucc

SEQ ID NO: 1574360 - RNA, 14 nt, Human adenovirus E
auauaccaaugcug

SEQ ID NO: 1574361 - RNA, 22 nt, Human adenovirus E
cgcgaggaggugacccugggcc

SEQ ID NO: 1574362 - RNA, 17 nt, Human adenovirus E
ucgcaaucaggcagcac

SEQ ID NO: 1574363 - RNA, 20 nt, Human adenovirus E
acuaggaacuucaggcuggg

SEQ ID NO: 1574364 - RNA, 13 nt, Human adenovirus E
ugagcaccacagc

SEQ ID NO: 1574365 - RNA, 13 nt, Human adenovirus E
aacgcgcuggugg

SEQ ID NO: 1574366 - RNA, 17 nt, Human adenovirus E
cugguacuuggccagcc

SEQ ID NO: 1574367 - RNA, 18 nt, Human adenovirus E
ugcacgccgcaccgcucc

SEQ ID NO: 1574368 - RNA, 14 nt, Human adenovirus E
cucccggaggaggg

SEQ ID NO: 1574369 - RNA, 12 nt, Human adenovirus E
gacaacccacau

SEQ ID NO: 1574370 - RNA, 15 nt, Human adenovirus E
gaauacaccacccuc

SEQ ID NO: 1574371 - RNA, 16 nt, Human adenovirus E
acgcgcacuuccucaa

SEQ ID NO: 1574372 - RNA, 18 nt, Human adenovirus E
ccaaagucaugagcgcgg

SEQ ID NO: 1574373 - RNA, 18 nt, Human adenovirus E
cggguucgugcgccaggc

SEQ ID NO: 1574374 - RNA, 13 nt, Human adenovirus E
cgggagcugagga

SEQ ID NO: 1574375 - RNA, 16 nt, Human adenovirus E
cgaguccaaccuggga

SEQ ID NO: 1574376 - RNA, 20 nt, Human adenovirus E
ccagcaaagccuccacgcgc

SEQ ID NO: 1574377 - RNA, 19 nt, Human adenovirus E
agccacgaccgccgcggcc

SEQ ID NO: 1574378 - RNA, 21 nt, Human adenovirus E
cuuuggaagauguugaagugg

SEQ ID NO: 1574379 - RNA, 13 nt, Human adenovirus E
cgaggugccccuc

SEQ ID NO: 1574380 - RNA, 19 nt, Human adenovirus E
ugagggagagacagcugcc

SEQ ID NO: 1574381 - RNA, 17 nt, Human adenovirus E
caaacuaaccuccacca

SEQ ID NO: 1574382 - RNA, 20 nt, Human adenovirus E
uagucgagggucuccuggau

SEQ ID NO: 1574383 - RNA, 19 nt, Human adenovirus E
ggcgacgaggccggccugg

SEQ ID NO: 1574384 - RNA, 14 nt, Human adenovirus E
gaggaugcagcagc

SEQ ID NO: 1574385 - RNA, 14 nt, Human adenovirus E
caagaacagccaga

SEQ ID NO: 1574386 - RNA, 20 nt, Human adenovirus E
aggacuccgccgacgacagc

SEQ ID NO: 1574387 - RNA, 16 nt, Human adenovirus E
gucaccuccacagccc

SEQ ID NO: 1574388 - RNA, 20 nt, Human adenovirus E
uuccacgguggcuuccagca

SEQ ID NO: 1574389 - RNA, 15 nt, Human adenovirus E
cacucaacccacccc

SEQ ID NO: 1574390 - RNA, 15 nt, Human adenovirus E
caagggucuguggac

SEQ ID NO: 1574391 - RNA, 18 nt, Human adenovirus E
gcggucauaccagcagcc

SEQ ID NO: 1574392 - RNA, 22 nt, Human adenovirus E
uggaagagggcgaggggcuggc

SEQ ID NO: 1574393 - RNA, 12 nt, Human adenovirus E
ucagcuggaagu

SEQ ID NO: 1574394 - RNA, 15 nt, Human adenovirus E
ccuggaagacugaug

SEQ ID NO: 1574395 - RNA, 22 nt, Human adenovirus E
ccacguacaugaucuccuuggg

SEQ ID NO: 1574396 - RNA, 17 nt, Human adenovirus E
cggugccgcccaggacu

SEQ ID NO: 1574397 - RNA, 21 nt, Human adenovirus E
acaagucggcggacaucgccu

SEQ ID NO: 1574398 - RNA, 16 nt, Human adenovirus E
ucaggcagaggaggag

SEQ ID NO: 1574399 - RNA, 20 nt, Human adenovirus E
cagcagcacacaacaggcgc

SEQ ID NO: 1574400 - RNA, 17 nt, Human adenovirus E
caugcccaacgugaacg

SEQ ID NO: 1574401 - RNA, 15 nt, Human adenovirus E
gguguccagcuggcg

SEQ ID NO: 1574402 - RNA, 20 nt, Human adenovirus E
ccagcagcaacuuccagcca

SEQ ID NO: 1574403 - RNA, 21 nt, Human adenovirus E
cagcaaggcguggaacagcac

SEQ ID NO: 1574404 - RNA, 16 nt, Human adenovirus E
caguuccgccaggagg

SEQ ID NO: 1574405 - RNA, 12 nt, Human adenovirus E
ccugcacaggca

SEQ ID NO: 1574406 - RNA, 14 nt, Human adenovirus E
ccacagcgcccugg

SEQ ID NO: 1574407 - RNA, 14 nt, Human adenovirus E
ugucuugcugcccg

SEQ ID NO: 1574408 - RNA, 19 nt, Human adenovirus E
cuugcacgagaaccgccug

SEQ ID NO: 1574409 - RNA, 14 nt, Human adenovirus E
auuacacagacaac

SEQ ID NO: 1574410 - RNA, 15 nt, Human adenovirus E
ucaccaccucccggu

SEQ ID NO: 1574411 - RNA, 18 nt, Human adenovirus E
gccacaauacaugcccau

SEQ ID NO: 1574412 - RNA, 22 nt, Human adenovirus E
cgucuccugcuugcaggccugc

SEQ ID NO: 1574413 - RNA, 14 nt, Human adenovirus E
ggggcggcagaacg

SEQ ID NO: 1574414 - RNA, 17 nt, Human adenovirus E
aacacuguaucccaccc

SEQ ID NO: 1574415 - RNA, 16 nt, Human adenovirus E
aucucgucgaagccgu

SEQ ID NO: 1574416 - RNA, 14 nt, Human adenovirus E
gagccgccucagca

SEQ ID NO: 1574417 - RNA, 17 nt, Human adenovirus E
cccgccaacgugccccg

SEQ ID NO: 1574418 - RNA, 14 nt, Human adenovirus E
gccgcccagccccg

SEQ ID NO: 1574419 - RNA, 13 nt, Human adenovirus E
acaauaucuuuga

SEQ ID NO: 1574420 - RNA, 12 nt, Human adenovirus E
caggcagcgggg

SEQ ID NO: 1574421 - RNA, 19 nt, Human adenovirus E
accgcagcuugcccucggc

SEQ ID NO: 1574422 - RNA, 19 nt, Human adenovirus E
uaaugagaaaauuacuauu

SEQ ID NO: 1574423 - RNA, 19 nt, Human adenovirus E
cgggugauccuccaccaga

SEQ ID NO: 1574424 - RNA, 14 nt, Human adenovirus E
cagagacaggagcg

SEQ ID NO: 1574425 - RNA, 15 nt, Human adenovirus E
acacgcccagaaacc

SEQ ID NO: 1574426 - RNA, 20 nt, Human adenovirus E
gaucucgucgaagccguuga

SEQ ID NO: 1574427 - RNA, 19 nt, Human adenovirus E
ggcuucgacaccuggacca

SEQ ID NO: 1574428 - RNA, 15 nt, Human adenovirus E
ucccuggccugcaac

SEQ ID NO: 1574429 - RNA, 15 nt, Human adenovirus E
gcgagcaaggacaga

SEQ ID NO: 1574430 - RNA, 21 nt, Human adenovirus E
gugcaaccggugcugagaccc

SEQ ID NO: 1574431 - RNA, 19 nt, Human adenovirus E
cuucacgccucgucaggcc

SEQ ID NO: 1574432 - RNA, 19 nt, Human adenovirus E
caguacgcgcucagcaccg

SEQ ID NO: 1574433 - RNA, 15 nt, Human adenovirus E
cuccauugcagggcc

SEQ ID NO: 1574434 - RNA, 22 nt, Human adenovirus E
cggagcacgaggaggagcuggc

SEQ ID NO: 1574435 - RNA, 22 nt, Human adenovirus E
cgggcaugggcguguggcagca

SEQ ID NO: 1574436 - RNA, 12 nt, Human adenovirus E
ccucuucuuggu

SEQ ID NO: 1574437 - RNA, 22 nt, Human adenovirus E
ugguaguugagggagagacagc

SEQ ID NO: 1574438 - RNA, 22 nt, Human adenovirus E
cuccaauugccugaacgccugc

SEQ ID NO: 1574439 - RNA, 17 nt, Human adenovirus E
gucaggcagaggaggag

SEQ ID NO: 1574440 - RNA, 17 nt, Human adenovirus E
cucaggcagaggaggac

SEQ ID NO: 1574441 - RNA, 18 nt, Human adenovirus E
gccgagcugucggccugc

SEQ ID NO: 1574442 - RNA, 20 nt, Human adenovirus E
cucgaaucaggcuggagccg

SEQ ID NO: 1574443 - RNA, 21 nt, Human adenovirus E
ccugacacaccaccacagcaa

SEQ ID NO: 1574444 - RNA, 23 nt, Human adenovirus E
acuacuuccgcgagacgcccagg

SEQ ID NO: 1574445 - RNA, 18 nt, Human adenovirus E
acgccaucgucuccugcu

SEQ ID NO: 1574446 - RNA, 21 nt, Human adenovirus E
cggcauggcccgcgggcaggg

SEQ ID NO: 1574447 - RNA, 19 nt, Human adenovirus E
gucuggcccgugaggcgcg

SEQ ID NO: 1574448 - RNA, 21 nt, Human adenovirus E
gcucggcuucgacaccuggac

SEQ ID NO: 1574449 - RNA, 20 nt, Human adenovirus E
gggaccccgugaccgagcug

SEQ ID NO: 1574450 - RNA, 21 nt, Human adenovirus E
ggcuggucgaaaaccgcuccc

SEQ ID NO: 1574451 - RNA, 23 nt, Human adenovirus E
gcaaggucgaggagaaccugcac

SEQ ID NO: 1574452 - RNA, 12 nt, Human adenovirus E
uaccucuucagg

SEQ ID NO: 1574453 - RNA, 23 nt, Human adenovirus E
cccgcgcgcgcgcacguggccgc

SEQ ID NO: 1574454 - RNA, 18 nt, Human adenovirus E
gucucgcacuccacgagc

SEQ ID NO: 1574455 - RNA, 21 nt, Human adenovirus E
aacaacagcccccuccacagc

SEQ ID NO: 1574456 - RNA, 11 nt, Human adenovirus E
acggaggccag

SEQ ID NO: 1574457 - RNA, 22 nt, Human adenovirus E
cacaauuacucacaccacacac

SEQ ID NO: 1574458 - RNA, 17 nt, Human adenovirus E
acuaccaccacuacagc

SEQ ID NO: 1574459 - RNA, 13 nt, Human adenovirus E
cucugccacaccu

SEQ ID NO: 1574460 - RNA, 19 nt, Human adenovirus E
cgcacgggacgcagggcca

SEQ ID NO: 1574461 - RNA, 15 nt, Human adenovirus E
gcccuugcgcgagca

SEQ ID NO: 1574462 - RNA, 13 nt, Human adenovirus E
cugcgccugaugg

SEQ ID NO: 1574463 - RNA, 14 nt, Human adenovirus E
gcaucugcugcugu

SEQ ID NO: 1574464 - RNA, 13 nt, Human adenovirus E
uuccagcaaagcc

SEQ ID NO: 1574465 - RNA, 21 nt, Human adenovirus E
ccgcaucugcaccucacagcu

SEQ ID NO: 1574466 - RNA, 13 nt, Human adenovirus E
gaucccuccaggu

SEQ ID NO: 1574467 - RNA, 15 nt, Human adenovirus E
ggccugcaaccccca

SEQ ID NO: 1574468 - RNA, 17 nt, Human adenovirus E
gugagcucgucgggguc

SEQ ID NO: 1574469 - RNA, 19 nt, Human adenovirus E
ccugccgcugcgcagcagu

SEQ ID NO: 1574470 - RNA, 17 nt, Human adenovirus E
gcgaugcgggcggcgcu

SEQ ID NO: 1574471 - RNA, 21 nt, Human adenovirus E
cucggacuucgugccgcugac

SEQ ID NO: 1574472 - RNA, 15 nt, Human adenovirus E
acagcgcccuggucg

SEQ ID NO: 1574473 - RNA, 13 nt, Human adenovirus E
ccgagcuccagcu

SEQ ID NO: 1574474 - RNA, 20 nt, Human adenovirus E
cagcagaaaaccagcagcua

SEQ ID NO: 1574475 - RNA, 16 nt, Human adenovirus E
cucccccggccacuac

SEQ ID NO: 1574476 - RNA, 14 nt, Human adenovirus E
gccaccucagcuca

SEQ ID NO: 1574477 - RNA, 14 nt, Human adenovirus E
gaccaggagcugau

SEQ ID NO: 1574478 - RNA, 16 nt, Human adenovirus E
gcgccgggcccgcgau

SEQ ID NO: 1574479 - RNA, 21 nt, Human adenovirus E
cagcguguucuccccccgacc

SEQ ID NO: 1574480 - RNA, 17 nt, Human adenovirus E
gcccguggucagcgacg

SEQ ID NO: 1574481 - RNA, 17 nt, Human adenovirus E
ugaucaccagcuggccu

SEQ ID NO: 1574482 - RNA, 22 nt, Human adenovirus E
ggccugcucgagugccacugcc

SEQ ID NO: 1574483 - RNA, 19 nt, Human adenovirus E
ccuccagugccuucucuag

SEQ ID NO: 1574484 - RNA, 23 nt, Human adenovirus E
cccgggaguuccuccacuuccuc

SEQ ID NO: 1574485 - RNA, 23 nt, Human adenovirus E
caugauuggcauuauuguugcug

SEQ ID NO: 1574486 - RNA, 15 nt, Human adenovirus E
gaccgaggugcccca

SEQ ID NO: 1574487 - RNA, 23 nt, Human adenovirus E
cugcccgacuuuaugagccaaag

SEQ ID NO: 1574488 - RNA, 20 nt, Human adenovirus E
ccacagcaacuuccugacca

SEQ ID NO: 1574489 - RNA, 12 nt, Human adenovirus E
ugacccugggcc

SEQ ID NO: 1574490 - RNA, 20 nt, Human adenovirus E
cugacguaaaggccaaaguc

SEQ ID NO: 1574491 - RNA, 21 nt, Human adenovirus E
gcgagcagaaggggggcaggg

SEQ ID NO: 1574492 - RNA, 15 nt, Human adenovirus E
ugcacccgugcagcc

SEQ ID NO: 1574493 - RNA, 16 nt, Human adenovirus E
cuaucauuaccucugc

SEQ ID NO: 1574494 - RNA, 19 nt, Human adenovirus E
cgacccgggcaaccuggaa

SEQ ID NO: 1574495 - RNA, 23 nt, Human adenovirus E
agcgcuagcagccgcggccaggg

SEQ ID NO: 1574496 - RNA, 18 nt, Human adenovirus E
ugcccucggccucggugc

SEQ ID NO: 1574497 - RNA, 12 nt, Human adenovirus E
ucuggaggagca

SEQ ID NO: 1574498 - RNA, 16 nt, Human adenovirus E
cgagccggggcagcgc

SEQ ID NO: 1574499 - RNA, 22 nt, Human adenovirus E
agcgcaugcggaucucgcucag

SEQ ID NO: 1574500 - RNA, 18 nt, Human adenovirus E
cugcguuacgugcagcag

SEQ ID NO: 1574501 - RNA, 22 nt, Human adenovirus E
agggccgcuggcuccuggaccu

SEQ ID NO: 1574502 - RNA, 22 nt, Human adenovirus E
ggccgcgcaccucugacccugc

SEQ ID NO: 1574503 - RNA, 22 nt, Human adenovirus E
cgcagcagcugcgcgccuucac

SEQ ID NO: 1574504 - RNA, 16 nt, Human adenovirus E
gccgaccgcggcgccg

SEQ ID NO: 1574505 - RNA, 17 nt, Human adenovirus E
cuguaccgcgaggccau

SEQ ID NO: 1574506 - RNA, 23 nt, Human adenovirus E
ccaaaaaucagacaugcauccca

SEQ ID NO: 1574507 - RNA, 13 nt, Human adenovirus E
cuuugacuuuggu

SEQ ID NO: 1574508 - RNA, 22 nt, Human adenovirus E
gccgcgaacgcucugcaaggag

SEQ ID NO: 1574509 - RNA, 11 nt, Human adenovirus E
gcccugcagga

SEQ ID NO: 1574510 - RNA, 13 nt, Human adenovirus E
gagcgcauggucu

SEQ ID NO: 1574511 - RNA, 22 nt, Human adenovirus E
augcugacgagcccgcgcggga

SEQ ID NO: 1574512 - RNA, 15 nt, Human adenovirus E
ugaagauggagccau

SEQ ID NO: 1574513 - RNA, 19 nt, Human adenovirus E
gugaagaagaccccgcagg

SEQ ID NO: 1574514 - RNA, 13 nt, Human adenovirus E
cauuaccacacag

SEQ ID NO: 1574515 - RNA, 23 nt, Human adenovirus E
gucuccgcggccggcgcgcucca

SEQ ID NO: 1574516 - RNA, 21 nt, Human adenovirus E
cacgugagccgcgcccugggc

SEQ ID NO: 1574517 - RNA, 23 nt, Human adenovirus E
gaccgacgcccguccucggcgcu

SEQ ID NO: 1574518 - RNA, 19 nt, Human adenovirus E
cauucggggaagacguggu

SEQ ID NO: 1574519 - RNA, 18 nt, Human adenovirus E
guccgcccgcccgcgccc

SEQ ID NO: 1574520 - RNA, 16 nt, Human adenovirus E
caaugguacugaucug

SEQ ID NO: 1574521 - RNA, 17 nt, Human adenovirus E
ccgcgcuugcugggcga

SEQ ID NO: 1574522 - RNA, 18 nt, Human adenovirus E
cacccccacggaggccag

SEQ ID NO: 1574523 - RNA, 18 nt, Human adenovirus E
aggaugcagcagcugaag

SEQ ID NO: 1574524 - RNA, 14 nt, Human adenovirus E
ugacugacccacug

SEQ ID NO: 1574525 - RNA, 15 nt, Human adenovirus E
cagggcuugcagacc

SEQ ID NO: 1574526 - RNA, 18 nt, Human adenovirus E
cggcagaucaacagccgc

SEQ ID NO: 1574527 - RNA, 15 nt, Human adenovirus E
aagaguuccaggcgg

SEQ ID NO: 1574528 - RNA, 15 nt, Human adenovirus E
cucaccgccacgccc

SEQ ID NO: 1574529 - RNA, 17 nt, Human adenovirus E
guugcaagggcccagcg

SEQ ID NO: 1574530 - RNA, 16 nt, Human adenovirus E
cgcggucauggaccag

SEQ ID NO: 1574531 - RNA, 21 nt, Human adenovirus E
ugcgaccugacggagucuucc

SEQ ID NO: 1574532 - RNA, 21 nt, Human adenovirus E
cagcgcccuggucgaguugga

SEQ ID NO: 1574533 - RNA, 22 nt, Human adenovirus E
cauugucaaugccaccucagcu

SEQ ID NO: 1574534 - RNA, 18 nt, Human adenovirus E
cgcaaucaggcagcaccg

SEQ ID NO: 1574535 - RNA, 13 nt, Human adenovirus E
auggaacuacagc

SEQ ID NO: 1574536 - RNA, 13 nt, Human adenovirus E
cggacgagcugac

SEQ ID NO: 1574537 - RNA, 14 nt, Human adenovirus E
aagacgugcuggag

SEQ ID NO: 1574538 - RNA, 22 nt, Human adenovirus E
cgcucugguggccaacgccagu

SEQ ID NO: 1574539 - RNA, 21 nt, Human adenovirus E
gcagcuugccauucgcgcacg

SEQ ID NO: 1574540 - RNA, 23 nt, Human adenovirus E
ucuaucucccgccugaaccugac

SEQ ID NO: 1574541 - RNA, 19 nt, Human adenovirus E
auguccaccugcggggcga

SEQ ID NO: 1574542 - RNA, 16 nt, Human adenovirus E
acuccccuccugcaca

SEQ ID NO: 1574543 - RNA, 16 nt, Human adenovirus E
gggaccugcuggaggc

SEQ ID NO: 1574544 - RNA, 19 nt, Human adenovirus E
ugcacgguaagagccuagc

SEQ ID NO: 1574545 - RNA, 14 nt, Human adenovirus E
gacguccugcagga

SEQ ID NO: 1574546 - RNA, 16 nt, Human adenovirus E
gcacgaggaggagcug

SEQ ID NO: 1574547 - RNA, 15 nt, Human adenovirus E
cgugaccgagcuggu

SEQ ID NO: 1574548 - RNA, 19 nt, Human adenovirus E
ccauggaaacgcagaccga

SEQ ID NO: 1574549 - RNA, 18 nt, Human adenovirus E
guaucguugacggcggcc

SEQ ID NO: 1574550 - RNA, 14 nt, Human adenovirus E
gucgcagggggcca

SEQ ID NO: 1574551 - RNA, 17 nt, Human adenovirus E
gaaauuguaaaacagcc

SEQ ID NO: 1574552 - RNA, 15 nt, Human adenovirus E
gcccgguggcugggu

SEQ ID NO: 1574553 - RNA, 15 nt, Human adenovirus E
cagccccaggccaac

SEQ ID NO: 1574554 - RNA, 14 nt, Human adenovirus E
cagaaagcacagac

SEQ ID NO: 1574555 - RNA, 14 nt, Human adenovirus E
aguugcagaggcgc

SEQ ID NO: 1574556 - RNA, 14 nt, Human adenovirus E
gcagccccaggcca

SEQ ID NO: 1574557 - RNA, 20 nt, Human adenovirus E
ucgcgcuccaaccccacgca

SEQ ID NO: 1574558 - RNA, 14 nt, Human adenovirus E
accagauccucagg

SEQ ID NO: 1574559 - RNA, 23 nt, Human adenovirus E
ggagaacagcagucaggcagagg

SEQ ID NO: 1574560 - RNA, 22 nt, Human adenovirus E
cugcucgggcaucagcuggaag

SEQ ID NO: 1574561 - RNA, 11 nt, Human adenovirus E
aguccccagag

SEQ ID NO: 1574562 - RNA, 16 nt, Human adenovirus E
gcaugaccucggcacu

SEQ ID NO: 1574563 - RNA, 19 nt, Human adenovirus E
caagcggugcguuccagca

SEQ ID NO: 1574564 - RNA, 12 nt, Human adenovirus E
caagcauggaga

SEQ ID NO: 1574565 - RNA, 16 nt, Human adenovirus E
cgagacgaugggcagg

SEQ ID NO: 1574566 - RNA, 23 nt, Human adenovirus E
agugcgucucgggacccugccau

SEQ ID NO: 1574567 - RNA, 19 nt, Human adenovirus E
cgggcggcgcugcagagcc

SEQ ID NO: 1574568 - RNA, 21 nt, Human adenovirus E
uccugcccgcgcugaucccca

SEQ ID NO: 1574569 - RNA, 16 nt, Human adenovirus E
ccacggcccucagcau

SEQ ID NO: 1574570 - RNA, 12 nt, Human adenovirus E
gugccccagagc

SEQ ID NO: 1574571 - RNA, 16 nt, Human adenovirus E
gccgccgggccuugga

SEQ ID NO: 1574572 - RNA, 19 nt, Human adenovirus E
cucagcaucagucgucugg

SEQ ID NO: 1574573 - RNA, 15 nt, Human adenovirus E
ccugauaucgccucc

SEQ ID NO: 1574574 - RNA, 16 nt, Human adenovirus E
gagccacaccacagcu

SEQ ID NO: 1574575 - RNA, 19 nt, Human adenovirus E
ccaggccgaaguccagcug

SEQ ID NO: 1574576 - RNA, 14 nt, Human adenovirus E
ggggaacgggaugc

SEQ ID NO: 1574577 - RNA, 20 nt, Human adenovirus E
caggcggcgcgagcugagcg

SEQ ID NO: 1574578 - RNA, 16 nt, Human adenovirus E
cagcagcgagcugggc

SEQ ID NO: 1574579 - RNA, 15 nt, Human adenovirus E
cgcagcagcgcaugc

SEQ ID NO: 1574580 - RNA, 17 nt, Human adenovirus E
ucccucguacgagagcg

SEQ ID NO: 1574581 - RNA, 12 nt, Human adenovirus E
guuguaccuggu

SEQ ID NO: 1574582 - RNA, 15 nt, Human adenovirus E
cggcggcggcagcgg

SEQ ID NO: 1574583 - RNA, 11 nt, Human adenovirus E
cgccaccaccc

SEQ ID NO: 1574584 - RNA, 15 nt, Human adenovirus E
auaacuguaaguacu

SEQ ID NO: 1574585 - RNA, 22 nt, Human adenovirus E
gggcauaaaguugcgagugaug

SEQ ID NO: 1574586 - RNA, 14 nt, Human adenovirus E
caaggaggaugcag

SEQ ID NO: 1574587 - RNA, 20 nt, Human adenovirus E
ucauaccagcagccgccgcc

SEQ ID NO: 1574588 - RNA, 19 nt, Human adenovirus E
guguaccaguccgggccgg

SEQ ID NO: 1574589 - RNA, 14 nt, Human adenovirus E
ccuggaccacugcc

SEQ ID NO: 1574590 - RNA, 22 nt, Human adenovirus E
caggacauggaauacaccaccc

SEQ ID NO: 1574591 - RNA, 21 nt, Human adenovirus E
gccacggcggcggcagcggcc

SEQ ID NO: 1574592 - RNA, 18 nt, Human adenovirus E
accgcgccauugguggcg

SEQ ID NO: 1574593 - RNA, 15 nt, Human adenovirus E
gcaacuuccugacca

SEQ ID NO: 1574594 - RNA, 16 nt, Human adenovirus E
guaugcgaucucgguc

SEQ ID NO: 1574595 - RNA, 11 nt, Human adenovirus E
ucuuccuccuc

SEQ ID NO: 1574596 - RNA, 13 nt, Human adenovirus E
aaaauuugaagau

SEQ ID NO: 1574597 - RNA, 17 nt, Human adenovirus E
ccagaacacgcugccca

SEQ ID NO: 1574598 - RNA, 16 nt, Human adenovirus E
acggcccugcgguggu

SEQ ID NO: 1574599 - RNA, 17 nt, Human adenovirus E
gugcucggggguggugu

SEQ ID NO: 1574600 - RNA, 13 nt, Human adenovirus E
agggcgcgcggga

SEQ ID NO: 1574601 - RNA, 14 nt, Human adenovirus E
acuuccaagaagag

SEQ ID NO: 1574602 - RNA, 17 nt, Human adenovirus E
ggcggcgauguugagcu

SEQ ID NO: 1574603 - RNA, 15 nt, Human adenovirus E
gugcugacccugagc

SEQ ID NO: 1574604 - RNA, 20 nt, Human adenovirus E
ucagcgacgagcagcuggcc

SEQ ID NO: 1574605 - RNA, 17 nt, Human adenovirus E
agcucugcaagcuccug

SEQ ID NO: 1574606 - RNA, 16 nt, Human adenovirus E
uccagccgaaacucau

SEQ ID NO: 1574607 - RNA, 15 nt, Human adenovirus E
gaggucaggggcgau

SEQ ID NO: 1574608 - RNA, 15 nt, Human adenovirus E
cuggagcgacaucgg

SEQ ID NO: 1574609 - RNA, 17 nt, Human adenovirus E
caugccgcagaugucgu

SEQ ID NO: 1574610 - RNA, 18 nt, Human adenovirus E
cagcagucaggcagagga

SEQ ID NO: 1574611 - RNA, 13 nt, Human adenovirus E
cgagccaggugag

SEQ ID NO: 1574612 - RNA, 17 nt, Human adenovirus E
cccccagcgguucuggg

SEQ ID NO: 1574613 - RNA, 13 nt, Human adenovirus E
gccuccacccauc

SEQ ID NO: 1574614 - RNA, 17 nt, Human adenovirus E
cggauggcuggcagagc

SEQ ID NO: 1574615 - RNA, 16 nt, Human adenovirus E
agccgccuggacccgg

SEQ ID NO: 1574616 - RNA, 13 nt, Human adenovirus E
aguuuuacaggau

SEQ ID NO: 1574617 - RNA, 15 nt, Human adenovirus E
gagcgaccaggagcu

SEQ ID NO: 1574618 - RNA, 21 nt, Human adenovirus E
cagccccgauuaugcagggug

SEQ ID NO: 1574619 - RNA, 20 nt, Human adenovirus E
cgcgguagcgguccaucagc

SEQ ID NO: 1574620 - RNA, 15 nt, Human adenovirus E
gcaacggccugcccg

SEQ ID NO: 1574621 - RNA, 12 nt, Human adenovirus E
gcuccugguccu

SEQ ID NO: 1574622 - RNA, 13 nt, Human adenovirus E
aggagaaggagga

SEQ ID NO: 1574623 - RNA, 13 nt, Human adenovirus E
cauggcgaccagc

SEQ ID NO: 1574624 - RNA, 21 nt, Human adenovirus E
uacucacaccacacacacaga

SEQ ID NO: 1574625 - RNA, 19 nt, Human adenovirus E
gacagcacucaggcagagg

SEQ ID NO: 1574626 - RNA, 17 nt, Human adenovirus E
caggccgaaguccagcu

SEQ ID NO: 1574627 - RNA, 15 nt, Human adenovirus E
ucguccagggcagcu

SEQ ID NO: 1574628 - RNA, 18 nt, Human adenovirus E
ccaccacccccaguaccg

SEQ ID NO: 1574629 - RNA, 14 nt, Human adenovirus E
accgccgacgagaa

SEQ ID NO: 1574630 - RNA, 23 nt, Human adenovirus E
gcccugcgcgucggccagguagc

SEQ ID NO: 1574631 - RNA, 12 nt, Human adenovirus E
cgagggccugcu

SEQ ID NO: 1574632 - RNA, 11 nt, Human adenovirus E
ggcggcagcag

SEQ ID NO: 1574633 - RNA, 12 nt, Human adenovirus E
gcaggggcgcag

SEQ ID NO: 1574634 - RNA, 22 nt, Human adenovirus E
uaccgcggucauaccagcagcc

SEQ ID NO: 1574635 - RNA, 18 nt, Human adenovirus E
gcagcuguuccugguggu

SEQ ID NO: 1574636 - RNA, 21 nt, Human adenovirus E
cccagcucugguacugcaggc

SEQ ID NO: 1574637 - RNA, 22 nt, Human adenovirus E
cugcaggaagcggcccaucaug

SEQ ID NO: 1574638 - RNA, 21 nt, Human adenovirus E
uccauguuuucugccaacacc

SEQ ID NO: 1574639 - RNA, 16 nt, Human adenovirus E
cggggucgcugagccc

SEQ ID NO: 1574640 - RNA, 18 nt, Human adenovirus E
agagcaucguggugcagg

SEQ ID NO: 1574641 - RNA, 17 nt, Human adenovirus E
agcuaccagccccagau

SEQ ID NO: 1574642 - RNA, 22 nt, Human adenovirus E
aucuguagaaaaaacaaaaaug

SEQ ID NO: 1574643 - RNA, 23 nt, Human adenovirus E
ccagcaggcggcgcgagcugagc

SEQ ID NO: 1574644 - RNA, 13 nt, Human adenovirus E
cuccccccaggga

SEQ ID NO: 1574645 - RNA, 15 nt, Human adenovirus E
gcggccgccgugagc

SEQ ID NO: 1574646 - RNA, 23 nt, Human adenovirus E
cgcaacucguaccugggcuaccu

SEQ ID NO: 1574647 - RNA, 17 nt, Human adenovirus E
gaugccgggcaggaggu

SEQ ID NO: 1574648 - RNA, 19 nt, Human adenovirus E
ucgcguucccauuacgggc

SEQ ID NO: 1574649 - RNA, 15 nt, Human adenovirus E
gcgaacuccauggcu

SEQ ID NO: 1574650 - RNA, 23 nt, Human adenovirus E
caacaaaagaaaaauccuccagg

SEQ ID NO: 1574651 - RNA, 22 nt, Human adenovirus E
cgccuggccaacuaccuggccu

SEQ ID NO: 1574652 - RNA, 20 nt, Human adenovirus E
cgcugcgcaacggccugccc

SEQ ID NO: 1574653 - RNA, 20 nt, Human adenovirus E
ugcuuucgugguauugcuau

SEQ ID NO: 1574654 - RNA, 21 nt, Human adenovirus E
cggacgauuggacccaggcca

SEQ ID NO: 1574655 - RNA, 17 nt, Human adenovirus E
ugaguccgucggccaug

SEQ ID NO: 1574656 - RNA, 21 nt, Human adenovirus E
cccggagacgcgcggccacgg

SEQ ID NO: 1574657 - RNA, 13 nt, Human adenovirus E
accaggagcugau

SEQ ID NO: 1574658 - RNA, 20 nt, Human adenovirus E
cagcagagguugccagcucg

SEQ ID NO: 1574659 - RNA, 23 nt, Human adenovirus E
acaccaccuggacaaaauaccac

SEQ ID NO: 1574660 - RNA, 21 nt, Human adenovirus E
ccgccgcgcaucuccaggugg

SEQ ID NO: 1574661 - RNA, 13 nt, Human adenovirus E
aucaucugggccu

SEQ ID NO: 1574662 - RNA, 17 nt, Human adenovirus E
gcagccccaggccaacc

SEQ ID NO: 1574663 - RNA, 17 nt, Human adenovirus E
cccacggaggccagcac

SEQ ID NO: 1574664 - RNA, 13 nt, Human adenovirus E
agguacaugggca

SEQ ID NO: 1574665 - RNA, 13 nt, Human adenovirus E
cgccuggggcaga

SEQ ID NO: 1574666 - RNA, 20 nt, Human adenovirus E
gagcauugccaaaugcaaga

SEQ ID NO: 1574667 - RNA, 18 nt, Human adenovirus E
gacuccguggcucugccu

SEQ ID NO: 1574668 - RNA, 12 nt, Human adenovirus E
cgagggccgcug

SEQ ID NO: 1574669 - RNA, 21 nt, Human adenovirus E
gagccuuguugcgcagggcca

SEQ ID NO: 1574670 - RNA, 22 nt, Human adenovirus E
cugcuaccugcugcgccuggcc

SEQ ID NO: 1574671 - RNA, 15 nt, Human adenovirus E
gagcccgcgcgggag

SEQ ID NO: 1574672 - RNA, 23 nt, Human adenovirus E
ugacggguuccugugggacgaug

SEQ ID NO: 1574673 - RNA, 21 nt, Human adenovirus E
cagcgggcccugaccggggcc

SEQ ID NO: 1574674 - RNA, 22 nt, Human adenovirus E
caccuggacaaaauaccaccuc

SEQ ID NO: 1574675 - RNA, 21 nt, Human adenovirus E
ucuggaggaagacgaggagga

SEQ ID NO: 1574676 - RNA, 17 nt, Human adenovirus E
cccagaucaucggcacc

SEQ ID NO: 1574677 - RNA, 14 nt, Human adenovirus E
uggcacgacaggca

SEQ ID NO: 1574678 - RNA, 12 nt, Human adenovirus E
accuccacccac

SEQ ID NO: 1574679 - RNA, 20 nt, Human adenovirus E
ggcgcacgggacgcagggcc

SEQ ID NO: 1574680 - RNA, 19 nt, Human adenovirus E
agacgcgcgccgggcggca

SEQ ID NO: 1574681 - RNA, 22 nt, Human adenovirus E
cuacggcaucucgauccagcag

SEQ ID NO: 1574682 - RNA, 20 nt, Human adenovirus E
guaauuggcccgccgcccug

SEQ ID NO: 1574683 - RNA, 20 nt, Human adenovirus E
acuuccgcgcucccuggggc

SEQ ID NO: 1574684 - RNA, 13 nt, Human adenovirus E
acugacgccagac

SEQ ID NO: 1574685 - RNA, 13 nt, Human adenovirus E
acucgcagcagcu

SEQ ID NO: 1574686 - RNA, 12 nt, Human adenovirus E
gccgcggugcuc

SEQ ID NO: 1574687 - RNA, 19 nt, Human adenovirus E
ccgaaggaagaggcggugu

SEQ ID NO: 1574688 - RNA, 19 nt, Human adenovirus E
cauuaccacacagacaacc

SEQ ID NO: 1574689 - RNA, 21 nt, Human adenovirus E
gugggaccugcuggaggccau

SEQ ID NO: 1574690 - RNA, 17 nt, Human adenovirus E
auuaccucugcucuaug

SEQ ID NO: 1574691 - RNA, 14 nt, Human adenovirus E
cuugcaggccugcg

SEQ ID NO: 1574692 - RNA, 14 nt, Human adenovirus E
ccaccguggugcag

SEQ ID NO: 1574693 - RNA, 22 nt, Human adenovirus E
cguagaccgacuuuaugggccg

SEQ ID NO: 1574694 - RNA, 13 nt, Human adenovirus E
ucguccagggcag

SEQ ID NO: 1574695 - RNA, 14 nt, Human adenovirus E
gccagaugaugcaa

SEQ ID NO: 1574696 - RNA, 22 nt, Human adenovirus E
  misc_feature (7)..(7): n is a, c, g or u
ccccaunuagcagucccacugc

SEQ ID NO: 1574697 - RNA, 14 nt, Human adenovirus E
gacagaugugggac

SEQ ID NO: 1574698 - RNA, 21 nt, Human adenovirus E
ugcgguacacgggguugcagc

SEQ ID NO: 1574699 - RNA, 19 nt, Human adenovirus E
cucgcaacgcugcacggga

SEQ ID NO: 1574700 - RNA, 15 nt, Human adenovirus E
gcuccuccucggccu

SEQ ID NO: 1574701 - RNA, 13 nt, Human adenovirus E
ccgcgcaccucug

SEQ ID NO: 1574702 - RNA, 13 nt, Human adenovirus E
caggcggucccag

SEQ ID NO: 1574703 - RNA, 12 nt, Human adenovirus E
ucggccaugggc

SEQ ID NO: 1574704 - RNA, 18 nt, Human adenovirus E
ugagcagagucaggcugg

SEQ ID NO: 1574705 - RNA, 13 nt, Human adenovirus E
gggccacccccag

SEQ ID NO: 1574706 - RNA, 23 nt, Human adenovirus E
ccagcagagucgggggcaggagc

SEQ ID NO: 1574707 - RNA, 23 nt, Human adenovirus E
uucgugcgccaggccugcaagau

SEQ ID NO: 1574708 - RNA, 21 nt, Human adenovirus E
ugggcauucgcaagaggcagc

SEQ ID NO: 1574709 - RNA, 14 nt, Human adenovirus E
agcgcucaccgcca

SEQ ID NO: 1574710 - RNA, 23 nt, Human adenovirus E
cucgcgccugcugcugcugcugg

SEQ ID NO: 1574711 - RNA, 23 nt, Human adenovirus E
gcagcaaagcccccgaucccucc

SEQ ID NO: 1574712 - RNA, 17 nt, Human adenovirus E
uccuccucguagaggaa

SEQ ID NO: 1574713 - RNA, 15 nt, Human adenovirus E
cauggagacucagcc

SEQ ID NO: 1574714 - RNA, 23 nt, Human adenovirus E
auuaccucugcucuaugcaauuc

SEQ ID NO: 1574715 - RNA, 21 nt, Human adenovirus E
ggaucaucugggagcugaaca

SEQ ID NO: 1574716 - RNA, 22 nt, Human adenovirus E
cgccugcugcugcugcuggugg

SEQ ID NO: 1574717 - RNA, 12 nt, Human adenovirus E
acgcgcacuucc

SEQ ID NO: 1574718 - RNA, 16 nt, Human adenovirus E
cggcgggcgcagcagc

SEQ ID NO: 1574719 - RNA, 13 nt, Human adenovirus E
cuuugaggaggag

SEQ ID NO: 1574720 - RNA, 12 nt, Human adenovirus E
caaggaggaugc

SEQ ID NO: 1574721 - RNA, 15 nt, Human adenovirus E
cggugccgcccagga

SEQ ID NO: 1574722 - RNA, 16 nt, Human adenovirus E
uugcagggccuguggg

SEQ ID NO: 1574723 - RNA, 15 nt, Human adenovirus E
cgcggcgacgaggcc

SEQ ID NO: 1574724 - RNA, 21 nt, Human adenovirus E
cccaauggggugacagugaca

SEQ ID NO: 1574725 - RNA, 19 nt, Human adenovirus E
ugccuuggcaguacaguua

SEQ ID NO: 1574726 - RNA, 14 nt, Human adenovirus E
acaaguacugcgcg

SEQ ID NO: 1574727 - RNA, 18 nt, Human adenovirus E
gccacccccagcgccgcg

SEQ ID NO: 1574728 - RNA, 12 nt, Human adenovirus E
gaggaggagcug

SEQ ID NO: 1574729 - RNA, 18 nt, Human adenovirus E
  misc_feature (6)..(6): n is a, c, g or u
cgggcnugggcgugcaga

SEQ ID NO: 1574730 - RNA, 22 nt, Human adenovirus E
gggucgcugagcccgugcugcu

SEQ ID NO: 1574731 - RNA, 15 nt, Human adenovirus E
accaagaacagccag

SEQ ID NO: 1574732 - RNA, 22 nt, Human adenovirus E
ggucgcagaagaucccgcccca

SEQ ID NO: 1574733 - RNA, 19 nt, Human adenovirus E
gaaccugccccccaaaguc

SEQ ID NO: 1574734 - RNA, 20 nt, Human adenovirus E
cagaccgugaaggaggagag

SEQ ID NO: 1574735 - RNA, 18 nt, Human adenovirus E
uccacagcggcggcagca

SEQ ID NO: 1574736 - RNA, 14 nt, Human adenovirus E
gcgggcgcagcagc

SEQ ID NO: 1574737 - RNA, 15 nt, Human adenovirus E
caaucaggcagcacc

SEQ ID NO: 1574738 - RNA, 16 nt, Human adenovirus E
cugcaaggagaaggag

SEQ ID NO: 1574739 - RNA, 14 nt, Human adenovirus E
gccucggaccuggc

SEQ ID NO: 1574740 - RNA, 22 nt, Human adenovirus E
ccauuuaaacuuucgccagcuu

SEQ ID NO: 1574741 - RNA, 15 nt, Human adenovirus E
ccgggcccagguugg

SEQ ID NO: 1574742 - RNA, 17 nt, Human adenovirus E
gggcgucgucgccggag

SEQ ID NO: 1574743 - RNA, 15 nt, Human adenovirus E
ucgggggcaggagca

SEQ ID NO: 1574744 - RNA, 17 nt, Human adenovirus E
ccgaggacgagggcaug

SEQ ID NO: 1574745 - RNA, 22 nt, Human adenovirus E
ggggaugaugauauucuggagc

SEQ ID NO: 1574746 - RNA, 15 nt, Human adenovirus E
ugguaguugagggag

SEQ ID NO: 1574747 - RNA, 21 nt, Human adenovirus E
cagcaagccgcugacggcgca

SEQ ID NO: 1574748 - RNA, 17 nt, Human adenovirus E
cugcaaccaccccugcc

SEQ ID NO: 1574749 - RNA, 18 nt, Human adenovirus E
gggccagacccagccaga

SEQ ID NO: 1574750 - RNA, 17 nt, Human adenovirus E
agggcguuggagaggag

SEQ ID NO: 1574751 - RNA, 17 nt, Human adenovirus E
ggcgcaaacccgggagc

SEQ ID NO: 1574752 - RNA, 18 nt, Human adenovirus E
uccgccgacgacagcagc

SEQ ID NO: 1574753 - RNA, 19 nt, Human adenovirus E
ccauccagaaaucccgcca

SEQ ID NO: 1574754 - RNA, 15 nt, Human adenovirus E
acccgagcaucgcca

SEQ ID NO: 1574755 - RNA, 16 nt, Human adenovirus E
cccgcgcuugcugggc

SEQ ID NO: 1574756 - RNA, 13 nt, Human adenovirus E
cgggcgcagcagc

SEQ ID NO: 1574757 - RNA, 20 nt, Human adenovirus E
ugccauucgcgcacggccag

SEQ ID NO: 1574758 - RNA, 17 nt, Human adenovirus E
gcagaggcguccgcccu

SEQ ID NO: 1574759 - RNA, 15 nt, Human adenovirus E
cagcgggcccugacc

SEQ ID NO: 1574760 - RNA, 15 nt, Human adenovirus E
cccugccgcccuggu

SEQ ID NO: 1574761 - RNA, 13 nt, Human adenovirus E
uucucuccagcac

SEQ ID NO: 1574762 - RNA, 21 nt, Human adenovirus E
ugucccuuuuguuuccacagc

SEQ ID NO: 1574763 - RNA, 16 nt, Human adenovirus E
gcgauggcggcggcgg

SEQ ID NO: 1574764 - RNA, 14 nt, Human adenovirus E
gcuugcaggccugc

SEQ ID NO: 1574765 - RNA, 17 nt, Human adenovirus E
ucaacacgcuccagccg

SEQ ID NO: 1574766 - RNA, 16 nt, Human adenovirus E
gagggcguggcugccc

SEQ ID NO: 1574767 - RNA, 21 nt, Human adenovirus E
aauacaccacccucucccccc

SEQ ID NO: 1574768 - RNA, 13 nt, Human adenovirus E
gcuggcggugcuc

SEQ ID NO: 1574769 - RNA, 17 nt, Human adenovirus E
gaagacguaugcgcagg

SEQ ID NO: 1574770 - RNA, 18 nt, Human adenovirus E
ggaggauuuggaggaaga

SEQ ID NO: 1574771 - RNA, 15 nt, Human adenovirus E
cugcggcguggagca

SEQ ID NO: 1574772 - RNA, 14 nt, Human adenovirus E
cugguacugcgccc

SEQ ID NO: 1574773 - RNA, 13 nt, Human adenovirus E
gcaggccggagcu

SEQ ID NO: 1574774 - RNA, 17 nt, Human adenovirus E
cgugccccggggccagg

SEQ ID NO: 1574775 - RNA, 11 nt, Human adenovirus E
accgcggcgcc

SEQ ID NO: 1574776 - RNA, 21 nt, Human adenovirus E
cagcaggcggcgcgagcugag

SEQ ID NO: 1574777 - RNA, 16 nt, Human adenovirus E
gcucgaccacacagua

SEQ ID NO: 1574778 - RNA, 13 nt, Human adenovirus E
agaggcagcagca

SEQ ID NO: 1574779 - RNA, 12 nt, Human adenovirus E
cagcacccagac

SEQ ID NO: 1574780 - RNA, 19 nt, Human adenovirus E
gccgaacucgcgccugcug

SEQ ID NO: 1574781 - RNA, 23 nt, Human adenovirus E
ccgcagcuugcccucggccucgg

SEQ ID NO: 1574782 - RNA, 13 nt, Human adenovirus E
acuaccuggccua

SEQ ID NO: 1574783 - RNA, 13 nt, Human adenovirus E
agcagcagcacac

SEQ ID NO: 1574784 - RNA, 14 nt, Human adenovirus E
cagcacccagcccg

SEQ ID NO: 1574785 - RNA, 14 nt, Human adenovirus E
gccuggcccucuuc

SEQ ID NO: 1574786 - RNA, 18 nt, Human adenovirus E
gaacacuguaucccaccc

SEQ ID NO: 1574787 - RNA, 20 nt, Human adenovirus E
cucaggcacacgcacuacca

SEQ ID NO: 1574788 - RNA, 17 nt, Human adenovirus E
ugaacgccugcugggcc

SEQ ID NO: 1574789 - RNA, 15 nt, Human adenovirus E
caaugguacugaucu

SEQ ID NO: 1574790 - RNA, 14 nt, Human adenovirus E
aggagcuggcagug

SEQ ID NO: 1574791 - RNA, 13 nt, Human adenovirus E
ccaagaaugaaca

SEQ ID NO: 1574792 - RNA, 16 nt, Human adenovirus E
aucguggugcaggagc

SEQ ID NO: 1574793 - RNA, 22 nt, Human adenovirus E
ggccgcgaacgcucugcaagga

SEQ ID NO: 1574794 - RNA, 23 nt, Human adenovirus E
ugcuccugguucaccugcagcag

SEQ ID NO: 1574795 - RNA, 13 nt, Human adenovirus E
guagagguaguug

SEQ ID NO: 1574796 - RNA, 23 nt, Human adenovirus E
ugcagggccuguggggcgugcag

SEQ ID NO: 1574797 - RNA, 11 nt, Human adenovirus E
cagaggaggag

SEQ ID NO: 1574798 - RNA, 18 nt, Human adenovirus E
cggugcaggccucucagc

SEQ ID NO: 1574799 - RNA, 18 nt, Human adenovirus E
ggcggugcccgaggccgc

SEQ ID NO: 1574800 - RNA, 11 nt, Human adenovirus E
cagagcuggaa

SEQ ID NO: 1574801 - RNA, 17 nt, Human adenovirus E
cagaugggccuggccgc

SEQ ID NO: 1574802 - RNA, 18 nt, Human adenovirus E
gugcugcacaccacccug

SEQ ID NO: 1574803 - RNA, 20 nt, Human adenovirus E
cccgggcaaccuggaagcca

SEQ ID NO: 1574804 - RNA, 13 nt, Human adenovirus E
agccccaggccaa

SEQ ID NO: 1574805 - RNA, 14 nt, Human adenovirus E
cgacucccaccugc

SEQ ID NO: 1574806 - RNA, 21 nt, Human adenovirus E
gccuuggaggcggcggcagga

SEQ ID NO: 1574807 - RNA, 16 nt, Human adenovirus E
aagauauuugcaauug

SEQ ID NO: 1574808 - RNA, 19 nt, Human adenovirus E
acgugccccggggccagga

SEQ ID NO: 1574809 - RNA, 16 nt, Human adenovirus E
cacugacguaaaggcc

SEQ ID NO: 1574810 - RNA, 17 nt, Human adenovirus E
ccugcucgagugccacu

SEQ ID NO: 1574811 - RNA, 14 nt, Human adenovirus E
accugcggggcgau

SEQ ID NO: 1574812 - RNA, 16 nt, Human adenovirus E
caugguggucaggguc

SEQ ID NO: 1574813 - RNA, 23 nt, Human adenovirus E
cacucucucagaccgugcagcag

SEQ ID NO: 1574814 - RNA, 18 nt, Human adenovirus E
gcgguggggcggccagcu

SEQ ID NO: 1574815 - RNA, 21 nt, Human adenovirus E
ccacugcuaccugcugcgccu

SEQ ID NO: 1574816 - RNA, 15 nt, Human adenovirus E
ccgcucccuggccug

SEQ ID NO: 1574817 - RNA, 19 nt, Human adenovirus E
gcacccggugcacucccag

SEQ ID NO: 1574818 - RNA, 18 nt, Human adenovirus E
ccugcggaaccacagggc

SEQ ID NO: 1574819 - RNA, 15 nt, Human adenovirus E
guggagcuaccagcc

SEQ ID NO: 1574820 - RNA, 23 nt, Human adenovirus E
ggcggagaugccuuucaagagcc

SEQ ID NO: 1574821 - RNA, 18 nt, Human adenovirus E
uggcgauggagcgcaugg

SEQ ID NO: 1574822 - RNA, 18 nt, Human adenovirus E
cagcaccacagggcaggc

SEQ ID NO: 1574823 - RNA, 22 nt, Human adenovirus E
cgacgcggagacccugcgcaag

SEQ ID NO: 1574824 - RNA, 20 nt, Human adenovirus E
guugcagggcgcccagcagg

SEQ ID NO: 1574825 - RNA, 18 nt, Human adenovirus E
caccauggaggugcagac

SEQ ID NO: 1574826 - RNA, 21 nt, Human adenovirus E
uccuggcugacguccugcagg

SEQ ID NO: 1574827 - RNA, 18 nt, Human adenovirus E
ggguuggcgcggaggaag

SEQ ID NO: 1574828 - RNA, 21 nt, Human adenovirus E
uccucaauaucacgaaaucau

SEQ ID NO: 1574829 - RNA, 12 nt, Human adenovirus E
ucaggcugggcu

SEQ ID NO: 1574830 - RNA, 13 nt, Human adenovirus E
cugacgcuccugg

SEQ ID NO: 1574831 - RNA, 14 nt, Human adenovirus E
ggcugacguccugc

SEQ ID NO: 1574832 - RNA, 13 nt, Human adenovirus E
ggaguuccuccac

SEQ ID NO: 1574833 - RNA, 22 nt, Human adenovirus E
uccugcggaaccacagggccag

SEQ ID NO: 1574834 - RNA, 17 nt, Human adenovirus E
cuccuggaccuggugaa

SEQ ID NO: 1574835 - RNA, 14 nt, Human adenovirus E
caggagcacaggga

SEQ ID NO: 1574836 - RNA, 13 nt, Human adenovirus E
aggauuuggagga

SEQ ID NO: 1574837 - RNA, 13 nt, Human adenovirus E
accgagcccauga

SEQ ID NO: 1574838 - RNA, 17 nt, Human adenovirus E
ugucauacuugagcugu

SEQ ID NO: 1574839 - RNA, 17 nt, Human adenovirus E
ucgcgguggggcggcca

SEQ ID NO: 1574840 - RNA, 19 nt, Human adenovirus E
uucugggugaucuuggccc

SEQ ID NO: 1574841 - RNA, 13 nt, Human adenovirus E
ucuucccacuccc

SEQ ID NO: 1574842 - RNA, 19 nt, Human adenovirus E
gcaggcggcgcgagcugag

SEQ ID NO: 1574843 - RNA, 11 nt, Human adenovirus E
ccguggagcug

SEQ ID NO: 1574844 - RNA, 10 nt, Human adenovirus E
augaacauua

SEQ ID NO: 1574845 - RNA, 19 nt, Human adenovirus E
gcaugagcaccacagcgcc

SEQ ID NO: 1574846 - RNA, 21 nt, Human adenovirus E
ucagcggcucgacuccguggc

SEQ ID NO: 1574847 - RNA, 17 nt, Human adenovirus E
ccuggucgaguuggaag

SEQ ID NO: 1574848 - RNA, 22 nt, Human adenovirus E
gcucgagugccacugccgcugc

SEQ ID NO: 1574849 - RNA, 14 nt, Human adenovirus E
agcugaaaguggag

SEQ ID NO: 1574850 - RNA, 12 nt, Human adenovirus E
cuaguccccaga

SEQ ID NO: 1574851 - RNA, 21 nt, Human adenovirus E
cuggaagacguaugcgcagga

SEQ ID NO: 1574852 - RNA, 24 nt, Human adenovirus E
cgagcgccccuuguggaagaagga

SEQ ID NO: 1574853 - RNA, 17 nt, Human adenovirus E
ccgcaagaccaccacuc

SEQ ID NO: 1574854 - RNA, 13 nt, Human adenovirus E
ccgcaacgacagg

SEQ ID NO: 1574855 - RNA, 20 nt, Human adenovirus E
gauuccaagagaagccccug

SEQ ID NO: 1574856 - RNA, 22 nt, Human adenovirus E
gcguggccuuuggcgcggagcu

SEQ ID NO: 1574857 - RNA, 15 nt, Human adenovirus E
cucuacggcaucucg

SEQ ID NO: 1574858 - RNA, 16 nt, Human adenovirus E
agagcgcccuccaccg

SEQ ID NO: 1574859 - RNA, 23 nt, Human adenovirus E
uggccaccucgccgcgcaggggc

SEQ ID NO: 1574860 - RNA, 13 nt, Human adenovirus E
agcacgaggagga

SEQ ID NO: 1574861 - RNA, 21 nt, Human adenovirus E
cuuaucaccuucuuccaguuc

SEQ ID NO: 1574862 - RNA, 18 nt, Human adenovirus E
ggaucugaaaaccgcuga

SEQ ID NO: 1574863 - RNA, 23 nt, Human adenovirus E
cccagagcgagguguaccagucc

SEQ ID NO: 1574864 - RNA, 19 nt, Human adenovirus E
cggucgcccgucucucagc

SEQ ID NO: 1574865 - RNA, 22 nt, Human adenovirus E
cagaaccugaaagagcucugca

SEQ ID NO: 1574866 - RNA, 21 nt, Human adenovirus E
gcuuccgcgucaguugcaggg

SEQ ID NO: 1574867 - RNA, 20 nt, Human adenovirus E
gaagagccuuucggugcgag

SEQ ID NO: 1574868 - RNA, 19 nt, Human adenovirus E
ucagacccacugcugaacc

SEQ ID NO: 1574869 - RNA, 18 nt, Human adenovirus E
acacauacaaagccucag

SEQ ID NO: 1574870 - RNA, 13 nt, Human adenovirus E
gcccggcgcgacu

SEQ ID NO: 1574871 - RNA, 14 nt, Human adenovirus E
ccgagcagcagcac

SEQ ID NO: 1574872 - RNA, 20 nt, Human adenovirus E
gguaucgcaaucaggcagca

SEQ ID NO: 1574873 - RNA, 15 nt, Human adenovirus E
cggcgaugcagcccc

SEQ ID NO: 1574874 - RNA, 13 nt, Human adenovirus E
auaugcucaugca

SEQ ID NO: 1574875 - RNA, 19 nt, Human adenovirus E
caggggguccagcaugacc

SEQ ID NO: 1574876 - RNA, 16 nt, Human adenovirus E
uccccgucuccugccg

SEQ ID NO: 1574877 - RNA, 17 nt, Human adenovirus E
gcggcgauguugagcug

SEQ ID NO: 1574878 - RNA, 17 nt, Human adenovirus E
cugcacuggcagcccag

SEQ ID NO: 1574879 - RNA, 23 nt, Human adenovirus E
uuuuaaugaaucagauguaucua

SEQ ID NO: 1574880 - RNA, 19 nt, Human adenovirus E
cggugagcgccagcaggcg

SEQ ID NO: 1574881 - RNA, 13 nt, Human adenovirus E
gagcccgagggcc

SEQ ID NO: 1574882 - RNA, 15 nt, Human adenovirus E
cuuugacaguacagg

SEQ ID NO: 1574883 - RNA, 21 nt, Human adenovirus E
cccagaucaucggcaccuucg

SEQ ID NO: 1574884 - RNA, 17 nt, Human adenovirus E
ugacacuacagaaacug

SEQ ID NO: 1574885 - RNA, 19 nt, Human adenovirus E
ggcagcagugucuggagga

SEQ ID NO: 1574886 - RNA, 17 nt, Human adenovirus E
agucgggggcaggagca

SEQ ID NO: 1574887 - RNA, 19 nt, Human adenovirus E
caacccuuccuccccggga

SEQ ID NO: 1574888 - RNA, 15 nt, Human adenovirus E
acuucucggugcuga

SEQ ID NO: 1574889 - RNA, 17 nt, Human adenovirus E
cagggggaucagcauca

SEQ ID NO: 1574890 - RNA, 15 nt, Human adenovirus E
gcagcgaagagaccc

SEQ ID NO: 1574891 - RNA, 14 nt, Human adenovirus E
agcuccucccucag

SEQ ID NO: 1574892 - RNA, 15 nt, Human adenovirus E
agcgcucuaguuuuu

SEQ ID NO: 1574893 - RNA, 22 nt, Human adenovirus E
uuccaccugaucccgaauacca

SEQ ID NO: 1574894 - RNA, 17 nt, Human adenovirus E
cacaauuacucacacca

SEQ ID NO: 1574895 - RNA, 21 nt, Human adenovirus E
cagcguccgauccuggucgag

SEQ ID NO: 1574896 - RNA, 20 nt, Human adenovirus E
caugcggggggagaugaggu

SEQ ID NO: 1574897 - RNA, 17 nt, Human adenovirus E
cgucgcagggggccacg

SEQ ID NO: 1574898 - RNA, 17 nt, Human adenovirus E
gaucguccagggcagcu

SEQ ID NO: 1574899 - RNA, 14 nt, Human adenovirus E
agcggcccugccaa

SEQ ID NO: 1574900 - RNA, 13 nt, Human adenovirus E
ggcggcggcagcg

SEQ ID NO: 1574901 - RNA, 15 nt, Human adenovirus E
ggcuggcgcgccugg

SEQ ID NO: 1574902 - RNA, 17 nt, Human adenovirus E
gaagcagcagcagcaga

SEQ ID NO: 1574903 - RNA, 17 nt, Human adenovirus E
uggagaacaaggccauc

SEQ ID NO: 1574904 - RNA, 14 nt, Human adenovirus E
cuaccagccccaga

SEQ ID NO: 1574905 - RNA, 15 nt, Human adenovirus E
ggccagcugcaccac

SEQ ID NO: 1574906 - RNA, 14 nt, Human adenovirus E
ggaggugugcguga

SEQ ID NO: 1574907 - RNA, 19 nt, Human adenovirus E
cucguaaaaguccacggcg

SEQ ID NO: 1574908 - RNA, 22 nt, Human adenovirus E
gcgcggucauggaccaggugcu

SEQ ID NO: 1574909 - RNA, 15 nt, Human adenovirus E
ucagguguccagcug

SEQ ID NO: 1574910 - RNA, 18 nt, Human adenovirus E
uuccucgggaaaacucau

SEQ ID NO: 1574911 - RNA, 21 nt, Human adenovirus E
ggugauccuccaccagagaag

SEQ ID NO: 1574912 - RNA, 24 nt, Human adenovirus E
ugaacaagucuauguuggcacagc

SEQ ID NO: 1574913 - RNA, 19 nt, Human adenovirus E
gccuuguaggcgcagcagc

SEQ ID NO: 1574914 - RNA, 15 nt, Human adenovirus E
gcuccacgguggccg

SEQ ID NO: 1574915 - RNA, 16 nt, Human adenovirus E
aguggcgcggcugcuc

SEQ ID NO: 1574916 - RNA, 14 nt, Human adenovirus E
ccugcgccgcuucu

SEQ ID NO: 1574917 - RNA, 12 nt, Human adenovirus E
cggaggccagca

SEQ ID NO: 1574918 - RNA, 23 nt, Human adenovirus E
ccguggucagcgacgagcagcug

SEQ ID NO: 1574919 - RNA, 23 nt, Human adenovirus E
acugaggggcgugccccagggca

SEQ ID NO: 1574920 - RNA, 21 nt, Human adenovirus E
ugaaggaggagagcaacuucc

SEQ ID NO: 1574921 - RNA, 13 nt, Human adenovirus E
gguacaugggcau

SEQ ID NO: 1574922 - RNA, 19 nt, Human adenovirus E
cugcuguuagugcuccccc

SEQ ID NO: 1574923 - RNA, 20 nt, Human adenovirus E
ggaguacuucaaaaugaaga

SEQ ID NO: 1574924 - RNA, 21 nt, Human adenovirus E
acgcacuaccaccacuacagc

SEQ ID NO: 1574925 - RNA, 21 nt, Human adenovirus E
agggauaagcugaaagagcag

SEQ ID NO: 1574926 - RNA, 22 nt, Human adenovirus E
ucaggcgccagcgccggcagga

SEQ ID NO: 1574927 - RNA, 15 nt, Human adenovirus E
cguggccgcggccaa

SEQ ID NO: 1574928 - RNA, 18 nt, Human adenovirus E
ucuucuacuuccuccuca

SEQ ID NO: 1574929 - RNA, 23 nt, Human adenovirus E
gucaaaaccauaucccagggcac

SEQ ID NO: 1574930 - RNA, 15 nt, Human adenovirus E
gcgagacgcccaggc

SEQ ID NO: 1574931 - RNA, 15 nt, Human adenovirus E
gccgccgccagaccg

SEQ ID NO: 1574932 - RNA, 21 nt, Human adenovirus E
aggugcaaccggugcugagac

SEQ ID NO: 1574933 - RNA, 22 nt, Human adenovirus E
aaagcgcccgaggaagcaauaa

SEQ ID NO: 1574934 - RNA, 18 nt, Human adenovirus E
gggcuaccgaggaagaaa

SEQ ID NO: 1574935 - RNA, 21 nt, Human adenovirus E
agcggcacccgcgcgugcaga

SEQ ID NO: 1574936 - RNA, 15 nt, Human adenovirus E
gauauucuggagcag

SEQ ID NO: 1574937 - RNA, 16 nt, Human adenovirus E
ugcccgaggacuacca

SEQ ID NO: 1574938 - RNA, 22 nt, Human adenovirus E
aagcagccgccgccagaccguc

SEQ ID NO: 1574939 - RNA, 22 nt, Human adenovirus E
gagccgcgcccugggccaggac

SEQ ID NO: 1574940 - RNA, 16 nt, Human adenovirus E
gucaagcugcugcuca

SEQ ID NO: 1574941 - RNA, 16 nt, Human adenovirus E
ggugcccgaggccgcc

SEQ ID NO: 1574942 - RNA, 15 nt, Human adenovirus E
gggccauguucaggg

SEQ ID NO: 1574943 - RNA, 16 nt, Human adenovirus E
auccccgcgcuccugg

SEQ ID NO: 1574944 - RNA, 21 nt, Human adenovirus E
aguucgugagguaaauccaag

SEQ ID NO: 1574945 - RNA, 23 nt, Human adenovirus E
uccagcggcggagcggcaucucg

SEQ ID NO: 1574946 - RNA, 15 nt, Human adenovirus E
agcccuuccaggaag

SEQ ID NO: 1574947 - RNA, 17 nt, Human adenovirus E
augggcgcggaccugca

SEQ ID NO: 1574948 - RNA, 16 nt, Human adenovirus E
gguugcaaucgcagug

SEQ ID NO: 1574949 - RNA, 22 nt, Human adenovirus E
aggugccccucagcguggagga

SEQ ID NO: 1574950 - RNA, 12 nt, Human adenovirus E
ggaggcagagga

SEQ ID NO: 1574951 - RNA, 18 nt, Human adenovirus E
cugaaagagcucugcaag

SEQ ID NO: 1574952 - RNA, 20 nt, Human adenovirus E
agcaacuacccggugguggg

SEQ ID NO: 1574953 - RNA, 13 nt, Human adenovirus E
cgugcgcgaggcc

SEQ ID NO: 1574954 - RNA, 13 nt, Human adenovirus E
gcagggggccacg

SEQ ID NO: 1574955 - RNA, 14 nt, Human adenovirus E
uggacaaaauacca

SEQ ID NO: 1574956 - RNA, 15 nt, Human adenovirus E
acagccgccuggacc

SEQ ID NO: 1574957 - RNA, 14 nt, Human adenovirus E
gggugaugaggucc

SEQ ID NO: 1574958 - RNA, 12 nt, Human adenovirus E
gggccugugggg

SEQ ID NO: 1574959 - RNA, 19 nt, Human adenovirus E
gugagcggggcuggacaga

SEQ ID NO: 1574960 - RNA, 14 nt, Human adenovirus E
caccgugcggugag

SEQ ID NO: 1574961 - RNA, 23 nt, Human adenovirus E
uccuggccguguugcucuacuac

SEQ ID NO: 1574962 - RNA, 16 nt, Human adenovirus E
ggcgggcgcagcagcg

SEQ ID NO: 1574963 - RNA, 19 nt, Human adenovirus E
uggcgcggcugcucaggcu

SEQ ID NO: 1574964 - RNA, 14 nt, Human adenovirus E
uaaacucacuuugu

SEQ ID NO: 1574965 - RNA, 14 nt, Human adenovirus E
aucgccaaccucgc

SEQ ID NO: 1574966 - RNA, 20 nt, Human adenovirus E
gaucgaggacgucagcggcg

SEQ ID NO: 1574967 - RNA, 23 nt, Human adenovirus E
uguuacugaggggggcaauguga

SEQ ID NO: 1574968 - RNA, 16 nt, Human adenovirus E
cccuucucccaggccg

SEQ ID NO: 1574969 - RNA, 21 nt, Human adenovirus E
gccgucaucgacagcguggug

SEQ ID NO: 1574970 - RNA, 20 nt, Human adenovirus E
agaaccuguucagagacagg

SEQ ID NO: 1574971 - RNA, 20 nt, Human adenovirus E
cagcgaaccccgcagaacag

SEQ ID NO: 1574972 - RNA, 21 nt, Human adenovirus E
caaggaggaugcagcagcuga

SEQ ID NO: 1574973 - RNA, 17 nt, Human adenovirus E
ucuacguuuugaugcaa

SEQ ID NO: 1574974 - RNA, 23 nt, Human adenovirus E
agcaugaugcccacggcccucag

SEQ ID NO: 1574975 - RNA, 15 nt, Human adenovirus E
gcgggcggcgccacc

SEQ ID NO: 1574976 - RNA, 15 nt, Human adenovirus E
cugaaaacaccaccu

SEQ ID NO: 1574977 - RNA, 16 nt, Human adenovirus E
cagagcucggugaugu

SEQ ID NO: 1574978 - RNA, 19 nt, Human adenovirus E
gacguaugcgcaggagcac

SEQ ID NO: 1574979 - RNA, 17 nt, Human adenovirus E
acccgcucucugcucaa

SEQ ID NO: 1574980 - RNA, 18 nt, Human adenovirus E
ucggcgcuguccggccgc

SEQ ID NO: 1574981 - RNA, 23 nt, Human adenovirus E
acgaaggcgcgcaggccggagcu

SEQ ID NO: 1574982 - RNA, 15 nt, Human adenovirus E
gaugccgggcaggag

SEQ ID NO: 1574983 - RNA, 18 nt, Human adenovirus E
cccgguuccacgcggggc

SEQ ID NO: 1574984 - RNA, 23 nt, Human adenovirus E
gcuggaggccaucgugcagaacc

SEQ ID NO: 1574985 - RNA, 16 nt, Human adenovirus E
caugcggggggagaug

SEQ ID NO: 1574986 - RNA, 18 nt, Human adenovirus E
gccagcuccuccucggcc

SEQ ID NO: 1574987 - RNA, 15 nt, Human adenovirus E
ccuccgggcacuccc

SEQ ID NO: 1574988 - RNA, 17 nt, Human adenovirus E
cgcggucauggaccagg

SEQ ID NO: 1574989 - RNA, 13 nt, Human adenovirus E
ccuucgccuccua

SEQ ID NO: 1574990 - RNA, 18 nt, Human adenovirus E
ucgacgccaucagcgagu

SEQ ID NO: 1574991 - RNA, 23 nt, Human adenovirus E
gcacguggccgcggccaaccugg

SEQ ID NO: 1574992 - RNA, 17 nt, Human adenovirus E
cagacccagccagauga

SEQ ID NO: 1574993 - RNA, 13 nt, Human adenovirus E
cggcacucuccag

SEQ ID NO: 1574994 - RNA, 17 nt, Human adenovirus E
cagaucuagggccucag

SEQ ID NO: 1574995 - RNA, 16 nt, Human adenovirus E
cggccuugcgcaggga

SEQ ID NO: 1574996 - RNA, 13 nt, Human adenovirus E
gguguccagcugg

SEQ ID NO: 1574997 - RNA, 16 nt, Human adenovirus E
acaaagccucagcguc

SEQ ID NO: 1574998 - RNA, 14 nt, Human adenovirus E
agguggacgaggag

SEQ ID NO: 1574999 - RNA, 15 nt, Human adenovirus E
aucucuccucgcuuu

SEQ ID NO: 1575000 - RNA, 24 nt, Human adenovirus E
gcagcaguauccggggaguccagc

SEQ ID NO: 1575001 - RNA, 22 nt, Human adenovirus E
caggcgcacgggacgcagggcc

SEQ ID NO: 1575002 - RNA, 21 nt, Human adenovirus E
ccugugucgucaccgccccgc

SEQ ID NO: 1575003 - RNA, 14 nt, Human adenovirus E
ccuggccaccuacc

SEQ ID NO: 1575004 - RNA, 19 nt, Human adenovirus E
gcaccuucgaguugcaagg

SEQ ID NO: 1575005 - RNA, 13 nt, Human adenovirus E
cggcaccaccgug

SEQ ID NO: 1575006 - RNA, 22 nt, Human adenovirus E
uggagcuaccagccccagaugg

SEQ ID NO: 1575007 - RNA, 16 nt, Human adenovirus E
cgaggcccuggccacc

SEQ ID NO: 1575008 - RNA, 13 nt, Human adenovirus E
cccggaugcaggg

SEQ ID NO: 1575009 - RNA, 21 nt, Human adenovirus E
cggggaguccagcgcgugacc

SEQ ID NO: 1575010 - RNA, 14 nt, Human adenovirus E
cuaacucuuauacc

SEQ ID NO: 1575011 - RNA, 14 nt, Human adenovirus E
gagccacaccacag

SEQ ID NO: 1575012 - RNA, 17 nt, Human adenovirus E
ccugcccgccaccugcu

SEQ ID NO: 1575013 - RNA, 18 nt, Human adenovirus E
cacccagucauagcaggg

SEQ ID NO: 1575014 - RNA, 17 nt, Human adenovirus E
gucgcagggggccacga

SEQ ID NO: 1575015 - RNA, 21 nt, Human adenovirus E
cagaccgugaaggaggagagc

SEQ ID NO: 1575016 - RNA, 17 nt, Human adenovirus E
caccaagaacagccaga

SEQ ID NO: 1575017 - RNA, 17 nt, Human adenovirus E
cacgaagcccugcagga

SEQ ID NO: 1575018 - RNA, 14 nt, Human adenovirus E
cuucaauuggagca

SEQ ID NO: 1575019 - RNA, 17 nt, Human adenovirus E
gugcugcacaccacccu

SEQ ID NO: 1575020 - RNA, 20 nt, Human adenovirus E
guguugcacaauaucuuuga

SEQ ID NO: 1575021 - RNA, 18 nt, Human adenovirus E
acacgguuuccggggcgg

SEQ ID NO: 1575022 - RNA, 16 nt, Human adenovirus E
ccgccaacgugccccg

SEQ ID NO: 1575023 - RNA, 14 nt, Human adenovirus E
agcagugcucaggu

SEQ ID NO: 1575024 - RNA, 20 nt, Human adenovirus E
gcgcgggaggcagguccaga

SEQ ID NO: 1575025 - RNA, 14 nt, Human adenovirus E
gccgccccucucag

SEQ ID NO: 1575026 - RNA, 18 nt, Human adenovirus E
ucacaccacacacacaga

SEQ ID NO: 1575027 - RNA, 17 nt, Human adenovirus E
cgcgagugccccccgcc

SEQ ID NO: 1575028 - RNA, 18 nt, Human adenovirus E
gcccagguuuuccaugca

SEQ ID NO: 1575029 - RNA, 19 nt, Human adenovirus E
cugggcgagguugagcucc

SEQ ID NO: 1575030 - RNA, 15 nt, Human adenovirus E
cgaguaccuggaaga

SEQ ID NO: 1575031 - RNA, 13 nt, Human adenovirus E
cuacuuccuccuc

SEQ ID NO: 1575032 - RNA, 23 nt, Human adenovirus E
ugcgucucgggacccugccauca

SEQ ID NO: 1575033 - RNA, 22 nt, Human adenovirus E
ggaguauggcaccagacgaugg

SEQ ID NO: 1575034 - RNA, 19 nt, Human adenovirus E
gcagcggccaucgccagca

SEQ ID NO: 1575035 - RNA, 19 nt, Human adenovirus E
cgauucccgaaccccacca

SEQ ID NO: 1575036 - RNA, 20 nt, Human adenovirus E
ggcagaggaggacagccugc

SEQ ID NO: 1575037 - RNA, 23 nt, Human adenovirus E
ggggcccggaugcaggggcggca

SEQ ID NO: 1575038 - RNA, 22 nt, Human adenovirus E
cgccguagaaggcuggcgggga

SEQ ID NO: 1575039 - RNA, 20 nt, Human adenovirus E
gcagcgacgagacucgggcc

SEQ ID NO: 1575040 - RNA, 14 nt, Human adenovirus E
cugccgcccgugga

SEQ ID NO: 1575041 - RNA, 17 nt, Human adenovirus E
ccccaccaugcagcuga

SEQ ID NO: 1575042 - RNA, 19 nt, Human adenovirus E
cacccugcaugccaacccu

SEQ ID NO: 1575043 - RNA, 14 nt, Human adenovirus E
agcauuaccacaca

SEQ ID NO: 1575044 - RNA, 17 nt, Human adenovirus E
gaacgaccacagcaacu

SEQ ID NO: 1575045 - RNA, 14 nt, Human adenovirus E
aggccgugcagcgg

SEQ ID NO: 1575046 - RNA, 21 nt, Human adenovirus E
ucgcaagaggcagcccuucca

SEQ ID NO: 1575047 - RNA, 21 nt, Human adenovirus E
gcguagagcuugggggcgagg

SEQ ID NO: 1575048 - RNA, 20 nt, Human adenovirus E
gaacucaagggucuguggac

SEQ ID NO: 1575049 - RNA, 13 nt, Human adenovirus E
cacucaggcagag

SEQ ID NO: 1575050 - RNA, 18 nt, Human adenovirus E
caaccucgccaucugccc

SEQ ID NO: 1575051 - RNA, 17 nt, Human adenovirus E
cgugaaccugagccagg

SEQ ID NO: 1575052 - RNA, 14 nt, Human adenovirus E
guaggccugggcgg

SEQ ID NO: 1575053 - RNA, 18 nt, Human adenovirus E
gcccagccccgccaccuc

SEQ ID NO: 1575054 - RNA, 15 nt, Human adenovirus E
cuccaguguaagccc

SEQ ID NO: 1575055 - RNA, 20 nt, Human adenovirus E
gccauggcgaccagcgugcg

SEQ ID NO: 1575056 - RNA, 17 nt, Human adenovirus E
cggccauccuggaggcc

SEQ ID NO: 1575057 - RNA, 18 nt, Human adenovirus E
ucagcggcgagggccugc

SEQ ID NO: 1575058 - RNA, 20 nt, Human adenovirus E
ucuacacuaaaaaaauacug

SEQ ID NO: 1575059 - RNA, 14 nt, Human adenovirus E
uccggccgcgaggg

SEQ ID NO: 1575060 - RNA, 19 nt, Human adenovirus E
acggccuuguaggcgcagc

SEQ ID NO: 1575061 - RNA, 20 nt, Human adenovirus E
acugcuaguaccaaugagca

SEQ ID NO: 1575062 - RNA, 19 nt, Human adenovirus E
aaggccgccgccccucuca

SEQ ID NO: 1575063 - RNA, 18 nt, Human adenovirus E
agcacgaggaggagcugg

SEQ ID NO: 1575064 - RNA, 17 nt, Human adenovirus E
caucguaggugaggaag

SEQ ID NO: 1575065 - RNA, 14 nt, Human adenovirus E
uacagcaacaaguu

SEQ ID NO: 1575066 - RNA, 19 nt, Human adenovirus E
ugagcagagucaggcuggg

SEQ ID NO: 1575067 - RNA, 17 nt, Human adenovirus E
ucgagagccacaccaca

SEQ ID NO: 1575068 - RNA, 14 nt, Human adenovirus E
gaggcgcgcgcagu

SEQ ID NO: 1575069 - RNA, 19 nt, Human adenovirus E
ucaggcagaggaggacagc

SEQ ID NO: 1575070 - RNA, 13 nt, Human adenovirus E
gcgagggggcgag

SEQ ID NO: 1575071 - RNA, 15 nt, Human adenovirus E
cuccacccucccagg

SEQ ID NO: 1575072 - RNA, 16 nt, Human adenovirus E
accucccuugcuguuc

SEQ ID NO: 1575073 - RNA, 16 nt, Human adenovirus E
cgcggugcccgaggcc

SEQ ID NO: 1575074 - RNA, 17 nt, Human adenovirus E
aguacggcgcggccagc

SEQ ID NO: 1575075 - RNA, 15 nt, Human adenovirus E
cagaggaggacagcc

SEQ ID NO: 1575076 - RNA, 17 nt, Human adenovirus E
cacgcucgccagcaccg

SEQ ID NO: 1575077 - RNA, 15 nt, Human adenovirus E
uccggcaccgcuucc

SEQ ID NO: 1575078 - RNA, 17 nt, Human adenovirus E
ggggcccggaugcaggg

SEQ ID NO: 1575079 - RNA, 15 nt, Human adenovirus E
ccugccgcugcgcag

SEQ ID NO: 1575080 - RNA, 16 nt, Human adenovirus E
cgagcgcaccaccgcc

SEQ ID NO: 1575081 - RNA, 14 nt, Human adenovirus E
gcagcagugucugg

SEQ ID NO: 1575082 - RNA, 17 nt, Human adenovirus E
gaaccgccuggggcaga

SEQ ID NO: 1575083 - RNA, 16 nt, Human adenovirus E
cagaggaggacagccu

SEQ ID NO: 1575084 - RNA, 17 nt, Human adenovirus E
cggaacaauacucucgc

SEQ ID NO: 1575085 - RNA, 16 nt, Human adenovirus E
cccgguaccacaucac

SEQ ID NO: 1575086 - RNA, 22 nt, Human adenovirus E
aggagggacuugagggcguaga

SEQ ID NO: 1575087 - RNA, 14 nt, Human adenovirus E
ggcugacgcugcgc

SEQ ID NO: 1575088 - RNA, 23 nt, Human adenovirus E
aagcccacggccgccagcuccuc

SEQ ID NO: 1575089 - RNA, 21 nt, Human adenovirus E
uggccaucgugaacgcgcugg

SEQ ID NO: 1575090 - RNA, 14 nt, Human adenovirus E
caucuuccagcaga

SEQ ID NO: 1575091 - RNA, 13 nt, Human adenovirus E
gggcguggggcag

SEQ ID NO: 1575092 - RNA, 22 nt, Human adenovirus E
ccaauugcaagccauccagaaa

SEQ ID NO: 1575093 - RNA, 16 nt, Human adenovirus E
cguuacucggagcugg

SEQ ID NO: 1575094 - RNA, 14 nt, Human adenovirus E
gagauugaccuggg

SEQ ID NO: 1575095 - RNA, 21 nt, Human adenovirus E
aucgcaaucaggcagcaccgg

SEQ ID NO: 1575096 - RNA, 12 nt, Human adenovirus E
cacaagaagaga

SEQ ID NO: 1575097 - RNA, 17 nt, Human adenovirus E
ccacuugaacucgggga

SEQ ID NO: 1575098 - RNA, 17 nt, Human adenovirus E
ccuggcugacguccugc

SEQ ID NO: 1575099 - RNA, 13 nt, Human adenovirus E
cugcucccagagc

SEQ ID NO: 1575100 - RNA, 19 nt, Human adenovirus E
cgcccuuuucaaccugggu

SEQ ID NO: 1575101 - RNA, 15 nt, Human adenovirus E
caaguuucuccacca

SEQ ID NO: 1575102 - RNA, 22 nt, Human adenovirus E
caggcuggagccgcagcuaacg

SEQ ID NO: 1575103 - RNA, 22 nt, Human adenovirus E
guuacaccugcccuggagauga

SEQ ID NO: 1575104 - RNA, 14 nt, Human adenovirus E
gcaggagggggcca

SEQ ID NO: 1575105 - RNA, 14 nt, Human adenovirus E
cggcgcggccagcc

SEQ ID NO: 1575106 - RNA, 15 nt, Human adenovirus E
ucgcgcacggccagc

SEQ ID NO: 1575107 - RNA, 19 nt, Human adenovirus E
cuaccagccccagaugggc

SEQ ID NO: 1575108 - RNA, 16 nt, Human adenovirus E
gccaucgugcagaacc

SEQ ID NO: 1575109 - RNA, 12 nt, Human adenovirus E
gcuaccagcccc

SEQ ID NO: 1575110 - RNA, 23 nt, Human adenovirus E
cucggccauccuggaggccgugg

SEQ ID NO: 1575111 - RNA, 14 nt, Human adenovirus E
aagcaacugcagcc

SEQ ID NO: 1575112 - RNA, 19 nt, Human adenovirus E
auuuggaggaagacuggga

SEQ ID NO: 1575113 - RNA, 17 nt, Human adenovirus E
gcauucuuaagcacacc

SEQ ID NO: 1575114 - RNA, 16 nt, Human adenovirus E
uacccuucucccaggc

SEQ ID NO: 1575115 - RNA, 21 nt, Human adenovirus E
ccagaguuuggaagagcggcg

SEQ ID NO: 1575116 - RNA, 19 nt, Human adenovirus E
auccgcagcagcgagcugg

SEQ ID NO: 1575117 - RNA, 15 nt, Human adenovirus E
cggccauccuggagg

SEQ ID NO: 1575118 - RNA, 21 nt, Human adenovirus E
cagcggcauugucggugugcu

SEQ ID NO: 1575119 - RNA, 16 nt, Human adenovirus E
accccaccaugcagcu

SEQ ID NO: 1575120 - RNA, 19 nt, Human adenovirus E
gacggccuuguaggcgcag

SEQ ID NO: 1575121 - RNA, 19 nt, Human adenovirus E
acagcacucaggcagagga

SEQ ID NO: 1575122 - RNA, 12 nt, Human adenovirus E
gaauacaccccc

SEQ ID NO: 1575123 - RNA, 23 nt, Human adenovirus E
cccugccaucacaccuuccaccu

SEQ ID NO: 1575124 - RNA, 15 nt, Human adenovirus E
uggaggaagacgagg

SEQ ID NO: 1575125 - RNA, 17 nt, Human adenovirus E
guccggguccagggacu

SEQ ID NO: 1575126 - RNA, 20 nt, Human adenovirus E
ggcagcagguggacugagga

SEQ ID NO: 1575127 - RNA, 14 nt, Human adenovirus E
gucucuucagaugg

SEQ ID NO: 1575128 - RNA, 20 nt, Human adenovirus E
uaccgcccagaucccgccug

SEQ ID NO: 1575129 - RNA, 15 nt, Human adenovirus E
uccagcaccaggcag

SEQ ID NO: 1575130 - RNA, 14 nt, Human adenovirus E
agccagaugaugca

SEQ ID NO: 1575131 - RNA, 13 nt, Human adenovirus E
gcccccgccccag

SEQ ID NO: 1575132 - RNA, 20 nt, Human adenovirus E
ccacccccagcgccgcgcuc

SEQ ID NO: 1575133 - RNA, 12 nt, Human adenovirus E
cacgcgcccgcg

SEQ ID NO: 1575134 - RNA, 14 nt, Human adenovirus E
gcggcgcugcagag

SEQ ID NO: 1575135 - RNA, 15 nt, Human adenovirus E
gccagaucguccagg

SEQ ID NO: 1575136 - RNA, 20 nt, Human adenovirus E
aaugugguagucaaauacug

SEQ ID NO: 1575137 - RNA, 14 nt, Human adenovirus E
uaaauuuuugcuuu

SEQ ID NO: 1575138 - RNA, 17 nt, Human adenovirus E
uggacaagaugagccgc

SEQ ID NO: 1575139 - RNA, 17 nt, Human adenovirus E
agucauaaucaucugca

SEQ ID NO: 1575140 - RNA, 21 nt, Human adenovirus E
acagcagucaggcagaggagg

SEQ ID NO: 1575141 - RNA, 22 nt, Human adenovirus E
cuugcugcuauagaaggcuuua

SEQ ID NO: 1575142 - RNA, 22 nt, Human adenovirus E
acgcgcccgcgcuugcugggcg

SEQ ID NO: 1575143 - RNA, 17 nt, Human adenovirus E
accugaaagagcucugc

SEQ ID NO: 1575144 - RNA, 22 nt, Human adenovirus E
acagcucgugcgagggggcgag

SEQ ID NO: 1575145 - RNA, 14 nt, Human adenovirus E
cuccggcaccgcuu

SEQ ID NO: 1575146 - RNA, 16 nt, Human adenovirus E
ucaucugcauguucau

SEQ ID NO: 1575147 - RNA, 14 nt, Human adenovirus E
gacgagcgcucgcg

SEQ ID NO: 1575148 - RNA, 23 nt, Human adenovirus E
gcacgcggccguucaugggcacc

SEQ ID NO: 1575149 - RNA, 15 nt, Human adenovirus E
gccacaccacagcua

SEQ ID NO: 1575150 - RNA, 13 nt, Human adenovirus E
ccgcgcuccugga

SEQ ID NO: 1575151 - RNA, 17 nt, Human adenovirus E
cagaaccccaccagcaa

SEQ ID NO: 1575152 - RNA, 16 nt, Human adenovirus E
gagcuccagcuccagu

SEQ ID NO: 1575153 - RNA, 16 nt, Human adenovirus E
gaagaugccgggcagg

SEQ ID NO: 1575154 - RNA, 15 nt, Human adenovirus E
cggauggcuggcaga

SEQ ID NO: 1575155 - RNA, 19 nt, Human adenovirus E
gcagccacagcgcgcaccc

SEQ ID NO: 1575156 - RNA, 13 nt, Human adenovirus E
ggcacagcacagg

SEQ ID NO: 1575157 - RNA, 18 nt, Human adenovirus E
caccucgcuuacgcacgu

SEQ ID NO: 1575158 - RNA, 19 nt, Human adenovirus E
gcugcgcaacggccugccc

SEQ ID NO: 1575159 - RNA, 14 nt, Human adenovirus E
gcccggcaggccac

SEQ ID NO: 1575160 - RNA, 16 nt, Human adenovirus E
gcccggcgcgacuaca

SEQ ID NO: 1575161 - RNA, 22 nt, Human adenovirus E
gagcccgugcugcucgagcgcc

SEQ ID NO: 1575162 - RNA, 15 nt, Human adenovirus E
cauacaaagccucag

SEQ ID NO: 1575163 - RNA, 21 nt, Human adenovirus E
gggagggggccugcgucgccg

SEQ ID NO: 1575164 - RNA, 15 nt, Human adenovirus E
gugcagaccaaccug

SEQ ID NO: 1575165 - RNA, 21 nt, Human adenovirus E
ugccgcuguccgagaagcugg

SEQ ID NO: 1575166 - RNA, 16 nt, Human adenovirus E
gacggguuccuguggg

SEQ ID NO: 1575167 - RNA, 15 nt, Human adenovirus E
ucagcaucaucuggg

SEQ ID NO: 1575168 - RNA, 21 nt, Human adenovirus E
guggccagaucguccagggca

SEQ ID NO: 1575169 - RNA, 17 nt, Human adenovirus E
ccucgacccccagaccg

SEQ ID NO: 1575170 - RNA, 14 nt, Human adenovirus E
gacccgagcgggag

SEQ ID NO: 1575171 - RNA, 22 nt, Human adenovirus E
auucuacacuaaaaaaauacug

SEQ ID NO: 1575172 - RNA, 14 nt, Human adenovirus E
gcaucugcaccuca

SEQ ID NO: 1575173 - RNA, 20 nt, Human adenovirus E
ucgcgcaccaguuccgccag

SEQ ID NO: 1575174 - RNA, 14 nt, Human adenovirus E
ccccggggccagga

SEQ ID NO: 1575175 - RNA, 22 nt, Human adenovirus E
cgcccugcgcgucggccaggua

SEQ ID NO: 1575176 - RNA, 19 nt, Human adenovirus E
cccaucuccgaggacgagg

SEQ ID NO: 1575177 - RNA, 14 nt, Human adenovirus E
uccacuuccucuuc

SEQ ID NO: 1575178 - RNA, 15 nt, Human adenovirus E
accccacgccgagcc

SEQ ID NO: 1575179 - RNA, 14 nt, Human adenovirus E
gcggggggagauga

SEQ ID NO: 1575180 - RNA, 17 nt, Human adenovirus E
gccggggcagcgccgcc

SEQ ID NO: 1575181 - RNA, 23 nt, Human adenovirus E
cgcagcuugcccucggccucggu

SEQ ID NO: 1575182 - RNA, 22 nt, Human adenovirus E
uggccagaucguccagggcagc

SEQ ID NO: 1575183 - RNA, 18 nt, Human adenovirus E
uccaagauauucugcucc

SEQ ID NO: 1575184 - RNA, 17 nt, Human adenovirus E
cggcggcgaugcagccc

SEQ ID NO: 1575185 - RNA, 21 nt, Human adenovirus E
ggccugcgcgcgcccagcaag

SEQ ID NO: 1575186 - RNA, 17 nt, Human adenovirus E
gcagaaaaccagcagcu

SEQ ID NO: 1575187 - RNA, 17 nt, Human adenovirus E
gcagggccaggcgcacg

SEQ ID NO: 1575188 - RNA, 18 nt, Human adenovirus E
guaaacgccgguggcacg

SEQ ID NO: 1575189 - RNA, 13 nt, Human adenovirus E
cuucccccaggau

SEQ ID NO: 1575190 - RNA, 22 nt, Human adenovirus E
cagcggcuugaguccgucggcc

SEQ ID NO: 1575191 - RNA, 16 nt, Human adenovirus E
ccgcgccgcagugggc

SEQ ID NO: 1575192 - RNA, 19 nt, Human adenovirus E
uagucgagggucuccugga

SEQ ID NO: 1575193 - RNA, 23 nt, Human adenovirus E
auccuggaggccguggugcccuc

SEQ ID NO: 1575194 - RNA, 22 nt, Human adenovirus E
ccacuuccucuucuuccuccuc

SEQ ID NO: 1575195 - RNA, 22 nt, Human adenovirus E
gggaagaucacccuagugagcu

SEQ ID NO: 1575196 - RNA, 22 nt, Human adenovirus E
agaguuuggaagagcggcgcaa

SEQ ID NO: 1575197 - RNA, 13 nt, Human adenovirus E
gguccgguccuuc

SEQ ID NO: 1575198 - RNA, 14 nt, Human adenovirus E
caucggcaccagcc

SEQ ID NO: 1575199 - RNA, 11 nt, Human adenovirus E
gagagccacac

SEQ ID NO: 1575200 - RNA, 12 nt, Human adenovirus E
ccucgcagcccc

SEQ ID NO: 1575201 - RNA, 16 nt, Human adenovirus E
ccgcagcaguggcagc

SEQ ID NO: 1575202 - RNA, 19 nt, Human adenovirus E
ugcgguggugaaggaggaa

SEQ ID NO: 1575203 - RNA, 13 nt, Human adenovirus E
uucuccggcuccc

SEQ ID NO: 1575204 - RNA, 16 nt, Human adenovirus E
ccaccacccccaguac

SEQ ID NO: 1575205 - RNA, 16 nt, Human adenovirus E
accaccacuacagccu

SEQ ID NO: 1575206 - RNA, 22 nt, Human adenovirus E
acccgguggaucuuuuccagga

SEQ ID NO: 1575207 - RNA, 17 nt, Human adenovirus E
cacacagacaacccaca

SEQ ID NO: 1575208 - RNA, 15 nt, Human adenovirus E
cgugccccagggcau

SEQ ID NO: 1575209 - RNA, 14 nt, Human adenovirus E
cgcaagaccaccac

SEQ ID NO: 1575210 - RNA, 17 nt, Human adenovirus E
ugagacccggcaccacc

SEQ ID NO: 1575211 - RNA, 13 nt, Human adenovirus E
ugccccagagcga

SEQ ID NO: 1575212 - RNA, 22 nt, Human adenovirus E
agguggaagaagcagccgccgc

SEQ ID NO: 1575213 - RNA, 16 nt, Human adenovirus E
aucacaccuuccaccu

SEQ ID NO: 1575214 - RNA, 16 nt, Human adenovirus E
augcagcugauggugc

SEQ ID NO: 1575215 - RNA, 22 nt, Human adenovirus E
ggggaucagcaguuugggcagc

SEQ ID NO: 1575216 - RNA, 23 nt, Human adenovirus E
ggacggcccuugacguggggcag

SEQ ID NO: 1575217 - RNA, 13 nt, Human adenovirus E
ggcgggcggcgcc

SEQ ID NO: 1575218 - RNA, 16 nt, Human adenovirus E
gcagugucuggaggag

SEQ ID NO: 1575219 - RNA, 13 nt, Human adenovirus E
gcuccucccucag

SEQ ID NO: 1575220 - RNA, 13 nt, Human adenovirus E
gucaggcugggcu

SEQ ID NO: 1575221 - RNA, 23 nt, Human adenovirus E
cagaccgugaaccugagccaggc

SEQ ID NO: 1575222 - RNA, 16 nt, Human adenovirus E
ucagcgccccgcaucc

SEQ ID NO: 1575223 - RNA, 19 nt, Human adenovirus E
cacgaggaggagcuggcag

SEQ ID NO: 1575224 - RNA, 23 nt, Human adenovirus E
cccaggacauggaauacaccacc

SEQ ID NO: 1575225 - RNA, 13 nt, Human adenovirus E
ccaaaaaucagac

SEQ ID NO: 1575226 - RNA, 13 nt, Human adenovirus E
gcagcagcacaca

SEQ ID NO: 1575227 - RNA, 22 nt, Human adenovirus E
agagacagcugccguccucccg

SEQ ID NO: 1575228 - RNA, 18 nt, Human adenovirus E
accuggaagccacccuga

SEQ ID NO: 1575229 - RNA, 15 nt, Human adenovirus E
augcaagagauggag

SEQ ID NO: 1575230 - RNA, 18 nt, Human adenovirus E
accacgugcgcacccuga

SEQ ID NO: 1575231 - RNA, 17 nt, Human adenovirus E
cucgcagcagcugcgcg

SEQ ID NO: 1575232 - RNA, 22 nt, Human adenovirus E
acuccaccuccacccaccacaa

SEQ ID NO: 1575233 - RNA, 18 nt, Human adenovirus E
gccguccucccggaggag

SEQ ID NO: 1575234 - RNA, 20 nt, Human adenovirus E
ccuggcgccuacggaggggc

SEQ ID NO: 1575235 - RNA, 20 nt, Human adenovirus E
cucggacgauuggacccagg

SEQ ID NO: 1575236 - RNA, 16 nt, Human adenovirus E
cggucaacuccuccuc

SEQ ID NO: 1575237 - RNA, 22 nt, Human adenovirus E
uccugguucaccugcagcagau

SEQ ID NO: 1575238 - RNA, 20 nt, Human adenovirus E
gggcggccuugcgcagggag

SEQ ID NO: 1575239 - RNA, 17 nt, Human adenovirus E
gcccuugcgcgagcaga

SEQ ID NO: 1575240 - RNA, 17 nt, Human adenovirus E
auccacggccagggcgg

SEQ ID NO: 1575241 - RNA, 18 nt, Human adenovirus E
gcuguuccugguggugca

SEQ ID NO: 1575242 - RNA, 14 nt, Human adenovirus E
caaggagaaggagg

SEQ ID NO: 1575243 - RNA, 14 nt, Human adenovirus E
cgcccugcgccuga

SEQ ID NO: 1575244 - RNA, 23 nt, Human adenovirus E
ucuccugccaccaauuggaggaa

SEQ ID NO: 1575245 - RNA, 16 nt, Human adenovirus E
ucgcgcacggccagcg

SEQ ID NO: 1575246 - RNA, 14 nt, Human adenovirus E
ucuaccucugccac

SEQ ID NO: 1575247 - RNA, 19 nt, Human adenovirus E
ggugaaggggugcgcgccg

SEQ ID NO: 1575248 - RNA, 14 nt, Human adenovirus E
cggcggccugggca

SEQ ID NO: 1575249 - RNA, 19 nt, Human adenovirus E
gcaucguggugcaggagcg

SEQ ID NO: 1575250 - RNA, 20 nt, Human adenovirus E
aaccgccccgccgcccagcc

SEQ ID NO: 1575251 - RNA, 18 nt, Human adenovirus E
ugcagaccaaccuggacc

SEQ ID NO: 1575252 - RNA, 18 nt, Human adenovirus E
caggcggucccagagcuc

SEQ ID NO: 1575253 - RNA, 15 nt, Human adenovirus E
cugccacaccuggca

SEQ ID NO: 1575254 - RNA, 18 nt, Human adenovirus E
gaggaagacugggacagc

SEQ ID NO: 1575255 - RNA, 16 nt, Human adenovirus E
cuuucauauccucucc

SEQ ID NO: 1575256 - RNA, 16 nt, Human adenovirus E
guugcgcagggccagg

SEQ ID NO: 1575257 - RNA, 18 nt, Human adenovirus E
ucgcagaaaaugaugcaa

SEQ ID NO: 1575258 - RNA, 22 nt, Human adenovirus E
caggguaucgcaaucaggcagc

SEQ ID NO: 1575259 - RNA, 12 nt, Human adenovirus E
ccucagcaauaa

SEQ ID NO: 1575260 - RNA, 21 nt, Human adenovirus E
cagggcaauccucgcacagaa

SEQ ID NO: 1575261 - RNA, 22 nt, Human adenovirus E
ccuguucagagacaggagcggc

SEQ ID NO: 1575262 - RNA, 20 nt, Human adenovirus E
gcuucacgcucgccagcacc

SEQ ID NO: 1575263 - RNA, 13 nt, Human adenovirus E
cuaccgucaccuc

SEQ ID NO: 1575264 - RNA, 13 nt, Human adenovirus E
ccggggaguccag

SEQ ID NO: 1575265 - RNA, 15 nt, Human adenovirus E
cacgcccagcacacg

SEQ ID NO: 1575266 - RNA, 18 nt, Human adenovirus E
uaccagaacgaccacagc

SEQ ID NO: 1575267 - RNA, 16 nt, Human adenovirus E
agcgccacugagacac

SEQ ID NO: 1575268 - RNA, 16 nt, Human adenovirus E
ucucgcucgccacauc

SEQ ID NO: 1575269 - RNA, 17 nt, Human adenovirus E
cccgcgaugcgggcggc

SEQ ID NO: 1575270 - RNA, 19 nt, Human adenovirus E
uacgcccgcgccaagagcc

SEQ ID NO: 1575271 - RNA, 13 nt, Human adenovirus E
acagcagccccag

SEQ ID NO: 1575272 - RNA, 22 nt, Human adenovirus E
uggcgauguuaccgcccagauc

SEQ ID NO: 1575273 - RNA, 21 nt, Human adenovirus E
agcgcucgcgguggggcggcc

SEQ ID NO: 1575274 - RNA, 19 nt, Human adenovirus E
cagggacucccucagcaug

SEQ ID NO: 1575275 - RNA, 12 nt, Human adenovirus E
caggccagcacg

SEQ ID NO: 1575276 - RNA, 18 nt, Human adenovirus E
caucccguacugcggcag

SEQ ID NO: 1575277 - RNA, 14 nt, Human adenovirus E
aaucuucucuucuc

SEQ ID NO: 1575278 - RNA, 20 nt, Human adenovirus E
ugguguacuaugccuucugc

SEQ ID NO: 1575279 - RNA, 21 nt, Human adenovirus E
guuuccacaucguaggugagg

SEQ ID NO: 1575280 - RNA, 18 nt, Human adenovirus E
aagacagucuggaggaag

SEQ ID NO: 1575281 - RNA, 14 nt, Human adenovirus E
ggccacgagccggg

SEQ ID NO: 1575282 - RNA, 18 nt, Human adenovirus E
cggugccgcccaggacua

SEQ ID NO: 1575283 - RNA, 22 nt, Human adenovirus E
cccguccucuucccacuccccu

SEQ ID NO: 1575284 - RNA, 21 nt, Human adenovirus E
cagaggcgcucuaucucccgc

SEQ ID NO: 1575285 - RNA, 15 nt, Human adenovirus E
cauagcaaccaacau

SEQ ID NO: 1575286 - RNA, 13 nt, Human adenovirus E
gggucccggccgg

SEQ ID NO: 1575287 - RNA, 14 nt, Human adenovirus E
gaucucgcucaggu

SEQ ID NO: 1575288 - RNA, 15 nt, Human adenovirus E
cuggggcgacggggg

SEQ ID NO: 1575289 - RNA, 16 nt, Human adenovirus E
ucgugguauugcuauu

SEQ ID NO: 1575290 - RNA, 16 nt, Human adenovirus E
gcuggcagagccccuu

SEQ ID NO: 1575291 - RNA, 17 nt, Human adenovirus E
uggagcgcguggcccgc

SEQ ID NO: 1575292 - RNA, 17 nt, Human adenovirus E
cucggacuucgugccgc

SEQ ID NO: 1575293 - RNA, 16 nt, Human adenovirus E
ggagaucuuccuucac

SEQ ID NO: 1575294 - RNA, 19 nt, Human adenovirus E
gacaggagcggcgaggagc

SEQ ID NO: 1575295 - RNA, 20 nt, Human adenovirus E
ggcagcagugucuggaggag

SEQ ID NO: 1575296 - RNA, 14 nt, Human adenovirus E
cggcggcgaugcag

SEQ ID NO: 1575297 - RNA, 15 nt, Human adenovirus E
aggcaccgcagcuug

SEQ ID NO: 1575298 - RNA, 16 nt, Human adenovirus E
gcaccugugggaccug

SEQ ID NO: 1575299 - RNA, 20 nt, Human adenovirus E
cggcuucgacaccuggacca

SEQ ID NO: 1575300 - RNA, 16 nt, Human adenovirus E
acgagaagcagcagca

SEQ ID NO: 1575301 - RNA, 18 nt, Human adenovirus E
ccgggugauccuccacca

SEQ ID NO: 1575302 - RNA, 12 nt, Human adenovirus E
gcgcgcccagca

SEQ ID NO: 1575303 - RNA, 18 nt, Human adenovirus E
uuaagaaaaucaacaaaa

SEQ ID NO: 1575304 - RNA, 20 nt, Human adenovirus E
cccggaugcaggggcggcag

SEQ ID NO: 1575305 - RNA, 12 nt, Human adenovirus E
ugcaccuguggg

SEQ ID NO: 1575306 - RNA, 17 nt, Human adenovirus E
ccgcaacaacagccccc

SEQ ID NO: 1575307 - RNA, 18 nt, Human adenovirus E
agacgccgcaccugcccc

SEQ ID NO: 1575308 - RNA, 22 nt, Human adenovirus E
gggccugcucgagugccacugc

SEQ ID NO: 1575309 - RNA, 21 nt, Human adenovirus E
ucuaaccggcggagaugacug

SEQ ID NO: 1575310 - RNA, 16 nt, Human adenovirus E
ugcucuauacgggcaa

SEQ ID NO: 1575311 - RNA, 16 nt, Human adenovirus E
acucaggcagaggagg

SEQ ID NO: 1575312 - RNA, 15 nt, Human adenovirus E
gcacagcacaggcau

SEQ ID NO: 1575313 - RNA, 21 nt, Human adenovirus E
gggcggccgccaugaacucug

SEQ ID NO: 1575314 - RNA, 12 nt, Human adenovirus E
gacccaggccau

SEQ ID NO: 1575315 - RNA, 18 nt, Human adenovirus E
aaguccuggcgggggcac

SEQ ID NO: 1575316 - RNA, 15 nt, Human adenovirus E
cacccgcgcgugcag

SEQ ID NO: 1575317 - RNA, 12 nt, Human adenovirus E
cugacccacugg

SEQ ID NO: 1575318 - RNA, 21 nt, Human adenovirus E
gcggcucgacuccguggccug

SEQ ID NO: 1575319 - RNA, 11 nt, Human adenovirus E
guugcagaggc

SEQ ID NO: 1575320 - RNA, 14 nt, Human adenovirus E
gacggaucccugga

SEQ ID NO: 1575321 - RNA, 13 nt, Human adenovirus E
aaaccagcagcua

SEQ ID NO: 1575322 - RNA, 17 nt, Human adenovirus E
cgugcaacacagaacca

SEQ ID NO: 1575323 - RNA, 15 nt, Human adenovirus E
agcagucccacugcu

SEQ ID NO: 1575324 - RNA, 18 nt, Human adenovirus E
uacuaacaaccaaacuaa

SEQ ID NO: 1575325 - RNA, 15 nt, Human adenovirus E
cccaauugcaagcca

SEQ ID NO: 1575326 - RNA, 23 nt, Human adenovirus E
gccacggcggcggcagcggccau

SEQ ID NO: 1575327 - RNA, 13 nt, Human adenovirus E
uggggcggccagc

SEQ ID NO: 1575328 - RNA, 11 nt, Human adenovirus E
ccgcuguggag

SEQ ID NO: 1575329 - RNA, 16 nt, Human adenovirus E
cuucccaccccacucu

SEQ ID NO: 1575330 - RNA, 13 nt, Human adenovirus E
cuuccagcaaagc

SEQ ID NO: 1575331 - RNA, 23 nt, Human adenovirus E
gccugggcggccuugcgcaggga

SEQ ID NO: 1575332 - RNA, 14 nt, Human adenovirus E
uccgcuccacgcgu

SEQ ID NO: 1575333 - RNA, 18 nt, Human adenovirus E
acguggccgcggccaacc

SEQ ID NO: 1575334 - RNA, 18 nt, Human adenovirus E
cuggaugccaucggcucc

SEQ ID NO: 1575335 - RNA, 15 nt, Human adenovirus E
ucguuguuggccagc

SEQ ID NO: 1575336 - RNA, 22 nt, Human adenovirus E
gccgaucccugcuugcauuuca

SEQ ID NO: 1575337 - RNA, 23 nt, Human adenovirus E
ucacagaucugcaucucccaggc

SEQ ID NO: 1575338 - RNA, 15 nt, Human adenovirus E
cuucccauggugggc

SEQ ID NO: 1575339 - RNA, 21 nt, Human adenovirus E
cacacauugaaagguccagaa

SEQ ID NO: 1575340 - RNA, 19 nt, Human adenovirus E
gacgcugcgcaacggccug

SEQ ID NO: 1575341 - RNA, 18 nt, Human adenovirus E
gcuggagcgcguggcccg

SEQ ID NO: 1575342 - RNA, 17 nt, Human adenovirus E
accuucuuccaguucau

SEQ ID NO: 1575343 - RNA, 18 nt, Human adenovirus E
auugucggugugcuuucg

SEQ ID NO: 1575344 - RNA, 22 nt, Human adenovirus E
cagcagcugaagcaacugcagc

SEQ ID NO: 1575345 - RNA, 15 nt, Human adenovirus E
uccacggccagggcg

SEQ ID NO: 1575346 - RNA, 19 nt, Human adenovirus E
cgggggagaugagcugggc

SEQ ID NO: 1575347 - RNA, 16 nt, Human adenovirus E
uccaagacaguucauu

SEQ ID NO: 1575348 - RNA, 15 nt, Human adenovirus E
cugacacaccaccac

SEQ ID NO: 1575349 - RNA, 24 nt, Human adenovirus E
gucccaugguggcgcagcugaccu

SEQ ID NO: 1575350 - RNA, 23 nt, Human adenovirus E
caggguauaaagcggcuggugau

SEQ ID NO: 1575351 - RNA, 20 nt, Human adenovirus E
aggguucucuaauuccucaa

SEQ ID NO: 1575352 - RNA, 17 nt, Human adenovirus E
cagaaaaagccacagaa

SEQ ID NO: 1575353 - RNA, 12 nt, Human adenovirus E
uuucccacccuc

SEQ ID NO: 1575354 - RNA, 23 nt, Human adenovirus E
cgggcacucccgcaucugcaccu

SEQ ID NO: 1575355 - RNA, 15 nt, Human adenovirus E
ccggagcagcuggga

SEQ ID NO: 1575356 - RNA, 16 nt, Human adenovirus E
cccaucaucgccgcgg

SEQ ID NO: 1575357 - RNA, 20 nt, Human adenovirus E
ggggccacgagccggggcag

SEQ ID NO: 1575358 - RNA, 14 nt, Human adenovirus E
gggcgucgucgccg

SEQ ID NO: 1575359 - RNA, 23 nt, Human adenovirus E
caaggccauccgcggcgacgagg

SEQ ID NO: 1575360 - RNA, 15 nt, Human adenovirus E
cgucaucgacagcgu

SEQ ID NO: 1575361 - RNA, 16 nt, Human adenovirus E
cagagcaucguggugc

SEQ ID NO: 1575362 - RNA, 13 nt, Human adenovirus E
gguguugcuuucg

SEQ ID NO: 1575363 - RNA, 16 nt, Human adenovirus E
gcaccaacgugcagac

SEQ ID NO: 1575364 - RNA, 22 nt, Human adenovirus E
acguggccgucguaccagaucc

SEQ ID NO: 1575365 - RNA, 18 nt, Human adenovirus E
aggcgcgcaggccggagc

SEQ ID NO: 1575366 - RNA, 20 nt, Human adenovirus E
guggcagcagugucuggagg

SEQ ID NO: 1575367 - RNA, 21 nt, Human adenovirus E
cgcgcucgaaggcccccggga

SEQ ID NO: 1575368 - RNA, 17 nt, Human adenovirus E
uugaucuccaccgcgcc

SEQ ID NO: 1575369 - RNA, 12 nt, Human adenovirus E
accccacccagu

SEQ ID NO: 1575370 - RNA, 24 nt, Human adenovirus E
gcacguggacgagcagaccuacca

SEQ ID NO: 1575371 - RNA, 17 nt, Human adenovirus E
agcaccgggugauccuc

SEQ ID NO: 1575372 - RNA, 16 nt, Human adenovirus E
caugcaucccagcugg

SEQ ID NO: 1575373 - RNA, 17 nt, Human adenovirus E
accuggcuguuccaggg

SEQ ID NO: 1575374 - RNA, 16 nt, Human adenovirus E
gggucccgcucgacca

SEQ ID NO: 1575375 - RNA, 22 nt, Human adenovirus E
gggcaacaucuccuucacccgg

SEQ ID NO: 1575376 - RNA, 17 nt, Human adenovirus E
ggcggcgcacgggcaga

SEQ ID NO: 1575377 - RNA, 19 nt, Human adenovirus E
gggaccugcuggaggccau

SEQ ID NO: 1575378 - RNA, 14 nt, Human adenovirus E
caucugcauguuca

SEQ ID NO: 1575379 - RNA, 19 nt, Human adenovirus E
uacucuuucauauccucuc

SEQ ID NO: 1575380 - RNA, 20 nt, Human adenovirus E
guccccagaguuuggaagag

SEQ ID NO: 1575381 - RNA, 22 nt, Human adenovirus E
gugacgcaguagaaggugcggg

SEQ ID NO: 1575382 - RNA, 24 nt, Human adenovirus E
cuccggcucccccggccacuaccc

SEQ ID NO: 1575383 - RNA, 23 nt, Human adenovirus E
ggaauggcuguugaugugaugga

SEQ ID NO: 1575384 - RNA, 18 nt, Human adenovirus E
agcccgccaacgugcccc

SEQ ID NO: 1575385 - RNA, 14 nt, Human adenovirus E
gagacgaugggcag

SEQ ID NO: 1575386 - RNA, 19 nt, Human adenovirus E
ccucaaaggccgcgugcgg

SEQ ID NO: 1575387 - RNA, 15 nt, Human adenovirus E
gcuaccugcucuucc

SEQ ID NO: 1575388 - RNA, 16 nt, Human adenovirus E
cagaucguccagggca

SEQ ID NO: 1575389 - RNA, 17 nt, Human adenovirus E
cgcgagacgcccaggcc

SEQ ID NO: 1575390 - RNA, 18 nt, Human adenovirus E
cgucaagcugcugcucag

SEQ ID NO: 1575391 - RNA, 19 nt, Human adenovirus E
cgugggcggcggccugggc

SEQ ID NO: 1575392 - RNA, 17 nt, Human adenovirus E
cuccgucaagcugcugc

SEQ ID NO: 1575393 - RNA, 21 nt, Human adenovirus E
gcgaucccauuugagcuggag

SEQ ID NO: 1575394 - RNA, 18 nt, Human adenovirus E
ugccaacccuucccaccc

SEQ ID NO: 1575395 - RNA, 14 nt, Human adenovirus E
ucuccgcuccgggu

SEQ ID NO: 1575396 - RNA, 16 nt, Human adenovirus E
gaacucuucgcggucc

SEQ ID NO: 1575397 - RNA, 13 nt, Human adenovirus E
aggaggagcuggc

SEQ ID NO: 1575398 - RNA, 14 nt, Human adenovirus E
ggacagcacucagg

SEQ ID NO: 1575399 - RNA, 14 nt, Human adenovirus E
acggucauguggau

SEQ ID NO: 1575400 - RNA, 12 nt, Human adenovirus E
gcaucccagcug

SEQ ID NO: 1575401 - RNA, 16 nt, Human adenovirus E
uggcacgacaggcagc

SEQ ID NO: 1575402 - RNA, 20 nt, Human adenovirus E
ccuggggcagaacgugcugc

SEQ ID NO: 1575403 - RNA, 19 nt, Human adenovirus E
cggcgagggccugcucgag

SEQ ID NO: 1575404 - RNA, 18 nt, Human adenovirus E
gccgguauacaagcccau

SEQ ID NO: 1575405 - RNA, 23 nt, Human adenovirus E
gucagcgacgagcagcuggcccg

SEQ ID NO: 1575406 - RNA, 18 nt, Human adenovirus E
cuccgaggagggcaagcc

SEQ ID NO: 1575407 - RNA, 15 nt, Human adenovirus E
accggggccgggacc

SEQ ID NO: 1575408 - RNA, 18 nt, Human adenovirus E
cguggucuucuccaucgc

SEQ ID NO: 1575409 - RNA, 20 nt, Human adenovirus E
ggugaacauucugcagagca

SEQ ID NO: 1575410 - RNA, 12 nt, Human adenovirus E
cucccaggacau

SEQ ID NO: 1575411 - RNA, 14 nt, Human adenovirus E
cggcaucucgcuga

SEQ ID NO: 1575412 - RNA, 12 nt, Human adenovirus E
gggcggcagcgg

SEQ ID NO: 1575413 - RNA, 22 nt, Human adenovirus E
cggagcacccccgccaugcgcg

SEQ ID NO: 1575414 - RNA, 13 nt, Human adenovirus E
ccacccucccagg

SEQ ID NO: 1575415 - RNA, 16 nt, Human adenovirus E
cagcccccuccacagc

SEQ ID NO: 1575416 - RNA, 16 nt, Human adenovirus E
gcuccgcgacacggca

SEQ ID NO: 1575417 - RNA, 23 nt, Human adenovirus E
ccaccacagcaaccucaggcaca

SEQ ID NO: 1575418 - RNA, 14 nt, Human adenovirus E
gcccgcaggcggga

SEQ ID NO: 1575419 - RNA, 16 nt, Human adenovirus E
gucucuucagauggau

SEQ ID NO: 1575420 - RNA, 14 nt, Human adenovirus E
uacucgcagcagcu

SEQ ID NO: 1575421 - RNA, 18 nt, Human adenovirus E
auccccgucuccugccgc

SEQ ID NO: 1575422 - RNA, 18 nt, Human adenovirus E
cugccaucacaccuucca

SEQ ID NO: 1575423 - RNA, 13 nt, Human adenovirus E
guaggugagcucg

SEQ ID NO: 1575424 - RNA, 13 nt, Human adenovirus E
ccucaaaugcuac

SEQ ID NO: 1575425 - RNA, 17 nt, Human adenovirus E
agccagcguccgauccu

SEQ ID NO: 1575426 - RNA, 19 nt, Human adenovirus E
ggugaccguggagcuggag

SEQ ID NO: 1575427 - RNA, 18 nt, Human adenovirus E
acgugccccggggccagg

SEQ ID NO: 1575428 - RNA, 16 nt, Human adenovirus E
gaccagucgccagggc

SEQ ID NO: 1575429 - RNA, 12 nt, Human adenovirus E
caacagccgccu

SEQ ID NO: 1575430 - RNA, 23 nt, Human adenovirus E
gcuggggcgacgggggcggugcc

SEQ ID NO: 1575431 - RNA, 21 nt, Human adenovirus E
agcgguguccggggcugcuag

SEQ ID NO: 1575432 - RNA, 17 nt, Human adenovirus E
gcaucaucugggccugg

SEQ ID NO: 1575433 - RNA, 17 nt, Human adenovirus E
aggccacaauacaugcc

SEQ ID NO: 1575434 - RNA, 16 nt, Human adenovirus E
cgaagcguucagggag

SEQ ID NO: 1575435 - RNA, 19 nt, Human adenovirus E
cugguggcgguguugcuuu

SEQ ID NO: 1575436 - RNA, 18 nt, Human adenovirus E
gcccuuuucaaccugggu

SEQ ID NO: 1575437 - RNA, 14 nt, Human adenovirus E
accaccgccucgga

SEQ ID NO: 1575438 - RNA, 17 nt, Human adenovirus E
gccauaggaccaccagg

SEQ ID NO: 1575439 - RNA, 12 nt, Human adenovirus E
ccgccuccaccc

SEQ ID NO: 1575440 - RNA, 15 nt, Human adenovirus E
accaggccgugcagc

SEQ ID NO: 1575441 - RNA, 19 nt, Human adenovirus E
auacgcgcacuuccucaaa

SEQ ID NO: 1575442 - RNA, 14 nt, Human adenovirus E
acgcgcucaucaag

SEQ ID NO: 1575443 - RNA, 15 nt, Human adenovirus E
cuggccuaccacucg

SEQ ID NO: 1575444 - RNA, 16 nt, Human adenovirus E
augguggcgcagcuga

SEQ ID NO: 1575445 - RNA, 18 nt, Human adenovirus E
cacacgcacuaccaccac

SEQ ID NO: 1575446 - RNA, 17 nt, Human adenovirus E
agaugagccgcuggaag

SEQ ID NO: 1575447 - RNA, 13 nt, Human adenovirus E
ucaccuccacagc

SEQ ID NO: 1575448 - RNA, 19 nt, Human adenovirus E
gccgccggugccgcccagg

SEQ ID NO: 1575449 - RNA, 16 nt, Human adenovirus E
ccugcugcgccuggcc

SEQ ID NO: 1575450 - RNA, 17 nt, Human adenovirus E
ucaccagcuggccuugg

SEQ ID NO: 1575451 - RNA, 13 nt, Human adenovirus E
ggcggcggcgcgc

SEQ ID NO: 1575452 - RNA, 21 nt, Human adenovirus E
cgcgaucccugagcuccuccc

SEQ ID NO: 1575453 - RNA, 14 nt, Human adenovirus E
ucuggaagaagcag

SEQ ID NO: 1575454 - RNA, 13 nt, Human adenovirus E
aggaucuggaggg

SEQ ID NO: 1575455 - RNA, 21 nt, Human adenovirus E
  misc_feature (8)..(8): n is a, c, g or u
gccccaunuagcagucccacu

SEQ ID NO: 1575456 - RNA, 20 nt, Human adenovirus E
ccgaggagaugcgcgcggcc

SEQ ID NO: 1575457 - RNA, 14 nt, Human adenovirus E
guccuggcgggggc

SEQ ID NO: 1575458 - RNA, 18 nt, Human adenovirus E
ucuccggcucccccggcc

SEQ ID NO: 1575459 - RNA, 14 nt, Human adenovirus E
uacaggagccauaa

SEQ ID NO: 1575460 - RNA, 18 nt, Human adenovirus E
aggugacccugggccuga

SEQ ID NO: 1575461 - RNA, 16 nt, Human adenovirus E
gaggccagcacccaga

SEQ ID NO: 1575462 - RNA, 22 nt, Human adenovirus E
cauuucccuuaacauggaucac

SEQ ID NO: 1575463 - RNA, 20 nt, Human adenovirus E
cauaguucaacacgcuccag

SEQ ID NO: 1575464 - RNA, 22 nt, Human adenovirus E
auacccgccaaauaaucacaca

SEQ ID NO: 1575465 - RNA, 12 nt, Human adenovirus E
ugcagggccugu

SEQ ID NO: 1575466 - RNA, 12 nt, Human adenovirus E
cagcggcggcag

SEQ ID NO: 1575467 - RNA, 19 nt, Human adenovirus E
ccggagaaaacuggcguga

SEQ ID NO: 1575468 - RNA, 14 nt, Human adenovirus E
gaggccgagccaca

SEQ ID NO: 1575469 - RNA, 16 nt, Human adenovirus E
ucaccgccccgcucag

SEQ ID NO: 1575470 - RNA, 17 nt, Human adenovirus E
ggccggagcuguccagg

SEQ ID NO: 1575471 - RNA, 17 nt, Human adenovirus E
cgguuguaccuggugga

SEQ ID NO: 1575472 - RNA, 17 nt, Human adenovirus E
acgaggaggaggcagag

SEQ ID NO: 1575473 - RNA, 21 nt, Human adenovirus E
ugccccuacgucuacaaggcc

SEQ ID NO: 1575474 - RNA, 15 nt, Human adenovirus E
ucuggagcaggcggc

SEQ ID NO: 1575475 - RNA, 20 nt, Human adenovirus E
gcagguccagaccucggcgc

SEQ ID NO: 1575476 - RNA, 23 nt, Human adenovirus E
ggccccgcagcagucgcugccgc

SEQ ID NO: 1575477 - RNA, 22 nt, Human adenovirus E
uguauuauggaacuacagcagg

SEQ ID NO: 1575478 - RNA, 15 nt, Human adenovirus E
ccugcgcaaggucga

SEQ ID NO: 1575479 - RNA, 18 nt, Human adenovirus E
uguggagcuaccagcccc

SEQ ID NO: 1575480 - RNA, 15 nt, Human adenovirus E
ggucgagcugaccca

SEQ ID NO: 1575481 - RNA, 18 nt, Human adenovirus E
guuauuuuuccuccaccc

SEQ ID NO: 1575482 - RNA, 13 nt, Human adenovirus E
cacgcuccagccg

SEQ ID NO: 1575483 - RNA, 17 nt, Human adenovirus E
cuccagaagacggauga

SEQ ID NO: 1575484 - RNA, 16 nt, Human adenovirus E
cgagagcgugaugcag

SEQ ID NO: 1575485 - RNA, 18 nt, Human adenovirus E
cggcgacuaccuccaccu

SEQ ID NO: 1575486 - RNA, 23 nt, Human adenovirus E
agcacagggacgauccccgggcg

SEQ ID NO: 1575487 - RNA, 12 nt, Human adenovirus E
cgcgcucaucaa

SEQ ID NO: 1575488 - RNA, 14 nt, Human adenovirus E
agcaccgaggagga

SEQ ID NO: 1575489 - RNA, 15 nt, Human adenovirus E
cuuccguggcggugc

SEQ ID NO: 1575490 - RNA, 14 nt, Human adenovirus E
ccuaccgcagcugg

SEQ ID NO: 1575491 - RNA, 19 nt, Human adenovirus E
uuacaaaguaacuguuguu

SEQ ID NO: 1575492 - RNA, 20 nt, Human adenovirus E
uaacucagguguccagcugg

SEQ ID NO: 1575493 - RNA, 19 nt, Human adenovirus E
gccccgguucgaggccggc

SEQ ID NO: 1575494 - RNA, 21 nt, Human adenovirus E
uccuuacaaguuucuccacca

SEQ ID NO: 1575495 - RNA, 16 nt, Human adenovirus E
cuaugccuucugcuac

SEQ ID NO: 1575496 - RNA, 18 nt, Human adenovirus E
gcaguuagcgcucuaguu

SEQ ID NO: 1575497 - RNA, 12 nt, Human adenovirus E
ugcccucggccu

SEQ ID NO: 1575498 - RNA, 13 nt, Human adenovirus E
uuccucaaaugcu

SEQ ID NO: 1575499 - RNA, 16 nt, Human adenovirus E
gaggaggggggccacc

SEQ ID NO: 1575500 - RNA, 13 nt, Human adenovirus E
accugcugggcau

SEQ ID NO: 1575501 - RNA, 14 nt, Human adenovirus E
cggaaagguugggg

SEQ ID NO: 1575502 - RNA, 15 nt, Human adenovirus E
caacaacagccaccu

SEQ ID NO: 1575503 - RNA, 17 nt, Human adenovirus E
gcaacucguaccugggc

SEQ ID NO: 1575504 - RNA, 21 nt, Human adenovirus E
caggaugcaccgugcggugag

SEQ ID NO: 1575505 - RNA, 21 nt, Human adenovirus E
uucauauccucuccgaaauuu

SEQ ID NO: 1575506 - RNA, 19 nt, Human adenovirus E
uaccaggaaauuccccagc

SEQ ID NO: 1575507 - RNA, 21 nt, Human adenovirus E
ccguggaaugggccagaccca

SEQ ID NO: 1575508 - RNA, 22 nt, Human adenovirus E
caaccacgugcgcacccugauc

SEQ ID NO: 1575509 - RNA, 22 nt, Human adenovirus E
aggacuccgccgacgacagcag

SEQ ID NO: 1575510 - RNA, 19 nt, Human adenovirus E
acuucuuccagaccagucg

SEQ ID NO: 1575511 - RNA, 19 nt, Human adenovirus E
agcagaucuagggccucag

SEQ ID NO: 1575512 - RNA, 14 nt, Human adenovirus E
ggggaacccguccu

SEQ ID NO: 1575513 - RNA, 15 nt, Human adenovirus E
ggaagaagcagaaga

SEQ ID NO: 1575514 - RNA, 18 nt, Human adenovirus E
acgcuccugguccuguga

SEQ ID NO: 1575515 - RNA, 21 nt, Human adenovirus E
auuucaccaacgccauccuga

SEQ ID NO: 1575516 - RNA, 18 nt, Human adenovirus E
cuucccagcucugguacu

SEQ ID NO: 1575517 - RNA, 21 nt, Human adenovirus E
ucccgcaucugcaccucacag

SEQ ID NO: 1575518 - RNA, 15 nt, Human adenovirus E
cgcauggucucggug

SEQ ID NO: 1575519 - RNA, 22 nt, Human adenovirus E
accuggccuaccacucggacgu

SEQ ID NO: 1575520 - RNA, 22 nt, Human adenovirus E
gcggaaccacagggccagcacc

SEQ ID NO: 1575521 - RNA, 22 nt, Human adenovirus E
gaugcaccugugggaccugcug

SEQ ID NO: 1575522 - RNA, 13 nt, Human adenovirus E
guucauuuuugcu

SEQ ID NO: 1575523 - RNA, 20 nt, Human adenovirus E
gccaacugaacgggggcgcc

SEQ ID NO: 1575524 - RNA, 14 nt, Human adenovirus E
aguacaggagccau

SEQ ID NO: 1575525 - RNA, 18 nt, Human adenovirus E
gaagacgaaggcgcgcag

SEQ ID NO: 1575526 - RNA, 18 nt, Human adenovirus E
accugugggaccugcugg

SEQ ID NO: 1575527 - RNA, 13 nt, Human adenovirus E
gagacagcugccg

SEQ ID NO: 1575528 - RNA, 14 nt, Human adenovirus E
caaguuccggagca

SEQ ID NO: 1575529 - RNA, 22 nt, Human adenovirus E
cagcaucaucugggccuggucg

SEQ ID NO: 1575530 - RNA, 20 nt, Human adenovirus E
ucaaauacucgcagaaaaug

SEQ ID NO: 1575531 - RNA, 18 nt, Human adenovirus E
gagcgcggucauggacca

SEQ ID NO: 1575532 - RNA, 13 nt, Human adenovirus E
ccgucgccgcacc

SEQ ID NO: 1575533 - RNA, 17 nt, Human adenovirus E
cauguagaacugguuga

SEQ ID NO: 1575534 - RNA, 16 nt, Human adenovirus E
augggcaccuggagcg

SEQ ID NO: 1575535 - RNA, 16 nt, Human adenovirus E
uauuuuuccuccaccc

SEQ ID NO: 1575536 - RNA, 24 nt, Human adenovirus E
cggucgcccgucucucagccaauc

SEQ ID NO: 1575537 - RNA, 14 nt, Human adenovirus E
cagcgcccuggucg

SEQ ID NO: 1575538 - RNA, 18 nt, Human adenovirus E
ggcggauggcuggcagag

SEQ ID NO: 1575539 - RNA, 15 nt, Human adenovirus E
cggucagggagauga

SEQ ID NO: 1575540 - RNA, 18 nt, Human adenovirus E
ugaacauuaaaccaugcu

SEQ ID NO: 1575541 - RNA, 23 nt, Human adenovirus E
gcgugcaggccccggucggggac

SEQ ID NO: 1575542 - RNA, 23 nt, Human adenovirus E
cgggguggacuucaccgagagcc

SEQ ID NO: 1575543 - RNA, 15 nt, Human adenovirus E
gggcaggaggucggg

SEQ ID NO: 1575544 - RNA, 18 nt, Human adenovirus E
gcguccagcgcagccagg

SEQ ID NO: 1575545 - RNA, 15 nt, Human adenovirus E
gcccggcggcaccgg

SEQ ID NO: 1575546 - RNA, 14 nt, Human adenovirus E
agaucuucgagggu

SEQ ID NO: 1575547 - RNA, 20 nt, Human adenovirus E
uggcaugcgaguuggaggag

SEQ ID NO: 1575548 - RNA, 11 nt, Human adenovirus E
gcacaggcagc

SEQ ID NO: 1575549 - RNA, 20 nt, Human adenovirus E
auuguaaaacagccacucuc

SEQ ID NO: 1575550 - RNA, 15 nt, Human adenovirus E
cguggaacagcacca

SEQ ID NO: 1575551 - RNA, 15 nt, Human adenovirus E
cgacaaaaaucagac

SEQ ID NO: 1575552 - RNA, 17 nt, Human adenovirus E
ucgauggugaagaugcc

SEQ ID NO: 1575553 - RNA, 22 nt, Human adenovirus E
gcuuggcgacgagcucggcggu

SEQ ID NO: 1575554 - RNA, 18 nt, Human adenovirus E
gagaucgagggcgagcuc

SEQ ID NO: 1575555 - RNA, 15 nt, Human adenovirus E
cuacagccuaggcca

SEQ ID NO: 1575556 - RNA, 16 nt, Human adenovirus E
cgcgguaccuggcgcc

SEQ ID NO: 1575557 - RNA, 18 nt, Human adenovirus E
ggagucaggucagugggc

SEQ ID NO: 1575558 - RNA, 19 nt, Human adenovirus E
uucagggaggcgcugcuga

SEQ ID NO: 1575559 - RNA, 19 nt, Human adenovirus E
cuggagcgcguggcccgcu

SEQ ID NO: 1575560 - RNA, 22 nt, Human adenovirus E
ccacggcaaccccacgccgagc

SEQ ID NO: 1575561 - RNA, 21 nt, Human adenovirus E
ccgaggagggcaagcccgugg

SEQ ID NO: 1575562 - RNA, 21 nt, Human adenovirus E
ucaccaaacugucaaauacuc

SEQ ID NO: 1575563 - RNA, 20 nt, Human adenovirus E
aaagcccccgaucccuccag

SEQ ID NO: 1575564 - RNA, 16 nt, Human adenovirus E
caugauccagcggcgg

SEQ ID NO: 1575565 - RNA, 19 nt, Human adenovirus E
cuccaagagcuucuucaac

SEQ ID NO: 1575566 - RNA, 22 nt, Human adenovirus E
ccaucccgaagggggucaucuu

SEQ ID NO: 1575567 - RNA, 18 nt, Human adenovirus E
cggccaucgccagcaugu

SEQ ID NO: 1575568 - RNA, 18 nt, Human adenovirus E
gcacuccauauaccaaug

SEQ ID NO: 1575569 - RNA, 15 nt, Human adenovirus E
uccuccagaagacgg

SEQ ID NO: 1575570 - RNA, 21 nt, Human adenovirus E
ggggugcgcucccggcggcgc

SEQ ID NO: 1575571 - RNA, 22 nt, Human adenovirus E
aggcggcagugguggcggggga

SEQ ID NO: 1575572 - RNA, 18 nt, Human adenovirus E
caggaaauuccccagccc

SEQ ID NO: 1575573 - RNA, 19 nt, Human adenovirus E
gauguacagguggcagaug

SEQ ID NO: 1575574 - RNA, 16 nt, Human adenovirus E
ggcgugcgcuccugga

SEQ ID NO: 1575575 - RNA, 24 nt, Human adenovirus E
ggcgaguuugcuuacggcaagcgc

SEQ ID NO: 1575576 - RNA, 13 nt, Human adenovirus E
gcagugggcgcag

SEQ ID NO: 1575577 - RNA, 16 nt, Human adenovirus E
cgguggggcggccagc

SEQ ID NO: 1575578 - RNA, 17 nt, Human adenovirus E
ucacacacgcccagcac

SEQ ID NO: 1575579 - RNA, 16 nt, Human adenovirus E
uccugcccgccaccug

SEQ ID NO: 1575580 - RNA, 21 nt, Human adenovirus E
acgcacgagaagguccuggcc

SEQ ID NO: 1575581 - RNA, 14 nt, Human adenovirus E
cggggugcuggaga

SEQ ID NO: 1575582 - RNA, 12 nt, Human adenovirus E
caacgccauccu

SEQ ID NO: 1575583 - RNA, 21 nt, Human adenovirus E
gggcguccagcgcagccaggg

SEQ ID NO: 1575584 - RNA, 14 nt, Human adenovirus E
cagcugauggugcc

SEQ ID NO: 1575585 - RNA, 16 nt, Human adenovirus E
gcccgguuccacgcgg

SEQ ID NO: 1575586 - RNA, 15 nt, Human adenovirus E
guucucuccagcacc

SEQ ID NO: 1575587 - RNA, 21 nt, Human adenovirus E
uggcggcgauguugagcugca

SEQ ID NO: 1575588 - RNA, 18 nt, Human adenovirus E
caucagucgucuggugcg

SEQ ID NO: 1575589 - RNA, 15 nt, Human adenovirus E
cugaucacaucgacc

SEQ ID NO: 1575590 - RNA, 23 nt, Human adenovirus E
ggugcccucgcgcuccaacccca

SEQ ID NO: 1575591 - RNA, 15 nt, Human adenovirus E
agcuaccuccagugc

SEQ ID NO: 1575592 - RNA, 22 nt, Human adenovirus E
aaucccaacaaaugccagcuga

SEQ ID NO: 1575593 - RNA, 17 nt, Human adenovirus E
gaugcccacggcccuca

SEQ ID NO: 1575594 - RNA, 16 nt, Human adenovirus E
gcgcccccaccacccu

SEQ ID NO: 1575595 - RNA, 14 nt, Human adenovirus E
ccgccuucgcguuc

SEQ ID NO: 1575596 - RNA, 15 nt, Human adenovirus E
caauauauagcccag

SEQ ID NO: 1575597 - RNA, 22 nt, Human adenovirus E
gcccaggccgaaguccagcuga

SEQ ID NO: 1575598 - RNA, 20 nt, Human adenovirus E
cgugaccuugcagcaggugc

SEQ ID NO: 1575599 - RNA, 14 nt, Human adenovirus E
ggggaucagccccg

SEQ ID NO: 1575600 - RNA, 21 nt, Human adenovirus E
guuccacgguggcuuccagca

SEQ ID NO: 1575601 - RNA, 15 nt, Human adenovirus E
cugcccgcaggcggg

SEQ ID NO: 1575602 - RNA, 20 nt, Human adenovirus E
  misc_feature (4)..(4): n is a, c, g or u
accnuacuuuuuccacccgc

SEQ ID NO: 1575603 - RNA, 13 nt, Human adenovirus E
cugcagcgggccc

SEQ ID NO: 1575604 - RNA, 20 nt, Human adenovirus E
acugacguaaaggccaaagu

SEQ ID NO: 1575605 - RNA, 14 nt, Human adenovirus E
gccugauggcucug

SEQ ID NO: 1575606 - RNA, 22 nt, Human adenovirus E
cggcgcagcuguuccugguggu

SEQ ID NO: 1575607 - RNA, 18 nt, Human adenovirus E
uggucagcgacgagcagc

SEQ ID NO: 1575608 - RNA, 16 nt, Human adenovirus E
cgugaggcgcgcgcag

SEQ ID NO: 1575609 - RNA, 13 nt, Human adenovirus E
gccauccuggagg

SEQ ID NO: 1575610 - RNA, 15 nt, Human adenovirus E
caccgagagccgccu

SEQ ID NO: 1575611 - RNA, 15 nt, Human adenovirus E
agggcuugcagaccg

SEQ ID NO: 1575612 - RNA, 21 nt, Human adenovirus E
cagcagcagaaaaagaccagc

SEQ ID NO: 1575613 - RNA, 15 nt, Human adenovirus E
cccucagggcccggc

SEQ ID NO: 1575614 - RNA, 14 nt, Human adenovirus E
gacguccagagcgc

SEQ ID NO: 1575615 - RNA, 23 nt, Human adenovirus E
gcggaauaucaaaaucucugccg

SEQ ID NO: 1575616 - RNA, 16 nt, Human adenovirus E
gcagcccccgcuggag

SEQ ID NO: 1575617 - RNA, 21 nt, Human adenovirus E
auaacaagacucggaacaaua

SEQ ID NO: 1575618 - RNA, 18 nt, Human adenovirus E
gacccugccaucacaccu

SEQ ID NO: 1575619 - RNA, 18 nt, Human adenovirus E
cagaccgugaaccugagc

SEQ ID NO: 1575620 - RNA, 12 nt, Human adenovirus E
agucuggaggaa

SEQ ID NO: 1575621 - RNA, 23 nt, Human adenovirus E
cuccacgcaacaccccgugcgcg

SEQ ID NO: 1575622 - RNA, 14 nt, Human adenovirus E
ccgcgcgugccccc

SEQ ID NO: 1575623 - RNA, 14 nt, Human adenovirus E
ugggcagggagagg

SEQ ID NO: 1575624 - RNA, 22 nt, Human adenovirus E
aggaagacugggagaacagcag

SEQ ID NO: 1575625 - RNA, 23 nt, Human adenovirus E
ucgauuccucgggaaaacucauc

SEQ ID NO: 1575626 - RNA, 20 nt, Human adenovirus E
cagagcaucguggugcagga

SEQ ID NO: 1575627 - RNA, 19 nt, Human adenovirus E
gucccccgaguuguccugg

SEQ ID NO: 1575628 - RNA, 11 nt, Human adenovirus E
gcucagccgcg

SEQ ID NO: 1575629 - RNA, 14 nt, Human adenovirus E
cgccgcgcaggggc

SEQ ID NO: 1575630 - RNA, 21 nt, Human adenovirus E
ucccugagcuccucccucagc

SEQ ID NO: 1575631 - RNA, 22 nt, Human adenovirus E
acucggacgugaucgaggacgu

SEQ ID NO: 1575632 - RNA, 15 nt, Human adenovirus E
ccaccucgccgcgca

SEQ ID NO: 1575633 - RNA, 12 nt, Human adenovirus E
ucgucaggccgu

SEQ ID NO: 1575634 - RNA, 15 nt, Human adenovirus E
ccacagcaaccucag

SEQ ID NO: 1575635 - RNA, 22 nt, Human adenovirus E
uacuuccgcgagacgcccaggc

SEQ ID NO: 1575636 - RNA, 17 nt, Human adenovirus E
gcaugcuggcuagaccc

SEQ ID NO: 1575637 - RNA, 17 nt, Human adenovirus E
ugcaagacuccgaggag

SEQ ID NO: 1575638 - RNA, 14 nt, Human adenovirus E
ugccgcccaggacu

SEQ ID NO: 1575639 - RNA, 18 nt, Human adenovirus E
gcgugcacgaagcccugc

SEQ ID NO: 1575640 - RNA, 21 nt, Human adenovirus E
agcgcggucauggaccaggug

SEQ ID NO: 1575641 - RNA, 18 nt, Human adenovirus E
acguggacgagcagaccu

SEQ ID NO: 1575642 - RNA, 20 nt, Human adenovirus E
gcucacccgcaguugucugu

SEQ ID NO: 1575643 - RNA, 19 nt, Human adenovirus E
acucaccccggggcugugg

SEQ ID NO: 1575644 - RNA, 22 nt, Human adenovirus E
cggcgguacaccucgcccugcu

SEQ ID NO: 1575645 - RNA, 20 nt, Human adenovirus E
ccucauuuuccccgagcgcc

SEQ ID NO: 1575646 - RNA, 18 nt, Human adenovirus E
ugcuauuuuggaucugac

SEQ ID NO: 1575647 - RNA, 19 nt, Human adenovirus E
uccaacguggagcugacca

SEQ ID NO: 1575648 - RNA, 18 nt, Human adenovirus E
cgaggccguggcccagcg

SEQ ID NO: 1575649 - RNA, 22 nt, Human adenovirus E
aaccugacacaccaccacagca

SEQ ID NO: 1575650 - RNA, 18 nt, Human adenovirus E
ggccugcgcgcgcccagc

SEQ ID NO: 1575651 - RNA, 18 nt, Human adenovirus E
agcgcccagucggcgaga

SEQ ID NO: 1575652 - RNA, 13 nt, Human adenovirus E
aucagacccacug

SEQ ID NO: 1575653 - RNA, 16 nt, Human adenovirus E
agauccuaggccuuuu

SEQ ID NO: 1575654 - RNA, 16 nt, Human adenovirus E
gccggggcagcgccgc

SEQ ID NO: 1575655 - RNA, 18 nt, Human adenovirus E
cccccgggaguuccucca

SEQ ID NO: 1575656 - RNA, 19 nt, Human adenovirus E
gccuguuccugaugcagga

SEQ ID NO: 1575657 - RNA, 16 nt, Human adenovirus E
ccucaagcugggagag

SEQ ID NO: 1575658 - RNA, 23 nt, Human adenovirus E
agaccagcagaaaaccagcagcu

SEQ ID NO: 1575659 - RNA, 17 nt, Human adenovirus E
cuccacguuccacacag

SEQ ID NO: 1575660 - RNA, 15 nt, Human adenovirus E
acgauuggacccagg

SEQ ID NO: 1575661 - RNA, 18 nt, Human adenovirus E
gcagggccaggcgcacgg

SEQ ID NO: 1575662 - RNA, 15 nt, Human adenovirus E
cagcaaagccuccac

SEQ ID NO: 1575663 - RNA, 23 nt, Human adenovirus E
aaaugaugcaaaacuaacacuuu

SEQ ID NO: 1575664 - RNA, 13 nt, Human adenovirus E
uacccgguggugg

SEQ ID NO: 1575665 - RNA, 22 nt, Human adenovirus E
cugagcuccucccucagcaaua

SEQ ID NO: 1575666 - RNA, 19 nt, Human adenovirus E
uacgagagcgugaugcagc

SEQ ID NO: 1575667 - RNA, 22 nt, Human adenovirus E
cggccugcgucaucacccaggg

SEQ ID NO: 1575668 - RNA, 20 nt, Human adenovirus E
gaauaucaaaaucucugccg

SEQ ID NO: 1575669 - RNA, 19 nt, Human adenovirus E
gagucgcggaugaaguggg

SEQ ID NO: 1575670 - RNA, 23 nt, Human adenovirus E
gauaccacccgguuguaccuggu

SEQ ID NO: 1575671 - RNA, 16 nt, Human adenovirus E
cagcguggaggagcuc

SEQ ID NO: 1575672 - RNA, 17 nt, Human adenovirus E
cagagacaggagcggcg

SEQ ID NO: 1575673 - RNA, 14 nt, Human adenovirus E
uacccguggaucau

SEQ ID NO: 1575674 - RNA, 19 nt, Human adenovirus E
accaguuccgccaggaggc

SEQ ID NO: 1575675 - RNA, 21 nt, Human adenovirus E
cgcuccgucaagcugcugcuc

SEQ ID NO: 1575676 - RNA, 13 nt, Human adenovirus E
gccacaguacaga

SEQ ID NO: 1575677 - RNA, 22 nt, Human adenovirus E
gguucugggugaucuuggcccg

SEQ ID NO: 1575678 - RNA, 19 nt, Human adenovirus E
ccacggcccucagcaucag

SEQ ID NO: 1575679 - RNA, 12 nt, Human adenovirus E
ggucgaggagaa

SEQ ID NO: 1575680 - RNA, 19 nt, Human adenovirus E
uggaggaguucacucccuc

SEQ ID NO: 1575681 - RNA, 21 nt, Human adenovirus E
gugguggcgggggagggggcc

SEQ ID NO: 1575682 - RNA, 19 nt, Human adenovirus E
ggagaugcggcccaugagc

SEQ ID NO: 1575683 - RNA, 16 nt, Human adenovirus E
cucaccaaggccaugg

SEQ ID NO: 1575684 - RNA, 16 nt, Human adenovirus E
caagcuccugcagaag

SEQ ID NO: 1575685 - RNA, 14 nt, Human adenovirus E
aggagggcaagccc

SEQ ID NO: 1575686 - RNA, 16 nt, Human adenovirus E
cugcuggaggccaucg

SEQ ID NO: 1575687 - RNA, 20 nt, Human adenovirus E
ggcagcggccgaggcggcug

SEQ ID NO: 1575688 - RNA, 17 nt, Human adenovirus E
ucugaaccugcccccca

SEQ ID NO: 1575689 - RNA, 20 nt, Human adenovirus E
gaucagcaucaucugggccu

SEQ ID NO: 1575690 - RNA, 16 nt, Human adenovirus E
aggagguggaagaagc

SEQ ID NO: 1575691 - RNA, 16 nt, Human adenovirus E
agggcaggcgcugagg

SEQ ID NO: 1575692 - RNA, 13 nt, Human adenovirus E
ccacacagacaac

SEQ ID NO: 1575693 - RNA, 17 nt, Human adenovirus E
gugggaccugcuggagg

SEQ ID NO: 1575694 - RNA, 17 nt, Human adenovirus E
ugcucgcaacgcugcac

SEQ ID NO: 1575695 - RNA, 21 nt, Human adenovirus E
gcuggcgggcggcgccacccu

SEQ ID NO: 1575696 - RNA, 13 nt, Human adenovirus E
ccuggggcgcccu

SEQ ID NO: 1575697 - RNA, 20 nt, Human adenovirus E
accucgccgcgcaggggcuc

SEQ ID NO: 1575698 - RNA, 14 nt, Human adenovirus E
ggccguggcccagc

SEQ ID NO: 1575699 - RNA, 23 nt, Human adenovirus E
ucgagcaguuauuuuuccuccac

SEQ ID NO: 1575700 - RNA, 18 nt, Human adenovirus E
uacacccccggaacauug

SEQ ID NO: 1575701 - RNA, 23 nt, Human adenovirus E
ucaacaaaagaaaaauccuccag

SEQ ID NO: 1575702 - RNA, 22 nt, Human adenovirus E
ggugggcuuggauguugaggua

SEQ ID NO: 1575703 - RNA, 16 nt, Human adenovirus E
caguaguacagaaaca

SEQ ID NO: 1575704 - RNA, 20 nt, Human adenovirus E
guccaccuuuuccaggguau

SEQ ID NO: 1575705 - RNA, 21 nt, Human adenovirus E
ugcucagucucaaguccagca

SEQ ID NO: 1575706 - RNA, 12 nt, Human adenovirus E
acggcccucagc

SEQ ID NO: 1575707 - RNA, 15 nt, Human adenovirus E
ucuacuuccuccuca

SEQ ID NO: 1575708 - RNA, 20 nt, Human adenovirus E
gggcguccagcgcagccagg

SEQ ID NO: 1575709 - RNA, 15 nt, Human adenovirus E
cgagcuccagcucca

SEQ ID NO: 1575710 - RNA, 14 nt, Human adenovirus E
agcagcuggcccgg

SEQ ID NO: 1575711 - RNA, 23 nt, Human adenovirus E
auuagggcaagccacaguacaga

SEQ ID NO: 1575712 - RNA, 20 nt, Human adenovirus E
gccgcuggcuccuggaccug

SEQ ID NO: 1575713 - RNA, 16 nt, Human adenovirus E
cagcccaauggcaccu

SEQ ID NO: 1575714 - RNA, 16 nt, Human adenovirus E
cugaaccugacacacc

SEQ ID NO: 1575715 - RNA, 19 nt, Human adenovirus E
gaggaugcagcagcugaag

SEQ ID NO: 1575716 - RNA, 20 nt, Human adenovirus E
gcggggggagaugaggugca

SEQ ID NO: 1575717 - RNA, 17 nt, Human adenovirus E
gucugcgaccugacgga

SEQ ID NO: 1575718 - RNA, 15 nt, Human adenovirus E
cucccucguacgaga

SEQ ID NO: 1575719 - RNA, 21 nt, Human adenovirus E
gcaccaccgccucggaccugg

SEQ ID NO: 1575720 - RNA, 17 nt, Human adenovirus E
guggagaacaaggccau

SEQ ID NO: 1575721 - RNA, 17 nt, Human adenovirus E
ccagaaaaagccacaga

SEQ ID NO: 1575722 - RNA, 21 nt, Human adenovirus E
cgggauagaaagccuggugga

SEQ ID NO: 1575723 - RNA, 17 nt, Human adenovirus E
augcccacggcccucag

SEQ ID NO: 1575724 - RNA, 16 nt, Human adenovirus E
cucggccauccuggag

SEQ ID NO: 1575725 - RNA, 18 nt, Human adenovirus E
cugguggcgguguugcuu

SEQ ID NO: 1575726 - RNA, 19 nt, Human adenovirus E
cguuacgugcagcagaagc

SEQ ID NO: 1575727 - RNA, 20 nt, Human adenovirus E
ccuuccucagcacccagccc

SEQ ID NO: 1575728 - RNA, 16 nt, Human adenovirus E
cuacagaaagcacaga

SEQ ID NO: 1575729 - RNA, 14 nt, Human adenovirus E
ugcaggagggggcc

SEQ ID NO: 1575730 - RNA, 19 nt, Human adenovirus E
gcgagcagaaggggggcag

SEQ ID NO: 1575731 - RNA, 23 nt, Human adenovirus E
gccgcuccgucaagcugcugcuc

SEQ ID NO: 1575732 - RNA, 14 nt, Human adenovirus E
caguggcagcggcc

SEQ ID NO: 1575733 - RNA, 16 nt, Human adenovirus E
ccgaggacgagggcau

SEQ ID NO: 1575734 - RNA, 14 nt, Human adenovirus E
uauguggcccccca

SEQ ID NO: 1575735 - RNA, 16 nt, Human adenovirus E
gaaggguaugcuuucg

SEQ ID NO: 1575736 - RNA, 13 nt, Human adenovirus E
gcuaccuccagug

SEQ ID NO: 1575737 - RNA, 17 nt, Human adenovirus E
ugcuggagcgcguggcc

SEQ ID NO: 1575738 - RNA, 13 nt, Human adenovirus E
gugaucgaggacg

SEQ ID NO: 1575739 - RNA, 13 nt, Human adenovirus E
cgccucuggguga

SEQ ID NO: 1575740 - RNA, 14 nt, Human adenovirus E
ggcaugaccucggc

SEQ ID NO: 1575741 - RNA, 19 nt, Human adenovirus E
agcucugcaagcuccugca

SEQ ID NO: 1575742 - RNA, 23 nt, Human adenovirus E
cagcaaggcguggaacagcacca

SEQ ID NO: 1575743 - RNA, 19 nt, Human adenovirus E
gaagacugggacagcacuc

SEQ ID NO: 1575744 - RNA, 15 nt, Human adenovirus E
cgagaagcagcagca

SEQ ID NO: 1575745 - RNA, 22 nt, Human adenovirus E
ccggcgucgugcacgcagcagc

SEQ ID NO: 1575746 - RNA, 20 nt, Human adenovirus E
gcaagacccccaauggggug

SEQ ID NO: 1575747 - RNA, 19 nt, Human adenovirus E
gccaaccggcucucggcca

SEQ ID NO: 1575748 - RNA, 18 nt, Human adenovirus E
cuguaucccacccugcau

SEQ ID NO: 1575749 - RNA, 16 nt, Human adenovirus E
cggcucggggcccgga

SEQ ID NO: 1575750 - RNA, 17 nt, Human adenovirus E
gagggccgcuggcuccu

SEQ ID NO: 1575751 - RNA, 19 nt, Human adenovirus E
gaacugcugcccgacggcc

SEQ ID NO: 1575752 - RNA, 17 nt, Human adenovirus E
ggcuggcggggaacggg

SEQ ID NO: 1575753 - RNA, 17 nt, Human adenovirus E
cccaccccacccaguga

SEQ ID NO: 1575754 - RNA, 16 nt, Human adenovirus E
ggcaacauccccgcgc

SEQ ID NO: 1575755 - RNA, 14 nt, Human adenovirus E
cuccuuacgugccc

SEQ ID NO: 1575756 - RNA, 22 nt, Human adenovirus E
cagcagugucuggaggagcaga

SEQ ID NO: 1575757 - RNA, 18 nt, Human adenovirus E
aauccaagccagccauga

SEQ ID NO: 1575758 - RNA, 18 nt, Human adenovirus E
ggugcgaggaugcgagcc

SEQ ID NO: 1575759 - RNA, 14 nt, Human adenovirus E
cgcagggaggugug

SEQ ID NO: 1575760 - RNA, 14 nt, Human adenovirus E
caccacagcgcccu

SEQ ID NO: 1575761 - RNA, 21 nt, Human adenovirus E
auugaaagcaacauaagcugg

SEQ ID NO: 1575762 - RNA, 12 nt, Human adenovirus E
ugcgcagggagg

SEQ ID NO: 1575763 - RNA, 18 nt, Human adenovirus E
acugcuaccugcugcgcc

SEQ ID NO: 1575764 - RNA, 16 nt, Human adenovirus E
guuccugaugcaggag

SEQ ID NO: 1575765 - RNA, 21 nt, Human adenovirus E
acugccgcugcaaccucugca

SEQ ID NO: 1575766 - RNA, 21 nt, Human adenovirus E
cgggcacuuccgcgcucccug

SEQ ID NO: 1575767 - RNA, 13 nt, Human adenovirus E
acgacaggcagcg

SEQ ID NO: 1575768 - RNA, 15 nt, Human adenovirus E
uacgugcaacacaga

SEQ ID NO: 1575769 - RNA, 11 nt, Human adenovirus E
uccuccuccac

SEQ ID NO: 1575770 - RNA, 13 nt, Human adenovirus E
ugacgcuccuggu

SEQ ID NO: 1575771 - RNA, 17 nt, Human adenovirus E
cugcgacuggccgaccc

SEQ ID NO: 1575772 - RNA, 17 nt, Human adenovirus E
cucgcgguggggcggcc

SEQ ID NO: 1575773 - RNA, 16 nt, Human adenovirus E
guggcagcggccgagg

SEQ ID NO: 1575774 - RNA, 22 nt, Human adenovirus E
acguggagcugaccaaccuggu

SEQ ID NO: 1575775 - RNA, 16 nt, Human adenovirus E
gaggccaucgugcaga

SEQ ID NO: 1575776 - RNA, 17 nt, Human adenovirus E
ugaccggggccgggacc

SEQ ID NO: 1575777 - RNA, 20 nt, Human adenovirus E
ggaaccacagggccagcacc

SEQ ID NO: 1575778 - RNA, 12 nt, Human adenovirus E
gaaaauggcaug

SEQ ID NO: 1575779 - RNA, 14 nt, Human adenovirus E
agggacugaggggc

SEQ ID NO: 1575780 - RNA, 21 nt, Human adenovirus E
cacgagaaccgccuggggcag

SEQ ID NO: 1575781 - RNA, 21 nt, Human adenovirus E
guccagcuggcgggcggcgcc

SEQ ID NO: 1575782 - RNA, 16 nt, Human adenovirus E
ggacgauguggacagc

SEQ ID NO: 1575783 - RNA, 13 nt, Human adenovirus E
auauucuggagca

SEQ ID NO: 1575784 - RNA, 21 nt, Human adenovirus E
gauuccucgggaaaacucauc

SEQ ID NO: 1575785 - RNA, 21 nt, Human adenovirus E
agguacacauacaaagccuca

SEQ ID NO: 1575786 - RNA, 22 nt, Human adenovirus E
ggcccggaugcaggggcggcag

SEQ ID NO: 1575787 - RNA, 17 nt, Human adenovirus E
acgggcagcccuuuggu

SEQ ID NO: 1575788 - RNA, 16 nt, Human adenovirus E
cucaggcagaggagga

SEQ ID NO: 1575789 - RNA, 20 nt, Human adenovirus E
agcgacaucggcaccagcca

SEQ ID NO: 1575790 - RNA, 12 nt, Human adenovirus E
cggcagcggcgg

SEQ ID NO: 1575791 - RNA, 21 nt, Human adenovirus E
ccugcgcaaggucgaggagaa

SEQ ID NO: 1575792 - RNA, 21 nt, Human adenovirus E
aagauggagccauagcaacca

SEQ ID NO: 1575793 - RNA, 17 nt, Human adenovirus E
cgacgagaagcagcagc

SEQ ID NO: 1575794 - RNA, 15 nt, Human adenovirus E
agcucagccgcgccu

SEQ ID NO: 1575795 - RNA, 19 nt, Human adenovirus E
gcagggccuguggggcgug

SEQ ID NO: 1575796 - RNA, 13 nt, Human adenovirus E
gagccgcuggaag

SEQ ID NO: 1575797 - RNA, 15 nt, Human adenovirus E
gcggcugcucaggcu

SEQ ID NO: 1575798 - RNA, 19 nt, Human adenovirus E
ucgcacuccacgagccagg

SEQ ID NO: 1575799 - RNA, 22 nt, Human adenovirus E
augccagcugaguuuucagccc

SEQ ID NO: 1575800 - RNA, 22 nt, Human adenovirus E
cagcaggugcugccgaccgcgg

SEQ ID NO: 1575801 - RNA, 20 nt, Human adenovirus E
ucugcccccgccccagcagc

SEQ ID NO: 1575802 - RNA, 13 nt, Human adenovirus E
cgucccgggggug

SEQ ID NO: 1575803 - RNA, 12 nt, Human adenovirus E
aggaaggcagcg

SEQ ID NO: 1575804 - RNA, 18 nt, Human adenovirus E
gcuggcuccuggaccugg

SEQ ID NO: 1575805 - RNA, 19 nt, Human adenovirus E
ggucucgaucauugagcac

SEQ ID NO: 1575806 - RNA, 22 nt, Human adenovirus E
cagaggaggacagccugcaaga

SEQ ID NO: 1575807 - RNA, 22 nt, Human adenovirus E
uggaaggcgacaacgcgcggcu

SEQ ID NO: 1575808 - RNA, 21 nt, Human adenovirus E
ugcaacacagaaccaccaggu

SEQ ID NO: 1575809 - RNA, 15 nt, Human adenovirus E
ccuucgucucuucag

SEQ ID NO: 1575810 - RNA, 20 nt, Human adenovirus E
ugaacaguauccgcagcagc

SEQ ID NO: 1575811 - RNA, 16 nt, Human adenovirus E
cuucaaaaugaagauc

SEQ ID NO: 1575812 - RNA, 15 nt, Human adenovirus E
ucgccuugugcaugg

SEQ ID NO: 1575813 - RNA, 14 nt, Human adenovirus E
cccacccugcaugc

SEQ ID NO: 1575814 - RNA, 14 nt, Human adenovirus E
gauggugaagaugc

SEQ ID NO: 1575815 - RNA, 12 nt, Human adenovirus E
cagacggucccg

SEQ ID NO: 1575816 - RNA, 23 nt, Human adenovirus E
acccccgccaugcgcgcggcgcg

SEQ ID NO: 1575817 - RNA, 16 nt, Human adenovirus E
gaccgccgcggccgcc

SEQ ID NO: 1575818 - RNA, 20 nt, Human adenovirus E
aucucuucuacuuccuccuc

SEQ ID NO: 1575819 - RNA, 22 nt, Human adenovirus E
gaacucuguggaaacaauaaca

SEQ ID NO: 1575820 - RNA, 11 nt, Human adenovirus E
ucaugaugcag

SEQ ID NO: 1575821 - RNA, 21 nt, Human adenovirus E
ucaacaauagcacucaaccca

SEQ ID NO: 1575822 - RNA, 17 nt, Human adenovirus E
gugaccgagcuggucau

SEQ ID NO: 1575823 - RNA, 22 nt, Human adenovirus E
uggaauacaccacccucucccc

SEQ ID NO: 1575824 - RNA, 15 nt, Human adenovirus E
gcuccucccucagca

SEQ ID NO: 1575825 - RNA, 13 nt, Human adenovirus E
cagggccuguggg

SEQ ID NO: 1575826 - RNA, 20 nt, Human adenovirus E
gaaccccgcagaacagggca

SEQ ID NO: 1575827 - RNA, 16 nt, Human adenovirus E
ucugcaagcuccugca

SEQ ID NO: 1575828 - RNA, 21 nt, Human adenovirus E
gcuugcccucggccucggugc

SEQ ID NO: 1575829 - RNA, 21 nt, Human adenovirus E
cggcgucgugcacgcagcagc

SEQ ID NO: 1575830 - RNA, 17 nt, Human adenovirus E
cccucuucccagcucug

SEQ ID NO: 1575831 - RNA, 21 nt, Human adenovirus E
acccacgugagccgcgcccug

SEQ ID NO: 1575832 - RNA, 22 nt, Human adenovirus E
ugaugcaaaacuaacacuuugc

SEQ ID NO: 1575833 - RNA, 19 nt, Human adenovirus E
gcucucacagaucacggga

SEQ ID NO: 1575834 - RNA, 18 nt, Human adenovirus E
caggccaugcaacgcauc

SEQ ID NO: 1575835 - RNA, 17 nt, Human adenovirus E
accaggugcucaucaag

SEQ ID NO: 1575836 - RNA, 21 nt, Human adenovirus E
aggcguccgcccuugcgcgag

SEQ ID NO: 1575837 - RNA, 19 nt, Human adenovirus E
gccucugggugaaggccac

SEQ ID NO: 1575838 - RNA, 17 nt, Human adenovirus E
cgaggccaucggccagg

SEQ ID NO: 1575839 - RNA, 17 nt, Human adenovirus E
aaccuauggcagcaagg

SEQ ID NO: 1575840 - RNA, 19 nt, Human adenovirus E
acuaggacguccagagcgc

SEQ ID NO: 1575841 - RNA, 12 nt, Human adenovirus E
aaauccacagcg

SEQ ID NO: 1575842 - RNA, 17 nt, Human adenovirus E
ccacaauuacucacacc

SEQ ID NO: 1575843 - RNA, 19 nt, Human adenovirus E
ccggcgcgcuccacggugg

SEQ ID NO: 1575844 - RNA, 19 nt, Human adenovirus E
cccaacaaaugccagcuga

SEQ ID NO: 1575845 - RNA, 16 nt, Human adenovirus E
gcggaugcuggcgcgc

SEQ ID NO: 1575846 - RNA, 20 nt, Human adenovirus E
ggcgcgugcaguggcgcggg

SEQ ID NO: 1575847 - RNA, 13 nt, Human adenovirus E
gcagugcucaggu

SEQ ID NO: 1575848 - RNA, 19 nt, Human adenovirus E
ggcaauccucgcacagaac

SEQ ID NO: 1575849 - RNA, 20 nt, Human adenovirus E
cauacgugcccaagcagaac

SEQ ID NO: 1575850 - RNA, 15 nt, Human adenovirus E
cgucaagcugcugcu

SEQ ID NO: 1575851 - RNA, 17 nt, Human adenovirus E
agcggcgagggccugcu

SEQ ID NO: 1575852 - RNA, 14 nt, Human adenovirus E
cgcggcgacgaggc

SEQ ID NO: 1575853 - RNA, 13 nt, Human adenovirus E
cuccucccucagc

SEQ ID NO: 1575854 - RNA, 23 nt, Human adenovirus E
cgggggugcgcucccggcggcgc

SEQ ID NO: 1575855 - RNA, 21 nt, Human adenovirus E
gcuuaaaaccuauggcagcaa

SEQ ID NO: 1575856 - RNA, 14 nt, Human adenovirus E
gcagaccaaccugg

SEQ ID NO: 1575857 - RNA, 24 nt, Human adenovirus E
acgcgcucagcaccgaggaggagc

SEQ ID NO: 1575858 - RNA, 13 nt, Human adenovirus E
cggcgcggccagc

SEQ ID NO: 1575859 - RNA, 16 nt, Human adenovirus E
caaccaggccgugcag

SEQ ID NO: 1575860 - RNA, 15 nt, Human adenovirus E
gaggggcggaacagc

SEQ ID NO: 1575861 - RNA, 19 nt, Human adenovirus E
ccguccucuucccacuccc

SEQ ID NO: 1575862 - RNA, 21 nt, Human adenovirus E
uggcagcagugucuggaggag

SEQ ID NO: 1575863 - RNA, 17 nt, Human adenovirus E
caaccaggccgugcagc

SEQ ID NO: 1575864 - RNA, 14 nt, Human adenovirus E
caaucaggcagcac

SEQ ID NO: 1575865 - RNA, 19 nt, Human adenovirus E
cgaggacgagggcaugcaa

SEQ ID NO: 1575866 - RNA, 17 nt, Human adenovirus E
gcggugcguuccagcau

SEQ ID NO: 1575867 - RNA, 13 nt, Human adenovirus E
gcacccgcccccc

SEQ ID NO: 1575868 - RNA, 22 nt, Human adenovirus E
gggcagacggucgaugaagcgc

SEQ ID NO: 1575869 - RNA, 19 nt, Human adenovirus E
ccuuguacgauaccacccg

SEQ ID NO: 1575870 - RNA, 23 nt, Human adenovirus E
agcccgcgcccgcccagucgcag

SEQ ID NO: 1575871 - RNA, 22 nt, Human adenovirus E
aucccaacaaaugccagcugag

SEQ ID NO: 1575872 - RNA, 17 nt, Human adenovirus E
cuggaucuuugugcgca

SEQ ID NO: 1575873 - RNA, 16 nt, Human adenovirus E
caagaagaggcagcag

SEQ ID NO: 1575874 - RNA, 19 nt, Human adenovirus E
ucaccgccccgcucagggu

SEQ ID NO: 1575875 - RNA, 13 nt, Human adenovirus E
auggaggugcaga

SEQ ID NO: 1575876 - RNA, 20 nt, Human adenovirus E
cucgcgaggcauacgugccc

SEQ ID NO: 1575877 - RNA, 18 nt, Human adenovirus E
acucagguguccagcugg

SEQ ID NO: 1575878 - RNA, 14 nt, Human adenovirus E
aucugcaccucaca

SEQ ID NO: 1575879 - RNA, 18 nt, Human adenovirus E
gaacacgcugcccacgua

SEQ ID NO: 1575880 - RNA, 15 nt, Human adenovirus E
gcaugcgaguuggag

SEQ ID NO: 1575881 - RNA, 23 nt, Human adenovirus E
gcaagaucuccaacguggagcug

SEQ ID NO: 1575882 - RNA, 13 nt, Human adenovirus E
accucgcccugcu

SEQ ID NO: 1575883 - RNA, 20 nt, Human adenovirus E
  misc_feature (8)..(8): n is a, c, g or u
cccaagcnugcaccaacccu

SEQ ID NO: 1575884 - RNA, 21 nt, Human adenovirus E
gcauguugaucaucgccuugu

SEQ ID NO: 1575885 - RNA, 18 nt, Human adenovirus E
gcauucuuaagcacaccc

SEQ ID NO: 1575886 - RNA, 16 nt, Human adenovirus E
gcaauugaccaugagu

SEQ ID NO: 1575887 - RNA, 16 nt, Human adenovirus E
cugagcgaccaggagc

SEQ ID NO: 1575888 - RNA, 21 nt, Human adenovirus E
cgcaagaggcagcccuuccag

SEQ ID NO: 1575889 - RNA, 21 nt, Human adenovirus E
ggucgcugagcccgugcugcu

SEQ ID NO: 1575890 - RNA, 22 nt, Human adenovirus E
uaugccaucuuccagcagaguc

SEQ ID NO: 1575891 - RNA, 23 nt, Human adenovirus E
auguuuucugccaacaccacuuc

SEQ ID NO: 1575892 - RNA, 14 nt, Human adenovirus E
ccacacacacagau

SEQ ID NO: 1575893 - RNA, 17 nt, Human adenovirus E
gcggaucucgcucaggu

SEQ ID NO: 1575894 - RNA, 14 nt, Human adenovirus E
gcuggcggugcuca

SEQ ID NO: 1575895 - RNA, 18 nt, Human adenovirus E
acauccccgcgcuccugg

SEQ ID NO: 1575896 - RNA, 20 nt, Human adenovirus E
acuuccucuucuuccuccuc

SEQ ID NO: 1575897 - RNA, 14 nt, Human adenovirus E
ggggcgugcaggcc

SEQ ID NO: 1575898 - RNA, 13 nt, Human adenovirus E
cacaccaccacag

SEQ ID NO: 1575899 - RNA, 17 nt, Human adenovirus E
caggcgccagcgccggc

SEQ ID NO: 1575900 - RNA, 22 nt, Human adenovirus E
ccauagcuuaccgagcagcagc

SEQ ID NO: 1575901 - RNA, 15 nt, Human adenovirus E
gagucgcggaugaag

SEQ ID NO: 1575902 - RNA, 13 nt, Human adenovirus E
uguaccccgguuc

SEQ ID NO: 1575903 - RNA, 17 nt, Human adenovirus E
ccugugggaccugcugg

SEQ ID NO: 1575904 - RNA, 13 nt, Human adenovirus E
gaagaggcagcag

SEQ ID NO: 1575905 - RNA, 22 nt, Human adenovirus E
caggacccuacguagaagaggu

SEQ ID NO: 1575906 - RNA, 14 nt, Human adenovirus E
cggcgcugcagagc

SEQ ID NO: 1575907 - RNA, 20 nt, Human adenovirus E
ggagggcgaguaccuggaag

SEQ ID NO: 1575908 - RNA, 19 nt, Human adenovirus E
uagcucggcuucgacaccu

SEQ ID NO: 1575909 - RNA, 12 nt, Human adenovirus E
cuaaagauggaa

SEQ ID NO: 1575910 - RNA, 15 nt, Human adenovirus E
cagagccccuuccgc

SEQ ID NO: 1575911 - RNA, 17 nt, Human adenovirus E
ucgagcugacccauuuc

SEQ ID NO: 1575912 - RNA, 22 nt, Human adenovirus E
ugggacagcacucaggcagagg

SEQ ID NO: 1575913 - RNA, 14 nt, Human adenovirus E
gauccacggccagg

SEQ ID NO: 1575914 - RNA, 21 nt, Human adenovirus E
cagagguugccagcucgucug

SEQ ID NO: 1575915 - RNA, 17 nt, Human adenovirus E
cacauacaaagccucag

SEQ ID NO: 1575916 - RNA, 12 nt, Human adenovirus E
gcuccagcucca

SEQ ID NO: 1575917 - RNA, 21 nt, Human adenovirus E
cccagcagcaacuuccagcca

SEQ ID NO: 1575918 - RNA, 21 nt, Human adenovirus E
acgucuacaaggcccugggca

SEQ ID NO: 1575919 - RNA, 18 nt, Human adenovirus E
ucaggccccgcagcaguc

SEQ ID NO: 1575920 - RNA, 22 nt, Human adenovirus E
cagcccgauggcaaucggugcg

SEQ ID NO: 1575921 - RNA, 23 nt, Human adenovirus E
cucccggaggaggggggccaccu

SEQ ID NO: 1575922 - RNA, 22 nt, Human adenovirus E
cgcuagcagccgcggccagggg

SEQ ID NO: 1575923 - RNA, 16 nt, Human adenovirus E
cgcagggccaggcgca

SEQ ID NO: 1575924 - RNA, 22 nt, Human adenovirus E
caccuggaccacugccgccgcu

SEQ ID NO: 1575925 - RNA, 15 nt, Human adenovirus E
ccacuaugcagcuca

SEQ ID NO: 1575926 - RNA, 18 nt, Human adenovirus E
gcagugucuggaggagca

SEQ ID NO: 1575927 - RNA, 19 nt, Human adenovirus E
acgccugcugggccuuggc

SEQ ID NO: 1575928 - RNA, 14 nt, Human adenovirus E
ucgacucccaccug

SEQ ID NO: 1575929 - RNA, 17 nt, Human adenovirus E
auagcacucaacccacc

SEQ ID NO: 1575930 - RNA, 18 nt, Human adenovirus E
gaacaccaucagggccgg

SEQ ID NO: 1575931 - RNA, 16 nt, Human adenovirus E
acagcugaggauuguc

SEQ ID NO: 1575932 - RNA, 17 nt, Human adenovirus E
acacaccaccacagcaa

SEQ ID NO: 1575933 - RNA, 15 nt, Human adenovirus E
ccgcucucugcucaa

SEQ ID NO: 1575934 - RNA, 17 nt, Human adenovirus E
ucgcaucaggccccgca

SEQ ID NO: 1575935 - RNA, 14 nt, Human adenovirus E
gaugaccugggcgg

SEQ ID NO: 1575936 - RNA, 18 nt, Human adenovirus E
agggcguuggagaggagc

SEQ ID NO: 1575937 - RNA, 13 nt, Human adenovirus E
cggcgacuaccuc

SEQ ID NO: 1575938 - RNA, 12 nt, Human adenovirus E
aagcaacauaag

SEQ ID NO: 1575939 - RNA, 19 nt, Human adenovirus E
ccaccgcgaguccaaccug

SEQ ID NO: 1575940 - RNA, 22 nt, Human adenovirus E
gccgaaaaagaaaaacagccau

SEQ ID NO: 1575941 - RNA, 21 nt, Human adenovirus E
cguuacugucguugucggauc

SEQ ID NO: 1575942 - RNA, 15 nt, Human adenovirus E
cccgagggccgcugg

SEQ ID NO: 1575943 - RNA, 13 nt, Human adenovirus E
caaacgcccaaaa

SEQ ID NO: 1575944 - RNA, 20 nt, Human adenovirus E
gcuguggagccacugcuacc

SEQ ID NO: 1575945 - RNA, 21 nt, Human adenovirus E
guauccgcagcagcgagcugg

SEQ ID NO: 1575946 - RNA, 17 nt, Human adenovirus E
aacagguggguaaaucg

SEQ ID NO: 1575947 - RNA, 14 nt, Human adenovirus E
cccugggccugaug

SEQ ID NO: 1575948 - RNA, 11 nt, Human adenovirus E
guguugaaauu

SEQ ID NO: 1575949 - RNA, 15 nt, Human adenovirus E
uucuuccuccuccac

SEQ ID NO: 1575950 - RNA, 12 nt, Human adenovirus E
ucaaaaucucug

SEQ ID NO: 1575951 - RNA, 15 nt, Human adenovirus E
gaaaucgcaguuggg

SEQ ID NO: 1575952 - RNA, 21 nt, Human adenovirus E
guggucagcgacgagcagcug

SEQ ID NO: 1575953 - RNA, 14 nt, Human adenovirus E
agcugaccaaccug

SEQ ID NO: 1575954 - RNA, 13 nt, Human adenovirus E
agccgccuggacc

SEQ ID NO: 1575955 - RNA, 12 nt, Human adenovirus E
acgugcagacca

SEQ ID NO: 1575956 - RNA, 18 nt, Human adenovirus E
ggaggugugcgugagggc

SEQ ID NO: 1575957 - RNA, 12 nt, Human adenovirus E
cgcugcacggga

SEQ ID NO: 1575958 - RNA, 19 nt, Human adenovirus E
ggcagguccagaccucggc

SEQ ID NO: 1575959 - RNA, 20 nt, Human adenovirus E
accaccugcaucugcugcug

SEQ ID NO: 1575960 - RNA, 21 nt, Human adenovirus E
ccagcccgccaacgugccccg

SEQ ID NO: 1575961 - RNA, 23 nt, Human adenovirus E
gccagcugaguuuucagcccgau

SEQ ID NO: 1575962 - RNA, 13 nt, Human adenovirus E
aacaggaagaacc

SEQ ID NO: 1575963 - RNA, 20 nt, Human adenovirus E
ggaacgagaccgagcuccag

SEQ ID NO: 1575964 - RNA, 17 nt, Human adenovirus E
ggccguggcccagcgcg

SEQ ID NO: 1575965 - RNA, 20 nt, Human adenovirus E
aggacccggagacgcgcggc

SEQ ID NO: 1575966 - RNA, 16 nt, Human adenovirus E
uacaacgcgcugcugg

SEQ ID NO: 1575967 - RNA, 15 nt, Human adenovirus E
cagcgcgcgcugccc

SEQ ID NO: 1575968 - RNA, 17 nt, Human adenovirus E
gcagcguccgcgucagg

SEQ ID NO: 1575969 - RNA, 16 nt, Human adenovirus E
cacugccgccgcuucc

SEQ ID NO: 1575970 - RNA, 12 nt, Human adenovirus E
caggcagcaccg

SEQ ID NO: 1575971 - RNA, 13 nt, Human adenovirus E
gcaagggcccagc

SEQ ID NO: 1575972 - RNA, 14 nt, Human adenovirus E
ugcgccaggccugc

SEQ ID NO: 1575973 - RNA, 17 nt, Human adenovirus E
aaacaagaagcugaaag

SEQ ID NO: 1575974 - RNA, 17 nt, Human adenovirus E
accacaaaaacuacacc

SEQ ID NO: 1575975 - RNA, 15 nt, Human adenovirus E
agauggcaccucucg

SEQ ID NO: 1575976 - RNA, 16 nt, Human adenovirus E
cagcagccccaggcca

SEQ ID NO: 1575977 - RNA, 16 nt, Human adenovirus E
ggaggagacugauggc

SEQ ID NO: 1575978 - RNA, 19 nt, Human adenovirus E
ggccacccccagcgccgcg

SEQ ID NO: 1575979 - RNA, 23 nt, Human adenovirus E
gcagcguguucuccccccgaccg

SEQ ID NO: 1575980 - RNA, 12 nt, Human adenovirus E
auaccagcagcc

SEQ ID NO: 1575981 - RNA, 19 nt, Human adenovirus E
gccccccugcucccagagc

SEQ ID NO: 1575982 - RNA, 15 nt, Human adenovirus E
ggcagcggggacaga

SEQ ID NO: 1575983 - RNA, 23 nt, Human adenovirus E
cuagaacagucagcgcucaccgc

SEQ ID NO: 1575984 - RNA, 13 nt, Human adenovirus E
cacgagccggggc

SEQ ID NO: 1575985 - RNA, 20 nt, Human adenovirus E
guucauuuuugcuugcugcu

SEQ ID NO: 1575986 - RNA, 18 nt, Human adenovirus E
ugagcggcccugccaacc

SEQ ID NO: 1575987 - RNA, 20 nt, Human adenovirus E
gccagagcaggaagcagaga

SEQ ID NO: 1575988 - RNA, 13 nt, Human adenovirus E
cgggcggcagggg

SEQ ID NO: 1575989 - RNA, 22 nt, Human adenovirus E
caggcacggguucgugcgccag

SEQ ID NO: 1575990 - RNA, 13 nt, Human adenovirus E
gacucccucagca

SEQ ID NO: 1575991 - RNA, 14 nt, Human adenovirus E
caagcccagcacca

SEQ ID NO: 1575992 - RNA, 23 nt, Human adenovirus E
gugggcguaggagucuugcagcu

SEQ ID NO: 1575993 - RNA, 13 nt, Human adenovirus E
cgcggcggugccc

SEQ ID NO: 1575994 - RNA, 20 nt, Human adenovirus E
cgucuaccccuacgaugcag

SEQ ID NO: 1575995 - RNA, 21 nt, Human adenovirus E
ccgccuggggcagaacgugcu

SEQ ID NO: 1575996 - RNA, 21 nt, Human adenovirus E
ucuccaccauuaaauauacug

SEQ ID NO: 1575997 - RNA, 17 nt, Human adenovirus E
gguggaauuugagcugc

SEQ ID NO: 1575998 - RNA, 19 nt, Human adenovirus E
uggcaccagacgaugggcg

SEQ ID NO: 1575999 - RNA, 21 nt, Human adenovirus E
gcuugccguccuucucgguga

SEQ ID NO: 1576000 - RNA, 21 nt, Human adenovirus E
cacccgguuguaccuggugga

SEQ ID NO: 1576001 - RNA, 17 nt, Human adenovirus E
ugcaucucuucagcacu

SEQ ID NO: 1576002 - RNA, 14 nt, Human adenovirus E
acguggagcugacc

SEQ ID NO: 1576003 - RNA, 13 nt, Human adenovirus E
gcccccgcuggag

SEQ ID NO: 1576004 - RNA, 12 nt, Human adenovirus E
auugacaagcgg

SEQ ID NO: 1576005 - RNA, 22 nt, Human adenovirus E
ccaccugggcgagguugagcuc

SEQ ID NO: 1576006 - RNA, 14 nt, Human adenovirus E
uagcuaccgccucu

SEQ ID NO: 1576007 - RNA, 20 nt, Human adenovirus E
aaagcgggaggguucucuaa

SEQ ID NO: 1576008 - RNA, 21 nt, Human adenovirus E
ggcgugccccagggcauggga

SEQ ID NO: 1576009 - RNA, 13 nt, Human adenovirus E
ucucuccagcacc

SEQ ID NO: 1576010 - RNA, 17 nt, Human adenovirus E
ggugauccuccaccaga

SEQ ID NO: 1576011 - RNA, 19 nt, Human adenovirus E
ccgcgcccugggccaggac

SEQ ID NO: 1576012 - RNA, 14 nt, Human adenovirus E
aucauugagcaccc

SEQ ID NO: 1576013 - RNA, 16 nt, Human adenovirus E
gccccgccgcccagcc

SEQ ID NO: 1576014 - RNA, 13 nt, Human adenovirus E
gaaagccuggugg

SEQ ID NO: 1576015 - RNA, 14 nt, Human adenovirus E
ccgccgcggccgcc

SEQ ID NO: 1576016 - RNA, 18 nt, Human adenovirus E
ucggacuucgugccgcug

SEQ ID NO: 1576017 - RNA, 21 nt, Human adenovirus E
cuuccccgagaaccagauccu

SEQ ID NO: 1576018 - RNA, 23 nt, Human adenovirus E
ucuggaggaagacgaggaggagg

SEQ ID NO: 1576019 - RNA, 13 nt, Human adenovirus E
ggaggaugcagca

SEQ ID NO: 1576020 - RNA, 22 nt, Human adenovirus E
cagcugaagcaacugcagccgu

SEQ ID NO: 1576021 - RNA, 14 nt, Human adenovirus E
agcaggggcgcagg

SEQ ID NO: 1576022 - RNA, 14 nt, Human adenovirus E
augcaggggcggca

SEQ ID NO: 1576023 - RNA, 23 nt, Human adenovirus E
caccgugcggugagcgccagcag

SEQ ID NO: 1576024 - RNA, 15 nt, Human adenovirus E
ggggagaugagcugg

SEQ ID NO: 1576025 - RNA, 15 nt, Human adenovirus E
guccagaaaaagcca

SEQ ID NO: 1576026 - RNA, 15 nt, Human adenovirus E
uggacccaggccaug

SEQ ID NO: 1576027 - RNA, 16 nt, Human adenovirus E
aggccggagcugucca

SEQ ID NO: 1576028 - RNA, 21 nt, Human adenovirus E
cgagcaguuauuuuuccucca

SEQ ID NO: 1576029 - RNA, 17 nt, Human adenovirus E
ccgaccgggugcuaacg

SEQ ID NO: 1576030 - RNA, 18 nt, Human adenovirus E
ggcaccucucgcccccgc

SEQ ID NO: 1576031 - RNA, 19 nt, Human adenovirus E
agcccacggccgccagcuc

SEQ ID NO: 1576032 - RNA, 18 nt, Human adenovirus E
cucacagcucaacagcug

SEQ ID NO: 1576033 - RNA, 14 nt, Human adenovirus E
uccuccacccuccc

SEQ ID NO: 1576034 - RNA, 14 nt, Human adenovirus E
acaaaaaugaacau

SEQ ID NO: 1576035 - RNA, 20 nt, Human adenovirus E
gaaagccccgcaaaaucaag

SEQ ID NO: 1576036 - RNA, 15 nt, Human adenovirus E
ccgagccacagcgac

SEQ ID NO: 1576037 - RNA, 17 nt, Human adenovirus E
uccaucauccccacgcc

SEQ ID NO: 1576038 - RNA, 23 nt, Human adenovirus E
gcucaaccccggcuucccccagg

SEQ ID NO: 1576039 - RNA, 17 nt, Human adenovirus E
gaucccgccccaguacg

SEQ ID NO: 1576040 - RNA, 19 nt, Human adenovirus E
ugcggcgguacaccucgcc

SEQ ID NO: 1576041 - RNA, 15 nt, Human adenovirus E
guuucaauguggauc

SEQ ID NO: 1576042 - RNA, 20 nt, Human adenovirus E
gcacagggacgauccccggg

SEQ ID NO: 1576043 - RNA, 14 nt, Human adenovirus E
aauuuuuagccaua

SEQ ID NO: 1576044 - RNA, 13 nt, Human adenovirus E
gcccuggccaccu

SEQ ID NO: 1576045 - RNA, 17 nt, Human adenovirus E
gaaggagaacaucgugg

SEQ ID NO: 1576046 - RNA, 21 nt, Human adenovirus E
ucaaccccggcuucccccagg

SEQ ID NO: 1576047 - RNA, 24 nt, Human adenovirus E
gcagccaggguccgguccuuccag

SEQ ID NO: 1576048 - RNA, 14 nt, Human adenovirus E
gucugcagcgggcc

SEQ ID NO: 1576049 - RNA, 14 nt, Human adenovirus E
uguuccugaugcag

SEQ ID NO: 1576050 - RNA, 20 nt, Human adenovirus E
ccagcgaaggguaugcuuuc

SEQ ID NO: 1576051 - RNA, 20 nt, Human adenovirus E
ucucagccaaucagcgcccc

SEQ ID NO: 1576052 - RNA, 18 nt, Human adenovirus E
agccgccgggccuuggag

SEQ ID NO: 1576053 - RNA, 14 nt, Human adenovirus E
ggacccgugaguuu

SEQ ID NO: 1576054 - RNA, 15 nt, Human adenovirus E
ucagacccacugcug

SEQ ID NO: 1576055 - RNA, 18 nt, Human adenovirus E
agccauagcaaccaacau

SEQ ID NO: 1576056 - RNA, 13 nt, Human adenovirus E
gcccgccaccugc

SEQ ID NO: 1576057 - RNA, 13 nt, Human adenovirus E
gaguaccuggaag

SEQ ID NO: 1576058 - RNA, 12 nt, Human adenovirus E
ugagcucuucgc

SEQ ID NO: 1576059 - RNA, 18 nt, Human adenovirus E
gggcccggaugcaggggc

SEQ ID NO: 1576060 - RNA, 24 nt, Human adenovirus E
gcugcccgacaugaugcaagaccc

SEQ ID NO: 1576061 - RNA, 16 nt, Human adenovirus E
cagaucccgccugggg

SEQ ID NO: 1576062 - RNA, 17 nt, Human adenovirus E
ggauggcuggcagagcc

SEQ ID NO: 1576063 - RNA, 17 nt, Human adenovirus E
acagcagcagagguugc

SEQ ID NO: 1576064 - RNA, 20 nt, Human adenovirus E
aaucccauccgcccaaggcc

SEQ ID NO: 1576065 - RNA, 23 nt, Human adenovirus E
gccccccggcggcgcgugcagug

SEQ ID NO: 1576066 - RNA, 15 nt, Human adenovirus E
gcaaccaccccugcc

SEQ ID NO: 1576067 - RNA, 13 nt, Human adenovirus E
cucuugcaggaca

SEQ ID NO: 1576068 - RNA, 12 nt, Human adenovirus E
cucggagcuggc

SEQ ID NO: 1576069 - RNA, 15 nt, Human adenovirus E
acccggcucugaacc

SEQ ID NO: 1576070 - RNA, 21 nt, Human adenovirus E
agcccacggccgccagcuccu

SEQ ID NO: 1576071 - RNA, 17 nt, Human adenovirus E
cagccagagcaggaagc

SEQ ID NO: 1576072 - RNA, 19 nt, Human adenovirus E
ggugcccgaggccgccagu

SEQ ID NO: 1576073 - RNA, 14 nt, Human adenovirus E
aucaccagcuggcc

SEQ ID NO: 1576074 - RNA, 12 nt, Human adenovirus E
cucucgccgccg

SEQ ID NO: 1576075 - RNA, 16 nt, Human adenovirus E
cgggacccugccgcug

SEQ ID NO: 1576076 - RNA, 21 nt, Human adenovirus E
cgaguugcaagggcccagcga

SEQ ID NO: 1576077 - RNA, 22 nt, Human adenovirus E
cccagaaaccggugacacacuc

SEQ ID NO: 1576078 - RNA, 14 nt, Human adenovirus E
gcugcugcugcugg

SEQ ID NO: 1576079 - RNA, 16 nt, Human adenovirus E
agcugcccgaggagca

SEQ ID NO: 1576080 - RNA, 12 nt, Human adenovirus E
gauccgcaccgg

SEQ ID NO: 1576081 - RNA, 20 nt, Human adenovirus E
cagggccauguucagggcgg

SEQ ID NO: 1576082 - RNA, 14 nt, Human adenovirus E
ccaagcgccagccc

SEQ ID NO: 1576083 - RNA, 21 nt, Human adenovirus E
ggaagcagagaaugagcagag

SEQ ID NO: 1576084 - RNA, 18 nt, Human adenovirus E
ggacaggguaucgcaauc

SEQ ID NO: 1576085 - RNA, 21 nt, Human adenovirus E
gggccauguucagggcggcca

SEQ ID NO: 1576086 - RNA, 23 nt, Human adenovirus E
ccacgcggggcgggagcugcggc

SEQ ID NO: 1576087 - RNA, 16 nt, Human adenovirus E
aucuucucuucucuuu

SEQ ID NO: 1576088 - RNA, 21 nt, Human adenovirus E
cugcccguucucgcucgccac

SEQ ID NO: 1576089 - RNA, 13 nt, Human adenovirus E
ggccaccucgccg

SEQ ID NO: 1576090 - RNA, 20 nt, Human adenovirus E
acgccugcugggccuuggcu

SEQ ID NO: 1576091 - RNA, 15 nt, Human adenovirus E
cuggaggagcagaac

SEQ ID NO: 1576092 - RNA, 21 nt, Human adenovirus E
ggccauguucagggcggccag

SEQ ID NO: 1576093 - RNA, 18 nt, Human adenovirus E
ccagcagcaacuuccagc

SEQ ID NO: 1576094 - RNA, 14 nt, Human adenovirus E
caguuacaccugcc

SEQ ID NO: 1576095 - RNA, 16 nt, Human adenovirus E
ccgggugauccuccac

SEQ ID NO: 1576096 - RNA, 20 nt, Human adenovirus E
cgccgcaccgcucccuggcc

SEQ ID NO: 1576097 - RNA, 18 nt, Human adenovirus E
cuuucauauccucuccga

SEQ ID NO: 1576098 - RNA, 12 nt, Human adenovirus E
cgccucaggcug

SEQ ID NO: 1576099 - RNA, 13 nt, Human adenovirus E
acuucaaaaugaa

SEQ ID NO: 1576100 - RNA, 19 nt, Human adenovirus E
caucaugguggucaggguc

SEQ ID NO: 1576101 - RNA, 15 nt, Human adenovirus E
uacaccacccucucc

SEQ ID NO: 1576102 - RNA, 14 nt, Human adenovirus E
cuuccagcaaagcc

SEQ ID NO: 1576103 - RNA, 15 nt, Human adenovirus E
gcaucuuggccugga

SEQ ID NO: 1576104 - RNA, 12 nt, Human adenovirus E
ggacgugcagcc

SEQ ID NO: 1576105 - RNA, 13 nt, Human adenovirus E
acgcacccgggcu

SEQ ID NO: 1576106 - RNA, 18 nt, Human adenovirus E
gcgcaagagucagagaaa

SEQ ID NO: 1576107 - RNA, 18 nt, Human adenovirus E
caccugcgagcccaaccc

SEQ ID NO: 1576108 - RNA, 13 nt, Human adenovirus E
ugcagcaggcgau

SEQ ID NO: 1576109 - RNA, 18 nt, Human adenovirus E
cucuucgggggcagaggc

SEQ ID NO: 1576110 - RNA, 13 nt, Human adenovirus E
cggccgcgcaccu

SEQ ID NO: 1576111 - RNA, 23 nt, Human adenovirus E
acgccuuacauguggagcuacca

SEQ ID NO: 1576112 - RNA, 19 nt, Human adenovirus E
ccagcagaaaaccagcagc

SEQ ID NO: 1576113 - RNA, 20 nt, Human adenovirus E
cuggcugacguccugcagga

SEQ ID NO: 1576114 - RNA, 15 nt, Human adenovirus E
ucgacaccuggacca

SEQ ID NO: 1576115 - RNA, 19 nt, Human adenovirus E
ccgcggagcacgaggagga

SEQ ID NO: 1576116 - RNA, 23 nt, Human adenovirus E
ggcaacauccccgcgcuccugga

SEQ ID NO: 1576117 - RNA, 16 nt, Human adenovirus E
ggacgcucgcgaggca

SEQ ID NO: 1576118 - RNA, 20 nt, Human adenovirus E
gcagccccccugcucccaga

SEQ ID NO: 1576119 - RNA, 15 nt, Human adenovirus E
cgacuaccuccaccu

SEQ ID NO: 1576120 - RNA, 14 nt, Human adenovirus E
gcagcacuggaaca

SEQ ID NO: 1576121 - RNA, 15 nt, Human adenovirus E
gcacgaggaggagcu

SEQ ID NO: 1576122 - RNA, 17 nt, Human adenovirus E
ucaccuccacagccccu

SEQ ID NO: 1576123 - RNA, 13 nt, Human adenovirus E
ccgcucucugcuc

SEQ ID NO: 1576124 - RNA, 16 nt, Human adenovirus E
ccuggaagccacccug

SEQ ID NO: 1576125 - RNA, 17 nt, Human adenovirus E
cgagaagcagcagcagc

SEQ ID NO: 1576126 - RNA, 11 nt, Human adenovirus E
uugcaagcgcc

SEQ ID NO: 1576127 - RNA, 16 nt, Human adenovirus E
ucacaugaccgccuuc

SEQ ID NO: 1576128 - RNA, 17 nt, Human adenovirus E
aggcagcgaccgacgcc

SEQ ID NO: 1576129 - RNA, 13 nt, Human adenovirus E
gaaccccaccagc

SEQ ID NO: 1576130 - RNA, 13 nt, Human adenovirus E
caagcccagcacc

SEQ ID NO: 1576131 - RNA, 13 nt, Human adenovirus E
uucuuccuccucc

SEQ ID NO: 1576132 - RNA, 14 nt, Human adenovirus E
caucgaccugauga

SEQ ID NO: 1576133 - RNA, 22 nt, Human adenovirus E
ccgucgcgaccuuucugaaucu

SEQ ID NO: 1576134 - RNA, 17 nt, Human adenovirus E
gcuccauugcagggccu

SEQ ID NO: 1576135 - RNA, 19 nt, Human adenovirus E
cgucucgagauccacggga

SEQ ID NO: 1576136 - RNA, 21 nt, Human adenovirus E
gcgcaucuccagguggccggg

SEQ ID NO: 1576137 - RNA, 15 nt, Human adenovirus E
gaaggugcggggguc

SEQ ID NO: 1576138 - RNA, 13 nt, Human adenovirus E
gccccaggccaac

SEQ ID NO: 1576139 - RNA, 14 nt, Human adenovirus E
cgagauccacggga

SEQ ID NO: 1576140 - RNA, 12 nt, Human adenovirus E
cagccgccgcca

SEQ ID NO: 1576141 - RNA, 16 nt, Human adenovirus E
cuaccucgacccccag

SEQ ID NO: 1576142 - RNA, 14 nt, Human adenovirus E
ggggcaguccgacc

SEQ ID NO: 1576143 - RNA, 14 nt, Human adenovirus E
ccacggcggcggca

SEQ ID NO: 1576144 - RNA, 13 nt, Human adenovirus E
gaggcccuggcca

SEQ ID NO: 1576145 - RNA, 17 nt, Human adenovirus E
auucuggagcaggcggc

SEQ ID NO: 1576146 - RNA, 20 nt, Human adenovirus E
cgacaaaaaucagacccacu

SEQ ID NO: 1576147 - RNA, 18 nt, Human adenovirus E
cacgagaaccgccugggg

SEQ ID NO: 1576148 - RNA, 17 nt, Human adenovirus E
cccgcguucugcgcgcg

SEQ ID NO: 1576149 - RNA, 15 nt, Human adenovirus E
ggugcgggggucccc

SEQ ID NO: 1576150 - RNA, 19 nt, Human adenovirus E
acugccgcugcaaccucug

SEQ ID NO: 1576151 - RNA, 17 nt, Human adenovirus E
cagcagugucuggagga

SEQ ID NO: 1576152 - RNA, 14 nt, Human adenovirus E
gcugcggcgcggcc

SEQ ID NO: 1576153 - RNA, 20 nt, Human adenovirus E
guauacaugaauggagaugu

SEQ ID NO: 1576154 - RNA, 22 nt, Human adenovirus E
  misc_feature (6)..(6): n is a, c, g or u
cgggcnugggcgugcagaccgu

SEQ ID NO: 1576155 - RNA, 14 nt, Human adenovirus E
uguggacagcagcg

SEQ ID NO: 1576156 - RNA, 17 nt, Human adenovirus E
cccaauuuaaaagcuua

SEQ ID NO: 1576157 - RNA, 23 nt, Human adenovirus E
aucgcgcgcgaggaggugacccu

SEQ ID NO: 1576158 - RNA, 23 nt, Human adenovirus E
gggcccggaugcaggggcggcag

SEQ ID NO: 1576159 - RNA, 23 nt, Human adenovirus E
gacgcccuuuucaaccugggucc

SEQ ID NO: 1576160 - RNA, 18 nt, Human adenovirus E
cugcacuggcagcccagc

SEQ ID NO: 1576161 - RNA, 23 nt, Human adenovirus E
agguccagcgaaggguaugcuuu

SEQ ID NO: 1576162 - RNA, 15 nt, Human adenovirus E
ggaugcagcagcuga

SEQ ID NO: 1576163 - RNA, 18 nt, Human adenovirus E
gccugcugggccuuggcu

SEQ ID NO: 1576164 - RNA, 16 nt, Human adenovirus E
ucaugguauuguuauu

SEQ ID NO: 1576165 - RNA, 23 nt, Human adenovirus E
uggggccguagaugaccccgaug

SEQ ID NO: 1576166 - RNA, 18 nt, Human adenovirus E
gaacugguugacggccuu

SEQ ID NO: 1576167 - RNA, 12 nt, Human adenovirus E
cuugggcggcug

SEQ ID NO: 1576168 - RNA, 15 nt, Human adenovirus E
caguuuuuccaacaa

SEQ ID NO: 1576169 - RNA, 21 nt, Human adenovirus E
agcgcgcgucgcccaucuccg

SEQ ID NO: 1576170 - RNA, 23 nt, Human adenovirus E
uaaccgccccgccgcccagcccc

SEQ ID NO: 1576171 - RNA, 16 nt, Human adenovirus E
cugaaagagcucugca

SEQ ID NO: 1576172 - RNA, 16 nt, Human adenovirus E
caggagcacagggacg

SEQ ID NO: 1576173 - RNA, 21 nt, Human adenovirus E
gaccgccgcggccgccgugag

SEQ ID NO: 1576174 - RNA, 16 nt, Human adenovirus E
gucgggggggucggca

SEQ ID NO: 1576175 - RNA, 17 nt, Human adenovirus E
auggaggaagacuggga

SEQ ID NO: 1576176 - RNA, 16 nt, Human adenovirus E
cucgacucccaccugc

SEQ ID NO: 1576177 - RNA, 16 nt, Human adenovirus E
gaagcaguaguacaga

SEQ ID NO: 1576178 - RNA, 14 nt, Human adenovirus E
cacgggguugcagc

SEQ ID NO: 1576179 - RNA, 22 nt, Human adenovirus E
ucuaugccaucuuccagcagag

SEQ ID NO: 1576180 - RNA, 13 nt, Human adenovirus E
gaugcagcaggcg

SEQ ID NO: 1576181 - RNA, 14 nt, Human adenovirus E
cggcgaugcagccc

SEQ ID NO: 1576182 - RNA, 18 nt, Human adenovirus E
ucguucucuccagcacca

SEQ ID NO: 1576183 - RNA, 21 nt, Human adenovirus E
uggaagagggcgaggggcugg

SEQ ID NO: 1576184 - RNA, 13 nt, Human adenovirus E
cugaaacucaccc

SEQ ID NO: 1576185 - RNA, 11 nt, Human adenovirus E
ccgcaccugcc

SEQ ID NO: 1576186 - RNA, 14 nt, Human adenovirus E
cugcccgacggcca

SEQ ID NO: 1576187 - RNA, 17 nt, Human adenovirus E
ugaaccugacacaccac

SEQ ID NO: 1576188 - RNA, 16 nt, Human adenovirus E
agggcgaguaccugga

SEQ ID NO: 1576189 - RNA, 17 nt, Human adenovirus E
aggccacgugggacggg

SEQ ID NO: 1576190 - RNA, 21 nt, Human adenovirus E
aacgcuccggaauccugcccg

SEQ ID NO: 1576191 - RNA, 21 nt, Human adenovirus E
ucgagcuugguggcgaaggag

SEQ ID NO: 1576192 - RNA, 22 nt, Human adenovirus E
uggaccacggcaaccccacgcc

SEQ ID NO: 1576193 - RNA, 16 nt, Human adenovirus E
ccggcgcgacccucgu

SEQ ID NO: 1576194 - RNA, 17 nt, Human adenovirus E
cugaaaacaccaccugg

SEQ ID NO: 1576195 - RNA, 23 nt, Human adenovirus E
gacgauccccgggcgucgcaggg

SEQ ID NO: 1576196 - RNA, 21 nt, Human adenovirus E
gcggccacggcggcggcagcg

SEQ ID NO: 1576197 - RNA, 15 nt, Human adenovirus E
cccugcucccagagc

SEQ ID NO: 1576198 - RNA, 16 nt, Human adenovirus E
agacugauggccacgg

SEQ ID NO: 1576199 - RNA, 21 nt, Human adenovirus E
cgccuggccaacuaccuggcc

SEQ ID NO: 1576200 - RNA, 21 nt, Human adenovirus E
gugcaggcaccgcagcuugcc

SEQ ID NO: 1576201 - RNA, 18 nt, Human adenovirus E
agcacccucagggcccgg

SEQ ID NO: 1576202 - RNA, 14 nt, Human adenovirus E
uaugcgcaggagca

SEQ ID NO: 1576203 - RNA, 20 nt, Human adenovirus E
ggucaucuugcaggucugcc

SEQ ID NO: 1576204 - RNA, 19 nt, Human adenovirus E
guuggacuugggugggagu

SEQ ID NO: 1576205 - RNA, 14 nt, Human adenovirus E
guucagggaggcgc

SEQ ID NO: 1576206 - RNA, 18 nt, Human adenovirus E
gcaccaacgugcagacca

SEQ ID NO: 1576207 - RNA, 21 nt, Human adenovirus E
cggaggccagcacccagacca

SEQ ID NO: 1576208 - RNA, 11 nt, Human adenovirus E
agcaaggagga

SEQ ID NO: 1576209 - RNA, 14 nt, Human adenovirus E
aggccgagccacag

SEQ ID NO: 1576210 - RNA, 13 nt, Human adenovirus E
gcgcuaccacccg

SEQ ID NO: 1576211 - RNA, 16 nt, Human adenovirus E
cgccgacgacagcagc

SEQ ID NO: 1576212 - RNA, 22 nt, Human adenovirus E
caacguggagcugaccaaccug

SEQ ID NO: 1576213 - RNA, 17 nt, Human adenovirus E
cccacggccgccagcuc

SEQ ID NO: 1576214 - RNA, 21 nt, Human adenovirus E
agcucugcaagcuccugcaga

SEQ ID NO: 1576215 - RNA, 19 nt, Human adenovirus E
cagaggaggaggagaugga

SEQ ID NO: 1576216 - RNA, 12 nt, Human adenovirus E
cauacuccaccu

SEQ ID NO: 1576217 - RNA, 17 nt, Human adenovirus E
agcgcuagcagccgcgg

SEQ ID NO: 1576218 - RNA, 19 nt, Human adenovirus E
gccccguccucuucccacu

SEQ ID NO: 1576219 - RNA, 17 nt, Human adenovirus E
gggcuggcgcgccuggg

SEQ ID NO: 1576220 - RNA, 20 nt, Human adenovirus E
caagaguuccaggcgguccc

SEQ ID NO: 1576221 - RNA, 19 nt, Human adenovirus E
ggccuuggaggcggcggca

SEQ ID NO: 1576222 - RNA, 12 nt, Human adenovirus E
ucucgccgccgc

SEQ ID NO: 1576223 - RNA, 14 nt, Human adenovirus E
ugaaacccuccggg

SEQ ID NO: 1576224 - RNA, 21 nt, Human adenovirus E
agcaguggcagcggccgaggc

SEQ ID NO: 1576225 - RNA, 16 nt, Human adenovirus E
caccaacgccaccguc

SEQ ID NO: 1576226 - RNA, 23 nt, Human adenovirus E
agccgguggagaaggauagcaag

SEQ ID NO: 1576227 - RNA, 20 nt, Human adenovirus E
caucaggccccgcagcaguc

SEQ ID NO: 1576228 - RNA, 12 nt, Human adenovirus E
aggccagcaccc

SEQ ID NO: 1576229 - RNA, 19 nt, Human adenovirus E
ccggaucuuucccacccuc

SEQ ID NO: 1576230 - RNA, 17 nt, Human adenovirus E
uaccucugccacaccug

SEQ ID NO: 1576231 - RNA, 17 nt, Human adenovirus E
ugaucccgcgaugcggg

SEQ ID NO: 1576232 - RNA, 15 nt, Human adenovirus E
caaacuaaccuccac

SEQ ID NO: 1576233 - RNA, 19 nt, Human adenovirus E
accgcaccgaggugccccu

SEQ ID NO: 1576234 - RNA, 12 nt, Human adenovirus E
cagcgcgagcgg

SEQ ID NO: 1576235 - RNA, 16 nt, Human adenovirus E
gcccggcgagcgcucc

SEQ ID NO: 1576236 - RNA, 14 nt, Human adenovirus E
cgagaagcagcagc

SEQ ID NO: 1576237 - RNA, 14 nt, Human adenovirus E
ggggcgcagggcau

SEQ ID NO: 1576238 - RNA, 13 nt, Human adenovirus E
caauaacaaaaaa

SEQ ID NO: 1576239 - RNA, 20 nt, Human adenovirus E
aacaccgccuaccgcagcug

SEQ ID NO: 1576240 - RNA, 12 nt, Human adenovirus E
guccaggccagc

SEQ ID NO: 1576241 - RNA, 16 nt, Human adenovirus E
caacagcaccaacgug

SEQ ID NO: 1576242 - RNA, 15 nt, Human adenovirus E
gcagccccaggccaa

SEQ ID NO: 1576243 - RNA, 16 nt, Human adenovirus E
cucugacgcuccuggu

SEQ ID NO: 1576244 - RNA, 18 nt, Human adenovirus E
cucgacuccguggccugg

SEQ ID NO: 1576245 - RNA, 15 nt, Human adenovirus E
gcaacaacagccccc

SEQ ID NO: 1576246 - RNA, 16 nt, Human adenovirus E
aggccaucggccaggc

SEQ ID NO: 1576247 - RNA, 16 nt, Human adenovirus E
ccauagccagccgacu

SEQ ID NO: 1576248 - RNA, 15 nt, Human adenovirus E
cgucgugcacgcagc

SEQ ID NO: 1576249 - RNA, 16 nt, Human adenovirus E
ggaauggcuguugaug

SEQ ID NO: 1576250 - RNA, 17 nt, Human adenovirus E
caaccgcacccgcgccg

SEQ ID NO: 1576251 - RNA, 13 nt, Human adenovirus E
gagcgcauccugc

SEQ ID NO: 1576252 - RNA, 13 nt, Human adenovirus E
gacggaugagcuc

SEQ ID NO: 1576253 - RNA, 17 nt, Human adenovirus E
cuccgggcacucccgca

SEQ ID NO: 1576254 - RNA, 11 nt, Human adenovirus E
uuuugaugcaa

SEQ ID NO: 1576255 - RNA, 15 nt, Human adenovirus E
ucgauuccucgggaa

SEQ ID NO: 1576256 - RNA, 15 nt, Human adenovirus E
cugagcgaccaggag

SEQ ID NO: 1576257 - RNA, 12 nt, Human adenovirus E
ccggagcagcug

SEQ ID NO: 1576258 - RNA, 19 nt, Human adenovirus E
gacccugaaagugcugacc

SEQ ID NO: 1576259 - RNA, 20 nt, Human adenovirus E
cugugggaccugcuggaggc

SEQ ID NO: 1576260 - RNA, 20 nt, Human adenovirus E
gaaacagguguugaugaugc

SEQ ID NO: 1576261 - RNA, 14 nt, Human adenovirus E
ccgaggagggcaag

SEQ ID NO: 1576262 - RNA, 16 nt, Human adenovirus E
gacaggcagcggggac

SEQ ID NO: 1576263 - RNA, 14 nt, Human adenovirus E
ggcgagguugagcu

SEQ ID NO: 1576264 - RNA, 15 nt, Human adenovirus E
cuucccccaggaugc

SEQ ID NO: 1576265 - RNA, 22 nt, Human adenovirus E
gacgcugcgcaacggccugccc

SEQ ID NO: 1576266 - RNA, 14 nt, Human adenovirus E
ccucgacucccacc

SEQ ID NO: 1576267 - RNA, 22 nt, Human adenovirus E
agccggcgcaaacccgggagcu

SEQ ID NO: 1576268 - RNA, 17 nt, Human adenovirus E
gggaggcuuccugcccg

SEQ ID NO: 1576269 - RNA, 21 nt, Human adenovirus E
cugccguagucuggagaagaa

SEQ ID NO: 1576270 - RNA, 15 nt, Human adenovirus E
ccgcggccaaccugg

SEQ ID NO: 1576271 - RNA, 21 nt, Human adenovirus E
gccggaucggggagaucuucc

SEQ ID NO: 1576272 - RNA, 13 nt, Human adenovirus E
ugaaacccuccgg

SEQ ID NO: 1576273 - RNA, 12 nt, Human adenovirus E
cggagcacgagg

SEQ ID NO: 1576274 - RNA, 20 nt, Human adenovirus E
caguuauuuuuccuccaccc

SEQ ID NO: 1576275 - RNA, 12 nt, Human adenovirus E
gcgccagcaggc

SEQ ID NO: 1576276 - RNA, 19 nt, Human adenovirus E
cauuucgcguacccggcuc

SEQ ID NO: 1576277 - RNA, 21 nt, Human adenovirus E
cugugccacccucgcucuggu

SEQ ID NO: 1576278 - RNA, 21 nt, Human adenovirus E
guugagggagagacagcugcc

SEQ ID NO: 1576279 - RNA, 19 nt, Human adenovirus E
gagcagaccuaccaggaga

SEQ ID NO: 1576280 - RNA, 21 nt, Human adenovirus E
ccuuggaagagggcgaggggc

SEQ ID NO: 1576281 - RNA, 19 nt, Human adenovirus E
ggcgagaucgagggcgagc

SEQ ID NO: 1576282 - RNA, 19 nt, Human adenovirus E
uguuaccacuaugcagcuc

SEQ ID NO: 1576283 - RNA, 17 nt, Human adenovirus E
caguuagucucuccacu

SEQ ID NO: 1576284 - RNA, 16 nt, Human adenovirus E
uccucccucagcaaua

SEQ ID NO: 1576285 - RNA, 23 nt, Human adenovirus E
ucgccgcaccgccgcugcaacca

SEQ ID NO: 1576286 - RNA, 13 nt, Human adenovirus E
ggaagaagaaagu

SEQ ID NO: 1576287 - RNA, 12 nt, Human adenovirus E
cgccgcagcagu

SEQ ID NO: 1576288 - RNA, 18 nt, Human adenovirus E
gcagcugaagcaacugca

SEQ ID NO: 1576289 - RNA, 23 nt, Human adenovirus E
aggccgucuacucgcagcagcug

SEQ ID NO: 1576290 - RNA, 15 nt, Human adenovirus E
ggugauccuccacca

SEQ ID NO: 1576291 - RNA, 17 nt, Human adenovirus E
caccugcaucugcugcu

SEQ ID NO: 1576292 - RNA, 14 nt, Human adenovirus E
auucugcagagcau

SEQ ID NO: 1576293 - RNA, 22 nt, Human adenovirus E
ggggaacccguccugaucugca

SEQ ID NO: 1576294 - RNA, 19 nt, Human adenovirus E
cgcgaggccaucggccagg

SEQ ID NO: 1576295 - RNA, 20 nt, Human adenovirus E
gcgggagaagaacuucccca

SEQ ID NO: 1576296 - RNA, 16 nt, Human adenovirus E
gacgagcugcuugccg

SEQ ID NO: 1576297 - RNA, 19 nt, Human adenovirus E
aggccgccgccccucucag

SEQ ID NO: 1576298 - RNA, 13 nt, Human adenovirus E
cgccauugguggc

SEQ ID NO: 1576299 - RNA, 21 nt, Human adenovirus E
augcggaugaagcacaaaauu

SEQ ID NO: 1576300 - RNA, 19 nt, Human adenovirus E
aucgccuccuuggaagagg

SEQ ID NO: 1576301 - RNA, 22 nt, Human adenovirus E
ucaccaaacugucaaauacucg

SEQ ID NO: 1576302 - RNA, 15 nt, Human adenovirus E
ccggaucgcugucca

SEQ ID NO: 1576303 - RNA, 13 nt, Human adenovirus E
guucaacagucca

SEQ ID NO: 1576304 - RNA, 23 nt, Human adenovirus E
cucuaugccaucuuccagcagag

SEQ ID NO: 1576305 - RNA, 13 nt, Human adenovirus E
ugcccccuccaga

SEQ ID NO: 1576306 - RNA, 17 nt, Human adenovirus E
aggccaucggccaggcg

SEQ ID NO: 1576307 - RNA, 22 nt, Human adenovirus E
uccaagaccccauagccagccg

SEQ ID NO: 1576308 - RNA, 13 nt, Human adenovirus E
cccgucuccugcc

SEQ ID NO: 1576309 - RNA, 21 nt, Human adenovirus E
ccucagcaugaugcccacggc

SEQ ID NO: 1576310 - RNA, 21 nt, Human adenovirus E
uaccucugcucuaugcaauuc

SEQ ID NO: 1576311 - RNA, 19 nt, Human adenovirus E
gagcgcggucauggaccag

SEQ ID NO: 1576312 - RNA, 18 nt, Human adenovirus E
gcugcccgaggagcaccc

SEQ ID NO: 1576313 - RNA, 16 nt, Human adenovirus E
caacaaaugccagcug

SEQ ID NO: 1576314 - RNA, 13 nt, Human adenovirus E
accaugcagcuga

SEQ ID NO: 1576315 - RNA, 19 nt, Human adenovirus E
cauccugcguuacgugcag

SEQ ID NO: 1576316 - RNA, 13 nt, Human adenovirus E
ucuacgaggacca

SEQ ID NO: 1576317 - RNA, 15 nt, Human adenovirus E
aggaggcagaggagg

SEQ ID NO: 1576318 - RNA, 23 nt, Human adenovirus E
ggcuucccccaggaugccccgag

SEQ ID NO: 1576319 - RNA, 19 nt, Human adenovirus E
gggauccaugguggcgcug

SEQ ID NO: 1576320 - RNA, 13 nt, Human adenovirus E
ugcguacaaaaug

SEQ ID NO: 1576321 - RNA, 23 nt, Human adenovirus E
uucaccaccugcaucugcugcug

SEQ ID NO: 1576322 - RNA, 23 nt, Human adenovirus E
cgcucgcgguggggcggccagcu

SEQ ID NO: 1576323 - RNA, 20 nt, Human adenovirus E
gcaccgcucccuggccugca

SEQ ID NO: 1576324 - RNA, 19 nt, Human adenovirus E
accgggugcuaacgagcgc

SEQ ID NO: 1576325 - RNA, 23 nt, Human adenovirus E
ugguggucccgugcaggcaccgc

SEQ ID NO: 1576326 - RNA, 13 nt, Human adenovirus E
cguggucagcgac

SEQ ID NO: 1576327 - RNA, 14 nt, Human adenovirus E
ggcggacgagcuga

SEQ ID NO: 1576328 - RNA, 14 nt, Human adenovirus E
gguccugggugagg

SEQ ID NO: 1576329 - RNA, 20 nt, Human adenovirus E
ccagcugacuaacucaggug

SEQ ID NO: 1576330 - RNA, 23 nt, Human adenovirus E
ggcuuucaagaacuugcagggcc

SEQ ID NO: 1576331 - RNA, 18 nt, Human adenovirus E
agacguaugcgcaggagc

SEQ ID NO: 1576332 - RNA, 19 nt, Human adenovirus E
cauuacuaccgucaccucc

SEQ ID NO: 1576333 - RNA, 18 nt, Human adenovirus E
cagggacgauccccgggc

SEQ ID NO: 1576334 - RNA, 21 nt, Human adenovirus E
ucgagcaguuauuuuuccucc

SEQ ID NO: 1576335 - RNA, 15 nt, Human adenovirus E
cgagccggggcagcg

SEQ ID NO: 1576336 - RNA, 15 nt, Human adenovirus E
cauuaccacacagac

SEQ ID NO: 1576337 - RNA, 22 nt, Human adenovirus E
uggucagggucuuguugcuagu

SEQ ID NO: 1576338 - RNA, 14 nt, Human adenovirus E
ugcccgccaccugc

SEQ ID NO: 1576339 - RNA, 14 nt, Human adenovirus E
cagcagcgagcugg

SEQ ID NO: 1576340 - RNA, 13 nt, Human adenovirus E
aggugaggaagag

SEQ ID NO: 1576341 - RNA, 14 nt, Human adenovirus E
aaucaggcagcacc

SEQ ID NO: 1576342 - RNA, 15 nt, Human adenovirus E
uugaauuuuaauuuu

SEQ ID NO: 1576343 - RNA, 20 nt, Human adenovirus E
uggacuucaccgagagccgc

SEQ ID NO: 1576344 - RNA, 10 nt, Human adenovirus E
ccucacagcg

SEQ ID NO: 1576345 - RNA, 11 nt, Human adenovirus E
cgcgccugggg

SEQ ID NO: 1576346 - RNA, 18 nt, Human adenovirus E
acgcccguccucggcgcu

SEQ ID NO: 1576347 - RNA, 19 nt, Human adenovirus E
cgcgacggugucgagccug

SEQ ID NO: 1576348 - RNA, 14 nt, Human adenovirus E
cgugcgcuccugga

SEQ ID NO: 1576349 - RNA, 23 nt, Human adenovirus E
gguagcuccauugcagggccucg

SEQ ID NO: 1576350 - RNA, 15 nt, Human adenovirus E
gccgccccucucagu

SEQ ID NO: 1576351 - RNA, 23 nt, Human adenovirus E
cccaccacaauuacucacaccac

SEQ ID NO: 1576352 - RNA, 22 nt, Human adenovirus E
cgcccaggacuacuccacccgc

SEQ ID NO: 1576353 - RNA, 20 nt, Human adenovirus E
uccugugggacgauguggac

SEQ ID NO: 1576354 - RNA, 17 nt, Human adenovirus E
ccgagcugucggccugc

SEQ ID NO: 1576355 - RNA, 21 nt, Human adenovirus E
ggaucgcuguccacgagcgcc

SEQ ID NO: 1576356 - RNA, 18 nt, Human adenovirus E
cugucaaauacucgcaga

SEQ ID NO: 1576357 - RNA, 22 nt, Human adenovirus E
acagcugccguccucccggagg

SEQ ID NO: 1576358 - RNA, 19 nt, Human adenovirus E
ugcaggccugcgggggcaa

SEQ ID NO: 1576359 - RNA, 16 nt, Human adenovirus E
gaacugguugacggcc

SEQ ID NO: 1576360 - RNA, 13 nt, Human adenovirus E
cugaaacacaaaa

SEQ ID NO: 1576361 - RNA, 21 nt, Human adenovirus E
gcaagcccguggucagcgacg

SEQ ID NO: 1576362 - RNA, 19 nt, Human adenovirus E
caccaagaacagccagagc

SEQ ID NO: 1576363 - RNA, 21 nt, Human adenovirus E
ccagggucucaaagcuccgcu

SEQ ID NO: 1576364 - RNA, 13 nt, Human adenovirus E
ggacgagcugacg

SEQ ID NO: 1576365 - RNA, 12 nt, Human adenovirus E
cucccucagcau

SEQ ID NO: 1576366 - RNA, 15 nt, Human adenovirus E
gccuuggaggcggcg

SEQ ID NO: 1576367 - RNA, 12 nt, Human adenovirus E
aacgcccaaaac

SEQ ID NO: 1576368 - RNA, 18 nt, Human adenovirus E
gagguaaauccaagccag

SEQ ID NO: 1576369 - RNA, 14 nt, Human adenovirus E
ggcggcucggggcc

SEQ ID NO: 1576370 - RNA, 11 nt, Human adenovirus E
ccgccagaccg

SEQ ID NO: 1576371 - RNA, 20 nt, Human adenovirus E
gcagagucgggggcaggagc

SEQ ID NO: 1576372 - RNA, 19 nt, Human adenovirus E
ccugggcauagucgcgccg

SEQ ID NO: 1576373 - RNA, 18 nt, Human adenovirus E
ccccggcggcgcgugcag

SEQ ID NO: 1576374 - RNA, 19 nt, Human adenovirus E
cucagcaaccugcugggca

SEQ ID NO: 1576375 - RNA, 12 nt, Human adenovirus E
gcacucaggcag

SEQ ID NO: 1576376 - RNA, 19 nt, Human adenovirus E
cccaguacgcgcucagcac

SEQ ID NO: 1576377 - RNA, 22 nt, Human adenovirus E
ggcggcgaagacgcgcgccggg

SEQ ID NO: 1576378 - RNA, 22 nt, Human adenovirus E
gcccuucgcccuagccgccucc

SEQ ID NO: 1576379 - RNA, 19 nt, Human adenovirus E
gcauuaccacacagacaac

SEQ ID NO: 1576380 - RNA, 16 nt, Human adenovirus E
ucuaaccuguccaccc

SEQ ID NO: 1576381 - RNA, 18 nt, Human adenovirus E
cggcgauguugagcugca

SEQ ID NO: 1576382 - RNA, 22 nt, Human adenovirus E
ccgcauccccaaauucaaacac

SEQ ID NO: 1576383 - RNA, 19 nt, Human adenovirus E
uccacugucgagagccaca

SEQ ID NO: 1576384 - RNA, 16 nt, Human adenovirus E
gaguuggaggagaugg

SEQ ID NO: 1576385 - RNA, 22 nt, Human adenovirus E
ugcucuuugccuucaccaccug

SEQ ID NO: 1576386 - RNA, 19 nt, Human adenovirus E
gacgggcucucgccgccgc

SEQ ID NO: 1576387 - RNA, 14 nt, Human adenovirus E
caaccaaacuaacc

SEQ ID NO: 1576388 - RNA, 23 nt, Human adenovirus E
agccccccugcucccagagcugg

SEQ ID NO: 1576389 - RNA, 21 nt, Human adenovirus E
uccgcguaauuggcccgccgc

SEQ ID NO: 1576390 - RNA, 23 nt, Human adenovirus E
cgccgagacggucaacuccuccu

SEQ ID NO: 1576391 - RNA, 19 nt, Human adenovirus E
ucgcggcgaacgagccggc

SEQ ID NO: 1576392 - RNA, 15 nt, Human adenovirus E
agacccgagcgggag

SEQ ID NO: 1576393 - RNA, 13 nt, Human adenovirus E
gcagcccccgcug

SEQ ID NO: 1576394 - RNA, 17 nt, Human adenovirus E
caccagcggguccaccu

SEQ ID NO: 1576395 - RNA, 24 nt, Human adenovirus E
gauccugcggaaccacagggccag

SEQ ID NO: 1576396 - RNA, 12 nt, Human adenovirus E
ccgagcagcagc

SEQ ID NO: 1576397 - RNA, 20 nt, Human adenovirus E
ugcagggccucgugcucggg

SEQ ID NO: 1576398 - RNA, 21 nt, Human adenovirus E
ccauguucagggcggccagac

SEQ ID NO: 1576399 - RNA, 22 nt, Human adenovirus E
gccgcaagaccaccacucgccg

SEQ ID NO: 1576400 - RNA, 23 nt, Human adenovirus E
gagacgcugcggagucaggucag

SEQ ID NO: 1576401 - RNA, 22 nt, Human adenovirus E
acuaugaggccgagccacagcg

SEQ ID NO: 1576402 - RNA, 18 nt, Human adenovirus E
cgaggacgucagcggcga

SEQ ID NO: 1576403 - RNA, 13 nt, Human adenovirus E
gacugggcggugc

SEQ ID NO: 1576404 - RNA, 19 nt, Human adenovirus E
gcgguacaccucgcccugc

SEQ ID NO: 1576405 - RNA, 13 nt, Human adenovirus E
uggcagcccagcc

SEQ ID NO: 1576406 - RNA, 15 nt, Human adenovirus E
ugugggaccugcugg

SEQ ID NO: 1576407 - RNA, 20 nt, Human adenovirus E
uccgcugggugacaaagagc

SEQ ID NO: 1576408 - RNA, 21 nt, Human adenovirus E
uucuggccugcacccucaucu

SEQ ID NO: 1576409 - RNA, 14 nt, Human adenovirus E
agcaggcggcgcga

SEQ ID NO: 1576410 - RNA, 18 nt, Human adenovirus E
cggucguuguccaccagc

SEQ ID NO: 1576411 - RNA, 16 nt, Human adenovirus E
ccugggcggcgagcac

SEQ ID NO: 1576412 - RNA, 12 nt, Human adenovirus E
ggcggcuggggc

SEQ ID NO: 1576413 - RNA, 19 nt, Human adenovirus E
ccacugucgagagccacac

SEQ ID NO: 1576414 - RNA, 17 nt, Human adenovirus E
gggcgugcgcuccugga

SEQ ID NO: 1576415 - RNA, 17 nt, Human adenovirus E
uauaccuucucauacau

SEQ ID NO: 1576416 - RNA, 17 nt, Human adenovirus E
ccuccacuaacaucucu

SEQ ID NO: 1576417 - RNA, 11 nt, Human adenovirus E
ccgccgcggcg

SEQ ID NO: 1576418 - RNA, 21 nt, Human adenovirus E
caccaacgugcagaccaaccu

SEQ ID NO: 1576419 - RNA, 14 nt, Human adenovirus E
cgcccaagaaugaa

SEQ ID NO: 1576420 - RNA, 17 nt, Human adenovirus E
cguucucuccagcacca

SEQ ID NO: 1576421 - RNA, 13 nt, Human adenovirus E
ucuaccucugcca

SEQ ID NO: 1576422 - RNA, 22 nt, Human adenovirus E
caaucucgguaucguugacggc

SEQ ID NO: 1576423 - RNA, 21 nt, Human adenovirus E
ccugcacuggcagcccagccg

SEQ ID NO: 1576424 - RNA, 18 nt, Human adenovirus E
ugcaucgggcggccgcca

SEQ ID NO: 1576425 - RNA, 15 nt, Human adenovirus E
ccaccaugcagcuga

SEQ ID NO: 1576426 - RNA, 19 nt, Human adenovirus E
gcccuagccgccuccaccc

SEQ ID NO: 1576427 - RNA, 16 nt, Human adenovirus E
ccaguaauaacaccgg

SEQ ID NO: 1576428 - RNA, 15 nt, Human adenovirus E
gccaggccugcaaga

SEQ ID NO: 1576429 - RNA, 13 nt, Human adenovirus E
ugcguuccagcau

SEQ ID NO: 1576430 - RNA, 19 nt, Human adenovirus E
acgauauguggccccccac

SEQ ID NO: 1576431 - RNA, 18 nt, Human adenovirus E
cagcagaaaaagaccagc

SEQ ID NO: 1576432 - RNA, 21 nt, Human adenovirus E
accgcucccuggccugcaacc

SEQ ID NO: 1576433 - RNA, 19 nt, Human adenovirus E
cagacggaucccuggaugc

SEQ ID NO: 1576434 - RNA, 21 nt, Human adenovirus E
cuuaguggugcuguguugcug

SEQ ID NO: 1576435 - RNA, 19 nt, Human adenovirus E
agcagagguugccagcucg

SEQ ID NO: 1576436 - RNA, 21 nt, Human adenovirus E
cagccacuugaacucggggau

SEQ ID NO: 1576437 - RNA, 18 nt, Human adenovirus E
  misc_feature (8)..(8): n is a, c, g or u
cggccgancgccugggcg

SEQ ID NO: 1576438 - RNA, 17 nt, Human adenovirus E
aaacagguguugaugau

SEQ ID NO: 1576439 - RNA, 20 nt, Human adenovirus E
agcagucaggcagaggagga

SEQ ID NO: 1576440 - RNA, 14 nt, Human adenovirus E
cuccagcaccaggc

SEQ ID NO: 1576441 - RNA, 21 nt, Human adenovirus E
cccggucccccacccaguccc

SEQ ID NO: 1576442 - RNA, 18 nt, Human adenovirus E
ccgccaugaacucugacu

SEQ ID NO: 1576443 - RNA, 15 nt, Human adenovirus E
caucaggccccgcag

SEQ ID NO: 1576444 - RNA, 20 nt, Human adenovirus E
gaagccuuuagacagcagcc

SEQ ID NO: 1576445 - RNA, 16 nt, Human adenovirus E
ggagcuaccagcccca

SEQ ID NO: 1576446 - RNA, 14 nt, Human adenovirus E
uggccaaccaggcc

SEQ ID NO: 1576447 - RNA, 18 nt, Human adenovirus E
augcaauucugacaauga

SEQ ID NO: 1576448 - RNA, 22 nt, Human adenovirus E
ugcggaacugguacuuggccag

SEQ ID NO: 1576449 - RNA, 21 nt, Human adenovirus E
ccagggggcgauccuggccca

SEQ ID NO: 1576450 - RNA, 19 nt, Human adenovirus E
ggacccgguagaggugggc

SEQ ID NO: 1576451 - RNA, 16 nt, Human adenovirus E
caccaacuucaucagc

SEQ ID NO: 1576452 - RNA, 14 nt, Human adenovirus E
ccgcucccuggccu

SEQ ID NO: 1576453 - RNA, 16 nt, Human adenovirus E
ugcgccgcuucuucgc

SEQ ID NO: 1576454 - RNA, 22 nt, Human adenovirus E
cccgcagaagcaagcuccagcu

SEQ ID NO: 1576455 - RNA, 22 nt, Human adenovirus E
gcuggcgggcggcgccacccug

SEQ ID NO: 1576456 - RNA, 17 nt, Human adenovirus E
gaaucaggcuggagccg

SEQ ID NO: 1576457 - RNA, 22 nt, Human adenovirus E
ccucgcucugguggccaacgcc

SEQ ID NO: 1576458 - RNA, 20 nt, Human adenovirus E
aggcgaggguucagccgcca

SEQ ID NO: 1576459 - RNA, 19 nt, Human adenovirus E
gucauggaccaggugcuca

SEQ ID NO: 1576460 - RNA, 14 nt, Human adenovirus E
guggcgaaggagcc

SEQ ID NO: 1576461 - RNA, 17 nt, Human adenovirus E
agccuuuagacagcagc

SEQ ID NO: 1576462 - RNA, 16 nt, Human adenovirus E
agaugccgggcaggag

SEQ ID NO: 1576463 - RNA, 23 nt, Human adenovirus E
gaaagcaaguuccggagcagcug

SEQ ID NO: 1576464 - RNA, 22 nt, Human adenovirus E
agcuugcccuucucgcugaaca

SEQ ID NO: 1576465 - RNA, 21 nt, Human adenovirus E
cucgucugccguagucuggag

SEQ ID NO: 1576466 - RNA, 15 nt, Human adenovirus E
uaauuacuccccucc

SEQ ID NO: 1576467 - RNA, 22 nt, Human adenovirus E
ugcaacuuuuuuuuggaggccg

SEQ ID NO: 1576468 - RNA, 16 nt, Human adenovirus E
acccugaaagugcuga

SEQ ID NO: 1576469 - RNA, 16 nt, Human adenovirus E
gcaagagauggaggaa

SEQ ID NO: 1576470 - RNA, 15 nt, Human adenovirus E
gugaccguggagcug

SEQ ID NO: 1576471 - RNA, 21 nt, Human adenovirus E
cagcugcaccacgcugcgccc

SEQ ID NO: 1576472 - RNA, 19 nt, Human adenovirus E
cuacacgggcgaguacgac

SEQ ID NO: 1576473 - RNA, 17 nt, Human adenovirus E
cguggaggauuuggagg

SEQ ID NO: 1576474 - RNA, 12 nt, Human adenovirus E
gcgcuucugcug

SEQ ID NO: 1576475 - RNA, 20 nt, Human adenovirus E
ccauguuuucugccaacacc

SEQ ID NO: 1576476 - RNA, 19 nt, Human adenovirus E
aaucuucauuuuaucuucu

SEQ ID NO: 1576477 - RNA, 17 nt, Human adenovirus E
cacuguaucccacccug

SEQ ID NO: 1576478 - RNA, 12 nt, Human adenovirus E
aggacgagggca

SEQ ID NO: 1576479 - RNA, 22 nt, Human adenovirus E
gcccagccccgccaccuccgac

SEQ ID NO: 1576480 - RNA, 18 nt, Human adenovirus E
ugcggcgcggccuggacc

SEQ ID NO: 1576481 - RNA, 14 nt, Human adenovirus E
gcagucccacugcu

SEQ ID NO: 1576482 - RNA, 23 nt, Human adenovirus E
ugauggccgugguccuggugacc

SEQ ID NO: 1576483 - RNA, 21 nt, Human adenovirus E
ggggaacccguccugaucugc

SEQ ID NO: 1576484 - RNA, 13 nt, Human adenovirus E
gcaucagcuggaa

SEQ ID NO: 1576485 - RNA, 18 nt, Human adenovirus E
accgguaagaaggagcgg

SEQ ID NO: 1576486 - RNA, 16 nt, Human adenovirus E
caggagggggccaccc

SEQ ID NO: 1576487 - RNA, 20 nt, Human adenovirus E
acucuuucauauccucuccg

SEQ ID NO: 1576488 - RNA, 19 nt, Human adenovirus E
gugcucgcaacgcugcacg

SEQ ID NO: 1576489 - RNA, 17 nt, Human adenovirus E
cagcggcggcagcaggu

SEQ ID NO: 1576490 - RNA, 23 nt, Human adenovirus E
gcggaacugguacuuggccagcc

SEQ ID NO: 1576491 - RNA, 21 nt, Human adenovirus E
auacagcucgugcgagggggc

SEQ ID NO: 1576492 - RNA, 22 nt, Human adenovirus E
gcaguagucgagggucuccugg

SEQ ID NO: 1576493 - RNA, 14 nt, Human adenovirus E
ggagcuggcagugc

SEQ ID NO: 1576494 - RNA, 17 nt, Human adenovirus E
uggcgguggggcggcag

SEQ ID NO: 1576495 - RNA, 19 nt, Human adenovirus E
gcgucucgagauccacggg

SEQ ID NO: 1576496 - RNA, 14 nt, Human adenovirus E
gccccgccaccucc

SEQ ID NO: 1576497 - RNA, 14 nt, Human adenovirus E
caccgcucccuggc

SEQ ID NO: 1576498 - RNA, 22 nt, Human adenovirus E
ugcaucucgugcuguacuacgu

SEQ ID NO: 1576499 - RNA, 23 nt, Human adenovirus E
cguaugcgcaggagcacagggac

SEQ ID NO: 1576500 - RNA, 12 nt, Human adenovirus E
ggagcagcuggg

SEQ ID NO: 1576501 - RNA, 13 nt, Human adenovirus E
acuccguggccug

SEQ ID NO: 1576502 - RNA, 19 nt, Human adenovirus E
cauccuggccguguugcuc

SEQ ID NO: 1576503 - RNA, 21 nt, Human adenovirus E
ccagcucgucugggguccgag

SEQ ID NO: 1576504 - RNA, 21 nt, Human adenovirus E
ucguacgagagcgugaugcag

SEQ ID NO: 1576505 - RNA, 20 nt, Human adenovirus E
ugcucuacuacaucuucugc

SEQ ID NO: 1576506 - RNA, 16 nt, Human adenovirus E
agacucgggccgcgaa

SEQ ID NO: 1576507 - RNA, 21 nt, Human adenovirus E
cagccugcaagacagucugga

SEQ ID NO: 1576508 - RNA, 15 nt, Human adenovirus E
cuguaucccacccug

SEQ ID NO: 1576509 - RNA, 15 nt, Human adenovirus E
cgugaaccugagcca

SEQ ID NO: 1576510 - RNA, 17 nt, Human adenovirus E
cuuguugcgcagggcca

SEQ ID NO: 1576511 - RNA, 19 nt, Human adenovirus E
cuuggaggcggcggcagga

SEQ ID NO: 1576512 - RNA, 13 nt, Human adenovirus E
aggaggaugcagc

SEQ ID NO: 1576513 - RNA, 19 nt, Human adenovirus E
cgucuaccucuaccucugc

SEQ ID NO: 1576514 - RNA, 22 nt, Human adenovirus E
ccaacgugccccggggccagga

SEQ ID NO: 1576515 - RNA, 16 nt, Human adenovirus E
gccagcacccagacca

SEQ ID NO: 1576516 - RNA, 14 nt, Human adenovirus E
agccacucucucag

SEQ ID NO: 1576517 - RNA, 13 nt, Human adenovirus E
ggacuugccgcag

SEQ ID NO: 1576518 - RNA, 17 nt, Human adenovirus E
uagaaugaccacaacca

SEQ ID NO: 1576519 - RNA, 15 nt, Human adenovirus E
uggacaacaccugau

SEQ ID NO: 1576520 - RNA, 13 nt, Human adenovirus E
cggcggcagcagg

SEQ ID NO: 1576521 - RNA, 23 nt, Human adenovirus E
gcgugcacgaagcccugcaggaa

SEQ ID NO: 1576522 - RNA, 15 nt, Human adenovirus E
gcgagggugcugccg

SEQ ID NO: 1576523 - RNA, 23 nt, Human adenovirus E
cacuuagcauuaccacacagaca

SEQ ID NO: 1576524 - RNA, 21 nt, Human adenovirus E
cucgcgcagagcgcccuccac

SEQ ID NO: 1576525 - RNA, 15 nt, Human adenovirus E
cgaggaggaggcaga

SEQ ID NO: 1576526 - RNA, 20 nt, Human adenovirus E
aaaugugguagucaaauacu

SEQ ID NO: 1576527 - RNA, 20 nt, Human adenovirus E
gcaaucaggcagcaccgggu

SEQ ID NO: 1576528 - RNA, 17 nt, Human adenovirus E
ggagcccgaggagaugc

SEQ ID NO: 1576529 - RNA, 21 nt, Human adenovirus E
accaccucccgguaccacauc

SEQ ID NO: 1576530 - RNA, 17 nt, Human adenovirus E
gcugcaaccucugcacg

SEQ ID NO: 1576531 - RNA, 18 nt, Human adenovirus E
cugaaucuaauacuacca

SEQ ID NO: 1576532 - RNA, 17 nt, Human adenovirus E
uccccucuucccagcuc

SEQ ID NO: 1576533 - RNA, 23 nt, Human adenovirus E
cugcagagcaucguggugcagga

SEQ ID NO: 1576534 - RNA, 18 nt, Human adenovirus E
augggcauuuuggagagg

SEQ ID NO: 1576535 - RNA, 11 nt, Human adenovirus E
ccaugaacucu

SEQ ID NO: 1576536 - RNA, 17 nt, Human adenovirus E
gagcucugcaagcuccu

SEQ ID NO: 1576537 - RNA, 16 nt, Human adenovirus E
cgcgcaucuccaggug

SEQ ID NO: 1576538 - RNA, 14 nt, Human adenovirus E
accgccgcggccgc

SEQ ID NO: 1576539 - RNA, 13 nt, Human adenovirus E
cacccacgugagc

SEQ ID NO: 1576540 - RNA, 13 nt, Human adenovirus E
ccccgcuggaggc

SEQ ID NO: 1576541 - RNA, 20 nt, Human adenovirus E
cucacaugaccgccuucgcg

SEQ ID NO: 1576542 - RNA, 19 nt, Human adenovirus E
  misc_feature (10)..(10): n is a, c, g or u
gcagcagccnuucuccacg

SEQ ID NO: 1576543 - RNA, 22 nt, Human adenovirus E
guccagggacucccucagcaug

SEQ ID NO: 1576544 - RNA, 16 nt, Human adenovirus E
ccagggauaggagcuc

SEQ ID NO: 1576545 - RNA, 15 nt, Human adenovirus E
cgucggccaugggca

SEQ ID NO: 1576546 - RNA, 22 nt, Human adenovirus E
cgcucgcgguggggcggccagc

SEQ ID NO: 1576547 - RNA, 14 nt, Human adenovirus E
guuggccagcugca

SEQ ID NO: 1576548 - RNA, 16 nt, Human adenovirus E
ccugacuuuggagagu

SEQ ID NO: 1576549 - RNA, 19 nt, Human adenovirus E
ucuccaucgcuuacagccu

SEQ ID NO: 1576550 - RNA, 18 nt, Human adenovirus E
ucugcaagcuccugcaga

SEQ ID NO: 1576551 - RNA, 14 nt, Human adenovirus E
cggcuucccccagg

SEQ ID NO: 1576552 - RNA, 18 nt, Human adenovirus E
gcagcagugucuggagga

SEQ ID NO: 1576553 - RNA, 22 nt, Human adenovirus E
cggccggauuccgcggcuaacg

SEQ ID NO: 1576554 - RNA, 10 nt, Human adenovirus E
gggaggaaca

SEQ ID NO: 1576555 - RNA, 12 nt, Human adenovirus E
ccaggcaggcca

SEQ ID NO: 1576556 - RNA, 13 nt, Human adenovirus E
cggcggccugggc

SEQ ID NO: 1576557 - RNA, 15 nt, Human adenovirus E
cuacuggucgcugcc

SEQ ID NO: 1576558 - RNA, 23 nt, Human adenovirus E
guggcucugccuuggcaguacag

SEQ ID NO: 1576559 - RNA, 15 nt, Human adenovirus E
gcacucaacccaccc

SEQ ID NO: 1576560 - RNA, 22 nt, Human adenovirus E
gggcaugggcguguggcagcag

SEQ ID NO: 1576561 - RNA, 23 nt, Human adenovirus E
ucaccgagcccgagggccgcugg

SEQ ID NO: 1576562 - RNA, 17 nt, Human adenovirus E
  misc_feature (6)..(6): n is a, c, g or u
ccgcancgugaagacgc

SEQ ID NO: 1576563 - RNA, 17 nt, Human adenovirus E
caccaacgugcagacca

SEQ ID NO: 1576564 - RNA, 20 nt, Human adenovirus E
caggaaggugauuggcuugu

SEQ ID NO: 1576565 - RNA, 23 nt, Human adenovirus E
auucuggccugcacccucaucuc

SEQ ID NO: 1576566 - RNA, 18 nt, Human adenovirus E
guugcagggcgcccagca

SEQ ID NO: 1576567 - RNA, 15 nt, Human adenovirus E
ugagguacaugggca

SEQ ID NO: 1576568 - RNA, 16 nt, Human adenovirus E
uacuucuuccagacca

SEQ ID NO: 1576569 - RNA, 13 nt, Human adenovirus E
gccacaccacagc

SEQ ID NO: 1576570 - RNA, 20 nt, Human adenovirus E
cugaucugauacuccucaau

SEQ ID NO: 1576571 - RNA, 23 nt, Human adenovirus E
cugacgcugcgcaacggccugcc

SEQ ID NO: 1576572 - RNA, 13 nt, Human adenovirus E
aacgccauccuga

SEQ ID NO: 1576573 - RNA, 23 nt, Human adenovirus E
augauauucuggagcaggcggcc

SEQ ID NO: 1576574 - RNA, 21 nt, Human adenovirus E
ucggugaagaagaccccgcag

SEQ ID NO: 1576575 - RNA, 19 nt, Human adenovirus E
gcagcgacgagacucgggc

SEQ ID NO: 1576576 - RNA, 16 nt, Human adenovirus E
caccaacccuccagga

SEQ ID NO: 1576577 - RNA, 15 nt, Human adenovirus E
ugucgcaucaggccc

SEQ ID NO: 1576578 - RNA, 17 nt, Human adenovirus E
cuccggaauccugcccg

SEQ ID NO: 1576579 - RNA, 15 nt, Human adenovirus E
gacgagcccgcgcgg

SEQ ID NO: 1576580 - RNA, 21 nt, Human adenovirus E
uggcaauggaggacccaccgc

SEQ ID NO: 1576581 - RNA, 13 nt, Human adenovirus E
ccgucaccuccac

SEQ ID NO: 1576582 - RNA, 13 nt, Human adenovirus E
ugggcaugagccc

SEQ ID NO: 1576583 - RNA, 20 nt, Human adenovirus E
aguucguaguugagcgccuc

SEQ ID NO: 1576584 - RNA, 17 nt, Human adenovirus E
gcaucuccagguggccg

SEQ ID NO: 1576585 - RNA, 21 nt, Human adenovirus E
cgagggccgcuggcuccugga

SEQ ID NO: 1576586 - RNA, 19 nt, Human adenovirus E
ucgcuguccacgagcgcca

SEQ ID NO: 1576587 - RNA, 12 nt, Human adenovirus E
gccagaugaugc

SEQ ID NO: 1576588 - RNA, 22 nt, Human adenovirus E
gcgaggccaucggccaggcgca

SEQ ID NO: 1576589 - RNA, 15 nt, Human adenovirus E
cucagccgcgccuac

SEQ ID NO: 1576590 - RNA, 18 nt, Human adenovirus E
acagcacucaggcagagg

SEQ ID NO: 1576591 - RNA, 16 nt, Human adenovirus E
cgcucagcaccgagga

SEQ ID NO: 1576592 - RNA, 23 nt, Human adenovirus E
ggaacucuugcaggacagcgaac

SEQ ID NO: 1576593 - RNA, 13 nt, Human adenovirus E
uagucaaauacug

SEQ ID NO: 1576594 - RNA, 17 nt, Human adenovirus E
gaggaggaggcagagga

SEQ ID NO: 1576595 - RNA, 22 nt, Human adenovirus E
gugcagcagaagcgugggccug

SEQ ID NO: 1576596 - RNA, 13 nt, Human adenovirus E
aggagcgcgggcu

SEQ ID NO: 1576597 - RNA, 18 nt, Human adenovirus E
gguccucgagcggugugc

SEQ ID NO: 1576598 - RNA, 20 nt, Human adenovirus E
gcccaucauguacgccagca

SEQ ID NO: 1576599 - RNA, 19 nt, Human adenovirus E
agucugcagcgggcccuga

SEQ ID NO: 1576600 - RNA, 15 nt, Human adenovirus E
cgcgaguccaaccug

SEQ ID NO: 1576601 - RNA, 16 nt, Human adenovirus E
agcgccgcgcucgaca

SEQ ID NO: 1576602 - RNA, 15 nt, Human adenovirus E
cugaaccugcccccc

SEQ ID NO: 1576603 - RNA, 12 nt, Human adenovirus E
accugggcggcg

SEQ ID NO: 1576604 - RNA, 22 nt, Human adenovirus E
cuccacgucgagguccucggcg

SEQ ID NO: 1576605 - RNA, 13 nt, Human adenovirus E
accgaggugcccc

SEQ ID NO: 1576606 - RNA, 14 nt, Human adenovirus E
caggucaucgcgcc

SEQ ID NO: 1576607 - RNA, 13 nt, Human adenovirus E
gaaaaagccacag

SEQ ID NO: 1576608 - RNA, 12 nt, Human adenovirus E
gccaggcgcacg

SEQ ID NO: 1576609 - RNA, 22 nt, Human adenovirus E
accagcaccauggaggugcaga

SEQ ID NO: 1576610 - RNA, 15 nt, Human adenovirus E
accgcucccuggccu

SEQ ID NO: 1576611 - RNA, 22 nt, Human adenovirus E
cggcagaacggggugcuggaga

SEQ ID NO: 1576612 - RNA, 14 nt, Human adenovirus E
aagaugagccgcug

SEQ ID NO: 1576613 - RNA, 12 nt, Human adenovirus E
ugcagcagcuga

SEQ ID NO: 1576614 - RNA, 17 nt, Human adenovirus E
cuccaacguggagcuga

SEQ ID NO: 1576615 - RNA, 19 nt, Human adenovirus E
uggcccgguggcugggucc

SEQ ID NO: 1576616 - RNA, 15 nt, Human adenovirus E
gacuccguggccugg

SEQ ID NO: 1576617 - RNA, 13 nt, Human adenovirus E
gguggugcagcau

SEQ ID NO: 1576618 - RNA, 13 nt, Human adenovirus E
cacagcacaggca

SEQ ID NO: 1576619 - RNA, 14 nt, Human adenovirus E
gaagacguggucag

SEQ ID NO: 1576620 - RNA, 20 nt, Human adenovirus E
ccgagucgcggaugaagugg

SEQ ID NO: 1576621 - RNA, 23 nt, Human adenovirus E
gcacagacugaacgacaagcugg

SEQ ID NO: 1576622 - RNA, 14 nt, Human adenovirus E
acuacaaugcucag

SEQ ID NO: 1576623 - RNA, 16 nt, Human adenovirus E
acgcaguagaaggugc

SEQ ID NO: 1576624 - RNA, 13 nt, Human adenovirus E
uuaccgagcagca

SEQ ID NO: 1576625 - RNA, 23 nt, Human adenovirus E
gugcccucgcgcuccaaccccac

SEQ ID NO: 1576626 - RNA, 13 nt, Human adenovirus E
ucaaccccggcuu

SEQ ID NO: 1576627 - RNA, 16 nt, Human adenovirus E
cugcccggcugcgggg

SEQ ID NO: 1576628 - RNA, 20 nt, Human adenovirus E
aacgugccccggggccagga

SEQ ID NO: 1576629 - RNA, 18 nt, Human adenovirus E
cggagaaaacuggcguga

SEQ ID NO: 1576630 - RNA, 19 nt, Human adenovirus E
cacagcaacuuccugacca

SEQ ID NO: 1576631 - RNA, 15 nt, Human adenovirus E
gaaucgcggacggcc

SEQ ID NO: 1576632 - RNA, 19 nt, Human adenovirus E
cacggauaccaucuccgcu

SEQ ID NO: 1576633 - RNA, 13 nt, Human adenovirus E
ucaaauuccuccu

SEQ ID NO: 1576634 - RNA, 16 nt, Human adenovirus E
gccagacccagccaga

SEQ ID NO: 1576635 - RNA, 19 nt, Human adenovirus E
aacacaaaauaaaauaaag

SEQ ID NO: 1576636 - RNA, 22 nt, Human adenovirus E
cacgcgcccgcgcuugcugggc

SEQ ID NO: 1576637 - RNA, 18 nt, Human adenovirus E
ggccgcuggcuccuggac

SEQ ID NO: 1576638 - RNA, 15 nt, Human adenovirus E
gcggcggcgcgccau

SEQ ID NO: 1576639 - RNA, 14 nt, Human adenovirus E
cugcuggaggccau

SEQ ID NO: 1576640 - RNA, 18 nt, Human adenovirus E
augcaagagauggaggaa

SEQ ID NO: 1576641 - RNA, 16 nt, Human adenovirus E
aacgccugcugggccu

SEQ ID NO: 1576642 - RNA, 12 nt, Human adenovirus E
gcagcaacuucc

SEQ ID NO: 1576643 - RNA, 23 nt, Human adenovirus E
agacugauggccacgggcagccc

SEQ ID NO: 1576644 - RNA, 15 nt, Human adenovirus E
uacccuucucccagg

SEQ ID NO: 1576645 - RNA, 20 nt, Human adenovirus E
uguuccacgguggcuuccag

SEQ ID NO: 1576646 - RNA, 16 nt, Human adenovirus E
agaccaaccuggaccg

SEQ ID NO: 1576647 - RNA, 14 nt, Human adenovirus E
ccgccgcuguggag

SEQ ID NO: 1576648 - RNA, 21 nt, Human adenovirus E
ugcaggccugcgggggcaaca

SEQ ID NO: 1576649 - RNA, 18 nt, Human adenovirus E
ggacccggacgugcagcc

SEQ ID NO: 1576650 - RNA, 16 nt, Human adenovirus E
uagaguuuggaagcag

SEQ ID NO: 1576651 - RNA, 20 nt, Human adenovirus E
agcccaucauguacgccagc

SEQ ID NO: 1576652 - RNA, 19 nt, Human adenovirus E
gagcucggagggggggauc

SEQ ID NO: 1576653 - RNA, 17 nt, Human adenovirus E
caaccuggaagccaccc

SEQ ID NO: 1576654 - RNA, 18 nt, Human adenovirus E
cuacuugcaucgggcggc

SEQ ID NO: 1576655 - RNA, 18 nt, Human adenovirus E
caaguacggcgcggccag

SEQ ID NO: 1576656 - RNA, 12 nt, Human adenovirus E
cgucacccgccc

SEQ ID NO: 1576657 - RNA, 22 nt, Human adenovirus E
cugaacgccuuccucagcaccc

SEQ ID NO: 1576658 - RNA, 20 nt, Human adenovirus E
gccuccaaacguuccauggc

SEQ ID NO: 1576659 - RNA, 14 nt, Human adenovirus E
acaccaccacagca

SEQ ID NO: 1576660 - RNA, 18 nt, Human adenovirus E
ccgaaagagggugcugag

SEQ ID NO: 1576661 - RNA, 21 nt, Human adenovirus E
gcaacucguaccugggcuacc

SEQ ID NO: 1576662 - RNA, 14 nt, Human adenovirus E
ccaggcggucccag

SEQ ID NO: 1576663 - RNA, 18 nt, Human adenovirus E
ucggaucuucagccagcg

SEQ ID NO: 1576664 - RNA, 16 nt, Human adenovirus E
cugccacaccuggcag

SEQ ID NO: 1576665 - RNA, 17 nt, Human adenovirus E
caccgcucccuggccug

SEQ ID NO: 1576666 - RNA, 19 nt, Human adenovirus E
cuaguugcgggugggcuuu

SEQ ID NO: 1576667 - RNA, 18 nt, Human adenovirus E
cauguucagggcggccag

SEQ ID NO: 1576668 - RNA, 15 nt, Human adenovirus E
ugugggacgaugagg

SEQ ID NO: 1576669 - RNA, 20 nt, Human adenovirus E
gcugcgcaacggccugcccg

SEQ ID NO: 1576670 - RNA, 14 nt, Human adenovirus E
cuuggcaguacagu

SEQ ID NO: 1576671 - RNA, 14 nt, Human adenovirus E
cguguggcagcagu

SEQ ID NO: 1576672 - RNA, 16 nt, Human adenovirus E
acacugguggccaccu

SEQ ID NO: 1576673 - RNA, 14 nt, Human adenovirus E
gcggugcaggccuc

SEQ ID NO: 1576674 - RNA, 20 nt, Human adenovirus E
cuacaagaccccguacgugc

SEQ ID NO: 1576675 - RNA, 15 nt, Human adenovirus E
uucauggaaugagua

SEQ ID NO: 1576676 - RNA, 17 nt, Human adenovirus E
gcccggcaggccaccau

SEQ ID NO: 1576677 - RNA, 23 nt, Human adenovirus E
cccgccugaaccugacacaccac

SEQ ID NO: 1576678 - RNA, 24 nt, Human adenovirus E
agcggcucgacuccguggccugga

SEQ ID NO: 1576679 - RNA, 18 nt, Human adenovirus E
uggaggcuccuuacgugc

SEQ ID NO: 1576680 - RNA, 20 nt, Human adenovirus E
gacccggacgugcagcccga

SEQ ID NO: 1576681 - RNA, 15 nt, Human adenovirus E
gagggucugggcagc

SEQ ID NO: 1576682 - RNA, 14 nt, Human adenovirus E
guggagcuaccagc

SEQ ID NO: 1576683 - RNA, 15 nt, Human adenovirus E
cgcugcccucggacu

SEQ ID NO: 1576684 - RNA, 15 nt, Human adenovirus E
aggcugggcucgagc

SEQ ID NO: 1576685 - RNA, 20 nt, Human adenovirus E
ccaggccgaaguccagcuga

SEQ ID NO: 1576686 - RNA, 19 nt, Human adenovirus E
agcccgccaacgugccccg

SEQ ID NO: 1576687 - RNA, 11 nt, Human adenovirus E
acgugcuggag

SEQ ID NO: 1576688 - RNA, 20 nt, Human adenovirus E
cgcgcaucuccagguggccg

SEQ ID NO: 1576689 - RNA, 22 nt, Human adenovirus E
cucguacgagagcgugaugcag

SEQ ID NO: 1576690 - RNA, 22 nt, Human adenovirus E
gcgcugaacgccuuccucagca

SEQ ID NO: 1576691 - RNA, 22 nt, Human adenovirus E
ggauccaugguggcgcugaacg

SEQ ID NO: 1576692 - RNA, 18 nt, Human adenovirus E
cacgucuucaaccgcuuc

SEQ ID NO: 1576693 - RNA, 13 nt, Human adenovirus E
cugcucaggcucc

SEQ ID NO: 1576694 - RNA, 15 nt, Human adenovirus E
cacguggccgcggcc

SEQ ID NO: 1576695 - RNA, 18 nt, Human adenovirus E
guggcccccuucacggac

SEQ ID NO: 1576696 - RNA, 13 nt, Human adenovirus E
cgguuccaccgcg

SEQ ID NO: 1576697 - RNA, 21 nt, Human adenovirus E
cgcgucggugaugcucuccac

SEQ ID NO: 1576698 - RNA, 17 nt, Human adenovirus E
cuccaguucguggagga

SEQ ID NO: 1576699 - RNA, 18 nt, Human adenovirus E
cgcagccccgcucgggug

SEQ ID NO: 1576700 - RNA, 21 nt, Human adenovirus E
cagcgccggcaggacccggag

SEQ ID NO: 1576701 - RNA, 13 nt, Human adenovirus E
gagauccacggcc

SEQ ID NO: 1576702 - RNA, 22 nt, Human adenovirus E
ggccagaucguccagggcagcu

SEQ ID NO: 1576703 - RNA, 19 nt, Human adenovirus E
accgcucccuggccugcaa

SEQ ID NO: 1576704 - RNA, 19 nt, Human adenovirus E
gcagcggccgaggcggcug

SEQ ID NO: 1576705 - RNA, 23 nt, Human adenovirus E
aaauuccucaaaugcuaccgcca

SEQ ID NO: 1576706 - RNA, 16 nt, Human adenovirus E
uucuccuagggaggaa

SEQ ID NO: 1576707 - RNA, 20 nt, Human adenovirus E
cugagcauucacaugcucau

SEQ ID NO: 1576708 - RNA, 13 nt, Human adenovirus E
gagcgaccaggag

SEQ ID NO: 1576709 - RNA, 18 nt, Human adenovirus E
gccauguucagggcggcc

SEQ ID NO: 1576710 - RNA, 22 nt, Human adenovirus E
gcuugccauucgcgcacggcca

SEQ ID NO: 1576711 - RNA, 19 nt, Human adenovirus E
accgggugauccuccacca

SEQ ID NO: 1576712 - RNA, 13 nt, Human adenovirus E
aauucaaggaaga

SEQ ID NO: 1576713 - RNA, 19 nt, Human adenovirus E
gccugcugacgccgaacuc

SEQ ID NO: 1576714 - RNA, 23 nt, Human adenovirus E
auggugaccgacgugcgcgaggc

SEQ ID NO: 1576715 - RNA, 18 nt, Human adenovirus E
caguauccgcagcagcga

SEQ ID NO: 1576716 - RNA, 16 nt, Human adenovirus E
ggauggcuggcagagc

SEQ ID NO: 1576717 - RNA, 17 nt, Human adenovirus E
auacaccacccucuccc

SEQ ID NO: 1576718 - RNA, 21 nt, Human adenovirus E
uaaagauggaaaauuauccuu

SEQ ID NO: 1576719 - RNA, 23 nt, Human adenovirus E
ccucgcucugguggccaacgcca

SEQ ID NO: 1576720 - RNA, 14 nt, Human adenovirus E
cuacgucguggugg

SEQ ID NO: 1576721 - RNA, 16 nt, Human adenovirus E
gggcacgauucugacc

SEQ ID NO: 1576722 - RNA, 15 nt, Human adenovirus E
ugacugacccacugg

SEQ ID NO: 1576723 - RNA, 22 nt, Human adenovirus E
ggccaccucgccgcgcaggggc

SEQ ID NO: 1576724 - RNA, 21 nt, Human adenovirus E
accgcaacucguaccugggcu

SEQ ID NO: 1576725 - RNA, 15 nt, Human adenovirus E
cgauuggacccaggc

SEQ ID NO: 1576726 - RNA, 12 nt, Human adenovirus E
caccaucaucuu

SEQ ID NO: 1576727 - RNA, 13 nt, Human adenovirus E
augcgcaggagca

SEQ ID NO: 1576728 - RNA, 11 nt, Human adenovirus E
acaccacccuc

SEQ ID NO: 1576729 - RNA, 20 nt, Human adenovirus E
cuccuucagcgcgcgcugcc

SEQ ID NO: 1576730 - RNA, 14 nt, Human adenovirus E
cggccucggugcac

SEQ ID NO: 1576731 - RNA, 20 nt, Human adenovirus E
gcuccggaauccugcccgcc

SEQ ID NO: 1576732 - RNA, 18 nt, Human adenovirus E
caugguggucccgugcag

SEQ ID NO: 1576733 - RNA, 16 nt, Human adenovirus E
gccaucgccaaccucg

SEQ ID NO: 1576734 - RNA, 13 nt, Human adenovirus E
cguaccagauccu

SEQ ID NO: 1576735 - RNA, 12 nt, Human adenovirus E
cggaugaagcac

SEQ ID NO: 1576736 - RNA, 13 nt, Human adenovirus E
gggcggcaggggc

SEQ ID NO: 1576737 - RNA, 21 nt, Human adenovirus E
gggagcugcggcgcggccugg

SEQ ID NO: 1576738 - RNA, 23 nt, Human adenovirus E
gcgcaaacccgggagcugaggaa

SEQ ID NO: 1576739 - RNA, 14 nt, Human adenovirus E
ucaccaccucccgg

SEQ ID NO: 1576740 - RNA, 17 nt, Human adenovirus E
gaaaaauccuccaggug

SEQ ID NO: 1576741 - RNA, 19 nt, Human adenovirus E
ccggggccaggaggacuac

SEQ ID NO: 1576742 - RNA, 13 nt, Human adenovirus E
aggccgugcagcg

SEQ ID NO: 1576743 - RNA, 22 nt, Human adenovirus E
gcccgacaugaugcaagacccg

SEQ ID NO: 1576744 - RNA, 19 nt, Human adenovirus E
gaugcaggggcggcagggg

SEQ ID NO: 1576745 - RNA, 23 nt, Human adenovirus E
cccauggugggcacgcacccggg

SEQ ID NO: 1576746 - RNA, 17 nt, Human adenovirus E
cucagcguggaggagcu

SEQ ID NO: 1576747 - RNA, 17 nt, Human adenovirus E
gagaccgagcuccagcu

SEQ ID NO: 1576748 - RNA, 14 nt, Human adenovirus E
cugaguuugggcaa

SEQ ID NO: 1576749 - RNA, 14 nt, Human adenovirus E
agacaggagcggcg

SEQ ID NO: 1576750 - RNA, 12 nt, Human adenovirus E
ccaccuccugau

SEQ ID NO: 1576751 - RNA, 22 nt, Human adenovirus E
caauuacucacaccacacacac

SEQ ID NO: 1576752 - RNA, 18 nt, Human adenovirus E
cagcuaccuccagugccu

SEQ ID NO: 1576753 - RNA, 19 nt, Human adenovirus E
acggggugguggaccuggc

SEQ ID NO: 1576754 - RNA, 14 nt, Human adenovirus E
gacgcgcggccacg

SEQ ID NO: 1576755 - RNA, 17 nt, Human adenovirus E
gccuucaauuggagcag

SEQ ID NO: 1576756 - RNA, 20 nt, Human adenovirus E
gggcauucgcaagaggcagc

SEQ ID NO: 1576757 - RNA, 13 nt, Human adenovirus E
guaccucaccugg

SEQ ID NO: 1576758 - RNA, 15 nt, Human adenovirus E
gccgguccucgagcg

SEQ ID NO: 1576759 - RNA, 21 nt, Human adenovirus E
ccguguugcucuacuacaucu

SEQ ID NO: 1576760 - RNA, 20 nt, Human adenovirus E
caaaaccauaucccagggca

SEQ ID NO: 1576761 - RNA, 15 nt, Human adenovirus E
gaagacgcgcgccgg

SEQ ID NO: 1576762 - RNA, 20 nt, Human adenovirus E
ccaguucauugacuggaucu

SEQ ID NO: 1576763 - RNA, 21 nt, Human adenovirus E
aagguccagaaaaagccacag

SEQ ID NO: 1576764 - RNA, 22 nt, Human adenovirus E
gccuacgaguugaaccucuucu

SEQ ID NO: 1576765 - RNA, 23 nt, Human adenovirus E
aagccuccacgcgcacauccaga

SEQ ID NO: 1576766 - RNA, 20 nt, Human adenovirus E
guccauaguucaacacgcuc

SEQ ID NO: 1576767 - RNA, 12 nt, Human adenovirus E
gcuucaggcgcc

SEQ ID NO: 1576768 - RNA, 16 nt, Human adenovirus E
gcgagacgcccaggcc

SEQ ID NO: 1576769 - RNA, 13 nt, Human adenovirus E
cugccgcccgugg

SEQ ID NO: 1576770 - RNA, 20 nt, Human adenovirus E
ccaucgagauugaccugggc

SEQ ID NO: 1576771 - RNA, 14 nt, Human adenovirus E
acgcugcccacgua

SEQ ID NO: 1576772 - RNA, 15 nt, Human adenovirus E
cuggcgggggcacaa

SEQ ID NO: 1576773 - RNA, 16 nt, Human adenovirus E
gaggaagacugggaga

SEQ ID NO: 1576774 - RNA, 15 nt, Human adenovirus E
ccagcacccagacca

SEQ ID NO: 1576775 - RNA, 22 nt, Human adenovirus E
cugcaagacagucuggaggaag

SEQ ID NO: 1576776 - RNA, 14 nt, Human adenovirus E
cguccgcgccgcag

SEQ ID NO: 1576777 - RNA, 24 nt, Human adenovirus E
cuugcgcaaguucgugcccgagga

SEQ ID NO: 1576778 - RNA, 22 nt, Human adenovirus E
ccugguccgggcgcugcacacc

SEQ ID NO: 1576779 - RNA, 16 nt, Human adenovirus E
cucccucggugaagaa

SEQ ID NO: 1576780 - RNA, 14 nt, Human adenovirus E
accaugcuagccug

SEQ ID NO: 1576781 - RNA, 17 nt, Human adenovirus E
ucacgggacccugccgc

SEQ ID NO: 1576782 - RNA, 22 nt, Human adenovirus E
gggcccgugggcggcggccugg

SEQ ID NO: 1576783 - RNA, 20 nt, Human adenovirus E
cggcauggcccgcgggcagg

SEQ ID NO: 1576784 - RNA, 12 nt, Human adenovirus E
accuccacagcc

SEQ ID NO: 1576785 - RNA, 17 nt, Human adenovirus E
ggagcggcgaggagccc

SEQ ID NO: 1576786 - RNA, 15 nt, Human adenovirus E
ugcccgcgcggggca

SEQ ID NO: 1576787 - RNA, 19 nt, Human adenovirus E
caugagcgcggucauggac

SEQ ID NO: 1576788 - RNA, 16 nt, Human adenovirus E
gugcgcgccgggcugg

SEQ ID NO: 1576789 - RNA, 16 nt, Human adenovirus E
gcagggcgcccagcag

SEQ ID NO: 1576790 - RNA, 15 nt, Human adenovirus E
uacuucaaaaugaag

SEQ ID NO: 1576791 - RNA, 13 nt, Human adenovirus E
acuuuuuccaccc

SEQ ID NO: 1576792 - RNA, 14 nt, Human adenovirus E
cagcgcagccaggg

SEQ ID NO: 1576793 - RNA, 17 nt, Human adenovirus E
aggcgauggcggcggcg

SEQ ID NO: 1576794 - RNA, 18 nt, Human adenovirus E
cucguacccguggaucau

SEQ ID NO: 1576795 - RNA, 14 nt, Human adenovirus E
ucaaacgcccaaaa

SEQ ID NO: 1576796 - RNA, 16 nt, Human adenovirus E
acuuggccagccacuu

SEQ ID NO: 1576797 - RNA, 15 nt, Human adenovirus E
cgggcaucagcugga

SEQ ID NO: 1576798 - RNA, 15 nt, Human adenovirus E
gcuggcggugcucaa

SEQ ID NO: 1576799 - RNA, 13 nt, Human adenovirus E
uccuucucgguga

SEQ ID NO: 1576800 - RNA, 15 nt, Human adenovirus E
cgacaugcccgaccc

SEQ ID NO: 1576801 - RNA, 16 nt, Human adenovirus E
cggucauaccagcagc

SEQ ID NO: 1576802 - RNA, 16 nt, Human adenovirus E
ccccacggaggccagc

SEQ ID NO: 1576803 - RNA, 22 nt, Human adenovirus E
agggcccagcgaaggcgagggu

SEQ ID NO: 1576804 - RNA, 11 nt, Human adenovirus E
augagcugggc

SEQ ID NO: 1576805 - RNA, 15 nt, Human adenovirus E
cgcgucaguugcagg

SEQ ID NO: 1576806 - RNA, 20 nt, Human adenovirus E
aaccugagccaggcuuucaa

SEQ ID NO: 1576807 - RNA, 14 nt, Human adenovirus E
uugcaagcgccgca

SEQ ID NO: 1576808 - RNA, 14 nt, Human adenovirus E
gcgcugcagagcca

SEQ ID NO: 1576809 - RNA, 16 nt, Human adenovirus E
uggccagaucguccag

SEQ ID NO: 1576810 - RNA, 13 nt, Human adenovirus E
cgcgguaccuggc

SEQ ID NO: 1576811 - RNA, 19 nt, Human adenovirus E
aacauucuggccugcaccc

SEQ ID NO: 1576812 - RNA, 21 nt, Human adenovirus E
cccugggccaggacgacccgg

SEQ ID NO: 1576813 - RNA, 16 nt, Human adenovirus E
ggcgcggaggaaggaa

SEQ ID NO: 1576814 - RNA, 16 nt, Human adenovirus E
uccccgcgcuccugga

SEQ ID NO: 1576815 - RNA, 21 nt, Human adenovirus E
cuccuagaacagucagcgcuc

SEQ ID NO: 1576816 - RNA, 22 nt, Human adenovirus E
cugggccaggacgacccgggca

SEQ ID NO: 1576817 - RNA, 13 nt, Human adenovirus E
gcaaccugcuggg

SEQ ID NO: 1576818 - RNA, 18 nt, Human adenovirus E
uaagaaaaucaacaaaag

SEQ ID NO: 1576819 - RNA, 15 nt, Human adenovirus E
caagcgccgcagcag

SEQ ID NO: 1576820 - RNA, 13 nt, Human adenovirus E
gguacuuggccag

SEQ ID NO: 1576821 - RNA, 18 nt, Human adenovirus E
augauccagcggcggagc

SEQ ID NO: 1576822 - RNA, 14 nt, Human adenovirus E
ugggcccgugggcg

SEQ ID NO: 1576823 - RNA, 17 nt, Human adenovirus E
ccagccccgccaccucc

SEQ ID NO: 1576824 - RNA, 17 nt, Human adenovirus E
cuggaggccguggugcc

SEQ ID NO: 1576825 - RNA, 23 nt, Human adenovirus E
gucguuggagaugcggcccauga

SEQ ID NO: 1576826 - RNA, 20 nt, Human adenovirus E
cugcgagcccaacccgcgcc

SEQ ID NO: 1576827 - RNA, 17 nt, Human adenovirus E
caucgauggugaagaug

SEQ ID NO: 1576828 - RNA, 19 nt, Human adenovirus E
gcgaucccauuugagcugg

SEQ ID NO: 1576829 - RNA, 21 nt, Human adenovirus E
gacgcgcgccgggcggcaggg

SEQ ID NO: 1576830 - RNA, 14 nt, Human adenovirus E
gacccugcgcaagg

SEQ ID NO: 1576831 - RNA, 17 nt, Human adenovirus E
uagcauuaccacacaga

SEQ ID NO: 1576832 - RNA, 20 nt, Human adenovirus E
augcauagucugcagcgggc

SEQ ID NO: 1576833 - RNA, 22 nt, Human adenovirus E
gagcucuaaccuguccacccgc

SEQ ID NO: 1576834 - RNA, 12 nt, Human adenovirus E
guggugcaggag

SEQ ID NO: 1576835 - RNA, 22 nt, Human adenovirus E
cugcagcgggcccugaccgggg

SEQ ID NO: 1576836 - RNA, 17 nt, Human adenovirus E
gcagccguagcuaccgc

SEQ ID NO: 1576837 - RNA, 16 nt, Human adenovirus E
ucaccuccacagcccc

SEQ ID NO: 1576838 - RNA, 16 nt, Human adenovirus E
cgggagcugcggcgcg

SEQ ID NO: 1576839 - RNA, 23 nt, Human adenovirus E
cagcugggacuugccgcagccgg

SEQ ID NO: 1576840 - RNA, 19 nt, Human adenovirus E
cccgccccaguacgcgcuc

SEQ ID NO: 1576841 - RNA, 22 nt, Human adenovirus E
acuccuagaacagucagcgcuc

SEQ ID NO: 1576842 - RNA, 12 nt, Human adenovirus E
caacggccugcc

SEQ ID NO: 1576843 - RNA, 20 nt, Human adenovirus E
cuggugaacauucugcagag

SEQ ID NO: 1576844 - RNA, 14 nt, Human adenovirus E
ucauguacagcaac

SEQ ID NO: 1576845 - RNA, 13 nt, Human adenovirus E
cgggcacuuccgc

SEQ ID NO: 1576846 - RNA, 21 nt, Human adenovirus E
caggagggggccacccccagc

SEQ ID NO: 1576847 - RNA, 18 nt, Human adenovirus E
cgagcugagcgaccagga

SEQ ID NO: 1576848 - RNA, 16 nt, Human adenovirus E
caacucguaccugggc

SEQ ID NO: 1576849 - RNA, 17 nt, Human adenovirus E
auuacuccccuccugca

SEQ ID NO: 1576850 - RNA, 23 nt, Human adenovirus E
gcaugcaauggcagaucacccug

SEQ ID NO: 1576851 - RNA, 17 nt, Human adenovirus E
uacagaaagcacagacu

SEQ ID NO: 1576852 - RNA, 16 nt, Human adenovirus E
caaguuucuccaccau

SEQ ID NO: 1576853 - RNA, 17 nt, Human adenovirus E
cuugcagggccuguggg

SEQ ID NO: 1576854 - RNA, 17 nt, Human adenovirus E
gccuaggccacaauaca

SEQ ID NO: 1576855 - RNA, 23 nt, Human adenovirus E
acaugcagccccggaugauccug

SEQ ID NO: 1576856 - RNA, 15 nt, Human adenovirus E
aagccuccacgcgca

SEQ ID NO: 1576857 - RNA, 23 nt, Human adenovirus E
gagacugauggccacgggcagcc

SEQ ID NO: 1576858 - RNA, 21 nt, Human adenovirus E
gagcagucucuggagcgggcu

SEQ ID NO: 1576859 - RNA, 22 nt, Human adenovirus E
gcccaacuacgcgcugcauccu

SEQ ID NO: 1576860 - RNA, 14 nt, Human adenovirus E
acgcgcugguggag

SEQ ID NO: 1576861 - RNA, 15 nt, Human adenovirus E
caucgucaaggaugc

SEQ ID NO: 1576862 - RNA, 23 nt, Human adenovirus E
gaggacgcgcucaucaagcaucu

SEQ ID NO: 1576863 - RNA, 13 nt, Human adenovirus E
cgcgcgcugcccg

SEQ ID NO: 1576864 - RNA, 13 nt, Human adenovirus E
uccgcgcccaccg

SEQ ID NO: 1576865 - RNA, 15 nt, Human adenovirus E
uaucuuugaggagga

SEQ ID NO: 1576866 - RNA, 19 nt, Human adenovirus E
gaucaaauuauacacugaa

SEQ ID NO: 1576867 - RNA, 18 nt, Human adenovirus E
gauccagcagaccuccuc

SEQ ID NO: 1576868 - RNA, 13 nt, Human adenovirus E
ccgcccuggugcg

SEQ ID NO: 1576869 - RNA, 21 nt, Human adenovirus E
acgggauagaaagccuggugg

SEQ ID NO: 1576870 - RNA, 17 nt, Human adenovirus E
acgccuagaaugaccac

SEQ ID NO: 1576871 - RNA, 23 nt, Human adenovirus E
guggaccuggccaaccaggccgu

SEQ ID NO: 1576872 - RNA, 14 nt, Human adenovirus E
gcggcgcacgggca

SEQ ID NO: 1576873 - RNA, 15 nt, Human adenovirus E
gcaagcgccgcagca

SEQ ID NO: 1576874 - RNA, 17 nt, Human adenovirus E
ccucugcacgccgcacc

SEQ ID NO: 1576875 - RNA, 13 nt, Human adenovirus E
aacggccugcccg

SEQ ID NO: 1576876 - RNA, 16 nt, Human adenovirus E
cgugccccggggccag

SEQ ID NO: 1576877 - RNA, 15 nt, Human adenovirus E
cagggcgcccagcag

SEQ ID NO: 1576878 - RNA, 23 nt, Human adenovirus E
cacgccgagccucaagcccguga

SEQ ID NO: 1576879 - RNA, 14 nt, Human adenovirus E
auauucugcuccug

SEQ ID NO: 1576880 - RNA, 16 nt, Human adenovirus E
gagcccaacccgcgcc

SEQ ID NO: 1576881 - RNA, 22 nt, Human adenovirus E
acugcgucuaccucuaccucug

SEQ ID NO: 1576882 - RNA, 20 nt, Human adenovirus E
caacgugcagaccaaccugg

SEQ ID NO: 1576883 - RNA, 18 nt, Human adenovirus E
ucaugggcaccuggagcg

SEQ ID NO: 1576884 - RNA, 19 nt, Human adenovirus E
cgcgagacgcccaggccga

SEQ ID NO: 1576885 - RNA, 20 nt, Human adenovirus E
cgccguugucaaccacugcg

SEQ ID NO: 1576886 - RNA, 19 nt, Human adenovirus E
aacgagggcguggcugccc

SEQ ID NO: 1576887 - RNA, 13 nt, Human adenovirus E
auccacagcggcg

SEQ ID NO: 1576888 - RNA, 17 nt, Human adenovirus E
cugugggaccugcugga

SEQ ID NO: 1576889 - RNA, 15 nt, Human adenovirus E
cgauguggacagcag

SEQ ID NO: 1576890 - RNA, 16 nt, Human adenovirus E
ggacucgggggcguag

SEQ ID NO: 1576891 - RNA, 16 nt, Human adenovirus E
cggcuccccgcgcacc

SEQ ID NO: 1576892 - RNA, 17 nt, Human adenovirus E
cgagggggcgaggagcc

SEQ ID NO: 1576893 - RNA, 18 nt, Human adenovirus E
agagcuguccgugucccc

SEQ ID NO: 1576894 - RNA, 15 nt, Human adenovirus E
ugcacgugcugcacg

SEQ ID NO: 1576895 - RNA, 18 nt, Human adenovirus E
gccggcggcggcgcaucg

SEQ ID NO: 1576896 - RNA, 13 nt, Human adenovirus E
ucccaggacaugg

SEQ ID NO: 1576897 - RNA, 16 nt, Human adenovirus E
aucucccgccugaacc

SEQ ID NO: 1576898 - RNA, 11 nt, Human adenovirus E
cuugcugcuau

SEQ ID NO: 1576899 - RNA, 21 nt, Human adenovirus E
cacuuagcauuaccacacaga

SEQ ID NO: 1576900 - RNA, 17 nt, Human adenovirus E
agcggugugccgcgguc

SEQ ID NO: 1576901 - RNA, 21 nt, Human adenovirus E
ccugcucgggcaucagcugga

SEQ ID NO: 1576902 - RNA, 21 nt, Human adenovirus E
uucacuccccucuucccagcu

SEQ ID NO: 1576903 - RNA, 16 nt, Human adenovirus E
uucuuaucugccuccu

SEQ ID NO: 1576904 - RNA, 15 nt, Human adenovirus E
caccacagcaaccuc

SEQ ID NO: 1576905 - RNA, 14 nt, Human adenovirus E
gcucccuggggcgc

SEQ ID NO: 1576906 - RNA, 17 nt, Human adenovirus E
ucggcaccagccaacug

SEQ ID NO: 1576907 - RNA, 16 nt, Human adenovirus E
ucaacuccuccuccag

SEQ ID NO: 1576908 - RNA, 22 nt, Human adenovirus E
ccugaucccgaauaccacagcg

SEQ ID NO: 1576909 - RNA, 15 nt, Human adenovirus E
gcuaccuccagugcc

SEQ ID NO: 1576910 - RNA, 18 nt, Human adenovirus E
cagaaccugaaagagcuc

SEQ ID NO: 1576911 - RNA, 18 nt, Human adenovirus E
uacgcgcacuuccucaaa

SEQ ID NO: 1576912 - RNA, 21 nt, Human adenovirus E
cuccuucagcgcgcgcugccc

SEQ ID NO: 1576913 - RNA, 16 nt, Human adenovirus E
agacagcagccccagg

SEQ ID NO: 1576914 - RNA, 20 nt, Human adenovirus E
acucccucagcaugaugccc

SEQ ID NO: 1576915 - RNA, 19 nt, Human adenovirus E
ugugggaccugcuggaggc

SEQ ID NO: 1576916 - RNA, 20 nt, Human adenovirus E
caacauccccgcgcuccugg

SEQ ID NO: 1576917 - RNA, 22 nt, Human adenovirus E
agcccgugcugcucgagcgccc

SEQ ID NO: 1576918 - RNA, 12 nt, Human adenovirus E
uuauacauguga

SEQ ID NO: 1576919 - RNA, 16 nt, Human adenovirus E
gcccggcaggccacca

SEQ ID NO: 1576920 - RNA, 18 nt, Human adenovirus E
guggccagaucguccagg

SEQ ID NO: 1576921 - RNA, 16 nt, Human adenovirus E
cuguaguggugugcau

SEQ ID NO: 1576922 - RNA, 18 nt, Human adenovirus E
gucaccuccacagccccu

SEQ ID NO: 1576923 - RNA, 21 nt, Human adenovirus E
ugccgcccaggacuacuccac

SEQ ID NO: 1576924 - RNA, 15 nt, Human adenovirus E
caggccgugcagcgg

SEQ ID NO: 1576925 - RNA, 16 nt, Human adenovirus E
cguuacgugcagcaga

SEQ ID NO: 1576926 - RNA, 21 nt, Human adenovirus E
gcucugcaaggagaaggagga

SEQ ID NO: 1576927 - RNA, 13 nt, Human adenovirus E
ggauggcuggcag

SEQ ID NO: 1576928 - RNA, 18 nt, Human adenovirus E
ggggaacccguccugauc

SEQ ID NO: 1576929 - RNA, 18 nt, Human adenovirus E
ccgcauccccaaauucaa

SEQ ID NO: 1576930 - RNA, 21 nt, Human adenovirus E
cucuuugccuucaccaccugc

SEQ ID NO: 1576931 - RNA, 15 nt, Human adenovirus E
agacuccgaggaggg

SEQ ID NO: 1576932 - RNA, 21 nt, Human adenovirus E
augcaagacccggucaccuuc

SEQ ID NO: 1576933 - RNA, 20 nt, Human adenovirus E
uggccugcaacccccagcug

SEQ ID NO: 1576934 - RNA, 13 nt, Human adenovirus E
cgcgcggcccggu

SEQ ID NO: 1576935 - RNA, 15 nt, Human adenovirus E
gcucccuggggcgcc

SEQ ID NO: 1576936 - RNA, 21 nt, Human adenovirus E
cuggaggccaucgugcagaac

SEQ ID NO: 1576937 - RNA, 21 nt, Human adenovirus E
cccagguuggugcgacugggc

SEQ ID NO: 1576938 - RNA, 16 nt, Human adenovirus E
uaccaguccgggccgg

SEQ ID NO: 1576939 - RNA, 16 nt, Human adenovirus E
aucugggagcugaaca

SEQ ID NO: 1576940 - RNA, 19 nt, Human adenovirus E
gcccccgcuggaggcuccu

SEQ ID NO: 1576941 - RNA, 23 nt, Human adenovirus E
gcagcugaagcaacugcagccgu

SEQ ID NO: 1576942 - RNA, 23 nt, Human adenovirus E
gcagguccagaccucggcgcgag

SEQ ID NO: 1576943 - RNA, 16 nt, Human adenovirus E
cuccugcacaggcagc

SEQ ID NO: 1576944 - RNA, 19 nt, Human adenovirus E
gcgcgaguucgccccccgg

SEQ ID NO: 1576945 - RNA, 16 nt, Human adenovirus E
gaagcguucagggagg

SEQ ID NO: 1576946 - RNA, 22 nt, Human adenovirus E
gcucgacuccguggccuggagg

SEQ ID NO: 1576947 - RNA, 16 nt, Human adenovirus E
accucgacccccagac

SEQ ID NO: 1576948 - RNA, 16 nt, Human adenovirus E
gugccccggggccagg

SEQ ID NO: 1576949 - RNA, 14 nt, Human adenovirus E
cgaggcauacgugc

SEQ ID NO: 1576950 - RNA, 12 nt, Human adenovirus E
cagcacucucaa

SEQ ID NO: 1576951 - RNA, 16 nt, Human adenovirus E
cuccaccuccacccac

SEQ ID NO: 1576952 - RNA, 16 nt, Human adenovirus E
gggggcagggggucca

SEQ ID NO: 1576953 - RNA, 19 nt, Human adenovirus E
acgaagcccugcaggaagc

SEQ ID NO: 1576954 - RNA, 15 nt, Human adenovirus E
uggccaacuaccugg

SEQ ID NO: 1576955 - RNA, 14 nt, Human adenovirus E
ucaggaugagcuga

SEQ ID NO: 1576956 - RNA, 17 nt, Human adenovirus E
ugcuaacgagcgccccu

SEQ ID NO: 1576957 - RNA, 15 nt, Human adenovirus E
caagaagcugaaagu

SEQ ID NO: 1576958 - RNA, 18 nt, Human adenovirus E
gcagagcgcccuccaccg

SEQ ID NO: 1576959 - RNA, 12 nt, Human adenovirus E
ccacaguacaga

SEQ ID NO: 1576960 - RNA, 22 nt, Human adenovirus E
ucuggaggaagacgaggaggag

SEQ ID NO: 1576961 - RNA, 13 nt, Human adenovirus E
ccggucaccuucc

SEQ ID NO: 1576962 - RNA, 18 nt, Human adenovirus E
ggccugcgucaucaccca

SEQ ID NO: 1576963 - RNA, 23 nt, Human adenovirus E
uuaacagaacauucuacacuaaa

SEQ ID NO: 1576964 - RNA, 22 nt, Human adenovirus E
cacgcccagcacacgcccagaa

SEQ ID NO: 1576965 - RNA, 19 nt, Human adenovirus E
ggagcuaccagccccagau

SEQ ID NO: 1576966 - RNA, 13 nt, Human adenovirus E
cugcaagcuccug

SEQ ID NO: 1576967 - RNA, 18 nt, Human adenovirus E
ccggcucccccggccacu

SEQ ID NO: 1576968 - RNA, 13 nt, Human adenovirus E
aaaaucagaccca

SEQ ID NO: 1576969 - RNA, 14 nt, Human adenovirus E
accucugccacacc

SEQ ID NO: 1576970 - RNA, 21 nt, Human adenovirus E
ccagaucauguacgaggaucu

SEQ ID NO: 1576971 - RNA, 23 nt, Human adenovirus E
ucaccaaggccauggcgaccagc

SEQ ID NO: 1576972 - RNA, 15 nt, Human adenovirus E
uccaccugcggggcg

SEQ ID NO: 1576973 - RNA, 14 nt, Human adenovirus E
acucaagggucugu

SEQ ID NO: 1576974 - RNA, 20 nt, Human adenovirus E
ugucccaugguggcgcagcu

SEQ ID NO: 1576975 - RNA, 17 nt, Human adenovirus E
ugcugcucgagcgccca

SEQ ID NO: 1576976 - RNA, 15 nt, Human adenovirus E
cucagcucaaaaugg

SEQ ID NO: 1576977 - RNA, 16 nt, Human adenovirus E
gucucgccgcgccggc

SEQ ID NO: 1576978 - RNA, 13 nt, Human adenovirus E
uugcuugcugcua

SEQ ID NO: 1576979 - RNA, 13 nt, Human adenovirus E
cggcgaggagccc

SEQ ID NO: 1576980 - RNA, 13 nt, Human adenovirus E
gcggaugaagcac

SEQ ID NO: 1576981 - RNA, 21 nt, Human adenovirus E
gcuguucguacuuaguggugc

SEQ ID NO: 1576982 - RNA, 13 nt, Human adenovirus E
acuugccgcagcc

SEQ ID NO: 1576983 - RNA, 20 nt, Human adenovirus E
cgccgacgagaagcagcagc

SEQ ID NO: 1576984 - RNA, 19 nt, Human adenovirus E
acggcguacgagcagaccg

SEQ ID NO: 1576985 - RNA, 19 nt, Human adenovirus E
ggcugcaaacuuccuccac

SEQ ID NO: 1576986 - RNA, 19 nt, Human adenovirus E
gguaaaucguucucuccag

SEQ ID NO: 1576987 - RNA, 22 nt, Human adenovirus E
ccuggaugucgacgccuaugag

SEQ ID NO: 1576988 - RNA, 22 nt, Human adenovirus E
aguaauaacaccgguuggggcc

SEQ ID NO: 1576989 - RNA, 22 nt, Human adenovirus E
gaggagcucaaccccggcuucc

SEQ ID NO: 1576990 - RNA, 12 nt, Human adenovirus E
cgagcgccucag

SEQ ID NO: 1576991 - RNA, 18 nt, Human adenovirus E
cguccguguggcagcccg

SEQ ID NO: 1576992 - RNA, 18 nt, Human adenovirus E
ggacagaggagggacuug

SEQ ID NO: 1576993 - RNA, 22 nt, Human adenovirus E
ggccagcugcaccacgcugcgc

SEQ ID NO: 1576994 - RNA, 16 nt, Human adenovirus E
agaagaggcagcagca

SEQ ID NO: 1576995 - RNA, 19 nt, Human adenovirus E
cgugcagcagaagcguggg

SEQ ID NO: 1576996 - RNA, 23 nt, Human adenovirus E
gcggcagcggccaucgccagcau

SEQ ID NO: 1576997 - RNA, 13 nt, Human adenovirus E
guagucuggagaa

SEQ ID NO: 1576998 - RNA, 17 nt, Human adenovirus E
ccaacgccauccugaau

SEQ ID NO: 1576999 - RNA, 16 nt, Human adenovirus E
agcacucaacccaccc

SEQ ID NO: 1577000 - RNA, 22 nt, Human adenovirus E
caguuauuuuuccuccacccuc

SEQ ID NO: 1577001 - RNA, 14 nt, Human adenovirus E
gcgcgcgcugcccg

SEQ ID NO: 1577002 - RNA, 14 nt, Human adenovirus E
cuaugccuucugcu

SEQ ID NO: 1577003 - RNA, 14 nt, Human adenovirus E
acgaggaccaaucc

SEQ ID NO: 1577004 - RNA, 12 nt, Human adenovirus E
ugauggacaugc

SEQ ID NO: 1577005 - RNA, 17 nt, Human adenovirus E
gcuggcagagccccuuc

SEQ ID NO: 1577006 - RNA, 19 nt, Human adenovirus E
ccacgcgcacauccagaaa

SEQ ID NO: 1577007 - RNA, 23 nt, Human adenovirus E
ucaugagcgcggucauggaccag

SEQ ID NO: 1577008 - RNA, 19 nt, Human adenovirus E
ccgccggugccgcccagga

SEQ ID NO: 1577009 - RNA, 15 nt, Human adenovirus E
accuccaccugagcg

SEQ ID NO: 1577010 - RNA, 12 nt, Human adenovirus E
acaguacagaua

SEQ ID NO: 1577011 - RNA, 17 nt, Human adenovirus E
gagggucugggcagcga

SEQ ID NO: 1577012 - RNA, 22 nt, Human adenovirus E
ccgcguaauuggcccgccgccc

SEQ ID NO: 1577013 - RNA, 19 nt, Human adenovirus E
ccccucagcguggaggagc

SEQ ID NO: 1577014 - RNA, 14 nt, Human adenovirus E
gaccaggugcucau

SEQ ID NO: 1577015 - RNA, 14 nt, Human adenovirus E
agauguugaagugg

SEQ ID NO: 1577016 - RNA, 18 nt, Human adenovirus E
aacaguccauaguucaac

SEQ ID NO: 1577017 - RNA, 18 nt, Human adenovirus E
auggugaagaugccgggc

SEQ ID NO: 1577018 - RNA, 17 nt, Human adenovirus E
ccaccacuacagcagca

SEQ ID NO: 1577019 - RNA, 14 nt, Human adenovirus E
gaagcaagcuccag

SEQ ID NO: 1577020 - RNA, 22 nt, Human adenovirus E
gauaaaccgaaguccuccccag

SEQ ID NO: 1577021 - RNA, 16 nt, Human adenovirus E
cgggacgcagggccau

SEQ ID NO: 1577022 - RNA, 15 nt, Human adenovirus E
auucccacggagccc

SEQ ID NO: 1577023 - RNA, 22 nt, Human adenovirus E
cgcaaggucgaggagaaccugc

SEQ ID NO: 1577024 - RNA, 21 nt, Human adenovirus E
gcauucgcaagaggcagcccu

SEQ ID NO: 1577025 - RNA, 21 nt, Human adenovirus E
gagguacaugggcaugagccc

SEQ ID NO: 1577026 - RNA, 22 nt, Human adenovirus E
ucaaguuucugugucugaaccc

SEQ ID NO: 1577027 - RNA, 19 nt, Human adenovirus E
gcccgcgcuugcugggcga

SEQ ID NO: 1577028 - RNA, 22 nt, Human adenovirus E
cagaugcgcccccaccacccuc

SEQ ID NO: 1577029 - RNA, 19 nt, Human adenovirus E
cagcccccuccacagccgg

SEQ ID NO: 1577030 - RNA, 19 nt, Human adenovirus E
guagggacugaggggcgug

SEQ ID NO: 1577031 - RNA, 20 nt, Human adenovirus E
ucauugccgucauucaugga

SEQ ID NO: 1577032 - RNA, 13 nt, Human adenovirus E
aaaauccuccagg

SEQ ID NO: 1577033 - RNA, 13 nt, Human adenovirus E
aagcgccagccca

SEQ ID NO: 1577034 - RNA, 14 nt, Human adenovirus E
gaccugcuggaggc

SEQ ID NO: 1577035 - RNA, 16 nt, Human adenovirus E
cugcacuggcagccca

SEQ ID NO: 1577036 - RNA, 18 nt, Human adenovirus E
uacgaguugaaccucuuc

SEQ ID NO: 1577037 - RNA, 13 nt, Human adenovirus E
cuccgcuggguga

SEQ ID NO: 1577038 - RNA, 13 nt, Human adenovirus E
cuguaucccaccc

SEQ ID NO: 1577039 - RNA, 21 nt, Human adenovirus E
caggagcgcgggcugccgcug

SEQ ID NO: 1577040 - RNA, 17 nt, Human adenovirus E
cgaaggguaugcuuucg

SEQ ID NO: 1577041 - RNA, 19 nt, Human adenovirus E
augaaguaaaugcaagcgg

SEQ ID NO: 1577042 - RNA, 17 nt, Human adenovirus E
gucauggaccaggugcu

SEQ ID NO: 1577043 - RNA, 13 nt, Human adenovirus E
ucaaguccagcaa

SEQ ID NO: 1577044 - RNA, 15 nt, Human adenovirus E
caucgcuuacagccu

SEQ ID NO: 1577045 - RNA, 22 nt, Human adenovirus E
gcaaguacggcgcggccagccu

SEQ ID NO: 1577046 - RNA, 20 nt, Human adenovirus E
acgcccuuuucaaccugggu

SEQ ID NO: 1577047 - RNA, 21 nt, Human adenovirus E
cagcggcucgacuccguggcc

SEQ ID NO: 1577048 - RNA, 15 nt, Human adenovirus E
gcccgcgcuugcugg

SEQ ID NO: 1577049 - RNA, 17 nt, Human adenovirus E
ggcuaccgcggcacgcg

SEQ ID NO: 1577050 - RNA, 22 nt, Human adenovirus E
cuguuccugguggugcagcaua

SEQ ID NO: 1577051 - RNA, 19 nt, Human adenovirus E
ugcgucucgggacccugcc

SEQ ID NO: 1577052 - RNA, 13 nt, Human adenovirus E
cgguggggcggcc

SEQ ID NO: 1577053 - RNA, 12 nt, Human adenovirus E
aaauacuggggg

SEQ ID NO: 1577054 - RNA, 16 nt, Human adenovirus E
gcggauggcuggcaga

SEQ ID NO: 1577055 - RNA, 15 nt, Human adenovirus E
gucacccgccccgcc

SEQ ID NO: 1577056 - RNA, 17 nt, Human adenovirus E
uggaggagcucagccgc

SEQ ID NO: 1577057 - RNA, 14 nt, Human adenovirus E
cgggcggcaggggc

SEQ ID NO: 1577058 - RNA, 16 nt, Human adenovirus E
gaucuccuccucuuga

SEQ ID NO: 1577059 - RNA, 15 nt, Human adenovirus E
agcagcuggcccggu

SEQ ID NO: 1577060 - RNA, 23 nt, Human adenovirus E
cuggugcggcgggcgcagcagcg

SEQ ID NO: 1577061 - RNA, 16 nt, Human adenovirus E
cacagcggcggcagca

SEQ ID NO: 1577062 - RNA, 20 nt, Human adenovirus E
ggccacgagccggggcagcg

SEQ ID NO: 1577063 - RNA, 23 nt, Human adenovirus E
ucaggcugggcucgagcaugacg

SEQ ID NO: 1577064 - RNA, 19 nt, Human adenovirus E
cagcaugaugcccacggcc

SEQ ID NO: 1577065 - RNA, 20 nt, Human adenovirus E
cucucagaccgugcagcaga

SEQ ID NO: 1577066 - RNA, 19 nt, Human adenovirus E
ugccugauggcucugauca

SEQ ID NO: 1577067 - RNA, 16 nt, Human adenovirus E
ucguucucuccagcac

SEQ ID NO: 1577068 - RNA, 21 nt, Human adenovirus E
gcuggguccuaaugcuagucc

SEQ ID NO: 1577069 - RNA, 17 nt, Human adenovirus E
acggacagcggcagcau

SEQ ID NO: 1577070 - RNA, 22 nt, Human adenovirus E
cccgccaaauaaucacacacgc

SEQ ID NO: 1577071 - RNA, 16 nt, Human adenovirus E
cagcagaagcgugggc

SEQ ID NO: 1577072 - RNA, 18 nt, Human adenovirus E
cagcuccuccucggccug

SEQ ID NO: 1577073 - RNA, 23 nt, Human adenovirus E
cgcauccugcguuacgugcagca

SEQ ID NO: 1577074 - RNA, 19 nt, Human adenovirus E
uccacgguggcuuccagca

SEQ ID NO: 1577075 - RNA, 19 nt, Human adenovirus E
agaguguaccgccgcggcc

SEQ ID NO: 1577076 - RNA, 14 nt, Human adenovirus E
gggcuaacucuuau

SEQ ID NO: 1577077 - RNA, 15 nt, Human adenovirus E
cccgcguucugcgcg

SEQ ID NO: 1577078 - RNA, 16 nt, Human adenovirus E
ggugccggcggagaug

SEQ ID NO: 1577079 - RNA, 20 nt, Human adenovirus E
cgcgucaguugcagggcgcc

SEQ ID NO: 1577080 - RNA, 13 nt, Human adenovirus E
gcggcccaugagc

SEQ ID NO: 1577081 - RNA, 12 nt, Human adenovirus E
aauccuccaggu

SEQ ID NO: 1577082 - RNA, 22 nt, Human adenovirus E
acaguuagucucuccacuuaca

SEQ ID NO: 1577083 - RNA, 17 nt, Human adenovirus E
ggccaccuaccacaucu

SEQ ID NO: 1577084 - RNA, 22 nt, Human adenovirus E
guacgagagcgugaugcagcag

SEQ ID NO: 1577085 - RNA, 20 nt, Human adenovirus E
gugcugaaaacaccaccugg

SEQ ID NO: 1577086 - RNA, 16 nt, Human adenovirus E
cagcuugcccucggcc

SEQ ID NO: 1577087 - RNA, 14 nt, Human adenovirus E
gccaaaaaucagac

SEQ ID NO: 1577088 - RNA, 20 nt, Human adenovirus E
cugcuguuagugcucccccg

SEQ ID NO: 1577089 - RNA, 19 nt, Human adenovirus E
agcugcccgaggagcaccc

SEQ ID NO: 1577090 - RNA, 17 nt, Human adenovirus E
ucgacgagcgcaccacc

SEQ ID NO: 1577091 - RNA, 16 nt, Human adenovirus E
cccacggaggccagca

SEQ ID NO: 1577092 - RNA, 12 nt, Human adenovirus E
gcgccucaggcu

SEQ ID NO: 1577093 - RNA, 23 nt, Human adenovirus E
gcaucccagcuggaucaugauca

SEQ ID NO: 1577094 - RNA, 18 nt, Human adenovirus E
gaucccgcgaugcgggcg

SEQ ID NO: 1577095 - RNA, 18 nt, Human adenovirus E
uaccgucaccuccacagc

SEQ ID NO: 1577096 - RNA, 15 nt, Human adenovirus E
cgcgcggccacggcg

SEQ ID NO: 1577097 - RNA, 11 nt, Human adenovirus E
ggccugcaaga

SEQ ID NO: 1577098 - RNA, 13 nt, Human adenovirus E
cagcggcggcagc

SEQ ID NO: 1577099 - RNA, 12 nt, Human adenovirus E
cccgcgcggggc

SEQ ID NO: 1577100 - RNA, 16 nt, Human adenovirus E
cggggguucaagcgcg

SEQ ID NO: 1577101 - RNA, 15 nt, Human adenovirus E
gcccagcaccagcac

SEQ ID NO: 1577102 - RNA, 17 nt, Human adenovirus E
gaacagcagucaggcag

SEQ ID NO: 1577103 - RNA, 15 nt, Human adenovirus E
ugccgcugcaaccuc

SEQ ID NO: 1577104 - RNA, 18 nt, Human adenovirus E
ccaagagaagccccuggg

SEQ ID NO: 1577105 - RNA, 13 nt, Human adenovirus E
uuuuccuccaccc

SEQ ID NO: 1577106 - RNA, 24 nt, Human adenovirus E
uggaaggcgacaacgcgcggcugg

SEQ ID NO: 1577107 - RNA, 14 nt, Human adenovirus E
ggagugaugaagau

SEQ ID NO: 1577108 - RNA, 13 nt, Human adenovirus E
ggaggaagacugg

SEQ ID NO: 1577109 - RNA, 17 nt, Human adenovirus E
gcucacuaccaauaaca

SEQ ID NO: 1577110 - RNA, 14 nt, Human adenovirus E
cgccaccugcuccg

SEQ ID NO: 1577111 - RNA, 21 nt, Human adenovirus E
ccagauccucagguaaaucaa

SEQ ID NO: 1577112 - RNA, 18 nt, Human adenovirus E
uccaucauccccacgccg

SEQ ID NO: 1577113 - RNA, 17 nt, Human adenovirus E
ggcgaugcagcccccgc

SEQ ID NO: 1577114 - RNA, 17 nt, Human adenovirus E
gcugaccaaccuggucu

SEQ ID NO: 1577115 - RNA, 16 nt, Human adenovirus E
gcgaugcagcccccgc

SEQ ID NO: 1577116 - RNA, 21 nt, Human adenovirus E
cggugcccgaggcccuggcca

SEQ ID NO: 1577117 - RNA, 14 nt, Human adenovirus E
gcagaaccuggucc

SEQ ID NO: 1577118 - RNA, 14 nt, Human adenovirus E
gaucagccccgcgc

SEQ ID NO: 1577119 - RNA, 22 nt, Human adenovirus E
ggggggucggcaucgaugguga

SEQ ID NO: 1577120 - RNA, 14 nt, Human adenovirus E
agauggagccauag

SEQ ID NO: 1577121 - RNA, 13 nt, Human adenovirus E
caagccgcugacg

SEQ ID NO: 1577122 - RNA, 14 nt, Human adenovirus E
caacuucucggugc

SEQ ID NO: 1577123 - RNA, 16 nt, Human adenovirus E
gucacccgccccgccc

SEQ ID NO: 1577124 - RNA, 18 nt, Human adenovirus E
uguucagagacaggagcg

SEQ ID NO: 1577125 - RNA, 14 nt, Human adenovirus E
cucccuggggcgcc

SEQ ID NO: 1577126 - RNA, 13 nt, Human adenovirus E
ggaggagcuggca

SEQ ID NO: 1577127 - RNA, 18 nt, Human adenovirus E
aacagcccccuccacagc

SEQ ID NO: 1577128 - RNA, 21 nt, Human adenovirus E
guacaacgcgcugcuggagcg

SEQ ID NO: 1577129 - RNA, 23 nt, Human adenovirus E
cagacaacccacauuacacagac

SEQ ID NO: 1577130 - RNA, 13 nt, Human adenovirus E
ggcgcugcagagc

SEQ ID NO: 1577131 - RNA, 20 nt, Human adenovirus E
ccggaucgcuguccacgagc

SEQ ID NO: 1577132 - RNA, 22 nt, Human adenovirus E
cccugaaagugcugacccugag

SEQ ID NO: 1577133 - RNA, 12 nt, Human adenovirus E
cggcgcgugcag

SEQ ID NO: 1577134 - RNA, 22 nt, Human adenovirus E
cccgccgcuguggagccacugc

SEQ ID NO: 1577135 - RNA, 17 nt, Human adenovirus E
gcaaucaggcagcaccg

SEQ ID NO: 1577136 - RNA, 12 nt, Human adenovirus E
ccaggucucugu

SEQ ID NO: 1577137 - RNA, 12 nt, Human adenovirus E
guggaucuuuuc

SEQ ID NO: 1577138 - RNA, 15 nt, Human adenovirus E
guuggcacagcacag

SEQ ID NO: 1577139 - RNA, 18 nt, Human adenovirus E
cccugccgcgcgcgcgcu

SEQ ID NO: 1577140 - RNA, 14 nt, Human adenovirus E
ggcaccugcgagcc

SEQ ID NO: 1577141 - RNA, 15 nt, Human adenovirus E
cgugguccuggugac

SEQ ID NO: 1577142 - RNA, 23 nt, Human adenovirus E
  misc_feature (6)..(6): n is a, c, g or u
gggcancggcggcgcgcgguuga

SEQ ID NO: 1577143 - RNA, 16 nt, Human adenovirus E
cucagcaaccugcugg

SEQ ID NO: 1577144 - RNA, 19 nt, Human adenovirus E
aacagcagucaggcagagg

SEQ ID NO: 1577145 - RNA, 16 nt, Human adenovirus E
cacccagaccaucaac

SEQ ID NO: 1577146 - RNA, 20 nt, Human adenovirus E
aauuugaagauggagccaua

SEQ ID NO: 1577147 - RNA, 23 nt, Human adenovirus E
ugcuaacgagcgccccuugugga

SEQ ID NO: 1577148 - RNA, 17 nt, Human adenovirus E
cgcgaguucucgcucac

SEQ ID NO: 1577149 - RNA, 15 nt, Human adenovirus E
agcgccgcagcagug

SEQ ID NO: 1577150 - RNA, 17 nt, Human adenovirus E
gacucugacgcuccugg

SEQ ID NO: 1577151 - RNA, 19 nt, Human adenovirus E
gcaccauggaggugcagac

SEQ ID NO: 1577152 - RNA, 16 nt, Human adenovirus E
cucuauguuuaauuuu

SEQ ID NO: 1577153 - RNA, 19 nt, Human adenovirus E
cgugucaugaugcaguugc

SEQ ID NO: 1577154 - RNA, 22 nt, Human adenovirus E
cccgccucguuccagacgcggc

SEQ ID NO: 1577155 - RNA, 16 nt, Human adenovirus E
cuacuggucgcugccc

SEQ ID NO: 1577156 - RNA, 14 nt, Human adenovirus E
caacacgcuccagc

SEQ ID NO: 1577157 - RNA, 21 nt, Human adenovirus E
gccgcgugcggucgcgcacca

SEQ ID NO: 1577158 - RNA, 20 nt, Human adenovirus E
cagcccaauggcaccugcga

SEQ ID NO: 1577159 - RNA, 13 nt, Human adenovirus E
acucacaccacac

SEQ ID NO: 1577160 - RNA, 16 nt, Human adenovirus E
guaacuguuguugauc

SEQ ID NO: 1577161 - RNA, 22 nt, Human adenovirus E
gaugcauagucugcagcgggcc

SEQ ID NO: 1577162 - RNA, 16 nt, Human adenovirus E
cgcuacaacagcacca

SEQ ID NO: 1577163 - RNA, 12 nt, Human adenovirus E
ugcaccucacag

SEQ ID NO: 1577164 - RNA, 14 nt, Human adenovirus E
cuccaccaacgcca

SEQ ID NO: 1577165 - RNA, 15 nt, Human adenovirus E
ggcuggggcgacggg

SEQ ID NO: 1577166 - RNA, 20 nt, Human adenovirus E
ggcgagcgcuccggcaccgc

SEQ ID NO: 1577167 - RNA, 21 nt, Human adenovirus E
ucagccaaucagcgccccgca

SEQ ID NO: 1577168 - RNA, 19 nt, Human adenovirus E
uuccagggcgcgcgggagg

SEQ ID NO: 1577169 - RNA, 18 nt, Human adenovirus E
ggggcgauccuggcccaa

SEQ ID NO: 1577170 - RNA, 14 nt, Human adenovirus E
uccagggcuccccg

SEQ ID NO: 1577171 - RNA, 18 nt, Human adenovirus E
cgcgaggaggugacccug

SEQ ID NO: 1577172 - RNA, 14 nt, Human adenovirus E
cucagggcccggcc

SEQ ID NO: 1577173 - RNA, 17 nt, Human adenovirus E
ccacggaggccagcacc

SEQ ID NO: 1577174 - RNA, 21 nt, Human adenovirus E
gacacuaggaacuucaggcug

SEQ ID NO: 1577175 - RNA, 17 nt, Human adenovirus E
cggcgcgugcaguggcg

SEQ ID NO: 1577176 - RNA, 13 nt, Human adenovirus E
uucugcuguuagu

SEQ ID NO: 1577177 - RNA, 14 nt, Human adenovirus E
gugagcggggcugg

SEQ ID NO: 1577178 - RNA, 17 nt, Human adenovirus E
cagggccagcaccgccc

SEQ ID NO: 1577179 - RNA, 14 nt, Human adenovirus E
agcggcggcggaga

SEQ ID NO: 1577180 - RNA, 23 nt, Human adenovirus E
guggacaacaccugauccaucac

SEQ ID NO: 1577181 - RNA, 13 nt, Human adenovirus E
cuacucgcagcag

SEQ ID NO: 1577182 - RNA, 18 nt, Human adenovirus E
ggagcugaccaaccuggu

SEQ ID NO: 1577183 - RNA, 12 nt, Human adenovirus E
gucuggaggagc

SEQ ID NO: 1577184 - RNA, 16 nt, Human adenovirus E
cuugcuguagcagaac

SEQ ID NO: 1577185 - RNA, 13 nt, Human adenovirus E
gcacccucagggc

SEQ ID NO: 1577186 - RNA, 13 nt, Human adenovirus E
cuguaccgcgagg

SEQ ID NO: 1577187 - RNA, 15 nt, Human adenovirus E
agggcguuggagagg

SEQ ID NO: 1577188 - RNA, 20 nt, Human adenovirus E
ucgcccggcggcaccggagc

SEQ ID NO: 1577189 - RNA, 17 nt, Human adenovirus E
cgaggccggccuggugu

SEQ ID NO: 1577190 - RNA, 16 nt, Human adenovirus E
ggcagaugcgccccca

SEQ ID NO: 1577191 - RNA, 19 nt, Human adenovirus E
uggcaugcgaguuggagga

SEQ ID NO: 1577192 - RNA, 18 nt, Human adenovirus E
gcaagcgguuggggggag

SEQ ID NO: 1577193 - RNA, 18 nt, Human adenovirus E
acccugggccugaugcac

SEQ ID NO: 1577194 - RNA, 13 nt, Human adenovirus E
gccagacgcgcgg

SEQ ID NO: 1577195 - RNA, 16 nt, Human adenovirus E
ggucccggcgcccgcc

SEQ ID NO: 1577196 - RNA, 21 nt, Human adenovirus E
ccaaugacggguuccuguggg

SEQ ID NO: 1577197 - RNA, 15 nt, Human adenovirus E
uguggaccucggccu

SEQ ID NO: 1577198 - RNA, 20 nt, Human adenovirus E
cauagcuuaccgagcagcag

SEQ ID NO: 1577199 - RNA, 17 nt, Human adenovirus E
cugccguccucccggag

SEQ ID NO: 1577200 - RNA, 12 nt, Human adenovirus E
agcgcauccugc

SEQ ID NO: 1577201 - RNA, 17 nt, Human adenovirus E
gaagaugccgggcagga

SEQ ID NO: 1577202 - RNA, 20 nt, Human adenovirus E
ccagccccgauuaugcaggg

SEQ ID NO: 1577203 - RNA, 22 nt, Human adenovirus E
cagagucgggggcaggagcagg

SEQ ID NO: 1577204 - RNA, 18 nt, Human adenovirus E
ccaggauacggaggcggg

SEQ ID NO: 1577205 - RNA, 19 nt, Human adenovirus E
agggugccggacuggggga

SEQ ID NO: 1577206 - RNA, 18 nt, Human adenovirus E
gaacugguacuuggccag

SEQ ID NO: 1577207 - RNA, 16 nt, Human adenovirus E
auccacggccagggcg

SEQ ID NO: 1577208 - RNA, 21 nt, Human adenovirus E
gaacgccuuccucagcaccca

SEQ ID NO: 1577209 - RNA, 21 nt, Human adenovirus E
cagggccuguggggcgugcag

SEQ ID NO: 1577210 - RNA, 21 nt, Human adenovirus E
cugcaaggagaaggaggagag

SEQ ID NO: 1577211 - RNA, 12 nt, Human adenovirus E
ccgccgccagac

SEQ ID NO: 1577212 - RNA, 17 nt, Human adenovirus E
guggcacgacaggcagc

SEQ ID NO: 1577213 - RNA, 13 nt, Human adenovirus E
gagagcaugagca

SEQ ID NO: 1577214 - RNA, 14 nt, Human adenovirus E
ggcggcggcggcga

SEQ ID NO: 1577215 - RNA, 13 nt, Human adenovirus E
gcgcccuccaccg

SEQ ID NO: 1577216 - RNA, 20 nt, Human adenovirus E
aagaucuccaacguggagcu

SEQ ID NO: 1577217 - RNA, 12 nt, Human adenovirus E
ggcccucagcau

SEQ ID NO: 1577218 - RNA, 21 nt, Human adenovirus E
uaguucaacacgcuccagccg

SEQ ID NO: 1577219 - RNA, 18 nt, Human adenovirus E
aaaccauaucccagggca

SEQ ID NO: 1577220 - RNA, 12 nt, Human adenovirus E
cguucucuccag

SEQ ID NO: 1577221 - RNA, 20 nt, Human adenovirus E
uauuuuuccuccacccuccc

SEQ ID NO: 1577222 - RNA, 15 nt, Human adenovirus E
cggugcgcugguggc

SEQ ID NO: 1577223 - RNA, 20 nt, Human adenovirus E
gggcggcgcugcagagccag

SEQ ID NO: 1577224 - RNA, 21 nt, Human adenovirus E
cagcaguuugggcagcggggu

SEQ ID NO: 1577225 - RNA, 16 nt, Human adenovirus E
acaaggcccugggcau

SEQ ID NO: 1577226 - RNA, 14 nt, Human adenovirus E
ccgacggcgcgccg

SEQ ID NO: 1577227 - RNA, 12 nt, Human adenovirus E
ccucacaugacc

SEQ ID NO: 1577228 - RNA, 15 nt, Human adenovirus E
cgcugcaaccucugc

SEQ ID NO: 1577229 - RNA, 20 nt, Human adenovirus E
uagcuuaccgagcagcagca

SEQ ID NO: 1577230 - RNA, 16 nt, Human adenovirus E
uucaagaacuugcagg

SEQ ID NO: 1577231 - RNA, 20 nt, Human adenovirus E
uccacacugguggccaccuc

SEQ ID NO: 1577232 - RNA, 20 nt, Human adenovirus E
gugagcucgucggggucgcu

SEQ ID NO: 1577233 - RNA, 14 nt, Human adenovirus E
ccacggcccucagc

SEQ ID NO: 1577234 - RNA, 16 nt, Human adenovirus E
cuagccgccuccaccc

SEQ ID NO: 1577235 - RNA, 18 nt, Human adenovirus E
gcgggacgcggcugaucg

SEQ ID NO: 1577236 - RNA, 20 nt, Human adenovirus E
caggugcugccgaccgcggc

SEQ ID NO: 1577237 - RNA, 16 nt, Human adenovirus E
uccugaauccccacug

SEQ ID NO: 1577238 - RNA, 17 nt, Human adenovirus E
gguucucuaauuccuca

SEQ ID NO: 1577239 - RNA, 21 nt, Human adenovirus E
gcuuacggcaagcgcagccgu

SEQ ID NO: 1577240 - RNA, 14 nt, Human adenovirus E
ggcggcggcagcgg

SEQ ID NO: 1577241 - RNA, 15 nt, Human adenovirus E
gaggaagacugggag

SEQ ID NO: 1577242 - RNA, 21 nt, Human adenovirus E
uggugaagaugccgggcagga

SEQ ID NO: 1577243 - RNA, 17 nt, Human adenovirus E
ggcagaacgugcugcac

SEQ ID NO: 1577244 - RNA, 16 nt, Human adenovirus E
agggcgaggggcuggc

SEQ ID NO: 1577245 - RNA, 13 nt, Human adenovirus E
caccaucgucaag

SEQ ID NO: 1577246 - RNA, 21 nt, Human adenovirus E
ugcgggcggcgcugcagagcc

SEQ ID NO: 1577247 - RNA, 20 nt, Human adenovirus E
gagcaugacggcgacuaccu

SEQ ID NO: 1577248 - RNA, 18 nt, Human adenovirus E
ccgccucggaccuggccg

SEQ ID NO: 1577249 - RNA, 16 nt, Human adenovirus E
cgcucccggcggcgcu

SEQ ID NO: 1577250 - RNA, 14 nt, Human adenovirus E
gcggccuggaccga

SEQ ID NO: 1577251 - RNA, 19 nt, Human adenovirus E
caccugcuccgcgcugccc

SEQ ID NO: 1577252 - RNA, 18 nt, Human adenovirus E
gccgcugacggcgcagcu

SEQ ID NO: 1577253 - RNA, 15 nt, Human adenovirus E
gcccgaggacuacca

SEQ ID NO: 1577254 - RNA, 17 nt, Human adenovirus E
ucugauaccaggucucu

SEQ ID NO: 1577255 - RNA, 14 nt, Human adenovirus E
accgcggcgccgcg

SEQ ID NO: 1577256 - RNA, 16 nt, Human adenovirus E
ggcaucucgauccagc

SEQ ID NO: 1577257 - RNA, 14 nt, Human adenovirus E
gacagcacucaggc

SEQ ID NO: 1577258 - RNA, 22 nt, Human adenovirus E
auaauuuucauuuuuccagccu

SEQ ID NO: 1577259 - RNA, 22 nt, Human adenovirus E
gacggcccuugacguggggcag

SEQ ID NO: 1577260 - RNA, 18 nt, Human adenovirus E
caucgacagcgugguggc

SEQ ID NO: 1577261 - RNA, 19 nt, Human adenovirus E
caggacgacccgggcaacc

SEQ ID NO: 1577262 - RNA, 13 nt, Human adenovirus E
cuaugcagcucac

SEQ ID NO: 1577263 - RNA, 16 nt, Human adenovirus E
aggagcagaaccugaa

SEQ ID NO: 1577264 - RNA, 22 nt, Human adenovirus E
agcuugggggcgaggaagacgg

SEQ ID NO: 1577265 - RNA, 17 nt, Human adenovirus E
cucucagcgccacugag

SEQ ID NO: 1577266 - RNA, 17 nt, Human adenovirus E
agcagucaggcagagga

SEQ ID NO: 1577267 - RNA, 16 nt, Human adenovirus E
ggccgccagcuccucc

SEQ ID NO: 1577268 - RNA, 20 nt, Human adenovirus E
guggagccacugcuaccugc

SEQ ID NO: 1577269 - RNA, 16 nt, Human adenovirus E
gcuuccguggcggugc

SEQ ID NO: 1577270 - RNA, 19 nt, Human adenovirus E
gacagcugccguccucccg

SEQ ID NO: 1577271 - RNA, 20 nt, Human adenovirus E
gcaagccgcugacggcgcag

SEQ ID NO: 1577272 - RNA, 23 nt, Human adenovirus E
uacgcacgucuucaaccgcuucc

SEQ ID NO: 1577273 - RNA, 21 nt, Human adenovirus E
gcgcugcccguucucgcucgc

SEQ ID NO: 1577274 - RNA, 16 nt, Human adenovirus E
cugcuccgcgcugccc

SEQ ID NO: 1577275 - RNA, 17 nt, Human adenovirus E
cagagucaggcugggcu

SEQ ID NO: 1577276 - RNA, 23 nt, Human adenovirus E
cgcgccugcugcugcugcuggug

SEQ ID NO: 1577277 - RNA, 22 nt, Human adenovirus E
cagagcuggaaguccgugcgcu

SEQ ID NO: 1577278 - RNA, 22 nt, Human adenovirus E
gcccagcaagauguacggaggc

SEQ ID NO: 1577279 - RNA, 22 nt, Human adenovirus E
ugggacgauguggacagcagcg

SEQ ID NO: 1577280 - RNA, 15 nt, Human adenovirus E
ggagcggcgaggagc

SEQ ID NO: 1577281 - RNA, 16 nt, Human adenovirus E
gcugcaaccucugcac

SEQ ID NO: 1577282 - RNA, 16 nt, Human adenovirus E
cagcaaagccuccacg

SEQ ID NO: 1577283 - RNA, 20 nt, Human adenovirus E
ccgagcuccagcuccagugu

SEQ ID NO: 1577284 - RNA, 16 nt, Human adenovirus E
ccaacccuccaggaua

SEQ ID NO: 1577285 - RNA, 24 nt, Human adenovirus E
agcccgcgcgggaggcagguccag

SEQ ID NO: 1577286 - RNA, 17 nt, Human adenovirus E
gagcugcccgaaggcaa

SEQ ID NO: 1577287 - RNA, 15 nt, Human adenovirus E
ugcgcgugcgcgggc

SEQ ID NO: 1577288 - RNA, 21 nt, Human adenovirus E
ucgcccugcucgggcaucagc

SEQ ID NO: 1577289 - RNA, 15 nt, Human adenovirus E
ccgcgcccugggcca

SEQ ID NO: 1577290 - RNA, 21 nt, Human adenovirus E
gcucgcgguggggcggccagc

SEQ ID NO: 1577291 - RNA, 20 nt, Human adenovirus E
ggugcccgaggcccuggcca

SEQ ID NO: 1577292 - RNA, 22 nt, Human adenovirus E
guccccggugcugacggcuccc

SEQ ID NO: 1577293 - RNA, 23 nt, Human adenovirus E
ggucucgcacuccacgagccagg

SEQ ID NO: 1577294 - RNA, 21 nt, Human adenovirus E
cagaaccuguucagagacagg

SEQ ID NO: 1577295 - RNA, 19 nt, Human adenovirus E
cucagccaucgccaaccuc

SEQ ID NO: 1577296 - RNA, 17 nt, Human adenovirus E
cauggaauacaccaccc

SEQ ID NO: 1577297 - RNA, 11 nt, Human adenovirus E
ucccagggcac

SEQ ID NO: 1577298 - RNA, 15 nt, Human adenovirus E
agcgcauggucuggu

SEQ ID NO: 1577299 - RNA, 19 nt, Human adenovirus E
acugacuuccuccgcggcc

SEQ ID NO: 1577300 - RNA, 21 nt, Human adenovirus E
gggcaucaacgggguggugga

SEQ ID NO: 1577301 - RNA, 22 nt, Human adenovirus E
cauccuggccguguugcucuac

SEQ ID NO: 1577302 - RNA, 22 nt, Human adenovirus E
accaucgucaaggaugcgcugc

SEQ ID NO: 1577303 - RNA, 22 nt, Human adenovirus E
agcagcagaaaaagaccagcag

SEQ ID NO: 1577304 - RNA, 19 nt, Human adenovirus E
caugcaucucuucagcacu

SEQ ID NO: 1577305 - RNA, 22 nt, Human adenovirus E
guccgguccuuccagggucgca

SEQ ID NO: 1577306 - RNA, 17 nt, Human adenovirus E
gggcgagguugagcucc

SEQ ID NO: 1577307 - RNA, 13 nt, Human adenovirus E
gagccaggugagg

SEQ ID NO: 1577308 - RNA, 20 nt, Human adenovirus E
gcagcggggacagauguggg

SEQ ID NO: 1577309 - RNA, 20 nt, Human adenovirus E
gggcgaggaagacggacucg

SEQ ID NO: 1577310 - RNA, 18 nt, Human adenovirus E
gauguacagguggcagau

SEQ ID NO: 1577311 - RNA, 18 nt, Human adenovirus E
accucccgguaccacauc

SEQ ID NO: 1577312 - RNA, 17 nt, Human adenovirus E
cgccuuccucagcaccc

SEQ ID NO: 1577313 - RNA, 20 nt, Human adenovirus E
cccagucauagcaggggcgc

SEQ ID NO: 1577314 - RNA, 19 nt, Human adenovirus E
cgacaggaugcaccgugcg

SEQ ID NO: 1577315 - RNA, 19 nt, Human adenovirus E
ccggcauuaacuccucgga

SEQ ID NO: 1577316 - RNA, 17 nt, Human adenovirus E
ggggcaccucggcccgg

SEQ ID NO: 1577317 - RNA, 11 nt, Human adenovirus E
cccaggccaug

SEQ ID NO: 1577318 - RNA, 13 nt, Human adenovirus E
aagacgaggagga

SEQ ID NO: 1577319 - RNA, 15 nt, Human adenovirus E
cuuaccauugucaau

SEQ ID NO: 1577320 - RNA, 22 nt, Human adenovirus E
uacuggccacugugucagucuu

SEQ ID NO: 1577321 - RNA, 20 nt, Human adenovirus E
cccgguggugggcgccgagc

SEQ ID NO: 1577322 - RNA, 19 nt, Human adenovirus E
cagaccucggcgcgagcgg

SEQ ID NO: 1577323 - RNA, 22 nt, Human adenovirus E
gggacagcacucaggcagagga

SEQ ID NO: 1577324 - RNA, 23 nt, Human adenovirus E
cuuccagauaacuggacagaaaa

SEQ ID NO: 1577325 - RNA, 15 nt, Human adenovirus E
aacaggagcuacaac

SEQ ID NO: 1577326 - RNA, 13 nt, Human adenovirus E
ccgccgcaagacc

SEQ ID NO: 1577327 - RNA, 12 nt, Human adenovirus E
cacccgccccgc

SEQ ID NO: 1577328 - RNA, 15 nt, Human adenovirus E
acccccacggaggcc

SEQ ID NO: 1577329 - RNA, 12 nt, Human adenovirus E
agcugucggccu

SEQ ID NO: 1577330 - RNA, 20 nt, Human adenovirus E
guuggcacagcacaggcaua

SEQ ID NO: 1577331 - RNA, 21 nt, Human adenovirus E
cccaggccgaaguccagcuga

SEQ ID NO: 1577332 - RNA, 23 nt, Human adenovirus E
agcaucuggcccggcaggccacc

SEQ ID NO: 1577333 - RNA, 16 nt, Human adenovirus E
cagggcaugggauggg

SEQ ID NO: 1577334 - RNA, 17 nt, Human adenovirus E
gagaugcaauugaaagc

SEQ ID NO: 1577335 - RNA, 16 nt, Human adenovirus E
ucgcccaucuccgagg

SEQ ID NO: 1577336 - RNA, 15 nt, Human adenovirus E
cuaccuauaccuccc

SEQ ID NO: 1577337 - RNA, 16 nt, Human adenovirus E
uccguggcggugcagg

SEQ ID NO: 1577338 - RNA, 18 nt, Human adenovirus E
agcagaagcgugggccug

SEQ ID NO: 1577339 - RNA, 13 nt, Human adenovirus E
agcacucaggcag

SEQ ID NO: 1577340 - RNA, 13 nt, Human adenovirus E
caccaccacagca

SEQ ID NO: 1577341 - RNA, 22 nt, Human adenovirus E
ccaguaauaacaccgguugggg

SEQ ID NO: 1577342 - RNA, 15 nt, Human adenovirus E
cgcuccggcaccgcu

SEQ ID NO: 1577343 - RNA, 18 nt, Human adenovirus E
cucuucuacuuccuccuc

SEQ ID NO: 1577344 - RNA, 22 nt, Human adenovirus E
ggagcgacaucggcaccagcca

SEQ ID NO: 1577345 - RNA, 19 nt, Human adenovirus E
gcaugcgaguuggaggaga

SEQ ID NO: 1577346 - RNA, 16 nt, Human adenovirus E
cgggcaaccuggaagc

SEQ ID NO: 1577347 - RNA, 23 nt, Human adenovirus E
aucacuauucuuaucugccuccu

SEQ ID NO: 1577348 - RNA, 21 nt, Human adenovirus E
uucagcgcacucucgaggacg

SEQ ID NO: 1577349 - RNA, 14 nt, Human adenovirus E
augagcaccacagc

SEQ ID NO: 1577350 - RNA, 23 nt, Human adenovirus E
ugcauagucugcagcgggcccug

SEQ ID NO: 1577351 - RNA, 18 nt, Human adenovirus E
cugcacuaccucuucagg

SEQ ID NO: 1577352 - RNA, 20 nt, Human adenovirus E
uggcacuaaucacacauuga

SEQ ID NO: 1577353 - RNA, 15 nt, Human adenovirus E
cauggcgaccagcgu

SEQ ID NO: 1577354 - RNA, 12 nt, Human adenovirus E
gcccggcugcgg

SEQ ID NO: 1577355 - RNA, 16 nt, Human adenovirus E
uacucgcagcagcugc

SEQ ID NO: 1577356 - RNA, 17 nt, Human adenovirus E
uacuaaaaauaauauag

SEQ ID NO: 1577357 - RNA, 23 nt, Human adenovirus E
gacggcccuugacguggggcagu

SEQ ID NO: 1577358 - RNA, 18 nt, Human adenovirus E
uaccacaucacccucugg

SEQ ID NO: 1577359 - RNA, 18 nt, Human adenovirus E
ugccgaccgcggcgccgc

SEQ ID NO: 1577360 - RNA, 16 nt, Human adenovirus E
ugccccggggccagga

SEQ ID NO: 1577361 - RNA, 21 nt, Human adenovirus E
gcugaaaguggagcugccgcc

SEQ ID NO: 1577362 - RNA, 20 nt, Human adenovirus E
gugcgcgccgggcugggcgc

SEQ ID NO: 1577363 - RNA, 15 nt, Human adenovirus E
caaguuccggagcag

SEQ ID NO: 1577364 - RNA, 17 nt, Human adenovirus E
agaccgucguccucggc

SEQ ID NO: 1577365 - RNA, 16 nt, Human adenovirus E
gcccgaggcccuggcc

SEQ ID NO: 1577366 - RNA, 20 nt, Human adenovirus E
agggcgaguaccuggaagac

SEQ ID NO: 1577367 - RNA, 20 nt, Human adenovirus E
gaucccauuugagcuggagg

SEQ ID NO: 1577368 - RNA, 18 nt, Human adenovirus E
gagagcgugaugcagcag

SEQ ID NO: 1577369 - RNA, 22 nt, Human adenovirus E
auggcuggcagagccccuuccg

SEQ ID NO: 1577370 - RNA, 18 nt, Human adenovirus E
ccgaccccgucaccacca

SEQ ID NO: 1577371 - RNA, 16 nt, Human adenovirus E
gaaggaaggcagcgac

SEQ ID NO: 1577372 - RNA, 18 nt, Human adenovirus E
cucgccaucugcccccac

SEQ ID NO: 1577373 - RNA, 20 nt, Human adenovirus E
ccacgcggggcgggagcugc

SEQ ID NO: 1577374 - RNA, 14 nt, Human adenovirus E
aaguccagcaaagc

SEQ ID NO: 1577375 - RNA, 13 nt, Human adenovirus E
uggaggaagacug

SEQ ID NO: 1577376 - RNA, 23 nt, Human adenovirus E
cggccgccgugagcggggcugga

SEQ ID NO: 1577377 - RNA, 19 nt, Human adenovirus E
ccacugccgcugcaaccuc

SEQ ID NO: 1577378 - RNA, 12 nt, Human adenovirus E
ucgcgcuucugc

SEQ ID NO: 1577379 - RNA, 20 nt, Human adenovirus E
ggcgugccccagggcauggg

SEQ ID NO: 1577380 - RNA, 15 nt, Human adenovirus E
acuggaucuuugugc

SEQ ID NO: 1577381 - RNA, 21 nt, Human adenovirus E
gccugggguucauguugugca

SEQ ID NO: 1577382 - RNA, 11 nt, Human adenovirus E
ucaguugcagg

SEQ ID NO: 1577383 - RNA, 18 nt, Human adenovirus E
accugauaucgccuccuu

SEQ ID NO: 1577384 - RNA, 19 nt, Human adenovirus E
gcagcagaaaaagaccagc

SEQ ID NO: 1577385 - RNA, 20 nt, Human adenovirus E
ggacguccagagcgcaguag

SEQ ID NO: 1577386 - RNA, 16 nt, Human adenovirus E
cgagaaccgccugggg

SEQ ID NO: 1577387 - RNA, 12 nt, Human adenovirus E
ggggccaggagg

SEQ ID NO: 1577388 - RNA, 16 nt, Human adenovirus E
cugauggugaccgagg

SEQ ID NO: 1577389 - RNA, 19 nt, Human adenovirus E
cagcaccauggaggugcag

SEQ ID NO: 1577390 - RNA, 17 nt, Human adenovirus E
ccuggacaaaauaccac

SEQ ID NO: 1577391 - RNA, 16 nt, Human adenovirus E
gcauucacaugcucau

SEQ ID NO: 1577392 - RNA, 19 nt, Human adenovirus E
ggccaggacgacccgggca

SEQ ID NO: 1577393 - RNA, 23 nt, Human adenovirus E
ggauuccgcggcuaacgagggcg

SEQ ID NO: 1577394 - RNA, 20 nt, Human adenovirus E
cccgcgaugcgggcggcgcu

SEQ ID NO: 1577395 - RNA, 20 nt, Human adenovirus E
agcagaaaaccagcagcuag

SEQ ID NO: 1577396 - RNA, 18 nt, Human adenovirus E
ggugauaucuuccagaua

SEQ ID NO: 1577397 - RNA, 23 nt, Human adenovirus E
gccaaccaggccgugcagcggca

SEQ ID NO: 1577398 - RNA, 15 nt, Human adenovirus E
gaccaccguggugca

SEQ ID NO: 1577399 - RNA, 18 nt, Human adenovirus E
gccucaggagugaugaag

SEQ ID NO: 1577400 - RNA, 23 nt, Human adenovirus E
uccggaauccugcccgccaccug

SEQ ID NO: 1577401 - RNA, 18 nt, Human adenovirus E
ggcgaggggcuggcgcgc

SEQ ID NO: 1577402 - RNA, 15 nt, Human adenovirus E
caucguugaagagga

SEQ ID NO: 1577403 - RNA, 20 nt, Human adenovirus E
  misc_feature (8)..(8): n is a, c, g or u
aguccugnugagcggcccug

SEQ ID NO: 1577404 - RNA, 20 nt, Human adenovirus E
caagaacagccagagcagga

SEQ ID NO: 1577405 - RNA, 19 nt, Human adenovirus E
caagucuauguuggcacag

SEQ ID NO: 1577406 - RNA, 17 nt, Human adenovirus E
gggugcuucacgcucgc

SEQ ID NO: 1577407 - RNA, 16 nt, Human adenovirus E
agcgccgcagcagugg

SEQ ID NO: 1577408 - RNA, 21 nt, Human adenovirus E
ccaggccgaaguccagcugac

SEQ ID NO: 1577409 - RNA, 12 nt, Human adenovirus E
uccaacguggag

SEQ ID NO: 1577410 - RNA, 20 nt, Human adenovirus E
cgggacccugccgcugcgca

SEQ ID NO: 1577411 - RNA, 12 nt, Human adenovirus E
gcgaugcagccc

SEQ ID NO: 1577412 - RNA, 18 nt, Human adenovirus E
cggaggccagcacccaga

SEQ ID NO: 1577413 - RNA, 16 nt, Human adenovirus E
cgcggagcacgaggag

SEQ ID NO: 1577414 - RNA, 14 nt, Human adenovirus E
guccguguccccgu

SEQ ID NO: 1577415 - RNA, 20 nt, Human adenovirus E
cuuccagauaacuggacaga

SEQ ID NO: 1577416 - RNA, 19 nt, Human adenovirus E
caccacgcugcgcccccag

SEQ ID NO: 1577417 - RNA, 18 nt, Human adenovirus E
cuuuagguuuuggaucag

SEQ ID NO: 1577418 - RNA, 19 nt, Human adenovirus E
gcaaggaggaugcagcagc

SEQ ID NO: 1577419 - RNA, 18 nt, Human adenovirus E
gcagcagguggacugagg

SEQ ID NO: 1577420 - RNA, 20 nt, Human adenovirus E
gccaacuaccuggccuacca

SEQ ID NO: 1577421 - RNA, 20 nt, Human adenovirus E
cccggcggcgcgugcagugg

SEQ ID NO: 1577422 - RNA, 22 nt, Human adenovirus E
cgccgaggcucucuucaacaag

SEQ ID NO: 1577423 - RNA, 22 nt, Human adenovirus E
ggacgccgaggcucucuucaac

SEQ ID NO: 1577424 - RNA, 16 nt, Human adenovirus E
cggccgaggcggcuga

SEQ ID NO: 1577425 - RNA, 20 nt, Human adenovirus E
gccaucacaccuuccaccug

SEQ ID NO: 1577426 - RNA, 16 nt, Human adenovirus E
caggccccgcagcagu

SEQ ID NO: 1577427 - RNA, 23 nt, Human adenovirus E
gucauagcaggggcgcagggcau

SEQ ID NO: 1577428 - RNA, 19 nt, Human adenovirus E
gccucuaccgaggucaggg

SEQ ID NO: 1577429 - RNA, 13 nt, Human adenovirus E
ugccgcccaggac

SEQ ID NO: 1577430 - RNA, 14 nt, Human adenovirus E
cgacgagcgcacca

SEQ ID NO: 1577431 - RNA, 15 nt, Human adenovirus E
cagguggacugagga

SEQ ID NO: 1577432 - RNA, 17 nt, Human adenovirus E
cgauaaacucacuuugu

SEQ ID NO: 1577433 - RNA, 16 nt, Human adenovirus E
uaccaccacuacagcc

SEQ ID NO: 1577434 - RNA, 18 nt, Human adenovirus E
ugagacgcugcggaguca

SEQ ID NO: 1577435 - RNA, 20 nt, Human adenovirus E
cugcaagacagucuggagga

SEQ ID NO: 1577436 - RNA, 18 nt, Human adenovirus E
cgaggaagaaaaccgcgc

SEQ ID NO: 1577437 - RNA, 23 nt, Human adenovirus E
gcuggagugccugcgccgcuucu

SEQ ID NO: 1577438 - RNA, 15 nt, Human adenovirus E
accgaggaggagcgc

SEQ ID NO: 1577439 - RNA, 20 nt, Human adenovirus E
uggacccggacgugcagccc

SEQ ID NO: 1577440 - RNA, 23 nt, Human adenovirus E
aggacgacccgggcaaccuggaa

SEQ ID NO: 1577441 - RNA, 14 nt, Human adenovirus E
ccgauccuggucga

SEQ ID NO: 1577442 - RNA, 20 nt, Human adenovirus E
cguaugcgcaggagcacagg

SEQ ID NO: 1577443 - RNA, 17 nt, Human adenovirus E
cggacgauuggacccag

SEQ ID NO: 1577444 - RNA, 15 nt, Human adenovirus E
aaccaucacagagag

SEQ ID NO: 1577445 - RNA, 19 nt, Human adenovirus E
ggaugcaggggcggcaggg

SEQ ID NO: 1577446 - RNA, 19 nt, Human adenovirus E
ccacgccuuacauguggag

SEQ ID NO: 1577447 - RNA, 19 nt, Human adenovirus E
  misc_feature (8)..(8): n is a, c, g or u
cccgggcnugggcgugcag

SEQ ID NO: 1577448 - RNA, 15 nt, Human adenovirus E
aucucgcucaggucg

SEQ ID NO: 1577449 - RNA, 23 nt, Human adenovirus E
ugcuguaguggugugcauguuga

SEQ ID NO: 1577450 - RNA, 22 nt, Human adenovirus E
gcgcccaccauuaccaccguca

SEQ ID NO: 1577451 - RNA, 16 nt, Human adenovirus E
guccaccugcggggcg

SEQ ID NO: 1577452 - RNA, 15 nt, Human adenovirus E
aauuuuuagccauag

SEQ ID NO: 1577453 - RNA, 16 nt, Human adenovirus E
uccacguuccacacag

SEQ ID NO: 1577454 - RNA, 11 nt, Human adenovirus E
guggacgccgu

SEQ ID NO: 1577455 - RNA, 12 nt, Human adenovirus E
cggcccucagca

SEQ ID NO: 1577456 - RNA, 15 nt, Human adenovirus E
aggguauaaagcggc

SEQ ID NO: 1577457 - RNA, 19 nt, Human adenovirus E
ugggcgugcagaccgugga

SEQ ID NO: 1577458 - RNA, 17 nt, Human adenovirus E
gcaccucugacccugcc

SEQ ID NO: 1577459 - RNA, 13 nt, Human adenovirus E
gagucgggggcag

SEQ ID NO: 1577460 - RNA, 17 nt, Human adenovirus E
ucaaguggugcccccuc

SEQ ID NO: 1577461 - RNA, 20 nt, Human adenovirus E
ggcccgcuacaacagcacca

SEQ ID NO: 1577462 - RNA, 24 nt, Human adenovirus E
gagcuugggggcgaggaagacgga

SEQ ID NO: 1577463 - RNA, 15 nt, Human adenovirus E
ccugccgcgccaacc

SEQ ID NO: 1577464 - RNA, 17 nt, Human adenovirus E
agucucaaguccagcaa

SEQ ID NO: 1577465 - RNA, 20 nt, Human adenovirus E
gcgcggccacggcggcggca

SEQ ID NO: 1577466 - RNA, 12 nt, Human adenovirus E
ggcuggagccgc

SEQ ID NO: 1577467 - RNA, 19 nt, Human adenovirus E
agcccaauggcaccugcga

SEQ ID NO: 1577468 - RNA, 20 nt, Human adenovirus E
gccuuuagacagcagcccca

SEQ ID NO: 1577469 - RNA, 17 nt, Human adenovirus E
ugcaggccugcgggggc

SEQ ID NO: 1577470 - RNA, 12 nt, Human adenovirus E
caucggccaggc

SEQ ID NO: 1577471 - RNA, 23 nt, Human adenovirus E
  misc_feature (9)..(9): n is a, c, g or u
uggacaucnagauucccacggag

SEQ ID NO: 1577472 - RNA, 14 nt, Human adenovirus E
gcguguggcagcag

SEQ ID NO: 1577473 - RNA, 22 nt, Human adenovirus E
gccgugagcggggcuggacaga

SEQ ID NO: 1577474 - RNA, 23 nt, Human adenovirus E
aggacgcgcucaucaagcaucug

SEQ ID NO: 1577475 - RNA, 14 nt, Human adenovirus E
cagggugaugaggu

SEQ ID NO: 1577476 - RNA, 14 nt, Human adenovirus E
gcagugggcgcaga

SEQ ID NO: 1577477 - RNA, 16 nt, Human adenovirus E
uccagaaaaagccaca

SEQ ID NO: 1577478 - RNA, 19 nt, Human adenovirus E
uacgcgcugcauccuucca

SEQ ID NO: 1577479 - RNA, 19 nt, Human adenovirus E
aauuccuccugucccucaa

SEQ ID NO: 1577480 - RNA, 20 nt, Human adenovirus E
gagcauuacucucaucaagu

SEQ ID NO: 1577481 - RNA, 15 nt, Human adenovirus E
ggcggacgcgcgccg

SEQ ID NO: 1577482 - RNA, 18 nt, Human adenovirus E
guggugcccccuccagaa

SEQ ID NO: 1577483 - RNA, 14 nt, Human adenovirus E
cuccacccucccag

SEQ ID NO: 1577484 - RNA, 16 nt, Human adenovirus E
caccaagaacagccag

SEQ ID NO: 1577485 - RNA, 15 nt, Human adenovirus E
gagggaagaacagga

SEQ ID NO: 1577486 - RNA, 12 nt, Human adenovirus E
gaugggacgaga

SEQ ID NO: 1577487 - RNA, 20 nt, Human adenovirus E
gaccgggugcuaacgagcgc

SEQ ID NO: 1577488 - RNA, 19 nt, Human adenovirus E
gucaaaaccauaucccagg

SEQ ID NO: 1577489 - RNA, 20 nt, Human adenovirus E
ccguuucuucuugggcggcu

SEQ ID NO: 1577490 - RNA, 13 nt, Human adenovirus E
ccggucucgauca

SEQ ID NO: 1577491 - RNA, 14 nt, Human adenovirus E
ugauggcgggacgc

SEQ ID NO: 1577492 - RNA, 19 nt, Human adenovirus E
gcccaggacuacuccaccc

SEQ ID NO: 1577493 - RNA, 15 nt, Human adenovirus E
cagccggagccgcuu

SEQ ID NO: 1577494 - RNA, 18 nt, Human adenovirus E
gccggcgucgcauggucu

SEQ ID NO: 1577495 - RNA, 17 nt, Human adenovirus E
cgagacgaugggcaggc

SEQ ID NO: 1577496 - RNA, 18 nt, Human adenovirus E
gccgcgcgcgcgcuacca

SEQ ID NO: 1577497 - RNA, 15 nt, Human adenovirus E
agcagaagcgugggc

SEQ ID NO: 1577498 - RNA, 19 nt, Human adenovirus E
guacuugaucuccaccgcg

SEQ ID NO: 1577499 - RNA, 16 nt, Human adenovirus E
caugucccccucgucc

SEQ ID NO: 1577500 - RNA, 20 nt, Human adenovirus E
cgccgcgcgugccccccaag

SEQ ID NO: 1577501 - RNA, 15 nt, Human adenovirus E
ugcgcgccgggcugg

SEQ ID NO: 1577502 - RNA, 19 nt, Human adenovirus E
ccaggcggucccagagcuc

SEQ ID NO: 1577503 - RNA, 21 nt, Human adenovirus E
gggcguuggagaggagcuugg

SEQ ID NO: 1577504 - RNA, 19 nt, Human adenovirus E
uggcaucggcacucuccag

SEQ ID NO: 1577505 - RNA, 22 nt, Human adenovirus E
aaguagcugauggaaguggcca

SEQ ID NO: 1577506 - RNA, 21 nt, Human adenovirus E
agaagggcgugcgcuccugga

SEQ ID NO: 1577507 - RNA, 17 nt, Human adenovirus E
gaaggauagcaagaaca

SEQ ID NO: 1577508 - RNA, 20 nt, Human adenovirus E
ccaggaaauuccccagccca

SEQ ID NO: 1577509 - RNA, 23 nt, Human adenovirus E
cguggcccgcuacaacagcacca

SEQ ID NO: 1577510 - RNA, 13 nt, Human adenovirus E
accacuucacucc

SEQ ID NO: 1577511 - RNA, 15 nt, Human adenovirus E
gugcguuccagcaug

SEQ ID NO: 1577512 - RNA, 13 nt, Human adenovirus E
uggugggcgccga

SEQ ID NO: 1577513 - RNA, 20 nt, Human adenovirus E
aaacccuccgggcacucccg

SEQ ID NO: 1577514 - RNA, 19 nt, Human adenovirus E
ccagaaaaagccacagaag

SEQ ID NO: 1577515 - RNA, 18 nt, Human adenovirus E
cguucagggaggcgcugc

SEQ ID NO: 1577516 - RNA, 15 nt, Human adenovirus E
caagacccccaaugg

SEQ ID NO: 1577517 - RNA, 17 nt, Human adenovirus E
gcuuaaaaccuauggca

SEQ ID NO: 1577518 - RNA, 15 nt, Human adenovirus E
cagccgcggccaggg

SEQ ID NO: 1577519 - RNA, 13 nt, Human adenovirus E
gagcgugaugcag

SEQ ID NO: 1577520 - RNA, 15 nt, Human adenovirus E
gcccggcaggccacc

SEQ ID NO: 1577521 - RNA, 23 nt, Human adenovirus E
cuucagcgcgcgcugcccguucu

SEQ ID NO: 1577522 - RNA, 14 nt, Human adenovirus E
caagcugcugcuca

SEQ ID NO: 1577523 - RNA, 17 nt, Human adenovirus E
ucccggcgcccgccuac

SEQ ID NO: 1577524 - RNA, 16 nt, Human adenovirus E
cccacauuacacagac

SEQ ID NO: 1577525 - RNA, 18 nt, Human adenovirus E
gcgcacggccagcgcgcg

SEQ ID NO: 1577526 - RNA, 19 nt, Human adenovirus E
cggcggugcccgaggccgc

SEQ ID NO: 1577527 - RNA, 17 nt, Human adenovirus E
ccugcuuaucaccuucu

SEQ ID NO: 1577528 - RNA, 23 nt, Human adenovirus E
gauccugcggaaccacagggcca

SEQ ID NO: 1577529 - RNA, 19 nt, Human adenovirus E
ggccaggcgcacguggacg

SEQ ID NO: 1577530 - RNA, 22 nt, Human adenovirus E
gcucgcgguggggcggccagcu

SEQ ID NO: 1577531 - RNA, 19 nt, Human adenovirus E
accgccucggaccuggccg

SEQ ID NO: 1577532 - RNA, 16 nt, Human adenovirus E
caguccuuucccgagc

SEQ ID NO: 1577533 - RNA, 22 nt, Human adenovirus E
cuuuagacagcagccccaggcc

SEQ ID NO: 1577534 - RNA, 18 nt, Human adenovirus E
guauugcuauuuuggauc

SEQ ID NO: 1577535 - RNA, 14 nt, Human adenovirus E
aggaagagaugcuc

SEQ ID NO: 1577536 - RNA, 13 nt, Human adenovirus E
uccggagcagcug

SEQ ID NO: 1577537 - RNA, 17 nt, Human adenovirus E
  misc_feature (8)..(8): n is a, c, g or u
gcacgaangaggccacg

SEQ ID NO: 1577538 - RNA, 14 nt, Human adenovirus E
ugauauucuggagc

SEQ ID NO: 1577539 - RNA, 16 nt, Human adenovirus E
ggcaucuugcacgaga

SEQ ID NO: 1577540 - RNA, 21 nt, Human adenovirus E
caguccauaguucaacacgcu

SEQ ID NO: 1577541 - RNA, 12 nt, Human adenovirus E
cgcccagcaaga

SEQ ID NO: 1577542 - RNA, 22 nt, Human adenovirus E
acagcuaccuccagugccuucu

SEQ ID NO: 1577543 - RNA, 22 nt, Human adenovirus E
cggcgcgagcugagcgaccagg

SEQ ID NO: 1577544 - RNA, 13 nt, Human adenovirus E
ggaggucgggguc

SEQ ID NO: 1577545 - RNA, 16 nt, Human adenovirus E
ugagcaaagagauucc

SEQ ID NO: 1577546 - RNA, 15 nt, Human adenovirus E
gcuacaacagcacca

SEQ ID NO: 1577547 - RNA, 17 nt, Human adenovirus E
caacccacauuacacag

SEQ ID NO: 1577548 - RNA, 11 nt, Human adenovirus E
cugcugaaccu

SEQ ID NO: 1577549 - RNA, 16 nt, Human adenovirus E
ccgggcuaccgcggca

SEQ ID NO: 1577550 - RNA, 15 nt, Human adenovirus E
ugcagcacuggaaca

SEQ ID NO: 1577551 - RNA, 18 nt, Human adenovirus E
acgugcucuuugccuuca

SEQ ID NO: 1577552 - RNA, 15 nt, Human adenovirus E
cgaacucgcgccugc

SEQ ID NO: 1577553 - RNA, 20 nt, Human adenovirus E
agaggcggaggcgacgggcu

SEQ ID NO: 1577554 - RNA, 17 nt, Human adenovirus E
cuacaaggcccugggca

SEQ ID NO: 1577555 - RNA, 17 nt, Human adenovirus E
cagagcgcccuccaccg

SEQ ID NO: 1577556 - RNA, 17 nt, Human adenovirus E
cauccccgcgcuccugg

SEQ ID NO: 1577557 - RNA, 21 nt, Human adenovirus E
auccacagcggcggcagcagg

SEQ ID NO: 1577558 - RNA, 12 nt, Human adenovirus E
ggaucagccccg

SEQ ID NO: 1577559 - RNA, 17 nt, Human adenovirus E
ugccgcgguccuccucg

SEQ ID NO: 1577560 - RNA, 13 nt, Human adenovirus E
acaccuuccaccu

SEQ ID NO: 1577561 - RNA, 20 nt, Human adenovirus E
gccuggccgccggugccgcc

SEQ ID NO: 1577562 - RNA, 15 nt, Human adenovirus E
gacagaugugggacg

SEQ ID NO: 1577563 - RNA, 16 nt, Human adenovirus E
cugcacaccacccugc

SEQ ID NO: 1577564 - RNA, 20 nt, Human adenovirus E
caccaccugcaucugcugcu

SEQ ID NO: 1577565 - RNA, 23 nt, Human adenovirus E
ggacuccgcgcaaggaccugagc

SEQ ID NO: 1577566 - RNA, 13 nt, Human adenovirus E
gaacagccagagc

SEQ ID NO: 1577567 - RNA, 21 nt, Human adenovirus E
gauaucgccuccuuggaagag

SEQ ID NO: 1577568 - RNA, 14 nt, Human adenovirus E
cggcccucagcauc

SEQ ID NO: 1577569 - RNA, 14 nt, Human adenovirus E
ggcagcggggacag

SEQ ID NO: 1577570 - RNA, 20 nt, Human adenovirus E
gacggcgcgcccguccucgc

SEQ ID NO: 1577571 - RNA, 17 nt, Human adenovirus E
  misc_feature (6)..(6): n is a, c, g or u
cgggcnugggcgugcag

SEQ ID NO: 1577572 - RNA, 21 nt, Human adenovirus E
cguagaggaaccccgcccacu

SEQ ID NO: 1577573 - RNA, 16 nt, Human adenovirus E
gcagcagcgagcuggg

SEQ ID NO: 1577574 - RNA, 15 nt, Human adenovirus E
agucauagcaggggc

SEQ ID NO: 1577575 - RNA, 17 nt, Human adenovirus E
gccucgugcucgggggu

SEQ ID NO: 1577576 - RNA, 21 nt, Human adenovirus E
cuucacccccacggaggccag

SEQ ID NO: 1577577 - RNA, 14 nt, Human adenovirus E
uccgguccuuccag

SEQ ID NO: 1577578 - RNA, 20 nt, Human adenovirus E
gcacuuccgcgcucccuggg

SEQ ID NO: 1577579 - RNA, 15 nt, Human adenovirus E
aacugucaaauacuc

SEQ ID NO: 1577580 - RNA, 13 nt, Human adenovirus E
cgcuguccuggcu

SEQ ID NO: 1577581 - RNA, 15 nt, Human adenovirus E
aacaguauccgcagc

SEQ ID NO: 1577582 - RNA, 16 nt, Human adenovirus E
cacggacagcggcagc

SEQ ID NO: 1577583 - RNA, 12 nt, Human adenovirus E
gcggccagcuga

SEQ ID NO: 1577584 - RNA, 18 nt, Human adenovirus E
ccgccuccacccaucauc

SEQ ID NO: 1577585 - RNA, 23 nt, Human adenovirus E
caggccgucuacucgcagcagcu

SEQ ID NO: 1577586 - RNA, 16 nt, Human adenovirus E
ggcccugcggugguga

SEQ ID NO: 1577587 - RNA, 18 nt, Human adenovirus E
cgcgagcgguuccaccgc

SEQ ID NO: 1577588 - RNA, 22 nt, Human adenovirus E
ggaccugcacuggcagcccagc

SEQ ID NO: 1577589 - RNA, 21 nt, Human adenovirus E
gccaccuccugaucccgcgau

SEQ ID NO: 1577590 - RNA, 19 nt, Human adenovirus E
ugaacacuguaucccaccc

SEQ ID NO: 1577591 - RNA, 17 nt, Human adenovirus E
agcaggaagcagagaau

SEQ ID NO: 1577592 - RNA, 14 nt, Human adenovirus E
cgacagcguggugg

SEQ ID NO: 1577593 - RNA, 15 nt, Human adenovirus E
ggggcgaggaagacg

SEQ ID NO: 1577594 - RNA, 21 nt, Human adenovirus E
cacuuacuaaguguugaauuu

SEQ ID NO: 1577595 - RNA, 20 nt, Human adenovirus E
gggugcgcucccggcggcgc

SEQ ID NO: 1577596 - RNA, 16 nt, Human adenovirus E
ggacaaaaaggaagaa

SEQ ID NO: 1577597 - RNA, 14 nt, Human adenovirus E
gagcacgaggagga

SEQ ID NO: 1577598 - RNA, 14 nt, Human adenovirus E
caguaguacagaaa

SEQ ID NO: 1577599 - RNA, 12 nt, Human adenovirus E
ucgcgcaccacc

SEQ ID NO: 1577600 - RNA, 21 nt, Human adenovirus E
ggagcacgaggaggagcuggc

SEQ ID NO: 1577601 - RNA, 16 nt, Human adenovirus E
ggccugcaacccccag

SEQ ID NO: 1577602 - RNA, 18 nt, Human adenovirus E
cugguacugcaggccccg

SEQ ID NO: 1577603 - RNA, 16 nt, Human adenovirus E
uggagcuaccagcccc

SEQ ID NO: 1577604 - RNA, 19 nt, Human adenovirus E
cacccccacggaggccagc

SEQ ID NO: 1577605 - RNA, 20 nt, Human adenovirus E
ccaccacuacagccuaggcc

SEQ ID NO: 1577606 - RNA, 14 nt, Human adenovirus E
guucuacacgggcg

SEQ ID NO: 1577607 - RNA, 22 nt, Human adenovirus E
  misc_feature (9)..(9): n is a, c, g or u
ccccgggcnugggcgugcagac

SEQ ID NO: 1577608 - RNA, 18 nt, Human adenovirus E
gcuggagugccugcgccg

SEQ ID NO: 1577609 - RNA, 20 nt, Human adenovirus E
gccccucagcguggaggagc

SEQ ID NO: 1577610 - RNA, 20 nt, Human adenovirus E
cucaucaagcaucuggcccg

SEQ ID NO: 1577611 - RNA, 17 nt, Human adenovirus E
ugccgggcaggaggucg

SEQ ID NO: 1577612 - RNA, 14 nt, Human adenovirus E
ugaucaccagcugg

SEQ ID NO: 1577613 - RNA, 23 nt, Human adenovirus E
cuacgcgcugcauccuuccauca

SEQ ID NO: 1577614 - RNA, 22 nt, Human adenovirus E
caugcaucucuucagcacucuc

SEQ ID NO: 1577615 - RNA, 23 nt, Human adenovirus E
uggaggcuaagcgaacggguugg

SEQ ID NO: 1577616 - RNA, 18 nt, Human adenovirus E
cgcgucguuguuggccag

SEQ ID NO: 1577617 - RNA, 15 nt, Human adenovirus E
gccucggaccuggcc

SEQ ID NO: 1577618 - RNA, 21 nt, Human adenovirus E
uacucgcagaaaaugaugcaa

SEQ ID NO: 1577619 - RNA, 17 nt, Human adenovirus E
gcagucccacugcuagu

SEQ ID NO: 1577620 - RNA, 12 nt, Human adenovirus E
cugcgcccggag

SEQ ID NO: 1577621 - RNA, 17 nt, Human adenovirus E
gucgcccagcgccucca

SEQ ID NO: 1577622 - RNA, 14 nt, Human adenovirus E
gacucccucagcau

SEQ ID NO: 1577623 - RNA, 15 nt, Human adenovirus E
auucggggaagacgu

SEQ ID NO: 1577624 - RNA, 18 nt, Human adenovirus E
cuuagcuuugacaguaca

SEQ ID NO: 1577625 - RNA, 14 nt, Human adenovirus E
ccgcagcagcgagc

SEQ ID NO: 1577626 - RNA, 11 nt, Human adenovirus E
aguuccuccac

SEQ ID NO: 1577627 - RNA, 16 nt, Human adenovirus E
uggcggauggcuggca

SEQ ID NO: 1577628 - RNA, 22 nt, Human adenovirus E
cagacgcgcggcuucaggcgcc

SEQ ID NO: 1577629 - RNA, 18 nt, Human adenovirus E
agagggcgaggggcuggc

SEQ ID NO: 1577630 - RNA, 13 nt, Human adenovirus E
ccaaauccaugau

SEQ ID NO: 1577631 - RNA, 23 nt, Human adenovirus E
uacaccaacuucaucagcgcccu

SEQ ID NO: 1577632 - RNA, 19 nt, Human adenovirus E
gagcgccagcaggcggcgc

SEQ ID NO: 1577633 - RNA, 19 nt, Human adenovirus E
gcgcagggaggugugcgug

SEQ ID NO: 1577634 - RNA, 23 nt, Human adenovirus E
agcaacaaguucaaggcgcgggu

SEQ ID NO: 1577635 - RNA, 18 nt, Human adenovirus E
ccacagaaguuucauggu

SEQ ID NO: 1577636 - RNA, 12 nt, Human adenovirus E
gcggcggcagca

SEQ ID NO: 1577637 - RNA, 22 nt, Human adenovirus E
cgugcauguucucgcgcaccag

SEQ ID NO: 1577638 - RNA, 22 nt, Human adenovirus E
uucugacaaugaggacguuacu

SEQ ID NO: 1577639 - RNA, 12 nt, Human adenovirus E
acaugcagcccc

SEQ ID NO: 1577640 - RNA, 23 nt, Human adenovirus E
cuacuuccaagaagaggcagcag

SEQ ID NO: 1577641 - RNA, 13 nt, Human adenovirus E
accuggaccacug

SEQ ID NO: 1577642 - RNA, 14 nt, Human adenovirus E
gcugccgcuguccg

SEQ ID NO: 1577643 - RNA, 23 nt, Human adenovirus E
aacccacauuacacagacaacca

SEQ ID NO: 1577644 - RNA, 11 nt, Human adenovirus E
uccaggccagc

SEQ ID NO: 1577645 - RNA, 16 nt, Human adenovirus E
uaccccuacgaugcag

SEQ ID NO: 1577646 - RNA, 18 nt, Human adenovirus E
cccugugucgucaccgcc

SEQ ID NO: 1577647 - RNA, 13 nt, Human adenovirus E
agagacaggagcg

SEQ ID NO: 1577648 - RNA, 16 nt, Human adenovirus E
ccuuucaagagccccu

SEQ ID NO: 1577649 - RNA, 13 nt, Human adenovirus E
ugaccggcugcag

SEQ ID NO: 1577650 - RNA, 23 nt, Human adenovirus E
gcggccacggcggcggcagcggc

SEQ ID NO: 1577651 - RNA, 14 nt, Human adenovirus E
cuggaucuccugcc

SEQ ID NO: 1577652 - RNA, 22 nt, Human adenovirus E
gagccuuguugcgcagggccag

SEQ ID NO: 1577653 - RNA, 21 nt, Human adenovirus E
cugaagcccacggccgccagc

SEQ ID NO: 1577654 - RNA, 19 nt, Human adenovirus E
agcucuucgcugggucugc

SEQ ID NO: 1577655 - RNA, 13 nt, Human adenovirus E
gccagcuccuccu

SEQ ID NO: 1577656 - RNA, 19 nt, Human adenovirus E
aaccggugcugagacccgg

SEQ ID NO: 1577657 - RNA, 18 nt, Human adenovirus E
gcugcaccacgcugcgcc

SEQ ID NO: 1577658 - RNA, 12 nt, Human adenovirus E
cggaaggugcaa

SEQ ID NO: 1577659 - RNA, 19 nt, Human adenovirus E
cugguccgggcgcugcaca

SEQ ID NO: 1577660 - RNA, 14 nt, Human adenovirus E
cagggccagcaccg

SEQ ID NO: 1577661 - RNA, 16 nt, Human adenovirus E
ugcaucucuucagcac

SEQ ID NO: 1577662 - RNA, 13 nt, Human adenovirus E
cgggcggcgcugc

SEQ ID NO: 1577663 - RNA, 14 nt, Human adenovirus E
cauccccggguaca

SEQ ID NO: 1577664 - RNA, 18 nt, Human adenovirus E
ugcucgaucuccuccucu

SEQ ID NO: 1577665 - RNA, 16 nt, Human adenovirus E
gggcgugccccagggc

SEQ ID NO: 1577666 - RNA, 22 nt, Human adenovirus E
cguccggcauuaacuccucgga

SEQ ID NO: 1577667 - RNA, 22 nt, Human adenovirus E
ccaaccaggccgugcagcggca

SEQ ID NO: 1577668 - RNA, 13 nt, Human adenovirus E
ucauguacagcaa

SEQ ID NO: 1577669 - RNA, 17 nt, Human adenovirus E
auaacagccaggucaaa

SEQ ID NO: 1577670 - RNA, 21 nt, Human adenovirus E
guggcacgacaggcagcgggg

SEQ ID NO: 1577671 - RNA, 14 nt, Human adenovirus E
cugacccacuggcc

SEQ ID NO: 1577672 - RNA, 16 nt, Human adenovirus E
gcaggggguccagcau

SEQ ID NO: 1577673 - RNA, 14 nt, Human adenovirus E
ucccgccugaaccu

SEQ ID NO: 1577674 - RNA, 15 nt, Human adenovirus E
agaccuaccaggaga

SEQ ID NO: 1577675 - RNA, 14 nt, Human adenovirus E
ccaugcgcgcggcg

SEQ ID NO: 1577676 - RNA, 19 nt, Human adenovirus E
ggaacucuugcaggacagc

SEQ ID NO: 1577677 - RNA, 12 nt, Human adenovirus E
cacuacccggac

SEQ ID NO: 1577678 - RNA, 14 nt, Human adenovirus E
aucccgcuggacca

SEQ ID NO: 1577679 - RNA, 22 nt, Human adenovirus E
gcgcacguggacgagcagaccu

SEQ ID NO: 1577680 - RNA, 21 nt, Human adenovirus E
cucuccaguucguggaggagu

SEQ ID NO: 1577681 - RNA, 22 nt, Human adenovirus E
gccaucacaccuuccaccugau

SEQ ID NO: 1577682 - RNA, 22 nt, Human adenovirus E
cgaugcagcccccgcuggaggc

SEQ ID NO: 1577683 - RNA, 15 nt, Human adenovirus E
cagagaaugagcaga

SEQ ID NO: 1577684 - RNA, 14 nt, Human adenovirus E
caggggcggcaggg

SEQ ID NO: 1577685 - RNA, 17 nt, Human adenovirus E
agccacugcuaccugcu

SEQ ID NO: 1577686 - RNA, 18 nt, Human adenovirus E
cgcgguggggcggccagc

SEQ ID NO: 1577687 - RNA, 19 nt, Human adenovirus E
cugcaggaccacaugcuug

SEQ ID NO: 1577688 - RNA, 16 nt, Human adenovirus E
gcgcccuccaccggca

SEQ ID NO: 1577689 - RNA, 20 nt, Human adenovirus E
gcugcggcgcggccuggacc

SEQ ID NO: 1577690 - RNA, 15 nt, Human adenovirus E
augauugaaaaccau

SEQ ID NO: 1577691 - RNA, 12 nt, Human adenovirus E
ccgccaccugcu

SEQ ID NO: 1577692 - RNA, 19 nt, Human adenovirus E
cggacgauuggacccaggc

SEQ ID NO: 1577693 - RNA, 15 nt, Human adenovirus E
gaugacugacccacu

SEQ ID NO: 1577694 - RNA, 16 nt, Human adenovirus E
aggagaugcgcgcggc

SEQ ID NO: 1577695 - RNA, 17 nt, Human adenovirus E
cucagguguccagcugg

SEQ ID NO: 1577696 - RNA, 20 nt, Human adenovirus E
gaauccugcccgccaccugc

SEQ ID NO: 1577697 - RNA, 19 nt, Human adenovirus E
aguacgugcaacacagaac

SEQ ID NO: 1577698 - RNA, 15 nt, Human adenovirus E
cacggcggcggcagc

SEQ ID NO: 1577699 - RNA, 16 nt, Human adenovirus E
caaggcguggaacagc

SEQ ID NO: 1577700 - RNA, 22 nt, Human adenovirus E
accuggucucguacaugggcau

SEQ ID NO: 1577701 - RNA, 23 nt, Human adenovirus E
gauucccgaaccccaccacccag

SEQ ID NO: 1577702 - RNA, 21 nt, Human adenovirus E
ccagcuggaucaugaucauug

SEQ ID NO: 1577703 - RNA, 22 nt, Human adenovirus E
auaucgccuccuuggaagaggu

SEQ ID NO: 1577704 - RNA, 14 nt, Human adenovirus E
aauaacauuuuugc

SEQ ID NO: 1577705 - RNA, 12 nt, Human adenovirus E
cgagcaggccgu

SEQ ID NO: 1577706 - RNA, 21 nt, Human adenovirus E
uaccaggagaucacccacgug

SEQ ID NO: 1577707 - RNA, 18 nt, Human adenovirus E
gggauaggagcuccugga

SEQ ID NO: 1577708 - RNA, 14 nt, Human adenovirus E
cagccagagcagga

SEQ ID NO: 1577709 - RNA, 13 nt, Human adenovirus E
gaguucgcccccc

SEQ ID NO: 1577710 - RNA, 13 nt, Human adenovirus E
ucgagugccacug

SEQ ID NO: 1577711 - RNA, 20 nt, Human adenovirus E
gcccgccaacgugccccggg

SEQ ID NO: 1577712 - RNA, 14 nt, Human adenovirus E
ugucaaccacugcg

SEQ ID NO: 1577713 - RNA, 14 nt, Human adenovirus E
gaugugcucgguga

SEQ ID NO: 1577714 - RNA, 16 nt, Human adenovirus E
ugguggcgaaggagcc

SEQ ID NO: 1577715 - RNA, 19 nt, Human adenovirus E
cagcguccgauccuggucg

SEQ ID NO: 1577716 - RNA, 12 nt, Human adenovirus E
acuaugccuucu

SEQ ID NO: 1577717 - RNA, 21 nt, Human adenovirus E
aaaucacccucaagcugggag

SEQ ID NO: 1577718 - RNA, 22 nt, Human adenovirus E
gccucuguuaaauuuuugcuuu

SEQ ID NO: 1577719 - RNA, 15 nt, Human adenovirus E
gucccggcgcccgcc

SEQ ID NO: 1577720 - RNA, 16 nt, Human adenovirus E
gcccggguccaggcca

SEQ ID NO: 1577721 - RNA, 12 nt, Human adenovirus E
ugcgcuccugga

SEQ ID NO: 1577722 - RNA, 19 nt, Human adenovirus E
uggaugcucuauacgggca

SEQ ID NO: 1577723 - RNA, 18 nt, Human adenovirus E
ccaagaagaggcagcagc

SEQ ID NO: 1577724 - RNA, 19 nt, Human adenovirus E
cugcacaccacccugcgcg

SEQ ID NO: 1577725 - RNA, 16 nt, Human adenovirus E
acgcccguccucggcg

SEQ ID NO: 1577726 - RNA, 13 nt, Human adenovirus E
gaaaauaacagcc

SEQ ID NO: 1577727 - RNA, 15 nt, Human adenovirus E
ggcgcgcaggccgga

SEQ ID NO: 1577728 - RNA, 11 nt, Human adenovirus E
aucggccaggc

SEQ ID NO: 1577729 - RNA, 16 nt, Human adenovirus E
ugcagaggcgcuggua

SEQ ID NO: 1577730 - RNA, 11 nt, Human adenovirus E
cgggguugggc

SEQ ID NO: 1577731 - RNA, 17 nt, Human adenovirus E
acccggacgugcagccc

SEQ ID NO: 1577732 - RNA, 21 nt, Human adenovirus E
cagcaugucccgcccgcggcg

SEQ ID NO: 1577733 - RNA, 13 nt, Human adenovirus E
ccaucgccagcau

SEQ ID NO: 1577734 - RNA, 13 nt, Human adenovirus E
gcaagcuccugca

SEQ ID NO: 1577735 - RNA, 18 nt, Human adenovirus E
agccuccacgcgcacauc

SEQ ID NO: 1577736 - RNA, 21 nt, Human adenovirus E
ugcacgagaaccgccuggggc

SEQ ID NO: 1577737 - RNA, 21 nt, Human adenovirus E
ggaccacggcaaccccacgcc

SEQ ID NO: 1577738 - RNA, 18 nt, Human adenovirus E
uaccuccagugccuucuc

SEQ ID NO: 1577739 - RNA, 14 nt, Human adenovirus E
gcggccuugcgcag

SEQ ID NO: 1577740 - RNA, 13 nt, Human adenovirus E
gaccgugcagcag

SEQ ID NO: 1577741 - RNA, 22 nt, Human adenovirus E
cucacagaucacgggacccugc

SEQ ID NO: 1577742 - RNA, 13 nt, Human adenovirus E
ucuuugaggagga

SEQ ID NO: 1577743 - RNA, 19 nt, Human adenovirus E
cugguacuuggccagccac

SEQ ID NO: 1577744 - RNA, 15 nt, Human adenovirus E
cguugcggugugccc

SEQ ID NO: 1577745 - RNA, 23 nt, Human adenovirus E
accaucaucuuagcgcuagcagc

SEQ ID NO: 1577746 - RNA, 15 nt, Human adenovirus E
gaucuccaccgcgcc

SEQ ID NO: 1577747 - RNA, 23 nt, Human adenovirus E
guaggcguccgcgccgcaguggg

SEQ ID NO: 1577748 - RNA, 17 nt, Human adenovirus E
cgccgcaccgcucccug

SEQ ID NO: 1577749 - RNA, 19 nt, Human adenovirus E
  misc_feature (9)..(9): n is a, c, g or u
agcacgaangaggccacgu

SEQ ID NO: 1577750 - RNA, 22 nt, Human adenovirus E
caccaacgugcagaccaaccug

SEQ ID NO: 1577751 - RNA, 14 nt, Human adenovirus E
acccccaguaccgc

SEQ ID NO: 1577752 - RNA, 17 nt, Human adenovirus E
cuccaucgcuuacagcc

SEQ ID NO: 1577753 - RNA, 22 nt, Human adenovirus E
gcgccagcccaauggcaccugc

SEQ ID NO: 1577754 - RNA, 13 nt, Human adenovirus E
agucucuggagcg

SEQ ID NO: 1577755 - RNA, 20 nt, Human adenovirus E
acccugugucgucaccgccc

SEQ ID NO: 1577756 - RNA, 18 nt, Human adenovirus E
acagccagagcaggaagc

SEQ ID NO: 1577757 - RNA, 21 nt, Human adenovirus E
uccagcuggcgggcggcgcca

SEQ ID NO: 1577758 - RNA, 19 nt, Human adenovirus E
accaggccgugcagcggca

SEQ ID NO: 1577759 - RNA, 19 nt, Human adenovirus E
gcuguccacgagcgccagc

SEQ ID NO: 1577760 - RNA, 18 nt, Human adenovirus E
uccgggcacucccgcauc

SEQ ID NO: 1577761 - RNA, 20 nt, Human adenovirus E
cgcacguagucauacagcuc

SEQ ID NO: 1577762 - RNA, 13 nt, Human adenovirus E
uguacagcaacaa

SEQ ID NO: 1577763 - RNA, 12 nt, Human adenovirus E
guaagccccaca

SEQ ID NO: 1577764 - RNA, 21 nt, Human adenovirus E
cuccccucuucccagcucugg

SEQ ID NO: 1577765 - RNA, 10 nt, Human adenovirus E
aacucuugca

SEQ ID NO: 1577766 - RNA, 22 nt, Human adenovirus E
  misc_feature (9)..(9): n is a, c, g or u
cuccagcunuuccaacccuucc

SEQ ID NO: 1577767 - RNA, 14 nt, Human adenovirus E
gucaaauacuggcc

SEQ ID NO: 1577768 - RNA, 16 nt, Human adenovirus E
acggaucccuggaugc

SEQ ID NO: 1577769 - RNA, 21 nt, Human adenovirus E
cuacgucuacaaggcccuggg

SEQ ID NO: 1577770 - RNA, 17 nt, Human adenovirus E
gcggcgaucggggcgau

SEQ ID NO: 1577771 - RNA, 14 nt, Human adenovirus E
ucugcccccgcccc

SEQ ID NO: 1577772 - RNA, 14 nt, Human adenovirus E
acacaacaggcgca

SEQ ID NO: 1577773 - RNA, 19 nt, Human adenovirus E
uaugaggccgagccacagc

SEQ ID NO: 1577774 - RNA, 13 nt, Human adenovirus E
ggagggugccgga

SEQ ID NO: 1577775 - RNA, 20 nt, Human adenovirus E
ggaccugcacuggcagccca

SEQ ID NO: 1577776 - RNA, 20 nt, Human adenovirus E
caccugaucccgaauaccac

SEQ ID NO: 1577777 - RNA, 18 nt, Human adenovirus E
gcucagcaccgaggagga

SEQ ID NO: 1577778 - RNA, 16 nt, Human adenovirus E
cugguacuuggccagc

SEQ ID NO: 1577779 - RNA, 17 nt, Human adenovirus E
gaccgagggggagagcu

SEQ ID NO: 1577780 - RNA, 17 nt, Human adenovirus E
ugaagaugccgggcagg

SEQ ID NO: 1577781 - RNA, 22 nt, Human adenovirus E
cuuuggaagauguugaaguggg

SEQ ID NO: 1577782 - RNA, 22 nt, Human adenovirus E
cagaccgguaagaaggagcggc

SEQ ID NO: 1577783 - RNA, 19 nt, Human adenovirus E
cucuuugccuucaccaccu

SEQ ID NO: 1577784 - RNA, 15 nt, Human adenovirus E
ugagcccgucccggg

SEQ ID NO: 1577785 - RNA, 21 nt, Human adenovirus E
ggugauacgguucucgagaug

SEQ ID NO: 1577786 - RNA, 14 nt, Human adenovirus E
cacuggcagcccag

SEQ ID NO: 1577787 - RNA, 19 nt, Human adenovirus E
uccgccgacgacagcagcg

SEQ ID NO: 1577788 - RNA, 16 nt, Human adenovirus E
cggcggcgaugcagcc

SEQ ID NO: 1577789 - RNA, 16 nt, Human adenovirus E
gcccgagggccgcugg

SEQ ID NO: 1577790 - RNA, 13 nt, Human adenovirus E
ggcgagcucgacg

SEQ ID NO: 1577791 - RNA, 20 nt, Human adenovirus E
cgcgaguucgccccccggcg

SEQ ID NO: 1577792 - RNA, 14 nt, Human adenovirus E
cggugaugcucucc

SEQ ID NO: 1577793 - RNA, 12 nt, Human adenovirus E
gaggcagcagca

SEQ ID NO: 1577794 - RNA, 18 nt, Human adenovirus E
ggggcagaacgugcugca

SEQ ID NO: 1577795 - RNA, 17 nt, Human adenovirus E
cagaccagucgccaggg

SEQ ID NO: 1577796 - RNA, 17 nt, Human adenovirus E
ggagcuccuggagcgag

SEQ ID NO: 1577797 - RNA, 22 nt, Human adenovirus E
aucccugagcuccucccucagc

SEQ ID NO: 1577798 - RNA, 18 nt, Human adenovirus E
gcacccgccccccucgca

SEQ ID NO: 1577799 - RNA, 13 nt, Human adenovirus E
guggcgcagcuga

SEQ ID NO: 1577800 - RNA, 15 nt, Human adenovirus E
ccaacgugcagacca

SEQ ID NO: 1577801 - RNA, 17 nt, Human adenovirus E
ggccgcgaacgcucugc

SEQ ID NO: 1577802 - RNA, 14 nt, Human adenovirus E
aggacagccugcaa

SEQ ID NO: 1577803 - RNA, 20 nt, Human adenovirus E
guaccccaccaugcagcuga

SEQ ID NO: 1577804 - RNA, 23 nt, Human adenovirus E
accgccgacgagaagcagcagca

SEQ ID NO: 1577805 - RNA, 19 nt, Human adenovirus E
cuuucauuuuugcgcacau

SEQ ID NO: 1577806 - RNA, 19 nt, Human adenovirus E
ucuucgagggucugggcag

SEQ ID NO: 1577807 - RNA, 14 nt, Human adenovirus E
cucgcuguccuggc

SEQ ID NO: 1577808 - RNA, 23 nt, Human adenovirus E
aaagaagacgauaaacucacuuu

SEQ ID NO: 1577809 - RNA, 19 nt, Human adenovirus E
aucgcuuacagccugugca

SEQ ID NO: 1577810 - RNA, 21 nt, Human adenovirus E
caggcacacgcacuaccacca

SEQ ID NO: 1577811 - RNA, 21 nt, Human adenovirus E
uguccacccgcucucugcuca

SEQ ID NO: 1577812 - RNA, 22 nt, Human adenovirus E
gauggacuacuugcaucgggcg

SEQ ID NO: 1577813 - RNA, 22 nt, Human adenovirus E
acggguucgugcgccaggccug

SEQ ID NO: 1577814 - RNA, 17 nt, Human adenovirus E
cccguucucgcucgcca

SEQ ID NO: 1577815 - RNA, 16 nt, Human adenovirus E
ccgcccaaggccgagc

SEQ ID NO: 1577816 - RNA, 14 nt, Human adenovirus E
uggacccaggccau

SEQ ID NO: 1577817 - RNA, 20 nt, Human adenovirus E
gcaggagggggccaccccca

SEQ ID NO: 1577818 - RNA, 23 nt, Human adenovirus E
gcaucuuggccuggaucuugaga

SEQ ID NO: 1577819 - RNA, 20 nt, Human adenovirus E
  misc_feature (7)..(7): n is a, c, g or u
uccccgnuacuaacaaccaa

SEQ ID NO: 1577820 - RNA, 14 nt, Human adenovirus E
cgcuguccggccgc

SEQ ID NO: 1577821 - RNA, 17 nt, Human adenovirus E
gaagcgcucgauggucu

SEQ ID NO: 1577822 - RNA, 15 nt, Human adenovirus E
ccgcgcgcgcgcuac

SEQ ID NO: 1577823 - RNA, 17 nt, Human adenovirus E
gauggccacgggcagcc

SEQ ID NO: 1577824 - RNA, 13 nt, Human adenovirus E
cucccuggccugc

SEQ ID NO: 1577825 - RNA, 14 nt, Human adenovirus E
agggcggccagacg

SEQ ID NO: 1577826 - RNA, 20 nt, Human adenovirus E
gcaccaguuccgccaggagg

SEQ ID NO: 1577827 - RNA, 23 nt, Human adenovirus E
cguacgagagcgugaugcagcag

SEQ ID NO: 1577828 - RNA, 15 nt, Human adenovirus E
ccuccuuggaagagg

SEQ ID NO: 1577829 - RNA, 14 nt, Human adenovirus E
gaaagagcagaacu

SEQ ID NO: 1577830 - RNA, 17 nt, Human adenovirus E
ugagggagagacagcug

SEQ ID NO: 1577831 - RNA, 16 nt, Human adenovirus E
caggaaauuccccagc

SEQ ID NO: 1577832 - RNA, 15 nt, Human adenovirus E
cacagaaccaccagg

SEQ ID NO: 1577833 - RNA, 18 nt, Human adenovirus E
uccaccaacgccaccguc

SEQ ID NO: 1577834 - RNA, 15 nt, Human adenovirus E
gacguuacugucguu

SEQ ID NO: 1577835 - RNA, 19 nt, Human adenovirus E
auggcaccucucgcccccg

SEQ ID NO: 1577836 - RNA, 20 nt, Human adenovirus E
cuaccucuaccucugccaca

SEQ ID NO: 1577837 - RNA, 20 nt, Human adenovirus E
caguauccggggaguccagc

SEQ ID NO: 1577838 - RNA, 15 nt, Human adenovirus E
ugggcgugcagaccg

SEQ ID NO: 1577839 - RNA, 12 nt, Human adenovirus E
gacccugggccu

SEQ ID NO: 1577840 - RNA, 17 nt, Human adenovirus E
ccgugaaggaggagagc

SEQ ID NO: 1577841 - RNA, 17 nt, Human adenovirus E
ggcgacgggcucucgcc

SEQ ID NO: 1577842 - RNA, 17 nt, Human adenovirus E
cucuucgggggcagagg

SEQ ID NO: 1577843 - RNA, 22 nt, Human adenovirus E
caaugccaccucagcucaaaau

SEQ ID NO: 1577844 - RNA, 16 nt, Human adenovirus E
ugcggcgggcgcagca

SEQ ID NO: 1577845 - RNA, 14 nt, Human adenovirus E
acgcgcacuuccuc

SEQ ID NO: 1577846 - RNA, 20 nt, Human adenovirus E
gccgcgcccugggccaggac

SEQ ID NO: 1577847 - RNA, 22 nt, Human adenovirus E
cgggcccugaccggggccggga

SEQ ID NO: 1577848 - RNA, 14 nt, Human adenovirus E
uaaucacacacgcc

SEQ ID NO: 1577849 - RNA, 17 nt, Human adenovirus E
ggcgauguugagcugca

SEQ ID NO: 1577850 - RNA, 23 nt, Human adenovirus E
agaccgacuuuaugggccggucc

SEQ ID NO: 1577851 - RNA, 20 nt, Human adenovirus E
gcgcgccgggcggcaggggc

SEQ ID NO: 1577852 - RNA, 19 nt, Human adenovirus E
gccccgcccgccaugcagc

SEQ ID NO: 1577853 - RNA, 17 nt, Human adenovirus E
cuaccucgacccccaga

SEQ ID NO: 1577854 - RNA, 22 nt, Human adenovirus E
aaagcaaggaggaugcagcagc

SEQ ID NO: 1577855 - RNA, 18 nt, Human adenovirus E
ccaggccgugcagcggca

SEQ ID NO: 1577856 - RNA, 16 nt, Human adenovirus E
agucucauugccguca

SEQ ID NO: 1577857 - RNA, 22 nt, Human adenovirus E
cucaugcaucucuucagcacuc

SEQ ID NO: 1577858 - RNA, 13 nt, Human adenovirus E
acgagaagcagca

SEQ ID NO: 1577859 - RNA, 22 nt, Human adenovirus E
ugcuugcauuucaaucccaaca

SEQ ID NO: 1577860 - RNA, 19 nt, Human adenovirus E
ggucuaaggaaucuucucu

SEQ ID NO: 1577861 - RNA, 14 nt, Human adenovirus E
ggaggaagacuggg

SEQ ID NO: 1577862 - RNA, 14 nt, Human adenovirus E
gagcgaccaggagc

SEQ ID NO: 1577863 - RNA, 13 nt, Human adenovirus E
accgcgaggccau

SEQ ID NO: 1577864 - RNA, 16 nt, Human adenovirus E
guagacguagaggggc

SEQ ID NO: 1577865 - RNA, 14 nt, Human adenovirus E
uacugaucugauac

SEQ ID NO: 1577866 - RNA, 13 nt, Human adenovirus E
caacuuccugacc

SEQ ID NO: 1577867 - RNA, 23 nt, Human adenovirus E
gcccgcggagcacgaggaggagc

SEQ ID NO: 1577868 - RNA, 11 nt, Human adenovirus E
accugcuggag

SEQ ID NO: 1577869 - RNA, 18 nt, Human adenovirus E
uguaccgcgaggccaucg

SEQ ID NO: 1577870 - RNA, 21 nt, Human adenovirus E
agcuguuccugguggugcagc

SEQ ID NO: 1577871 - RNA, 19 nt, Human adenovirus E
ugcuccugguucaccugca

SEQ ID NO: 1577872 - RNA, 14 nt, Human adenovirus E
guggaagaagcagc

SEQ ID NO: 1577873 - RNA, 20 nt, Human adenovirus E
uucuuaucugccuccuccaa

SEQ ID NO: 1577874 - RNA, 21 nt, Human adenovirus E
accuugcagcaggugcugccg

SEQ ID NO: 1577875 - RNA, 12 nt, Human adenovirus E
cgauaaacucac

SEQ ID NO: 1577876 - RNA, 20 nt, Human adenovirus E
agccacagcgacccaugcuc

SEQ ID NO: 1577877 - RNA, 19 nt, Human adenovirus E
acugcucgaucuccuccuc

SEQ ID NO: 1577878 - RNA, 22 nt, Human adenovirus E
uggagcagucucuggagcgggc

SEQ ID NO: 1577879 - RNA, 16 nt, Human adenovirus E
gaggcagguccagacc

SEQ ID NO: 1577880 - RNA, 15 nt, Human adenovirus E
uugucggaucaaauu

SEQ ID NO: 1577881 - RNA, 21 nt, Human adenovirus E
gagccgcgcccugggccagga

SEQ ID NO: 1577882 - RNA, 16 nt, Human adenovirus E
ccgcgcuugcugggcg

SEQ ID NO: 1577883 - RNA, 13 nt, Human adenovirus E
gaggccagcaccc

SEQ ID NO: 1577884 - RNA, 19 nt, Human adenovirus E
gaggcguacaugccgcaga

SEQ ID NO: 1577885 - RNA, 16 nt, Human adenovirus E
uuggcgauggagcgca

SEQ ID NO: 1577886 - RNA, 20 nt, Human adenovirus E
gcuauguuggagcaacauuu

SEQ ID NO: 1577887 - RNA, 22 nt, Human adenovirus E
ugagcaaagagauucccacgcc

SEQ ID NO: 1577888 - RNA, 22 nt, Human adenovirus E
ucgcaucaggccccgcagcagu

SEQ ID NO: 1577889 - RNA, 23 nt, Human adenovirus E
cuucugcccccgccccagcagca

SEQ ID NO: 1577890 - RNA, 11 nt, Human adenovirus E
ccugcaucucg

SEQ ID NO: 1577891 - RNA, 22 nt, Human adenovirus E
gcuucuucaacgagcaggccgu

SEQ ID NO: 1577892 - RNA, 14 nt, Human adenovirus E
cgguccuuccaggg

SEQ ID NO: 1577893 - RNA, 14 nt, Human adenovirus E
cagauccucaggua

SEQ ID NO: 1577894 - RNA, 15 nt, Human adenovirus E
ccauagccagccgac

SEQ ID NO: 1577895 - RNA, 17 nt, Human adenovirus E
cacuucacuccccucuu

SEQ ID NO: 1577896 - RNA, 15 nt, Human adenovirus E
gcccacuccgagacg

SEQ ID NO: 1577897 - RNA, 15 nt, Human adenovirus E
gcccuuuucaaccug

SEQ ID NO: 1577898 - RNA, 21 nt, Human adenovirus E
gaagacgaggaggaggcagag

SEQ ID NO: 1577899 - RNA, 16 nt, Human adenovirus E
agugucuggaggagca

SEQ ID NO: 1577900 - RNA, 19 nt, Human adenovirus E
ggcaccggagcacccccgc

SEQ ID NO: 1577901 - RNA, 17 nt, Human adenovirus E
agcucgcgguugagaag

SEQ ID NO: 1577902 - RNA, 15 nt, Human adenovirus E
gauggaaguggccag

SEQ ID NO: 1577903 - RNA, 20 nt, Human adenovirus E
caucgagauugaccugggcu

SEQ ID NO: 1577904 - RNA, 20 nt, Human adenovirus E
ggcgcacguggacgagcaga

SEQ ID NO: 1577905 - RNA, 12 nt, Human adenovirus E
ugcggcgggcgc

SEQ ID NO: 1577906 - RNA, 14 nt, Human adenovirus E
cuggagaugaugcu

SEQ ID NO: 1577907 - RNA, 14 nt, Human adenovirus E
ggcgaguaccugga

SEQ ID NO: 1577908 - RNA, 13 nt, Human adenovirus E
ccccgcgcgcgcg

SEQ ID NO: 1577909 - RNA, 16 nt, Human adenovirus E
auuguuuuuugcaauc

SEQ ID NO: 1577910 - RNA, 20 nt, Human adenovirus E
ccauggugggcacgcacccg

SEQ ID NO: 1577911 - RNA, 22 nt, Human adenovirus E
ccaugcgcgcggcgcggagccu

SEQ ID NO: 1577912 - RNA, 16 nt, Human adenovirus E
cgcgacggugucgagc

SEQ ID NO: 1577913 - RNA, 22 nt, Human adenovirus E
ggggccgggaccgagggggaga

SEQ ID NO: 1577914 - RNA, 18 nt, Human adenovirus E
ggcgccagcgccggcagg

SEQ ID NO: 1577915 - RNA, 22 nt, Human adenovirus E
gacgcccaggccgaaguccagc

SEQ ID NO: 1577916 - RNA, 13 nt, Human adenovirus E
aauuauauaugca

SEQ ID NO: 1577917 - RNA, 16 nt, Human adenovirus E
gcagccccgcucgggu

SEQ ID NO: 1577918 - RNA, 14 nt, Human adenovirus E
caucgugcagaacc

SEQ ID NO: 1577919 - RNA, 13 nt, Human adenovirus E
ggggacgagcugc

SEQ ID NO: 1577920 - RNA, 18 nt, Human adenovirus E
ccagcagccgccgccgca

SEQ ID NO: 1577921 - RNA, 18 nt, Human adenovirus E
uggugggccuuuggaaga

SEQ ID NO: 1577922 - RNA, 22 nt, Human adenovirus E
cuucacccccacggaggccagc

SEQ ID NO: 1577923 - RNA, 15 nt, Human adenovirus E
cuacagaaagcacag

SEQ ID NO: 1577924 - RNA, 17 nt, Human adenovirus E
ggaagcuauguuggagc

SEQ ID NO: 1577925 - RNA, 20 nt, Human adenovirus E
ggaggccaucgugcagaacc

SEQ ID NO: 1577926 - RNA, 19 nt, Human adenovirus E
ucaccacuacuaucucuuc

SEQ ID NO: 1577927 - RNA, 16 nt, Human adenovirus E
ucagcaguuugggcag

SEQ ID NO: 1577928 - RNA, 13 nt, Human adenovirus E
ugcuagucagcgg

SEQ ID NO: 1577929 - RNA, 22 nt, Human adenovirus E
caagagcuucuucaacgagcag

SEQ ID NO: 1577930 - RNA, 20 nt, Human adenovirus E
cuccgaggucaaccaaccuc

SEQ ID NO: 1577931 - RNA, 22 nt, Human adenovirus E
ggacugggggacaaagguaccc

SEQ ID NO: 1577932 - RNA, 20 nt, Human adenovirus E
ugcccgucuacuccaagagc

SEQ ID NO: 1577933 - RNA, 14 nt, Human adenovirus E
ugcaagacuccgag

SEQ ID NO: 1577934 - RNA, 19 nt, Human adenovirus E
accaucgucaaggaugcgc

SEQ ID NO: 1577935 - RNA, 16 nt, Human adenovirus E
cccaacuacgcgcugc

SEQ ID NO: 1577936 - RNA, 14 nt, Human adenovirus E
agauauuugcaauu

SEQ ID NO: 1577937 - RNA, 14 nt, Human adenovirus E
cgcgguccuccucg

SEQ ID NO: 1577938 - RNA, 16 nt, Human adenovirus E
ugccgcgguccuccuc

SEQ ID NO: 1577939 - RNA, 19 nt, Human adenovirus E
cucaacccaccccacccag

SEQ ID NO: 1577940 - RNA, 12 nt, Human adenovirus E
cccuagccgccu

SEQ ID NO: 1577941 - RNA, 15 nt, Human adenovirus E
uacacagacaaccac

SEQ ID NO: 1577942 - RNA, 12 nt, Human adenovirus E
gggccaccccca

SEQ ID NO: 1577943 - RNA, 19 nt, Human adenovirus E
cugcgcgcgcccagcaaga

SEQ ID NO: 1577944 - RNA, 23 nt, Human adenovirus E
aguguuuuauugauucaacaguu

SEQ ID NO: 1577945 - RNA, 13 nt, Human adenovirus E
ugccuucugcuac

SEQ ID NO: 1577946 - RNA, 22 nt, Human adenovirus E
ggcggcgcaucgcccggcggca

SEQ ID NO: 1577947 - RNA, 21 nt, Human adenovirus E
cgcucgcgguggggcggccag

SEQ ID NO: 1577948 - RNA, 14 nt, Human adenovirus E
gggccuggccgccg

SEQ ID NO: 1577949 - RNA, 16 nt, Human adenovirus E
acgggacgcagggcca

SEQ ID NO: 1577950 - RNA, 17 nt, Human adenovirus E
ggcagaggaggaggaga

SEQ ID NO: 1577951 - RNA, 13 nt, Human adenovirus E
ccccuccacagcc

SEQ ID NO: 1577952 - RNA, 15 nt, Human adenovirus E
acccggacgugcagc

SEQ ID NO: 1577953 - RNA, 22 nt, Human adenovirus E
ccugcucgagugccacugccgc

SEQ ID NO: 1577954 - RNA, 13 nt, Human adenovirus E
cccccacccaguc

SEQ ID NO: 1577955 - RNA, 14 nt, Human adenovirus E
acgcgcugcuggag

SEQ ID NO: 1577956 - RNA, 18 nt, Human adenovirus E
ggaggauguccaagcgca

SEQ ID NO: 1577957 - RNA, 15 nt, Human adenovirus E
ccaaaagauccccgu

SEQ ID NO: 1577958 - RNA, 14 nt, Human adenovirus E
gaagcgugggccug

SEQ ID NO: 1577959 - RNA, 13 nt, Human adenovirus E
uggugcaggagcg

SEQ ID NO: 1577960 - RNA, 13 nt, Human adenovirus E
cggacgugcagcc

SEQ ID NO: 1577961 - RNA, 22 nt, Human adenovirus E
uggucuccacguuccacacagu

SEQ ID NO: 1577962 - RNA, 17 nt, Human adenovirus E
cagcuugcccucggccu

SEQ ID NO: 1577963 - RNA, 18 nt, Human adenovirus E
ccggcggcgcacgggcag

SEQ ID NO: 1577964 - RNA, 22 nt, Human adenovirus E
gccugcaagacagucuggagga

SEQ ID NO: 1577965 - RNA, 15 nt, Human adenovirus E
ugacguccugcagga

SEQ ID NO: 1577966 - RNA, 13 nt, Human adenovirus E
ugcucuuugccuu

SEQ ID NO: 1577967 - RNA, 19 nt, Human adenovirus E
uuggaagcaguaguacaga

SEQ ID NO: 1577968 - RNA, 14 nt, Human adenovirus E
ugcaucccagcugg

SEQ ID NO: 1577969 - RNA, 17 nt, Human adenovirus E
ggaccccgugaccgagc

SEQ ID NO: 1577970 - RNA, 14 nt, Human adenovirus E
agcuuaccuuugga

SEQ ID NO: 1577971 - RNA, 12 nt, Human adenovirus E
uccugcacaggc

SEQ ID NO: 1577972 - RNA, 14 nt, Human adenovirus E
agauguacggaggc

SEQ ID NO: 1577973 - RNA, 15 nt, Human adenovirus E
acggcaagcgcagcc

SEQ ID NO: 1577974 - RNA, 15 nt, Human adenovirus E
ugcagcaggcgaugg

SEQ ID NO: 1577975 - RNA, 18 nt, Human adenovirus E
uggaauuugagcugcccg

SEQ ID NO: 1577976 - RNA, 21 nt, Human adenovirus E
gccccaguacgcgcucagcac

SEQ ID NO: 1577977 - RNA, 22 nt, Human adenovirus E
ccuucuccggcucccccggcca

SEQ ID NO: 1577978 - RNA, 22 nt, Human adenovirus E
aguuuggaagcaguaguacaga

SEQ ID NO: 1577979 - RNA, 20 nt, Human adenovirus E
uccugguucaccugcagcag

SEQ ID NO: 1577980 - RNA, 21 nt, Human adenovirus E
gucuauguuggcacagcacag

SEQ ID NO: 1577981 - RNA, 22 nt, Human adenovirus E
caccggcauucuuaagcacacc

SEQ ID NO: 1577982 - RNA, 18 nt, Human adenovirus E
ccgggcuaccgcggcacg

SEQ ID NO: 1577983 - RNA, 14 nt, Human adenovirus E
gcgcgaggagguga

SEQ ID NO: 1577984 - RNA, 21 nt, Human adenovirus E
gagggcgagaucgagggcgag

SEQ ID NO: 1577985 - RNA, 21 nt, Human adenovirus E
ugcccucggacuucgugccgc

SEQ ID NO: 1577986 - RNA, 16 nt, Human adenovirus E
agggugcugagggacg

SEQ ID NO: 1577987 - RNA, 21 nt, Human adenovirus E
gaugauauucuggagcaggcg

SEQ ID NO: 1577988 - RNA, 15 nt, Human adenovirus E
gccaggaggacuaca

SEQ ID NO: 1577989 - RNA, 19 nt, Human adenovirus E
accgaaagagggugcugag

SEQ ID NO: 1577990 - RNA, 22 nt, Human adenovirus E
ucauuuguuggcauuaccccua

SEQ ID NO: 1577991 - RNA, 23 nt, Human adenovirus E
ggcucgucugccguagucuggag

SEQ ID NO: 1577992 - RNA, 14 nt, Human adenovirus E
ggagcuguccaggg

SEQ ID NO: 1577993 - RNA, 15 nt, Human adenovirus E
uccacgagccaggug

SEQ ID NO: 1577994 - RNA, 16 nt, Human adenovirus E
aggccucucagcgcca

SEQ ID NO: 1577995 - RNA, 23 nt, Human adenovirus E
gcacccuuguacgauaccacccg

SEQ ID NO: 1577996 - RNA, 21 nt, Human adenovirus E
gcaaguuccggagcagcuggg

SEQ ID NO: 1577997 - RNA, 12 nt, Human adenovirus E
gucgccagggcu

SEQ ID NO: 1577998 - RNA, 21 nt, Human adenovirus E
cugcugggccuuggcucccuc

SEQ ID NO: 1577999 - RNA, 14 nt, Human adenovirus E
caccucgcccugcu

SEQ ID NO: 1578000 - RNA, 20 nt, Human adenovirus E
uccuccgcggccggccauug

SEQ ID NO: 1578001 - RNA, 21 nt, Human adenovirus E
acgcgcucagcaccgaggagg

SEQ ID NO: 1578002 - RNA, 16 nt, Human adenovirus E
cauucuuaagcacacc

SEQ ID NO: 1578003 - RNA, 15 nt, Human adenovirus E
gucaccaccaagaac

SEQ ID NO: 1578004 - RNA, 14 nt, Human adenovirus E
cagcaccaggcagg

SEQ ID NO: 1578005 - RNA, 15 nt, Human adenovirus E
ccuccacccucccag

SEQ ID NO: 1578006 - RNA, 16 nt, Human adenovirus E
aucguucucuccagca

SEQ ID NO: 1578007 - RNA, 15 nt, Human adenovirus E
ucaccugcagcagau

SEQ ID NO: 1578008 - RNA, 17 nt, Human adenovirus E
cgaacuccauggcuugc

SEQ ID NO: 1578009 - RNA, 17 nt, Human adenovirus E
accuggccaaccaggcc

SEQ ID NO: 1578010 - RNA, 14 nt, Human adenovirus E
ccuccugcacaggc

SEQ ID NO: 1578011 - RNA, 13 nt, Human adenovirus E
cccgcgcgugcag

SEQ ID NO: 1578012 - RNA, 18 nt, Human adenovirus E
acaguuuuacaggauucg

SEQ ID NO: 1578013 - RNA, 14 nt, Human adenovirus E
gcuguagcagaacc

SEQ ID NO: 1578014 - RNA, 19 nt, Human adenovirus E
gccucaggcugacgcugcg

SEQ ID NO: 1578015 - RNA, 17 nt, Human adenovirus E
caugguggcgcugaacg

SEQ ID NO: 1578016 - RNA, 15 nt, Human adenovirus E
aacccgggagcugag

SEQ ID NO: 1578017 - RNA, 20 nt, Human adenovirus E
cauggcccgcgggcagggac

SEQ ID NO: 1578018 - RNA, 23 nt, Human adenovirus E
ggaaugggccagacccagccaga

SEQ ID NO: 1578019 - RNA, 17 nt, Human adenovirus E
cccagggauaggagcuc

SEQ ID NO: 1578020 - RNA, 15 nt, Human adenovirus E
cgcgugaagaccgcg

SEQ ID NO: 1578021 - RNA, 13 nt, Human adenovirus E
gaaaaucgcccag

SEQ ID NO: 1578022 - RNA, 13 nt, Human adenovirus E
cugagggacgagg

SEQ ID NO: 1578023 - RNA, 15 nt, Human adenovirus E
gggaguugcgcgccg

SEQ ID NO: 1578024 - RNA, 19 nt, Human adenovirus E
gugcacgaagcccugcagg

SEQ ID NO: 1578025 - RNA, 21 nt, Human adenovirus E
cacgccccgcaaucaccucaa

SEQ ID NO: 1578026 - RNA, 13 nt, Human adenovirus E
gagcagcagcaca

SEQ ID NO: 1578027 - RNA, 17 nt, Human adenovirus E
acgggacgcagggccau

SEQ ID NO: 1578028 - RNA, 15 nt, Human adenovirus E
uccggaauccugccc

SEQ ID NO: 1578029 - RNA, 21 nt, Human adenovirus E
acccccacggaggccagcacc

SEQ ID NO: 1578030 - RNA, 13 nt, Human adenovirus E
cugggcagcgacg

SEQ ID NO: 1578031 - RNA, 20 nt, Human adenovirus E
gccaggugaggucgggcugg

SEQ ID NO: 1578032 - RNA, 19 nt, Human adenovirus E
uuucuagaaacgaggagga

SEQ ID NO: 1578033 - RNA, 23 nt, Human adenovirus E
ggacgacccgggcaaccuggaag

SEQ ID NO: 1578034 - RNA, 16 nt, Human adenovirus E
ggcccggcaggccacc

SEQ ID NO: 1578035 - RNA, 22 nt, Human adenovirus E
gcacccggcgucgugcacgcag

SEQ ID NO: 1578036 - RNA, 22 nt, Human adenovirus E
cuggugaacauucugcagagca

SEQ ID NO: 1578037 - RNA, 18 nt, Human adenovirus E
gaagacgcgcgccgggcg

SEQ ID NO: 1578038 - RNA, 16 nt, Human adenovirus E
ccugggccugaugcac

SEQ ID NO: 1578039 - RNA, 23 nt, Human adenovirus E
ccggaauccugcccgccaccugc

SEQ ID NO: 1578040 - RNA, 16 nt, Human adenovirus E
cuuccaucauccccac

SEQ ID NO: 1578041 - RNA, 19 nt, Human adenovirus E
ugcggcgggcgcagcagcg

SEQ ID NO: 1578042 - RNA, 16 nt, Human adenovirus E
aagaggcagcagcagc

SEQ ID NO: 1578043 - RNA, 14 nt, Human adenovirus E
aggaugagcugaag

SEQ ID NO: 1578044 - RNA, 13 nt, Human adenovirus E
ggggcggccagcu

SEQ ID NO: 1578045 - RNA, 13 nt, Human adenovirus E
uccucgcagcccc

SEQ ID NO: 1578046 - RNA, 19 nt, Human adenovirus E
uaucaugcaacuuggaagg

SEQ ID NO: 1578047 - RNA, 15 nt, Human adenovirus E
ggugccgcccaggac

SEQ ID NO: 1578048 - RNA, 14 nt, Human adenovirus E
caacgaugaaguaa

SEQ ID NO: 1578049 - RNA, 17 nt, Human adenovirus E
aguucauguacagcaac

SEQ ID NO: 1578050 - RNA, 17 nt, Human adenovirus E
ccacgguggcuuccagc

SEQ ID NO: 1578051 - RNA, 19 nt, Human adenovirus E
ggccgccgugagcggggcu

SEQ ID NO: 1578052 - RNA, 22 nt, Human adenovirus E
ggucagcgacgagcagcuggcc

SEQ ID NO: 1578053 - RNA, 14 nt, Human adenovirus E
cuggaucugacgcc

SEQ ID NO: 1578054 - RNA, 17 nt, Human adenovirus E
ggagacgcgcggccacg

SEQ ID NO: 1578055 - RNA, 13 nt, Human adenovirus E
cguugggcaggga

SEQ ID NO: 1578056 - RNA, 14 nt, Human adenovirus E
cacgcucgccagca

SEQ ID NO: 1578057 - RNA, 15 nt, Human adenovirus E
caccaaucagucccg

SEQ ID NO: 1578058 - RNA, 15 nt, Human adenovirus E
cacccucgcucuggu

SEQ ID NO: 1578059 - RNA, 17 nt, Human adenovirus E
cacgguggcuuccagca

SEQ ID NO: 1578060 - RNA, 13 nt, Human adenovirus E
ugcaucucccagg

SEQ ID NO: 1578061 - RNA, 15 nt, Human adenovirus E
ggcuccuggaccugg

SEQ ID NO: 1578062 - RNA, 15 nt, Human adenovirus E
gcugcugcugcuggu

SEQ ID NO: 1578063 - RNA, 12 nt, Human adenovirus E
agcggggcugga

SEQ ID NO: 1578064 - RNA, 23 nt, Human adenovirus E
guuggguuucggugacggcgggg

SEQ ID NO: 1578065 - RNA, 19 nt, Human adenovirus E
uccggccgcgagggugcug

SEQ ID NO: 1578066 - RNA, 16 nt, Human adenovirus E
gcgcccgccuaccuga

SEQ ID NO: 1578067 - RNA, 19 nt, Human adenovirus E
ugaccccgaugaccggcug

SEQ ID NO: 1578068 - RNA, 14 nt, Human adenovirus E
cggcagaugcgccc

SEQ ID NO: 1578069 - RNA, 19 nt, Human adenovirus E
gccaaccucgccaucugcc

SEQ ID NO: 1578070 - RNA, 14 nt, Human adenovirus E
ccacuggcucccgc

SEQ ID NO: 1578071 - RNA, 16 nt, Human adenovirus E
ugggccgguccucgag

SEQ ID NO: 1578072 - RNA, 15 nt, Human adenovirus E
accgccgcggccgcc

SEQ ID NO: 1578073 - RNA, 19 nt, Human adenovirus E
agcagaaaaagaccagcag

SEQ ID NO: 1578074 - RNA, 12 nt, Human adenovirus E
gcacagcacagg

SEQ ID NO: 1578075 - RNA, 19 nt, Human adenovirus E
ucaacuucucggugcugag

SEQ ID NO: 1578076 - RNA, 13 nt, Human adenovirus E
gcggaaccacagg

SEQ ID NO: 1578077 - RNA, 20 nt, Human adenovirus E
cugcagcgggcccugaccgg

SEQ ID NO: 1578078 - RNA, 19 nt, Human adenovirus E
ucccagcggcgaggaggau

SEQ ID NO: 1578079 - RNA, 18 nt, Human adenovirus E
agcauugccaaaugcaag

SEQ ID NO: 1578080 - RNA, 16 nt, Human adenovirus E
cgagcuccagcuccag

SEQ ID NO: 1578081 - RNA, 16 nt, Human adenovirus E
cagaugcggcgguaca

SEQ ID NO: 1578082 - RNA, 21 nt, Human adenovirus E
ggucucaaagcuccgcuugcc

SEQ ID NO: 1578083 - RNA, 15 nt, Human adenovirus E
aacacgacuuucaaa

SEQ ID NO: 1578084 - RNA, 15 nt, Human adenovirus E
cgugcccaagcagaa

SEQ ID NO: 1578085 - RNA, 15 nt, Human adenovirus E
gagcgcgagcaagga

SEQ ID NO: 1578086 - RNA, 13 nt, Human adenovirus E
cgggguugcagca

SEQ ID NO: 1578087 - RNA, 22 nt, Human adenovirus E
cccauggaaacgcagaccgagc

SEQ ID NO: 1578088 - RNA, 20 nt, Human adenovirus E
cgagcuugguggcgaaggag

SEQ ID NO: 1578089 - RNA, 18 nt, Human adenovirus E
gccgccgcaagaccacca

SEQ ID NO: 1578090 - RNA, 16 nt, Human adenovirus E
acgacccgcaaccccg

SEQ ID NO: 1578091 - RNA, 23 nt, Human adenovirus E
auccgcagcagcgagcugggcag

SEQ ID NO: 1578092 - RNA, 14 nt, Human adenovirus E
cacccaucaucaug

SEQ ID NO: 1578093 - RNA, 23 nt, Human adenovirus E
gcaaacacaugucccccucgucc

SEQ ID NO: 1578094 - RNA, 13 nt, Human adenovirus E
caucggcaccagc

SEQ ID NO: 1578095 - RNA, 20 nt, Human adenovirus E
agauccucagguaaaucaag

SEQ ID NO: 1578096 - RNA, 20 nt, Human adenovirus E
gcccauggaaacgcagaccg

SEQ ID NO: 1578097 - RNA, 15 nt, Human adenovirus E
ugcccuucucgcuga

SEQ ID NO: 1578098 - RNA, 15 nt, Human adenovirus E
ccaacgcuccacgca

SEQ ID NO: 1578099 - RNA, 15 nt, Human adenovirus E
acccacugcugaacc

SEQ ID NO: 1578100 - RNA, 23 nt, Human adenovirus E
ggcagggauacaaguccuggcgg

SEQ ID NO: 1578101 - RNA, 20 nt, Human adenovirus E
guugaugaccugggcggcga

SEQ ID NO: 1578102 - RNA, 20 nt, Human adenovirus E
ccgcgaucccugagcuccuc

SEQ ID NO: 1578103 - RNA, 18 nt, Human adenovirus E
ccugaccggggccgggac

SEQ ID NO: 1578104 - RNA, 22 nt, Human adenovirus E
auggcggcggcggcgaugcagc

SEQ ID NO: 1578105 - RNA, 14 nt, Human adenovirus E
ccgaauaccacagc

SEQ ID NO: 1578106 - RNA, 14 nt, Human adenovirus E
cgcgcccgcgcuug

SEQ ID NO: 1578107 - RNA, 20 nt, Human adenovirus E
aaccaugaagauccuaggcc

SEQ ID NO: 1578108 - RNA, 15 nt, Human adenovirus E
cgcgcccugggccag

SEQ ID NO: 1578109 - RNA, 14 nt, Human adenovirus E
ucccgcaucugcac

SEQ ID NO: 1578110 - RNA, 21 nt, Human adenovirus E
agggucccgugccccuggggu

SEQ ID NO: 1578111 - RNA, 23 nt, Human adenovirus E
gcaaagcccccgaucccuccagg

SEQ ID NO: 1578112 - RNA, 23 nt, Human adenovirus E
cucagcguggaggagcucagccg

SEQ ID NO: 1578113 - RNA, 15 nt, Human adenovirus E
cagagguugccagcu

SEQ ID NO: 1578114 - RNA, 19 nt, Human adenovirus E
acuccccuccugcacaggc

SEQ ID NO: 1578115 - RNA, 16 nt, Human adenovirus E
caggcagcggggacag

SEQ ID NO: 1578116 - RNA, 15 nt, Human adenovirus E
auuaccucugcucua

SEQ ID NO: 1578117 - RNA, 20 nt, Human adenovirus E
agguuuaaaauuugaagaug

SEQ ID NO: 1578118 - RNA, 15 nt, Human adenovirus E
uagaaugaccacaac

SEQ ID NO: 1578119 - RNA, 15 nt, Human adenovirus E
acacggccaccaagg

SEQ ID NO: 1578120 - RNA, 20 nt, Human adenovirus E
gcauuaccccuacacaugau

SEQ ID NO: 1578121 - RNA, 18 nt, Human adenovirus E
ucacggacagcggcagca

SEQ ID NO: 1578122 - RNA, 13 nt, Human adenovirus E
agcuggcagugcg

SEQ ID NO: 1578123 - RNA, 20 nt, Human adenovirus E
ucaugaacugcucgaucucc

SEQ ID NO: 1578124 - RNA, 15 nt, Human adenovirus E
gagacgcccaggccg

SEQ ID NO: 1578125 - RNA, 17 nt, Human adenovirus E
aagagauggaggaaucc

SEQ ID NO: 1578126 - RNA, 13 nt, Human adenovirus E
gcgagacgcccag

SEQ ID NO: 1578127 - RNA, 12 nt, Human adenovirus E
cacagcacaggc

SEQ ID NO: 1578128 - RNA, 20 nt, Human adenovirus E
cugacggagucuuccaacuc

SEQ ID NO: 1578129 - RNA, 15 nt, Human adenovirus E
ucacggcguacgagc

SEQ ID NO: 1578130 - RNA, 13 nt, Human adenovirus E
augcagcagcuga

SEQ ID NO: 1578131 - RNA, 23 nt, Human adenovirus E
gagguaguugagcgugguggcga

SEQ ID NO: 1578132 - RNA, 17 nt, Human adenovirus E
ccaggacuacuccaccc

SEQ ID NO: 1578133 - RNA, 14 nt, Human adenovirus E
cagcacccagacca

SEQ ID NO: 1578134 - RNA, 14 nt, Human adenovirus E
gugcgagggggcga

SEQ ID NO: 1578135 - RNA, 19 nt, Human adenovirus E
ggcgcugcagagccagccg

SEQ ID NO: 1578136 - RNA, 22 nt, Human adenovirus E
gccacaccacagcuaccuccag

SEQ ID NO: 1578137 - RNA, 13 nt, Human adenovirus E
cccgaggaagcaa

SEQ ID NO: 1578138 - RNA, 15 nt, Human adenovirus E
cagaacgugcugcac

SEQ ID NO: 1578139 - RNA, 14 nt, Human adenovirus E
ccagaacgaccaca

SEQ ID NO: 1578140 - RNA, 13 nt, Human adenovirus E
cacgcccagcaca

SEQ ID NO: 1578141 - RNA, 15 nt, Human adenovirus E
caaccaccccugccg

SEQ ID NO: 1578142 - RNA, 18 nt, Human adenovirus E
gacccggacgugcagccc

SEQ ID NO: 1578143 - RNA, 11 nt, Human adenovirus E
acgagcugacg

SEQ ID NO: 1578144 - RNA, 11 nt, Human adenovirus E
ccgagccacag

SEQ ID NO: 1578145 - RNA, 15 nt, Human adenovirus E
uaacauuuuugccau

SEQ ID NO: 1578146 - RNA, 14 nt, Human adenovirus E
ggcacgacaggcag

SEQ ID NO: 1578147 - RNA, 11 nt, Human adenovirus E
ggaccacugcc

SEQ ID NO: 1578148 - RNA, 21 nt, Human adenovirus E
uggcacgacaggcagcgggga

SEQ ID NO: 1578149 - RNA, 23 nt, Human adenovirus E
cguggaacagcaccacagggcag

SEQ ID NO: 1578150 - RNA, 21 nt, Human adenovirus E
gcaccgggugauccuccacca

SEQ ID NO: 1578151 - RNA, 21 nt, Human adenovirus E
ucgagggucugggcagcgacg

SEQ ID NO: 1578152 - RNA, 13 nt, Human adenovirus E
accccugccgccc

SEQ ID NO: 1578153 - RNA, 20 nt, Human adenovirus E
acuucucgcgcuucugcugu

SEQ ID NO: 1578154 - RNA, 17 nt, Human adenovirus E
gcgcacccgccccccuc

SEQ ID NO: 1578155 - RNA, 15 nt, Human adenovirus E
cucuguccccggugc

SEQ ID NO: 1578156 - RNA, 17 nt, Human adenovirus E
gugaacauucugcagag

SEQ ID NO: 1578157 - RNA, 15 nt, Human adenovirus E
auccccagauaauuu

SEQ ID NO: 1578158 - RNA, 16 nt, Human adenovirus E
caguauccgcagcagc

SEQ ID NO: 1578159 - RNA, 16 nt, Human adenovirus E
accgucguccucggcg

SEQ ID NO: 1578160 - RNA, 23 nt, Human adenovirus E
gcgccgcagcaguggcagcggcc

SEQ ID NO: 1578161 - RNA, 17 nt, Human adenovirus E
ggcgggggagaugagcu

SEQ ID NO: 1578162 - RNA, 14 nt, Human adenovirus E
gcgaacgcucugca

SEQ ID NO: 1578163 - RNA, 16 nt, Human adenovirus E
cucgagugccacugcc

SEQ ID NO: 1578164 - RNA, 22 nt, Human adenovirus E
cugggguucauguugugcagga

SEQ ID NO: 1578165 - RNA, 15 nt, Human adenovirus E
gcccugggccaggac

SEQ ID NO: 1578166 - RNA, 16 nt, Human adenovirus E
gacaagcuggaacacu

SEQ ID NO: 1578167 - RNA, 23 nt, Human adenovirus E
gcugacaguaugauuuuuuacaa

SEQ ID NO: 1578168 - RNA, 16 nt, Human adenovirus E
cagucaggcagaggag

SEQ ID NO: 1578169 - RNA, 21 nt, Human adenovirus E
agccuuguugcgcagggccag

SEQ ID NO: 1578170 - RNA, 13 nt, Human adenovirus E
guacuuggccagc

SEQ ID NO: 1578171 - RNA, 13 nt, Human adenovirus E
gccgcuggcuccu

SEQ ID NO: 1578172 - RNA, 15 nt, Human adenovirus E
gaucccugcuugcau

SEQ ID NO: 1578173 - RNA, 16 nt, Human adenovirus E
ugcggcgcggccugga

SEQ ID NO: 1578174 - RNA, 12 nt, Human adenovirus E
cagcggcagcau

SEQ ID NO: 1578175 - RNA, 20 nt, Human adenovirus E
aucacccuagugagcugcgg

SEQ ID NO: 1578176 - RNA, 17 nt, Human adenovirus E
agcaggucgggcgcgga

SEQ ID NO: 1578177 - RNA, 14 nt, Human adenovirus E
ugaccuugcagcag

SEQ ID NO: 1578178 - RNA, 15 nt, Human adenovirus E
ugcgcgucggccagg

SEQ ID NO: 1578179 - RNA, 19 nt, Human adenovirus E
cagcggccaucgccagcau

SEQ ID NO: 1578180 - RNA, 14 nt, Human adenovirus E
cugcugguggcccc

SEQ ID NO: 1578181 - RNA, 22 nt, Human adenovirus E
aggccaucgugcagaaccccac

SEQ ID NO: 1578182 - RNA, 16 nt, Human adenovirus E
gcgccgggcggcaggg

SEQ ID NO: 1578183 - RNA, 20 nt, Human adenovirus E
gcagcaaaguuagccuugca

SEQ ID NO: 1578184 - RNA, 14 nt, Human adenovirus E
acgauccccgggcg

SEQ ID NO: 1578185 - RNA, 16 nt, Human adenovirus E
cgagaccgagcuccag

SEQ ID NO: 1578186 - RNA, 18 nt, Human adenovirus E
ggaucagcaucaucuggg

SEQ ID NO: 1578187 - RNA, 19 nt, Human adenovirus E
agaugagccgcuggaagac

SEQ ID NO: 1578188 - RNA, 16 nt, Human adenovirus E
cggcgcaaacccggga

SEQ ID NO: 1578189 - RNA, 17 nt, Human adenovirus E
cgugagcggggcuggac

SEQ ID NO: 1578190 - RNA, 14 nt, Human adenovirus E
caucaucugggccu

SEQ ID NO: 1578191 - RNA, 17 nt, Human adenovirus E
cgcgcggcuggcggugc

SEQ ID NO: 1578192 - RNA, 21 nt, Human adenovirus E
ugcagaacaaugacuucaccc

SEQ ID NO: 1578193 - RNA, 19 nt, Human adenovirus E
  misc_feature (8)..(8): n is a, c, g or u
uacacucnugcaccauccc

SEQ ID NO: 1578194 - RNA, 15 nt, Human adenovirus E
gccaggacgacccgg

SEQ ID NO: 1578195 - RNA, 14 nt, Human adenovirus E
cgccagcuuugcag

SEQ ID NO: 1578196 - RNA, 20 nt, Human adenovirus E
gacagcacucaggcagagga

SEQ ID NO: 1578197 - RNA, 15 nt, Human adenovirus E
ccaacgcgcaccgca

SEQ ID NO: 1578198 - RNA, 13 nt, Human adenovirus E
caggaagcagaga

SEQ ID NO: 1578199 - RNA, 13 nt, Human adenovirus E
gaguuuuuccagg

SEQ ID NO: 1578200 - RNA, 14 nt, Human adenovirus E
gcaagcuccugcag

SEQ ID NO: 1578201 - RNA, 20 nt, Human adenovirus E
cagagaaugagcagagucag

SEQ ID NO: 1578202 - RNA, 18 nt, Human adenovirus E
gcgggguuucuucuuggg

SEQ ID NO: 1578203 - RNA, 14 nt, Human adenovirus E
cgugcagccacagc

SEQ ID NO: 1578204 - RNA, 22 nt, Human adenovirus E
gggcugccgcuguccgagaagc

SEQ ID NO: 1578205 - RNA, 15 nt, Human adenovirus E
ucccaacaaaugcca

SEQ ID NO: 1578206 - RNA, 21 nt, Human adenovirus E
gcccgugggcggcggccuggg

SEQ ID NO: 1578207 - RNA, 13 nt, Human adenovirus E
caccguggugcag

SEQ ID NO: 1578208 - RNA, 22 nt, Human adenovirus E
acggcgcagcuguuccuggugg

SEQ ID NO: 1578209 - RNA, 16 nt, Human adenovirus E
gugcacccgugcagcc

SEQ ID NO: 1578210 - RNA, 16 nt, Human adenovirus E
ccgcggcgccgcgccg

SEQ ID NO: 1578211 - RNA, 12 nt, Human adenovirus E
gagugaugaaga

SEQ ID NO: 1578212 - RNA, 15 nt, Human adenovirus E
gcaaggaccugagcg

SEQ ID NO: 1578213 - RNA, 16 nt, Human adenovirus E
gccuccuuggaagagg

SEQ ID NO: 1578214 - RNA, 14 nt, Human adenovirus E
uaggagcuccugga

SEQ ID NO: 1578215 - RNA, 15 nt, Human adenovirus E
agcaagcagcacgga

SEQ ID NO: 1578216 - RNA, 15 nt, Human adenovirus E
uccccuccugcacag

SEQ ID NO: 1578217 - RNA, 17 nt, Human adenovirus E
ggcgaagacgcgcgccg

SEQ ID NO: 1578218 - RNA, 17 nt, Human adenovirus E
guccggguggaugauga

SEQ ID NO: 1578219 - RNA, 15 nt, Human adenovirus E
agaagccccuggggg

SEQ ID NO: 1578220 - RNA, 16 nt, Human adenovirus E
cugaaaguggagcugc

SEQ ID NO: 1578221 - RNA, 22 nt, Human adenovirus E
gaccuaccaggagaucacccac

SEQ ID NO: 1578222 - RNA, 15 nt, Human adenovirus E
acgcccgcgccaaga

SEQ ID NO: 1578223 - RNA, 23 nt, Human adenovirus E
aagucuauguuggcacagcacag

SEQ ID NO: 1578224 - RNA, 19 nt, Human adenovirus E
guuguuggccagcugcacc

SEQ ID NO: 1578225 - RNA, 22 nt, Human adenovirus E
ucgcgccugcugcugcugcugg

SEQ ID NO: 1578226 - RNA, 22 nt, Human adenovirus E
ccagacaugcaagagauggagg

SEQ ID NO: 1578227 - RNA, 14 nt, Human adenovirus E
agccuaggccacaa

SEQ ID NO: 1578228 - RNA, 21 nt, Human adenovirus E
guucaucaauaaacugaugga

SEQ ID NO: 1578229 - RNA, 21 nt, Human adenovirus E
gugccccgguucgaggccggc

SEQ ID NO: 1578230 - RNA, 13 nt, Human adenovirus E
cggcagugguggc

SEQ ID NO: 1578231 - RNA, 16 nt, Human adenovirus E
uuccgcgcucccuggg

SEQ ID NO: 1578232 - RNA, 13 nt, Human adenovirus E
uggaagagcggcg

SEQ ID NO: 1578233 - RNA, 17 nt, Human adenovirus E
cccaacccgcgccucaa

SEQ ID NO: 1578234 - RNA, 22 nt, Human adenovirus E
  misc_feature (10)..(10): n is a, c, g or u
ggcucauuanuccagcagaggc

SEQ ID NO: 1578235 - RNA, 15 nt, Human adenovirus E
gcaaacccgggagcu

SEQ ID NO: 1578236 - RNA, 17 nt, Human adenovirus E
ucaucaugagcaaagag

SEQ ID NO: 1578237 - RNA, 16 nt, Human adenovirus E
aggacaaaaaggaaga

SEQ ID NO: 1578238 - RNA, 18 nt, Human adenovirus E
ugacaguacaggagccau

SEQ ID NO: 1578239 - RNA, 12 nt, Human adenovirus E
cuuaccuuuggu

SEQ ID NO: 1578240 - RNA, 12 nt, Human adenovirus E
ugcuugcugcua

SEQ ID NO: 1578241 - RNA, 23 nt, Human adenovirus E
cauggaggugcagacggaucccu

SEQ ID NO: 1578242 - RNA, 17 nt, Human adenovirus E
ucguuguuggccagcug

SEQ ID NO: 1578243 - RNA, 20 nt, Human adenovirus E
ugcacaauaucuuugaggag

SEQ ID NO: 1578244 - RNA, 16 nt, Human adenovirus E
ucgggcaucagcugga

SEQ ID NO: 1578245 - RNA, 18 nt, Human adenovirus E
uggccaacuaccuggccu

SEQ ID NO: 1578246 - RNA, 20 nt, Human adenovirus E
agggaacguguacugggugc

SEQ ID NO: 1578247 - RNA, 14 nt, Human adenovirus E
cccgcgcuccugga

SEQ ID NO: 1578248 - RNA, 18 nt, Human adenovirus E
cagaagcacacagcucaa

SEQ ID NO: 1578249 - RNA, 14 nt, Human adenovirus E
gcuucacgcucgcc

SEQ ID NO: 1578250 - RNA, 19 nt, Human adenovirus E
cgugccccagggcauggga

SEQ ID NO: 1578251 - RNA, 12 nt, Human adenovirus E
cgcgcuggugga

SEQ ID NO: 1578252 - RNA, 20 nt, Human adenovirus E
caugaucaagcccagcacca

SEQ ID NO: 1578253 - RNA, 22 nt, Human adenovirus E
gccgcagcaguggcagcggccg

SEQ ID NO: 1578254 - RNA, 15 nt, Human adenovirus E
gacuccguggcucug

SEQ ID NO: 1578255 - RNA, 22 nt, Human adenovirus E
gggggugcgcucccggcggcgc

SEQ ID NO: 1578256 - RNA, 21 nt, Human adenovirus E
agggcgugcgcuccuggacgc

SEQ ID NO: 1578257 - RNA, 19 nt, Human adenovirus E
ugcccuucgcccuagccgc

SEQ ID NO: 1578258 - RNA, 13 nt, Human adenovirus E
cccugggccagga

SEQ ID NO: 1578259 - RNA, 20 nt, Human adenovirus E
gaaggugcggggguccccgu

SEQ ID NO: 1578260 - RNA, 20 nt, Human adenovirus E
ggucacggcguacgagcaga

SEQ ID NO: 1578261 - RNA, 14 nt, Human adenovirus E
ccaagaacagccag

SEQ ID NO: 1578262 - RNA, 19 nt, Human adenovirus E
cguacuugcuguagcagaa

SEQ ID NO: 1578263 - RNA, 14 nt, Human adenovirus E
cagggcggccagac

SEQ ID NO: 1578264 - RNA, 17 nt, Human adenovirus E
ggagcuggagugccugc

SEQ ID NO: 1578265 - RNA, 22 nt, Human adenovirus E
cugcugaauaucaccgagcccg

SEQ ID NO: 1578266 - RNA, 21 nt, Human adenovirus E
gacccagaucaucggcaccuu

SEQ ID NO: 1578267 - RNA, 15 nt, Human adenovirus E
caguauccgcagcag

SEQ ID NO: 1578268 - RNA, 13 nt, Human adenovirus E
acuucgugccgcu

SEQ ID NO: 1578269 - RNA, 15 nt, Human adenovirus E
ugcucuuugccuuca

SEQ ID NO: 1578270 - RNA, 15 nt, Human adenovirus E
ccugugggaccugcu

SEQ ID NO: 1578271 - RNA, 16 nt, Human adenovirus E
acagcaaccucaggca

SEQ ID NO: 1578272 - RNA, 14 nt, Human adenovirus E
gcgcaggccggagc

SEQ ID NO: 1578273 - RNA, 14 nt, Human adenovirus E
guugugguccuggg

SEQ ID NO: 1578274 - RNA, 16 nt, Human adenovirus E
gcgccagcgccggcag

SEQ ID NO: 1578275 - RNA, 15 nt, Human adenovirus E
agcucaaccccggcu

SEQ ID NO: 1578276 - RNA, 13 nt, Human adenovirus E
cccgagggccgcu

SEQ ID NO: 1578277 - RNA, 22 nt, Human adenovirus E
cugcugcugguggcccccuuca

SEQ ID NO: 1578278 - RNA, 18 nt, Human adenovirus E
ugccugaacgccugcugg

SEQ ID NO: 1578279 - RNA, 15 nt, Human adenovirus E
cagaugcgcccccac

SEQ ID NO: 1578280 - RNA, 15 nt, Human adenovirus E
caaccucaggcacac

SEQ ID NO: 1578281 - RNA, 13 nt, Human adenovirus E
cuaccucugccac

SEQ ID NO: 1578282 - RNA, 18 nt, Human adenovirus E
gaagaccccggcgcaagu

SEQ ID NO: 1578283 - RNA, 21 nt, Human adenovirus E
acgcccuuuucaaccuggguc

SEQ ID NO: 1578284 - RNA, 19 nt, Human adenovirus E
ucgacaagaugaauacacc

SEQ ID NO: 1578285 - RNA, 18 nt, Human adenovirus E
  misc_feature (6)..(6): n is a, c, g or u
ccccgnuacuaacaacca

SEQ ID NO: 1578286 - RNA, 23 nt, Human adenovirus E
acaagucuauguuggcacagcac

SEQ ID NO: 1578287 - RNA, 17 nt, Human adenovirus E
gucccccacccaguccc

SEQ ID NO: 1578288 - RNA, 17 nt, Human adenovirus E
ucgcccuagccgccucc

SEQ ID NO: 1578289 - RNA, 19 nt, Human adenovirus E
acaaaauaaaauaaaguuc

SEQ ID NO: 1578290 - RNA, 12 nt, Human adenovirus E
cacccucgcucu

SEQ ID NO: 1578291 - RNA, 16 nt, Human adenovirus E
cugucgagagccacac

SEQ ID NO: 1578292 - RNA, 20 nt, Human adenovirus E
cuggccugcacccucaucuc

SEQ ID NO: 1578293 - RNA, 21 nt, Human adenovirus E
uucuacacuaaaaaaauacug

SEQ ID NO: 1578294 - RNA, 20 nt, Human adenovirus E
acacgggguugcagcacugg

SEQ ID NO: 1578295 - RNA, 15 nt, Human adenovirus E
cgcugcucaccaccu

SEQ ID NO: 1578296 - RNA, 21 nt, Human adenovirus E
gcuccgcgacacggcacgcgg

SEQ ID NO: 1578297 - RNA, 18 nt, Human adenovirus E
accgccuaccgcagcugg

SEQ ID NO: 1578298 - RNA, 21 nt, Human adenovirus E
cggcggcgaagacgcgcgccg

SEQ ID NO: 1578299 - RNA, 13 nt, Human adenovirus E
gaacucuugcagg

SEQ ID NO: 1578300 - RNA, 23 nt, Human adenovirus E
ucgaaggcgggcaugaccucggc

SEQ ID NO: 1578301 - RNA, 14 nt, Human adenovirus E
gcccgaggaagcaa

SEQ ID NO: 1578302 - RNA, 17 nt, Human adenovirus E
gagccggucguccccgg

SEQ ID NO: 1578303 - RNA, 19 nt, Human adenovirus E
cccaucauguacgccagca

SEQ ID NO: 1578304 - RNA, 21 nt, Human adenovirus E
aauugucgcuaugauugaaaa

SEQ ID NO: 1578305 - RNA, 14 nt, Human adenovirus E
cgcgcgcacguggc

SEQ ID NO: 1578306 - RNA, 13 nt, Human adenovirus E
ggacgaggagggc

SEQ ID NO: 1578307 - RNA, 23 nt, Human adenovirus E
ccgcgccaaccgcacccgcgccg

SEQ ID NO: 1578308 - RNA, 18 nt, Human adenovirus E
ggaucgcuguccacgagc

SEQ ID NO: 1578309 - RNA, 14 nt, Human adenovirus E
cagcaggcggcgcg

SEQ ID NO: 1578310 - RNA, 13 nt, Human adenovirus E
ccugauggcucug

SEQ ID NO: 1578311 - RNA, 15 nt, Human adenovirus E
agagcaugagcacca

SEQ ID NO: 1578312 - RNA, 19 nt, Human adenovirus E
caacgcgcugcuggagcgc

SEQ ID NO: 1578313 - RNA, 13 nt, Human adenovirus E
ccgaggugccccu

SEQ ID NO: 1578314 - RNA, 19 nt, Human adenovirus E
uucuaucauuaccucugcu

SEQ ID NO: 1578315 - RNA, 18 nt, Human adenovirus E
agugccacugccgcugca

SEQ ID NO: 1578316 - RNA, 15 nt, Human adenovirus E
ccucugcacgccgca

SEQ ID NO: 1578317 - RNA, 14 nt, Human adenovirus E
ccccuacacaugau

SEQ ID NO: 1578318 - RNA, 23 nt, Human adenovirus E
ggaaguggccagaucguccaggg

SEQ ID NO: 1578319 - RNA, 18 nt, Human adenovirus E
agcccggguccaggccag

SEQ ID NO: 1578320 - RNA, 19 nt, Human adenovirus E
cugccgcugcgcagcagua

SEQ ID NO: 1578321 - RNA, 17 nt, Human adenovirus E
cguggaggagcucagcc

SEQ ID NO: 1578322 - RNA, 21 nt, Human adenovirus E
caggacccuacguagaagagg

SEQ ID NO: 1578323 - RNA, 19 nt, Human adenovirus E
ucuccaguucguggaggag

SEQ ID NO: 1578324 - RNA, 21 nt, Human adenovirus E
cauaguugugguccuggguga

SEQ ID NO: 1578325 - RNA, 17 nt, Human adenovirus E
caggagcgcgggcugcc

SEQ ID NO: 1578326 - RNA, 19 nt, Human adenovirus E
gagcccgcgcgggaggcag

SEQ ID NO: 1578327 - RNA, 13 nt, Human adenovirus E
aagcgugggccug

SEQ ID NO: 1578328 - RNA, 17 nt, Human adenovirus E
ugcaugccaacccuucc

SEQ ID NO: 1578329 - RNA, 22 nt, Human adenovirus E
cggcgaaguugaaaaacuggga

SEQ ID NO: 1578330 - RNA, 18 nt, Human adenovirus E
gagccgcgcccugggcca

SEQ ID NO: 1578331 - RNA, 21 nt, Human adenovirus E
acagggcaauccucgcacaga

SEQ ID NO: 1578332 - RNA, 21 nt, Human adenovirus E
cuaugccaucuuccagcagag

SEQ ID NO: 1578333 - RNA, 19 nt, Human adenovirus E
caacaugguagcccaucau

SEQ ID NO: 1578334 - RNA, 14 nt, Human adenovirus E
cuccggaauccugc

SEQ ID NO: 1578335 - RNA, 23 nt, Human adenovirus E
ugacggccuuguaggcgcagcag

SEQ ID NO: 1578336 - RNA, 17 nt, Human adenovirus E
uccaagaagaggcagca

SEQ ID NO: 1578337 - RNA, 16 nt, Human adenovirus E
gccacgaccgccgcgg

SEQ ID NO: 1578338 - RNA, 17 nt, Human adenovirus E
ccggggcgggggagaug

SEQ ID NO: 1578339 - RNA, 19 nt, Human adenovirus E
gcacccgugcagccacagc

SEQ ID NO: 1578340 - RNA, 20 nt, Human adenovirus E
gcgacacggucauguggaug

SEQ ID NO: 1578341 - RNA, 17 nt, Human adenovirus E
agcaugaugcccacggc

SEQ ID NO: 1578342 - RNA, 17 nt, Human adenovirus E
caucuccgcuccggguc

SEQ ID NO: 1578343 - RNA, 21 nt, Human adenovirus E
cagcagugucuggaggagcag

SEQ ID NO: 1578344 - RNA, 17 nt, Human adenovirus E
ggacgaugaggacuccg

SEQ ID NO: 1578345 - RNA, 12 nt, Human adenovirus E
ggcagcgccgcc

SEQ ID NO: 1578346 - RNA, 16 nt, Human adenovirus E
gaagcugaaaguggag

SEQ ID NO: 1578347 - RNA, 14 nt, Human adenovirus E
cgccgcccagcccc

SEQ ID NO: 1578348 - RNA, 21 nt, Human adenovirus E
cuccaagucugugccacccuc

SEQ ID NO: 1578349 - RNA, 13 nt, Human adenovirus E
cgcucccuggccu

SEQ ID NO: 1578350 - RNA, 13 nt, Human adenovirus E
cccgccaccugcu

SEQ ID NO: 1578351 - RNA, 21 nt, Human adenovirus E
agcggccgaccgcgauggcuc

SEQ ID NO: 1578352 - RNA, 21 nt, Human adenovirus E
gcacgugcauguucucgcgca

SEQ ID NO: 1578353 - RNA, 19 nt, Human adenovirus E
aucagcaucaucugggccu

SEQ ID NO: 1578354 - RNA, 20 nt, Human adenovirus E
cgacugcgucuaccucuacc

SEQ ID NO: 1578355 - RNA, 15 nt, Human adenovirus E
gcuaccugcugcgcc

SEQ ID NO: 1578356 - RNA, 17 nt, Human adenovirus E
cccggcggcaccggagc

SEQ ID NO: 1578357 - RNA, 21 nt, Human adenovirus E
accggcucucggccauccugg

SEQ ID NO: 1578358 - RNA, 20 nt, Human adenovirus E
agccgcgcccugggccagga

SEQ ID NO: 1578359 - RNA, 17 nt, Human adenovirus E
cccugaagcaaacagac

SEQ ID NO: 1578360 - RNA, 23 nt, Human adenovirus E
augagguccacacugguggccac

SEQ ID NO: 1578361 - RNA, 15 nt, Human adenovirus E
cuucacgccucguca

SEQ ID NO: 1578362 - RNA, 15 nt, Human adenovirus E
cucaccaaggccaug

SEQ ID NO: 1578363 - RNA, 18 nt, Human adenovirus E
auucccacggagcccaug

SEQ ID NO: 1578364 - RNA, 15 nt, Human adenovirus E
aggcggcggcaggac

SEQ ID NO: 1578365 - RNA, 16 nt, Human adenovirus E
ugaggccgagccacag

SEQ ID NO: 1578366 - RNA, 18 nt, Human adenovirus E
caugcaacuuggaaggga

SEQ ID NO: 1578367 - RNA, 15 nt, Human adenovirus E
cggcuucccccagga

SEQ ID NO: 1578368 - RNA, 15 nt, Human adenovirus E
agagguucccaagau

SEQ ID NO: 1578369 - RNA, 19 nt, Human adenovirus E
caaccuggaagccacccug

SEQ ID NO: 1578370 - RNA, 17 nt, Human adenovirus E
ucccggcggcgcucuga

SEQ ID NO: 1578371 - RNA, 17 nt, Human adenovirus E
caucgccucgcugaacu

SEQ ID NO: 1578372 - RNA, 13 nt, Human adenovirus E
ccgaggagggcaa

SEQ ID NO: 1578373 - RNA, 19 nt, Human adenovirus E
ucagucucaaguccagcaa

SEQ ID NO: 1578374 - RNA, 16 nt, Human adenovirus E
ggcgcgagcugagcga

SEQ ID NO: 1578375 - RNA, 19 nt, Human adenovirus E
ccacaagaaguaccucacc

SEQ ID NO: 1578376 - RNA, 16 nt, Human adenovirus E
gaggucaaggugcggc

SEQ ID NO: 1578377 - RNA, 14 nt, Human adenovirus E
gcuugcccucggcc

SEQ ID NO: 1578378 - RNA, 22 nt, Human adenovirus E
cgcgcuugcugggcgaagagga

SEQ ID NO: 1578379 - RNA, 21 nt, Human adenovirus E
ucucugcucaauauauagccc

SEQ ID NO: 1578380 - RNA, 17 nt, Human adenovirus E
guucgugcccgaggacu

SEQ ID NO: 1578381 - RNA, 14 nt, Human adenovirus E
cgugguccugguga

SEQ ID NO: 1578382 - RNA, 23 nt, Human adenovirus E
gccguugauguuguggcccacga

SEQ ID NO: 1578383 - RNA, 19 nt, Human adenovirus E
cccggugcugacggcuccc

SEQ ID NO: 1578384 - RNA, 20 nt, Human adenovirus E
  misc_feature (8)..(8): n is a, c, g or u
cucauuanuccagcagaggc

SEQ ID NO: 1578385 - RNA, 18 nt, Human adenovirus E
cuucggaucuucagccag

SEQ ID NO: 1578386 - RNA, 17 nt, Human adenovirus E
ugaccaccguggugcag

SEQ ID NO: 1578387 - RNA, 22 nt, Human adenovirus E
gaugcggcccaugagcugcgag

SEQ ID NO: 1578388 - RNA, 17 nt, Human adenovirus E
guaccaguccgggccgg

SEQ ID NO: 1578389 - RNA, 14 nt, Human adenovirus E
cucgccgcucgccg

SEQ ID NO: 1578390 - RNA, 13 nt, Human adenovirus E
cggcccucagcau

SEQ ID NO: 1578391 - RNA, 13 nt, Human adenovirus E
uccucuucuuggu

SEQ ID NO: 1578392 - RNA, 23 nt, Human adenovirus E
gccggacuacuucuuccagacca

SEQ ID NO: 1578393 - RNA, 23 nt, Human adenovirus E
agcagcaacuuccagccacgacc

SEQ ID NO: 1578394 - RNA, 13 nt, Human adenovirus E
ccggagcugucca

SEQ ID NO: 1578395 - RNA, 13 nt, Human adenovirus E
cccacggccgcca

SEQ ID NO: 1578396 - RNA, 21 nt, Human adenovirus E
gaucagcaucaucugggccug

SEQ ID NO: 1578397 - RNA, 21 nt, Human adenovirus E
caccguggaaugggccagacc

SEQ ID NO: 1578398 - RNA, 18 nt, Human adenovirus E
ucagggaggcgcugcuga

SEQ ID NO: 1578399 - RNA, 22 nt, Human adenovirus E
acuaggaacuucaggcugggcu

SEQ ID NO: 1578400 - RNA, 23 nt, Human adenovirus E
cagcuguuccugguggugcagca

SEQ ID NO: 1578401 - RNA, 15 nt, Human adenovirus E
ugacggcggccugcc

SEQ ID NO: 1578402 - RNA, 19 nt, Human adenovirus E
cccugagcgacgaucuggg

SEQ ID NO: 1578403 - RNA, 17 nt, Human adenovirus E
ccagccgccgggccuug

SEQ ID NO: 1578404 - RNA, 16 nt, Human adenovirus E
cugaucuguagaaaaa

SEQ ID NO: 1578405 - RNA, 13 nt, Human adenovirus E
acacgcuccagcc

SEQ ID NO: 1578406 - RNA, 21 nt, Human adenovirus E
cuggcgggcggcgccacccug

SEQ ID NO: 1578407 - RNA, 15 nt, Human adenovirus E
cugccgcccuggugc

SEQ ID NO: 1578408 - RNA, 16 nt, Human adenovirus E
gaccgagcuccagcuc

SEQ ID NO: 1578409 - RNA, 22 nt, Human adenovirus E
cagauaaaccgaaguccucccc

SEQ ID NO: 1578410 - RNA, 17 nt, Human adenovirus E
gacaugcaucccagcug

SEQ ID NO: 1578411 - RNA, 20 nt, Human adenovirus E
ggugauaucuuccagauaac

SEQ ID NO: 1578412 - RNA, 15 nt, Human adenovirus E
ugucgagccugcuga

SEQ ID NO: 1578413 - RNA, 17 nt, Human adenovirus E
cagcagguggacugagg

SEQ ID NO: 1578414 - RNA, 20 nt, Human adenovirus E
gcgaccaggagcugaugcau

SEQ ID NO: 1578415 - RNA, 19 nt, Human adenovirus E
ggccgagcugucggccugc

SEQ ID NO: 1578416 - RNA, 14 nt, Human adenovirus E
cucgcagcagcugc

SEQ ID NO: 1578417 - RNA, 16 nt, Human adenovirus E
ggccugaugcaccugu

SEQ ID NO: 1578418 - RNA, 15 nt, Human adenovirus E
gucggccaugggcau

SEQ ID NO: 1578419 - RNA, 17 nt, Human adenovirus E
caagcuggaacacuuac

SEQ ID NO: 1578420 - RNA, 20 nt, Human adenovirus E
cacgaagcccugcaggaagc

SEQ ID NO: 1578421 - RNA, 14 nt, Human adenovirus E
gcgcgccaucagca

SEQ ID NO: 1578422 - RNA, 20 nt, Human adenovirus E
cccgccucguuccagacgcg

SEQ ID NO: 1578423 - RNA, 22 nt, Human adenovirus E
agcccacggccgccagcuccuc

SEQ ID NO: 1578424 - RNA, 14 nt, Human adenovirus E
gcuuucggacauuu

SEQ ID NO: 1578425 - RNA, 17 nt, Human adenovirus E
cggcccugcggugguga

SEQ ID NO: 1578426 - RNA, 20 nt, Human adenovirus E
caugcggaucucgcucaggu

SEQ ID NO: 1578427 - RNA, 15 nt, Human adenovirus E
ggccgccggugccgc

SEQ ID NO: 1578428 - RNA, 22 nt, Human adenovirus E
aacucaccccggggcuguggac

SEQ ID NO: 1578429 - RNA, 16 nt, Human adenovirus E
ucuaugcaauucugac

SEQ ID NO: 1578430 - RNA, 21 nt, Human adenovirus E
uccuccaagucugugccaccc

SEQ ID NO: 1578431 - RNA, 22 nt, Human adenovirus E
uggcuuccagcaaagccuccac

SEQ ID NO: 1578432 - RNA, 23 nt, Human adenovirus E
ggggccacgagccggggcagcgc

SEQ ID NO: 1578433 - RNA, 16 nt, Human adenovirus E
gaagcccugcaggaag

SEQ ID NO: 1578434 - RNA, 14 nt, Human adenovirus E
cucgggacccugcc

SEQ ID NO: 1578435 - RNA, 16 nt, Human adenovirus E
acaaguuucuccacca

SEQ ID NO: 1578436 - RNA, 14 nt, Human adenovirus E
ccacccuccaccgc

SEQ ID NO: 1578437 - RNA, 16 nt, Human adenovirus E
ugaauccccacuggcu

SEQ ID NO: 1578438 - RNA, 14 nt, Human adenovirus E
gcaccugugggacc

SEQ ID NO: 1578439 - RNA, 20 nt, Human adenovirus E
caagcgccgcagcaguggca

SEQ ID NO: 1578440 - RNA, 15 nt, Human adenovirus E
acugccgcugcaacc

SEQ ID NO: 1578441 - RNA, 15 nt, Human adenovirus E
gaccggggccgggac

SEQ ID NO: 1578442 - RNA, 17 nt, Human adenovirus E
gucucuucgggggcaga

SEQ ID NO: 1578443 - RNA, 14 nt, Human adenovirus E
augccccgaggaaa

SEQ ID NO: 1578444 - RNA, 14 nt, Human adenovirus E
cuuucauuuuugcg

SEQ ID NO: 1578445 - RNA, 15 nt, Human adenovirus E
uggccagcugcacca

SEQ ID NO: 1578446 - RNA, 17 nt, Human adenovirus E
ccaucugcccccaccgc

SEQ ID NO: 1578447 - RNA, 18 nt, Human adenovirus E
gcuccuagucgaagaccc

SEQ ID NO: 1578448 - RNA, 17 nt, Human adenovirus E
ugcgccaccacccccag

SEQ ID NO: 1578449 - RNA, 19 nt, Human adenovirus E
cccccggcggcgcgugcag

SEQ ID NO: 1578450 - RNA, 18 nt, Human adenovirus E
ggcgcugcagagccagcc

SEQ ID NO: 1578451 - RNA, 21 nt, Human adenovirus E
gaguucgccccccggcggcgc

SEQ ID NO: 1578452 - RNA, 22 nt, Human adenovirus E
caggccgagacgaugggcaggc

SEQ ID NO: 1578453 - RNA, 18 nt, Human adenovirus E
gcacgggacgcagggcca

SEQ ID NO: 1578454 - RNA, 17 nt, Human adenovirus E
cgcugacggcgcagcug

SEQ ID NO: 1578455 - RNA, 17 nt, Human adenovirus E
agaucucuugcacgucc

SEQ ID NO: 1578456 - RNA, 22 nt, Human adenovirus E
gcgcugguggagaacaaggcca

SEQ ID NO: 1578457 - RNA, 19 nt, Human adenovirus E
cgugcugcacaccacccug

SEQ ID NO: 1578458 - RNA, 17 nt, Human adenovirus E
aguugcaagggcccagc

SEQ ID NO: 1578459 - RNA, 12 nt, Human adenovirus E
aauaccaccuca

SEQ ID NO: 1578460 - RNA, 19 nt, Human adenovirus E
cagcggaaugccgcggugc

SEQ ID NO: 1578461 - RNA, 14 nt, Human adenovirus E
gcggcagcggccau

SEQ ID NO: 1578462 - RNA, 20 nt, Human adenovirus E
gcggccagcugaaaaccauc

SEQ ID NO: 1578463 - RNA, 16 nt, Human adenovirus E
ggggaagacgugguca

SEQ ID NO: 1578464 - RNA, 21 nt, Human adenovirus E
gcaguuauuuuuccuccaccc

SEQ ID NO: 1578465 - RNA, 17 nt, Human adenovirus E
acucagguguccagcug

SEQ ID NO: 1578466 - RNA, 12 nt, Human adenovirus E
cgaccacagcaa

SEQ ID NO: 1578467 - RNA, 23 nt, Human adenovirus E
gccgucuacucgcagcagcugcg

SEQ ID NO: 1578468 - RNA, 15 nt, Human adenovirus E
ggcuucccccaggau

SEQ ID NO: 1578469 - RNA, 19 nt, Human adenovirus E
aaaacgucacccgccccgc

SEQ ID NO: 1578470 - RNA, 21 nt, Human adenovirus E
gccaggcgcacgggacgcagg

SEQ ID NO: 1578471 - RNA, 23 nt, Human adenovirus E
uuucgcggguugggacggcugcg

SEQ ID NO: 1578472 - RNA, 21 nt, Human adenovirus E
gaagacgaaggcgcgcaggcc

SEQ ID NO: 1578473 - RNA, 16 nt, Human adenovirus E
cuugggggcgaggaag

SEQ ID NO: 1578474 - RNA, 23 nt, Human adenovirus E
uaccgcgaggccaucggccaggc

SEQ ID NO: 1578475 - RNA, 19 nt, Human adenovirus E
caaguggugcccccuccag

SEQ ID NO: 1578476 - RNA, 23 nt, Human adenovirus E
ggcacggggaacucuugcaggac

SEQ ID NO: 1578477 - RNA, 18 nt, Human adenovirus E
ccagcugaaaaccaucau

SEQ ID NO: 1578478 - RNA, 14 nt, Human adenovirus E
aacccaccacgccu

SEQ ID NO: 1578479 - RNA, 21 nt, Human adenovirus E
cuggcagcccagccgccgggc

SEQ ID NO: 1578480 - RNA, 18 nt, Human adenovirus E
ccugcuugcaggccugcg

SEQ ID NO: 1578481 - RNA, 22 nt, Human adenovirus E
gccccucagcguggaggagcuc

SEQ ID NO: 1578482 - RNA, 17 nt, Human adenovirus E
gccagaucguccagggc

SEQ ID NO: 1578483 - RNA, 20 nt, Human adenovirus E
  misc_feature (6)..(6): n is a, c, g or u
guguangccacgugaccggg

SEQ ID NO: 1578484 - RNA, 22 nt, Human adenovirus E
aucacccagucauagcaggggc

SEQ ID NO: 1578485 - RNA, 11 nt, Human adenovirus E
ggaggcagagg

SEQ ID NO: 1578486 - RNA, 19 nt, Human adenovirus E
gacccggagacgcgcggcc

SEQ ID NO: 1578487 - RNA, 13 nt, Human adenovirus E
caaagagcugucc

SEQ ID NO: 1578488 - RNA, 14 nt, Human adenovirus E
uggaggagcucagc

SEQ ID NO: 1578489 - RNA, 20 nt, Human adenovirus E
cggcccaucaagcagguggc

SEQ ID NO: 1578490 - RNA, 21 nt, Human adenovirus E
ggcgcagggcaugguguugca

SEQ ID NO: 1578491 - RNA, 22 nt, Human adenovirus E
caaagucuaaaaauacccgcca

SEQ ID NO: 1578492 - RNA, 18 nt, Human adenovirus E
gcagggcaugguguugca

SEQ ID NO: 1578493 - RNA, 18 nt, Human adenovirus E
accccgucaccaccaaga

SEQ ID NO: 1578494 - RNA, 18 nt, Human adenovirus E
aggugcggcccaucaagc

SEQ ID NO: 1578495 - RNA, 18 nt, Human adenovirus E
uugcgcagggccaggcgc

SEQ ID NO: 1578496 - RNA, 22 nt, Human adenovirus E
aucaaguggugcccccuccaga

SEQ ID NO: 1578497 - RNA, 19 nt, Human adenovirus E
gcugguggcgguguugcuu

SEQ ID NO: 1578498 - RNA, 15 nt, Human adenovirus E
uuuggaggaagacug

SEQ ID NO: 1578499 - RNA, 17 nt, Human adenovirus E
agucuggaggaagacga

SEQ ID NO: 1578500 - RNA, 16 nt, Human adenovirus E
cugcugcugcuggugg

SEQ ID NO: 1578501 - RNA, 21 nt, Human adenovirus E
ugaacgccugcugggccuugg

SEQ ID NO: 1578502 - RNA, 20 nt, Human adenovirus E
ccugcgucaucacccagggg

SEQ ID NO: 1578503 - RNA, 15 nt, Human adenovirus E
aagcaaguuccggag

SEQ ID NO: 1578504 - RNA, 21 nt, Human adenovirus E
acccagcccgccaacgugccc

SEQ ID NO: 1578505 - RNA, 22 nt, Human adenovirus E
gcccaugaucaagcccagcacc

SEQ ID NO: 1578506 - RNA, 13 nt, Human adenovirus E
cgcgagcaaggac

SEQ ID NO: 1578507 - RNA, 16 nt, Human adenovirus E
agaccgugaaggagga

SEQ ID NO: 1578508 - RNA, 13 nt, Human adenovirus E
auucuggccugca

SEQ ID NO: 1578509 - RNA, 16 nt, Human adenovirus E
cagagacaggagcggc

SEQ ID NO: 1578510 - RNA, 16 nt, Human adenovirus E
cgguuguaccuggugg

SEQ ID NO: 1578511 - RNA, 22 nt, Human adenovirus E
aggccguccugacuuuggagag

SEQ ID NO: 1578512 - RNA, 14 nt, Human adenovirus E
ggcacagcacaggc

SEQ ID NO: 1578513 - RNA, 17 nt, Human adenovirus E
gcaagccacaguacaga

SEQ ID NO: 1578514 - RNA, 21 nt, Human adenovirus E
ucgcuuacgcacgucuucaac

SEQ ID NO: 1578515 - RNA, 15 nt, Human adenovirus E
ugggcccuucgccuc

SEQ ID NO: 1578516 - RNA, 15 nt, Human adenovirus E
cgcagugggcgcaga

SEQ ID NO: 1578517 - RNA, 22 nt, Human adenovirus E
cugccgcaagaucucuugcacg

SEQ ID NO: 1578518 - RNA, 13 nt, Human adenovirus E
aggccgaucccug

SEQ ID NO: 1578519 - RNA, 20 nt, Human adenovirus E
uggaauuuuaucaaguuucu

SEQ ID NO: 1578520 - RNA, 13 nt, Human adenovirus E
gugcauguugauc

SEQ ID NO: 1578521 - RNA, 12 nt, Human adenovirus E
ccaccugcaucu

SEQ ID NO: 1578522 - RNA, 16 nt, Human adenovirus E
cugccuuggcaguaca

SEQ ID NO: 1578523 - RNA, 13 nt, Human adenovirus E
gugucgagccugc

SEQ ID NO: 1578524 - RNA, 15 nt, Human adenovirus E
cgcgucgcccaucuc

SEQ ID NO: 1578525 - RNA, 12 nt, Human adenovirus E
gccugcugcugc

SEQ ID NO: 1578526 - RNA, 20 nt, Human adenovirus E
ccucgucaggccguccugac

SEQ ID NO: 1578527 - RNA, 20 nt, Human adenovirus E
guggaagaaggaaggcagcg

SEQ ID NO: 1578528 - RNA, 12 nt, Human adenovirus E
gucuccaugagc

SEQ ID NO: 1578529 - RNA, 23 nt, Human adenovirus E
cagcaguauccggggaguccagc

SEQ ID NO: 1578530 - RNA, 14 nt, Human adenovirus E
gcccugggccagga

SEQ ID NO: 1578531 - RNA, 18 nt, Human adenovirus E
agcaaaguuagccuugca

SEQ ID NO: 1578532 - RNA, 14 nt, Human adenovirus E
ccugcacuggcagc

SEQ ID NO: 1578533 - RNA, 15 nt, Human adenovirus E
ugaaccugagccagg

SEQ ID NO: 1578534 - RNA, 17 nt, Human adenovirus E
cuggcugacguccugca

SEQ ID NO: 1578535 - RNA, 21 nt, Human adenovirus E
auccucagguaaaucaagugg

SEQ ID NO: 1578536 - RNA, 15 nt, Human adenovirus E
ggaggccagcaccca

SEQ ID NO: 1578537 - RNA, 13 nt, Human adenovirus E
gucaggcagagga

SEQ ID NO: 1578538 - RNA, 19 nt, Human adenovirus E
  misc_feature (10)..(10): n is a, c, g or u
uaaaucagcnuaccaccac

SEQ ID NO: 1578539 - RNA, 18 nt, Human adenovirus E
cagaccgguaagaaggag

SEQ ID NO: 1578540 - RNA, 21 nt, Human adenovirus E
ggaugaugauauucuggagca

SEQ ID NO: 1578541 - RNA, 17 nt, Human adenovirus E
cggccggcgcgcuccac

SEQ ID NO: 1578542 - RNA, 14 nt, Human adenovirus E
cacagcacaggcau

SEQ ID NO: 1578543 - RNA, 14 nt, Human adenovirus E
aaaauaacagccag

SEQ ID NO: 1578544 - RNA, 15 nt, Human adenovirus E
gcugcagagccagcc

SEQ ID NO: 1578545 - RNA, 14 nt, Human adenovirus E
aagauguugaagug

SEQ ID NO: 1578546 - RNA, 21 nt, Human adenovirus E
agcagguggacugaggaucgc

SEQ ID NO: 1578547 - RNA, 17 nt, Human adenovirus E
cucgacucccaccugcu

SEQ ID NO: 1578548 - RNA, 14 nt, Human adenovirus E
gccacucucucaga

SEQ ID NO: 1578549 - RNA, 14 nt, Human adenovirus E
caauggcaccugcg

SEQ ID NO: 1578550 - RNA, 17 nt, Human adenovirus E
ugcccuucgcccuagcc

SEQ ID NO: 1578551 - RNA, 21 nt, Human adenovirus E
cgggugaaugacauccgcgcc

SEQ ID NO: 1578552 - RNA, 23 nt, Human adenovirus E
cagcugaggauuguccucggugg

SEQ ID NO: 1578553 - RNA, 14 nt, Human adenovirus E
gaacgccugcuggg

SEQ ID NO: 1578554 - RNA, 16 nt, Human adenovirus E
auuagggcaagccaca

SEQ ID NO: 1578555 - RNA, 14 nt, Human adenovirus E
gggccacgagccgg

SEQ ID NO: 1578556 - RNA, 15 nt, Human adenovirus E
uggaacagcaccaca

SEQ ID NO: 1578557 - RNA, 19 nt, Human adenovirus E
agcaucaucugggccuggu

SEQ ID NO: 1578558 - RNA, 17 nt, Human adenovirus E
gcacguggacgagcaga

SEQ ID NO: 1578559 - RNA, 23 nt, Human adenovirus E
acauucuacacuaaaaaaauacu

SEQ ID NO: 1578560 - RNA, 17 nt, Human adenovirus E
cauggcuugcagggucc

SEQ ID NO: 1578561 - RNA, 18 nt, Human adenovirus E
gcuucuucaacgagcagg

SEQ ID NO: 1578562 - RNA, 22 nt, Human adenovirus E
ugccgaaaaagaaaaacagcca

SEQ ID NO: 1578563 - RNA, 17 nt, Human adenovirus E
gaccaccguggugcaga

SEQ ID NO: 1578564 - RNA, 14 nt, Human adenovirus E
cgagcgggagaaga

SEQ ID NO: 1578565 - RNA, 21 nt, Human adenovirus E
uccaagaagaggcagcagcag

SEQ ID NO: 1578566 - RNA, 19 nt, Human adenovirus E
cgcccguaaacgccggugg

SEQ ID NO: 1578567 - RNA, 14 nt, Human adenovirus E
accguggugcagaa

SEQ ID NO: 1578568 - RNA, 17 nt, Human adenovirus E
uaaacuuucgccagcuu

SEQ ID NO: 1578569 - RNA, 21 nt, Human adenovirus E
acugguagguguagagggugc

SEQ ID NO: 1578570 - RNA, 19 nt, Human adenovirus E
cguggaggagcucagccgc

SEQ ID NO: 1578571 - RNA, 15 nt, Human adenovirus E
ccacggccagggcgg

SEQ ID NO: 1578572 - RNA, 21 nt, Human adenovirus E
gacucccucagcaugaugccc

SEQ ID NO: 1578573 - RNA, 15 nt, Human adenovirus E
gcccacggcccucag

SEQ ID NO: 1578574 - RNA, 16 nt, Human adenovirus E
ccuguggggcgugcag

SEQ ID NO: 1578575 - RNA, 22 nt, Human adenovirus E
ccauaguucaacacgcuccagc

SEQ ID NO: 1578576 - RNA, 24 nt, Human adenovirus E
cggcagaacggggugcuggagagc

SEQ ID NO: 1578577 - RNA, 21 nt, Human adenovirus E
cuuucauguuacacaugcauc

SEQ ID NO: 1578578 - RNA, 14 nt, Human adenovirus E
gcagagaaugagca

SEQ ID NO: 1578579 - RNA, 15 nt, Human adenovirus E
caacccuucccaccc

SEQ ID NO: 1578580 - RNA, 17 nt, Human adenovirus E
agcccgagggccgcugg

SEQ ID NO: 1578581 - RNA, 18 nt, Human adenovirus E
gcaaccaacauuggaaau

SEQ ID NO: 1578582 - RNA, 14 nt, Human adenovirus E
uguaaaacagccac

SEQ ID NO: 1578583 - RNA, 15 nt, Human adenovirus E
ccggaugcaggggcg

SEQ ID NO: 1578584 - RNA, 13 nt, Human adenovirus E
gcgccaggccugc

SEQ ID NO: 1578585 - RNA, 18 nt, Human adenovirus E
uaccccuacacaugauca

SEQ ID NO: 1578586 - RNA, 17 nt, Human adenovirus E
agaacggggugcuggag

SEQ ID NO: 1578587 - RNA, 16 nt, Human adenovirus E
ccgccaccugcuccgc

SEQ ID NO: 1578588 - RNA, 16 nt, Human adenovirus E
ugagcaccacagcgcc

SEQ ID NO: 1578589 - RNA, 14 nt, Human adenovirus E
gugaagaugccggg

SEQ ID NO: 1578590 - RNA, 20 nt, Human adenovirus E
gaggaacaacaagcauggag

SEQ ID NO: 1578591 - RNA, 15 nt, Human adenovirus E
augaccaccugggcg

SEQ ID NO: 1578592 - RNA, 21 nt, Human adenovirus E
cuccgagacgaaagcccgggu

SEQ ID NO: 1578593 - RNA, 20 nt, Human adenovirus E
cuauaccucccuugcuguuc

SEQ ID NO: 1578594 - RNA, 14 nt, Human adenovirus E
aggagcugaugcau

SEQ ID NO: 1578595 - RNA, 15 nt, Human adenovirus E
gggugcgcgacgccg

SEQ ID NO: 1578596 - RNA, 19 nt, Human adenovirus E
gcuggcgggcggcgccacc

SEQ ID NO: 1578597 - RNA, 19 nt, Human adenovirus E
gaacucuucgcgguccuuc

SEQ ID NO: 1578598 - RNA, 20 nt, Human adenovirus E
cgggcggcgcugcagagcca

SEQ ID NO: 1578599 - RNA, 16 nt, Human adenovirus E
gagcugcccgaggagc

SEQ ID NO: 1578600 - RNA, 13 nt, Human adenovirus E
aucugccuccucc

SEQ ID NO: 1578601 - RNA, 16 nt, Human adenovirus E
cccgcuacaacagcac

SEQ ID NO: 1578602 - RNA, 15 nt, Human adenovirus E
agcgcucgcgguggg

SEQ ID NO: 1578603 - RNA, 23 nt, Human adenovirus E
auugcuauuuuggaucugacacu

SEQ ID NO: 1578604 - RNA, 19 nt, Human adenovirus E
acgugcagaccaaccugga

SEQ ID NO: 1578605 - RNA, 18 nt, Human adenovirus E
agccuggcgaacaggugg

SEQ ID NO: 1578606 - RNA, 20 nt, Human adenovirus E
aggauagcaagaacaggagc

SEQ ID NO: 1578607 - RNA, 15 nt, Human adenovirus E
cccauacuccaccuc

SEQ ID NO: 1578608 - RNA, 18 nt, Human adenovirus E
uggaggaauggcuguuga

SEQ ID NO: 1578609 - RNA, 20 nt, Human adenovirus E
gcagcagaaaaagaccagca

SEQ ID NO: 1578610 - RNA, 20 nt, Human adenovirus E
aagacgaggaggaggcagag

SEQ ID NO: 1578611 - RNA, 12 nt, Human adenovirus E
cacgaggaggag

SEQ ID NO: 1578612 - RNA, 23 nt, Human adenovirus E
ggugcagacggaucccuggaugc

SEQ ID NO: 1578613 - RNA, 19 nt, Human adenovirus E
gccgcgcucgacaugaccg

SEQ ID NO: 1578614 - RNA, 12 nt, Human adenovirus E
gcgcgugccccc

SEQ ID NO: 1578615 - RNA, 18 nt, Human adenovirus E
gcugacguccugcaggac

SEQ ID NO: 1578616 - RNA, 14 nt, Human adenovirus E
cguguucucccccc

SEQ ID NO: 1578617 - RNA, 14 nt, Human adenovirus E
ggcgcagggcaugg

SEQ ID NO: 1578618 - RNA, 18 nt, Human adenovirus E
cgagggggcgaggagccc

SEQ ID NO: 1578619 - RNA, 18 nt, Human adenovirus E
aggaggcagaggaggagg

SEQ ID NO: 1578620 - RNA, 22 nt, Human adenovirus E
accaggaaauuccccagcccac

SEQ ID NO: 1578621 - RNA, 19 nt, Human adenovirus E
cgaagccuuuagacagcag

SEQ ID NO: 1578622 - RNA, 20 nt, Human adenovirus E
cugccaccaauuggaggaau

SEQ ID NO: 1578623 - RNA, 14 nt, Human adenovirus E
ggaggaugcagcag

SEQ ID NO: 1578624 - RNA, 18 nt, Human adenovirus E
agaucuagggccucagga

SEQ ID NO: 1578625 - RNA, 18 nt, Human adenovirus E
caucaucugggccugguc

SEQ ID NO: 1578626 - RNA, 20 nt, Human adenovirus E
ucugggugaucuuggcccgg

SEQ ID NO: 1578627 - RNA, 15 nt, Human adenovirus E
ugggcguguggcagc

SEQ ID NO: 1578628 - RNA, 19 nt, Human adenovirus E
cuucggaucuucagccagc

SEQ ID NO: 1578629 - RNA, 14 nt, Human adenovirus E
gaaugccgcggugc

SEQ ID NO: 1578630 - RNA, 21 nt, Human adenovirus E
cuugaacucggggaucagcag

SEQ ID NO: 1578631 - RNA, 13 nt, Human adenovirus E
auccuccaccaga

SEQ ID NO: 1578632 - RNA, 17 nt, Human adenovirus E
cuucuacuuccuccuca

SEQ ID NO: 1578633 - RNA, 21 nt, Human adenovirus E
gaggacuacaccaacuucauc

SEQ ID NO: 1578634 - RNA, 14 nt, Human adenovirus E
cagaaaucccgcca

SEQ ID NO: 1578635 - RNA, 21 nt, Human adenovirus E
cucaaccccggcuucccccag

SEQ ID NO: 1578636 - RNA, 20 nt, Human adenovirus E
ucaaugucauuuucauacac

SEQ ID NO: 1578637 - RNA, 23 nt, Human adenovirus E
cccgcaucugcaccucacagcuc

SEQ ID NO: 1578638 - RNA, 16 nt, Human adenovirus E
gaagggcgugcgcucc

SEQ ID NO: 1578639 - RNA, 11 nt, Human adenovirus E
ugauccuccac

SEQ ID NO: 1578640 - RNA, 15 nt, Human adenovirus E
ggaagagcggcgcaa

SEQ ID NO: 1578641 - RNA, 23 nt, Human adenovirus E
cuugccauucgcgcacggccagc

SEQ ID NO: 1578642 - RNA, 18 nt, Human adenovirus E
aagcgcccgaggaagcaa

SEQ ID NO: 1578643 - RNA, 23 nt, Human adenovirus E
gagcgcggucauggaccaggugc

SEQ ID NO: 1578644 - RNA, 17 nt, Human adenovirus E
cgugcgcuccuggacgc

SEQ ID NO: 1578645 - RNA, 17 nt, Human adenovirus E
agccgcugacggcgcag

SEQ ID NO: 1578646 - RNA, 22 nt, Human adenovirus E
uagccccguccucuucccacuc

SEQ ID NO: 1578647 - RNA, 14 nt, Human adenovirus E
ucaucugggccugg

SEQ ID NO: 1578648 - RNA, 13 nt, Human adenovirus E
aaacacgacuuuc

SEQ ID NO: 1578649 - RNA, 22 nt, Human adenovirus E
ugaggacuccgccgacgacagc

SEQ ID NO: 1578650 - RNA, 13 nt, Human adenovirus E
guuguugauuuua

SEQ ID NO: 1578651 - RNA, 17 nt, Human adenovirus E
ggcccggaugcaggggc

SEQ ID NO: 1578652 - RNA, 20 nt, Human adenovirus E
gcguaggagucuugcagcuu

SEQ ID NO: 1578653 - RNA, 20 nt, Human adenovirus E
ccugcguuacgugcagcaga

SEQ ID NO: 1578654 - RNA, 15 nt, Human adenovirus E
ggccgaucccugcuu

SEQ ID NO: 1578655 - RNA, 14 nt, Human adenovirus E
ucugcaaggagaag

SEQ ID NO: 1578656 - RNA, 22 nt, Human adenovirus E
gggcaugaccucggcacucagg

SEQ ID NO: 1578657 - RNA, 22 nt, Human adenovirus E
cugagcauucacaugcucaucg

SEQ ID NO: 1578658 - RNA, 14 nt, Human adenovirus E
cauauccucuccga

SEQ ID NO: 1578659 - RNA, 16 nt, Human adenovirus E
auuauggaacuacagc

SEQ ID NO: 1578660 - RNA, 21 nt, Human adenovirus E
gcgucgcagggggccacgagc

SEQ ID NO: 1578661 - RNA, 16 nt, Human adenovirus E
guagaggugggcuugg

SEQ ID NO: 1578662 - RNA, 14 nt, Human adenovirus E
gagccaaagcaugu

SEQ ID NO: 1578663 - RNA, 12 nt, Human adenovirus E
aacagccagagc

SEQ ID NO: 1578664 - RNA, 16 nt, Human adenovirus E
ggaggagguggaagaa

SEQ ID NO: 1578665 - RNA, 22 nt, Human adenovirus E
cugggacagcacucaggcagag

SEQ ID NO: 1578666 - RNA, 23 nt, Human adenovirus E
ccaggacauggaauacaccaccc

SEQ ID NO: 1578667 - RNA, 19 nt, Human adenovirus E
caccagcaagccgcugacg

SEQ ID NO: 1578668 - RNA, 16 nt, Human adenovirus E
aaacugccgucauuuc

SEQ ID NO: 1578669 - RNA, 14 nt, Human adenovirus E
gcccagcaccagca

SEQ ID NO: 1578670 - RNA, 17 nt, Human adenovirus E
gcuguccaggguccuga

SEQ ID NO: 1578671 - RNA, 17 nt, Human adenovirus E
cuucucccaggccgaga

SEQ ID NO: 1578672 - RNA, 20 nt, Human adenovirus E
cagcaacuuccagccacgac

SEQ ID NO: 1578673 - RNA, 15 nt, Human adenovirus E
ugagcgaccaggagc

SEQ ID NO: 1578674 - RNA, 18 nt, Human adenovirus E
ugcuagaugcaacaacaa

SEQ ID NO: 1578675 - RNA, 13 nt, Human adenovirus E
cggagacccugcg

SEQ ID NO: 1578676 - RNA, 13 nt, Human adenovirus E
gcggccuggaccg

SEQ ID NO: 1578677 - RNA, 14 nt, Human adenovirus E
cagucucuggagcg

SEQ ID NO: 1578678 - RNA, 17 nt, Human adenovirus E
gcccccgaucccuccag

SEQ ID NO: 1578679 - RNA, 15 nt, Human adenovirus E
gccuucaccaccugc

SEQ ID NO: 1578680 - RNA, 16 nt, Human adenovirus E
caagccacaguacaga

SEQ ID NO: 1578681 - RNA, 16 nt, Human adenovirus E
ucaagggucuguggac

SEQ ID NO: 1578682 - RNA, 17 nt, Human adenovirus E
ggcucugaaccugcccc

SEQ ID NO: 1578683 - RNA, 14 nt, Human adenovirus E
ggcgauggagcgca

SEQ ID NO: 1578684 - RNA, 22 nt, Human adenovirus E
acgucagcggcgagggccugcu

SEQ ID NO: 1578685 - RNA, 14 nt, Human adenovirus E
cagccccgccaccu

SEQ ID NO: 1578686 - RNA, 20 nt, Human adenovirus E
aggccguggcccagcgcgag

SEQ ID NO: 1578687 - RNA, 21 nt, Human adenovirus E
ggcgcgacuacauccgcgacu

SEQ ID NO: 1578688 - RNA, 18 nt, Human adenovirus E
agccuuguugcgcagggc

SEQ ID NO: 1578689 - RNA, 17 nt, Human adenovirus E
caagaagaggcagcagc

SEQ ID NO: 1578690 - RNA, 12 nt, Human adenovirus E
auuccccagccc

SEQ ID NO: 1578691 - RNA, 22 nt, Human adenovirus E
gacgcccucgggaucgcgggcg

SEQ ID NO: 1578692 - RNA, 12 nt, Human adenovirus E
cuaacacuuugc

SEQ ID NO: 1578693 - RNA, 17 nt, Human adenovirus E
cugguggacaagaugag

SEQ ID NO: 1578694 - RNA, 17 nt, Human adenovirus E
agcugaaaguggagcug

SEQ ID NO: 1578695 - RNA, 20 nt, Human adenovirus E
agggcguuggagaggagcuu

SEQ ID NO: 1578696 - RNA, 15 nt, Human adenovirus E
aaacugucaaauacu

SEQ ID NO: 1578697 - RNA, 20 nt, Human adenovirus E
  misc_feature (11)..(11): n is a, c, g or u
aggagccguanagggcguug

SEQ ID NO: 1578698 - RNA, 19 nt, Human adenovirus E
cucuguggaaacaauaaca

SEQ ID NO: 1578699 - RNA, 15 nt, Human adenovirus E
gccagcgccggcagg

SEQ ID NO: 1578700 - RNA, 20 nt, Human adenovirus E
gcucccggcggcgcucugac

SEQ ID NO: 1578701 - RNA, 21 nt, Human adenovirus E
cugaacaguauccgcagcagc

SEQ ID NO: 1578702 - RNA, 20 nt, Human adenovirus E
cuauguuggcacagcacagg

SEQ ID NO: 1578703 - RNA, 19 nt, Human adenovirus E
gucucggugacggcgcgcc

SEQ ID NO: 1578704 - RNA, 15 nt, Human adenovirus E
ucacggugaaggggu

SEQ ID NO: 1578705 - RNA, 17 nt, Human adenovirus E
cuuaccgagcagcagca

SEQ ID NO: 1578706 - RNA, 22 nt, Human adenovirus E
ccacgcggggcgggagcugcgg

SEQ ID NO: 1578707 - RNA, 22 nt, Human adenovirus E
cagggagaugaaacccuccggg

SEQ ID NO: 1578708 - RNA, 14 nt, Human adenovirus E
gcagaacagggcaa

SEQ ID NO: 1578709 - RNA, 20 nt, Human adenovirus E
auauuaacgcgcacaaaaag

SEQ ID NO: 1578710 - RNA, 17 nt, Human adenovirus E
agcgccucggccgcgug

SEQ ID NO: 1578711 - RNA, 13 nt, Human adenovirus E
aggucgaggagaa

SEQ ID NO: 1578712 - RNA, 16 nt, Human adenovirus E
gagaagcuggcggcca

SEQ ID NO: 1578713 - RNA, 15 nt, Human adenovirus E
ucaccgagagccgcc

SEQ ID NO: 1578714 - RNA, 12 nt, Human adenovirus E
acaccuggacca

SEQ ID NO: 1578715 - RNA, 19 nt, Human adenovirus E
auuucaaucccaacaaaug

SEQ ID NO: 1578716 - RNA, 12 nt, Human adenovirus E
ucgggcggccgc

SEQ ID NO: 1578717 - RNA, 14 nt, Human adenovirus E
gcgcgcgcccagca

SEQ ID NO: 1578718 - RNA, 22 nt, Human adenovirus E
gcuaagcgaacggguugggcug

SEQ ID NO: 1578719 - RNA, 15 nt, Human adenovirus E
gucucaaagcuccgc

SEQ ID NO: 1578720 - RNA, 14 nt, Human adenovirus E
ugcgcgccgggcug

SEQ ID NO: 1578721 - RNA, 18 nt, Human adenovirus E
cccgugaggcgcgcgcag

SEQ ID NO: 1578722 - RNA, 13 nt, Human adenovirus E
ggugaugaggucc

SEQ ID NO: 1578723 - RNA, 20 nt, Human adenovirus E
ugccugagcauucacaugcu

SEQ ID NO: 1578724 - RNA, 21 nt, Human adenovirus E
gauacucaccaaggccauggc

SEQ ID NO: 1578725 - RNA, 18 nt, Human adenovirus E
cggccggauuccgcggcu

SEQ ID NO: 1578726 - RNA, 16 nt, Human adenovirus E
guagcaauugaccaug

SEQ ID NO: 1578727 - RNA, 23 nt, Human adenovirus E
gcucaccacuacuaucucuuccu

SEQ ID NO: 1578728 - RNA, 16 nt, Human adenovirus E
ccgaggcccuggccac

SEQ ID NO: 1578729 - RNA, 23 nt, Human adenovirus E
gcacggauaccaucuccgcuccg

SEQ ID NO: 1578730 - RNA, 15 nt, Human adenovirus E
cccggggcuguggac

SEQ ID NO: 1578731 - RNA, 19 nt, Human adenovirus E
ggggaacucuugcaggaca

SEQ ID NO: 1578732 - RNA, 22 nt, Human adenovirus E
agcugccguccucccggaggag

SEQ ID NO: 1578733 - RNA, 13 nt, Human adenovirus E
gggacagaggagg

SEQ ID NO: 1578734 - RNA, 21 nt, Human adenovirus E
gcuccggaauccugcccgcca

SEQ ID NO: 1578735 - RNA, 21 nt, Human adenovirus E
uaacgagcgccccuuguggaa

SEQ ID NO: 1578736 - RNA, 19 nt, Human adenovirus E
ccagccccgccaccuccga

SEQ ID NO: 1578737 - RNA, 21 nt, Human adenovirus E
ugcaggccccggucggggacc

SEQ ID NO: 1578738 - RNA, 14 nt, Human adenovirus E
caggccgugcagcg

SEQ ID NO: 1578739 - RNA, 23 nt, Human adenovirus E
cggaauaucaaaaucucugccgc

SEQ ID NO: 1578740 - RNA, 19 nt, Human adenovirus E
guucuuuuaacagaacauu

SEQ ID NO: 1578741 - RNA, 21 nt, Human adenovirus E
caaguccuggcgggggcacaa

SEQ ID NO: 1578742 - RNA, 13 nt, Human adenovirus E
uggucgcugcccg

SEQ ID NO: 1578743 - RNA, 21 nt, Human adenovirus E
aggguaucgcaaucaggcagc

SEQ ID NO: 1578744 - RNA, 23 nt, Human adenovirus E
gccaacgcuccacgcaacacccc

SEQ ID NO: 1578745 - RNA, 14 nt, Human adenovirus E
ccucaagcccguga

SEQ ID NO: 1578746 - RNA, 18 nt, Human adenovirus E
acccgugcagccacagcg

SEQ ID NO: 1578747 - RNA, 13 nt, Human adenovirus E
cucugacccugcc

SEQ ID NO: 1578748 - RNA, 14 nt, Human adenovirus E
cgccccgcucaggg

SEQ ID NO: 1578749 - RNA, 14 nt, Human adenovirus E
ugcggaugaagcac

SEQ ID NO: 1578750 - RNA, 15 nt, Human adenovirus E
ccauacuccaccucc

SEQ ID NO: 1578751 - RNA, 15 nt, Human adenovirus E
ccggguccaggccag

SEQ ID NO: 1578752 - RNA, 14 nt, Human adenovirus E
aggggacgagcugc

SEQ ID NO: 1578753 - RNA, 21 nt, Human adenovirus E
gccccgccgcccagccccgcc

SEQ ID NO: 1578754 - RNA, 23 nt, Human adenovirus E
gggaagacguggucagcucgucg

SEQ ID NO: 1578755 - RNA, 15 nt, Human adenovirus E
agaguuuggaagagc

SEQ ID NO: 1578756 - RNA, 19 nt, Human adenovirus E
cccagccccgccaccuccg

SEQ ID NO: 1578757 - RNA, 22 nt, Human adenovirus E
ccacagcgacccaugcuccccg

SEQ ID NO: 1578758 - RNA, 16 nt, Human adenovirus E
gccgcggccaaccugg

SEQ ID NO: 1578759 - RNA, 17 nt, Human adenovirus E
gccccggggccaggagg

SEQ ID NO: 1578760 - RNA, 15 nt, Human adenovirus E
cgcagccccccugcu

SEQ ID NO: 1578761 - RNA, 14 nt, Human adenovirus E
cugcccgccaccug

SEQ ID NO: 1578762 - RNA, 16 nt, Human adenovirus E
ccagaguuuggaagag

SEQ ID NO: 1578763 - RNA, 14 nt, Human adenovirus E
ggcgggcggcgcca

SEQ ID NO: 1578764 - RNA, 15 nt, Human adenovirus E
acucaccccggggcu

SEQ ID NO: 1578765 - RNA, 23 nt, Human adenovirus E
cacgguggcuuccagcaaagccu

SEQ ID NO: 1578766 - RNA, 19 nt, Human adenovirus E
aucgagauugaccugggcu

SEQ ID NO: 1578767 - RNA, 16 nt, Human adenovirus E
cucagguguccagcug

SEQ ID NO: 1578768 - RNA, 15 nt, Human adenovirus E
cgagagccgccucag

SEQ ID NO: 1578769 - RNA, 14 nt, Human adenovirus E
gaccaccguccccc

SEQ ID NO: 1578770 - RNA, 21 nt, Human adenovirus E
gcccaggccgaaguccagcug

SEQ ID NO: 1578771 - RNA, 13 nt, Human adenovirus E
augugacacuggu

SEQ ID NO: 1578772 - RNA, 23 nt, Human adenovirus E
cuucacccccacggaggccagca

SEQ ID NO: 1578773 - RNA, 13 nt, Human adenovirus E
agauccucaggua

SEQ ID NO: 1578774 - RNA, 17 nt, Human adenovirus E
ggcggcgcgugcagugg

SEQ ID NO: 1578775 - RNA, 17 nt, Human adenovirus E
ccauacuccaccuccac

SEQ ID NO: 1578776 - RNA, 15 nt, Human adenovirus E
gcaucucccaggcuu

SEQ ID NO: 1578777 - RNA, 13 nt, Human adenovirus E
gccagccgacuuc

SEQ ID NO: 1578778 - RNA, 14 nt, Human adenovirus E
cugguacuuggcca

SEQ ID NO: 1578779 - RNA, 18 nt, Human adenovirus E
aagaugccgggcaggagg

SEQ ID NO: 1578780 - RNA, 23 nt, Human adenovirus E
cggugugcgcgugcccgugcgca

SEQ ID NO: 1578781 - RNA, 14 nt, Human adenovirus E
uacauuaaaucagc

SEQ ID NO: 1578782 - RNA, 18 nt, Human adenovirus E
cagaccggugaggagcuc

SEQ ID NO: 1578783 - RNA, 22 nt, Human adenovirus E
cagcaacuuccugaccaccgug

SEQ ID NO: 1578784 - RNA, 16 nt, Human adenovirus E
cucggacgucaccugc

SEQ ID NO: 1578785 - RNA, 23 nt, Human adenovirus E
ggccagacccagccagaugaugc

SEQ ID NO: 1578786 - RNA, 20 nt, Human adenovirus E
cauguggcgguucaccaccu

SEQ ID NO: 1578787 - RNA, 22 nt, Human adenovirus E
cgcgacuuggcggauggcuggc

SEQ ID NO: 1578788 - RNA, 14 nt, Human adenovirus E
ccccauagccagcc

SEQ ID NO: 1578789 - RNA, 19 nt, Human adenovirus E
augaccaucgaccugauga

SEQ ID NO: 1578790 - RNA, 23 nt, Human adenovirus E
uuuccagggcgcgcgggaggucc

SEQ ID NO: 1578791 - RNA, 14 nt, Human adenovirus E
caccaugcagcuga

SEQ ID NO: 1578792 - RNA, 12 nt, Human adenovirus E
cguugggcaggg

SEQ ID NO: 1578793 - RNA, 22 nt, Human adenovirus E
ggucagaaaagacgaucuuuuu

SEQ ID NO: 1578794 - RNA, 22 nt, Human adenovirus E
cgcaagccgguauacaagccca

SEQ ID NO: 1578795 - RNA, 23 nt, Human adenovirus E
uggcggcggcggcgaugcagccc

SEQ ID NO: 1578796 - RNA, 13 nt, Human adenovirus E
caggaccaccagc

SEQ ID NO: 1578797 - RNA, 21 nt, Human adenovirus E
cgugccccccaagcgccagcc

SEQ ID NO: 1578798 - RNA, 18 nt, Human adenovirus E
caucauguacgccagcaa

SEQ ID NO: 1578799 - RNA, 16 nt, Human adenovirus E
cgguggcuuccagcaa

SEQ ID NO: 1578800 - RNA, 18 nt, Human adenovirus E
agucauucagccggugga

SEQ ID NO: 1578801 - RNA, 22 nt, Human adenovirus E
ccagcugcaccacgcugcgccc

SEQ ID NO: 1578802 - RNA, 19 nt, Human adenovirus E
ugcggaacugguacuuggc

SEQ ID NO: 1578803 - RNA, 16 nt, Human adenovirus E
ggcaccgcagcuugcc

SEQ ID NO: 1578804 - RNA, 17 nt, Human adenovirus E
cgcucguagggacugag

SEQ ID NO: 1578805 - RNA, 19 nt, Human adenovirus E
cggauggcuggcagagccc

SEQ ID NO: 1578806 - RNA, 18 nt, Human adenovirus E
gucaaugccaccucagcu

SEQ ID NO: 1578807 - RNA, 14 nt, Human adenovirus E
ggacugggcggugc

SEQ ID NO: 1578808 - RNA, 21 nt, Human adenovirus E
gcagaggaggaggagauggag

SEQ ID NO: 1578809 - RNA, 14 nt, Human adenovirus E
aggccguggcccag

SEQ ID NO: 1578810 - RNA, 22 nt, Human adenovirus E
uguccaaaaagcgcguccgggu

SEQ ID NO: 1578811 - RNA, 22 nt, Human adenovirus E
gugagccgcgcccugggccagg

SEQ ID NO: 1578812 - RNA, 19 nt, Human adenovirus E
ggagaaccugcacuaccuc

SEQ ID NO: 1578813 - RNA, 22 nt, Human adenovirus E
gacgauccccgggcgucgcagg

SEQ ID NO: 1578814 - RNA, 21 nt, Human adenovirus E
cuaugaggccgagccacagcg

SEQ ID NO: 1578815 - RNA, 18 nt, Human adenovirus E
acuugcuguagcagaacc

SEQ ID NO: 1578816 - RNA, 18 nt, Human adenovirus E
cggugcacccgugcagcc

SEQ ID NO: 1578817 - RNA, 20 nt, Human adenovirus E
gccuuguaggcgcagcagcc

SEQ ID NO: 1578818 - RNA, 18 nt, Human adenovirus E
cgagcgcgagcaaggaca

SEQ ID NO: 1578819 - RNA, 14 nt, Human adenovirus E
cagcaccgccccgc

SEQ ID NO: 1578820 - RNA, 21 nt, Human adenovirus E
ucgcgguggggcggccagcug

SEQ ID NO: 1578821 - RNA, 20 nt, Human adenovirus E
ugcacgagaaccgccugggg

SEQ ID NO: 1578822 - RNA, 19 nt, Human adenovirus E
ccaggccgugcagcggcag

SEQ ID NO: 1578823 - RNA, 15 nt, Human adenovirus E
ccccuucacggacag

SEQ ID NO: 1578824 - RNA, 15 nt, Human adenovirus E
uggaucuuuuccagg

SEQ ID NO: 1578825 - RNA, 12 nt, Human adenovirus E
cgguccuccucg

SEQ ID NO: 1578826 - RNA, 15 nt, Human adenovirus E
agcacacagcucaac

SEQ ID NO: 1578827 - RNA, 16 nt, Human adenovirus E
cacagggccagcaccg

SEQ ID NO: 1578828 - RNA, 23 nt, Human adenovirus E
ugagggcgaaagugucccugacc

SEQ ID NO: 1578829 - RNA, 12 nt, Human adenovirus E
agugccacugcc

SEQ ID NO: 1578830 - RNA, 20 nt, Human adenovirus E
caccgcgaguccaaccuggg

SEQ ID NO: 1578831 - RNA, 13 nt, Human adenovirus E
ccaacgugcagac

SEQ ID NO: 1578832 - RNA, 16 nt, Human adenovirus E
uuaccgagcagcagca

SEQ ID NO: 1578833 - RNA, 12 nt, Human adenovirus E
ucuuccuccucc

SEQ ID NO: 1578834 - RNA, 22 nt, Human adenovirus E
ggcggcagaacggggugcugga

SEQ ID NO: 1578835 - RNA, 22 nt, Human adenovirus E
aaggccauggcgaccagcgugc

SEQ ID NO: 1578836 - RNA, 16 nt, Human adenovirus E
acuaccgucaccucca

SEQ ID NO: 1578837 - RNA, 17 nt, Human adenovirus E
acccuagugagcugcgg

SEQ ID NO: 1578838 - RNA, 21 nt, Human adenovirus E
agcagcagagguugccagcuc

SEQ ID NO: 1578839 - RNA, 18 nt, Human adenovirus E
guccggguggaugaugac

SEQ ID NO: 1578840 - RNA, 18 nt, Human adenovirus E
ccugaucccgaauaccac

SEQ ID NO: 1578841 - RNA, 20 nt, Human adenovirus E
cugcccccgccccagcagca

SEQ ID NO: 1578842 - RNA, 18 nt, Human adenovirus E
cgggggcaggagcaggaa

SEQ ID NO: 1578843 - RNA, 13 nt, Human adenovirus E
cauucuggccugc

SEQ ID NO: 1578844 - RNA, 13 nt, Human adenovirus E
ugaccacaaccac

SEQ ID NO: 1578845 - RNA, 14 nt, Human adenovirus E
cgcugcuggagcgc

SEQ ID NO: 1578846 - RNA, 15 nt, Human adenovirus E
gcguggaggagcuca

SEQ ID NO: 1578847 - RNA, 22 nt, Human adenovirus E
gacccccggucccccacccagu

SEQ ID NO: 1578848 - RNA, 15 nt, Human adenovirus E
agcgacgagcagcug

SEQ ID NO: 1578849 - RNA, 22 nt, Human adenovirus E
accauuaccaccgucagugaaa

SEQ ID NO: 1578850 - RNA, 16 nt, Human adenovirus E
cagcuguuccuggugg

SEQ ID NO: 1578851 - RNA, 15 nt, Human adenovirus E
uggaaacgcagaccg

SEQ ID NO: 1578852 - RNA, 21 nt, Human adenovirus E
ccaacgaggcuuuccaucccg

SEQ ID NO: 1578853 - RNA, 17 nt, Human adenovirus E
gucaagcugcugcucag

SEQ ID NO: 1578854 - RNA, 14 nt, Human adenovirus E
aagcgugggccugu

SEQ ID NO: 1578855 - RNA, 20 nt, Human adenovirus E
ucaaggaugcgcugcucgac

SEQ ID NO: 1578856 - RNA, 19 nt, Human adenovirus E
gacaugcaucccagcugga

SEQ ID NO: 1578857 - RNA, 16 nt, Human adenovirus E
cccggcgcuaccugcu

SEQ ID NO: 1578858 - RNA, 19 nt, Human adenovirus E
cugguugguggcgcacccg

SEQ ID NO: 1578859 - RNA, 17 nt, Human adenovirus E
ugaagcaacugcagccg

SEQ ID NO: 1578860 - RNA, 13 nt, Human adenovirus E
cucuagcaccgcc

SEQ ID NO: 1578861 - RNA, 15 nt, Human adenovirus E
gagcgccagcaggcg

SEQ ID NO: 1578862 - RNA, 18 nt, Human adenovirus E
gcagagcaucguggugca

SEQ ID NO: 1578863 - RNA, 13 nt, Human adenovirus E
cccgugcaggcac

SEQ ID NO: 1578864 - RNA, 19 nt, Human adenovirus E
ggcagugguggcgggggag

SEQ ID NO: 1578865 - RNA, 18 nt, Human adenovirus E
uuuucauuuuuccagccu

SEQ ID NO: 1578866 - RNA, 19 nt, Human adenovirus E
uagacagcagccccaggcc

SEQ ID NO: 1578867 - RNA, 22 nt, Human adenovirus E
cacucaggcagaggaggacagc

SEQ ID NO: 1578868 - RNA, 13 nt, Human adenovirus E
cgacccgcaaccc

SEQ ID NO: 1578869 - RNA, 21 nt, Human adenovirus E
aguacaggagccauaauggcu

SEQ ID NO: 1578870 - RNA, 10 nt, Human adenovirus E
caggcggcag

SEQ ID NO: 1578871 - RNA, 15 nt, Human adenovirus E
ggaucagcaucaucu

SEQ ID NO: 1578872 - RNA, 13 nt, Human adenovirus E
ccgugcagcagau

SEQ ID NO: 1578873 - RNA, 18 nt, Human adenovirus E
cuagcagccgcggccagg

SEQ ID NO: 1578874 - RNA, 16 nt, Human adenovirus E
gaaccugagccaggcu

SEQ ID NO: 1578875 - RNA, 20 nt, Human adenovirus E
  misc_feature (7)..(7): n is a, c, g or u
gacaucnagauucccacgga

SEQ ID NO: 1578876 - RNA, 14 nt, Human adenovirus E
gcagcagcagcaga

SEQ ID NO: 1578877 - RNA, 23 nt, Human adenovirus E
cacaugcuuggucuugcgggguu

SEQ ID NO: 1578878 - RNA, 18 nt, Human adenovirus E
cagcguggaggagcucag

SEQ ID NO: 1578879 - RNA, 18 nt, Human adenovirus E
ggcggcgcugcagagcca

SEQ ID NO: 1578880 - RNA, 18 nt, Human adenovirus E
ggagaaagcaagcagcac

SEQ ID NO: 1578881 - RNA, 19 nt, Human adenovirus E
gcuugcauuucaaucccaa

SEQ ID NO: 1578882 - RNA, 15 nt, Human adenovirus E
ggccaacuaccuggc

SEQ ID NO: 1578883 - RNA, 12 nt, Human adenovirus E
gucaggcugggc

SEQ ID NO: 1578884 - RNA, 22 nt, Human adenovirus E
gccucgacucccaccugcuucg

SEQ ID NO: 1578885 - RNA, 23 nt, Human adenovirus E
cacagccuugaacaucugaaugc

SEQ ID NO: 1578886 - RNA, 20 nt, Human adenovirus E
cgagcagaaggggggcaggg

SEQ ID NO: 1578887 - RNA, 18 nt, Human adenovirus E
ugcaggagcgcgggcugc

SEQ ID NO: 1578888 - RNA, 20 nt, Human adenovirus E
cgacaauuacuuggcggugg

SEQ ID NO: 1578889 - RNA, 20 nt, Human adenovirus E
ccugaguuccuuugacgagg

SEQ ID NO: 1578890 - RNA, 19 nt, Human adenovirus E
cguaccagauccucaggua

SEQ ID NO: 1578891 - RNA, 19 nt, Human adenovirus E
agcuugcccucggccucgg

SEQ ID NO: 1578892 - RNA, 16 nt, Human adenovirus E
ccgccgccgcuccguc

SEQ ID NO: 1578893 - RNA, 13 nt, Human adenovirus E
uacaccuguuacc

SEQ ID NO: 1578894 - RNA, 18 nt, Human adenovirus E
gccaguccagacuguauu

SEQ ID NO: 1578895 - RNA, 15 nt, Human adenovirus E
gagcuugggggcgag

SEQ ID NO: 1578896 - RNA, 20 nt, Human adenovirus E
ccuucgcccuagccgccucc

SEQ ID NO: 1578897 - RNA, 15 nt, Human adenovirus E
ggaugcaugcggggg

SEQ ID NO: 1578898 - RNA, 22 nt, Human adenovirus E
gcccccgaucccuccagguaca

SEQ ID NO: 1578899 - RNA, 16 nt, Human adenovirus E
caggcgccagcgccgg

SEQ ID NO: 1578900 - RNA, 23 nt, Human adenovirus E
ggacccuacguagaagaggugga

SEQ ID NO: 1578901 - RNA, 20 nt, Human adenovirus E
ugccagcugaguuuucagcc

SEQ ID NO: 1578902 - RNA, 20 nt, Human adenovirus E
uggcggcgauguugagcugc

SEQ ID NO: 1578903 - RNA, 12 nt, Human adenovirus E
gauacgggugau

SEQ ID NO: 1578904 - RNA, 21 nt, Human adenovirus E
agcaaggaggaugcagcagcu

SEQ ID NO: 1578905 - RNA, 13 nt, Human adenovirus E
auugaccugggcu

SEQ ID NO: 1578906 - RNA, 22 nt, Human adenovirus E
gacgucagcggcgagggccugc

SEQ ID NO: 1578907 - RNA, 19 nt, Human adenovirus E
gccuccacgcgcacaucca

SEQ ID NO: 1578908 - RNA, 18 nt, Human adenovirus E
ggcauugucggugugcuu

SEQ ID NO: 1578909 - RNA, 12 nt, Human adenovirus E
gcucacccgcag

SEQ ID NO: 1578910 - RNA, 18 nt, Human adenovirus E
ucaagcccagcaccagca

SEQ ID NO: 1578911 - RNA, 13 nt, Human adenovirus E
ggccaucggccag

SEQ ID NO: 1578912 - RNA, 20 nt, Human adenovirus E
cugcacuggcagcccagccg

SEQ ID NO: 1578913 - RNA, 14 nt, Human adenovirus E
guucgugcccgagg

SEQ ID NO: 1578914 - RNA, 19 nt, Human adenovirus E
gcucugguacugcaggccc

SEQ ID NO: 1578915 - RNA, 22 nt, Human adenovirus E
ccucggacgauuggacccaggc

SEQ ID NO: 1578916 - RNA, 18 nt, Human adenovirus E
gcgggcaugaccucggca

SEQ ID NO: 1578917 - RNA, 16 nt, Human adenovirus E
gacgccaucagcgagu

SEQ ID NO: 1578918 - RNA, 23 nt, Human adenovirus E
cugugggacgauguggacagcag

SEQ ID NO: 1578919 - RNA, 15 nt, Human adenovirus E
cagcaggugcugccg

SEQ ID NO: 1578920 - RNA, 16 nt, Human adenovirus E
gccacaccuggcagac

SEQ ID NO: 1578921 - RNA, 21 nt, Human adenovirus E
ccacgccgggcuaccgcggca

SEQ ID NO: 1578922 - RNA, 20 nt, Human adenovirus E
accagcagaaaaccagcagc

SEQ ID NO: 1578923 - RNA, 22 nt, Human adenovirus E
ccacgagcgccagcuguugggg

SEQ ID NO: 1578924 - RNA, 15 nt, Human adenovirus E
ccagaugggccuggc

SEQ ID NO: 1578925 - RNA, 16 nt, Human adenovirus E
aaggaggaaagaaagc

SEQ ID NO: 1578926 - RNA, 16 nt, Human adenovirus E
acgaggccggccuggu

SEQ ID NO: 1578927 - RNA, 14 nt, Human adenovirus E
cauaggaccaccag

SEQ ID NO: 1578928 - RNA, 18 nt, Human adenovirus E
caaccaccccugccgccc

SEQ ID NO: 1578929 - RNA, 13 nt, Human adenovirus E
gacgcucgcgagg

SEQ ID NO: 1578930 - RNA, 13 nt, Human adenovirus E
ccaucggccaggc

SEQ ID NO: 1578931 - RNA, 14 nt, Human adenovirus E
cuggccaccuacca

SEQ ID NO: 1578932 - RNA, 16 nt, Human adenovirus E
augggacgagaccgga

SEQ ID NO: 1578933 - RNA, 19 nt, Human adenovirus E
acuccuagccccguccucu

SEQ ID NO: 1578934 - RNA, 14 nt, Human adenovirus E
ccaacaaaugccag

SEQ ID NO: 1578935 - RNA, 21 nt, Human adenovirus E
cucugggugaaggccacggga

SEQ ID NO: 1578936 - RNA, 20 nt, Human adenovirus E
ggcgccuacggaggggcgga

SEQ ID NO: 1578937 - RNA, 15 nt, Human adenovirus E
agucgcugccgccgc

SEQ ID NO: 1578938 - RNA, 13 nt, Human adenovirus E
auggcgaccagcg

SEQ ID NO: 1578939 - RNA, 17 nt, Human adenovirus E
caaacugucaaauacuc

SEQ ID NO: 1578940 - RNA, 18 nt, Human adenovirus E
accgccgacgagaagcag

SEQ ID NO: 1578941 - RNA, 17 nt, Human adenovirus E
cugagcgggggggagga

SEQ ID NO: 1578942 - RNA, 15 nt, Human adenovirus E
gcaaucaggcagcac

SEQ ID NO: 1578943 - RNA, 14 nt, Human adenovirus E
gacuaccuccaccu

SEQ ID NO: 1578944 - RNA, 18 nt, Human adenovirus E
ccauccgcggcgacgagg

SEQ ID NO: 1578945 - RNA, 14 nt, Human adenovirus E
cagcagucaggcag

SEQ ID NO: 1578946 - RNA, 14 nt, Human adenovirus E
ucaccuuccgcucc

SEQ ID NO: 1578947 - RNA, 21 nt, Human adenovirus E
cgaucaugugcuccuucugga

SEQ ID NO: 1578948 - RNA, 20 nt, Human adenovirus E
cagcgaguggcgcggcugcu

SEQ ID NO: 1578949 - RNA, 19 nt, Human adenovirus E
ucgaggagaaccugcacua

SEQ ID NO: 1578950 - RNA, 24 nt, Human adenovirus E
gcggugcccgaggcccuggccacc

SEQ ID NO: 1578951 - RNA, 18 nt, Human adenovirus E
gucacggcguacgagcag

SEQ ID NO: 1578952 - RNA, 21 nt, Human adenovirus E
ccuuagcuuugacaguacagg

SEQ ID NO: 1578953 - RNA, 22 nt, Human adenovirus E
  misc_feature (8)..(8): n is a, c, g or u
acgggganggcguaggccuggg

SEQ ID NO: 1578954 - RNA, 14 nt, Human adenovirus E
gaagguggacccgg

SEQ ID NO: 1578955 - RNA, 17 nt, Human adenovirus E
cugaaaguggagcugcc

SEQ ID NO: 1578956 - RNA, 21 nt, Human adenovirus E
aggcgcucgccaacgcuccac

SEQ ID NO: 1578957 - RNA, 20 nt, Human adenovirus E
ccaccgcgaguccaaccugg

SEQ ID NO: 1578958 - RNA, 19 nt, Human adenovirus E
caaggagaaggaggagagc

SEQ ID NO: 1578959 - RNA, 20 nt, Human adenovirus E
caccgguuggggccugcgcg

SEQ ID NO: 1578960 - RNA, 16 nt, Human adenovirus E
ucagcaaccugcuggg

SEQ ID NO: 1578961 - RNA, 20 nt, Human adenovirus E
ccuggcagacgggcaugggc

SEQ ID NO: 1578962 - RNA, 19 nt, Human adenovirus E
ggccgucuacucgcagcag

SEQ ID NO: 1578963 - RNA, 15 nt, Human adenovirus E
gcacgaagcccugca

SEQ ID NO: 1578964 - RNA, 16 nt, Human adenovirus E
agcagcgagcugggca

SEQ ID NO: 1578965 - RNA, 21 nt, Human adenovirus E
cggcagaugcgcccccaccac

SEQ ID NO: 1578966 - RNA, 15 nt, Human adenovirus E
cagcaguggcagcgg

SEQ ID NO: 1578967 - RNA, 14 nt, Human adenovirus E
cggugcccgaggcc

SEQ ID NO: 1578968 - RNA, 19 nt, Human adenovirus E
accucugccacaccuggca

SEQ ID NO: 1578969 - RNA, 18 nt, Human adenovirus E
cggugucgagccugcuga

SEQ ID NO: 1578970 - RNA, 15 nt, Human adenovirus E
gcaucaucugggccu

SEQ ID NO: 1578971 - RNA, 20 nt, Human adenovirus E
augucucuucgggggcagag

SEQ ID NO: 1578972 - RNA, 21 nt, Human adenovirus E
caggccucucagcgccacuga

SEQ ID NO: 1578973 - RNA, 23 nt, Human adenovirus E
cgaccgccgcggccgccgugagc

SEQ ID NO: 1578974 - RNA, 19 nt, Human adenovirus E
ucuacuucaaccccuucuc

SEQ ID NO: 1578975 - RNA, 21 nt, Human adenovirus E
gggccacgagccggggcagcg

SEQ ID NO: 1578976 - RNA, 20 nt, Human adenovirus E
gccgcugaccuuccgcgagu

SEQ ID NO: 1578977 - RNA, 15 nt, Human adenovirus E
ugcgcgccgagacgg

SEQ ID NO: 1578978 - RNA, 14 nt, Human adenovirus E
ccuagaaugaccac

SEQ ID NO: 1578979 - RNA, 23 nt, Human adenovirus E
agaacuuacauugugcauggaca

SEQ ID NO: 1578980 - RNA, 17 nt, Human adenovirus E
gugucccagcggcgagg

SEQ ID NO: 1578981 - RNA, 23 nt, Human adenovirus E
gagcucgugucuccgcuggguga

SEQ ID NO: 1578982 - RNA, 17 nt, Human adenovirus E
cgccagacgccgcaccu

SEQ ID NO: 1578983 - RNA, 15 nt, Human adenovirus E
agccagagcaggaag

SEQ ID NO: 1578984 - RNA, 21 nt, Human adenovirus E
gcgaaagugucccugaccaug

SEQ ID NO: 1578985 - RNA, 19 nt, Human adenovirus E
ggcggauggcuggcagagc

SEQ ID NO: 1578986 - RNA, 11 nt, Human adenovirus E
gcgcuccugga

SEQ ID NO: 1578987 - RNA, 19 nt, Human adenovirus E
aagauguugaagugggcgu

SEQ ID NO: 1578988 - RNA, 16 nt, Human adenovirus E
cgcauggucucgguga

SEQ ID NO: 1578989 - RNA, 18 nt, Human adenovirus E
ggucgcccgucucucagc

SEQ ID NO: 1578990 - RNA, 21 nt, Human adenovirus E
ggcagggauacaaguccuggc

SEQ ID NO: 1578991 - RNA, 14 nt, Human adenovirus E
gacggcgacuaccu

SEQ ID NO: 1578992 - RNA, 20 nt, Human adenovirus E
gccauuggugauggacaugc

SEQ ID NO: 1578993 - RNA, 22 nt, Human adenovirus E
ugccuucaccaccugcaucugc

SEQ ID NO: 1578994 - RNA, 19 nt, Human adenovirus E
aggaagacugggacagcac

SEQ ID NO: 1578995 - RNA, 14 nt, Human adenovirus E
ggauacggaggcgg

SEQ ID NO: 1578996 - RNA, 18 nt, Human adenovirus E
ccacgguggcuuccagca

SEQ ID NO: 1578997 - RNA, 19 nt, Human adenovirus E
cgugcagaccaaccuggac

SEQ ID NO: 1578998 - RNA, 19 nt, Human adenovirus E
ccucgggggucaaaaccau

SEQ ID NO: 1578999 - RNA, 14 nt, Human adenovirus E
gccacaccacagcu

SEQ ID NO: 1579000 - RNA, 22 nt, Human adenovirus E
auucaaacaccucauuugcaua

SEQ ID NO: 1579001 - RNA, 19 nt, Human adenovirus E
cacuccccucuucccagcu

SEQ ID NO: 1579002 - RNA, 16 nt, Human adenovirus E
gaccgggggucccggc

SEQ ID NO: 1579003 - RNA, 15 nt, Human adenovirus E
cagagcaggaagcag

SEQ ID NO: 1579004 - RNA, 16 nt, Human adenovirus E
ccucugccacaccugg

SEQ ID NO: 1579005 - RNA, 22 nt, Human adenovirus E
ugcaagcggugcguuccagcau

SEQ ID NO: 1579006 - RNA, 16 nt, Human adenovirus E
ucuuccucuucuuggu

SEQ ID NO: 1579007 - RNA, 19 nt, Human adenovirus E
cgagggugcugccgcggcg

SEQ ID NO: 1579008 - RNA, 20 nt, Human adenovirus E
ggagccccgggcccagguug

SEQ ID NO: 1579009 - RNA, 22 nt, Human adenovirus E
cauccgcggcgacgaggccggc

SEQ ID NO: 1579010 - RNA, 15 nt, Human adenovirus E
gaaccccaccaccca

SEQ ID NO: 1579011 - RNA, 22 nt, Human adenovirus E
ccuccucaggcggcaguggugg

SEQ ID NO: 1579012 - RNA, 18 nt, Human adenovirus E
ucgacuccguggccugga

SEQ ID NO: 1579013 - RNA, 20 nt, Human adenovirus E
cggugcgcugguggcggugu

SEQ ID NO: 1579014 - RNA, 20 nt, Human adenovirus E
cgggugcuucacgcucgcca

SEQ ID NO: 1579015 - RNA, 12 nt, Human adenovirus E
cggcggagauga

SEQ ID NO: 1579016 - RNA, 22 nt, Human adenovirus E
gcgggguuucuucuugggcggc

SEQ ID NO: 1579017 - RNA, 16 nt, Human adenovirus E
guacggcgcggccagc

SEQ ID NO: 1579018 - RNA, 18 nt, Human adenovirus E
caucaacgggguggugga

SEQ ID NO: 1579019 - RNA, 11 nt, Human adenovirus E
agagccacacc

SEQ ID NO: 1579020 - RNA, 19 nt, Human adenovirus E
uccacgcggggcgggagcu

SEQ ID NO: 1579021 - RNA, 15 nt, Human adenovirus E
ggauaggagcuccug

SEQ ID NO: 1579022 - RNA, 19 nt, Human adenovirus E
caacgugccccggggccag

SEQ ID NO: 1579023 - RNA, 19 nt, Human adenovirus E
uuaacaucacuagagacua

SEQ ID NO: 1579024 - RNA, 20 nt, Human adenovirus E
gcuguagcauagucugccug

SEQ ID NO: 1579025 - RNA, 22 nt, Human adenovirus E
accuguuaccacuaugcagcuc

SEQ ID NO: 1579026 - RNA, 13 nt, Human adenovirus E
aaaaauacccgcc

SEQ ID NO: 1579027 - RNA, 21 nt, Human adenovirus E
agcagugucuggaggagcaga

SEQ ID NO: 1579028 - RNA, 13 nt, Human adenovirus E
gggcgcagggcau

SEQ ID NO: 1579029 - RNA, 20 nt, Human adenovirus E
ucaccgagagccgccucagc

SEQ ID NO: 1579030 - RNA, 20 nt, Human adenovirus E
acgggaugcacgugcugcac

SEQ ID NO: 1579031 - RNA, 22 nt, Human adenovirus E
  misc_feature (11)..(11): n is a, c, g or u
aggagccguanagggcguugga

SEQ ID NO: 1579032 - RNA, 16 nt, Human adenovirus E
gcgaugcgggcggcgc

SEQ ID NO: 1579033 - RNA, 18 nt, Human adenovirus E
gugacaaagagcuguccg

SEQ ID NO: 1579034 - RNA, 17 nt, Human adenovirus E
cggcggugcccgaggcc

SEQ ID NO: 1579035 - RNA, 19 nt, Human adenovirus E
ccugagcuccucccucagc

SEQ ID NO: 1579036 - RNA, 15 nt, Human adenovirus E
ccuuggcaguacagu

SEQ ID NO: 1579037 - RNA, 22 nt, Human adenovirus E
  misc_feature (8)..(8): n is a, c, g or u
gcaucgcnuaccugcgccacca

SEQ ID NO: 1579038 - RNA, 19 nt, Human adenovirus E
ccacgguggcuuccagcaa

SEQ ID NO: 1579039 - RNA, 21 nt, Human adenovirus E
aaucguucucuccagcaccag

SEQ ID NO: 1579040 - RNA, 20 nt, Human adenovirus E
ucaggucggucuccacgcgg

SEQ ID NO: 1579041 - RNA, 23 nt, Human adenovirus E
gcccugggcauagucgcgccgcg

SEQ ID NO: 1579042 - RNA, 15 nt, Human adenovirus E
auuaccacacagaca

SEQ ID NO: 1579043 - RNA, 20 nt, Human adenovirus E
accgcggucauaccagcagc

SEQ ID NO: 1579044 - RNA, 21 nt, Human adenovirus E
ugaacaguauccgcagcagcg

SEQ ID NO: 1579045 - RNA, 15 nt, Human adenovirus E
acauccagaaacaag

SEQ ID NO: 1579046 - RNA, 19 nt, Human adenovirus E
cacgugcgcacccugaucg

SEQ ID NO: 1579047 - RNA, 17 nt, Human adenovirus E
cuuggaagagggcgagg

SEQ ID NO: 1579048 - RNA, 19 nt, Human adenovirus E
gagcuggagugccugcgcc

SEQ ID NO: 1579049 - RNA, 15 nt, Human adenovirus E
ucgcgguccuuccag

SEQ ID NO: 1579050 - RNA, 16 nt, Human adenovirus E
caccacuacagcagca

SEQ ID NO: 1579051 - RNA, 14 nt, Human adenovirus E
cauuuuugccaugc

SEQ ID NO: 1579052 - RNA, 19 nt, Human adenovirus E
gguccucggcguuggccau

SEQ ID NO: 1579053 - RNA, 15 nt, Human adenovirus E
acgucaccugcggcg

SEQ ID NO: 1579054 - RNA, 15 nt, Human adenovirus E
acucgcagcagcugc

SEQ ID NO: 1579055 - RNA, 14 nt, Human adenovirus E
ccaacguggagcug

SEQ ID NO: 1579056 - RNA, 22 nt, Human adenovirus E
gaucgcggcgaacgagccggcg

SEQ ID NO: 1579057 - RNA, 18 nt, Human adenovirus E
acucucaacuccucgggg

SEQ ID NO: 1579058 - RNA, 14 nt, Human adenovirus E
agcgccagcaggcg

SEQ ID NO: 1579059 - RNA, 19 nt, Human adenovirus E
ggcuucaggcgccagcgcc

SEQ ID NO: 1579060 - RNA, 15 nt, Human adenovirus E
ugguggccaccucgc

SEQ ID NO: 1579061 - RNA, 14 nt, Human adenovirus E
agcaccacagcgcc

SEQ ID NO: 1579062 - RNA, 19 nt, Human adenovirus E
gcuguugaugugauggaag

SEQ ID NO: 1579063 - RNA, 15 nt, Human adenovirus E
gcccccgccccagca

SEQ ID NO: 1579064 - RNA, 19 nt, Human adenovirus E
cuccgcuugccguccuucu

SEQ ID NO: 1579065 - RNA, 17 nt, Human adenovirus E
uaaccuguccacccgcu

SEQ ID NO: 1579066 - RNA, 18 nt, Human adenovirus E
acucagccaucgccaacc

SEQ ID NO: 1579067 - RNA, 15 nt, Human adenovirus E
agucuggaggaagac

SEQ ID NO: 1579068 - RNA, 18 nt, Human adenovirus E
agcgacgaucugggggug

SEQ ID NO: 1579069 - RNA, 21 nt, Human adenovirus E
agguggacccggacgugcagc

SEQ ID NO: 1579070 - RNA, 21 nt, Human adenovirus E
cagcgacgagacucgggccgc

SEQ ID NO: 1579071 - RNA, 18 nt, Human adenovirus E
gcauguucauuuuugcuu

SEQ ID NO: 1579072 - RNA, 12 nt, Human adenovirus E
gggucuccugga

SEQ ID NO: 1579073 - RNA, 15 nt, Human adenovirus E
cuggcgccuacggag

SEQ ID NO: 1579074 - RNA, 19 nt, Human adenovirus E
gggcucucgccgccgcgac

SEQ ID NO: 1579075 - RNA, 13 nt, Human adenovirus E
cuugcauuucaau

SEQ ID NO: 1579076 - RNA, 19 nt, Human adenovirus E
cggagauggcaccucucgc

SEQ ID NO: 1579077 - RNA, 17 nt, Human adenovirus E
gccgcugcaaccacccc

SEQ ID NO: 1579078 - RNA, 13 nt, Human adenovirus E
cgaucccuccagg

SEQ ID NO: 1579079 - RNA, 21 nt, Human adenovirus E
aguggcauuuuugaugugggc

SEQ ID NO: 1579080 - RNA, 19 nt, Human adenovirus E
gcaucuggcccggcaggcc

SEQ ID NO: 1579081 - RNA, 15 nt, Human adenovirus E
gaacuugcagggccu

SEQ ID NO: 1579082 - RNA, 13 nt, Human adenovirus E
gcuugcaggccug

SEQ ID NO: 1579083 - RNA, 23 nt, Human adenovirus E
cggggaucagcaguuugggcagc

SEQ ID NO: 1579084 - RNA, 16 nt, Human adenovirus E
ugccgccgccgcuccg

SEQ ID NO: 1579085 - RNA, 15 nt, Human adenovirus E
cggcgggcgcagcag

SEQ ID NO: 1579086 - RNA, 14 nt, Human adenovirus E
caucuggcccggca

SEQ ID NO: 1579087 - RNA, 12 nt, Human adenovirus E
uaccaaugagca

SEQ ID NO: 1579088 - RNA, 18 nt, Human adenovirus E
  misc_feature (4)..(4): n is a, c, g or u
ggcnugggcgugcagacc

SEQ ID NO: 1579089 - RNA, 16 nt, Human adenovirus E
ggccaacuaccuggcc

SEQ ID NO: 1579090 - RNA, 16 nt, Human adenovirus E
gcaggaccaccagcac

SEQ ID NO: 1579091 - RNA, 14 nt, Human adenovirus E
gggugacgcaguag

SEQ ID NO: 1579092 - RNA, 13 nt, Human adenovirus E
cuugagcuguccc

SEQ ID NO: 1579093 - RNA, 18 nt, Human adenovirus E
  misc_feature (9)..(9): n is a, c, g or u
cuccagcunuuccaaccc

SEQ ID NO: 1579094 - RNA, 15 nt, Human adenovirus E
cucggucuccucaca

SEQ ID NO: 1579095 - RNA, 16 nt, Human adenovirus E
gagcucgacgagccgg

SEQ ID NO: 1579096 - RNA, 18 nt, Human adenovirus E
caccaagaacagccagag

SEQ ID NO: 1579097 - RNA, 15 nt, Human adenovirus E
ugcgcagggccaggc

SEQ ID NO: 1579098 - RNA, 14 nt, Human adenovirus E
cagguggcagaugc

SEQ ID NO: 1579099 - RNA, 17 nt, Human adenovirus E
ggccugcacccucaucu

SEQ ID NO: 1579100 - RNA, 15 nt, Human adenovirus E
cggaggccagcaccc

SEQ ID NO: 1579101 - RNA, 21 nt, Human adenovirus E
uuuccuccacccucccaggac

SEQ ID NO: 1579102 - RNA, 18 nt, Human adenovirus E
guugucgagcuugguggc

SEQ ID NO: 1579103 - RNA, 13 nt, Human adenovirus E
gaugaagugggcg

SEQ ID NO: 1579104 - RNA, 22 nt, Human adenovirus E
ugcaggacagcgaaccccgcag

SEQ ID NO: 1579105 - RNA, 16 nt, Human adenovirus E
gcagccccccugcucc

SEQ ID NO: 1579106 - RNA, 21 nt, Human adenovirus E
cagcacucucaacuccucggg

SEQ ID NO: 1579107 - RNA, 20 nt, Human adenovirus E
ccaugguggcgcagcugacc

SEQ ID NO: 1579108 - RNA, 22 nt, Human adenovirus E
ggcaggacccggagacgcgcgg

SEQ ID NO: 1579109 - RNA, 16 nt, Human adenovirus E
cagaccagucgccagg

SEQ ID NO: 1579110 - RNA, 13 nt, Human adenovirus E
guccaggccagca

SEQ ID NO: 1579111 - RNA, 18 nt, Human adenovirus E
caggccccggucggggac

SEQ ID NO: 1579112 - RNA, 15 nt, Human adenovirus E
guggucggccuggcc

SEQ ID NO: 1579113 - RNA, 15 nt, Human adenovirus E
cucccgccugaaccu

SEQ ID NO: 1579114 - RNA, 20 nt, Human adenovirus E
gcggaccugcacuggcagcc

SEQ ID NO: 1579115 - RNA, 15 nt, Human adenovirus E
augugauggaaguag

SEQ ID NO: 1579116 - RNA, 19 nt, Human adenovirus E
cgagcagaaggggggcagg

SEQ ID NO: 1579117 - RNA, 16 nt, Human adenovirus E
gcauagucugccugcu

SEQ ID NO: 1579118 - RNA, 15 nt, Human adenovirus E
accaucuccgcuccg

SEQ ID NO: 1579119 - RNA, 23 nt, Human adenovirus E
agcccggggaccccgagugguac

SEQ ID NO: 1579120 - RNA, 15 nt, Human adenovirus E
gauccuccaccagag

SEQ ID NO: 1579121 - RNA, 17 nt, Human adenovirus E
accacagggccagcacc

SEQ ID NO: 1579122 - RNA, 17 nt, Human adenovirus E
uuguugcgcagggccag

SEQ ID NO: 1579123 - RNA, 18 nt, Human adenovirus E
acagucuggaggaagacg

SEQ ID NO: 1579124 - RNA, 17 nt, Human adenovirus E
cgcaggcgggacagagg

SEQ ID NO: 1579125 - RNA, 13 nt, Human adenovirus E
caggaugagcuga

SEQ ID NO: 1579126 - RNA, 17 nt, Human adenovirus E
agauggcgagggggagc

SEQ ID NO: 1579127 - RNA, 13 nt, Human adenovirus E
gcaagagauggag

SEQ ID NO: 1579128 - RNA, 15 nt, Human adenovirus E
cagcuggcgggcggc

SEQ ID NO: 1579129 - RNA, 18 nt, Human adenovirus E
gcccccgcuggaggcucc

SEQ ID NO: 1579130 - RNA, 23 nt, Human adenovirus E
auggaggugcagacggaucccug

SEQ ID NO: 1579131 - RNA, 15 nt, Human adenovirus E
ccaagcgccagccca

SEQ ID NO: 1579132 - RNA, 21 nt, Human adenovirus E
  misc_feature (9)..(9): n is a, c, g or u
cagcagccnuucuccacgggg

SEQ ID NO: 1579133 - RNA, 23 nt, Human adenovirus E
cuggccgaccccgucaccaccaa

SEQ ID NO: 1579134 - RNA, 17 nt, Human adenovirus E
cuuucauauccucuccg

SEQ ID NO: 1579135 - RNA, 15 nt, Human adenovirus E
cgcccugggccagga

SEQ ID NO: 1579136 - RNA, 12 nt, Human adenovirus E
cgcagcagcgca

SEQ ID NO: 1579137 - RNA, 22 nt, Human adenovirus E
aguagucgagggucuccuggau

SEQ ID NO: 1579138 - RNA, 15 nt, Human adenovirus E
uccgggucucggcau

SEQ ID NO: 1579139 - RNA, 12 nt, Human adenovirus E
gauccagcggcg

SEQ ID NO: 1579140 - RNA, 19 nt, Human adenovirus E
cugagacccggcaccaccg

SEQ ID NO: 1579141 - RNA, 17 nt, Human adenovirus E
cugcucgggcaucagcu

SEQ ID NO: 1579142 - RNA, 18 nt, Human adenovirus E
cgcggucauaccagcagc

SEQ ID NO: 1579143 - RNA, 12 nt, Human adenovirus E
gcucaacagcug

SEQ ID NO: 1579144 - RNA, 14 nt, Human adenovirus E
ggccgcggccaacc

SEQ ID NO: 1579145 - RNA, 20 nt, Human adenovirus E
ugaacucggggaucagcagu

SEQ ID NO: 1579146 - RNA, 14 nt, Human adenovirus E
ccucccggaggagg

SEQ ID NO: 1579147 - RNA, 20 nt, Human adenovirus E
gaccuuccgcgagugccccc

SEQ ID NO: 1579148 - RNA, 14 nt, Human adenovirus E
cggauggcuggcag

SEQ ID NO: 1579149 - RNA, 16 nt, Human adenovirus E
ggugacccugggccug

SEQ ID NO: 1579150 - RNA, 15 nt, Human adenovirus E
agacgaugggcaggc

SEQ ID NO: 1579151 - RNA, 22 nt, Human adenovirus E
caggacccggagacgcgcggcc

SEQ ID NO: 1579152 - RNA, 16 nt, Human adenovirus E
agguguccagcuggcg

SEQ ID NO: 1579153 - RNA, 15 nt, Human adenovirus E
cuguggaccucggcc

SEQ ID NO: 1579154 - RNA, 20 nt, Human adenovirus E
gcaggcaccgcagcuugccc

SEQ ID NO: 1579155 - RNA, 14 nt, Human adenovirus E
ggaccaccagcacg

SEQ ID NO: 1579156 - RNA, 13 nt, Human adenovirus E
accaccggcggcg

SEQ ID NO: 1579157 - RNA, 16 nt, Human adenovirus E
gcucgcaacgcugcac

SEQ ID NO: 1579158 - RNA, 16 nt, Human adenovirus E
caggggcgcagggcau

SEQ ID NO: 1579159 - RNA, 20 nt, Human adenovirus E
guggaggauuuggaggaaga

SEQ ID NO: 1579160 - RNA, 21 nt, Human adenovirus E
ccaucgugcagaaccccacca

SEQ ID NO: 1579161 - RNA, 18 nt, Human adenovirus E
ucgcaucaggccccgcag

SEQ ID NO: 1579162 - RNA, 15 nt, Human adenovirus E
ucaagcaucuggccc

SEQ ID NO: 1579163 - RNA, 17 nt, Human adenovirus E
ugacggguuccuguggg

SEQ ID NO: 1579164 - RNA, 14 nt, Human adenovirus E
gcaacgcugcacgg

SEQ ID NO: 1579165 - RNA, 13 nt, Human adenovirus E
uuccggagcagcu

SEQ ID NO: 1579166 - RNA, 12 nt, Human adenovirus E
gcacggccagcg

SEQ ID NO: 1579167 - RNA, 12 nt, Human adenovirus E
uucccccaggau

SEQ ID NO: 1579168 - RNA, 13 nt, Human adenovirus E
ucacccugcucau

SEQ ID NO: 1579169 - RNA, 22 nt, Human adenovirus E
cagccagagcaggaagcagaga

SEQ ID NO: 1579170 - RNA, 12 nt, Human adenovirus E
caccacccagac

SEQ ID NO: 1579171 - RNA, 21 nt, Human adenovirus E
aauuccgucgaccguuaaaaa

SEQ ID NO: 1579172 - RNA, 21 nt, Human adenovirus E
cauguccaccugcggggcgau

SEQ ID NO: 1579173 - RNA, 14 nt, Human adenovirus E
gaggagagcaugag

SEQ ID NO: 1579174 - RNA, 15 nt, Human adenovirus E
caccucacagcucaa

SEQ ID NO: 1579175 - RNA, 14 nt, Human adenovirus E
gcggcuggggcgac

SEQ ID NO: 1579176 - RNA, 20 nt, Human adenovirus E
gugcccccgcgguaccuggc

SEQ ID NO: 1579177 - RNA, 13 nt, Human adenovirus E
ucaaugccaccuc

SEQ ID NO: 1579178 - RNA, 14 nt, Human adenovirus E
accacuacagcagc

SEQ ID NO: 1579179 - RNA, 19 nt, Human adenovirus E
gcacucucaacuccucggg

SEQ ID NO: 1579180 - RNA, 14 nt, Human adenovirus E
ucgcugccgccgcc

SEQ ID NO: 1579181 - RNA, 15 nt, Human adenovirus E
ggcgauccuggccca

SEQ ID NO: 1579182 - RNA, 14 nt, Human adenovirus E
gcggggcgggagcu

SEQ ID NO: 1579183 - RNA, 18 nt, Human adenovirus E
cgagcgcuccggcaccgc

SEQ ID NO: 1579184 - RNA, 22 nt, Human adenovirus E
gucuggaggaagacgaggagga

SEQ ID NO: 1579185 - RNA, 16 nt, Human adenovirus E
gggccacgagccgggg

SEQ ID NO: 1579186 - RNA, 13 nt, Human adenovirus E
caaguccagcaaa

SEQ ID NO: 1579187 - RNA, 15 nt, Human adenovirus E
guaggugggguagca

SEQ ID NO: 1579188 - RNA, 12 nt, Human adenovirus E
uggcuggcagag

SEQ ID NO: 1579189 - RNA, 21 nt, Human adenovirus E
ucgaggacgucagcggcgagg

SEQ ID NO: 1579190 - RNA, 19 nt, Human adenovirus E
uccugcggaaccacagggc

SEQ ID NO: 1579191 - RNA, 20 nt, Human adenovirus E
ccaacuucaucagcgcccug

SEQ ID NO: 1579192 - RNA, 20 nt, Human adenovirus E
caccaaggccgccgccccuc

SEQ ID NO: 1579193 - RNA, 12 nt, Human adenovirus E
cccagcaccagc

SEQ ID NO: 1579194 - RNA, 14 nt, Human adenovirus E
cgggcuaccgcggc

SEQ ID NO: 1579195 - RNA, 16 nt, Human adenovirus E
gccgcgcccugggcca

SEQ ID NO: 1579196 - RNA, 20 nt, Human adenovirus E
ccagggacucccucagcaug

SEQ ID NO: 1579197 - RNA, 17 nt, Human adenovirus E
agggcgaguaccuggaa

SEQ ID NO: 1579198 - RNA, 19 nt, Human adenovirus E
gcugacggggaucagcccc

SEQ ID NO: 1579199 - RNA, 14 nt, Human adenovirus E
augcacgugcugca

SEQ ID NO: 1579200 - RNA, 20 nt, Human adenovirus E
caaggacagacccuucugac

SEQ ID NO: 1579201 - RNA, 14 nt, Human adenovirus E
gccggcgcuucugc

SEQ ID NO: 1579202 - RNA, 14 nt, Human adenovirus E
guaccucaccuggc

SEQ ID NO: 1579203 - RNA, 21 nt, Human adenovirus E
augucauacuugagcuguccc

SEQ ID NO: 1579204 - RNA, 15 nt, Human adenovirus E
ccgccgcccagcccc

SEQ ID NO: 1579205 - RNA, 22 nt, Human adenovirus E
gcuuuaccgacaaaaaucagac

SEQ ID NO: 1579206 - RNA, 20 nt, Human adenovirus E
ccagcaugucccgcccgcgg

SEQ ID NO: 1579207 - RNA, 13 nt, Human adenovirus E
ggcuggcagagcc

SEQ ID NO: 1579208 - RNA, 18 nt, Human adenovirus E
cgugaacgcgcuggugga

SEQ ID NO: 1579209 - RNA, 14 nt, Human adenovirus E
gcaagccacaguac

SEQ ID NO: 1579210 - RNA, 22 nt, Human adenovirus E
uccacgguggcuuccagcaaag

SEQ ID NO: 1579211 - RNA, 14 nt, Human adenovirus E
cgcucgccacaucc

SEQ ID NO: 1579212 - RNA, 15 nt, Human adenovirus E
ggcgagguugagcuc

SEQ ID NO: 1579213 - RNA, 16 nt, Human adenovirus E
gaccaggagcugaugc

SEQ ID NO: 1579214 - RNA, 13 nt, Human adenovirus E
cgccaggccugca

SEQ ID NO: 1579215 - RNA, 15 nt, Human adenovirus E
ccacagaaguuucau

SEQ ID NO: 1579216 - RNA, 22 nt, Human adenovirus E
acgcacgagaagguccuggcca

SEQ ID NO: 1579217 - RNA, 19 nt, Human adenovirus E
uugagcugcccgaggagca

SEQ ID NO: 1579218 - RNA, 14 nt, Human adenovirus E
cccgaauaccacag

SEQ ID NO: 1579219 - RNA, 19 nt, Human adenovirus E
gaccgcggcgccgcgccgg

SEQ ID NO: 1579220 - RNA, 16 nt, Human adenovirus E
agaaagcaagcagcac

SEQ ID NO: 1579221 - RNA, 19 nt, Human adenovirus E
gugcugccgcggcggugcc

SEQ ID NO: 1579222 - RNA, 18 nt, Human adenovirus E
cgccuccuuggaagaggu

SEQ ID NO: 1579223 - RNA, 16 nt, Human adenovirus E
acagccacucucucag

SEQ ID NO: 1579224 - RNA, 19 nt, Human adenovirus E
aagccuuuagacagcagcc

SEQ ID NO: 1579225 - RNA, 15 nt, Human adenovirus E
ugcaucuuggccugg

SEQ ID NO: 1579226 - RNA, 23 nt, Human adenovirus E
cuguccgagaagcuggcggccau

SEQ ID NO: 1579227 - RNA, 16 nt, Human adenovirus E
accguggugcagaaca

SEQ ID NO: 1579228 - RNA, 11 nt, Human adenovirus E
ccccgccgccc

SEQ ID NO: 1579229 - RNA, 20 nt, Human adenovirus E
ggagagacagcugccguccu

SEQ ID NO: 1579230 - RNA, 16 nt, Human adenovirus E
ccuacuuugagcugcc

SEQ ID NO: 1579231 - RNA, 15 nt, Human adenovirus E
agaugcaauugaaag

SEQ ID NO: 1579232 - RNA, 15 nt, Human adenovirus E
guaugcgcaggagca

SEQ ID NO: 1579233 - RNA, 22 nt, Human adenovirus E
caaggugcggcccaucaagcag

SEQ ID NO: 1579234 - RNA, 14 nt, Human adenovirus E
agcuggccuuggaa

SEQ ID NO: 1579235 - RNA, 15 nt, Human adenovirus E
ccacauuacacagac

SEQ ID NO: 1579236 - RNA, 21 nt, Human adenovirus E
gccucggugcacccgugcagc

SEQ ID NO: 1579237 - RNA, 15 nt, Human adenovirus E
ccgcaccgccgcugc

SEQ ID NO: 1579238 - RNA, 16 nt, Human adenovirus E
uccaccuuuuccaggg

SEQ ID NO: 1579239 - RNA, 22 nt, Human adenovirus E
gagaaccgccuggggcagaacg

SEQ ID NO: 1579240 - RNA, 21 nt, Human adenovirus E
uccgaggacgagggcaugcaa

SEQ ID NO: 1579241 - RNA, 13 nt, Human adenovirus E
cagacccacugcu

SEQ ID NO: 1579242 - RNA, 21 nt, Human adenovirus E
agucuaaaaauacccgccaaa

SEQ ID NO: 1579243 - RNA, 17 nt, Human adenovirus E
ccuuagcuuugacagua

SEQ ID NO: 1579244 - RNA, 14 nt, Human adenovirus E
gcuccucccucagc

SEQ ID NO: 1579245 - RNA, 17 nt, Human adenovirus E
cuucucgcgcuucugcu

SEQ ID NO: 1579246 - RNA, 13 nt, Human adenovirus E
ggagauggaggaa

SEQ ID NO: 1579247 - RNA, 13 nt, Human adenovirus E
gcagucccacugc

SEQ ID NO: 1579248 - RNA, 13 nt, Human adenovirus E
aggagauggagga

SEQ ID NO: 1579249 - RNA, 23 nt, Human adenovirus E
ggagcacgaggaggagcuggcag

SEQ ID NO: 1579250 - RNA, 17 nt, Human adenovirus E
ucaccgagagccgccuc

SEQ ID NO: 1579251 - RNA, 20 nt, Human adenovirus E
gcaugaauuggcucagcgcc

SEQ ID NO: 1579252 - RNA, 11 nt, Human adenovirus E
ccaggugcuca

SEQ ID NO: 1579253 - RNA, 16 nt, Human adenovirus E
ccccaggaugccccga

SEQ ID NO: 1579254 - RNA, 18 nt, Human adenovirus E
ucccuggccugcaacccc

SEQ ID NO: 1579255 - RNA, 23 nt, Human adenovirus E
cccgccaacgugccccggggcca

SEQ ID NO: 1579256 - RNA, 15 nt, Human adenovirus E
gaacagccagagcag

SEQ ID NO: 1579257 - RNA, 20 nt, Human adenovirus E
gagccacaccacagcuaccu

SEQ ID NO: 1579258 - RNA, 13 nt, Human adenovirus E
acuuggcgguggg

SEQ ID NO: 1579259 - RNA, 19 nt, Human adenovirus E
ccagcugcaccacgcugcg

SEQ ID NO: 1579260 - RNA, 14 nt, Human adenovirus E
ggaggggcggaaca

SEQ ID NO: 1579261 - RNA, 21 nt, Human adenovirus E
ggggccacgagccggggcagc

SEQ ID NO: 1579262 - RNA, 19 nt, Human adenovirus E
agccuuuagacagcagccc

SEQ ID NO: 1579263 - RNA, 21 nt, Human adenovirus E
acgugcccauagacaaggagg

SEQ ID NO: 1579264 - RNA, 19 nt, Human adenovirus E
acuacaaugcucagucuca

SEQ ID NO: 1579265 - RNA, 20 nt, Human adenovirus E
  misc_feature (10)..(10): n is a, c, g or u
cagcacgaangaggccacgu

SEQ ID NO: 1579266 - RNA, 15 nt, Human adenovirus E
gcgugcaggccccgg

SEQ ID NO: 1579267 - RNA, 20 nt, Human adenovirus E
cagagauccacggccagggc

SEQ ID NO: 1579268 - RNA, 18 nt, Human adenovirus E
ucccgccccaguacgcgc

SEQ ID NO: 1579269 - RNA, 17 nt, Human adenovirus E
cgcgguggggcggccag

SEQ ID NO: 1579270 - RNA, 20 nt, Human adenovirus E
accgcagcagaggaggcagc

SEQ ID NO: 1579271 - RNA, 22 nt, Human adenovirus E
agcggcucgacuccguggccug

SEQ ID NO: 1579272 - RNA, 17 nt, Human adenovirus E
gugcgcuucaggcucau

SEQ ID NO: 1579273 - RNA, 18 nt, Human adenovirus E
cucguccacauccaggaa

SEQ ID NO: 1579274 - RNA, 20 nt, Human adenovirus E
cgugcucuuugccuucacca

SEQ ID NO: 1579275 - RNA, 17 nt, Human adenovirus E
cuucgcggugcccgagg

SEQ ID NO: 1579276 - RNA, 20 nt, Human adenovirus E
acugggcuuuucggcgcggu

SEQ ID NO: 1579277 - RNA, 22 nt, Human adenovirus E
gggccuuggaggcggcggcagg

SEQ ID NO: 1579278 - RNA, 17 nt, Human adenovirus E
acauccgcgacugcguc

SEQ ID NO: 1579279 - RNA, 20 nt, Human adenovirus E
cucgugcgagggggcgagga

SEQ ID NO: 1579280 - RNA, 16 nt, Human adenovirus E
ggggcgauccuggccc

SEQ ID NO: 1579281 - RNA, 17 nt, Human adenovirus E
gcggcgcgagcugagcg

SEQ ID NO: 1579282 - RNA, 14 nt, Human adenovirus E
aggugaggaagagc

SEQ ID NO: 1579283 - RNA, 16 nt, Human adenovirus E
cugcugcgccuggcca

SEQ ID NO: 1579284 - RNA, 19 nt, Human adenovirus E
ggaucagcaguuugggcag

SEQ ID NO: 1579285 - RNA, 17 nt, Human adenovirus E
ggccgaaguccagcuga

SEQ ID NO: 1579286 - RNA, 17 nt, Human adenovirus E
cagcccccgcuggaggc

SEQ ID NO: 1579287 - RNA, 14 nt, Human adenovirus E
uguuggccagcugc

SEQ ID NO: 1579288 - RNA, 14 nt, Human adenovirus E
ucguaggugagcuc

SEQ ID NO: 1579289 - RNA, 22 nt, Human adenovirus E
caggagcgcgggcugccgcugu

SEQ ID NO: 1579290 - RNA, 12 nt, Human adenovirus E
caccucacagcu

SEQ ID NO: 1579291 - RNA, 18 nt, Human adenovirus E
uggaccacugccgccgcu

SEQ ID NO: 1579292 - RNA, 17 nt, Human adenovirus E
cggaaccacagggccag

SEQ ID NO: 1579293 - RNA, 18 nt, Human adenovirus E
cagcggggugucggggaa

SEQ ID NO: 1579294 - RNA, 15 nt, Human adenovirus E
accccguacgugccc

SEQ ID NO: 1579295 - RNA, 22 nt, Human adenovirus E
gaaccugacacaccaccacagc

SEQ ID NO: 1579296 - RNA, 16 nt, Human adenovirus E
gccuuggcaguacagu

SEQ ID NO: 1579297 - RNA, 21 nt, Human adenovirus E
caugauggccgugguccuggu

SEQ ID NO: 1579298 - RNA, 12 nt, Human adenovirus E
cggaugaagugg

SEQ ID NO: 1579299 - RNA, 19 nt, Human adenovirus E
agggcgagaucgagggcga

SEQ ID NO: 1579300 - RNA, 19 nt, Human adenovirus E
agcuagaaaauccacagcg

SEQ ID NO: 1579301 - RNA, 19 nt, Human adenovirus E
gagggugcugagggacgag

SEQ ID NO: 1579302 - RNA, 20 nt, Human adenovirus E
cuggggguguugucccugcg

SEQ ID NO: 1579303 - RNA, 17 nt, Human adenovirus E
uggcuccuggaccuggu

SEQ ID NO: 1579304 - RNA, 12 nt, Human adenovirus E
uggaccucggcc

SEQ ID NO: 1579305 - RNA, 16 nt, Human adenovirus E
ugaaaacaccaccugg

SEQ ID NO: 1579306 - RNA, 15 nt, Human adenovirus E
cuuacggcaagcgca

SEQ ID NO: 1579307 - RNA, 20 nt, Human adenovirus E
acaccuggaccacugccgcc

SEQ ID NO: 1579308 - RNA, 16 nt, Human adenovirus E
caugcugacgagcccg

SEQ ID NO: 1579309 - RNA, 14 nt, Human adenovirus E
gggcgcccagcagg

SEQ ID NO: 1579310 - RNA, 13 nt, Human adenovirus E
cgccggugccgcc

SEQ ID NO: 1579311 - RNA, 11 nt, Human adenovirus E
ccugcgccgcu

SEQ ID NO: 1579312 - RNA, 12 nt, Human adenovirus E
cuaccacccaca

SEQ ID NO: 1579313 - RNA, 17 nt, Human adenovirus E
gcagcgggcccugaccg

SEQ ID NO: 1579314 - RNA, 12 nt, Human adenovirus E
cuccuccuccag

SEQ ID NO: 1579315 - RNA, 22 nt, Human adenovirus E
cggagaugccuuucaagagccc

SEQ ID NO: 1579316 - RNA, 17 nt, Human adenovirus E
ggaugucaaauuccucc

SEQ ID NO: 1579317 - RNA, 20 nt, Human adenovirus E
gacguagaggggcuccucga

SEQ ID NO: 1579318 - RNA, 13 nt, Human adenovirus E
uacaccaacuuca

SEQ ID NO: 1579319 - RNA, 15 nt, Human adenovirus E
cgaugugcucgguga

SEQ ID NO: 1579320 - RNA, 24 nt, Human adenovirus E
cgccucugggugaaggccacggga

SEQ ID NO: 1579321 - RNA, 15 nt, Human adenovirus E
ugaugacagcaacag

SEQ ID NO: 1579322 - RNA, 17 nt, Human adenovirus E
ucccagacaugcaagag

SEQ ID NO: 1579323 - RNA, 22 nt, Human adenovirus E
ggcgcacguggacgagcagacc

SEQ ID NO: 1579324 - RNA, 22 nt, Human adenovirus E
gcgcgagcagaaggggggcagg

SEQ ID NO: 1579325 - RNA, 20 nt, Human adenovirus E
ggcgagaucgagggcgagcu

SEQ ID NO: 1579326 - RNA, 16 nt, Human adenovirus E
agcacccagcccgcca

SEQ ID NO: 1579327 - RNA, 17 nt, Human adenovirus E
uccaucccgcuggacca

SEQ ID NO: 1579328 - RNA, 17 nt, Human adenovirus E
ugaaccugagccaggcu

SEQ ID NO: 1579329 - RNA, 19 nt, Human adenovirus E
accucaauccgcguaauug

SEQ ID NO: 1579330 - RNA, 19 nt, Human adenovirus E
aagcuauguuggagcaaca

SEQ ID NO: 1579331 - RNA, 16 nt, Human adenovirus E
cucagguugucaguuu

SEQ ID NO: 1579332 - RNA, 21 nt, Human adenovirus E
cgcgagcugagcgaccaggag

SEQ ID NO: 1579333 - RNA, 14 nt, Human adenovirus E
ugcacuggcagccc

SEQ ID NO: 1579334 - RNA, 13 nt, Human adenovirus E
cgugcagcagaag

SEQ ID NO: 1579335 - RNA, 12 nt, Human adenovirus E
gacggcggccug

SEQ ID NO: 1579336 - RNA, 16 nt, Human adenovirus E
accaccacagcaaccu

SEQ ID NO: 1579337 - RNA, 22 nt, Human adenovirus E
ccucggccgcguggccuuuggc

SEQ ID NO: 1579338 - RNA, 21 nt, Human adenovirus E
uguaccccaccaugcagcuga

SEQ ID NO: 1579339 - RNA, 12 nt, Human adenovirus E
gguccuggguga

SEQ ID NO: 1579340 - RNA, 14 nt, Human adenovirus E
ccccucagcgugga

SEQ ID NO: 1579341 - RNA, 18 nt, Human adenovirus E
cuacuuccaagaagaggc

SEQ ID NO: 1579342 - RNA, 18 nt, Human adenovirus E
gggcgucgucgccggagc

SEQ ID NO: 1579343 - RNA, 14 nt, Human adenovirus E
cuucuuccuccucc

SEQ ID NO: 1579344 - RNA, 20 nt, Human adenovirus E
gcccagcacacgcccagaaa

SEQ ID NO: 1579345 - RNA, 17 nt, Human adenovirus E
ggcacgacaggcagcgg

SEQ ID NO: 1579346 - RNA, 19 nt, Human adenovirus E
guaccccaccaugcagcug

SEQ ID NO: 1579347 - RNA, 14 nt, Human adenovirus E
cagaacuuccagca

SEQ ID NO: 1579348 - RNA, 17 nt, Human adenovirus E
ccuggaccgaaagaggg

SEQ ID NO: 1579349 - RNA, 13 nt, Human adenovirus E
ggagacgcgcggc

SEQ ID NO: 1579350 - RNA, 20 nt, Human adenovirus E
gggccgcuggcuccuggacc

SEQ ID NO: 1579351 - RNA, 16 nt, Human adenovirus E
ggggcagaggcggagg

SEQ ID NO: 1579352 - RNA, 16 nt, Human adenovirus E
cugaugcaccuguggg

SEQ ID NO: 1579353 - RNA, 15 nt, Human adenovirus E
gcucccuggccugca

SEQ ID NO: 1579354 - RNA, 13 nt, Human adenovirus E
cagccguuccgca

SEQ ID NO: 1579355 - RNA, 15 nt, Human adenovirus E
gacaucggcgugaag

SEQ ID NO: 1579356 - RNA, 22 nt, Human adenovirus E
cuggcgccuacggaggggcgga

SEQ ID NO: 1579357 - RNA, 20 nt, Human adenovirus E
cuccucaggcggcaguggug

SEQ ID NO: 1579358 - RNA, 16 nt, Human adenovirus E
gcagggccuguggggc

SEQ ID NO: 1579359 - RNA, 16 nt, Human adenovirus E
cgcgcccugggccagg

SEQ ID NO: 1579360 - RNA, 20 nt, Human adenovirus E
gcaugagcaccacagcgccc

SEQ ID NO: 1579361 - RNA, 14 nt, Human adenovirus E
gcugcugcucaggg

SEQ ID NO: 1579362 - RNA, 17 nt, Human adenovirus E
cugcucgaucuccuccu

SEQ ID NO: 1579363 - RNA, 17 nt, Human adenovirus E
agagccacaccacagcu

SEQ ID NO: 1579364 - RNA, 18 nt, Human adenovirus E
uggacaaaauaccaccuc

SEQ ID NO: 1579365 - RNA, 14 nt, Human adenovirus E
  misc_feature (5)..(5): n is a, c, g or u
gcugnugagcgaga

SEQ ID NO: 1579366 - RNA, 12 nt, Human adenovirus E
acuccuccucca

SEQ ID NO: 1579367 - RNA, 18 nt, Human adenovirus E
cgccugcugggccuuggc

SEQ ID NO: 1579368 - RNA, 14 nt, Human adenovirus E
ugccagccccgauu

SEQ ID NO: 1579369 - RNA, 13 nt, Human adenovirus E
ccagcuggccuug

SEQ ID NO: 1579370 - RNA, 18 nt, Human adenovirus E
gauugaaaaccaucacag

SEQ ID NO: 1579371 - RNA, 15 nt, Human adenovirus E
agcaccacagggcag

SEQ ID NO: 1579372 - RNA, 20 nt, Human adenovirus E
caggaugcaccgugcgguga

SEQ ID NO: 1579373 - RNA, 19 nt, Human adenovirus E
caacgugcagaccaaccug

SEQ ID NO: 1579374 - RNA, 18 nt, Human adenovirus E
ccaccaugcagcugaugg

SEQ ID NO: 1579375 - RNA, 17 nt, Human adenovirus E
uccaucgcuuacagccu

SEQ ID NO: 1579376 - RNA, 19 nt, Human adenovirus E
accgagggggagagcuacu

SEQ ID NO: 1579377 - RNA, 20 nt, Human adenovirus E
cugcaguacgugcaacacag

SEQ ID NO: 1579378 - RNA, 21 nt, Human adenovirus E
cauccgcggcgacgaggccgg

SEQ ID NO: 1579379 - RNA, 19 nt, Human adenovirus E
ugccaucacaccuuccacc

SEQ ID NO: 1579380 - RNA, 21 nt, Human adenovirus E
cgccagcccaauggcaccugc

SEQ ID NO: 1579381 - RNA, 15 nt, Human adenovirus E
accggugaggagcuc

SEQ ID NO: 1579382 - RNA, 14 nt, Human adenovirus E
caguuccgccagga

SEQ ID NO: 1579383 - RNA, 20 nt, Human adenovirus E
gccaugcggaugaagcacaa

SEQ ID NO: 1579384 - RNA, 17 nt, Human adenovirus E
ccggcgcgacuacaucc

SEQ ID NO: 1579385 - RNA, 15 nt, Human adenovirus E
cucaggcggcagugg

SEQ ID NO: 1579386 - RNA, 17 nt, Human adenovirus E
caugcccgccucguucc

SEQ ID NO: 1579387 - RNA, 15 nt, Human adenovirus E
cugcacaggcagcaa

SEQ ID NO: 1579388 - RNA, 14 nt, Human adenovirus E
guacgagcagaccg

SEQ ID NO: 1579389 - RNA, 18 nt, Human adenovirus E
ugguggcgcgcaccucgc

SEQ ID NO: 1579390 - RNA, 23 nt, Human adenovirus E
ggcuuuaccgacaaaaaucagac

SEQ ID NO: 1579391 - RNA, 20 nt, Human adenovirus E
cgaaaaagaaaaacagccau

SEQ ID NO: 1579392 - RNA, 13 nt, Human adenovirus E
caccaccgccucg

SEQ ID NO: 1579393 - RNA, 22 nt, Human adenovirus E
caaggggggucugaaacucacc

SEQ ID NO: 1579394 - RNA, 15 nt, Human adenovirus E
gagccccgggcccag

SEQ ID NO: 1579395 - RNA, 15 nt, Human adenovirus E
gccccuuguggaaga

SEQ ID NO: 1579396 - RNA, 16 nt, Human adenovirus E
ggugcacuuggggaau

SEQ ID NO: 1579397 - RNA, 17 nt, Human adenovirus E
ugcugaaaaagggccgc

SEQ ID NO: 1579398 - RNA, 18 nt, Human adenovirus E
ucccgguaccacaucacc

SEQ ID NO: 1579399 - RNA, 22 nt, Human adenovirus E
uaccagauccucagguaaauca

SEQ ID NO: 1579400 - RNA, 18 nt, Human adenovirus E
gacaugcaucccagcugg

SEQ ID NO: 1579401 - RNA, 18 nt, Human adenovirus E
cgccggcggcggucucgg

SEQ ID NO: 1579402 - RNA, 19 nt, Human adenovirus E
guggaaaauaacagccagg

SEQ ID NO: 1579403 - RNA, 16 nt, Human adenovirus E
ucccauacuccaccuc

SEQ ID NO: 1579404 - RNA, 13 nt, Human adenovirus E
caacccuuccucc

SEQ ID NO: 1579405 - RNA, 14 nt, Human adenovirus E
uauccgcagcagcg

SEQ ID NO: 1579406 - RNA, 13 nt, Human adenovirus E
gacagcggcagca

SEQ ID NO: 1579407 - RNA, 19 nt, Human adenovirus E
gauucccacggagcccaug

SEQ ID NO: 1579408 - RNA, 17 nt, Human adenovirus E
gcgaguccaaccuggga

SEQ ID NO: 1579409 - RNA, 17 nt, Human adenovirus E
agacgcgcggccacggc

SEQ ID NO: 1579410 - RNA, 14 nt, Human adenovirus E
ccggugacacacuc

SEQ ID NO: 1579411 - RNA, 14 nt, Human adenovirus E
gcacggccagcgcg

SEQ ID NO: 1579412 - RNA, 18 nt, Human adenovirus E
ggcacgauucugaccugc

SEQ ID NO: 1579413 - RNA, 18 nt, Human adenovirus E
  misc_feature (7)..(7): n is a, c, g or u
ccgggcnugggcgugcag

SEQ ID NO: 1579414 - RNA, 18 nt, Human adenovirus E
aggucgaggagaaccugc

SEQ ID NO: 1579415 - RNA, 18 nt, Human adenovirus E
gcuccggaauccugcccg

SEQ ID NO: 1579416 - RNA, 15 nt, Human adenovirus E
cgcgccugcugcugc

SEQ ID NO: 1579417 - RNA, 18 nt, Human adenovirus E
aucucgaaucaggcugga

SEQ ID NO: 1579418 - RNA, 24 nt, Human adenovirus E
gcagccccccugcucccagagcug

SEQ ID NO: 1579419 - RNA, 18 nt, Human adenovirus E
agccacugcuaccugcug

SEQ ID NO: 1579420 - RNA, 17 nt, Human adenovirus E
uggaggcggcggcagga

SEQ ID NO: 1579421 - RNA, 14 nt, Human adenovirus E
accaccacuacagc

SEQ ID NO: 1579422 - RNA, 20 nt, Human adenovirus E
uaccugcugcgccuggccaa

SEQ ID NO: 1579423 - RNA, 15 nt, Human adenovirus E
uggaggaagacuggg

SEQ ID NO: 1579424 - RNA, 15 nt, Human adenovirus E
uguaggcgcagcagc

SEQ ID NO: 1579425 - RNA, 15 nt, Human adenovirus E
cagcacucaggcaga

SEQ ID NO: 1579426 - RNA, 20 nt, Human adenovirus E
guccagagauccacggccag

SEQ ID NO: 1579427 - RNA, 12 nt, Human adenovirus E
ccagggcauggg

SEQ ID NO: 1579428 - RNA, 21 nt, Human adenovirus E
aggacgucagcggcgagggcc

SEQ ID NO: 1579429 - RNA, 23 nt, Human adenovirus E
cagaacaaugacuucacccccac

SEQ ID NO: 1579430 - RNA, 16 nt, Human adenovirus E
uuuaaugaaucagaug

SEQ ID NO: 1579431 - RNA, 15 nt, Human adenovirus E
ucaacagccgccugg

SEQ ID NO: 1579432 - RNA, 13 nt, Human adenovirus E
gagcaaggacaga

SEQ ID NO: 1579433 - RNA, 19 nt, Human adenovirus E
acgucagcggcgagggccu

SEQ ID NO: 1579434 - RNA, 21 nt, Human adenovirus E
acgagccggggcagcgccgcc

SEQ ID NO: 1579435 - RNA, 20 nt, Human adenovirus E
cuggacgcugcucaccaccu

SEQ ID NO: 1579436 - RNA, 13 nt, Human adenovirus E
gcgcccggagaaa

SEQ ID NO: 1579437 - RNA, 15 nt, Human adenovirus E
cucuucuuccuccuc

SEQ ID NO: 1579438 - RNA, 18 nt, Human adenovirus E
gccgggaccgagggggag

SEQ ID NO: 1579439 - RNA, 14 nt, Human adenovirus E
cgccggcaggaccc

SEQ ID NO: 1579440 - RNA, 14 nt, Human adenovirus E
gguauugcuauuuu

SEQ ID NO: 1579441 - RNA, 21 nt, Human adenovirus E
gcagaucuagggccucaggag

SEQ ID NO: 1579442 - RNA, 13 nt, Human adenovirus E
cagggccagcacc

SEQ ID NO: 1579443 - RNA, 13 nt, Human adenovirus E
cgacgagcagcug

SEQ ID NO: 1579444 - RNA, 23 nt, Human adenovirus E
aaccugggauccaugguggcgcu

SEQ ID NO: 1579445 - RNA, 21 nt, Human adenovirus E
gccagcgccggcaggacccgg

SEQ ID NO: 1579446 - RNA, 22 nt, Human adenovirus E
uccgggucucggcauggcccgc

SEQ ID NO: 1579447 - RNA, 21 nt, Human adenovirus E
cauggaccaggugcucaucaa

SEQ ID NO: 1579448 - RNA, 18 nt, Human adenovirus E
cgcucccuggggcgcccu

SEQ ID NO: 1579449 - RNA, 17 nt, Human adenovirus E
agugcugacccugagcg

SEQ ID NO: 1579450 - RNA, 21 nt, Human adenovirus E
cuacugaauuuuuguccacug

SEQ ID NO: 1579451 - RNA, 21 nt, Human adenovirus E
aaguggaaaccuaaaccccau

SEQ ID NO: 1579452 - RNA, 21 nt, Human adenovirus E
gugggcuuggauguugaggua

SEQ ID NO: 1579453 - RNA, 22 nt, Human adenovirus E
agcgcgagcgguuccaccgcga

SEQ ID NO: 1579454 - RNA, 15 nt, Human adenovirus E
auacuuuuaucuaug

SEQ ID NO: 1579455 - RNA, 13 nt, Human adenovirus E
gagggugcugccg

SEQ ID NO: 1579456 - RNA, 22 nt, Human adenovirus E
auugaacuaugauuccuagaca

SEQ ID NO: 1579457 - RNA, 15 nt, Human adenovirus E
uggugaaggaggaaa

SEQ ID NO: 1579458 - RNA, 16 nt, Human adenovirus E
gagcgaccaggagcug

SEQ ID NO: 1579459 - RNA, 12 nt, Human adenovirus E
uuccugaugcag

SEQ ID NO: 1579460 - RNA, 15 nt, Human adenovirus E
guucagggcggccag

SEQ ID NO: 1579461 - RNA, 14 nt, Human adenovirus E
gccagggcuugcag

SEQ ID NO: 1579462 - RNA, 13 nt, Human adenovirus E
gaacaggaagaac

SEQ ID NO: 1579463 - RNA, 13 nt, Human adenovirus E
gucaacaauagca

SEQ ID NO: 1579464 - RNA, 15 nt, Human adenovirus E
cuaccucugccacac

SEQ ID NO: 1579465 - RNA, 22 nt, Human adenovirus E
caggcgauggcggcggcggcga

SEQ ID NO: 1579466 - RNA, 15 nt, Human adenovirus E
agcccacggccgcca

SEQ ID NO: 1579467 - RNA, 16 nt, Human adenovirus E
ccaccccacccaguga

SEQ ID NO: 1579468 - RNA, 14 nt, Human adenovirus E
acccugccgcugcg

SEQ ID NO: 1579469 - RNA, 18 nt, Human adenovirus E
gacagaaaaucgcccagg

SEQ ID NO: 1579470 - RNA, 21 nt, Human adenovirus E
caaguggugcccccuccagaa

SEQ ID NO: 1579471 - RNA, 17 nt, Human adenovirus E
aggagcacccucagggc

SEQ ID NO: 1579472 - RNA, 15 nt, Human adenovirus E
ugaugcccacggccc

SEQ ID NO: 1579473 - RNA, 22 nt, Human adenovirus E
  misc_feature (9)..(9): n is a, c, g or u
gcgcgcaanuacacccccgccg

SEQ ID NO: 1579474 - RNA, 15 nt, Human adenovirus E
uuggggcaccucggc

SEQ ID NO: 1579475 - RNA, 15 nt, Human adenovirus E
ccucauuuuccccga

SEQ ID NO: 1579476 - RNA, 21 nt, Human adenovirus E
ugccugaacgccugcugggcc

SEQ ID NO: 1579477 - RNA, 17 nt, Human adenovirus E
aggagcucaaccccggc

SEQ ID NO: 1579478 - RNA, 12 nt, Human adenovirus E
gccaccucagcu

SEQ ID NO: 1579479 - RNA, 16 nt, Human adenovirus E
gcacgaagcccugcag

SEQ ID NO: 1579480 - RNA, 23 nt, Human adenovirus E
cuucaggcgccagcgccggcagg

SEQ ID NO: 1579481 - RNA, 23 nt, Human adenovirus E
uugccugaacgccugcugggccu

SEQ ID NO: 1579482 - RNA, 18 nt, Human adenovirus E
ccccgcagcagucgcugc

SEQ ID NO: 1579483 - RNA, 18 nt, Human adenovirus E
agcgaacggguugggcug

SEQ ID NO: 1579484 - RNA, 18 nt, Human adenovirus E
gugaccguggagcuggag

SEQ ID NO: 1579485 - RNA, 16 nt, Human adenovirus E
gagaugaaacccuccg

SEQ ID NO: 1579486 - RNA, 15 nt, Human adenovirus E
gcugcugcugguggc

SEQ ID NO: 1579487 - RNA, 18 nt, Human adenovirus E
gaggccaucggccaggcg

SEQ ID NO: 1579488 - RNA, 12 nt, Human adenovirus E
ggagccacugcu

SEQ ID NO: 1579489 - RNA, 23 nt, Human adenovirus E
agaagcugaaaguggagcugccg

SEQ ID NO: 1579490 - RNA, 15 nt, Human adenovirus E
cagcugauggugccc

SEQ ID NO: 1579491 - RNA, 21 nt, Human adenovirus E
auccaucgagauugaccuggg

SEQ ID NO: 1579492 - RNA, 15 nt, Human adenovirus E
ucaagcccagcacca

SEQ ID NO: 1579493 - RNA, 12 nt, Human adenovirus E
augaccugggcg

SEQ ID NO: 1579494 - RNA, 23 nt, Human adenovirus E
ggccuguuccugaugcaggaggg

SEQ ID NO: 1579495 - RNA, 12 nt, Human adenovirus E
gaaggggggcag

SEQ ID NO: 1579496 - RNA, 16 nt, Human adenovirus E
cuggagcgcguggccc

SEQ ID NO: 1579497 - RNA, 15 nt, Human adenovirus E
cagcagucaggcaga

SEQ ID NO: 1579498 - RNA, 14 nt, Human adenovirus E
cggggcagcgccgc

SEQ ID NO: 1579499 - RNA, 18 nt, Human adenovirus E
ugaaggaggaaagaaagc

SEQ ID NO: 1579500 - RNA, 14 nt, Human adenovirus E
gccccgggcccagg

SEQ ID NO: 1579501 - RNA, 12 nt, Human adenovirus E
cgcucagcaccg

SEQ ID NO: 1579502 - RNA, 23 nt, Human adenovirus E
ggccgucccagacaugcaagaga

SEQ ID NO: 1579503 - RNA, 12 nt, Human adenovirus E
acgugcucuuug

SEQ ID NO: 1579504 - RNA, 16 nt, Human adenovirus E
cagucucaaguccagc

SEQ ID NO: 1579505 - RNA, 20 nt, Human adenovirus E
ggcgcuguccggccgcgagg

SEQ ID NO: 1579506 - RNA, 16 nt, Human adenovirus E
cucugccacaccuggc

SEQ ID NO: 1579507 - RNA, 15 nt, Human adenovirus E
acggaacugcugccc

SEQ ID NO: 1579508 - RNA, 19 nt, Human adenovirus E
accgcgaguccaaccuggg

SEQ ID NO: 1579509 - RNA, 13 nt, Human adenovirus E
ugaugcagcaggc

SEQ ID NO: 1579510 - RNA, 15 nt, Human adenovirus E
uuggcgcggaggaag

SEQ ID NO: 1579511 - RNA, 23 nt, Human adenovirus E
cugcuaccugcugcgccuggcca

SEQ ID NO: 1579512 - RNA, 20 nt, Human adenovirus E
ucugcaaggagaaggaggag

SEQ ID NO: 1579513 - RNA, 13 nt, Human adenovirus E
cgcggcgacgagg

SEQ ID NO: 1579514 - RNA, 20 nt, Human adenovirus E
cuugcccuucucgcugaaca

SEQ ID NO: 1579515 - RNA, 18 nt, Human adenovirus E
cccagaguuuggaagagc

SEQ ID NO: 1579516 - RNA, 15 nt, Human adenovirus E
gcgcugcucgaccgc

SEQ ID NO: 1579517 - RNA, 23 nt, Human adenovirus E
gcucugcaaggagaaggaggaga

SEQ ID NO: 1579518 - RNA, 22 nt, Human adenovirus E
cagguggcagaugcggcgguac

SEQ ID NO: 1579519 - RNA, 21 nt, Human adenovirus E
acccagaccgguaagaaggag

SEQ ID NO: 1579520 - RNA, 18 nt, Human adenovirus E
uacgauaccacccgguug

SEQ ID NO: 1579521 - RNA, 13 nt, Human adenovirus E
gcaguaguacaga

SEQ ID NO: 1579522 - RNA, 14 nt, Human adenovirus E
ggucccggccgggg

SEQ ID NO: 1579523 - RNA, 19 nt, Human adenovirus E
uguggggcgugcaggcccc

SEQ ID NO: 1579524 - RNA, 21 nt, Human adenovirus E
cggccauuuuuucggggguga

SEQ ID NO: 1579525 - RNA, 12 nt, Human adenovirus E
ugagcgccagca

SEQ ID NO: 1579526 - RNA, 17 nt, Human adenovirus E
cuggaccacugccgccg

SEQ ID NO: 1579527 - RNA, 17 nt, Human adenovirus E
ugccuuggcaguacagu

SEQ ID NO: 1579528 - RNA, 17 nt, Human adenovirus E
cacuggcucccgccgcc

SEQ ID NO: 1579529 - RNA, 19 nt, Human adenovirus E
ggaugcgucgccaccacca

SEQ ID NO: 1579530 - RNA, 20 nt, Human adenovirus E
cgugguggcggacgcgcgcc

SEQ ID NO: 1579531 - RNA, 19 nt, Human adenovirus E
gcccaugagcugcgagaag

SEQ ID NO: 1579532 - RNA, 15 nt, Human adenovirus E
ccauggcuugcaggg

SEQ ID NO: 1579533 - RNA, 18 nt, Human adenovirus E
uuugauacugauggaaac

SEQ ID NO: 1579534 - RNA, 15 nt, Human adenovirus E
agaagcaagcuccag

SEQ ID NO: 1579535 - RNA, 13 nt, Human adenovirus E
caccacuacagcc

SEQ ID NO: 1579536 - RNA, 20 nt, Human adenovirus E
gugcccgaggcccuggccac

SEQ ID NO: 1579537 - RNA, 23 nt, Human adenovirus E
auccugcccgccaccugcuccgc

SEQ ID NO: 1579538 - RNA, 20 nt, Human adenovirus E
ccucguuucgcggguuggga

SEQ ID NO: 1579539 - RNA, 14 nt, Human adenovirus E
ucugggugaaggcc

SEQ ID NO: 1579540 - RNA, 19 nt, Human adenovirus E
uccuaggccuuuuaauuuu

SEQ ID NO: 1579541 - RNA, 19 nt, Human adenovirus E
aacucagguguccagcugg

SEQ ID NO: 1579542 - RNA, 20 nt, Human adenovirus E
cgcgcgggaguugcgguaca

SEQ ID NO: 1579543 - RNA, 16 nt, Human adenovirus E
auaacaaaaaaaauga

SEQ ID NO: 1579544 - RNA, 18 nt, Human adenovirus E
gccgggcggcaggggcgg

SEQ ID NO: 1579545 - RNA, 15 nt, Human adenovirus E
cgacgagcagcuggc

SEQ ID NO: 1579546 - RNA, 15 nt, Human adenovirus E
caaaauucucaggug

SEQ ID NO: 1579547 - RNA, 23 nt, Human adenovirus E
cgcacguggccgcggccaaccug

SEQ ID NO: 1579548 - RNA, 19 nt, Human adenovirus E
ggacuccguggcucugccu

SEQ ID NO: 1579549 - RNA, 16 nt, Human adenovirus E
ccgcggcacgcgcuuc

SEQ ID NO: 1579550 - RNA, 22 nt, Human adenovirus E
uuagggcaagccacaguacaga

SEQ ID NO: 1579551 - RNA, 15 nt, Human adenovirus E
cggggcgggagcugc

SEQ ID NO: 1579552 - RNA, 16 nt, Human adenovirus E
cuucacccccacggag

SEQ ID NO: 1579553 - RNA, 18 nt, Human adenovirus E
caccgcgaguccaaccug

SEQ ID NO: 1579554 - RNA, 16 nt, Human adenovirus E
gcgaacgcucugcaag

SEQ ID NO: 1579555 - RNA, 15 nt, Human adenovirus E
ccacggaggccagca

SEQ ID NO: 1579556 - RNA, 19 nt, Human adenovirus E
guuccagacgcggcuguag

SEQ ID NO: 1579557 - RNA, 19 nt, Human adenovirus E
accacagcaaccucaggca

SEQ ID NO: 1579558 - RNA, 22 nt, Human adenovirus E
gauccccgucuccugccgcgcc

SEQ ID NO: 1579559 - RNA, 19 nt, Human adenovirus E
ucagcaugaugcccacggc

SEQ ID NO: 1579560 - RNA, 16 nt, Human adenovirus E
  misc_feature (7)..(7): n is a, c, g or u
acacucnugcaccauc

SEQ ID NO: 1579561 - RNA, 15 nt, Human adenovirus E
ccaucauccccacgc

SEQ ID NO: 1579562 - RNA, 24 nt, Human adenovirus E
aggaggcgcucuccccccagggau

SEQ ID NO: 1579563 - RNA, 21 nt, Human adenovirus E
uggucagcgacgagcagcugg

SEQ ID NO: 1579564 - RNA, 18 nt, Human adenovirus E
ccauacuccaccuccacc

SEQ ID NO: 1579565 - RNA, 15 nt, Human adenovirus E
ggacugaggggcgug

SEQ ID NO: 1579566 - RNA, 16 nt, Human adenovirus E
agcccgucccgggggu

SEQ ID NO: 1579567 - RNA, 20 nt, Human adenovirus E
ucagacccacugcugaaccu

SEQ ID NO: 1579568 - RNA, 18 nt, Human adenovirus E
agcagugucuggaggagc

SEQ ID NO: 1579569 - RNA, 17 nt, Human adenovirus E
cgcaggccggagcuguc

SEQ ID NO: 1579570 - RNA, 15 nt, Human adenovirus E
cgcggaggaaggaag

SEQ ID NO: 1579571 - RNA, 20 nt, Human adenovirus E
cuggagaagaaucgccaggg

SEQ ID NO: 1579572 - RNA, 22 nt, Human adenovirus E
gcguggcccgcuacaacagcac

SEQ ID NO: 1579573 - RNA, 22 nt, Human adenovirus E
gacgcaguagaaggugcggggg

SEQ ID NO: 1579574 - RNA, 18 nt, Human adenovirus E
cuccaacguggagcugac

SEQ ID NO: 1579575 - RNA, 18 nt, Human adenovirus E
gcaccgcucccuggccug

SEQ ID NO: 1579576 - RNA, 16 nt, Human adenovirus E
cugacgcuccuggucc

SEQ ID NO: 1579577 - RNA, 20 nt, Human adenovirus E
gucagcgacgagcagcuggc

SEQ ID NO: 1579578 - RNA, 22 nt, Human adenovirus E
caccguaagcagugcucaggug

SEQ ID NO: 1579579 - RNA, 16 nt, Human adenovirus E
ccagaaaaagccacag

SEQ ID NO: 1579580 - RNA, 20 nt, Human adenovirus E
ggccagaucguccagggcag

SEQ ID NO: 1579581 - RNA, 13 nt, Human adenovirus E
gccgcgcgcgggu

SEQ ID NO: 1579582 - RNA, 16 nt, Human adenovirus E
accuguucagagacag

SEQ ID NO: 1579583 - RNA, 22 nt, Human adenovirus E
ugcacgagaaccgccuggggca

SEQ ID NO: 1579584 - RNA, 20 nt, Human adenovirus E
ugcaacacagaaccaccagg

SEQ ID NO: 1579585 - RNA, 18 nt, Human adenovirus E
cagcagcgagcugggcag

SEQ ID NO: 1579586 - RNA, 17 nt, Human adenovirus E
uuuucauuuuuccagcc

SEQ ID NO: 1579587 - RNA, 21 nt, Human adenovirus E
uaacauuuuugccaugcguca

SEQ ID NO: 1579588 - RNA, 18 nt, Human adenovirus E
uggccagaucguccaggg

SEQ ID NO: 1579589 - RNA, 17 nt, Human adenovirus E
cuccacgucgagguccu

SEQ ID NO: 1579590 - RNA, 16 nt, Human adenovirus E
cggagcacgaggagga

SEQ ID NO: 1579591 - RNA, 19 nt, Human adenovirus E
ccucuucuuccuccuccac

SEQ ID NO: 1579592 - RNA, 17 nt, Human adenovirus E
ccugcacuggcagccca

SEQ ID NO: 1579593 - RNA, 15 nt, Human adenovirus E
augacagcaacagua

SEQ ID NO: 1579594 - RNA, 11 nt, Human adenovirus E
agcaagcagca

SEQ ID NO: 1579595 - RNA, 13 nt, Human adenovirus E
gugcccccuccag

SEQ ID NO: 1579596 - RNA, 19 nt, Human adenovirus E
agcgcgcgucgcccaucuc

SEQ ID NO: 1579597 - RNA, 12 nt, Human adenovirus E
agcuucuucaac

SEQ ID NO: 1579598 - RNA, 21 nt, Human adenovirus E
cagcggcggagcggcaucucg

SEQ ID NO: 1579599 - RNA, 18 nt, Human adenovirus E
uuacaaguuucuccacca

SEQ ID NO: 1579600 - RNA, 17 nt, Human adenovirus E
acagcacucaggcagag

SEQ ID NO: 1579601 - RNA, 21 nt, Human adenovirus E
gacggcccuugacguggggca

SEQ ID NO: 1579602 - RNA, 17 nt, Human adenovirus E
aagagucagagaaaggc

SEQ ID NO: 1579603 - RNA, 19 nt, Human adenovirus E
ggcgcucuccccccaggga

SEQ ID NO: 1579604 - RNA, 15 nt, Human adenovirus E
agcaccgccccgccc

SEQ ID NO: 1579605 - RNA, 19 nt, Human adenovirus E
ugcagcccccgcuggaggc

SEQ ID NO: 1579606 - RNA, 18 nt, Human adenovirus E
agggucuuguugcuagug

SEQ ID NO: 1579607 - RNA, 20 nt, Human adenovirus E
ccaccacagcaaccucaggc

SEQ ID NO: 1579608 - RNA, 13 nt, Human adenovirus E
gcggcgcggagcc

SEQ ID NO: 1579609 - RNA, 22 nt, Human adenovirus E
gccggacuacuucuuccagacc

SEQ ID NO: 1579610 - RNA, 13 nt, Human adenovirus E
aucaucggcaccu

SEQ ID NO: 1579611 - RNA, 15 nt, Human adenovirus E
ugcagggggaucagc

SEQ ID NO: 1579612 - RNA, 19 nt, Human adenovirus E
cauguggagcuaccagccc

SEQ ID NO: 1579613 - RNA, 15 nt, Human adenovirus E
gccuuucaagagccc

SEQ ID NO: 1579614 - RNA, 14 nt, Human adenovirus E
cagcaggugcugcc

SEQ ID NO: 1579615 - RNA, 12 nt, Human adenovirus E
ggcuggggcgac

SEQ ID NO: 1579616 - RNA, 16 nt, Human adenovirus E
ggaagaacaggaagaa

SEQ ID NO: 1579617 - RNA, 22 nt, Human adenovirus E
cacugccgcugcaaccucugca

SEQ ID NO: 1579618 - RNA, 23 nt, Human adenovirus E
caauaaggcacuacaaugcucag

SEQ ID NO: 1579619 - RNA, 21 nt, Human adenovirus E
ggacuacuucuuccagaccag

SEQ ID NO: 1579620 - RNA, 15 nt, Human adenovirus E
cugcgcaacggccug

SEQ ID NO: 1579621 - RNA, 12 nt, Human adenovirus E
aagacaguucau

SEQ ID NO: 1579622 - RNA, 15 nt, Human adenovirus E
aggcgcugguagagg

SEQ ID NO: 1579623 - RNA, 19 nt, Human adenovirus E
gaggagacugauggccacg

SEQ ID NO: 1579624 - RNA, 16 nt, Human adenovirus E
caaucaggcagcaccg

SEQ ID NO: 1579625 - RNA, 20 nt, Human adenovirus E
uaccuggcgccuacggaggg

SEQ ID NO: 1579626 - RNA, 15 nt, Human adenovirus E
agguguagagggugc

SEQ ID NO: 1579627 - RNA, 20 nt, Human adenovirus E
gccggcgcuucugcccccgc

SEQ ID NO: 1579628 - RNA, 14 nt, Human adenovirus E
uugcgcacaugugc

SEQ ID NO: 1579629 - RNA, 13 nt, Human adenovirus E
cgcggggcgggag

SEQ ID NO: 1579630 - RNA, 11 nt, Human adenovirus E
uccuccuccag

SEQ ID NO: 1579631 - RNA, 20 nt, Human adenovirus E
aguggccagaucguccaggg

SEQ ID NO: 1579632 - RNA, 19 nt, Human adenovirus E
gagaacagcagucaggcag

SEQ ID NO: 1579633 - RNA, 22 nt, Human adenovirus E
gugcacgaagcccugcaggaag

SEQ ID NO: 1579634 - RNA, 24 nt, Human adenovirus E
  misc_feature (13)..(13): n is a, c, g or u
cauguuacacucnugcaccauccc

SEQ ID NO: 1579635 - RNA, 14 nt, Human adenovirus E
caugcaucccagcu

SEQ ID NO: 1579636 - RNA, 17 nt, Human adenovirus E
cucuucagcacucucaa

SEQ ID NO: 1579637 - RNA, 18 nt, Human adenovirus E
uguccagcuggcgggcgg

SEQ ID NO: 1579638 - RNA, 13 nt, Human adenovirus E
ccuccaccugagc

SEQ ID NO: 1579639 - RNA, 21 nt, Human adenovirus E
agcuuaccgagcagcagcaca

SEQ ID NO: 1579640 - RNA, 20 nt, Human adenovirus E
ggaugauccugcggaaccac

SEQ ID NO: 1579641 - RNA, 21 nt, Human adenovirus E
agcacgaggaggagcuggcag

SEQ ID NO: 1579642 - RNA, 18 nt, Human adenovirus E
ccccacggaggccagcac

SEQ ID NO: 1579643 - RNA, 13 nt, Human adenovirus E
uccucccucagca

SEQ ID NO: 1579644 - RNA, 21 nt, Human adenovirus E
caggcuuugagcucggagggg

SEQ ID NO: 1579645 - RNA, 17 nt, Human adenovirus E
ucgagggucugggcagc

SEQ ID NO: 1579646 - RNA, 18 nt, Human adenovirus E
uacgcccgcgccaagagc

SEQ ID NO: 1579647 - RNA, 17 nt, Human adenovirus E
cgaggaauuucaguggg

SEQ ID NO: 1579648 - RNA, 19 nt, Human adenovirus E
ggcccuugacguggggcag

SEQ ID NO: 1579649 - RNA, 16 nt, Human adenovirus E
uaccuagccuacaacu

SEQ ID NO: 1579650 - RNA, 16 nt, Human adenovirus E
gcaagacagucuggag

SEQ ID NO: 1579651 - RNA, 15 nt, Human adenovirus E
cgcgcucccuggggc

SEQ ID NO: 1579652 - RNA, 20 nt, Human adenovirus E
cggcauugucggugugcuuu

SEQ ID NO: 1579653 - RNA, 24 nt, Human adenovirus E
gugcggcgggcgcagcagcgcaug

SEQ ID NO: 1579654 - RNA, 23 nt, Human adenovirus E
cgcgcugguggagaacaaggcca

SEQ ID NO: 1579655 - RNA, 20 nt, Human adenovirus E
ccuggccaacuaccuggccu

SEQ ID NO: 1579656 - RNA, 18 nt, Human adenovirus E
cuccaguucguggaggag

SEQ ID NO: 1579657 - RNA, 21 nt, Human adenovirus E
gggggccacccccagcgccgc

SEQ ID NO: 1579658 - RNA, 14 nt, Human adenovirus E
cccguaucgggcgc

SEQ ID NO: 1579659 - RNA, 18 nt, Human adenovirus E
gaaucgaguacaauaaca

SEQ ID NO: 1579660 - RNA, 13 nt, Human adenovirus E
ggagcuggcagug

SEQ ID NO: 1579661 - RNA, 17 nt, Human adenovirus E
cccagcggcgaggagga

SEQ ID NO: 1579662 - RNA, 17 nt, Human adenovirus E
ugggcguguggcagcag

SEQ ID NO: 1579663 - RNA, 19 nt, Human adenovirus E
ggcuccuagucgaagaccc

SEQ ID NO: 1579664 - RNA, 13 nt, Human adenovirus E
gugcauggacagg

SEQ ID NO: 1579665 - RNA, 19 nt, Human adenovirus E
cuccgcgacacggcacgcg

SEQ ID NO: 1579666 - RNA, 23 nt, Human adenovirus E
acggggaucagccccgcgcgcgc

SEQ ID NO: 1579667 - RNA, 22 nt, Human adenovirus E
cgcacguggccgcggccaaccu

SEQ ID NO: 1579668 - RNA, 15 nt, Human adenovirus E
caucaugccugaugg

SEQ ID NO: 1579669 - RNA, 17 nt, Human adenovirus E
cgggugauccuccacca

SEQ ID NO: 1579670 - RNA, 17 nt, Human adenovirus E
gccggagcggcacccgc

SEQ ID NO: 1579671 - RNA, 15 nt, Human adenovirus E
ccgcgaguccaaccu

SEQ ID NO: 1579672 - RNA, 22 nt, Human adenovirus E
cagcugccguccucccggagga

SEQ ID NO: 1579673 - RNA, 16 nt, Human adenovirus E
cugauggccacgggca

SEQ ID NO: 1579674 - RNA, 13 nt, Human adenovirus E
gggccgggaccga

SEQ ID NO: 1579675 - RNA, 21 nt, Human adenovirus E
acugggacagcacucaggcag

SEQ ID NO: 1579676 - RNA, 15 nt, Human adenovirus E
ugagcugcgagaagg

SEQ ID NO: 1579677 - RNA, 16 nt, Human adenovirus E
gcugggcgaagaggag

SEQ ID NO: 1579678 - RNA, 13 nt, Human adenovirus E
gcggucccagagc

SEQ ID NO: 1579679 - RNA, 14 nt, Human adenovirus E
gccgugagcggggc

SEQ ID NO: 1579680 - RNA, 14 nt, Human adenovirus E
ggacagauguggga

SEQ ID NO: 1579681 - RNA, 14 nt, Human adenovirus E
cacaccaccacagc

SEQ ID NO: 1579682 - RNA, 14 nt, Human adenovirus E
gcagggccuguggg

SEQ ID NO: 1579683 - RNA, 15 nt, Human adenovirus E
gcgcugcagagccag

SEQ ID NO: 1579684 - RNA, 23 nt, Human adenovirus E
acucaucgcgggaaggaugcuac

SEQ ID NO: 1579685 - RNA, 18 nt, Human adenovirus E
agcccacggccgccagcu

SEQ ID NO: 1579686 - RNA, 22 nt, Human adenovirus E
guacucuuucauauccucuccg

SEQ ID NO: 1579687 - RNA, 17 nt, Human adenovirus E
cuccacgagccagguga

SEQ ID NO: 1579688 - RNA, 15 nt, Human adenovirus E
cucacagaucugcau

SEQ ID NO: 1579689 - RNA, 15 nt, Human adenovirus E
gagaaggauagcaag

SEQ ID NO: 1579690 - RNA, 23 nt, Human adenovirus E
  misc_feature (12)..(12): n is a, c, g or u
acccccagcugnugagcgagacc

SEQ ID NO: 1579691 - RNA, 23 nt, Human adenovirus E
gagccgccucagcaaccugcugg

SEQ ID NO: 1579692 - RNA, 22 nt, Human adenovirus E
agcuaccuccagugccuucucu

SEQ ID NO: 1579693 - RNA, 12 nt, Human adenovirus E
acagccacucuc

SEQ ID NO: 1579694 - RNA, 16 nt, Human adenovirus E
caaccaaacuaaccuc

SEQ ID NO: 1579695 - RNA, 21 nt, Human adenovirus E
uggggcgcccucaaaggccgc

SEQ ID NO: 1579696 - RNA, 16 nt, Human adenovirus E
cgcuggcuccuggacc

SEQ ID NO: 1579697 - RNA, 18 nt, Human adenovirus E
ccagaacgaccacagcaa

SEQ ID NO: 1579698 - RNA, 19 nt, Human adenovirus E
gcagucauaaucaucugca

SEQ ID NO: 1579699 - RNA, 15 nt, Human adenovirus E
cgcuggcuccuggac

SEQ ID NO: 1579700 - RNA, 13 nt, Human adenovirus E
ggaccugcuggag

SEQ ID NO: 1579701 - RNA, 21 nt, Human adenovirus E
cagagucgggggcaggagcag

SEQ ID NO: 1579702 - RNA, 13 nt, Human adenovirus E
aagauggagccau

SEQ ID NO: 1579703 - RNA, 13 nt, Human adenovirus E
gacccugggccug

SEQ ID NO: 1579704 - RNA, 21 nt, Human adenovirus E
ucguggaugcucuauacgggc

SEQ ID NO: 1579705 - RNA, 12 nt, Human adenovirus E
ggugugcuuucg

SEQ ID NO: 1579706 - RNA, 13 nt, Human adenovirus E
cuaccuccagugc

SEQ ID NO: 1579707 - RNA, 21 nt, Human adenovirus E
uaugauugaaaaccaucacag

SEQ ID NO: 1579708 - RNA, 22 nt, Human adenovirus E
agauggggguuggcgcggagga

SEQ ID NO: 1579709 - RNA, 20 nt, Human adenovirus E
aagaagcugaaaguggagcu

SEQ ID NO: 1579710 - RNA, 22 nt, Human adenovirus E
uacuggggguauaggcagggag

SEQ ID NO: 1579711 - RNA, 22 nt, Human adenovirus E
gagggugcugccgcggcggugc

SEQ ID NO: 1579712 - RNA, 13 nt, Human adenovirus E
ggcgugcagaccg

SEQ ID NO: 1579713 - RNA, 15 nt, Human adenovirus E
acucgccagaggcgc

SEQ ID NO: 1579714 - RNA, 22 nt, Human adenovirus E
agcguguucuccccccgaccgg

SEQ ID NO: 1579715 - RNA, 16 nt, Human adenovirus E
gccaaggggggucuga

SEQ ID NO: 1579716 - RNA, 14 nt, Human adenovirus E
acaggcagcaaagc

SEQ ID NO: 1579717 - RNA, 12 nt, Human adenovirus E
augcagcagcug

SEQ ID NO: 1579718 - RNA, 17 nt, Human adenovirus E
caucagggccgggugcu

SEQ ID NO: 1579719 - RNA, 21 nt, Human adenovirus E
cgcggccgccgugagcggggc

SEQ ID NO: 1579720 - RNA, 19 nt, Human adenovirus E
agacgaaggcgcgcaggcc

SEQ ID NO: 1579721 - RNA, 13 nt, Human adenovirus E
gccgaggcucucu

SEQ ID NO: 1579722 - RNA, 20 nt, Human adenovirus E
ccugcgcaaggucgaggaga

SEQ ID NO: 1579723 - RNA, 18 nt, Human adenovirus E
guguccggggcugcuagu

SEQ ID NO: 1579724 - RNA, 14 nt, Human adenovirus E
ccuuacgugccccc

SEQ ID NO: 1579725 - RNA, 13 nt, Human adenovirus E
cgaggaggaggca

SEQ ID NO: 1579726 - RNA, 15 nt, Human adenovirus E
gagucugaaucuuua

SEQ ID NO: 1579727 - RNA, 14 nt, Human adenovirus E
caagccacaguaca

SEQ ID NO: 1579728 - RNA, 21 nt, Human adenovirus E
ccacagcaaccucaggcacac

SEQ ID NO: 1579729 - RNA, 23 nt, Human adenovirus E
caccgccccgcccgccaugcagc

SEQ ID NO: 1579730 - RNA, 22 nt, Human adenovirus E
ccagugagcauugccaaaugca

SEQ ID NO: 1579731 - RNA, 17 nt, Human adenovirus E
ggugauggucucccgca

SEQ ID NO: 1579732 - RNA, 23 nt, Human adenovirus E
gggaucagcaguuugggcagcgg

SEQ ID NO: 1579733 - RNA, 23 nt, Human adenovirus E
gccugaugcaccugugggaccug

SEQ ID NO: 1579734 - RNA, 16 nt, Human adenovirus E
cagccgaaacucaucg

SEQ ID NO: 1579735 - RNA, 17 nt, Human adenovirus E
acacuaaaaaaauacug

SEQ ID NO: 1579736 - RNA, 14 nt, Human adenovirus E
aacccuucccaccc

SEQ ID NO: 1579737 - RNA, 16 nt, Human adenovirus E
gccucggaccuggccg

SEQ ID NO: 1579738 - RNA, 22 nt, Human adenovirus E
uccgcguaauuggcccgccgcc

SEQ ID NO: 1579739 - RNA, 18 nt, Human adenovirus E
cuuuugguucucugcuac

SEQ ID NO: 1579740 - RNA, 14 nt, Human adenovirus E
cagccaccuccuga

SEQ ID NO: 1579741 - RNA, 17 nt, Human adenovirus E
aagcgcggaaagcggcc

SEQ ID NO: 1579742 - RNA, 16 nt, Human adenovirus E
ccucggcgggggagaa

SEQ ID NO: 1579743 - RNA, 19 nt, Human adenovirus E
gcgucguuguuggccagcu

SEQ ID NO: 1579744 - RNA, 15 nt, Human adenovirus E
ugccccggggccagg

SEQ ID NO: 1579745 - RNA, 14 nt, Human adenovirus E
cgccgcccuggugu

SEQ ID NO: 1579746 - RNA, 21 nt, Human adenovirus E
aguuagcugaucuguagaaaa

SEQ ID NO: 1579747 - RNA, 14 nt, Human adenovirus E
aggagcuccuggag

SEQ ID NO: 1579748 - RNA, 17 nt, Human adenovirus E
cacgaggaggagcuggc

SEQ ID NO: 1579749 - RNA, 20 nt, Human adenovirus E
ccuguccacccgcucucugc

SEQ ID NO: 1579750 - RNA, 19 nt, Human adenovirus E
cgaggagccccgggcccag

SEQ ID NO: 1579751 - RNA, 18 nt, Human adenovirus E
gcagaaggggggcagggg

SEQ ID NO: 1579752 - RNA, 22 nt, Human adenovirus E
cgcgaggccaucggccaggcgc

SEQ ID NO: 1579753 - RNA, 17 nt, Human adenovirus E
ucgagggucuccuggau

SEQ ID NO: 1579754 - RNA, 23 nt, Human adenovirus E
gaugcgcugcucgaccgcaccga

SEQ ID NO: 1579755 - RNA, 22 nt, Human adenovirus E
gguuuaaaauuugaagauggag

SEQ ID NO: 1579756 - RNA, 15 nt, Human adenovirus E
cuccuagggaggaac

SEQ ID NO: 1579757 - RNA, 21 nt, Human adenovirus E
gcaccugugggaccugcugga

SEQ ID NO: 1579758 - RNA, 14 nt, Human adenovirus E
gcaugcggggggag

SEQ ID NO: 1579759 - RNA, 23 nt, Human adenovirus E
gcucgucugccguagucuggaga

SEQ ID NO: 1579760 - RNA, 23 nt, Human adenovirus E
ggucgagcgcgagcaaggacaga

SEQ ID NO: 1579761 - RNA, 20 nt, Human adenovirus E
cgugcgcgaggccguggccc

SEQ ID NO: 1579762 - RNA, 22 nt, Human adenovirus E
cggugaggagcucaaccccggc

SEQ ID NO: 1579763 - RNA, 23 nt, Human adenovirus E
ggaggcagaggaggagguggaag

SEQ ID NO: 1579764 - RNA, 18 nt, Human adenovirus E
cagucucaaguccagcaa

SEQ ID NO: 1579765 - RNA, 20 nt, Human adenovirus E
ggcgcagggcaugguguugc

SEQ ID NO: 1579766 - RNA, 21 nt, Human adenovirus E
cgccgcucgccgucgccgcac

SEQ ID NO: 1579767 - RNA, 17 nt, Human adenovirus E
gaugccuuucaagagcc

SEQ ID NO: 1579768 - RNA, 19 nt, Human adenovirus E
guacucuucgagggggaac

SEQ ID NO: 1579769 - RNA, 20 nt, Human adenovirus E
cgccgcuguggagccacugc

SEQ ID NO: 1579770 - RNA, 22 nt, Human adenovirus E
gacgaggauuucgaggcggacg

SEQ ID NO: 1579771 - RNA, 12 nt, Human adenovirus E
ucaggcagcacc

SEQ ID NO: 1579772 - RNA, 18 nt, Human adenovirus E
caauuauauaugcaaugg

SEQ ID NO: 1579773 - RNA, 16 nt, Human adenovirus E
cccacggagcccaugg

SEQ ID NO: 1579774 - RNA, 14 nt, Human adenovirus E
cgaggaggaggcag

SEQ ID NO: 1579775 - RNA, 20 nt, Human adenovirus E
gucgcccaucuccgaggacg

SEQ ID NO: 1579776 - RNA, 20 nt, Human adenovirus E
uggcaguuacaccugcccug

SEQ ID NO: 1579777 - RNA, 16 nt, Human adenovirus E
ggagaaggaggagagc

SEQ ID NO: 1579778 - RNA, 19 nt, Human adenovirus E
gguggcacgacaggcagcg

SEQ ID NO: 1579779 - RNA, 22 nt, Human adenovirus E
cgcugcccguucucgcucgcca

SEQ ID NO: 1579780 - RNA, 16 nt, Human adenovirus E
cacgaccgccgcggcc

SEQ ID NO: 1579781 - RNA, 14 nt, Human adenovirus E
gaugccgggcagga

SEQ ID NO: 1579782 - RNA, 19 nt, Human adenovirus E
acgccuuacauguggagcu

SEQ ID NO: 1579783 - RNA, 18 nt, Human adenovirus E
agacaugcaagagaugga

SEQ ID NO: 1579784 - RNA, 14 nt, Human adenovirus E
cgcggagacccugc

SEQ ID NO: 1579785 - RNA, 13 nt, Human adenovirus E
cccuggccaccua

SEQ ID NO: 1579786 - RNA, 15 nt, Human adenovirus E
cacagccuugaacau

SEQ ID NO: 1579787 - RNA, 22 nt, Human adenovirus E
cagccgccuggacccggugccg

SEQ ID NO: 1579788 - RNA, 22 nt, Human adenovirus E
ggcauucuuaagcacacccuca

SEQ ID NO: 1579789 - RNA, 23 nt, Human adenovirus E
gauuucgaggcggacgagcugac

SEQ ID NO: 1579790 - RNA, 20 nt, Human adenovirus E
cggagcacgaggaggagcug

SEQ ID NO: 1579791 - RNA, 17 nt, Human adenovirus E
guccaccuuuuccaggg

SEQ ID NO: 1579792 - RNA, 18 nt, Human adenovirus E
cgggugauggucucccgc

SEQ ID NO: 1579793 - RNA, 22 nt, Human adenovirus E
cucccgguaccacaucacccuc

SEQ ID NO: 1579794 - RNA, 19 nt, Human adenovirus E
ccuggccaccuaccacauc

SEQ ID NO: 1579795 - RNA, 15 nt, Human adenovirus E
gcagucaggcagagg

SEQ ID NO: 1579796 - RNA, 24 nt, Human adenovirus E
gaguuaaucuuaccauugucaaug

SEQ ID NO: 1579797 - RNA, 15 nt, Human adenovirus E
cucaucaaguuucaa

SEQ ID NO: 1579798 - RNA, 17 nt, Human adenovirus E
ucucagccaaucagcgc

SEQ ID NO: 1579799 - RNA, 20 nt, Human adenovirus E
cggacgauuggacccaggcc

SEQ ID NO: 1579800 - RNA, 13 nt, Human adenovirus E
ggccauccuggag

SEQ ID NO: 1579801 - RNA, 13 nt, Human adenovirus E
ccugacacaccac

SEQ ID NO: 1579802 - RNA, 17 nt, Human adenovirus E
cgaugaaguaaaugcaa

SEQ ID NO: 1579803 - RNA, 18 nt, Human adenovirus E
cugugggaccugcuggag

SEQ ID NO: 1579804 - RNA, 17 nt, Human adenovirus E
ggccugcaacccccagc

SEQ ID NO: 1579805 - RNA, 22 nt, Human adenovirus E
gaacgcuccggaauccugcccg

SEQ ID NO: 1579806 - RNA, 21 nt, Human adenovirus E
uagccgccuccacccaucauc

SEQ ID NO: 1579807 - RNA, 21 nt, Human adenovirus E
augugacgcccgcggagcacg

SEQ ID NO: 1579808 - RNA, 19 nt, Human adenovirus E
cuguggggcgugcaggccc

SEQ ID NO: 1579809 - RNA, 23 nt, Human adenovirus E
gagccggcgcaaacccgggagcu

SEQ ID NO: 1579810 - RNA, 23 nt, Human adenovirus E
gagcgcucgcgguggggcggcca

SEQ ID NO: 1579811 - RNA, 18 nt, Human adenovirus E
cgcgcaucuccagguggc

SEQ ID NO: 1579812 - RNA, 16 nt, Human adenovirus E
cggauaccaucuccgc

SEQ ID NO: 1579813 - RNA, 20 nt, Human adenovirus E
uacuugcuguagcagaaccu

SEQ ID NO: 1579814 - RNA, 19 nt, Human adenovirus E
gcacccuuguacgauacca

SEQ ID NO: 1579815 - RNA, 14 nt, Human adenovirus E
ccacucucucagac

SEQ ID NO: 1579816 - RNA, 23 nt, Human adenovirus E
auggcggcggcggcgaugcagcc

SEQ ID NO: 1579817 - RNA, 22 nt, Human adenovirus E
ggcccgguuguugaugaccugg

SEQ ID NO: 1579818 - RNA, 20 nt, Human adenovirus E
cgcgguggggcggccagcug

SEQ ID NO: 1579819 - RNA, 14 nt, Human adenovirus E
cgccagcuccuccu

SEQ ID NO: 1579820 - RNA, 17 nt, Human adenovirus E
cagggcaugggaugggu

SEQ ID NO: 1579821 - RNA, 14 nt, Human adenovirus E
gguggucaugcuga

SEQ ID NO: 1579822 - RNA, 17 nt, Human adenovirus E
guccuggcgggggcaca

SEQ ID NO: 1579823 - RNA, 21 nt, Human adenovirus E
cggugagcgccagcaggcggc

SEQ ID NO: 1579824 - RNA, 19 nt, Human adenovirus E
cucgccgcgcgugcccccc

SEQ ID NO: 1579825 - RNA, 18 nt, Human adenovirus E
gugcccgugcgcacccgc

SEQ ID NO: 1579826 - RNA, 16 nt, Human adenovirus E
accauggaggugcaga

SEQ ID NO: 1579827 - RNA, 24 nt, Human adenovirus E
gacggccuuguaggcgcagcagcc

SEQ ID NO: 1579828 - RNA, 16 nt, Human adenovirus E
caggcgauggcggcgg

SEQ ID NO: 1579829 - RNA, 14 nt, Human adenovirus E
caggcggcaguggu

SEQ ID NO: 1579830 - RNA, 16 nt, Human adenovirus E
acagcacucaggcaga

SEQ ID NO: 1579831 - RNA, 21 nt, Human adenovirus E
gcccaucauguacgccagcaa

SEQ ID NO: 1579832 - RNA, 17 nt, Human adenovirus E
cgcugcagagccagccg

SEQ ID NO: 1579833 - RNA, 19 nt, Human adenovirus E
caucuggcccggcaggcca

SEQ ID NO: 1579834 - RNA, 20 nt, Human adenovirus E
ccuuccaggaaggcuuccag

SEQ ID NO: 1579835 - RNA, 20 nt, Human adenovirus E
gugacacacucaaaaaaaua

SEQ ID NO: 1579836 - RNA, 17 nt, Human adenovirus E
cccaggacuacuccacc

SEQ ID NO: 1579837 - RNA, 16 nt, Human adenovirus E
gggacucccucagcau

SEQ ID NO: 1579838 - RNA, 15 nt, Human adenovirus E
uccgggccggacuac

SEQ ID NO: 1579839 - RNA, 12 nt, Human adenovirus E
cgcucccugggg

SEQ ID NO: 1579840 - RNA, 14 nt, Human adenovirus E
agauggaggaagac

SEQ ID NO: 1579841 - RNA, 16 nt, Human adenovirus E
caggcgggacagagga

SEQ ID NO: 1579842 - RNA, 12 nt, Human adenovirus E
gcacacagcuca

SEQ ID NO: 1579843 - RNA, 13 nt, Human adenovirus E
gccccuuguggaa

SEQ ID NO: 1579844 - RNA, 18 nt, Human adenovirus E
aagagccuuucggugcga

SEQ ID NO: 1579845 - RNA, 20 nt, Human adenovirus E
aacucuuauaccuucucaua

SEQ ID NO: 1579846 - RNA, 16 nt, Human adenovirus E
aggggggcaaugugac

SEQ ID NO: 1579847 - RNA, 16 nt, Human adenovirus E
cuggcccggcaggcca

SEQ ID NO: 1579848 - RNA, 21 nt, Human adenovirus E
ugcgcuccuggacgcugcuca

SEQ ID NO: 1579849 - RNA, 22 nt, Human adenovirus E
cuggagcgacaucggcaccagc

SEQ ID NO: 1579850 - RNA, 15 nt, Human adenovirus E
gcuggcgcgcacgua

SEQ ID NO: 1579851 - RNA, 12 nt, Human adenovirus E
cgcgcaccaccg

SEQ ID NO: 1579852 - RNA, 20 nt, Human adenovirus E
acaaccacaaaaacuacacc

SEQ ID NO: 1579853 - RNA, 20 nt, Human adenovirus E
gacggccuuguaggcgcagc

SEQ ID NO: 1579854 - RNA, 20 nt, Human adenovirus E
ccugcucgagugccacugcc

SEQ ID NO: 1579855 - RNA, 20 nt, Human adenovirus E
ggccugcgucaucacccagg

SEQ ID NO: 1579856 - RNA, 22 nt, Human adenovirus E
cugcuucggaucuucagccagc

SEQ ID NO: 1579857 - RNA, 15 nt, Human adenovirus E
gcaacauccccgcgc

SEQ ID NO: 1579858 - RNA, 18 nt, Human adenovirus E
uaugcagggugaugaggu

SEQ ID NO: 1579859 - RNA, 24 nt, Human adenovirus E
gagaaggaacucuucgcgguccuu

SEQ ID NO: 1579860 - RNA, 18 nt, Human adenovirus E
gccacuacccggacgagu

SEQ ID NO: 1579861 - RNA, 19 nt, Human adenovirus E
uggccuuggaagagggcga

SEQ ID NO: 1579862 - RNA, 23 nt, Human adenovirus E
cuccggcaccgcuuccaagcgcu

SEQ ID NO: 1579863 - RNA, 20 nt, Human adenovirus E
cagcuuggcgacgagcucgg

SEQ ID NO: 1579864 - RNA, 17 nt, Human adenovirus E
auuuuaaugaaucagau

SEQ ID NO: 1579865 - RNA, 13 nt, Human adenovirus E
uugaacaugcagc

SEQ ID NO: 1579866 - RNA, 22 nt, Human adenovirus E
ggccucuguuaaauuuuugcuu

SEQ ID NO: 1579867 - RNA, 12 nt, Human adenovirus E
cauuggugaugg

SEQ ID NO: 1579868 - RNA, 16 nt, Human adenovirus E
ugcuccgcgcugcccu

SEQ ID NO: 1579869 - RNA, 15 nt, Human adenovirus E
acaaagccucagcgu

SEQ ID NO: 1579870 - RNA, 18 nt, Human adenovirus E
cagcagaaaaccagcagc

SEQ ID NO: 1579871 - RNA, 22 nt, Human adenovirus E
gccccgucguuuccaagacccc

SEQ ID NO: 1579872 - RNA, 18 nt, Human adenovirus E
gccuggccaacuaccugg

SEQ ID NO: 1579873 - RNA, 16 nt, Human adenovirus E
aacuugcagggccugu

SEQ ID NO: 1579874 - RNA, 21 nt, Human adenovirus E
cauccagaaacaagacaauag

SEQ ID NO: 1579875 - RNA, 18 nt, Human adenovirus E
agcugauggugcccaagc

SEQ ID NO: 1579876 - RNA, 16 nt, Human adenovirus E
ccucaagcccgugacc

SEQ ID NO: 1579877 - RNA, 13 nt, Human adenovirus E
uguggacagcagc

SEQ ID NO: 1579878 - RNA, 13 nt, Human adenovirus E
uggugaaggagga

SEQ ID NO: 1579879 - RNA, 19 nt, Human adenovirus E
guucgcucaccugcgcccc

SEQ ID NO: 1579880 - RNA, 19 nt, Human adenovirus E
ugcccccgccccagcagca

SEQ ID NO: 1579881 - RNA, 21 nt, Human adenovirus E
uggcgacgagcucggcgguga

SEQ ID NO: 1579882 - RNA, 15 nt, Human adenovirus E
uuaacgcgcacaaaa

SEQ ID NO: 1579883 - RNA, 16 nt, Human adenovirus E
ucgagggucugggcag

SEQ ID NO: 1579884 - RNA, 23 nt, Human adenovirus E
cccugcgacuggccgaccccguc

SEQ ID NO: 1579885 - RNA, 22 nt, Human adenovirus E
gccucgcugaacuaccagaacg

SEQ ID NO: 1579886 - RNA, 16 nt, Human adenovirus E
ccggcggcgcgugcag

SEQ ID NO: 1579887 - RNA, 20 nt, Human adenovirus E
gugaaggggugcgcgccggg

SEQ ID NO: 1579888 - RNA, 16 nt, Human adenovirus E
gaucucuugcacgucc

SEQ ID NO: 1579889 - RNA, 16 nt, Human adenovirus E
cugccgcccuggugcg

SEQ ID NO: 1579890 - RNA, 14 nt, Human adenovirus E
acgucguggugguc

SEQ ID NO: 1579891 - RNA, 22 nt, Human adenovirus E
ccacugccgcugcaaccucugc

SEQ ID NO: 1579892 - RNA, 20 nt, Human adenovirus E
  misc_feature (9)..(9): n is a, c, g or u
ccccgggcnugggcgugcag

SEQ ID NO: 1579893 - RNA, 13 nt, Human adenovirus E
cuggaccugguga

SEQ ID NO: 1579894 - RNA, 21 nt, Human adenovirus E
cagaagagcggcggugggaau

SEQ ID NO: 1579895 - RNA, 11 nt, Human adenovirus E
ugagcaccaca

SEQ ID NO: 1579896 - RNA, 12 nt, Human adenovirus E
gaugcaggggcg

SEQ ID NO: 1579897 - RNA, 11 nt, Human adenovirus E
ucguaccuggg

SEQ ID NO: 1579898 - RNA, 15 nt, Human adenovirus E
uccugcguuacgugc

SEQ ID NO: 1579899 - RNA, 19 nt, Human adenovirus E
gacagcgaaccccgcagaa

SEQ ID NO: 1579900 - RNA, 20 nt, Human adenovirus E
cgaggaggagcuggcagugc

SEQ ID NO: 1579901 - RNA, 16 nt, Human adenovirus E
gcccccgccccagcag

SEQ ID NO: 1579902 - RNA, 14 nt, Human adenovirus E
gugcccgaggccgc

SEQ ID NO: 1579903 - RNA, 14 nt, Human adenovirus E
gggucggagagcga

SEQ ID NO: 1579904 - RNA, 19 nt, Human adenovirus E
ugcccaagcagaaccuguu

SEQ ID NO: 1579905 - RNA, 14 nt, Human adenovirus E
gaguuuggaagcag

SEQ ID NO: 1579906 - RNA, 13 nt, Human adenovirus E
ggagacucagcca

SEQ ID NO: 1579907 - RNA, 17 nt, Human adenovirus E
cuucccaccccacucug

SEQ ID NO: 1579908 - RNA, 21 nt, Human adenovirus E
acgugagccgcgcccugggcc

SEQ ID NO: 1579909 - RNA, 20 nt, Human adenovirus E
caccgggugauccuccacca

SEQ ID NO: 1579910 - RNA, 13 nt, Human adenovirus E
aauaacagccagg

SEQ ID NO: 1579911 - RNA, 13 nt, Human adenovirus E
agagccggcggcg

SEQ ID NO: 1579912 - RNA, 18 nt, Human adenovirus E
caagaaguaccucaccug

SEQ ID NO: 1579913 - RNA, 14 nt, Human adenovirus E
cuaccucugccaca

SEQ ID NO: 1579914 - RNA, 20 nt, Human adenovirus E
gucuaccucuaccucugcca

SEQ ID NO: 1579915 - RNA, 17 nt, Human adenovirus E
  misc_feature (7)..(7): n is a, c, g or u
gcagccnuucuccacgg

SEQ ID NO: 1579916 - RNA, 19 nt, Human adenovirus E
ggcgauguugagcugcacg

SEQ ID NO: 1579917 - RNA, 23 nt, Human adenovirus E
ggcgcccugcgcgucggccaggu

SEQ ID NO: 1579918 - RNA, 20 nt, Human adenovirus E
aguacaguuagucucuccac

SEQ ID NO: 1579919 - RNA, 21 nt, Human adenovirus E
caucccuucgagaucagguuc

SEQ ID NO: 1579920 - RNA, 12 nt, Human adenovirus E
ccaucacagaga

SEQ ID NO: 1579921 - RNA, 18 nt, Human adenovirus E
cagggggccacgagccgg

SEQ ID NO: 1579922 - RNA, 19 nt, Human adenovirus E
ccaugguggcgcagcugac

SEQ ID NO: 1579923 - RNA, 13 nt, Human adenovirus E
cgugcggugagcg

SEQ ID NO: 1579924 - RNA, 18 nt, Human adenovirus E
cuuugugcccgcccaggu

SEQ ID NO: 1579925 - RNA, 20 nt, Human adenovirus E
gggccuguggggcgugcagg

SEQ ID NO: 1579926 - RNA, 14 nt, Human adenovirus E
gcaagaccaccacu

SEQ ID NO: 1579927 - RNA, 16 nt, Human adenovirus E
ggaugcacgugcugca

SEQ ID NO: 1579928 - RNA, 18 nt, Human adenovirus E
uaccucgacccccagacc

SEQ ID NO: 1579929 - RNA, 15 nt, Human adenovirus E
ucucuaauuccucaa

SEQ ID NO: 1579930 - RNA, 22 nt, Human adenovirus E
guacacauacaaagccucagcg

SEQ ID NO: 1579931 - RNA, 16 nt, Human adenovirus E
uacucacaccacacac

SEQ ID NO: 1579932 - RNA, 20 nt, Human adenovirus E
cccccaaagucaugagcgcg

SEQ ID NO: 1579933 - RNA, 15 nt, Human adenovirus E
gcaagagauggagga

SEQ ID NO: 1579934 - RNA, 15 nt, Human adenovirus E
ugcucaugcaucucu

SEQ ID NO: 1579935 - RNA, 15 nt, Human adenovirus E
gacgccaucagcgag

SEQ ID NO: 1579936 - RNA, 18 nt, Human adenovirus E
acgauuggacccaggcca

SEQ ID NO: 1579937 - RNA, 12 nt, Human adenovirus E
agagcggcgcaa

SEQ ID NO: 1579938 - RNA, 22 nt, Human adenovirus E
gacagcagcguguucucccccc

SEQ ID NO: 1579939 - RNA, 22 nt, Human adenovirus E
gucugcccgcaggcgggacaga

SEQ ID NO: 1579940 - RNA, 22 nt, Human adenovirus E
ggcagcagugucuggaggagca

SEQ ID NO: 1579941 - RNA, 18 nt, Human adenovirus E
cgcccagguuuuccaugc

SEQ ID NO: 1579942 - RNA, 19 nt, Human adenovirus E
gaucccauuugagcuggag

SEQ ID NO: 1579943 - RNA, 17 nt, Human adenovirus E
gaacuugcagggccugu

SEQ ID NO: 1579944 - RNA, 19 nt, Human adenovirus E
gaagcugaaaguggagcug

SEQ ID NO: 1579945 - RNA, 18 nt, Human adenovirus E
cggggugucggggaagga

SEQ ID NO: 1579946 - RNA, 20 nt, Human adenovirus E
ucgccaaccucgccaucugc

SEQ ID NO: 1579947 - RNA, 21 nt, Human adenovirus E
caagucuacuggucgcugccc

SEQ ID NO: 1579948 - RNA, 24 nt, Human adenovirus E
agaucaaaccgcagcagaggaggc

SEQ ID NO: 1579949 - RNA, 18 nt, Human adenovirus E
gaacgccugcugggccuu

SEQ ID NO: 1579950 - RNA, 14 nt, Human adenovirus E
agacaguucauuug

SEQ ID NO: 1579951 - RNA, 20 nt, Human adenovirus E
cagucauagcaggggcgcag

SEQ ID NO: 1579952 - RNA, 14 nt, Human adenovirus E
ccccaccaugcagc

SEQ ID NO: 1579953 - RNA, 21 nt, Human adenovirus E
cgggcacgauucugaccugcc

SEQ ID NO: 1579954 - RNA, 23 nt, Human adenovirus E
cugcaggccccggcgggcugcaa

SEQ ID NO: 1579955 - RNA, 15 nt, Human adenovirus E
ggagauggaggaaga

SEQ ID NO: 1579956 - RNA, 16 nt, Human adenovirus E
ugagcuccucccucag

SEQ ID NO: 1579957 - RNA, 13 nt, Human adenovirus E
ccggagcagcugg

SEQ ID NO: 1579958 - RNA, 21 nt, Human adenovirus E
gaagaacucaagggucugugg

SEQ ID NO: 1579959 - RNA, 20 nt, Human adenovirus E
ugggcacgcacccgggcuug

SEQ ID NO: 1579960 - RNA, 13 nt, Human adenovirus E
agcuccagcucca

SEQ ID NO: 1579961 - RNA, 14 nt, Human adenovirus E
ccagcugcaccacg

SEQ ID NO: 1579962 - RNA, 18 nt, Human adenovirus E
auccgcccaaggccgagc

SEQ ID NO: 1579963 - RNA, 15 nt, Human adenovirus E
ggagagcaugagcac

SEQ ID NO: 1579964 - RNA, 22 nt, Human adenovirus E
cgcggcgaacgagccggcgcaa

SEQ ID NO: 1579965 - RNA, 20 nt, Human adenovirus E
aagaucuucgagggucuggg

SEQ ID NO: 1579966 - RNA, 23 nt, Human adenovirus E
acuccccucuucccagcucuggu

SEQ ID NO: 1579967 - RNA, 21 nt, Human adenovirus E
ccgaagccuuuagacagcagc

SEQ ID NO: 1579968 - RNA, 14 nt, Human adenovirus E
agcggggcuggaca

SEQ ID NO: 1579969 - RNA, 15 nt, Human adenovirus E
ccuggucgagcgcga

SEQ ID NO: 1579970 - RNA, 13 nt, Human adenovirus E
cuccuggaccugg

SEQ ID NO: 1579971 - RNA, 16 nt, Human adenovirus E
cagaugggccuggccg

SEQ ID NO: 1579972 - RNA, 20 nt, Human adenovirus E
acgcgucaaguuagcaacua

SEQ ID NO: 1579973 - RNA, 15 nt, Human adenovirus E
cagggacucccucag

SEQ ID NO: 1579974 - RNA, 13 nt, Human adenovirus E
aaggaggugaaga

SEQ ID NO: 1579975 - RNA, 16 nt, Human adenovirus E
ggcgcgcaggccggag

SEQ ID NO: 1579976 - RNA, 20 nt, Human adenovirus E
uccgucaagcugcugcucag

SEQ ID NO: 1579977 - RNA, 20 nt, Human adenovirus E
gauggugaagaugccgggca

SEQ ID NO: 1579978 - RNA, 22 nt, Human adenovirus E
cuuccgcgucaguugcagggcg

SEQ ID NO: 1579979 - RNA, 18 nt, Human adenovirus E
gagggucugggcagcgac

SEQ ID NO: 1579980 - RNA, 19 nt, Human adenovirus E
  misc_feature (6)..(6): n is a, c, g or u
uuccunuacaccaaucagu

SEQ ID NO: 1579981 - RNA, 15 nt, Human adenovirus E
gaaaccgaaaguaag

SEQ ID NO: 1579982 - RNA, 14 nt, Human adenovirus E
gcgcuccuggaugu

SEQ ID NO: 1579983 - RNA, 12 nt, Human adenovirus E
cagggcccggcc

SEQ ID NO: 1579984 - RNA, 14 nt, Human adenovirus E
gaacuugcagggcc

SEQ ID NO: 1579985 - RNA, 19 nt, Human adenovirus E
cccaugguggcgcagcuga

SEQ ID NO: 1579986 - RNA, 22 nt, Human adenovirus E
agcccgcgcgggaggcaggucc

SEQ ID NO: 1579987 - RNA, 13 nt, Human adenovirus E
uucccacuccccu

SEQ ID NO: 1579988 - RNA, 19 nt, Human adenovirus E
cgcaugaccaccugggcga

SEQ ID NO: 1579989 - RNA, 14 nt, Human adenovirus E
ccgcgucagggugg

SEQ ID NO: 1579990 - RNA, 19 nt, Human adenovirus E
agggggcgauccuggccca

SEQ ID NO: 1579991 - RNA, 19 nt, Human adenovirus E
gcugaucguguucgcgacc

SEQ ID NO: 1579992 - RNA, 12 nt, Human adenovirus E
gacgcuccuggu

SEQ ID NO: 1579993 - RNA, 22 nt, Human adenovirus E
agagcuucuucaacgagcaggc

SEQ ID NO: 1579994 - RNA, 17 nt, Human adenovirus E
agguggacgaggagggc

SEQ ID NO: 1579995 - RNA, 15 nt, Human adenovirus E
acgggacgcagggcc

SEQ ID NO: 1579996 - RNA, 16 nt, Human adenovirus E
ccaagcgccagcccaa

SEQ ID NO: 1579997 - RNA, 22 nt, Human adenovirus E
acgugagccgcgcccugggcca

SEQ ID NO: 1579998 - RNA, 13 nt, Human adenovirus E
uguggagccacug

SEQ ID NO: 1579999 - RNA, 19 nt, Human adenovirus E
ccaaccgcacccgcgccga

SEQ ID NO: 1580000 - RNA, 15 nt, Human adenovirus E
cagcaaagcccccga

SEQ ID NO: 1580001 - RNA, 16 nt, Human adenovirus E
ccuuccaggaaggcuu

SEQ ID NO: 1580002 - RNA, 17 nt, Human adenovirus E
ugcugcacgagcuguac

SEQ ID NO: 1580003 - RNA, 14 nt, Human adenovirus E
cgaccacagcaacu

SEQ ID NO: 1580004 - RNA, 16 nt, Human adenovirus E
uuacuacggccccugg

SEQ ID NO: 1580005 - RNA, 19 nt, Human adenovirus E
ccucuccccccgcacagcc

SEQ ID NO: 1580006 - RNA, 16 nt, Human adenovirus E
gugacccugggccuga

SEQ ID NO: 1580007 - RNA, 14 nt, Human adenovirus E
cgguguugcuuucg

SEQ ID NO: 1580008 - RNA, 21 nt, Human adenovirus E
aacuguaaguacucuuucaua

SEQ ID NO: 1580009 - RNA, 18 nt, Human adenovirus E
cucugguacugcaggccc

SEQ ID NO: 1580010 - RNA, 16 nt, Human adenovirus E
ggcgucgucgccggag

SEQ ID NO: 1580011 - RNA, 20 nt, Human adenovirus E
ggacaagauaaacaccgccu

SEQ ID NO: 1580012 - RNA, 20 nt, Human adenovirus E
gaagggcgugcgcuccugga

SEQ ID NO: 1580013 - RNA, 17 nt, Human adenovirus E
gcaagacagucuggagg

SEQ ID NO: 1580014 - RNA, 16 nt, Human adenovirus E
acuuccuccgcggccg

SEQ ID NO: 1580015 - RNA, 21 nt, Human adenovirus E
ggccgccgugagcggggcugg

SEQ ID NO: 1580016 - RNA, 19 nt, Human adenovirus E
ggcugaaaccgaaaguaag

SEQ ID NO: 1580017 - RNA, 17 nt, Human adenovirus E
acagucuggaggaagac

SEQ ID NO: 1580018 - RNA, 21 nt, Human adenovirus E
gugaacgaguucauguacagc

SEQ ID NO: 1580019 - RNA, 16 nt, Human adenovirus E
gcggcgcgccaucagc

SEQ ID NO: 1580020 - RNA, 17 nt, Human adenovirus E
gugccucuuccaugguu

SEQ ID NO: 1580021 - RNA, 18 nt, Human adenovirus E
agcugaaguaugaauggg

SEQ ID NO: 1580022 - RNA, 18 nt, Human adenovirus E
cagcggcgagggccugcu

SEQ ID NO: 1580023 - RNA, 17 nt, Human adenovirus E
cccacauuacacagaca

SEQ ID NO: 1580024 - RNA, 14 nt, Human adenovirus E
gcagggcgcccagc

SEQ ID NO: 1580025 - RNA, 15 nt, Human adenovirus E
cgggcgcgcaugacc

SEQ ID NO: 1580026 - RNA, 16 nt, Human adenovirus E
ggcagcaccgggugau

SEQ ID NO: 1580027 - RNA, 20 nt, Human adenovirus E
cccucagcguggaggagcuc

SEQ ID NO: 1580028 - RNA, 22 nt, Human adenovirus E
gcgaugggcccgugggcggcgg

SEQ ID NO: 1580029 - RNA, 22 nt, Human adenovirus E
acguggccgcggccaaccuggu

SEQ ID NO: 1580030 - RNA, 14 nt, Human adenovirus E
ggacagcggcagca

SEQ ID NO: 1580031 - RNA, 21 nt, Human adenovirus E
ggccugaugcaccugugggac

SEQ ID NO: 1580032 - RNA, 17 nt, Human adenovirus E
gaucccauacuccaccu

SEQ ID NO: 1580033 - RNA, 17 nt, Human adenovirus E
accauugucaaugccac

SEQ ID NO: 1580034 - RNA, 13 nt, Human adenovirus E
ugcaggucugccu

SEQ ID NO: 1580035 - RNA, 19 nt, Human adenovirus E
gaucccauacuccaccucc

SEQ ID NO: 1580036 - RNA, 14 nt, Human adenovirus E
caagagauggagga

SEQ ID NO: 1580037 - RNA, 15 nt, Human adenovirus E
gaacacgcugcccac

SEQ ID NO: 1580038 - RNA, 12 nt, Human adenovirus E
guccuuccaggg

SEQ ID NO: 1580039 - RNA, 16 nt, Human adenovirus E
cucgaucuccuccucu

SEQ ID NO: 1580040 - RNA, 13 nt, Human adenovirus E
auuuacacuggca

SEQ ID NO: 1580041 - RNA, 14 nt, Human adenovirus E
gcgccaccaccccc

SEQ ID NO: 1580042 - RNA, 17 nt, Human adenovirus E
agaacagccagagcagg

SEQ ID NO: 1580043 - RNA, 13 nt, Human adenovirus E
gcgggggagauga

SEQ ID NO: 1580044 - RNA, 23 nt, Human adenovirus E
cauugccaaaugcaagacugcua

SEQ ID NO: 1580045 - RNA, 24 nt, Human adenovirus E
cacucuuaaagaguagcccgcgcc

SEQ ID NO: 1580046 - RNA, 19 nt, Human adenovirus E
gcgggcacuuccgcgcucc

SEQ ID NO: 1580047 - RNA, 22 nt, Human adenovirus E
agcuugccauucgcgcacggcc

SEQ ID NO: 1580048 - RNA, 16 nt, Human adenovirus E
cagccccaggccaacc

SEQ ID NO: 1580049 - RNA, 16 nt, Human adenovirus E
cugaccggggccggga

SEQ ID NO: 1580050 - RNA, 12 nt, Human adenovirus E
gcgcgcuaccac

SEQ ID NO: 1580051 - RNA, 23 nt, Human adenovirus E
agccguugauguuguggcccacg

SEQ ID NO: 1580052 - RNA, 20 nt, Human adenovirus E
caugaccaucgaccugauga

SEQ ID NO: 1580053 - RNA, 13 nt, Human adenovirus E
ucaggcgccagcg

SEQ ID NO: 1580054 - RNA, 18 nt, Human adenovirus E
cuaggacguccagagcgc

SEQ ID NO: 1580055 - RNA, 16 nt, Human adenovirus E
cuacugaacucugugg

SEQ ID NO: 1580056 - RNA, 15 nt, Human adenovirus E
ucacaccacacacac

SEQ ID NO: 1580057 - RNA, 18 nt, Human adenovirus E
auggcgagggggagcgcg

SEQ ID NO: 1580058 - RNA, 15 nt, Human adenovirus E
ggcguguggcagcag

SEQ ID NO: 1580059 - RNA, 22 nt, Human adenovirus E
gagggugcugaaaacaccaccu

SEQ ID NO: 1580060 - RNA, 17 nt, Human adenovirus E
ccuucucuagcaccgcc

SEQ ID NO: 1580061 - RNA, 13 nt, Human adenovirus E
accaugcuagccu

SEQ ID NO: 1580062 - RNA, 17 nt, Human adenovirus E
agccuacaacuauggcg

SEQ ID NO: 1580063 - RNA, 18 nt, Human adenovirus E
gugaagaccgcguaguug

SEQ ID NO: 1580064 - RNA, 13 nt, Human adenovirus E
gcaucugcugcug

SEQ ID NO: 1580065 - RNA, 16 nt, Human adenovirus E
ccccggggccaggagg

SEQ ID NO: 1580066 - RNA, 18 nt, Human adenovirus E
cagucuggaggaagacga

SEQ ID NO: 1580067 - RNA, 21 nt, Human adenovirus E
gcauguucauuuuugcuugcu

SEQ ID NO: 1580068 - RNA, 21 nt, Human adenovirus E
cgcagcagcgagcugggcagg

SEQ ID NO: 1580069 - RNA, 12 nt, Human adenovirus E
cggggcagaagc

SEQ ID NO: 1580070 - RNA, 17 nt, Human adenovirus E
caucggcacucuccagu

SEQ ID NO: 1580071 - RNA, 18 nt, Human adenovirus E
acgugcccaagcagaacc

SEQ ID NO: 1580072 - RNA, 14 nt, Human adenovirus E
cacaaaauucucag

SEQ ID NO: 1580073 - RNA, 11 nt, Human adenovirus E
cagaaguuuca

SEQ ID NO: 1580074 - RNA, 14 nt, Human adenovirus E
cugcagagccagcc

SEQ ID NO: 1580075 - RNA, 21 nt, Human adenovirus E
uacacauacaaagccucagcg

SEQ ID NO: 1580076 - RNA, 23 nt, Human adenovirus E
cggguucgugcgccaggccugca

SEQ ID NO: 1580077 - RNA, 15 nt, Human adenovirus E
augagcaccacagcg

SEQ ID NO: 1580078 - RNA, 18 nt, Human adenovirus E
caguuauuuuuccuccac

SEQ ID NO: 1580079 - RNA, 23 nt, Human adenovirus E
uggacuacuugcaucgggcggcc

SEQ ID NO: 1580080 - RNA, 15 nt, Human adenovirus E
guccucgcagccccg

SEQ ID NO: 1580081 - RNA, 23 nt, Human adenovirus E
cagcagagucgggggcaggagca

SEQ ID NO: 1580082 - RNA, 15 nt, Human adenovirus E
ugccccagggcaugg

SEQ ID NO: 1580083 - RNA, 22 nt, Human adenovirus E
uccugcguuacgugcagcagaa

SEQ ID NO: 1580084 - RNA, 21 nt, Human adenovirus E
gcccagucggcgagauggggg

SEQ ID NO: 1580085 - RNA, 18 nt, Human adenovirus E
gccagcugcaccacgcug

SEQ ID NO: 1580086 - RNA, 18 nt, Human adenovirus E
cacgggacgcagggccau

SEQ ID NO: 1580087 - RNA, 19 nt, Human adenovirus E
cagcaucaucugggccugg

SEQ ID NO: 1580088 - RNA, 17 nt, Human adenovirus E
accccaccacccagacc

SEQ ID NO: 1580089 - RNA, 17 nt, Human adenovirus E
guccacgagcgccagcu

SEQ ID NO: 1580090 - RNA, 22 nt, Human adenovirus E
uggagaguucguccucgcagcc

SEQ ID NO: 1580091 - RNA, 19 nt, Human adenovirus E
gacgcgcgccgggcggcag

SEQ ID NO: 1580092 - RNA, 16 nt, Human adenovirus E
guugaagugggcgugg

SEQ ID NO: 1580093 - RNA, 16 nt, Human adenovirus E
augauauucuggagca

SEQ ID NO: 1580094 - RNA, 19 nt, Human adenovirus E
cgcagcagaggaggcagca

SEQ ID NO: 1580095 - RNA, 15 nt, Human adenovirus E
cagcaucaaccgcaa

SEQ ID NO: 1580096 - RNA, 15 nt, Human adenovirus E
cucggccauccugga

SEQ ID NO: 1580097 - RNA, 17 nt, Human adenovirus E
cagggaggcgcugcuga

SEQ ID NO: 1580098 - RNA, 18 nt, Human adenovirus E
cucugccacaccuggcag

SEQ ID NO: 1580099 - RNA, 20 nt, Human adenovirus E
caggacccgguagagguggg

SEQ ID NO: 1580100 - RNA, 11 nt, Human adenovirus E
cgccaccacca

SEQ ID NO: 1580101 - RNA, 20 nt, Human adenovirus E
acagcacucaggcagaggag

SEQ ID NO: 1580102 - RNA, 14 nt, Human adenovirus E
gaccucggcgcgag

SEQ ID NO: 1580103 - RNA, 15 nt, Human adenovirus E
ccgccgcgcaucucc

SEQ ID NO: 1580104 - RNA, 23 nt, Human adenovirus E
accgccaaaaaucagacaugcau

SEQ ID NO: 1580105 - RNA, 20 nt, Human adenovirus E
gcggccggcgcgcuccacgg

SEQ ID NO: 1580106 - RNA, 18 nt, Human adenovirus E
  misc_feature (7)..(7): n is a, c, g or u
ccccaunuagcaguccca

SEQ ID NO: 1580107 - RNA, 13 nt, Human adenovirus E
gcggcggcagcag

SEQ ID NO: 1580108 - RNA, 14 nt, Human adenovirus E
ggcuggucgggguc

SEQ ID NO: 1580109 - RNA, 17 nt, Human adenovirus E
cacacugguggccaccu

SEQ ID NO: 1580110 - RNA, 14 nt, Human adenovirus E
cuccugcacaggca

SEQ ID NO: 1580111 - RNA, 20 nt, Human adenovirus E
guggagucguggcgccugca

SEQ ID NO: 1580112 - RNA, 17 nt, Human adenovirus E
uagcacucaacccaccc

SEQ ID NO: 1580113 - RNA, 16 nt, Human adenovirus E
acggugccggcggaga

SEQ ID NO: 1580114 - RNA, 22 nt, Human adenovirus E
ucagcgacgagcagcuggcccg

SEQ ID NO: 1580115 - RNA, 15 nt, Human adenovirus E
cuguuccugaugcag

SEQ ID NO: 1580116 - RNA, 18 nt, Human adenovirus E
uagcuuaccgagcagcag

SEQ ID NO: 1580117 - RNA, 16 nt, Human adenovirus E
gcuccagcuccagugu

SEQ ID NO: 1580118 - RNA, 18 nt, Human adenovirus E
gcgcacguggccgcggcc

SEQ ID NO: 1580119 - RNA, 14 nt, Human adenovirus E
gaugcaccuguggg

SEQ ID NO: 1580120 - RNA, 16 nt, Human adenovirus E
uggaacaaacucugaa

SEQ ID NO: 1580121 - RNA, 12 nt, Human adenovirus E
caaggccauccg

SEQ ID NO: 1580122 - RNA, 21 nt, Human adenovirus E
cuugcugaaaaagggccgcgg

SEQ ID NO: 1580123 - RNA, 15 nt, Human adenovirus E
gagauggugggccuu

SEQ ID NO: 1580124 - RNA, 21 nt, Human adenovirus E
cggcgcaaacccgggagcuga

SEQ ID NO: 1580125 - RNA, 20 nt, Human adenovirus E
cugggugacaaagagcuguc

SEQ ID NO: 1580126 - RNA, 18 nt, Human adenovirus E
guacagguggcagaugcg

SEQ ID NO: 1580127 - RNA, 18 nt, Human adenovirus E
cugagcgggggggaggac

SEQ ID NO: 1580128 - RNA, 12 nt, Human adenovirus E
cguggagcugga

SEQ ID NO: 1580129 - RNA, 12 nt, Human adenovirus E
ggaucuggaggg

SEQ ID NO: 1580130 - RNA, 18 nt, Human adenovirus E
uucguccucgcagccccg

SEQ ID NO: 1580131 - RNA, 17 nt, Human adenovirus E
ggccgcgagggugcugc

SEQ ID NO: 1580132 - RNA, 17 nt, Human adenovirus E
cccucuaugccaucuuc

SEQ ID NO: 1580133 - RNA, 20 nt, Human adenovirus E
gcgucgcagggggccacgag

SEQ ID NO: 1580134 - RNA, 22 nt, Human adenovirus E
acgugcccccgcgguaccuggc

SEQ ID NO: 1580135 - RNA, 19 nt, Human adenovirus E
ucugccuucccaugguggg

SEQ ID NO: 1580136 - RNA, 21 nt, Human adenovirus E
cggcgcgcuccuuggcggcga

SEQ ID NO: 1580137 - RNA, 17 nt, Human adenovirus E
gcccacggcccucagca

SEQ ID NO: 1580138 - RNA, 13 nt, Human adenovirus E
agcaccaggcagg

SEQ ID NO: 1580139 - RNA, 22 nt, Human adenovirus E
ugcgucaucacccagggggcga

SEQ ID NO: 1580140 - RNA, 22 nt, Human adenovirus E
ccggggcagaagcacacagcuc

SEQ ID NO: 1580141 - RNA, 16 nt, Human adenovirus E
guuccggagcagcugg

SEQ ID NO: 1580142 - RNA, 13 nt, Human adenovirus E
gccgccuccaccc

SEQ ID NO: 1580143 - RNA, 19 nt, Human adenovirus E
gcugacguccugcaggacc

SEQ ID NO: 1580144 - RNA, 20 nt, Human adenovirus E
acagcagucaggcagaggag

SEQ ID NO: 1580145 - RNA, 11 nt, Human adenovirus E
ugcagcccccg

SEQ ID NO: 1580146 - RNA, 13 nt, Human adenovirus E
uccgagaagcugg

SEQ ID NO: 1580147 - RNA, 22 nt, Human adenovirus E
cggagaguguaccgccgcggcc

SEQ ID NO: 1580148 - RNA, 19 nt, Human adenovirus E
cccgguuguaccuggugga

SEQ ID NO: 1580149 - RNA, 18 nt, Human adenovirus E
gagguacaugggcaugag

SEQ ID NO: 1580150 - RNA, 15 nt, Human adenovirus E
accccaccacccaga

SEQ ID NO: 1580151 - RNA, 24 nt, Human adenovirus E
agcacaggcauaugcucaugcauc

SEQ ID NO: 1580152 - RNA, 23 nt, Human adenovirus E
cgaguugaaccucuucucgccgc

SEQ ID NO: 1580153 - RNA, 12 nt, Human adenovirus E
cagucuggagga

SEQ ID NO: 1580154 - RNA, 20 nt, Human adenovirus E
ccugcacaggcagcaaagcc

SEQ ID NO: 1580155 - RNA, 16 nt, Human adenovirus E
ggccauggcgaccagc

SEQ ID NO: 1580156 - RNA, 18 nt, Human adenovirus E
cgggcuaccgcggcacgc

SEQ ID NO: 1580157 - RNA, 14 nt, Human adenovirus E
gccgcgcccugggc

SEQ ID NO: 1580158 - RNA, 18 nt, Human adenovirus E
uccugguucaccugcagc

SEQ ID NO: 1580159 - RNA, 15 nt, Human adenovirus E
guacggaggcgcucg

SEQ ID NO: 1580160 - RNA, 16 nt, Human adenovirus E
gccgccgcaagaccac

SEQ ID NO: 1580161 - RNA, 23 nt, Human adenovirus E
gacguggggcaguuucuugagcu

SEQ ID NO: 1580162 - RNA, 19 nt, Human adenovirus E
uuagcuuugacaguacagg

SEQ ID NO: 1580163 - RNA, 18 nt, Human adenovirus E
aguuugcuuacggcaagc

SEQ ID NO: 1580164 - RNA, 20 nt, Human adenovirus E
ggaggagcucagccgcgccu

SEQ ID NO: 1580165 - RNA, 12 nt, Human adenovirus E
uucaccaccugc

SEQ ID NO: 1580166 - RNA, 23 nt, Human adenovirus E
cgaggcggacgagcugacgggga

SEQ ID NO: 1580167 - RNA, 23 nt, Human adenovirus E
gugcccauagacaaggaggugaa

SEQ ID NO: 1580168 - RNA, 20 nt, Human adenovirus E
cagcaaagccuccacgcgca

SEQ ID NO: 1580169 - RNA, 20 nt, Human adenovirus E
accugcagcagauugacaag

SEQ ID NO: 1580170 - RNA, 19 nt, Human adenovirus E
gccuuugugcccgcccagg

SEQ ID NO: 1580171 - RNA, 19 nt, Human adenovirus E
caggcugggcugggacccc

SEQ ID NO: 1580172 - RNA, 17 nt, Human adenovirus E
accagaacgaccacagc

SEQ ID NO: 1580173 - RNA, 16 nt, Human adenovirus E
cacgugcugcacgagc

SEQ ID NO: 1580174 - RNA, 19 nt, Human adenovirus E
accccauuacuggcaccgu

SEQ ID NO: 1580175 - RNA, 23 nt, Human adenovirus E
ccacccgcagaagcaagcuccag

SEQ ID NO: 1580176 - RNA, 16 nt, Human adenovirus E
agccggcggcggcgca

SEQ ID NO: 1580177 - RNA, 20 nt, Human adenovirus E
cgaguuugcuuacggcaagc

SEQ ID NO: 1580178 - RNA, 15 nt, Human adenovirus E
ggcgagggggagcgc

SEQ ID NO: 1580179 - RNA, 16 nt, Human adenovirus E
caaccacgugcgcacc

SEQ ID NO: 1580180 - RNA, 16 nt, Human adenovirus E
aaugauucgacaagau

SEQ ID NO: 1580181 - RNA, 14 nt, Human adenovirus E
agagcgugaugcag

SEQ ID NO: 1580182 - RNA, 22 nt, Human adenovirus E
ccccuggggugugaccaccguc

SEQ ID NO: 1580183 - RNA, 11 nt, Human adenovirus E
agaagcuggcg

SEQ ID NO: 1580184 - RNA, 20 nt, Human adenovirus E
cagguacacauacaaagccu

SEQ ID NO: 1580185 - RNA, 17 nt, Human adenovirus E
accuccaccaacgccac

SEQ ID NO: 1580186 - RNA, 22 nt, Human adenovirus E
uuggcgauguuaccgcccagau

SEQ ID NO: 1580187 - RNA, 23 nt, Human adenovirus E
aggacuacuccacccgcaugaau

SEQ ID NO: 1580188 - RNA, 15 nt, Human adenovirus E
aucagacccacugcu

SEQ ID NO: 1580189 - RNA, 20 nt, Human adenovirus E
cccagaccggugaggagcuc

SEQ ID NO: 1580190 - RNA, 22 nt, Human adenovirus E
cucugcucaauauauagcccag

SEQ ID NO: 1580191 - RNA, 11 nt, Human adenovirus E
aggcugagcuc

SEQ ID NO: 1580192 - RNA, 19 nt, Human adenovirus E
gccgccgcgcaucuccagg

SEQ ID NO: 1580193 - RNA, 20 nt, Human adenovirus E
  misc_feature (9)..(9): n is a, c, g or u
gcgcgcaanuacacccccgc

SEQ ID NO: 1580194 - RNA, 17 nt, Human adenovirus E
agcuuugacaguacagg

SEQ ID NO: 1580195 - RNA, 12 nt, Human adenovirus E
ucuuccagacca

SEQ ID NO: 1580196 - RNA, 14 nt, Human adenovirus E
gaggcccggcgcga

SEQ ID NO: 1580197 - RNA, 13 nt, Human adenovirus E
uugcgcgagcaga

SEQ ID NO: 1580198 - RNA, 14 nt, Human adenovirus E
gcaagcagcacgga

SEQ ID NO: 1580199 - RNA, 19 nt, Human adenovirus E
ugacgccgaacucgcgccu

SEQ ID NO: 1580200 - RNA, 22 nt, Human adenovirus E
accguggagcuggagugccugc

SEQ ID NO: 1580201 - RNA, 16 nt, Human adenovirus E
accaugcagcugaugg

SEQ ID NO: 1580202 - RNA, 16 nt, Human adenovirus E
gugggcguggggcagu

SEQ ID NO: 1580203 - RNA, 19 nt, Human adenovirus E
ucacagcucaacagcugag

SEQ ID NO: 1580204 - RNA, 19 nt, Human adenovirus E
cacaggcauaugcucaugc

SEQ ID NO: 1580205 - RNA, 22 nt, Human adenovirus E
uaaccggcggagaugacugacc

SEQ ID NO: 1580206 - RNA, 19 nt, Human adenovirus E
cgcucaggucgcugcagua

SEQ ID NO: 1580207 - RNA, 18 nt, Human adenovirus E
caugaucaagcccagcac

SEQ ID NO: 1580208 - RNA, 19 nt, Human adenovirus E
cgcucaucaagcaucuggc

SEQ ID NO: 1580209 - RNA, 16 nt, Human adenovirus E
cucgggaucgcgggcg

SEQ ID NO: 1580210 - RNA, 13 nt, Human adenovirus E
ggaaucuucucuu

SEQ ID NO: 1580211 - RNA, 23 nt, Human adenovirus E
gucgagggucuccuggaugaugu

SEQ ID NO: 1580212 - RNA, 22 nt, Human adenovirus E
ucuugcgggguuucuucuuggg

SEQ ID NO: 1580213 - RNA, 22 nt, Human adenovirus E
ccugugggacgauguggacagc

SEQ ID NO: 1580214 - RNA, 22 nt, Human adenovirus E
cacuccauauaccaaugcugua

SEQ ID NO: 1580215 - RNA, 23 nt, Human adenovirus E
accugaucccgaauaccacagcg

SEQ ID NO: 1580216 - RNA, 16 nt, Human adenovirus E
cagaccuaccaggaga

SEQ ID NO: 1580217 - RNA, 13 nt, Human adenovirus E
cucaccgccacgc

SEQ ID NO: 1580218 - RNA, 19 nt, Human adenovirus E
gaguacuucaaaaugaaga

SEQ ID NO: 1580219 - RNA, 12 nt, Human adenovirus E
uaaccuccacca

SEQ ID NO: 1580220 - RNA, 15 nt, Human adenovirus E
cggcaggccaccauc

SEQ ID NO: 1580221 - RNA, 18 nt, Human adenovirus E
ccagcccacgaccguacu

SEQ ID NO: 1580222 - RNA, 19 nt, Human adenovirus E
gaccuggccaaccaggccg

SEQ ID NO: 1580223 - RNA, 17 nt, Human adenovirus E
caucaggccccgcagca

SEQ ID NO: 1580224 - RNA, 21 nt, Human adenovirus E
cguccgcccuugcgcgagcag

SEQ ID NO: 1580225 - RNA, 23 nt, Human adenovirus E
aauacucgcagaaaaugaugcaa

SEQ ID NO: 1580226 - RNA, 21 nt, Human adenovirus E
cuuaaccgccccgccgcccag

SEQ ID NO: 1580227 - RNA, 16 nt, Human adenovirus E
cugcgcgucggccagg

SEQ ID NO: 1580228 - RNA, 14 nt, Human adenovirus E
caccacucgccgcu

SEQ ID NO: 1580229 - RNA, 15 nt, Human adenovirus E
aguuucaauguggau

SEQ ID NO: 1580230 - RNA, 14 nt, Human adenovirus E
gacccggugccgcc

SEQ ID NO: 1580231 - RNA, 13 nt, Human adenovirus E
cgcggccacggcg

SEQ ID NO: 1580232 - RNA, 14 nt, Human adenovirus E
aggggcggaacagc

SEQ ID NO: 1580233 - RNA, 21 nt, Human adenovirus E
cugcaggccccggcgggcugc

SEQ ID NO: 1580234 - RNA, 22 nt, Human adenovirus E
acgucaccugcggcguggagca

SEQ ID NO: 1580235 - RNA, 15 nt, Human adenovirus E
ggcgaugcagccccc

SEQ ID NO: 1580236 - RNA, 16 nt, Human adenovirus E
ccgucacggugaaggg

SEQ ID NO: 1580237 - RNA, 23 nt, Human adenovirus E
cacuccgagacgaaagcccgggu

SEQ ID NO: 1580238 - RNA, 22 nt, Human adenovirus E
agccggcggcggcgcaucgccc

SEQ ID NO: 1580239 - RNA, 12 nt, Human adenovirus E
aacccccagcug

SEQ ID NO: 1580240 - RNA, 18 nt, Human adenovirus E
cccgggcccagguuggug

SEQ ID NO: 1580241 - RNA, 11 nt, Human adenovirus E
ggcggccagcu

SEQ ID NO: 1580242 - RNA, 16 nt, Human adenovirus E
guccagcuggcgggcg

SEQ ID NO: 1580243 - RNA, 12 nt, Human adenovirus E
ggcgauccuggc

SEQ ID NO: 1580244 - RNA, 16 nt, Human adenovirus E
cugccguagucuggag

SEQ ID NO: 1580245 - RNA, 13 nt, Human adenovirus E
cggaggccagcac

SEQ ID NO: 1580246 - RNA, 15 nt, Human adenovirus E
aucuaguaugaugag

SEQ ID NO: 1580247 - RNA, 15 nt, Human adenovirus E
ggaagacugggagaa

SEQ ID NO: 1580248 - RNA, 17 nt, Human adenovirus E
gccucgcugaacuacca

SEQ ID NO: 1580249 - RNA, 23 nt, Human adenovirus E
cgcgacugcgucuaccucuaccu

SEQ ID NO: 1580250 - RNA, 16 nt, Human adenovirus E
gacacaccaccacagc

SEQ ID NO: 1580251 - RNA, 18 nt, Human adenovirus E
ggaaugccgcggugcucc

SEQ ID NO: 1580252 - RNA, 16 nt, Human adenovirus E
ugggcguguggcagca

SEQ ID NO: 1580253 - RNA, 18 nt, Human adenovirus E
uggcggccaucaacuucu

SEQ ID NO: 1580254 - RNA, 21 nt, Human adenovirus E
aagagggcgaggggcuggcgc

SEQ ID NO: 1580255 - RNA, 19 nt, Human adenovirus E
ccuggacuaauggaagcua

SEQ ID NO: 1580256 - RNA, 20 nt, Human adenovirus E
gcucguagggacugaggggc

SEQ ID NO: 1580257 - RNA, 22 nt, Human adenovirus E
ugcaagacccggucaccuuccg

SEQ ID NO: 1580258 - RNA, 13 nt, Human adenovirus E
cggcacucagguu

SEQ ID NO: 1580259 - RNA, 19 nt, Human adenovirus E
ccgcaacucguaccugggc

SEQ ID NO: 1580260 - RNA, 15 nt, Human adenovirus E
ccacuacagcagcag

SEQ ID NO: 1580261 - RNA, 15 nt, Human adenovirus E
gaacaacaagcaugg

SEQ ID NO: 1580262 - RNA, 16 nt, Human adenovirus E
gcaugucccgcccgcg

SEQ ID NO: 1580263 - RNA, 23 nt, Human adenovirus E
gcauucguuacucggagcuggca

SEQ ID NO: 1580264 - RNA, 22 nt, Human adenovirus E
  misc_feature (13)..(13): n is a, c, g or u
cauuaaaucagcnuaccaccac

SEQ ID NO: 1580265 - RNA, 14 nt, Human adenovirus E
ucuaccucgacccc

SEQ ID NO: 1580266 - RNA, 20 nt, Human adenovirus E
gagaguuucaugaccagcau

SEQ ID NO: 1580267 - RNA, 11 nt, Human adenovirus E
cuccagcacca

SEQ ID NO: 1580268 - RNA, 23 nt, Human adenovirus E
ccuggccaaccaggccgugcagc

SEQ ID NO: 1580269 - RNA, 23 nt, Human adenovirus E
ugaucacuauucuuaucugccuc

SEQ ID NO: 1580270 - RNA, 19 nt, Human adenovirus E
ccacgugagccgcgcccug

SEQ ID NO: 1580271 - RNA, 13 nt, Human adenovirus E
gcaggggcggcuc

SEQ ID NO: 1580272 - RNA, 15 nt, Human adenovirus E
cagcggcggcagcag

SEQ ID NO: 1580273 - RNA, 21 nt, Human adenovirus E
cauccccgcgcuccuggaugu

SEQ ID NO: 1580274 - RNA, 15 nt, Human adenovirus E
agccccgggcccagg

SEQ ID NO: 1580275 - RNA, 19 nt, Human adenovirus E
auuccuaaaguuagcuuua

SEQ ID NO: 1580276 - RNA, 16 nt, Human adenovirus E
gagggcgaguaccugg

SEQ ID NO: 1580277 - RNA, 23 nt, Human adenovirus E
uguuccacgguggcuuccagcaa

SEQ ID NO: 1580278 - RNA, 12 nt, Human adenovirus E
augcaggagggg

SEQ ID NO: 1580279 - RNA, 20 nt, Human adenovirus E
gccucaggagugaugaagau

SEQ ID NO: 1580280 - RNA, 15 nt, Human adenovirus E
accugcgccaccacc

SEQ ID NO: 1580281 - RNA, 19 nt, Human adenovirus E
cagcacucucaacuccucg

SEQ ID NO: 1580282 - RNA, 23 nt, Human adenovirus E
cuggcugacguccugcaggacca

SEQ ID NO: 1580283 - RNA, 15 nt, Human adenovirus E
aacaacaagcaugga

SEQ ID NO: 1580284 - RNA, 24 nt, Human adenovirus E
gccagcccaauggcaccugcgagc

SEQ ID NO: 1580285 - RNA, 17 nt, Human adenovirus E
uccgccgacgacagcag

SEQ ID NO: 1580286 - RNA, 23 nt, Human adenovirus E
ccaaggccgccgccccucucagu

SEQ ID NO: 1580287 - RNA, 20 nt, Human adenovirus E
gggcgugcagaccguggaca

SEQ ID NO: 1580288 - RNA, 15 nt, Human adenovirus E
gaggccaucggccag

SEQ ID NO: 1580289 - RNA, 12 nt, Human adenovirus E
gaagcagcagca

SEQ ID NO: 1580290 - RNA, 17 nt, Human adenovirus E
ccaggaggcgcucuccc

SEQ ID NO: 1580291 - RNA, 20 nt, Human adenovirus E
uggcauuuuugaugugggcc

SEQ ID NO: 1580292 - RNA, 17 nt, Human adenovirus E
accucaggcacacgcac

SEQ ID NO: 1580293 - RNA, 11 nt, Human adenovirus E
cgccuggccaa

SEQ ID NO: 1580294 - RNA, 22 nt, Human adenovirus E
ugcgaucucggucaugaacugc

SEQ ID NO: 1580295 - RNA, 16 nt, Human adenovirus E
gcgcucgcucacccgc

SEQ ID NO: 1580296 - RNA, 17 nt, Human adenovirus E
ucgccagggcuugcaga

SEQ ID NO: 1580297 - RNA, 13 nt, Human adenovirus E
cccacgcuacguc

SEQ ID NO: 1580298 - RNA, 14 nt, Human adenovirus E
ccagacgccgcacc

SEQ ID NO: 1580299 - RNA, 21 nt, Human adenovirus E
ggcuccgcgacacggcacgcg

SEQ ID NO: 1580300 - RNA, 15 nt, Human adenovirus E
gaucccgaauaccac

SEQ ID NO: 1580301 - RNA, 14 nt, Human adenovirus E
caagcccaucauug

SEQ ID NO: 1580302 - RNA, 17 nt, Human adenovirus E
  misc_feature (8)..(8): n is a, c, g or u
gugggcancggcggcgc

SEQ ID NO: 1580303 - RNA, 14 nt, Human adenovirus E
agcaagcuccagcu

SEQ ID NO: 1580304 - RNA, 16 nt, Human adenovirus E
ugagcgacgaucuggg

SEQ ID NO: 1580305 - RNA, 19 nt, Human adenovirus E
guguuguaaaucacccagu

SEQ ID NO: 1580306 - RNA, 20 nt, Human adenovirus E
ucgcagccccgcucgggugg

SEQ ID NO: 1580307 - RNA, 17 nt, Human adenovirus E
acccgugcagccacagc

SEQ ID NO: 1580308 - RNA, 20 nt, Human adenovirus E
cccucggacuucgugccgcu

SEQ ID NO: 1580309 - RNA, 14 nt, Human adenovirus E
cagaaccugaaaga

SEQ ID NO: 1580310 - RNA, 21 nt, Human adenovirus E
ggacggcugcgggaguauggc

SEQ ID NO: 1580311 - RNA, 16 nt, Human adenovirus E
ucgaaggcgggcauga

SEQ ID NO: 1580312 - RNA, 12 nt, Human adenovirus E
ccugcugggccu

SEQ ID NO: 1580313 - RNA, 22 nt, Human adenovirus E
cggcuggugauccggggcagaa

SEQ ID NO: 1580314 - RNA, 20 nt, Human adenovirus E
cgaggacgagggcaugcaag

SEQ ID NO: 1580315 - RNA, 13 nt, Human adenovirus E
cccauagccagcc

SEQ ID NO: 1580316 - RNA, 23 nt, Human adenovirus E
aagcugaaaguggagcugccgcc

SEQ ID NO: 1580317 - RNA, 13 nt, Human adenovirus E
cggcgacgaggcc

SEQ ID NO: 1580318 - RNA, 11 nt, Human adenovirus E
cccagcggcga

SEQ ID NO: 1580319 - RNA, 21 nt, Human adenovirus E
cguggcucugccuuggcagua

SEQ ID NO: 1580320 - RNA, 23 nt, Human adenovirus E
ccccagggauaggagcuccugga

SEQ ID NO: 1580321 - RNA, 13 nt, Human adenovirus E
gguuccuguggga

SEQ ID NO: 1580322 - RNA, 22 nt, Human adenovirus E
cuaggacguccagagcgcagua

SEQ ID NO: 1580323 - RNA, 16 nt, Human adenovirus E
ggugggcgccgagcuc

SEQ ID NO: 1580324 - RNA, 22 nt, Human adenovirus E
aggcaauuuuuaagaaaaucaa

SEQ ID NO: 1580325 - RNA, 15 nt, Human adenovirus E
acucguaccugggcu

SEQ ID NO: 1580326 - RNA, 13 nt, Human adenovirus E
ccuagccgccucc

SEQ ID NO: 1580327 - RNA, 21 nt, Human adenovirus E
aaaucguucucuccagcacca

SEQ ID NO: 1580328 - RNA, 18 nt, Human adenovirus E
gcccgcgcuugcugggcg

SEQ ID NO: 1580329 - RNA, 16 nt, Human adenovirus E
ccgccgugagcggggc

SEQ ID NO: 1580330 - RNA, 15 nt, Human adenovirus E
cuaggacguccagag

SEQ ID NO: 1580331 - RNA, 14 nt, Human adenovirus E
cguaguugagcgcc

SEQ ID NO: 1580332 - RNA, 17 nt, Human adenovirus E
ucgugcgccaggccugc

SEQ ID NO: 1580333 - RNA, 14 nt, Human adenovirus E
ggagcuccuggagc

SEQ ID NO: 1580334 - RNA, 14 nt, Human adenovirus E
agcagccccaggcc

SEQ ID NO: 1580335 - RNA, 12 nt, Human adenovirus E
cagcgccgggcc

SEQ ID NO: 1580336 - RNA, 17 nt, Human adenovirus E
gggccugcgcgcgccca

SEQ ID NO: 1580337 - RNA, 22 nt, Human adenovirus E
gggccauguucagggcggccag

SEQ ID NO: 1580338 - RNA, 23 nt, Human adenovirus E
acgccgcaccgcucccuggccug

SEQ ID NO: 1580339 - RNA, 18 nt, Human adenovirus E
cccuccugcacaggcagc

SEQ ID NO: 1580340 - RNA, 15 nt, Human adenovirus E
ggucugcgaccugac

SEQ ID NO: 1580341 - RNA, 15 nt, Human adenovirus E
cgagggugcugccgc

SEQ ID NO: 1580342 - RNA, 16 nt, Human adenovirus E
gaccacagcaacuucc

SEQ ID NO: 1580343 - RNA, 23 nt, Human adenovirus E
gcagaggaggaggagauggagga

SEQ ID NO: 1580344 - RNA, 18 nt, Human adenovirus E
ugauccccaucaucgccg

SEQ ID NO: 1580345 - RNA, 21 nt, Human adenovirus E
cgugcaggcaccgcagcuugc

SEQ ID NO: 1580346 - RNA, 18 nt, Human adenovirus E
uccaguguaagccccaca

SEQ ID NO: 1580347 - RNA, 13 nt, Human adenovirus E
ucgggggcagagg

SEQ ID NO: 1580348 - RNA, 18 nt, Human adenovirus E
cgacaacgcgcggcuggc

SEQ ID NO: 1580349 - RNA, 18 nt, Human adenovirus E
cgauuaugcagggugaug

SEQ ID NO: 1580350 - RNA, 15 nt, Human adenovirus E
cggccagccugcuga

SEQ ID NO: 1580351 - RNA, 15 nt, Human adenovirus E
ugcagggugaugagg

SEQ ID NO: 1580352 - RNA, 13 nt, Human adenovirus E
gccgccagcuccu

SEQ ID NO: 1580353 - RNA, 16 nt, Human adenovirus E
ccugcucuuccaccgc

SEQ ID NO: 1580354 - RNA, 15 nt, Human adenovirus E
aggccggccuggugu

SEQ ID NO: 1580355 - RNA, 17 nt, Human adenovirus E
gcaccgccccgcccgcc

SEQ ID NO: 1580356 - RNA, 19 nt, Human adenovirus E
ccgaacucgcgccugcugc

SEQ ID NO: 1580357 - RNA, 15 nt, Human adenovirus E
gcggccgccaugaac

SEQ ID NO: 1580358 - RNA, 18 nt, Human adenovirus E
augccaacccuucccacc

SEQ ID NO: 1580359 - RNA, 17 nt, Human adenovirus E
ccugacacaccaccaca

SEQ ID NO: 1580360 - RNA, 22 nt, Human adenovirus E
gggaggcuuccugcccgcgcug

SEQ ID NO: 1580361 - RNA, 14 nt, Human adenovirus E
cuagccgccuccac

SEQ ID NO: 1580362 - RNA, 17 nt, Human adenovirus E
caagcugcugcucaggg

SEQ ID NO: 1580363 - RNA, 21 nt, Human adenovirus E
caggguaucgcaaucaggcag

SEQ ID NO: 1580364 - RNA, 15 nt, Human adenovirus E
uggcagaucacccug

SEQ ID NO: 1580365 - RNA, 20 nt, Human adenovirus E
cucuuugccuucaccaccug

SEQ ID NO: 1580366 - RNA, 18 nt, Human adenovirus E
aggcgcucuccccccagg

SEQ ID NO: 1580367 - RNA, 12 nt, Human adenovirus E
auucucaggugc

SEQ ID NO: 1580368 - RNA, 21 nt, Human adenovirus E
ccaccgcgaguccaaccuggg

SEQ ID NO: 1580369 - RNA, 19 nt, Human adenovirus E
gucagcgacgagcagcugg

SEQ ID NO: 1580370 - RNA, 20 nt, Human adenovirus E
gcauuauuguugcuguagug

SEQ ID NO: 1580371 - RNA, 19 nt, Human adenovirus E
caccuggacaaaauaccac

SEQ ID NO: 1580372 - RNA, 15 nt, Human adenovirus E
ucagaccgugcagca

SEQ ID NO: 1580373 - RNA, 13 nt, Human adenovirus E
cacuuccucuucu

SEQ ID NO: 1580374 - RNA, 15 nt, Human adenovirus E
accaguccgggccgg

SEQ ID NO: 1580375 - RNA, 22 nt, Human adenovirus E
cugaagcccacggccgccagcu

SEQ ID NO: 1580376 - RNA, 16 nt, Human adenovirus E
ggugaggucgggcugg

SEQ ID NO: 1580377 - RNA, 15 nt, Human adenovirus E
uuacuccccuccugc

SEQ ID NO: 1580378 - RNA, 17 nt, Human adenovirus E
ccagcgccggcaggacc

SEQ ID NO: 1580379 - RNA, 13 nt, Human adenovirus E
ccgaggugcccca

SEQ ID NO: 1580380 - RNA, 18 nt, Human adenovirus E
auggcagcaaggcgugga

SEQ ID NO: 1580381 - RNA, 16 nt, Human adenovirus E
accagcaagccgcuga

SEQ ID NO: 1580382 - RNA, 17 nt, Human adenovirus E
ccgauguagguggggua

SEQ ID NO: 1580383 - RNA, 15 nt, Human adenovirus E
gcauggucucgguga

SEQ ID NO: 1580384 - RNA, 12 nt, Human adenovirus E
aucgcagugcag

SEQ ID NO: 1580385 - RNA, 19 nt, Human adenovirus E
uggucagcgacgagcagcu

SEQ ID NO: 1580386 - RNA, 22 nt, Human adenovirus E
caggcacacgcacuaccaccac

SEQ ID NO: 1580387 - RNA, 17 nt, Human adenovirus E
ccaaacuaaccuccacc

SEQ ID NO: 1580388 - RNA, 20 nt, Human adenovirus E
aauaauacuuucauuuuugc

SEQ ID NO: 1580389 - RNA, 12 nt, Human adenovirus E
gacgcagggcca

SEQ ID NO: 1580390 - RNA, 15 nt, Human adenovirus E
uaguggugugcaugu

SEQ ID NO: 1580391 - RNA, 17 nt, Human adenovirus E
gccgcccagccccgcca

SEQ ID NO: 1580392 - RNA, 19 nt, Human adenovirus E
caaugccaccucagcucaa

SEQ ID NO: 1580393 - RNA, 21 nt, Human adenovirus E
acuccccucuucccagcucug

SEQ ID NO: 1580394 - RNA, 11 nt, Human adenovirus E
uaccuccaccu

SEQ ID NO: 1580395 - RNA, 15 nt, Human adenovirus E
acgcacgucuucaac

SEQ ID NO: 1580396 - RNA, 14 nt, Human adenovirus E
cggucauguggaug

SEQ ID NO: 1580397 - RNA, 12 nt, Human adenovirus E
cccuggccugca

SEQ ID NO: 1580398 - RNA, 16 nt, Human adenovirus E
augaagauccuaggcc

SEQ ID NO: 1580399 - RNA, 13 nt, Human adenovirus E
ggcgcggccagcc

SEQ ID NO: 1580400 - RNA, 23 nt, Human adenovirus E
gggggccacgagccggggcagcg

SEQ ID NO: 1580401 - RNA, 17 nt, Human adenovirus E
agauggauuccaagaga

SEQ ID NO: 1580402 - RNA, 13 nt, Human adenovirus E
cacagccggcgcu

SEQ ID NO: 1580403 - RNA, 14 nt, Human adenovirus E
guucuacgaggacc

SEQ ID NO: 1580404 - RNA, 19 nt, Human adenovirus E
caccacagcuaccuccagu

SEQ ID NO: 1580405 - RNA, 13 nt, Human adenovirus E
cucugaaccugcc

SEQ ID NO: 1580406 - RNA, 22 nt, Human adenovirus E
acuggcagcccagccgccgggc

SEQ ID NO: 1580407 - RNA, 24 nt, Human adenovirus E
cgccgacgcggagacccugcgcaa

SEQ ID NO: 1580408 - RNA, 16 nt, Human adenovirus E
aucuggcccggcaggc

SEQ ID NO: 1580409 - RNA, 22 nt, Human adenovirus E
cagcgaucccauuugagcugga

SEQ ID NO: 1580410 - RNA, 14 nt, Human adenovirus E
augcagccccggau

SEQ ID NO: 1580411 - RNA, 21 nt, Human adenovirus E
  misc_feature (8)..(8): n is a, c, g or u
uccagcunuuccaacccuucc

SEQ ID NO: 1580412 - RNA, 19 nt, Human adenovirus E
uggacucugacgcuccugg

SEQ ID NO: 1580413 - RNA, 21 nt, Human adenovirus E
ccucuaccgaggucaggggcg

SEQ ID NO: 1580414 - RNA, 14 nt, Human adenovirus E
cgagcggugugccg

SEQ ID NO: 1580415 - RNA, 21 nt, Human adenovirus E
ggcaccggagcacccccgcca

SEQ ID NO: 1580416 - RNA, 23 nt, Human adenovirus E
aacaagucuauguuggcacagca

SEQ ID NO: 1580417 - RNA, 17 nt, Human adenovirus E
gaucgaccagguggugg

SEQ ID NO: 1580418 - RNA, 14 nt, Human adenovirus E
gcucgccucgggca

SEQ ID NO: 1580419 - RNA, 20 nt, Human adenovirus E
cccgccaaauaaucacacac

SEQ ID NO: 1580420 - RNA, 17 nt, Human adenovirus E
acguacucgcgcgccac

SEQ ID NO: 1580421 - RNA, 16 nt, Human adenovirus E
cucggugauccgcacc

SEQ ID NO: 1580422 - RNA, 23 nt, Human adenovirus E
acagccgccuggacccggugccg

SEQ ID NO: 1580423 - RNA, 22 nt, Human adenovirus E
cugcccgacaugaugcaagacc

SEQ ID NO: 1580424 - RNA, 13 nt, Human adenovirus E
acgcggagacccu

SEQ ID NO: 1580425 - RNA, 21 nt, Human adenovirus E
gguagcuccauugcagggccu

SEQ ID NO: 1580426 - RNA, 22 nt, Human adenovirus E
cuuaaaaccuauggcagcaagg

SEQ ID NO: 1580427 - RNA, 15 nt, Human adenovirus E
ucagggccgggugcu

SEQ ID NO: 1580428 - RNA, 14 nt, Human adenovirus E
ggcgauccccggca

SEQ ID NO: 1580429 - RNA, 22 nt, Human adenovirus E
acccagcccgccaacgugcccc

SEQ ID NO: 1580430 - RNA, 22 nt, Human adenovirus E
ccgcaguugucuguaucacaag

SEQ ID NO: 1580431 - RNA, 19 nt, Human adenovirus E
cagaacggggugcuggaga

SEQ ID NO: 1580432 - RNA, 13 nt, Human adenovirus E
gcagaggaggagg

SEQ ID NO: 1580433 - RNA, 15 nt, Human adenovirus E
caggaggcgcucucc

SEQ ID NO: 1580434 - RNA, 14 nt, Human adenovirus E
cugugucugaaccc

SEQ ID NO: 1580435 - RNA, 16 nt, Human adenovirus E
cgcgcuugcugggcga

SEQ ID NO: 1580436 - RNA, 14 nt, Human adenovirus E
caaaaccauauccc

SEQ ID NO: 1580437 - RNA, 14 nt, Human adenovirus E
agaagcgugggccu

SEQ ID NO: 1580438 - RNA, 17 nt, Human adenovirus E
cugcugcugcugguggc

SEQ ID NO: 1580439 - RNA, 17 nt, Human adenovirus E
gcugagcgaccaggagc

SEQ ID NO: 1580440 - RNA, 15 nt, Human adenovirus E
gugcgcgccgggcug

SEQ ID NO: 1580441 - RNA, 21 nt, Human adenovirus E
ggcguccgcgccgcagugggc

SEQ ID NO: 1580442 - RNA, 13 nt, Human adenovirus E
aagguccuggcca

SEQ ID NO: 1580443 - RNA, 20 nt, Human adenovirus E
acgcgcccgcgcuugcuggg

SEQ ID NO: 1580444 - RNA, 19 nt, Human adenovirus E
cguccucucgagccgcacc

SEQ ID NO: 1580445 - RNA, 15 nt, Human adenovirus E
gucuccaugagcucg

SEQ ID NO: 1580446 - RNA, 14 nt, Human adenovirus E
cgcagaacagggca

SEQ ID NO: 1580447 - RNA, 15 nt, Human adenovirus E
ccuuccucagcaccc

SEQ ID NO: 1580448 - RNA, 18 nt, Human adenovirus E
ugcgagccgauggggaag

SEQ ID NO: 1580449 - RNA, 15 nt, Human adenovirus E
cucguaccugggcua

SEQ ID NO: 1580450 - RNA, 19 nt, Human adenovirus E
ucccgugcaggcaccgcag

SEQ ID NO: 1580451 - RNA, 13 nt, Human adenovirus E
ggcuggagccgca

SEQ ID NO: 1580452 - RNA, 18 nt, Human adenovirus E
cagaccgugcagcagauc

SEQ ID NO: 1580453 - RNA, 13 nt, Human adenovirus E
caagcagcacgga

SEQ ID NO: 1580454 - RNA, 18 nt, Human adenovirus E
cagcaccaggcaggccac

SEQ ID NO: 1580455 - RNA, 20 nt, Human adenovirus E
cacuaccaccacuacagccu

SEQ ID NO: 1580456 - RNA, 22 nt, Human adenovirus E
gcgcuucugcccccgccccagc

SEQ ID NO: 1580457 - RNA, 22 nt, Human adenovirus E
cagggccagcaccgccccgccc

SEQ ID NO: 1580458 - RNA, 14 nt, Human adenovirus E
gcaagcgcagccgu

SEQ ID NO: 1580459 - RNA, 16 nt, Human adenovirus E
cccguccucgcggggc

SEQ ID NO: 1580460 - RNA, 15 nt, Human adenovirus E
gcgagggccugcucg

SEQ ID NO: 1580461 - RNA, 18 nt, Human adenovirus E
gccagggcuugcagaccg

SEQ ID NO: 1580462 - RNA, 14 nt, Human adenovirus E
ucggcgcgagcggg

SEQ ID NO: 1580463 - RNA, 18 nt, Human adenovirus E
accugaaagagcucugca

SEQ ID NO: 1580464 - RNA, 14 nt, Human adenovirus E
agccgcggccaggg

SEQ ID NO: 1580465 - RNA, 16 nt, Human adenovirus E
uaaccgccccgccgcc

SEQ ID NO: 1580466 - RNA, 16 nt, Human adenovirus E
gacgauguggacagca

SEQ ID NO: 1580467 - RNA, 15 nt, Human adenovirus E
agcccugcaggaagc

SEQ ID NO: 1580468 - RNA, 15 nt, Human adenovirus E
cgccgccgcuccguc

SEQ ID NO: 1580469 - RNA, 20 nt, Human adenovirus E
acgugccccggggccaggag

SEQ ID NO: 1580470 - RNA, 15 nt, Human adenovirus E
ccugccgcgcgcgcg

SEQ ID NO: 1580471 - RNA, 13 nt, Human adenovirus E
cugcaccucacag

SEQ ID NO: 1580472 - RNA, 16 nt, Human adenovirus E
ccuggccguguugcuc

SEQ ID NO: 1580473 - RNA, 14 nt, Human adenovirus E
uccugcccgccacc

SEQ ID NO: 1580474 - RNA, 12 nt, Human adenovirus E
uaccacccacac

SEQ ID NO: 1580475 - RNA, 23 nt, Human adenovirus E
uuuuacaguauggugauugaacu

SEQ ID NO: 1580476 - RNA, 18 nt, Human adenovirus E
gggcugcuagucagcggc

SEQ ID NO: 1580477 - RNA, 23 nt, Human adenovirus E
gcccggaugcaggggcggcaggg

SEQ ID NO: 1580478 - RNA, 19 nt, Human adenovirus E
acagcgaaccccgcagaac

SEQ ID NO: 1580479 - RNA, 20 nt, Human adenovirus E
cuuagcauuaccacacagac

SEQ ID NO: 1580480 - RNA, 20 nt, Human adenovirus E
agcuaccuccagugccuucu

SEQ ID NO: 1580481 - RNA, 18 nt, Human adenovirus E
cgcugagcccgugcugcu

SEQ ID NO: 1580482 - RNA, 18 nt, Human adenovirus E
ccaggacuacuccacccg

SEQ ID NO: 1580483 - RNA, 17 nt, Human adenovirus E
ugcggcccaugagcugc

SEQ ID NO: 1580484 - RNA, 17 nt, Human adenovirus E
gcucccuggccugcaac

SEQ ID NO: 1580485 - RNA, 20 nt, Human adenovirus E
cguggaggauuuggaggaag

SEQ ID NO: 1580486 - RNA, 14 nt, Human adenovirus E
augauuccuagaca

SEQ ID NO: 1580487 - RNA, 22 nt, Human adenovirus E
ggugccccucagcguggaggag

SEQ ID NO: 1580488 - RNA, 15 nt, Human adenovirus E
aucgccaaccucgcc

SEQ ID NO: 1580489 - RNA, 13 nt, Human adenovirus E
ugcgccaggccug

SEQ ID NO: 1580490 - RNA, 16 nt, Human adenovirus E
gcaggccccggcgggc

SEQ ID NO: 1580491 - RNA, 13 nt, Human adenovirus E
gcguaggccuggg

SEQ ID NO: 1580492 - RNA, 16 nt, Human adenovirus E
uucuacuuccuccuca

SEQ ID NO: 1580493 - RNA, 15 nt, Human adenovirus E
aucacacacgcccag

SEQ ID NO: 1580494 - RNA, 18 nt, Human adenovirus E
gcucgcgguggggcggcc

SEQ ID NO: 1580495 - RNA, 16 nt, Human adenovirus E
gaccggugaggagcuc

SEQ ID NO: 1580496 - RNA, 20 nt, Human adenovirus E
cuccgacgcggccgucccag

SEQ ID NO: 1580497 - RNA, 19 nt, Human adenovirus E
gggcagaacgugcugcaca

SEQ ID NO: 1580498 - RNA, 15 nt, Human adenovirus E
cguuacgugcagcag

SEQ ID NO: 1580499 - RNA, 12 nt, Human adenovirus E
ccagcugcacca

SEQ ID NO: 1580500 - RNA, 23 nt, Human adenovirus E
acaguagaugggacgagaccgga

SEQ ID NO: 1580501 - RNA, 10 nt, Human adenovirus E
ugccagcuga

SEQ ID NO: 1580502 - RNA, 17 nt, Human adenovirus E
ccauagcuuaccgagca

SEQ ID NO: 1580503 - RNA, 15 nt, Human adenovirus E
gcagucucuggagcg

SEQ ID NO: 1580504 - RNA, 21 nt, Human adenovirus E
caggugcugccgaccgcggcg

SEQ ID NO: 1580505 - RNA, 14 nt, Human adenovirus E
uggggaagaacugg

SEQ ID NO: 1580506 - RNA, 21 nt, Human adenovirus E
cagagcucggugaugugcucu

SEQ ID NO: 1580507 - RNA, 18 nt, Human adenovirus E
cauccccaaauucaaaca

SEQ ID NO: 1580508 - RNA, 18 nt, Human adenovirus E
cccgccaaauaaucacac

SEQ ID NO: 1580509 - RNA, 21 nt, Human adenovirus E
cgcgcagagcgcccuccaccg

SEQ ID NO: 1580510 - RNA, 18 nt, Human adenovirus E
gguuguugaugaccuggg

SEQ ID NO: 1580511 - RNA, 15 nt, Human adenovirus E
gccgccggugccgcc

SEQ ID NO: 1580512 - RNA, 17 nt, Human adenovirus E
ggggcggcucggggccc

SEQ ID NO: 1580513 - RNA, 13 nt, Human adenovirus E
cugcagagccagc

SEQ ID NO: 1580514 - RNA, 16 nt, Human adenovirus E
gggcguagagcuuggg

SEQ ID NO: 1580515 - RNA, 18 nt, Human adenovirus E
ugccgcagccgguggggc

SEQ ID NO: 1580516 - RNA, 13 nt, Human adenovirus E
gcgcacggccagc

SEQ ID NO: 1580517 - RNA, 15 nt, Human adenovirus E
cagugacagaggauu

SEQ ID NO: 1580518 - RNA, 21 nt, Human adenovirus E
ccgcagcagcgagcugggcag

SEQ ID NO: 1580519 - RNA, 14 nt, Human adenovirus E
caaauaaucacaca

SEQ ID NO: 1580520 - RNA, 19 nt, Human adenovirus E
cggccagccugcugaugcc

SEQ ID NO: 1580521 - RNA, 15 nt, Human adenovirus E
cguggucuucuccau

SEQ ID NO: 1580522 - RNA, 14 nt, Human adenovirus E
ugccccccgccgcu

SEQ ID NO: 1580523 - RNA, 19 nt, Human adenovirus E
agguuggugcgacugggcu

SEQ ID NO: 1580524 - RNA, 15 nt, Human adenovirus E
cacagggccagcacc

SEQ ID NO: 1580525 - RNA, 15 nt, Human adenovirus E
uagcgguccaucagc

SEQ ID NO: 1580526 - RNA, 21 nt, Human adenovirus E
ccuggugaccguggagcugga

SEQ ID NO: 1580527 - RNA, 17 nt, Human adenovirus E
cggagcacgaggaggag

SEQ ID NO: 1580528 - RNA, 22 nt, Human adenovirus E
accagccccagaugggccuggc

SEQ ID NO: 1580529 - RNA, 16 nt, Human adenovirus E
cagaccgugcagcaga

SEQ ID NO: 1580530 - RNA, 23 nt, Human adenovirus E
ugcuguagcauagucugccugcu

SEQ ID NO: 1580531 - RNA, 16 nt, Human adenovirus E
ugccgcugaccuuccg

SEQ ID NO: 1580532 - RNA, 14 nt, Human adenovirus E
cagccgcggccagg

SEQ ID NO: 1580533 - RNA, 23 nt, Human adenovirus E
cacgccuagaaugaccacaacca

SEQ ID NO: 1580534 - RNA, 20 nt, Human adenovirus E
uaccucugcucuaugcaauu

SEQ ID NO: 1580535 - RNA, 19 nt, Human adenovirus E
ccagcggcgaggaggaugu

SEQ ID NO: 1580536 - RNA, 14 nt, Human adenovirus E
cccauacuccaccu

SEQ ID NO: 1580537 - RNA, 22 nt, Human adenovirus E
cugcaccacgcugcgcccccag

SEQ ID NO: 1580538 - RNA, 15 nt, Human adenovirus E
ggacagccugcaaga

SEQ ID NO: 1580539 - RNA, 13 nt, Human adenovirus E
gaaaguggagcug

SEQ ID NO: 1580540 - RNA, 13 nt, Human adenovirus E
cccgugcagccac

SEQ ID NO: 1580541 - RNA, 13 nt, Human adenovirus E
caggaggucgggg

SEQ ID NO: 1580542 - RNA, 14 nt, Human adenovirus E
ccauaucccagggc

SEQ ID NO: 1580543 - RNA, 20 nt, Human adenovirus E
ucaaccacugcgacaacgac

SEQ ID NO: 1580544 - RNA, 15 nt, Human adenovirus E
cauagucugccugcu

SEQ ID NO: 1580545 - RNA, 12 nt, Human adenovirus E
cgccccagcagc

SEQ ID NO: 1580546 - RNA, 14 nt, Human adenovirus E
caggauucgagcag

SEQ ID NO: 1580547 - RNA, 19 nt, Human adenovirus E
cgccguugucaaccacugc

SEQ ID NO: 1580548 - RNA, 22 nt, Human adenovirus E
cgcgucguuguuggccagcugc

SEQ ID NO: 1580549 - RNA, 18 nt, Human adenovirus E
gcaauccucgcacagaac

SEQ ID NO: 1580550 - RNA, 14 nt, Human adenovirus E
ggcgcggccuggac

SEQ ID NO: 1580551 - RNA, 17 nt, Human adenovirus E
ccaagaccccauagcca

SEQ ID NO: 1580552 - RNA, 20 nt, Human adenovirus E
guggucagcgacgagcagcu

SEQ ID NO: 1580553 - RNA, 17 nt, Human adenovirus E
ucacaccuuccaccuga

SEQ ID NO: 1580554 - RNA, 19 nt, Human adenovirus E
guggccagaucguccaggg

SEQ ID NO: 1580555 - RNA, 16 nt, Human adenovirus E
cagggcccggcccacg

SEQ ID NO: 1580556 - RNA, 17 nt, Human adenovirus E
cagcaccgaggaggagc

SEQ ID NO: 1580557 - RNA, 22 nt, Human adenovirus E
uggacagaaaaucgcccaggca

SEQ ID NO: 1580558 - RNA, 22 nt, Human adenovirus E
uggucgaaaaccgcucccgauc

SEQ ID NO: 1580559 - RNA, 23 nt, Human adenovirus E
cgggacccugccgcugcgcagca

SEQ ID NO: 1580560 - RNA, 22 nt, Human adenovirus E
cccgaugaccggcugcaggugg

SEQ ID NO: 1580561 - RNA, 22 nt, Human adenovirus E
ugcuaccugcugcgccuggcca

SEQ ID NO: 1580562 - RNA, 15 nt, Human adenovirus E
gaagcgugggccugu

SEQ ID NO: 1580563 - RNA, 21 nt, Human adenovirus E
caccacgcugcgcccccagcg

SEQ ID NO: 1580564 - RNA, 19 nt, Human adenovirus E
gcgcgccgguacgcccgcg

SEQ ID NO: 1580565 - RNA, 13 nt, Human adenovirus E
cugcugguggccc

SEQ ID NO: 1580566 - RNA, 22 nt, Human adenovirus E
cggucuucgcggugcccgaggc

SEQ ID NO: 1580567 - RNA, 16 nt, Human adenovirus E
ggagcucagccgcgcc

SEQ ID NO: 1580568 - RNA, 14 nt, Human adenovirus E
gccguccucccgga

SEQ ID NO: 1580569 - RNA, 17 nt, Human adenovirus E
guacuuaguggugcugu

SEQ ID NO: 1580570 - RNA, 18 nt, Human adenovirus E
cucagguguccagcuggc

SEQ ID NO: 1580571 - RNA, 20 nt, Human adenovirus E
ggcgggagcugcggcgcggc

SEQ ID NO: 1580572 - RNA, 21 nt, Human adenovirus E
accucaggcacacgcacuacc

SEQ ID NO: 1580573 - RNA, 18 nt, Human adenovirus E
cgaguucgccccccggcg

SEQ ID NO: 1580574 - RNA, 13 nt, Human adenovirus E
ccacggccagggc

SEQ ID NO: 1580575 - RNA, 16 nt, Human adenovirus E
uaguuuauacauguga

SEQ ID NO: 1580576 - RNA, 13 nt, Human adenovirus E
cgugcgcuccugg

SEQ ID NO: 1580577 - RNA, 22 nt, Human adenovirus E
gaugaggugcaucuuggccugg

SEQ ID NO: 1580578 - RNA, 14 nt, Human adenovirus E
accacacacacaga

SEQ ID NO: 1580579 - RNA, 13 nt, Human adenovirus E
agugcucaggugu

SEQ ID NO: 1580580 - RNA, 14 nt, Human adenovirus E
ugcaccucacagcu

SEQ ID NO: 1580581 - RNA, 12 nt, Human adenovirus E
ccugggccagga

SEQ ID NO: 1580582 - RNA, 23 nt, Human adenovirus E
uaggagcuccuggagcgaggcga

SEQ ID NO: 1580583 - RNA, 13 nt, Human adenovirus E
caaccacaaaaac

SEQ ID NO: 1580584 - RNA, 18 nt, Human adenovirus E
aggcuccuuacgugcccc

SEQ ID NO: 1580585 - RNA, 16 nt, Human adenovirus E
cgcgcuccacgguggc

SEQ ID NO: 1580586 - RNA, 16 nt, Human adenovirus E
cacaccuuccaccuga

SEQ ID NO: 1580587 - RNA, 20 nt, Human adenovirus E
agaaggccgaucccugcuug

SEQ ID NO: 1580588 - RNA, 21 nt, Human adenovirus E
ugcaagcggugcguuccagca

SEQ ID NO: 1580589 - RNA, 17 nt, Human adenovirus E
cacugcuaccugcugcg

SEQ ID NO: 1580590 - RNA, 16 nt, Human adenovirus E
gcagcaggugcugccg

SEQ ID NO: 1580591 - RNA, 13 nt, Human adenovirus E
aucugggccuggu

SEQ ID NO: 1580592 - RNA, 16 nt, Human adenovirus E
agcugcugcucagggg

SEQ ID NO: 1580593 - RNA, 13 nt, Human adenovirus E
augguggcgcagc

SEQ ID NO: 1580594 - RNA, 14 nt, Human adenovirus E
cgaucccugagcuc

SEQ ID NO: 1580595 - RNA, 15 nt, Human adenovirus E
cgccgcaccgcuccc

SEQ ID NO: 1580596 - RNA, 15 nt, Human adenovirus E
uccccgugccagcga

SEQ ID NO: 1580597 - RNA, 19 nt, Human adenovirus E
ccgucaccuccacagcccc

SEQ ID NO: 1580598 - RNA, 16 nt, Human adenovirus E
cagcacucaggcagag

SEQ ID NO: 1580599 - RNA, 20 nt, Human adenovirus E
ccuggugaccguggagcugg

SEQ ID NO: 1580600 - RNA, 15 nt, Human adenovirus E
gacaucggcaccagc

SEQ ID NO: 1580601 - RNA, 14 nt, Human adenovirus E
cugcacgccgcacc

SEQ ID NO: 1580602 - RNA, 18 nt, Human adenovirus E
cauguacgaggaucugga

SEQ ID NO: 1580603 - RNA, 12 nt, Human adenovirus E
ggcgaugcagcc

SEQ ID NO: 1580604 - RNA, 12 nt, Human adenovirus E
uacaccacccuc

SEQ ID NO: 1580605 - RNA, 14 nt, Human adenovirus E
caucgucuccugcu

SEQ ID NO: 1580606 - RNA, 19 nt, Human adenovirus E
agacaugcaucccagcugg

SEQ ID NO: 1580607 - RNA, 18 nt, Human adenovirus E
ccugucuuucguccucgc

SEQ ID NO: 1580608 - RNA, 14 nt, Human adenovirus E
cagcagcagcagaa

SEQ ID NO: 1580609 - RNA, 23 nt, Human adenovirus E
ugagcgaccaggagcugaugcau

SEQ ID NO: 1580610 - RNA, 17 nt, Human adenovirus E
augcaggagggggccac

SEQ ID NO: 1580611 - RNA, 17 nt, Human adenovirus E
uggcccgugaggcgcgc

SEQ ID NO: 1580612 - RNA, 15 nt, Human adenovirus E
caacucguaccuggg

SEQ ID NO: 1580613 - RNA, 14 nt, Human adenovirus E
cgaccaggagcuga

SEQ ID NO: 1580614 - RNA, 16 nt, Human adenovirus E
agcgcaugcggaucuc

SEQ ID NO: 1580615 - RNA, 17 nt, Human adenovirus E
accgccucggaccuggc

SEQ ID NO: 1580616 - RNA, 23 nt, Human adenovirus E
  misc_feature (14)..(14): n is a, c, g or u
aggucagugggcancggcggcgc

SEQ ID NO: 1580617 - RNA, 17 nt, Human adenovirus E
cagccaucgccaaccuc

SEQ ID NO: 1580618 - RNA, 16 nt, Human adenovirus E
gagcugcggcgcggcc

SEQ ID NO: 1580619 - RNA, 16 nt, Human adenovirus E
ugaccagcaugaaggg

SEQ ID NO: 1580620 - RNA, 13 nt, Human adenovirus E
ucucuucagcacu

SEQ ID NO: 1580621 - RNA, 16 nt, Human adenovirus E
gugcaucuuggccugg

SEQ ID NO: 1580622 - RNA, 23 nt, Human adenovirus E
cgugagccgcgcccugggccagg

SEQ ID NO: 1580623 - RNA, 15 nt, Human adenovirus E
cccgcgaugcgggcg

SEQ ID NO: 1580624 - RNA, 13 nt, Human adenovirus E
ccgcccgcccgcg

SEQ ID NO: 1580625 - RNA, 16 nt, Human adenovirus E
uccggcaccgcuucca

SEQ ID NO: 1580626 - RNA, 12 nt, Human adenovirus E
caaggaggugaa

SEQ ID NO: 1580627 - RNA, 17 nt, Human adenovirus E
cguuacucggagcuggc

SEQ ID NO: 1580628 - RNA, 19 nt, Human adenovirus E
gccgaccgcgauggcucgu

SEQ ID NO: 1580629 - RNA, 13 nt, Human adenovirus E
cggucccccaccc

SEQ ID NO: 1580630 - RNA, 16 nt, Human adenovirus E
cgcucccuggccugca

SEQ ID NO: 1580631 - RNA, 20 nt, Human adenovirus E
gcagcggccaucgccagcau

SEQ ID NO: 1580632 - RNA, 18 nt, Human adenovirus E
cgagggucugggcagcga

SEQ ID NO: 1580633 - RNA, 23 nt, Human adenovirus E
  misc_feature (9)..(9): n is a, c, g or u
agcacgaangaggccacguggga

SEQ ID NO: 1580634 - RNA, 21 nt, Human adenovirus E
ucauuuccggguucccacgcu

SEQ ID NO: 1580635 - RNA, 17 nt, Human adenovirus E
gagcagaccgugaagga

SEQ ID NO: 1580636 - RNA, 19 nt, Human adenovirus E
cgggugcuucacgcucgcc

SEQ ID NO: 1580637 - RNA, 12 nt, Human adenovirus E
cugacccugagc

SEQ ID NO: 1580638 - RNA, 17 nt, Human adenovirus E
caccucugacccugccg

SEQ ID NO: 1580639 - RNA, 23 nt, Human adenovirus E
cagcgcgcgucguuguuggccag

SEQ ID NO: 1580640 - RNA, 17 nt, Human adenovirus E
acuucaucagcgcccug

SEQ ID NO: 1580641 - RNA, 19 nt, Human adenovirus E
gaccacggcaaccccacgc

SEQ ID NO: 1580642 - RNA, 13 nt, Human adenovirus E
cuccacgcgcaca

SEQ ID NO: 1580643 - RNA, 23 nt, Human adenovirus E
aucccgauauugucuugcugccc

SEQ ID NO: 1580644 - RNA, 12 nt, Human adenovirus E
uacuuccuccuc

SEQ ID NO: 1580645 - RNA, 15 nt, Human adenovirus E
ggugucggggaagga

SEQ ID NO: 1580646 - RNA, 15 nt, Human adenovirus E
cauuaccucugcucu

SEQ ID NO: 1580647 - RNA, 13 nt, Human adenovirus E
uuauuguugcugu

SEQ ID NO: 1580648 - RNA, 16 nt, Human adenovirus E
uucgugagguaaaucc

SEQ ID NO: 1580649 - RNA, 23 nt, Human adenovirus E
ugaagacgccgccgcgcaucucc

SEQ ID NO: 1580650 - RNA, 12 nt, Human adenovirus E
cgcgccaucagc

SEQ ID NO: 1580651 - RNA, 14 nt, Human adenovirus E
acuaccuccaccug

SEQ ID NO: 1580652 - RNA, 11 nt, Human adenovirus E
gugcagaccaa

SEQ ID NO: 1580653 - RNA, 21 nt, Human adenovirus E
cgaggaggauguccaagcgca

SEQ ID NO: 1580654 - RNA, 13 nt, Human adenovirus E
cgcaaucaccuca

SEQ ID NO: 1580655 - RNA, 14 nt, Human adenovirus E
cggcgcccgccuac

SEQ ID NO: 1580656 - RNA, 15 nt, Human adenovirus E
gaaguccagagaucc

SEQ ID NO: 1580657 - RNA, 16 nt, Human adenovirus E
ggcuggagccgcagcu

SEQ ID NO: 1580658 - RNA, 22 nt, Human adenovirus E
cucccaggacauggaauacacc

SEQ ID NO: 1580659 - RNA, 14 nt, Human adenovirus E
caccaggcaggcca

SEQ ID NO: 1580660 - RNA, 20 nt, Human adenovirus E
agcccccgcuggaggcuccu

SEQ ID NO: 1580661 - RNA, 13 nt, Human adenovirus E
cauggcgcugacg

SEQ ID NO: 1580662 - RNA, 13 nt, Human adenovirus E
gcgcuaccugcuc

SEQ ID NO: 1580663 - RNA, 15 nt, Human adenovirus E
gcagguggacugagg

SEQ ID NO: 1580664 - RNA, 22 nt, Human adenovirus E
auccugcccgccaccugcuccg

SEQ ID NO: 1580665 - RNA, 22 nt, Human adenovirus E
cacgagaaccgccuggggcaga

SEQ ID NO: 1580666 - RNA, 19 nt, Human adenovirus E
cgauauugucuugcugccc

SEQ ID NO: 1580667 - RNA, 15 nt, Human adenovirus E
uagguuuuggaucag

SEQ ID NO: 1580668 - RNA, 11 nt, Human adenovirus E
agcagccgccg

SEQ ID NO: 1580669 - RNA, 20 nt, Human adenovirus E
ggccgaccccgucaccacca

SEQ ID NO: 1580670 - RNA, 20 nt, Human adenovirus E
guuccaggcggucccagagc

SEQ ID NO: 1580671 - RNA, 20 nt, Human adenovirus E
gcauggucucggugacggcg

SEQ ID NO: 1580672 - RNA, 21 nt, Human adenovirus E
agacgcgcggccacggcggcg

SEQ ID NO: 1580673 - RNA, 14 nt, Human adenovirus E
gccaccacccccag

SEQ ID NO: 1580674 - RNA, 12 nt, Human adenovirus E
caucacaccuuc

SEQ ID NO: 1580675 - RNA, 20 nt, Human adenovirus E
cccaagcagaaccuguucag

SEQ ID NO: 1580676 - RNA, 15 nt, Human adenovirus E
cagcagccccaggcc

SEQ ID NO: 1580677 - RNA, 17 nt, Human adenovirus E
ccacggcccucagcauc

SEQ ID NO: 1580678 - RNA, 15 nt, Human adenovirus E
acuccguggccugga

SEQ ID NO: 1580679 - RNA, 21 nt, Human adenovirus E
augggcgcggaccugcacugg

SEQ ID NO: 1580680 - RNA, 22 nt, Human adenovirus E
agcaucuggcccggcaggccac

SEQ ID NO: 1580681 - RNA, 17 nt, Human adenovirus E
cagaccgugaaggagga

SEQ ID NO: 1580682 - RNA, 17 nt, Human adenovirus E
cugaccaccguggugca

SEQ ID NO: 1580683 - RNA, 16 nt, Human adenovirus E
ccaccuaccacaucuu

SEQ ID NO: 1580684 - RNA, 22 nt, Human adenovirus E
acuucaaccccuucuccggcuc

SEQ ID NO: 1580685 - RNA, 24 nt, Human adenovirus E
ggaugcaugcggggggagaugagg

SEQ ID NO: 1580686 - RNA, 13 nt, Human adenovirus E
gugcaacacagaa

SEQ ID NO: 1580687 - RNA, 13 nt, Human adenovirus E
ugcguacccggag

SEQ ID NO: 1580688 - RNA, 22 nt, Human adenovirus E
aggcacacgcacuaccaccacu

SEQ ID NO: 1580689 - RNA, 12 nt, Human adenovirus E
cccagagcugga

SEQ ID NO: 1580690 - RNA, 21 nt, Human adenovirus E
ggcggcgcugcagagccagcc

SEQ ID NO: 1580691 - RNA, 22 nt, Human adenovirus E
ucuucuccaucgcuuacagccu

SEQ ID NO: 1580692 - RNA, 22 nt, Human adenovirus E
augcaccugugggaccugcugg

SEQ ID NO: 1580693 - RNA, 14 nt, Human adenovirus E
ggaggaggcagagg

SEQ ID NO: 1580694 - RNA, 19 nt, Human adenovirus E
augaugauauucuggagca

SEQ ID NO: 1580695 - RNA, 23 nt, Human adenovirus E
cccgauuaugcagggugaugagg

SEQ ID NO: 1580696 - RNA, 14 nt, Human adenovirus E
cauggagacucagc

SEQ ID NO: 1580697 - RNA, 23 nt, Human adenovirus E
cagacccacugcugaaccucuau

SEQ ID NO: 1580698 - RNA, 16 nt, Human adenovirus E
cugcaaacuuccucca

SEQ ID NO: 1580699 - RNA, 20 nt, Human adenovirus E
cgggccgcgaacgcucugca

SEQ ID NO: 1580700 - RNA, 13 nt, Human adenovirus E
aaguaccucaccu

SEQ ID NO: 1580701 - RNA, 16 nt, Human adenovirus E
ccgccucggaccuggc

SEQ ID NO: 1580702 - RNA, 21 nt, Human adenovirus E
auuagcagucauaaucaucug

SEQ ID NO: 1580703 - RNA, 16 nt, Human adenovirus E
uagcauguagaacugg

SEQ ID NO: 1580704 - RNA, 15 nt, Human adenovirus E
acagggcaauccucg

SEQ ID NO: 1580705 - RNA, 15 nt, Human adenovirus E
aagggccgcgggguc

SEQ ID NO: 1580706 - RNA, 14 nt, Human adenovirus E
aguucguggaggag

SEQ ID NO: 1580707 - RNA, 19 nt, Human adenovirus E
augaggccgagccacagcg

SEQ ID NO: 1580708 - RNA, 13 nt, Human adenovirus E
ugagguggacgag

SEQ ID NO: 1580709 - RNA, 16 nt, Human adenovirus E
cacggcaaccccacgc

SEQ ID NO: 1580710 - RNA, 14 nt, Human adenovirus E
ccagacgcgcggcu

SEQ ID NO: 1580711 - RNA, 16 nt, Human adenovirus E
acuuccagccacgacc

SEQ ID NO: 1580712 - RNA, 20 nt, Human adenovirus E
cgaaggaccccauccaggug

SEQ ID NO: 1580713 - RNA, 17 nt, Human adenovirus E
gcagaccaaccuggacc

SEQ ID NO: 1580714 - RNA, 19 nt, Human adenovirus E
ggcgcuguccggccgcgag

SEQ ID NO: 1580715 - RNA, 14 nt, Human adenovirus E
ugacggcgcagcug

SEQ ID NO: 1580716 - RNA, 21 nt, Human adenovirus E
caggaggcgcucuccccccag

SEQ ID NO: 1580717 - RNA, 16 nt, Human adenovirus E
cuauguuggcacagca

SEQ ID NO: 1580718 - RNA, 16 nt, Human adenovirus E
ggcuguggaccucggc

SEQ ID NO: 1580719 - RNA, 17 nt, Human adenovirus E
ccgcaucugcaccucac

SEQ ID NO: 1580720 - RNA, 22 nt, Human adenovirus E
ggcgcccugcgcgucggccagg

SEQ ID NO: 1580721 - RNA, 18 nt, Human adenovirus E
gauguuggagauggcgag

SEQ ID NO: 1580722 - RNA, 15 nt, Human adenovirus E
aggcuggagccgcag

SEQ ID NO: 1580723 - RNA, 15 nt, Human adenovirus E
uaaaauuaacaauua

SEQ ID NO: 1580724 - RNA, 14 nt, Human adenovirus E
ugcacuaccucuuc

SEQ ID NO: 1580725 - RNA, 16 nt, Human adenovirus E
caagcggccacagugc

SEQ ID NO: 1580726 - RNA, 11 nt, Human adenovirus E
ggaugagcucg

SEQ ID NO: 1580727 - RNA, 17 nt, Human adenovirus E
accucgacccccagacc

SEQ ID NO: 1580728 - RNA, 16 nt, Human adenovirus E
gcccgccaccugcucc

SEQ ID NO: 1580729 - RNA, 22 nt, Human adenovirus E
cauggaauacaccacccucucc

SEQ ID NO: 1580730 - RNA, 12 nt, Human adenovirus E
acuccaccucca

SEQ ID NO: 1580731 - RNA, 19 nt, Human adenovirus E
gcugggucugcgaccugac

SEQ ID NO: 1580732 - RNA, 23 nt, Human adenovirus E
ccgacaaaaaucagacccacugc

SEQ ID NO: 1580733 - RNA, 12 nt, Human adenovirus E
caguaguacaga

SEQ ID NO: 1580734 - RNA, 16 nt, Human adenovirus E
uccucccggaggaggg

SEQ ID NO: 1580735 - RNA, 13 nt, Human adenovirus E
cagcagcugaagc

SEQ ID NO: 1580736 - RNA, 23 nt, Human adenovirus E
gagacgcgcggccacggcggcgg

SEQ ID NO: 1580737 - RNA, 19 nt, Human adenovirus E
agagcgugaugcagcaggc

SEQ ID NO: 1580738 - RNA, 21 nt, Human adenovirus E
gcaugucccgcccgcggcgag

SEQ ID NO: 1580739 - RNA, 13 nt, Human adenovirus E
gucgggggcagga

SEQ ID NO: 1580740 - RNA, 22 nt, Human adenovirus E
gcggcuggugauccggggcaga

SEQ ID NO: 1580741 - RNA, 14 nt, Human adenovirus E
aaagguuggggcac

SEQ ID NO: 1580742 - RNA, 15 nt, Human adenovirus E
cgagacgcccaggcc

SEQ ID NO: 1580743 - RNA, 14 nt, Human adenovirus E
caacagcugaggau

SEQ ID NO: 1580744 - RNA, 17 nt, Human adenovirus E
cuccugcacaggcagca

SEQ ID NO: 1580745 - RNA, 17 nt, Human adenovirus E
cggaauccugcccgcca

SEQ ID NO: 1580746 - RNA, 20 nt, Human adenovirus E
cucgcacuccacgagccagg

SEQ ID NO: 1580747 - RNA, 13 nt, Human adenovirus E
acccucgcucugg

SEQ ID NO: 1580748 - RNA, 16 nt, Human adenovirus E
ccggaugcaggggcgg

SEQ ID NO: 1580749 - RNA, 22 nt, Human adenovirus E
caaccgcaacucguaccugggc

SEQ ID NO: 1580750 - RNA, 13 nt, Human adenovirus E
cuaccgcagcugg

SEQ ID NO: 1580751 - RNA, 22 nt, Human adenovirus E
ucagcacucucaacuccucggg

SEQ ID NO: 1580752 - RNA, 12 nt, Human adenovirus E
uauuugcaauug

SEQ ID NO: 1580753 - RNA, 18 nt, Human adenovirus E
ucugccacaccuggcaga

SEQ ID NO: 1580754 - RNA, 18 nt, Human adenovirus E
cuuccagauaacuggaca

SEQ ID NO: 1580755 - RNA, 14 nt, Human adenovirus E
ugcuguaggauuca

SEQ ID NO: 1580756 - RNA, 19 nt, Human adenovirus E
ucgugcagaaccccaccag

SEQ ID NO: 1580757 - RNA, 16 nt, Human adenovirus E
gucgaugggcucgccu

SEQ ID NO: 1580758 - RNA, 12 nt, Human adenovirus E
agcccgaggaga

SEQ ID NO: 1580759 - RNA, 14 nt, Human adenovirus E
ccgcgagugccccc

SEQ ID NO: 1580760 - RNA, 21 nt, Human adenovirus E
ccacccugugucgucaccgcc

SEQ ID NO: 1580761 - RNA, 13 nt, Human adenovirus E
gaccguggagcug

SEQ ID NO: 1580762 - RNA, 17 nt, Human adenovirus E
gacuucacccccacgga

SEQ ID NO: 1580763 - RNA, 21 nt, Human adenovirus E
cuagcauguagaacugguuga

SEQ ID NO: 1580764 - RNA, 15 nt, Human adenovirus E
uggcccgcgggcagg

SEQ ID NO: 1580765 - RNA, 17 nt, Human adenovirus E
gcgcgguaggcccugga

SEQ ID NO: 1580766 - RNA, 23 nt, Human adenovirus E
cuucacggacagcggcagcauca

SEQ ID NO: 1580767 - RNA, 23 nt, Human adenovirus E
ccugguguacaacgcgcugcugg

SEQ ID NO: 1580768 - RNA, 16 nt, Human adenovirus E
agggagagacagcugc

SEQ ID NO: 1580769 - RNA, 22 nt, Human adenovirus E
cugaggggcgugccccagggca

SEQ ID NO: 1580770 - RNA, 20 nt, Human adenovirus E
guccacacugguggccaccu

SEQ ID NO: 1580771 - RNA, 15 nt, Human adenovirus E
ccacccucgcucugg

SEQ ID NO: 1580772 - RNA, 17 nt, Human adenovirus E
gaucgugaacauucugg

SEQ ID NO: 1580773 - RNA, 18 nt, Human adenovirus E
cagaagcaagcuccagcu

SEQ ID NO: 1580774 - RNA, 20 nt, Human adenovirus E
gggcaugagcccgucccggg

SEQ ID NO: 1580775 - RNA, 18 nt, Human adenovirus E
cucucaucaaguuucaau

SEQ ID NO: 1580776 - RNA, 20 nt, Human adenovirus E
ugcuaccgccaaaaaucaga

SEQ ID NO: 1580777 - RNA, 20 nt, Human adenovirus E
gggcaucaacgggguggugg

SEQ ID NO: 1580778 - RNA, 16 nt, Human adenovirus E
guggcggugcaggccu

SEQ ID NO: 1580779 - RNA, 15 nt, Human adenovirus E
accggcucucggcca

SEQ ID NO: 1580780 - RNA, 19 nt, Human adenovirus E
ucacaugcucaucgcuauu

SEQ ID NO: 1580781 - RNA, 16 nt, Human adenovirus E
guuagaguuuggaagc

SEQ ID NO: 1580782 - RNA, 22 nt, Human adenovirus E
ugguggacaagaugagccgcug

SEQ ID NO: 1580783 - RNA, 17 nt, Human adenovirus E
gcaagucuacuggucgc

SEQ ID NO: 1580784 - RNA, 13 nt, Human adenovirus E
aggcagaggagga

SEQ ID NO: 1580785 - RNA, 12 nt, Human adenovirus E
uccaagccagcc

SEQ ID NO: 1580786 - RNA, 14 nt, Human adenovirus E
gacuugggugggag

SEQ ID NO: 1580787 - RNA, 16 nt, Human adenovirus E
gaaugagcagagucag

SEQ ID NO: 1580788 - RNA, 22 nt, Human adenovirus E
  misc_feature (8)..(8): n is a, c, g or u
acuugcangaguuuuuccaggg

SEQ ID NO: 1580789 - RNA, 13 nt, Human adenovirus E
gggcaccuggagc

SEQ ID NO: 1580790 - RNA, 18 nt, Human adenovirus E
aucagacaugcaucccag

SEQ ID NO: 1580791 - RNA, 17 nt, Human adenovirus E
cggucaacuccuccucc

SEQ ID NO: 1580792 - RNA, 17 nt, Human adenovirus E
ccggcgggcugcaaacu

SEQ ID NO: 1580793 - RNA, 14 nt, Human adenovirus E
aggaggagcuggca

SEQ ID NO: 1580794 - RNA, 23 nt, Human adenovirus E
ggcgcaucgcccggcggcaccgg

SEQ ID NO: 1580795 - RNA, 14 nt, Human adenovirus E
cccgggcaaccugg

SEQ ID NO: 1580796 - RNA, 21 nt, Human adenovirus E
ugcaggagcgcgggcugccgc

SEQ ID NO: 1580797 - RNA, 14 nt, Human adenovirus E
agcagccgccgcca

SEQ ID NO: 1580798 - RNA, 14 nt, Human adenovirus E
ucauuuuuccagcc

SEQ ID NO: 1580799 - RNA, 21 nt, Human adenovirus E
cggacuacuucuuccagacca

SEQ ID NO: 1580800 - RNA, 21 nt, Human adenovirus E
uucacccccacggaggccagc

SEQ ID NO: 1580801 - RNA, 13 nt, Human adenovirus E
gcgcccagcaaga

SEQ ID NO: 1580802 - RNA, 16 nt, Human adenovirus E
acauguggagcuacca

SEQ ID NO: 1580803 - RNA, 14 nt, Human adenovirus E
aggagaaccugcac

SEQ ID NO: 1580804 - RNA, 19 nt, Human adenovirus E
aggccgaaguccagcugac

SEQ ID NO: 1580805 - RNA, 22 nt, Human adenovirus E
uaccggacaagauaaacaccgc

SEQ ID NO: 1580806 - RNA, 14 nt, Human adenovirus E
ggagauagcauaga

SEQ ID NO: 1580807 - RNA, 14 nt, Human adenovirus E
cagcaagccgcuga

SEQ ID NO: 1580808 - RNA, 20 nt, Human adenovirus E
cagcgguguccggggcugcu

SEQ ID NO: 1580809 - RNA, 12 nt, Human adenovirus E
ggcagaggagga

SEQ ID NO: 1580810 - RNA, 21 nt, Human adenovirus E
gaagugggcguggggcagucc

SEQ ID NO: 1580811 - RNA, 21 nt, Human adenovirus E
ugguggucaugcugacgagcc

SEQ ID NO: 1580812 - RNA, 15 nt, Human adenovirus E
gggcguagagcuugg

SEQ ID NO: 1580813 - RNA, 14 nt, Human adenovirus E
ucaacuccuccucc

SEQ ID NO: 1580814 - RNA, 18 nt, Human adenovirus E
acagcaccaacgugcaga

SEQ ID NO: 1580815 - RNA, 22 nt, Human adenovirus E
cagccggcgcuucugcccccgc

SEQ ID NO: 1580816 - RNA, 16 nt, Human adenovirus E
cugaccaaccuggucu

SEQ ID NO: 1580817 - RNA, 18 nt, Human adenovirus E
acgccugcugggccuugg

SEQ ID NO: 1580818 - RNA, 17 nt, Human adenovirus E
ccacgcgcacauccaga

SEQ ID NO: 1580819 - RNA, 14 nt, Human adenovirus E
uucagagacaggag

SEQ ID NO: 1580820 - RNA, 19 nt, Human adenovirus E
cugcccccgccccagcagc

SEQ ID NO: 1580821 - RNA, 20 nt, Human adenovirus E
gucgggggcaggagcaggaa

SEQ ID NO: 1580822 - RNA, 16 nt, Human adenovirus E
gaucugacacuacaga

SEQ ID NO: 1580823 - RNA, 15 nt, Human adenovirus E
ccucagcguggagga

SEQ ID NO: 1580824 - RNA, 20 nt, Human adenovirus E
uccgaccgagucgcggauga

SEQ ID NO: 1580825 - RNA, 21 nt, Human adenovirus E
ugaacauucugcagagcaucg

SEQ ID NO: 1580826 - RNA, 23 nt, Human adenovirus E
gcaguagucgagggucuccugga

SEQ ID NO: 1580827 - RNA, 15 nt, Human adenovirus E
ccugcacuggcagcc

SEQ ID NO: 1580828 - RNA, 19 nt, Human adenovirus E
gaaucuuuauuugauuuuu

SEQ ID NO: 1580829 - RNA, 14 nt, Human adenovirus E
augcuacccacgug

SEQ ID NO: 1580830 - RNA, 23 nt, Human adenovirus E
gccugguggacaagaugagccgc

SEQ ID NO: 1580831 - RNA, 16 nt, Human adenovirus E
agaagcgugggccugu

SEQ ID NO: 1580832 - RNA, 19 nt, Human adenovirus E
augcaggggcggcaggggc

SEQ ID NO: 1580833 - RNA, 14 nt, Human adenovirus E
auuuggaggaagac

SEQ ID NO: 1580834 - RNA, 18 nt, Human adenovirus E
ugcucgggcaucagcugg

SEQ ID NO: 1580835 - RNA, 19 nt, Human adenovirus E
gaggcagcagcagcagaaa

SEQ ID NO: 1580836 - RNA, 14 nt, Human adenovirus E
cucgagcgcccagu

SEQ ID NO: 1580837 - RNA, 14 nt, Human adenovirus E
cagcgccccgcauc

SEQ ID NO: 1580838 - RNA, 12 nt, Human adenovirus E
gggaggcgcugc

SEQ ID NO: 1580839 - RNA, 14 nt, Human adenovirus E
ggccggccggauuc

SEQ ID NO: 1580840 - RNA, 23 nt, Human adenovirus E
accgugcggugagcgccagcagg

SEQ ID NO: 1580841 - RNA, 21 nt, Human adenovirus E
  misc_feature (6)..(6): n is a, c, g or u
cccaunuagcagucccacugc

SEQ ID NO: 1580842 - RNA, 14 nt, Human adenovirus E
gauaggagcuccug

SEQ ID NO: 1580843 - RNA, 13 nt, Human adenovirus E
aagccacagaagu

SEQ ID NO: 1580844 - RNA, 20 nt, Human adenovirus E
gcgcagagcgcccuccaccg

SEQ ID NO: 1580845 - RNA, 16 nt, Human adenovirus E
ccgcagaacagggcaa

SEQ ID NO: 1580846 - RNA, 18 nt, Human adenovirus E
gccagcgccggcaggacc

SEQ ID NO: 1580847 - RNA, 17 nt, Human adenovirus E
acucgcgccugcugcug

SEQ ID NO: 1580848 - RNA, 14 nt, Human adenovirus E
cggcucccccggcc

SEQ ID NO: 1580849 - RNA, 15 nt, Human adenovirus E
gcacucaggcagagg

SEQ ID NO: 1580850 - RNA, 14 nt, Human adenovirus E
cacgccgcaccgcu

SEQ ID NO: 1580851 - RNA, 19 nt, Human adenovirus E
cggcgcgccaucagcaagc

SEQ ID NO: 1580852 - RNA, 14 nt, Human adenovirus E
agaggcagcagcag

SEQ ID NO: 1580853 - RNA, 19 nt, Human adenovirus E
caccucgcuuacgcacguc

SEQ ID NO: 1580854 - RNA, 22 nt, Human adenovirus E
acaucacccucugguugaacau

SEQ ID NO: 1580855 - RNA, 18 nt, Human adenovirus E
cuucugccucgauggugg

SEQ ID NO: 1580856 - RNA, 15 nt, Human adenovirus E
cgcagugcaggggga

SEQ ID NO: 1580857 - RNA, 16 nt, Human adenovirus E
cucaaguccagcaaag

SEQ ID NO: 1580858 - RNA, 21 nt, Human adenovirus E
cucgggccgcgaacgcucugc

SEQ ID NO: 1580859 - RNA, 11 nt, Human adenovirus E
ggaucuucagc

SEQ ID NO: 1580860 - RNA, 22 nt, Human adenovirus E
accugggauccaugguggcgcu

SEQ ID NO: 1580861 - RNA, 22 nt, Human adenovirus E
cugaccaccguggugcagaaca

SEQ ID NO: 1580862 - RNA, 19 nt, Human adenovirus E
gccgggccuuggaggcggc

SEQ ID NO: 1580863 - RNA, 14 nt, Human adenovirus E
agccgccuccaccc

SEQ ID NO: 1580864 - RNA, 13 nt, Human adenovirus E
aaucucuccucgc

SEQ ID NO: 1580865 - RNA, 13 nt, Human adenovirus E
ggcuuugagcucg

SEQ ID NO: 1580866 - RNA, 13 nt, Human adenovirus E
agcaccgccccgc

SEQ ID NO: 1580867 - RNA, 22 nt, Human adenovirus E
caaccuggaagccacccugaac

SEQ ID NO: 1580868 - RNA, 14 nt, Human adenovirus E
cagcacacaacagg

SEQ ID NO: 1580869 - RNA, 21 nt, Human adenovirus E
cgcagagcgcccuccaccggc

SEQ ID NO: 1580870 - RNA, 22 nt, Human adenovirus E
  misc_feature (9)..(9): n is a, c, g or u
ugccaaccnuacuuuuuccacc

SEQ ID NO: 1580871 - RNA, 13 nt, Human adenovirus E
agcagccgcggcc

SEQ ID NO: 1580872 - RNA, 14 nt, Human adenovirus E
ugcaucugcugcug

SEQ ID NO: 1580873 - RNA, 20 nt, Human adenovirus E
ccaacgugcagaccaaccug

SEQ ID NO: 1580874 - RNA, 20 nt, Human adenovirus E
gagguccacacugguggcca

SEQ ID NO: 1580875 - RNA, 13 nt, Human adenovirus E
acgaggaggaggc

SEQ ID NO: 1580876 - RNA, 21 nt, Human adenovirus E
gcagagucgggggcaggagca

SEQ ID NO: 1580877 - RNA, 18 nt, Human adenovirus E
aagccugguggacaagau

SEQ ID NO: 1580878 - RNA, 17 nt, Human adenovirus E
cuauguuggcacagcac

SEQ ID NO: 1580879 - RNA, 13 nt, Human adenovirus E
gcuguccacgagc

SEQ ID NO: 1580880 - RNA, 16 nt, Human adenovirus E
caggccgaaguccagc

SEQ ID NO: 1580881 - RNA, 14 nt, Human adenovirus E
gcugcacaccaccc

SEQ ID NO: 1580882 - RNA, 14 nt, Human adenovirus E
caaccaaccucugg

SEQ ID NO: 1580883 - RNA, 12 nt, Human adenovirus E
acacugguggcc

SEQ ID NO: 1580884 - RNA, 15 nt, Human adenovirus E
cagauccucguccgc

SEQ ID NO: 1580885 - RNA, 16 nt, Human adenovirus E
gugggcggcggccugg

SEQ ID NO: 1580886 - RNA, 20 nt, Human adenovirus E
cgugcggugagcgccagcag

SEQ ID NO: 1580887 - RNA, 16 nt, Human adenovirus E
gagacacacuuggaaa

SEQ ID NO: 1580888 - RNA, 20 nt, Human adenovirus E
uggaggaagacugggacagc

SEQ ID NO: 1580889 - RNA, 22 nt, Human adenovirus E
accccauccagguguagguuuc

SEQ ID NO: 1580890 - RNA, 19 nt, Human adenovirus E
cucagcacccagcccgcca

SEQ ID NO: 1580891 - RNA, 14 nt, Human adenovirus E
aacgcgcacaaaaa

SEQ ID NO: 1580892 - RNA, 16 nt, Human adenovirus E
auucgcaagaggcagc

SEQ ID NO: 1580893 - RNA, 19 nt, Human adenovirus E
gccccucagcguggaggag

SEQ ID NO: 1580894 - RNA, 14 nt, Human adenovirus E
gauggccacgggca

SEQ ID NO: 1580895 - RNA, 19 nt, Human adenovirus E
ggucuucgcggugcccgag

SEQ ID NO: 1580896 - RNA, 17 nt, Human adenovirus E
uccacgcgcacauccag

SEQ ID NO: 1580897 - RNA, 17 nt, Human adenovirus E
gugcgcgugcgcgggca

SEQ ID NO: 1580898 - RNA, 22 nt, Human adenovirus E
gcugaacgccuuccucagcacc

SEQ ID NO: 1580899 - RNA, 15 nt, Human adenovirus E
gcucugaaccugccc

SEQ ID NO: 1580900 - RNA, 17 nt, Human adenovirus E
gccgccgcgcaucucca

SEQ ID NO: 1580901 - RNA, 14 nt, Human adenovirus E
cgcucccuggggcg

SEQ ID NO: 1580902 - RNA, 20 nt, Human adenovirus E
caagaugagccgcuggaaga

SEQ ID NO: 1580903 - RNA, 17 nt, Human adenovirus E
uuggacccaggccaugc

SEQ ID NO: 1580904 - RNA, 22 nt, Human adenovirus E
cacggccaccaaggccgccgcc

SEQ ID NO: 1580905 - RNA, 22 nt, Human adenovirus E
caccaacuucaucagcgcccug

SEQ ID NO: 1580906 - RNA, 14 nt, Human adenovirus E
cucggccauccugg

SEQ ID NO: 1580907 - RNA, 19 nt, Human adenovirus E
ggaagaaggaaggcagcga

SEQ ID NO: 1580908 - RNA, 18 nt, Human adenovirus E
gcgccgggcggcaggggc

SEQ ID NO: 1580909 - RNA, 19 nt, Human adenovirus E
cgggaugcgucgccaccac

SEQ ID NO: 1580910 - RNA, 12 nt, Human adenovirus E
ggggcggccagc

SEQ ID NO: 1580911 - RNA, 16 nt, Human adenovirus E
cgugaccuugcagcag

SEQ ID NO: 1580912 - RNA, 13 nt, Human adenovirus E
aagcagcagcagc

SEQ ID NO: 1580913 - RNA, 21 nt, Human adenovirus E
cagcaucaucugggccugguc

SEQ ID NO: 1580914 - RNA, 23 nt, Human adenovirus E
ucgauggugaagaugccgggcag

SEQ ID NO: 1580915 - RNA, 20 nt, Human adenovirus E
ccugcaagacagucuggagg

SEQ ID NO: 1580916 - RNA, 17 nt, Human adenovirus E
acggucaacuccuccuc

SEQ ID NO: 1580917 - RNA, 18 nt, Human adenovirus E
cauggaauacaccacccu

SEQ ID NO: 1580918 - RNA, 13 nt, Human adenovirus E
cggucgcagaaga

SEQ ID NO: 1580919 - RNA, 16 nt, Human adenovirus E
gaggaagacugggaca

SEQ ID NO: 1580920 - RNA, 22 nt, Human adenovirus E
ccgccccuaacggucgcccguc

SEQ ID NO: 1580921 - RNA, 15 nt, Human adenovirus E
aggacccggagacgc

SEQ ID NO: 1580922 - RNA, 19 nt, Human adenovirus E
ccgcagcaguggcagcggc

SEQ ID NO: 1580923 - RNA, 13 nt, Human adenovirus E
agcagcgagcugg

SEQ ID NO: 1580924 - RNA, 17 nt, Human adenovirus E
cacggcguacgagcaga

SEQ ID NO: 1580925 - RNA, 19 nt, Human adenovirus E
gcgcgccgggcggcagggg

SEQ ID NO: 1580926 - RNA, 17 nt, Human adenovirus E
ggaggaugcagcagcug

SEQ ID NO: 1580927 - RNA, 16 nt, Human adenovirus E
cuggccguguugcucu

SEQ ID NO: 1580928 - RNA, 16 nt, Human adenovirus E
cacgccgcaccgcucc

SEQ ID NO: 1580929 - RNA, 15 nt, Human adenovirus E
gccagcacccagacc

SEQ ID NO: 1580930 - RNA, 12 nt, Human adenovirus E
uacggcgcggcc

SEQ ID NO: 1580931 - RNA, 17 nt, Human adenovirus E
cuggagugccugcgccg

SEQ ID NO: 1580932 - RNA, 16 nt, Human adenovirus E
cgagggcguggcugcc

SEQ ID NO: 1580933 - RNA, 16 nt, Human adenovirus E
cgcgcgaggaggugac

SEQ ID NO: 1580934 - RNA, 15 nt, Human adenovirus E
ggaacuacagcaggc

SEQ ID NO: 1580935 - RNA, 18 nt, Human adenovirus E
caugagcucgugucuccg

SEQ ID NO: 1580936 - RNA, 20 nt, Human adenovirus E
uaaucuuaccauugucaaug

SEQ ID NO: 1580937 - RNA, 20 nt, Human adenovirus E
guauccggggaguccagcgc

SEQ ID NO: 1580938 - RNA, 20 nt, Human adenovirus E
cacgugagccgcgcccuggg

SEQ ID NO: 1580939 - RNA, 17 nt, Human adenovirus E
uuugccuucaccaccug

SEQ ID NO: 1580940 - RNA, 18 nt, Human adenovirus E
aaccccaccacccagacc

SEQ ID NO: 1580941 - RNA, 13 nt, Human adenovirus E
gcacucccaguuc

SEQ ID NO: 1580942 - RNA, 19 nt, Human adenovirus E
gacuccguggccuggaggc

SEQ ID NO: 1580943 - RNA, 21 nt, Human adenovirus E
ugcagcgaagagaccccgggu

SEQ ID NO: 1580944 - RNA, 24 nt, Human adenovirus E
gcgaugggcccgugggcggcggcc

SEQ ID NO: 1580945 - RNA, 20 nt, Human adenovirus E
cccguccucuucccacuccc

SEQ ID NO: 1580946 - RNA, 18 nt, Human adenovirus E
cccgggcaaccuggaagc

SEQ ID NO: 1580947 - RNA, 14 nt, Human adenovirus E
cagcaaccugcugg

SEQ ID NO: 1580948 - RNA, 23 nt, Human adenovirus E
acugucuuccggaucgcugucca

SEQ ID NO: 1580949 - RNA, 19 nt, Human adenovirus E
uggcauuguuuuuugcaau

SEQ ID NO: 1580950 - RNA, 21 nt, Human adenovirus E
ccucggacgucaccugcggcg

SEQ ID NO: 1580951 - RNA, 18 nt, Human adenovirus E
ccgguccuuccagggucg

SEQ ID NO: 1580952 - RNA, 16 nt, Human adenovirus E
cacacgcccagcacac

SEQ ID NO: 1580953 - RNA, 19 nt, Human adenovirus E
cuccugcuugcaggccugc

SEQ ID NO: 1580954 - RNA, 16 nt, Human adenovirus E
cguaggugagcucguc

SEQ ID NO: 1580955 - RNA, 21 nt, Human adenovirus E
gacuuggcggauggcuggcag

SEQ ID NO: 1580956 - RNA, 20 nt, Human adenovirus E
cgcgcgcaacaugguagccc

SEQ ID NO: 1580957 - RNA, 21 nt, Human adenovirus E
auaauuuucauuuuuccagcc

SEQ ID NO: 1580958 - RNA, 19 nt, Human adenovirus E
uggugaccguggagcugga

SEQ ID NO: 1580959 - RNA, 19 nt, Human adenovirus E
ugcaggaccacaugcuugg

SEQ ID NO: 1580960 - RNA, 16 nt, Human adenovirus E
ggccaucgugcagaac

SEQ ID NO: 1580961 - RNA, 17 nt, Human adenovirus E
gcggcggagcggcaucu

SEQ ID NO: 1580962 - RNA, 14 nt, Human adenovirus E
gaggagguggaaga

SEQ ID NO: 1580963 - RNA, 20 nt, Human adenovirus E
guacugcggcagaugcgccc

SEQ ID NO: 1580964 - RNA, 16 nt, Human adenovirus E
cagaugaaaagggacg

SEQ ID NO: 1580965 - RNA, 19 nt, Human adenovirus E
ggcugacguccugcaggac

SEQ ID NO: 1580966 - RNA, 20 nt, Human adenovirus E
caauggaggacccaccgcuc

SEQ ID NO: 1580967 - RNA, 12 nt, Human adenovirus E
uauucuggagca

SEQ ID NO: 1580968 - RNA, 18 nt, Human adenovirus E
cggcgggcgcagcagcgc

SEQ ID NO: 1580969 - RNA, 19 nt, Human adenovirus E
cuggccguguugcucuacu

SEQ ID NO: 1580970 - RNA, 13 nt, Human adenovirus E
gcgcaucuccagg

SEQ ID NO: 1580971 - RNA, 17 nt, Human adenovirus E
ccggugccgcccaggac

SEQ ID NO: 1580972 - RNA, 22 nt, Human adenovirus E
ccuuccgcgagugccccccgcc

SEQ ID NO: 1580973 - RNA, 20 nt, Human adenovirus E
ugcaagcgccgcagcagugg

SEQ ID NO: 1580974 - RNA, 22 nt, Human adenovirus E
uaccaccacuacagccuaggcc

SEQ ID NO: 1580975 - RNA, 14 nt, Human adenovirus E
ccuccaccaacgcc

SEQ ID NO: 1580976 - RNA, 17 nt, Human adenovirus E
uccugcacaggcagcaa

SEQ ID NO: 1580977 - RNA, 21 nt, Human adenovirus E
ggagaaagcaagcagcacgga

SEQ ID NO: 1580978 - RNA, 11 nt, Human adenovirus E
cuggacagaaa

SEQ ID NO: 1580979 - RNA, 13 nt, Human adenovirus E
augggccuggccg

SEQ ID NO: 1580980 - RNA, 20 nt, Human adenovirus E
ggcggccuugcgcagggagg

SEQ ID NO: 1580981 - RNA, 17 nt, Human adenovirus E
cauccucgaacgcuccg

SEQ ID NO: 1580982 - RNA, 19 nt, Human adenovirus E
uucacccggcgcuaccugc

SEQ ID NO: 1580983 - RNA, 20 nt, Human adenovirus E
gccaggcgcacguggacgag

SEQ ID NO: 1580984 - RNA, 15 nt, Human adenovirus E
cucgggaucucgccg

SEQ ID NO: 1580985 - RNA, 15 nt, Human adenovirus E
cugaaaguggagcug

SEQ ID NO: 1580986 - RNA, 13 nt, Human adenovirus E
cgugccccagggc

SEQ ID NO: 1580987 - RNA, 15 nt, Human adenovirus E
uggagccacugcuac

SEQ ID NO: 1580988 - RNA, 17 nt, Human adenovirus E
cagccacucucucagac

SEQ ID NO: 1580989 - RNA, 16 nt, Human adenovirus E
ggagagacagcugccg

SEQ ID NO: 1580990 - RNA, 14 nt, Human adenovirus E
ugcucgagugccac

SEQ ID NO: 1580991 - RNA, 17 nt, Human adenovirus E
ccgagacgaugggcagg

SEQ ID NO: 1580992 - RNA, 15 nt, Human adenovirus E
gcgugcgcuccugga

SEQ ID NO: 1580993 - RNA, 19 nt, Human adenovirus E
cuggcccaauugcaagcca

SEQ ID NO: 1580994 - RNA, 19 nt, Human adenovirus E
ugccgaccgcggcgccgcg

SEQ ID NO: 1580995 - RNA, 14 nt, Human adenovirus E
gcgccgggcggcag

SEQ ID NO: 1580996 - RNA, 15 nt, Human adenovirus E
gagcagcagcacaca

SEQ ID NO: 1580997 - RNA, 22 nt, Human adenovirus E
cagagcaucguggugcaggagc

SEQ ID NO: 1580998 - RNA, 13 nt, Human adenovirus E
ggcaccuggagcg

SEQ ID NO: 1580999 - RNA, 15 nt, Human adenovirus E
agcaucaucugggcc

SEQ ID NO: 1581000 - RNA, 15 nt, Human adenovirus E
caggagcugaugcau

SEQ ID NO: 1581001 - RNA, 15 nt, Human adenovirus E
ccugcccgccaccug

SEQ ID NO: 1581002 - RNA, 22 nt, Human adenovirus E
aaugcgcgugcacgaagcccug

SEQ ID NO: 1581003 - RNA, 18 nt, Human adenovirus E
agcagccccaggccaacc

SEQ ID NO: 1581004 - RNA, 12 nt, Human adenovirus E
aaugccaccuca

SEQ ID NO: 1581005 - RNA, 11 nt, Human adenovirus E
guucagccgcc

SEQ ID NO: 1581006 - RNA, 23 nt, Human adenovirus E
ggcauacgugcccaagcagaacc

SEQ ID NO: 1581007 - RNA, 13 nt, Human adenovirus E
auggcaccucucg

SEQ ID NO: 1581008 - RNA, 14 nt, Human adenovirus E
cugacgcuccuggu

SEQ ID NO: 1581009 - RNA, 16 nt, Human adenovirus E
agcgccucggccgcgu

SEQ ID NO: 1581010 - RNA, 14 nt, Human adenovirus E
ggcggcuggggcga

SEQ ID NO: 1581011 - RNA, 17 nt, Human adenovirus E
ucggagagcgaagacga

SEQ ID NO: 1581012 - RNA, 14 nt, Human adenovirus E
ucuacuucaacccc

SEQ ID NO: 1581013 - RNA, 12 nt, Human adenovirus E
accuggccaacc

SEQ ID NO: 1581014 - RNA, 18 nt, Human adenovirus E
ccacggaggccagcaccc

SEQ ID NO: 1581015 - RNA, 22 nt, Human adenovirus E
cugcucaauauauagcccagau

SEQ ID NO: 1581016 - RNA, 20 nt, Human adenovirus E
gaucugacgccucuggguga

SEQ ID NO: 1581017 - RNA, 16 nt, Human adenovirus E
gcacguggacgagcag

SEQ ID NO: 1581018 - RNA, 20 nt, Human adenovirus E
guuaccacuaugcagcucac

SEQ ID NO: 1581019 - RNA, 17 nt, Human adenovirus E
uagcaagaacaggagcu

SEQ ID NO: 1581020 - RNA, 21 nt, Human adenovirus E
acugaacgacaagcuggaaca

SEQ ID NO: 1581021 - RNA, 16 nt, Human adenovirus E
caggacuacuccaccc

SEQ ID NO: 1581022 - RNA, 12 nt, Human adenovirus E
ggcggcggccug

SEQ ID NO: 1581023 - RNA, 17 nt, Human adenovirus E
aggcguacaugccgcag

SEQ ID NO: 1581024 - RNA, 15 nt, Human adenovirus E
uggaagagggcgagg

SEQ ID NO: 1581025 - RNA, 21 nt, Human adenovirus E
gaccugcacuggcagcccagc

SEQ ID NO: 1581026 - RNA, 13 nt, Human adenovirus E
gcagcgagcuggg

SEQ ID NO: 1581027 - RNA, 13 nt, Human adenovirus E
ggcggugcaggcc

SEQ ID NO: 1581028 - RNA, 19 nt, Human adenovirus E
cucaucuccuuugugauuu

SEQ ID NO: 1581029 - RNA, 18 nt, Human adenovirus E
ugcucaggggguccgggu

SEQ ID NO: 1581030 - RNA, 22 nt, Human adenovirus E
agcagcacggauaccaucuccg

SEQ ID NO: 1581031 - RNA, 22 nt, Human adenovirus E
cccugggcauagucgcgccgcg

SEQ ID NO: 1581032 - RNA, 11 nt, Human adenovirus E
gaugaugcuga

SEQ ID NO: 1581033 - RNA, 21 nt, Human adenovirus E
uggggcgugcaggccccgguc

SEQ ID NO: 1581034 - RNA, 14 nt, Human adenovirus E
agcaucuggcccgg

SEQ ID NO: 1581035 - RNA, 15 nt, Human adenovirus E
gagaagccccugggg

SEQ ID NO: 1581036 - RNA, 16 nt, Human adenovirus E
gaacgagccggcgcaa

SEQ ID NO: 1581037 - RNA, 14 nt, Human adenovirus E
uccugcacaggcag

SEQ ID NO: 1581038 - RNA, 20 nt, Human adenovirus E
acgagcagaccuaccaggag

SEQ ID NO: 1581039 - RNA, 21 nt, Human adenovirus E
acuuggcgguggggcggcaga

SEQ ID NO: 1581040 - RNA, 21 nt, Human adenovirus E
  misc_feature (5)..(5): n is a, c, g or u
agcunuuccaacccuuccucc

SEQ ID NO: 1581041 - RNA, 18 nt, Human adenovirus E
gugcggugagcgccagca

SEQ ID NO: 1581042 - RNA, 18 nt, Human adenovirus E
gcugccgaccgcggcgcc

SEQ ID NO: 1581043 - RNA, 21 nt, Human adenovirus E
gcaacauccccgcgcuccugg

SEQ ID NO: 1581044 - RNA, 13 nt, Human adenovirus E
cgcuuacagccug

SEQ ID NO: 1581045 - RNA, 20 nt, Human adenovirus E
cgaacgggaucggccggugg

SEQ ID NO: 1581046 - RNA, 18 nt, Human adenovirus E
cuaccgucaccuccacag

SEQ ID NO: 1581047 - RNA, 17 nt, Human adenovirus E
agcagaaaaccagcagc

SEQ ID NO: 1581048 - RNA, 14 nt, Human adenovirus E
acgccugcugggcc

SEQ ID NO: 1581049 - RNA, 14 nt, Human adenovirus E
cuggcagcccagcc

SEQ ID NO: 1581050 - RNA, 23 nt, Human adenovirus E
uccaccagcggguccaccuuuuc

SEQ ID NO: 1581051 - RNA, 23 nt, Human adenovirus E
agcggcuggugauccggggcaga

SEQ ID NO: 1581052 - RNA, 20 nt, Human adenovirus E
caggacgacccgggcaaccu

SEQ ID NO: 1581053 - RNA, 16 nt, Human adenovirus E
ucagcaucagucgucu

SEQ ID NO: 1581054 - RNA, 15 nt, Human adenovirus E
uggcagcccagccgc

SEQ ID NO: 1581055 - RNA, 21 nt, Human adenovirus E
agccccguccucuucccacuc

SEQ ID NO: 1581056 - RNA, 12 nt, Human adenovirus E
acgacagcagcg

SEQ ID NO: 1581057 - RNA, 19 nt, Human adenovirus E
guagucaaauacuggccac

SEQ ID NO: 1581058 - RNA, 18 nt, Human adenovirus E
ugaccaccguggugcaga

SEQ ID NO: 1581059 - RNA, 19 nt, Human adenovirus E
gcagcagugucuggaggag

SEQ ID NO: 1581060 - RNA, 22 nt, Human adenovirus E
gcgcucgccaacgcuccacgca

SEQ ID NO: 1581061 - RNA, 19 nt, Human adenovirus E
ggucucggcauggcccgcg

SEQ ID NO: 1581062 - RNA, 15 nt, Human adenovirus E
gacacaccaccacag

SEQ ID NO: 1581063 - RNA, 14 nt, Human adenovirus E
cacacacgcccagc

SEQ ID NO: 1581064 - RNA, 19 nt, Human adenovirus E
aaguugaaaaacugggagu

SEQ ID NO: 1581065 - RNA, 17 nt, Human adenovirus E
gaugcagcccccgcugg

SEQ ID NO: 1581066 - RNA, 15 nt, Human adenovirus E
aggacaaaaaggaag

SEQ ID NO: 1581067 - RNA, 14 nt, Human adenovirus E
ucggcguuggccau

SEQ ID NO: 1581068 - RNA, 17 nt, Human adenovirus E
aaccccaccagcaagcc

SEQ ID NO: 1581069 - RNA, 16 nt, Human adenovirus E
cccaauggcaccugcg

SEQ ID NO: 1581070 - RNA, 23 nt, Human adenovirus E
gggggacaaagguacccucgauc

SEQ ID NO: 1581071 - RNA, 21 nt, Human adenovirus E
cugcgcccccguaucgggcgc

SEQ ID NO: 1581072 - RNA, 21 nt, Human adenovirus E
cggaggcgacgggcucucgcc

SEQ ID NO: 1581073 - RNA, 17 nt, Human adenovirus E
gcaucucuucagcacuc

SEQ ID NO: 1581074 - RNA, 16 nt, Human adenovirus E
gcggcgcacgggcaga

SEQ ID NO: 1581075 - RNA, 15 nt, Human adenovirus E
ccaacguggagcuga

SEQ ID NO: 1581076 - RNA, 19 nt, Human adenovirus E
caugguggucccgugcagg

SEQ ID NO: 1581077 - RNA, 22 nt, Human adenovirus E
caggcuuucaagaacuugcagg

SEQ ID NO: 1581078 - RNA, 19 nt, Human adenovirus E
cccaugguggcgcagcuga

SEQ ID NO: 1581079 - RNA, 15 nt, Human adenovirus E
cccauccgcccaagg

SEQ ID NO: 1581080 - RNA, 12 nt, Human adenovirus E
ccauagccagcc

SEQ ID NO: 1581081 - RNA, 21 nt, Human adenovirus E
cccaggccgaaguccagcuga

SEQ ID NO: 1581082 - RNA, 15 nt, Human adenovirus E
cccgcuggaccacgg

SEQ ID NO: 1581083 - RNA, 13 nt, Human adenovirus E
cgcuguccacgag

SEQ ID NO: 1581084 - RNA, 16 nt, Human adenovirus E
cacgaagcccugcagg

SEQ ID NO: 1581085 - RNA, 22 nt, Human adenovirus E
ccuccacuuccucuucuuccuc

SEQ ID NO: 1581086 - RNA, 19 nt, Human adenovirus E
ccucagcaugaugcccacg

SEQ ID NO: 1581087 - RNA, 19 nt, Human adenovirus E
ccucagggcccggcccacg

SEQ ID NO: 1581088 - RNA, 21 nt, Human adenovirus E
cguugauguuguggcccacga

SEQ ID NO: 1581089 - RNA, 23 nt, Human adenovirus E
cguugauguuguggcccacgaug

SEQ ID NO: 1581090 - RNA, 20 nt, Human adenovirus E
cguucucuccagcaccaggc

SEQ ID NO: 1581091 - RNA, 17 nt, Human adenovirus E
ccgcagcuugcccucgg

SEQ ID NO: 1581092 - RNA, 13 nt, Human adenovirus E
gaggagcccgagg

SEQ ID NO: 1581093 - RNA, 16 nt, Human adenovirus E
gaggauuguccucggu

SEQ ID NO: 1581094 - RNA, 21 nt, Human adenovirus E
ccgguggcacgacaggcagcg

SEQ ID NO: 1581095 - RNA, 16 nt, Human adenovirus E
cacagaaccaccaggu

SEQ ID NO: 1581096 - RNA, 17 nt, Human adenovirus E
acugacgccagacgccg

SEQ ID NO: 1581097 - RNA, 11 nt, Human adenovirus E
cagagccagcc

SEQ ID NO: 1581098 - RNA, 17 nt, Human adenovirus E
cacggcguacgagcaga

SEQ ID NO: 1581099 - RNA, 14 nt, Human adenovirus E
ccacgugagccgcg

SEQ ID NO: 1581100 - RNA, 20 nt, Human adenovirus E
ccagcaugucccgcccgcgg

SEQ ID NO: 1581101 - RNA, 21 nt, Human adenovirus E
ccagcaggcggcgcgagcuga

SEQ ID NO: 1581102 - RNA, 14 nt, Human adenovirus E
ccuggcgccuacgg

SEQ ID NO: 1581103 - RNA, 23 nt, Human adenovirus E
ccugggcuaugugacgcccgcgg

SEQ ID NO: 1581104 - RNA, 17 nt, Human adenovirus E
caugcuuggucuugcgg

SEQ ID NO: 1581105 - RNA, 20 nt, Human adenovirus E
cagucgccagggcuugcaga

SEQ ID NO: 1581106 - RNA, 13 nt, Human adenovirus E
augcaagacccgg

SEQ ID NO: 1581107 - RNA, 14 nt, Human adenovirus E
cuucacccccacgg

SEQ ID NO: 1581108 - RNA, 19 nt, Human adenovirus E
cuuccgcgagacgcccagg

SEQ ID NO: 1581109 - RNA, 17 nt, Human adenovirus E
cucggcauggcccgcgg

SEQ ID NO: 1581110 - RNA, 18 nt, Human adenovirus E
gcagcguccgcgucaggg

SEQ ID NO: 1581111 - RNA, 21 nt, Human adenovirus E
gcaugcggaucucgcucaggu

SEQ ID NO: 1581112 - RNA, 17 nt, Human adenovirus E
guacccucgaucccggg

SEQ ID NO: 1581113 - RNA, 16 nt, Human adenovirus E
guaagcagugcucagg

SEQ ID NO: 1581114 - RNA, 15 nt, Human adenovirus E
gccgcgguccuccuc

SEQ ID NO: 1581115 - RNA, 14 nt, Human adenovirus E
gcggccagacgcgc

SEQ ID NO: 1581116 - RNA, 15 nt, Human adenovirus E
ccaaggccgagcugu

SEQ ID NO: 1581117 - RNA, 20 nt, Human adenovirus E
caucaagcagguggccccgg

SEQ ID NO: 1581118 - RNA, 16 nt, Human adenovirus E
cauaggaccaccagga

SEQ ID NO: 1581119 - RNA, 15 nt, Human adenovirus E
cauccgcgcccaccg

SEQ ID NO: 1581120 - RNA, 17 nt, Human adenovirus E
aggacccggagacgcgc

SEQ ID NO: 1581121 - RNA, 14 nt, Human adenovirus E
aguucaaggcgcgg

SEQ ID NO: 1581122 - RNA, 14 nt, Human adenovirus E
aguuggcuuucagg

SEQ ID NO: 1581123 - RNA, 19 nt, Human adenovirus E
accugcacuaccucuucag

SEQ ID NO: 1581124 - RNA, 14 nt, Human adenovirus E
gccccucguccauc

SEQ ID NO: 1581125 - RNA, 19 nt, Human adenovirus E
gaauaucaccgagcccgag

SEQ ID NO: 1581126 - RNA, 13 nt, Human adenovirus E
ucaacuccucggg

SEQ ID NO: 1581127 - RNA, 14 nt, Human adenovirus E
guucgugcccgagg

SEQ ID NO: 1581128 - RNA, 13 nt, Human adenovirus E
ugaccucgucggg

SEQ ID NO: 1581129 - RNA, 20 nt, Human adenovirus E
uggaccuggugaacauucug

SEQ ID NO: 1581130 - RNA, 16 nt, Human adenovirus E
gucccugcucguccuc

SEQ ID NO: 1581131 - RNA, 17 nt, Human adenovirus E
guccagcgcagccaggg

SEQ ID NO: 1581132 - RNA, 20 nt, Human adenovirus E
gucauagcaggggcgcaggg

SEQ ID NO: 1581133 - RNA, 22 nt, Human adenovirus E
guccagagauccacggccaggg

SEQ ID NO: 1581134 - RNA, 15 nt, Human adenovirus E
gggccgguccucgag

SEQ ID NO: 1581135 - RNA, 16 nt, Human adenovirus E
gggccucgugcucggg

SEQ ID NO: 1581136 - RNA, 23 nt, Human adenovirus E
cucgcgguggggcggccagcuga

SEQ ID NO: 1581137 - RNA, 22 nt, Human adenovirus E
ccggcgcaaacccgggagcuga

SEQ ID NO: 1581138 - RNA, 14 nt, Human adenovirus E
cgcgcuccacggug

SEQ ID NO: 1581139 - RNA, 15 nt, Human adenovirus E
ccgcgcugcccucgg

SEQ ID NO: 1581140 - RNA, 17 nt, Human adenovirus E
ccgcgccuacgaguuga

SEQ ID NO: 1581141 - RNA, 22 nt, Human adenovirus E
ccgcggccggcgcgcuccacgg

SEQ ID NO: 1581142 - RNA, 16 nt, Human adenovirus E
uagcugaagcccacgg

SEQ ID NO: 1581143 - RNA, 19 nt, Human adenovirus E
guggaccucgauuccucgg

SEQ ID NO: 1581144 - RNA, 21 nt, Human adenovirus E
guggacguuuagagccucggg

SEQ ID NO: 1581145 - RNA, 17 nt, Human adenovirus E
guggucagcucgucggg

SEQ ID NO: 1581146 - RNA, 19 nt, Human adenovirus E
gccaggccugcaagaucuc

SEQ ID NO: 1581147 - RNA, 19 nt, Human adenovirus E
cgucgccggcggcgcacgg

SEQ ID NO: 1581148 - RNA, 16 nt, Human adenovirus E
cucuucugccucgaug

SEQ ID NO: 1581149 - RNA, 18 nt, Human adenovirus E
gucaagcugcugcucagg

SEQ ID NO: 1581150 - RNA, 21 nt, Human adenovirus E
guagaccacgacgcccucggg

SEQ ID NO: 1581151 - RNA, 14 nt, Human adenovirus E
gugagcucgucggg

SEQ ID NO: 1581152 - RNA, 23 nt, Human adenovirus E
gugcaaccggugcugagacccgg

SEQ ID NO: 1581153 - RNA, 23 nt, Human adenovirus E
gugacggcgcgcccguccucgcg

SEQ ID NO: 1581154 - RNA, 19 nt, Human adenovirus E
gucuucgcggugcccgagg

SEQ ID NO: 1581155 - RNA, 22 nt, Human adenovirus E
gcugccgcggcggugcccgagg

SEQ ID NO: 1581156 - RNA, 20 nt, Human adenovirus E
gccgccagaccgucguccuc

SEQ ID NO: 1581157 - RNA, 23 nt, Human adenovirus E
gccgagacggucaacuccuccuc

SEQ ID NO: 1581158 - RNA, 22 nt, Human adenovirus E
gccuacuuugagcugcccgagg

SEQ ID NO: 1581159 - RNA, 17 nt, Human adenovirus E
gccgccagcuccuccuc

SEQ ID NO: 1581160 - RNA, 18 nt, Human adenovirus E
acgauguggacagcagcg

SEQ ID NO: 1581161 - RNA, 19 nt, Human adenovirus E
accgugaaccugagccagg

SEQ ID NO: 1581162 - RNA, 18 nt, Human adenovirus E
acaguauccgcagcagcg

SEQ ID NO: 1581163 - RNA, 20 nt, Human adenovirus E
accaagaacggggaaaucac

SEQ ID NO: 1581164 - RNA, 22 nt, Human adenovirus E
accaaggccauggcgaccagcg

SEQ ID NO: 1581165 - RNA, 22 nt, Human adenovirus E
ccgaagggggucaucuugcagg

SEQ ID NO: 1581166 - RNA, 22 nt, Human adenovirus E
cccagcaagauguacggaggcg

SEQ ID NO: 1581167 - RNA, 12 nt, Human adenovirus E
cccagcccacga

SEQ ID NO: 1581168 - RNA, 16 nt, Human adenovirus E
cccacggagcccaugg

SEQ ID NO: 1581169 - RNA, 20 nt, Human adenovirus E
ccucugggugaaggccacgg

SEQ ID NO: 1581170 - RNA, 18 nt, Human adenovirus E
ccucguaaaaguccacgg

SEQ ID NO: 1581171 - RNA, 22 nt, Human adenovirus E
ccucgcgcucgaaggcccccgg

SEQ ID NO: 1581172 - RNA, 20 nt, Human adenovirus E
cgcggcuguagaccacgacg

SEQ ID NO: 1581173 - RNA, 17 nt, Human adenovirus E
cgaggcggacgagcuga

SEQ ID NO: 1581174 - RNA, 16 nt, Human adenovirus E
cgcacggucgagcuga

SEQ ID NO: 1581175 - RNA, 18 nt, Human adenovirus E
cgcacguggacgagcaga

SEQ ID NO: 1581176 - RNA, 16 nt, Human adenovirus E
cgcagcagcgagcugg

SEQ ID NO: 1581177 - RNA, 18 nt, Human
cguguccccugacagggc

SEQ ID NO: 1581178 - RNA, 16 nt, Human
cguguccccugacagg

SEQ ID NO: 1581179 - RNA, 19 nt, Human
cguguccccugacagggcc

SEQ ID NO: 1581180 - RNA, 14 nt, Human
ccccgagggcugag

SEQ ID NO: 1581181 - RNA, 21 nt, Human
ccccgagggcugagccugguc

SEQ ID NO: 1581182 - RNA, 19 nt, Human
ccccgagggcugagccugg

SEQ ID NO: 1581183 - RNA, 16 nt, Human
ccccugacagggccag

SEQ ID NO: 1581184 - RNA, 17 nt, Human
ccgaagcccaggggccg

SEQ ID NO: 1581185 - RNA, 16 nt, Human
ccgaagcccaggggcc

SEQ ID NO: 1581186 - RNA, 15 nt, Human
ccgaagcccaggggc

SEQ ID NO: 1581187 - RNA, 14 nt, Human
ccuggaugcccagg

SEQ ID NO: 1581188 - RNA, 15 nt, Human
caggaccccagcucu

SEQ ID NO: 1581189 - RNA, 17 nt, Human
caggaccccagcucugc

SEQ ID NO: 1581190 - RNA, 16 nt, Human
caggaccccagcucug

SEQ ID NO: 1581191 - RNA, 18 nt, Human
caggaccccagcucugcg

SEQ ID NO: 1581192 - RNA, 21 nt, Human
caggagggaggcaggggaggg

SEQ ID NO: 1581193 - RNA, 15 nt, Human
caggagggaggcagg

SEQ ID NO: 1581194 - RNA, 22 nt, Human
caggguguggggccaugccucc

SEQ ID NO: 1581195 - RNA, 17 nt, Human
caggguguggggccaug

SEQ ID NO: 1581196 - RNA, 16 nt, Human
caggguguggggccau

SEQ ID NO: 1581197 - RNA, 16 nt, Human
ccacgagggugccgug

SEQ ID NO: 1581198 - RNA, 21 nt, Human
caugucaagagucgcugugcc

SEQ ID NO: 1581199 - RNA, 19 nt, Human
caugucaagagucgcugug

SEQ ID NO: 1581200 - RNA, 14 nt, Human
caugcaccacgggc

SEQ ID NO: 1581201 - RNA, 18 nt, Human
cacaggcuuagggacagg

SEQ ID NO: 1581202 - RNA, 22 nt, Human
cacaggcuuagggacaggaccc

SEQ ID NO: 1581203 - RNA, 19 nt, Human
cacaggcuuagggacagga

SEQ ID NO: 1581204 - RNA, 16 nt, Human
ggggccggccaguggc

SEQ ID NO: 1581205 - RNA, 16 nt, Human
gguccugcagccugca

SEQ ID NO: 1581206 - RNA, 15 nt, Human
gguccugcagccugc

SEQ ID NO: 1581207 - RNA, 15 nt, Human
aaauauuauaacuca

SEQ ID NO: 1581208 - RNA, 17 nt, Human
ggacaggaccccagcuc

SEQ ID NO: 1581209 - RNA, 16 nt, Human
ggacaggaccccagcu

SEQ ID NO: 1581210 - RNA, 15 nt, Human
ggacaggaccccagc

SEQ ID NO: 1581211 - RNA, 14 nt, Human
ggacaggaccccag

SEQ ID NO: 1581212 - RNA, 20 nt, Human
ggacaggaccccagcucugc

SEQ ID NO: 1581213 - RNA, 18 nt, Human
ggacaggaccccagcucu

SEQ ID NO: 1581214 - RNA, 21 nt, Human
ggacaggaccccagcucugcg

SEQ ID NO: 1581215 - RNA, 22 nt, Human
cuuagggacaggaccccagcuc

SEQ ID NO: 1581216 - RNA, 21 nt, Human
cuuagggacaggaccccagcu

SEQ ID NO: 1581217 - RNA, 23 nt, Human
cuuagggacaggaccccagcucu

SEQ ID NO: 1581218 - RNA, 20 nt, Human
cuuagggacaggaccccagc

SEQ ID NO: 1581219 - RNA, 18 nt, Human
cuuagggacaggacccca

SEQ ID NO: 1581220 - RNA, 14 nt, Human
guccugcagccugc

SEQ ID NO: 1581221 - RNA, 10 nt, Human
guccugcagc

SEQ ID NO: 1581222 - RNA, 16 nt, Human
aagaaaaguuuaccau

SEQ ID NO: 1581223 - RNA, 21 nt, Human
aagauguagcgcuuugaauau

SEQ ID NO: 1581224 - RNA, 17 nt, Human
gugugaggguccugcag

SEQ ID NO: 1581225 - RNA, 14 nt, Human
aaguuuaccaucug

SEQ ID NO: 1581226 - RNA, 19 nt, Human
aaguuagaacauuugcugu

SEQ ID NO: 1581227 - RNA, 24 nt, Human
guuuuuggaugguguuacauauua

SEQ ID NO: 1581228 - RNA, 12 nt, Human
aaggagcaucua

SEQ ID NO: 1581229 - RNA, 21 nt, Human
guugggucaccagacggggcu

SEQ ID NO: 1581230 - RNA, 14 nt, Human
guugggucaccaga

SEQ ID NO: 1581231 - RNA, 22 nt, Human
aauuuacccucuugaauauaau

SEQ ID NO: 1581232 - RNA, 19 nt, Human
aauuuacccucuugaauau

SEQ ID NO: 1581233 - RNA, 17 nt, Human
aauuuaucaguaccuaa

SEQ ID NO: 1581234 - RNA, 19 nt, Human
uauagauugaaauuuccua

SEQ ID NO: 1581235 - RNA, 16 nt, Human
uauggccgggcagggu

SEQ ID NO: 1581236 - RNA, 13 nt, Human
uauuucauuuauu

SEQ ID NO: 1581237 - RNA, 18 nt, Human
ucauuugacuaagagucu

SEQ ID NO: 1581238 - RNA, 18 nt, Human
accgacguugccaucaaa

SEQ ID NO: 1581239 - RNA, 11 nt, Human
ugagccugguc

SEQ ID NO: 1581240 - RNA, 19 nt, Human
ugaggguccugcagccugc

SEQ ID NO: 1581241 - RNA, 18 nt, Human
ugaggguccugcagccug

SEQ ID NO: 1581242 - RNA, 15 nt, Human
ugaggguccugcagc

SEQ ID NO: 1581243 - RNA, 14 nt, Human
ugaggguccugcag

SEQ ID NO: 1581244 - RNA, 22 nt, Human
ugaggguccugcagccugcagg

SEQ ID NO: 1581245 - RNA, 21 nt, Human
ugaggguccugcagccugcag

SEQ ID NO: 1581246 - RNA, 23 nt, Human
ugaggguccugcagccugcagga

SEQ ID NO: 1581247 - RNA, 14 nt, Human
agagucgcugugcc

SEQ ID NO: 1581248 - RNA, 19 nt, Human
agagucgcugugccacagg

SEQ ID NO: 1581249 - RNA, 15 nt, Human
agagucgcugugcca

SEQ ID NO: 1581250 - RNA, 14 nt, Human
ugaauauaaucccu

SEQ ID NO: 1581251 - RNA, 22 nt, Human
ucuggucuaaauuguguuacua

SEQ ID NO: 1581252 - RNA, 21 nt, Human
agccugcaggaccucgugcca

SEQ ID NO: 1581253 - RNA, 20 nt, Human
agccugcaggaccucgugcc

SEQ ID NO: 1581254 - RNA, 21 nt, Human
ugcaguuugguguguccuccg

SEQ ID NO: 1581255 - RNA, 22 nt, Human
agcucugcgucgguccuggugc

SEQ ID NO: 1581256 - RNA, 23 nt, Human
agcucugcgucgguccuggugcc

SEQ ID NO: 1581257 - RNA, 17 nt, Human
agggcugagccuggucc

SEQ ID NO: 1581258 - RNA, 16 nt, Human
agggcugagccugguc

SEQ ID NO: 1581259 - RNA, 13 nt, Human
agggacuuagcaa

SEQ ID NO: 1581260 - RNA, 18 nt, Human
agucgcugugccacaggc

SEQ ID NO: 1581261 - RNA, 18 nt, Human
uguccccugacagggcca

SEQ ID NO: 1581262 - RNA, 16 nt, Human
uguccccugacagggc

SEQ ID NO: 1581263 - RNA, 15 nt, Human
uguccccugacaggg

SEQ ID NO: 1581264 - RNA, 19 nt, Human
agugugaggguccugcagc

SEQ ID NO: 1581265 - RNA, 16 nt, Human
aguuuaccaucugaaa

SEQ ID NO: 1581266 - RNA, 12 nt, Human
aguuuaccaucu

SEQ ID NO: 1581267 - RNA, 21 nt, Human
aguuuugugaaggugauuuau

SEQ ID NO: 1581268 - RNA, 19 nt, Human
auaacucauuuguuguuug

SEQ ID NO: 1581269 - RNA, 17 nt, Human
auaaucaaauacauuuu

SEQ ID NO: 1581270 - RNA, 22 nt, Human
uugacacuuauagauugaaauu

SEQ ID NO: 1581271 - RNA, 13 nt, Human
uugauuauaaagu

SEQ ID NO: 1581272 - RNA, 18 nt, Human
auccuaaauuuacccucu

SEQ ID NO: 1581273 - RNA, 16 nt, Human
auauuuuuuaucauaa

SEQ ID NO: 1581274 - RNA, 18 nt, Human
augccuccucaggagccg

SEQ ID NO: 1581275 - RNA, 14 nt, Human
augccuccucagga

SEQ ID NO: 1581276 - RNA, 15 nt, Human
augccuccucaggag

SEQ ID NO: 1581277 - RNA, 13 nt, Human
augccuccucagg

SEQ ID NO: 1581278 - RNA, 21 nt, Human
auguagcgcuuugaauaugaa

SEQ ID NO: 1581279 - RNA, 19 nt, Human
auguagcgcuuugaauaug

SEQ ID NO: 1581280 - RNA, 18 nt, Human
uuugugaaggugauuuau

SEQ ID NO: 1581281 - RNA, 14 nt, Human
augguguuacauau

SEQ ID NO: 1581282 - RNA, 22 nt, Human
auugguuuuccaaucauuugac

SEQ ID NO: 1581283 - RNA, 22 nt, Human
aauauuauaacucauuuguugu

SEQ ID NO: 1581284 - RNA, 16 nt, Human
agggacaggaccccag

SEQ ID NO: 1581285 - RNA, 13 nt, Human
agggacaggaccc

SEQ ID NO: 1581286 - RNA, 18 nt, Human
agggacaggaccccagcu

SEQ ID NO: 1581287 - RNA, 17 nt, Human
agggacaggaccccagc

SEQ ID NO: 1581288 - RNA, 19 nt, Human
aguggccuuccccagcaug

SEQ ID NO: 1581289 - RNA, 18 nt, Human
aguggccuuccccagcau

SEQ ID NO: 1581290 - RNA, 13 nt, Human
caaauacauuuua

SEQ ID NO: 1581291 - RNA, 15 nt, Human
caccccgagggcuga

SEQ ID NO: 1581292 - RNA, 19 nt, Human
ccaguggccuuccccagca

SEQ ID NO: 1581293 - RNA, 17 nt, Human
ccaguggccuuccccag

SEQ ID NO: 1581294 - RNA, 23 nt, Human
ccagugcaguuugguguguccuc

SEQ ID NO: 1581295 - RNA, 15 nt, Human
ccgggcagggugugg

SEQ ID NO: 1581296 - RNA, 16 nt, Human
cgaagcccaggggccg

SEQ ID NO: 1581297 - RNA, 13 nt, Human
cggaauauauuuu

SEQ ID NO: 1581298 - RNA, 15 nt, Human
cgcugugccacaggc

SEQ ID NO: 1581299 - RNA, 11 nt, Human
cuaaaaacaua

SEQ ID NO: 1581300 - RNA, 14 nt, Human
cuaaauuuuaagug

SEQ ID NO: 1581301 - RNA, 21 nt, Human
cucaggagccgaagcccaggg

SEQ ID NO: 1581302 - RNA, 23 nt, Human
cucaggagccgaagcccaggggc

SEQ ID NO: 1581303 - RNA, 22 nt, Human
cuguauauauuuauggccgggc

SEQ ID NO: 1581304 - RNA, 13 nt, Human
cugugccacaggc

SEQ ID NO: 1581305 - RNA, 20 nt, Human
gacaggaccccagcucugcg

SEQ ID NO: 1581306 - RNA, 18 nt, Human
gacaggaccccagcucug

SEQ ID NO: 1581307 - RNA, 17 nt, Human
gacaggaccccagcucu

SEQ ID NO: 1581308 - RNA, 16 nt, Human
gacaggaccccagcuc

SEQ ID NO: 1581309 - RNA, 15 nt, Human
gacaggaccccagcu

SEQ ID NO: 1581310 - RNA, 14 nt, Human
gacaggaccccagc

SEQ ID NO: 1581311 - RNA, 19 nt, Human
gacaggaccccagcucugc

SEQ ID NO: 1581312 - RNA, 22 nt, Human
gaggggugcggcggucccagcu

SEQ ID NO: 1581313 - RNA, 19 nt, Human
gaggggugcggcgguccca

SEQ ID NO: 1581314 - RNA, 23 nt, Human
gagggugccguguccccugacag

SEQ ID NO: 1581315 - RNA, 18 nt, Human
gaggguccugcagccugc

SEQ ID NO: 1581316 - RNA, 21 nt, Human
gaggguccugcagccugcagg

SEQ ID NO: 1581317 - RNA, 17 nt, Human
gaggguccugcagccug

SEQ ID NO: 1581318 - RNA, 13 nt, Human
gaggguccugcag

SEQ ID NO: 1581319 - RNA, 20 nt, Human
gcccuggaugcccaggaauc

SEQ ID NO: 1581320 - RNA, 20 nt, Human
gcucugcgucgguccuggug

SEQ ID NO: 1581321 - RNA, 21 nt, Human
gcucugcgucgguccuggugc

SEQ ID NO: 1581322 - RNA, 23 nt, Human
gcuuagggacaggaccccagcuc

SEQ ID NO: 1581323 - RNA, 22 nt, Human
gcuuagggacaggaccccagcu

SEQ ID NO: 1581324 - RNA, 23 nt, Human
guacaguugcuguugugugauca

SEQ ID NO: 1581325 - RNA, 21 nt, Human
gguuuuccaaucauuugacua

SEQ ID NO: 1581326 - RNA, 19 nt, Human
ggugcggcggucccagcuc

SEQ ID NO: 1581327 - RNA, 20 nt, Human
ggugcccuggaugcccagga

SEQ ID NO: 1581328 - RNA, 19 nt, Human
ggugcccuggaugcccagg

SEQ ID NO: 1581329 - RNA, 18 nt, Human
ggugcccuggaugcccag

SEQ ID NO: 1581330 - RNA, 15 nt, Human
ggugcccuggaugcc

SEQ ID NO: 1581331 - RNA, 15 nt, Human
ggucccagcucccug

SEQ ID NO: 1581332 - RNA, 14 nt, Human
ggucccagcucccu

SEQ ID NO: 1581333 - RNA, 12 nt, Human
ggucccagcucc

SEQ ID NO: 1581334 - RNA, 20 nt, Human
ggucccagcucccuggcucc

SEQ ID NO: 1581335 - RNA, 13 nt, Human
gggcugagccugg

SEQ ID NO: 1581336 - RNA, 23 nt, Human
gggcugagccuggucccacgagg

SEQ ID NO: 1581337 - RNA, 15 nt, Human
gggcugagccugguc

SEQ ID NO: 1581338 - RNA, 22 nt, Human
gggcccggguugggucaccaga

SEQ ID NO: 1581339 - RNA, 21 nt, Human
gggcccggguugggucaccag

SEQ ID NO: 1581340 - RNA, 19 nt, Human
ggggugcggcggucccagc

SEQ ID NO: 1581341 - RNA, 11 nt, Human
gucccagcucc

SEQ ID NO: 1581342 - RNA, 18 nt, Human
guccuccgccuuaccagg

SEQ ID NO: 1581343 - RNA, 23 nt, Human
guccuggugcccuggaugcccag

SEQ ID NO: 1581344 - RNA, 20 nt, Human
guccuggugcccuggaugcc

SEQ ID NO: 1581345 - RNA, 12 nt, Human
guccuggugccc

SEQ ID NO: 1581346 - RNA, 11 nt, Human
guccuggugcc

SEQ ID NO: 1581347 - RNA, 15 nt, Human
gucccagcucccugg

SEQ ID NO: 1581348 - RNA, 18 nt, Human
gugcccuggaugcccagg

SEQ ID NO: 1581349 - RNA, 19 nt, Human
gugcccuggaugcccagga

SEQ ID NO: 1581350 - RNA, 19 nt, Human
ucaccagacggggcuggag

SEQ ID NO: 1581351 - RNA, 15 nt, Human
ucaccagacggggcu

SEQ ID NO: 1581352 - RNA, 17 nt, Human
uauuauauguucuagaa

SEQ ID NO: 1581353 - RNA, 14 nt, Human
uauuauauguucua

SEQ ID NO: 1581354 - RNA, 20 nt, Human
uccccagcaugcaccacggg

SEQ ID NO: 1581355 - RNA, 19 nt, Human
uccccagcaugcaccacgg

SEQ ID NO: 1581356 - RNA, 21 nt, Human
uccccagcaugcaccacgggc

SEQ ID NO: 1581357 - RNA, 19 nt, Human
uccgccuuaccaggagaag

SEQ ID NO: 1581358 - RNA, 16 nt, Human
ucuaucagauuaaguu

SEQ ID NO: 1581359 - RNA, 13 nt, Human
ugccuccucagga

SEQ ID NO: 1581360 - RNA, 12 nt, Human
ugccuccucagg

SEQ ID NO: 1581361 - RNA, 16 nt, Human
ugccuccucaggagcc

SEQ ID NO: 1581362 - RNA, 19 nt, Human
ugggucaccagacggggcu

SEQ ID NO: 1581363 - RNA, 20 nt, Human
ugggucaccagacggggcug

SEQ ID NO: 1581364 - RNA, 20 nt, Human
uuauugguuuuccaaucauu

SEQ ID NO: 1581365 - RNA, 16 nt, Human
uuauggccgggcaggg

SEQ ID NO: 1581366 - RNA, 13 nt, Human
uuuccuaauuuau

SEQ ID NO: 1581367 - RNA, 21 nt, Human
uuuacccucuugaauauaauc

SEQ ID NO: 1581368 - RNA, 13 nt, Human
uuuaccaucugaa

SEQ ID NO: 1581369 - RNA, 14 nt, Human
uuuaccaucugaaa

SEQ ID NO: 1581370 - RNA, 13 nt, Human
uuguuugguuaua

SEQ ID NO: 1581371 - RNA, 18 nt, Human
uucuaagucauucauaaa

SEQ ID NO: 1581372 - RNA, 14 nt, Human
aaaaauuuuuguuu

SEQ ID NO: 1581373 - RNA, 13 nt, Human
aaaaauuuuuguu

SEQ ID NO: 1581374 - RNA, 15 nt, Human
accccgagggcugag

SEQ ID NO: 1581375 - RNA, 13 nt, Human
agacggggcugga

SEQ ID NO: 1581376 - RNA, 15 nt, Human
agcaugcaccacggg

SEQ ID NO: 1581377 - RNA, 17 nt, Human
aggaccccagcucugcg

SEQ ID NO: 1581378 - RNA, 16 nt, Human
aggaccccagcucugc

SEQ ID NO: 1581379 - RNA, 14 nt, Human
aggaccccagcucu

SEQ ID NO: 1581380 - RNA, 13 nt, Human
aggaccccagcuc

SEQ ID NO: 1581381 - RNA, 14 nt, Human
aggaccucgugcca

SEQ ID NO: 1581382 - RNA, 17 nt, Human
cuaauuuauucuaaauu

SEQ ID NO: 1581383 - RNA, 16 nt, Human
ccugcagccugcagga

SEQ ID NO: 1581384 - RNA, 19 nt, Human
ccucaggagccgaagccca

SEQ ID NO: 1581385 - RNA, 12 nt, Human
ccucaggagccg

SEQ ID NO: 1581386 - RNA, 21 nt, Human
ccucaggagccgaagcccagg

SEQ ID NO: 1581387 - RNA, 22 nt, Human
ccaggagggaggcaggggaggg

SEQ ID NO: 1581388 - RNA, 15 nt, Human
ccaggagggaggcag

SEQ ID NO: 1581389 - RNA, 19 nt, Human
ccaggggccggccaguggc

SEQ ID NO: 1581390 - RNA, 21 nt, Human
ccaggagggaggcaggggagg

SEQ ID NO: 1581391 - RNA, 20 nt, Human
cagaauaaucaaauacauuu

SEQ ID NO: 1581392 - RNA, 22 nt, Human
cagugcaguuugguguguccuc

SEQ ID NO: 1581393 - RNA, 23 nt, Human
cuggagugugaggguccugcagc

SEQ ID NO: 1581394 - RNA, 21 nt, Human
cuggugcccuggaugcccagg

SEQ ID NO: 1581395 - RNA, 20 nt, Human
cuggugcccuggaugcccag

SEQ ID NO: 1581396 - RNA, 17 nt, Human
cuggugcccuggaugcc

SEQ ID NO: 1581397 - RNA, 16 nt, Human
gauacuugaauaacca

SEQ ID NO: 1581398 - RNA, 20 nt, Human
ggagugugaggguccugcag

SEQ ID NO: 1581399 - RNA, 18 nt, Human
aaaaaguuugucuuaguu

SEQ ID NO: 1581400 - RNA, 11 nt, Human
aaaaaguuugu

SEQ ID NO: 1581401 - RNA, 13 nt, Human
ggccuuccccagc

SEQ ID NO: 1581402 - RNA, 14 nt, Human
ggccuuccccagca

SEQ ID NO: 1581403 - RNA, 17 nt, Human
gggccggccaguggccu

SEQ ID NO: 1581404 - RNA, 23 nt, Human
ggggccaugccuccucaggagcc

SEQ ID NO: 1581405 - RNA, 19 nt, Human
ggggccaugccuccucagg

SEQ ID NO: 1581406 - RNA, 17 nt, Human
ggggccaugccuccuca

SEQ ID NO: 1581407 - RNA, 14 nt, Human
ggggccaugccucc

SEQ ID NO: 1581408 - RNA, 19 nt, Human
ggguccugcagccugcagg

SEQ ID NO: 1581409 - RNA, 23 nt, Human
ggguccugcagccugcaggaccu

SEQ ID NO: 1581410 - RNA, 18 nt, Human
ggguccugcagccugcag

SEQ ID NO: 1581411 - RNA, 13 nt, Human
guaauccuaaauu

SEQ ID NO: 1581412 - RNA, 23 nt, Human
aaagugguacuugaucauuuuua

SEQ ID NO: 1581413 - RNA, 20 nt, Human
aaagugguacuugaucauuu

SEQ ID NO: 1581414 - RNA, 14 nt, Human
aaagugguacuuga

SEQ ID NO: 1581415 - RNA, 17 nt, Human
gcggcggucccagcucc

SEQ ID NO: 1581416 - RNA, 16 nt, Human
gcggcggucccagcuc

SEQ ID NO: 1581417 - RNA, 14 nt, Human
gcggcggucccagc

SEQ ID NO: 1581418 - RNA, 16 nt, Human
gucgcugugccacagg

SEQ ID NO: 1581419 - RNA, 14 nt, Human
guccccugacaggg

SEQ ID NO: 1581420 - RNA, 14 nt, Human
aagaaacaacagaa

SEQ ID NO: 1581421 - RNA, 21 nt, Human
uagggacaggaccccagcucu

SEQ ID NO: 1581422 - RNA, 22 nt, Human
uagggacaggaccccagcucug

SEQ ID NO: 1581423 - RNA, 20 nt, Human
uagggacaggaccccagcuc

SEQ ID NO: 1581424 - RNA, 19 nt, Human
uagggacaggaccccagcu

SEQ ID NO: 1581425 - RNA, 15 nt, Human
uaguucccaggugau

SEQ ID NO: 1581426 - RNA, 16 nt, Human
acaggcuuagggacag

SEQ ID NO: 1581427 - RNA, 18 nt, Human
acaggaccccagcucugc

SEQ ID NO: 1581428 - RNA, 19 nt, Human
acaggaccccagcucugcg

SEQ ID NO: 1581429 - RNA, 17 nt, Human
acaggaccccagcucug

SEQ ID NO: 1581430 - RNA, 16 nt, Human
acaggaccccagcucu

SEQ ID NO: 1581431 - RNA, 15 nt, Human
acaggaccccagcuc

SEQ ID NO: 1581432 - RNA, 14 nt, Human
acaggaccccagcu

SEQ ID NO: 1581433 - RNA, 13 nt, Human
acaggaccccagc

SEQ ID NO: 1581434 - RNA, 12 nt, Human
acaggaccccag

SEQ ID NO: 1581435 - RNA, 21 nt, Human
aauuaguacagaaauauccau

SEQ ID NO: 1581436 - RNA, 21 nt, Human
uaagcaaguuaaguguccucc

SEQ ID NO: 1581437 - RNA, 10 nt, Human
ucccagcucc

SEQ ID NO: 1581438 - RNA, 15 nt, Human
acuaauuuuacuucu

SEQ ID NO: 1581439 - RNA, 22 nt, Human
uccucaggagccgaagcccagg

SEQ ID NO: 1581440 - RNA, 21 nt, Human
uccucaggagccgaagcccag

SEQ ID NO: 1581441 - RNA, 17 nt, Human
uccugcagccugcagga

SEQ ID NO: 1581442 - RNA, 13 nt, Human
uccugcagccugc

SEQ ID NO: 1581443 - RNA, 20 nt, Human
ucugcgucgguccuggugcc

SEQ ID NO: 1581444 - RNA, 20 nt, Human
acuugaucauuuuuaccauu

SEQ ID NO: 1581445 - RNA, 19 nt, Human
ugaaauuuccuaauuuauu

SEQ ID NO: 1581446 - RNA, 19 nt, Human
ugacagggccagugcaguu

SEQ ID NO: 1581447 - RNA, 16 nt, Human
ugacagggccagugca

SEQ ID NO: 1581448 - RNA, 22 nt, Human
aggagggaggcaggggaggggu

SEQ ID NO: 1581449 - RNA, 13 nt, Human
uggccgggcaggg

SEQ ID NO: 1581450 - RNA, 12 nt, Human
uggccgggcagg

SEQ ID NO: 1581451 - RNA, 13 nt, Human
agcccaggggccg

SEQ ID NO: 1581452 - RNA, 14 nt, Human
agccgaagcccagg

SEQ ID NO: 1581453 - RNA, 21 nt, Human
agucucaugccuugagaucug

SEQ ID NO: 1581454 - RNA, 15 nt, Human
agggugccguguccc

SEQ ID NO: 1581455 - RNA, 24 nt, Human
agggugccguguccccugacaggg

SEQ ID NO: 1581456 - RNA, 22 nt, Human
auaaaccuugucuaugaaauga

SEQ ID NO: 1581457 - RNA, 19 nt, Human
auaccaaguugauacuuga

SEQ ID NO: 1581458 - RNA, 16 nt, Human
aguuugguguguccuc

SEQ ID NO: 1581459 - RNA, 13 nt, Human
agugguuuagaaa

SEQ ID NO: 1581460 - RNA, 19 nt, Human
aucaauucuguauuccaga

SEQ ID NO: 1581461 - RNA, 23 nt, Human
auauauuuauggccgggcagggu

SEQ ID NO: 1581462 - RNA, 22 nt, Human
uuugaaaacucuguguuuggaa

SEQ ID NO: 1581463 - RNA, 14 nt, Human
augaaaugacuucu

SEQ ID NO: 1581464 - RNA, 24 nt, Human
auuacuuacguauguuuguacuug

SEQ ID NO: 1581465 - RNA, 15 nt, Human
uuuugauauaugaaa

SEQ ID NO: 1581466 - RNA, 16 nt, Human
uuuuguuugguuauau

SEQ ID NO: 1581467 - RNA, 13 nt, Human
uuuuguuugguua

SEQ ID NO: 1581468 - RNA, 21 nt, Human
uuuuguuugguuauaucgaaa

SEQ ID NO: 1581469 - RNA, 13 nt, Human
cagacggggcugg

SEQ ID NO: 1581470 - RNA, 19 nt, Human
cagacggggcuggagugug

SEQ ID NO: 1581471 - RNA, 17 nt, Human
cagcaugcaccacgggc

SEQ ID NO: 1581472 - RNA, 18 nt, Human
caggaccucgugccaccc

SEQ ID NO: 1581473 - RNA, 19 nt, Human
caggaaucuguauauauuu

SEQ ID NO: 1581474 - RNA, 19 nt, Human
caggagaagaaccugaaga

SEQ ID NO: 1581475 - RNA, 21 nt, Human
caggagccgaagcccaggggc

SEQ ID NO: 1581476 - RNA, 18 nt, Human
caggagccgaagcccagg

SEQ ID NO: 1581477 - RNA, 17 nt, Human
caggagccgaagcccag

SEQ ID NO: 1581478 - RNA, 17 nt, Human
caggcuuagggacagga

SEQ ID NO: 1581479 - RNA, 16 nt, Human
caggcuuagggacagg

SEQ ID NO: 1581480 - RNA, 16 nt, Human
cagggccagugcaguu

SEQ ID NO: 1581481 - RNA, 13 nt, Human
caggggaggggug

SEQ ID NO: 1581482 - RNA, 22 nt, Human
caggggccggccaguggccuuc

SEQ ID NO: 1581483 - RNA, 17 nt, Human
caggggccggccagugg

SEQ ID NO: 1581484 - RNA, 14 nt, Human
cauuuuuaccauua

SEQ ID NO: 1581485 - RNA, 19 nt, Human
cauucauaaaccuugucua

SEQ ID NO: 1581486 - RNA, 23 nt, Human
ccaccccgagggcugagccuggu

SEQ ID NO: 1581487 - RNA, 20 nt, Human
ccagcaugcaccacgggccc

SEQ ID NO: 1581488 - RNA, 18 nt, Human
ccagcaugcaccacgggc

SEQ ID NO: 1581489 - RNA, 18 nt, Human
ccauuauuuuuaggaugu

SEQ ID NO: 1581490 - RNA, 17 nt, Human
ccaucugaaagugguac

SEQ ID NO: 1581491 - RNA, 18 nt, Human
cccggguugggucaccag

SEQ ID NO: 1581492 - RNA, 23 nt, Human
cccgagggcugagccugguccca

SEQ ID NO: 1581493 - RNA, 19 nt, Human
ccguguccccugacagggc

SEQ ID NO: 1581494 - RNA, 17 nt, Human
ccguguccccugacagg

SEQ ID NO: 1581495 - RNA, 13 nt, Human
ccgccuuaccagg

SEQ ID NO: 1581496 - RNA, 20 nt, Human
ccuggucccacgagggugcc

SEQ ID NO: 1581497 - RNA, 20 nt, Human
ccuggugcccuggaugccca

SEQ ID NO: 1581498 - RNA, 18 nt, Human
ccuggugcccuggaugcc

SEQ ID NO: 1581499 - RNA, 12 nt, Human
ccuggugcccug

SEQ ID NO: 1581500 - RNA, 21 nt, Human
ccuggugcccuggaugcccag

SEQ ID NO: 1581501 - RNA, 22 nt, Human
ccuggugcccuggaugcccagg

SEQ ID NO: 1581502 - RNA, 13 nt, Human
cuccucaggagcc

SEQ ID NO: 1581503 - RNA, 12 nt, Human
cuccucaggagc

SEQ ID NO: 1581504 - RNA, 14 nt, Human
cugaagaacuauuu

SEQ ID NO: 1581505 - RNA, 17 nt, Human
cugcgucgguccuggug

SEQ ID NO: 1581506 - RNA, 18 nt, Human
cugcgucgguccuggugc

SEQ ID NO: 1581507 - RNA, 16 nt, Human
gaaucuguauauauuu

SEQ ID NO: 1581508 - RNA, 18 nt, Human
gaacuuacuugcauacca

SEQ ID NO: 1581509 - RNA, 18 nt, Human
gaaccugaagaacuauuu

SEQ ID NO: 1581510 - RNA, 23 nt, Human
gagccuggucccacgagggugcc

SEQ ID NO: 1581511 - RNA, 19 nt, Human
gagccuggucccacgaggg

SEQ ID NO: 1581512 - RNA, 14 nt, Human
gauagacugcuaca

SEQ ID NO: 1581513 - RNA, 13 nt, Human
gagucgcugugcc

SEQ ID NO: 1581514 - RNA, 17 nt, Human
gcacuaaaguuaguaaa

SEQ ID NO: 1581515 - RNA, 12 nt, Human
gcaggggagggg

SEQ ID NO: 1581516 - RNA, 21 nt, Human
gccuggucccacgagggugcc

SEQ ID NO: 1581517 - RNA, 14 nt, Human
ggcggucccagcuc

SEQ ID NO: 1581518 - RNA, 17 nt, Human
ggcucccaugucaagag

SEQ ID NO: 1581519 - RNA, 22 nt, Human
ggcuuagggacaggaccccagc

SEQ ID NO: 1581520 - RNA, 23 nt, Human
ucaggagccgaagcccaggggcc

SEQ ID NO: 1581521 - RNA, 22 nt, Human
uauuccagacuugggaggaugu

SEQ ID NO: 1581522 - RNA, 22 nt, Human
ucgugccaccccgagggcugag

SEQ ID NO: 1581523 - RNA, 18 nt, Human
ugcccuggaugcccagga

SEQ ID NO: 1581524 - RNA, 16 nt, Human
ugcccuggaugcccag

SEQ ID NO: 1581525 - RNA, 21 nt, Human
ugccguguccccugacagggc

SEQ ID NO: 1581526 - RNA, 20 nt, Human
ugccacaggcuuagggacag

SEQ ID NO: 1581527 - RNA, 21 nt, Human
ugccacaggcuuagggacagg

SEQ ID NO: 1581528 - RNA, 17 nt, Human
ugccacaggcuuaggga

SEQ ID NO: 1581529 - RNA, 19 nt, Human
uuauuagaaaaauauuaua

SEQ ID NO: 1581530 - RNA, 23 nt, Human
uuauguuguuguuguuuuuggau

SEQ ID NO: 1581531 - RNA, 21 nt, Human
uuauaucgaaauaguuacagg

SEQ ID NO: 1581532 - RNA, 22 nt, Human
cucugcgucgguccuggugccc

SEQ ID NO: 1581533 - RNA, 21 nt, Human
cucugcgucgguccuggugcc

SEQ ID NO: 1581534 - RNA, 20 nt, Human
cucugcgucgguccuggugc

SEQ ID NO: 1581535 - RNA, 19 nt, Human
cucugcgucgguccuggug

SEQ ID NO: 1581536 - RNA, 17 nt, Human
cuccgccuuaccaggag

SEQ ID NO: 1581537 - RNA, 16 nt, Human
cggcggucccagcucc

SEQ ID NO: 1581538 - RNA, 15 nt, Human
cggcggucccagcuc

SEQ ID NO: 1581539 - RNA, 18 nt, Human
ccugcaggaccucgugcc

SEQ ID NO: 1581540 - RNA, 17 nt, Human
ccugcaggaccucgugc

SEQ ID NO: 1581541 - RNA, 19 nt, Human
ccugcagccugcaggaccu

SEQ ID NO: 1581542 - RNA, 22 nt, Human
ccaugucaagagucgcugugcc

SEQ ID NO: 1581543 - RNA, 21 nt, Human
cagccugcaggaccucgugcc

SEQ ID NO: 1581544 - RNA, 12 nt, Human
cagccugcagga

SEQ ID NO: 1581545 - RNA, 15 nt, Human
ggcggucccagcucc

SEQ ID NO: 1581546 - RNA, 22 nt, Human
ggccaguggccuuccccagcau

SEQ ID NO: 1581547 - RNA, 19 nt, Human
ggccaguggccuuccccag

SEQ ID NO: 1581548 - RNA, 22 nt, Human
ggccagugcaguuugguguguc

SEQ ID NO: 1581549 - RNA, 21 nt, Human
ggccaugccuccucaggagcc

SEQ ID NO: 1581550 - RNA, 18 nt, Human
ggccaugccuccucagga

SEQ ID NO: 1581551 - RNA, 17 nt, Human
ggccaugccuccucagg

SEQ ID NO: 1581552 - RNA, 22 nt, Human
gggacaggaccccagcucugcg

SEQ ID NO: 1581553 - RNA, 21 nt, Human
gggacaggaccccagcucugc

SEQ ID NO: 1581554 - RNA, 19 nt, Human
gggacaggaccccagcucu

SEQ ID NO: 1581555 - RNA, 17 nt, Human
gggacaggaccccagcu

SEQ ID NO: 1581556 - RNA, 15 nt, Human
gggacaggaccccag

SEQ ID NO: 1581557 - RNA, 22 nt, Human
gggccaugccuccucaggagcc

SEQ ID NO: 1581558 - RNA, 23 nt, Human
gggccaugccuccucaggagccg

SEQ ID NO: 1581559 - RNA, 13 nt, Human
gggccaugccucc

SEQ ID NO: 1581560 - RNA, 13 nt, Human
gguccuggugccc

SEQ ID NO: 1581561 - RNA, 12 nt, Human
gguccuggugcc

SEQ ID NO: 1581562 - RNA, 24 nt, Human
gguccuggugcccuggaugcccag

SEQ ID NO: 1581563 - RNA, 14 nt, Human
gguccuggugcccu

SEQ ID NO: 1581564 - RNA, 21 nt, Human
gcuggagugugaggguccugc

SEQ ID NO: 1581565 - RNA, 15 nt, Human
gcuggagugugaggg

SEQ ID NO: 1581566 - RNA, 13 nt, Human
gcugugccacagg

SEQ ID NO: 1581567 - RNA, 19 nt, Human
gcugugccacaggcuuagg

SEQ ID NO: 1581568 - RNA, 20 nt, Human
gcugugccacaggcuuaggg

SEQ ID NO: 1581569 - RNA, 15 nt, Human
gcugugccacaggcu

SEQ ID NO: 1581570 - RNA, 14 nt, Human
gcugugccacaggc

SEQ ID NO: 1581571 - RNA, 21 nt, Human
gccaguggccuuccccagcau

SEQ ID NO: 1581572 - RNA, 17 nt, Human
cuucuaagucauucaua

SEQ ID NO: 1581573 - RNA, 18 nt, Human
gugccaccccgagggcug

SEQ ID NO: 1581574 - RNA, 15 nt, Human
gugaggguccugcag

SEQ ID NO: 1581575 - RNA, 14 nt, Human
gugaggguccugca

SEQ ID NO: 1581576 - RNA, 23 nt, Human
gugaggguccugcagccugcagg

SEQ ID NO: 1581577 - RNA, 24 nt, Human
gugaggguccugcagccugcagga

SEQ ID NO: 1581578 - RNA, 11 nt, Human
aaauuguguua

SEQ ID NO: 1581579 - RNA, 23 nt, Human
guguggggccaugccuccucagg

SEQ ID NO: 1581580 - RNA, 21 nt, Human
guguggggccaugccuccuca

SEQ ID NO: 1581581 - RNA, 14 nt, Human
guguauuucauuua

SEQ ID NO: 1581582 - RNA, 19 nt, Human
guggccuuccccagcaugc

SEQ ID NO: 1581583 - RNA, 21 nt, Human
guggccuuccccagcaugcac

SEQ ID NO: 1581584 - RNA, 18 nt, Human
guggccuuccccagcaug

SEQ ID NO: 1581585 - RNA, 17 nt, Human
guggccuuccccagcau

SEQ ID NO: 1581586 - RNA, 21 nt, Human
guggggccaugccuccucagg

SEQ ID NO: 1581587 - RNA, 22 nt, Human
guggggccaugccuccucagga

SEQ ID NO: 1581588 - RNA, 15 nt, Human
aagcccaggggccgg

SEQ ID NO: 1581589 - RNA, 18 nt, Human
uaccauuauuuuuaggau

SEQ ID NO: 1581590 - RNA, 20 nt, Human
aauuacuuacguauguuugu

SEQ ID NO: 1581591 - RNA, 15 nt, Human
uauaacucauuuguu

SEQ ID NO: 1581592 - RNA, 17 nt, Human
uagaaacauguaauccu

SEQ ID NO: 1581593 - RNA, 14 nt, Human
acgagggugccgug

SEQ ID NO: 1581594 - RNA, 15 nt, Human
uccccugacagggcc

SEQ ID NO: 1581595 - RNA, 12 nt, Human
uccccugacagg

SEQ ID NO: 1581596 - RNA, 11 nt, Human
accccagcucu

SEQ ID NO: 1581597 - RNA, 16 nt, Human
ucgcugugccacaggc

SEQ ID NO: 1581598 - RNA, 20 nt, Human
agaaauuacuaauuuuacuu

SEQ ID NO: 1581599 - RNA, 17 nt, Human
agaauaaucaaauacau

SEQ ID NO: 1581600 - RNA, 20 nt, Human
ugaaaaagcuggauuuucuu

SEQ ID NO: 1581601 - RNA, 12 nt, Human
agauuuuguugg

SEQ ID NO: 1581602 - RNA, 22 nt, Human
ugaccccaggagggaggcaggg

SEQ ID NO: 1581603 - RNA, 20 nt, Human
ugaccccaggagggaggcag

SEQ ID NO: 1581604 - RNA, 17 nt, Human
agccacauauugagaug

SEQ ID NO: 1581605 - RNA, 17 nt, Human
ugaucaaacaugucucu

SEQ ID NO: 1581606 - RNA, 19 nt, Human
ugauauuuuuuaucauaaa

SEQ ID NO: 1581607 - RNA, 17 nt, Human
ugauauuuuuuaucaua

SEQ ID NO: 1581608 - RNA, 14 nt, Human
ugaguagucucaug

SEQ ID NO: 1581609 - RNA, 17 nt, Human
ugcagccugcaggaccu

SEQ ID NO: 1581610 - RNA, 18 nt, Human
ugcagccugcaggaccuc

SEQ ID NO: 1581611 - RNA, 22 nt, Human
agccuggucccacgagggugcc

SEQ ID NO: 1581612 - RNA, 17 nt, Human
ugcggcggucccagcuc

SEQ ID NO: 1581613 - RNA, 14 nt, Human
ugcggcggucccag

SEQ ID NO: 1581614 - RNA, 13 nt, Human
ugcggcgguccca

SEQ ID NO: 1581615 - RNA, 18 nt, Human
ugcggcggucccagcucc

SEQ ID NO: 1581616 - RNA, 15 nt, Human
uggccuuccccagca

SEQ ID NO: 1581617 - RNA, 23 nt, Human
uggccuuccccagcaugcaccac

SEQ ID NO: 1581618 - RNA, 13 nt, Human
uggccuuccccag

SEQ ID NO: 1581619 - RNA, 23 nt, Human
aggguguggggccaugccuccuc

SEQ ID NO: 1581620 - RNA, 22 nt, Human
aggguguggggccaugccuccu

SEQ ID NO: 1581621 - RNA, 19 nt, Human
ugucaagagucgcugugcc

SEQ ID NO: 1581622 - RNA, 17 nt, Human
ugucaagagucgcugug

SEQ ID NO: 1581623 - RNA, 15 nt, Human
aguuagaacauuugc

SEQ ID NO: 1581624 - RNA, 16 nt, Human
uuacaggcacuaaagu

SEQ ID NO: 1581625 - RNA, 16 nt, Human
auaaccaucugaaagu

SEQ ID NO: 1581626 - RNA, 21 nt, Human
auaaucccuggaugauauuuu

SEQ ID NO: 1581627 - RNA, 20 nt, Human
auaaucccuggaugauauuu

SEQ ID NO: 1581628 - RNA, 22 nt, Human
uuagggacaggaccccagcucu

SEQ ID NO: 1581629 - RNA, 21 nt, Human
uuagggacaggaccccagcuc

SEQ ID NO: 1581630 - RNA, 20 nt, Human
auaguucccaggugauauuu

SEQ ID NO: 1581631 - RNA, 18 nt, Human
uuaguuuugugaagguga

SEQ ID NO: 1581632 - RNA, 13 nt, Human
uugaaauuuccua

SEQ ID NO: 1581633 - RNA, 14 nt, Human
uuccuuuuuuugau

SEQ ID NO: 1581634 - RNA, 17 nt, Human
uuuaagcaaguuaagug

SEQ ID NO: 1581635 - RNA, 16 nt, Human
uuuaagcaaguuaagu

SEQ ID NO: 1581636 - RNA, 14 nt, Human
auggccgggcaggg

SEQ ID NO: 1581637 - RNA, 22 nt, Human
uuggaugguguuacauauuaua

SEQ ID NO: 1581638 - RNA, 23 nt, Human
aguugauacuugaauaaccaucu

SEQ ID NO: 1581639 - RNA, 17 nt, Human
aguggccuuccccagca

SEQ ID NO: 1581640 - RNA, 21 nt, Human
aggguccugcagccugcagga

SEQ ID NO: 1581641 - RNA, 19 nt, Human
aggguccugcagccugcag

SEQ ID NO: 1581642 - RNA, 17 nt, Human
aggguccugcagccugc

SEQ ID NO: 1581643 - RNA, 16 nt, Human
aggguccugcagccug

SEQ ID NO: 1581644 - RNA, 23 nt, Human
aggcuuagggacaggaccccagc

SEQ ID NO: 1581645 - RNA, 21 nt, Human
aacuuacuugcauaccaaguu

SEQ ID NO: 1581646 - RNA, 17 nt, Human
acagggccagugcaguu

SEQ ID NO: 1581647 - RNA, 22 nt, Human
accaucugaaagugguacuuga

SEQ ID NO: 1581648 - RNA, 22 nt, Human
caagagucgcugugccacaggc

SEQ ID NO: 1581649 - RNA, 19 nt, Human
caagagucgcugugccaca

SEQ ID NO: 1581650 - RNA, 15 nt, Human
ccaugccuccucagg

SEQ ID NO: 1581651 - RNA, 16 nt, Human
ccaugccuccucagga

SEQ ID NO: 1581652 - RNA, 17 nt, Human
cccacgagggugccgug

SEQ ID NO: 1581653 - RNA, 12 nt, Human
cccagcucugcg

SEQ ID NO: 1581654 - RNA, 11 nt, Human
cccagcucugc

SEQ ID NO: 1581655 - RNA, 22 nt, Human
ccagcucugcgucgguccuggu

SEQ ID NO: 1581656 - RNA, 17 nt, Human
ccagugcuuuauguugu

SEQ ID NO: 1581657 - RNA, 15 nt, Human
caugccuccucagga

SEQ ID NO: 1581658 - RNA, 19 nt, Human
cauagaaaacacuacagug

SEQ ID NO: 1581659 - RNA, 19 nt, Human
caguggccuuccccagcau

SEQ ID NO: 1581660 - RNA, 17 nt, Human
caguggccuuccccagc

SEQ ID NO: 1581661 - RNA, 18 nt, Human
caguggccuuccccagca

SEQ ID NO: 1581662 - RNA, 22 nt, Human
cggccaguggccuuccccagca

SEQ ID NO: 1581663 - RNA, 12 nt, Human
cggucccagcuc

SEQ ID NO: 1581664 - RNA, 13 nt, Human
cggucccagcucc

SEQ ID NO: 1581665 - RNA, 13 nt, Human
cgguccuggugcc

SEQ ID NO: 1581666 - RNA, 19 nt, Human
cgugccaccccgagggcug

SEQ ID NO: 1581667 - RNA, 22 nt, Human
cgugccaccccgagggcugagc

SEQ ID NO: 1581668 - RNA, 15 nt, Human
cgugccaccccgagg

SEQ ID NO: 1581669 - RNA, 12 nt, Human
cugacagggcca

SEQ ID NO: 1581670 - RNA, 17 nt, Human
cugacagggccagugca

SEQ ID NO: 1581671 - RNA, 12 nt, Human
cugagccugguc

SEQ ID NO: 1581672 - RNA, 19 nt, Human
cuggucccacgagggugcc

SEQ ID NO: 1581673 - RNA, 17 nt, Human
cuggucccacgagggug

SEQ ID NO: 1581674 - RNA, 14 nt, Human
cuggucccacgagg

SEQ ID NO: 1581675 - RNA, 19 nt, Human
gaaauuacuaauuuuacuu

SEQ ID NO: 1581676 - RNA, 20 nt, Human
gaaauuuccuaauuuauucu

SEQ ID NO: 1581677 - RNA, 20 nt, Human
gaaauuacuaauuuuacuuc

SEQ ID NO: 1581678 - RNA, 20 nt, Human
gacaugggugaacuuacuug

SEQ ID NO: 1581679 - RNA, 14 nt, Human
gaccccagcucugc

SEQ ID NO: 1581680 - RNA, 12 nt, Human
gaccccagcucu

SEQ ID NO: 1581681 - RNA, 15 nt, Human
gagccgaagcccagg

SEQ ID NO: 1581682 - RNA, 14 nt, Human
gagccgaagcccag

SEQ ID NO: 1581683 - RNA, 15 nt, Human
gccaugccuccucag

SEQ ID NO: 1581684 - RNA, 18 nt, Human
gccguguccccugacagg

SEQ ID NO: 1581685 - RNA, 13 nt, Human
gccgaagcccagg

SEQ ID NO: 1581686 - RNA, 12 nt, Human
gccuccucagga

SEQ ID NO: 1581687 - RNA, 15 nt, Human
gcgucgguccuggug

SEQ ID NO: 1581688 - RNA, 18 nt, Human
uuuuggaugguguuacau

SEQ ID NO: 1581689 - RNA, 15 nt, Human
uuuucuaaauuuauc

SEQ ID NO: 1581690 - RNA, 13 nt, Human
uuuuuugauauau

SEQ ID NO: 1581691 - RNA, 13 nt, Human
uuugaauaugaaa

SEQ ID NO: 1581692 - RNA, 15 nt, Human
guauguuuguacuug

SEQ ID NO: 1581693 - RNA, 16 nt, Human
gucaccagacggggcu

SEQ ID NO: 1581694 - RNA, 17 nt, Human
gucaccagacggggcug

SEQ ID NO: 1581695 - RNA, 17 nt, Human
gucgcugugccacaggc

SEQ ID NO: 1581696 - RNA, 18 nt, Human
gucgguccuggugcccug

SEQ ID NO: 1581697 - RNA, 17 nt, Human
gucgguccuggugcccu

SEQ ID NO: 1581698 - RNA, 15 nt, Human
gucgguccuggugcc

SEQ ID NO: 1581699 - RNA, 14 nt, Human
gugauauuuuucuu

SEQ ID NO: 1581700 - RNA, 22 nt, Human
gugcggcggucccagcucccug

SEQ ID NO: 1581701 - RNA, 19 nt, Human
gugcggcggucccagcucc

SEQ ID NO: 1581702 - RNA, 18 nt, Human
gugcggcggucccagcuc

SEQ ID NO: 1581703 - RNA, 21 nt, Human
gugcaguuugguguguccucc

SEQ ID NO: 1581704 - RNA, 14 nt, Human
gugguacuugauca

SEQ ID NO: 1581705 - RNA, 16 nt, Human
guggugaccccaggag

SEQ ID NO: 1581706 - RNA, 18 nt, Human
guggugaccccaggaggg

SEQ ID NO: 1581707 - RNA, 23 nt, Human
guguuacuagccucaaaauacau

SEQ ID NO: 1581708 - RNA, 18 nt, Human
guguccccugacagggcc

SEQ ID NO: 1581709 - RNA, 20 nt, Human
guuacauauuauauguucua

SEQ ID NO: 1581710 - RNA, 21 nt, Human
uaaagaaaaguuuaccaucug

SEQ ID NO: 1581711 - RNA, 15 nt, Human
uaaaguuaguaaaga

SEQ ID NO: 1581712 - RNA, 22 nt, Human
uaagugguucuuugguuccagu

SEQ ID NO: 1581713 - RNA, 18 nt, Human
uaagucauucauaaaccu

SEQ ID NO: 1581714 - RNA, 14 nt, Human
uacagcuccuuuga

SEQ ID NO: 1581715 - RNA, 20 nt, Human
uacagcuccuuugaaaacuc

SEQ ID NO: 1581716 - RNA, 18 nt, Human
uccagcaaaucaagcuga

SEQ ID NO: 1581717 - RNA, 18 nt, Human
ucccacgagggugccgug

SEQ ID NO: 1581718 - RNA, 18 nt, Human
uccuccgccuuaccagga

SEQ ID NO: 1581719 - RNA, 16 nt, Human
ugcgucgguccuggug

SEQ ID NO: 1581720 - RNA, 17 nt, Human
ugcuaaaggagcaucua

SEQ ID NO: 1581721 - RNA, 21 nt, Human
uguccuccgccuuaccaggag

SEQ ID NO: 1581722 - RNA, 13 nt, Human
uuaaauauuuagu

SEQ ID NO: 1581723 - RNA, 21 nt, Human
uuaagagguugauuauaaagu

SEQ ID NO: 1581724 - RNA, 15 nt, Human
uuaagcaaguuaagu

SEQ ID NO: 1581725 - RNA, 22 nt, Human
aagagucgcugugccacaggcu

SEQ ID NO: 1581726 - RNA, 15 nt, Human
aagagucgcugugcc

SEQ ID NO: 1581727 - RNA, 19 nt, Human
accacgggcccggguuggg

SEQ ID NO: 1581728 - RNA, 13 nt, Human
agcaucuaucaga

SEQ ID NO: 1581729 - RNA, 20 nt, Human
agggacaggaccccagcucu

SEQ ID NO: 1581730 - RNA, 21 nt, Human
agggacaggaccccagcucug

SEQ ID NO: 1581731 - RNA, 21 nt, Human
cucgugccaccccgagggcug

SEQ ID NO: 1581732 - RNA, 13 nt, Human
ccuuccccagcau

SEQ ID NO: 1581733 - RNA, 12 nt, Human
ccuuccccagca

SEQ ID NO: 1581734 - RNA, 14 nt, Human
cuaagucauucaua

SEQ ID NO: 1581735 - RNA, 19 nt, Human
cggcggucccagcucccug

SEQ ID NO: 1581736 - RNA, 16 nt, Human
cccugacagggccagu

SEQ ID NO: 1581737 - RNA, 13 nt, Human
cccugacagggcc

SEQ ID NO: 1581738 - RNA, 16 nt, Human
cccuggaugcccagga

SEQ ID NO: 1581739 - RNA, 15 nt, Human
cccuggaugcccagg

SEQ ID NO: 1581740 - RNA, 22 nt, Human
ccucaggagccgaagcccaggg

SEQ ID NO: 1581741 - RNA, 19 nt, Human
cccagcaugcaccacgggc

SEQ ID NO: 1581742 - RNA, 23 nt, Human
cccagcaugcaccacgggcccgg

SEQ ID NO: 1581743 - RNA, 15 nt, Human
ccagacggggcugga

SEQ ID NO: 1581744 - RNA, 15 nt, Human
ccagaucaaggaugu

SEQ ID NO: 1581745 - RNA, 18 nt, Human
ccagacuugggaggaugu

SEQ ID NO: 1581746 - RNA, 14 nt, Human
caggaccccagcuc

SEQ ID NO: 1581747 - RNA, 13 nt, Human
caggaccccagcu

SEQ ID NO: 1581748 - RNA, 12 nt, Human
caggaccccagc

SEQ ID NO: 1581749 - RNA, 17 nt, Human
caggaccucgugccacc

SEQ ID NO: 1581750 - RNA, 14 nt, Human
cauuuguuguuuga

SEQ ID NO: 1581751 - RNA, 17 nt, Human
gccggccaguggccuuc

SEQ ID NO: 1581752 - RNA, 15 nt, Human
gccuccucaggagcc

SEQ ID NO: 1581753 - RNA, 17 nt, Human
gccaccccgagggcuga

SEQ ID NO: 1581754 - RNA, 23 nt, Human
gccaccccgagggcugagccugg

SEQ ID NO: 1581755 - RNA, 16 nt, Human
gccaccccgagggcug

SEQ ID NO: 1581756 - RNA, 13 nt, Human
ggaccccagcucu

SEQ ID NO: 1581757 - RNA, 15 nt, Human
ggaccccagcucugc

SEQ ID NO: 1581758 - RNA, 12 nt, Human
ggaccccagcuc

SEQ ID NO: 1581759 - RNA, 17 nt, Human
aaaagcuggauuuucuu

SEQ ID NO: 1581760 - RNA, 18 nt, Human
gaccucgugccaccccga

SEQ ID NO: 1581761 - RNA, 20 nt, Human
gagggcugagccugguccca

SEQ ID NO: 1581762 - RNA, 20 nt, Human
cuuauuagaaaaauauuaua

SEQ ID NO: 1581763 - RNA, 15 nt, Human
cuggaugcccaggaa

SEQ ID NO: 1581764 - RNA, 14 nt, Human
cuggaugcccagga

SEQ ID NO: 1581765 - RNA, 13 nt, Human
cuggaugcccagg

SEQ ID NO: 1581766 - RNA, 16 nt, Human
cuggaugcccaggaau

SEQ ID NO: 1581767 - RNA, 14 nt, Human
cuggaugauauuuu

SEQ ID NO: 1581768 - RNA, 11 nt, Human
cuggugcccug

SEQ ID NO: 1581769 - RNA, 15 nt, Human
cugcagccugcagga

SEQ ID NO: 1581770 - RNA, 19 nt, Human
cugcagccugcaggaccuc

SEQ ID NO: 1581771 - RNA, 14 nt, Human
cugcagccugcagg

SEQ ID NO: 1581772 - RNA, 12 nt, Human
cugcagccugca

SEQ ID NO: 1581773 - RNA, 16 nt, Human
aacauuugcugucagc

SEQ ID NO: 1581774 - RNA, 18 nt, Human
guccugcagccugcagga

SEQ ID NO: 1581775 - RNA, 23 nt, Human
gugccguguccccugacagggcc

SEQ ID NO: 1581776 - RNA, 22 nt, Human
gugccguguccccugacagggc

SEQ ID NO: 1581777 - RNA, 18 nt, Human
uaguuuugugaaggugau

SEQ ID NO: 1581778 - RNA, 12 nt, Human
accauuauuuuu

SEQ ID NO: 1581779 - RNA, 16 nt, Human
accagacggggcugga

SEQ ID NO: 1581780 - RNA, 21 nt, Human
accagacggggcuggagugug

SEQ ID NO: 1581781 - RNA, 15 nt, Human
accagacggggcugg

SEQ ID NO: 1581782 - RNA, 14 nt, Human
accagacggggcug

SEQ ID NO: 1581783 - RNA, 18 nt, Human
acaguugcuguuguguga

SEQ ID NO: 1581784 - RNA, 23 nt, Human
accucgugccaccccgagggcug

SEQ ID NO: 1581785 - RNA, 19 nt, Human
accucgugccaccccgagg

SEQ ID NO: 1581786 - RNA, 17 nt, Human
acgggcccggguugggu

SEQ ID NO: 1581787 - RNA, 16 nt, Human
acgggcccggguuggg

SEQ ID NO: 1581788 - RNA, 21 nt, Human
acgggcccggguugggucacc

SEQ ID NO: 1581789 - RNA, 20 nt, Human
acgggcccggguugggucac

SEQ ID NO: 1581790 - RNA, 16 nt, Human
ucgguccuggugcccu

SEQ ID NO: 1581791 - RNA, 13 nt, Human
ucgguccuggugc

SEQ ID NO: 1581792 - RNA, 15 nt, Human
acuuauagauugaaa

SEQ ID NO: 1581793 - RNA, 19 nt, Human
acuugaauaaccaucugaa

SEQ ID NO: 1581794 - RNA, 20 nt, Human
acuugaauaaccaucugaaa

SEQ ID NO: 1581795 - RNA, 15 nt, Human
agagucuccauuuaa

SEQ ID NO: 1581796 - RNA, 18 nt, Human
aggagccgaagcccaggg

SEQ ID NO: 1581797 - RNA, 16 nt, Human
aggagccgaagcccag

SEQ ID NO: 1581798 - RNA, 21 nt, Human
uggagugugaggguccugcag

SEQ ID NO: 1581799 - RNA, 13 nt, Human
agggaggcagggg

SEQ ID NO: 1581800 - RNA, 20 nt, Human
uggggccaugccuccucagg

SEQ ID NO: 1581801 - RNA, 21 nt, Human
uggggccaugccuccucagga

SEQ ID NO: 1581802 - RNA, 19 nt, Human
uggggccaugccuccucag

SEQ ID NO: 1581803 - RNA, 14 nt, Human
uggggccaugccuc

SEQ ID NO: 1581804 - RNA, 23 nt, Human
aggggugcggcggucccagcucc

SEQ ID NO: 1581805 - RNA, 21 nt, Human
aggggugcggcggucccagcu

SEQ ID NO: 1581806 - RNA, 20 nt, Human
aggggugcggcggucccagc

SEQ ID NO: 1581807 - RNA, 22 nt, Human
aggggugcggcggucccagcuc

SEQ ID NO: 1581808 - RNA, 18 nt, Human
aggugauauuuuucuuau

SEQ ID NO: 1581809 - RNA, 19 nt, Human
uggugcccuggaugcccag

SEQ ID NO: 1581810 - RNA, 14 nt, Human
uguaguaucucaua

SEQ ID NO: 1581811 - RNA, 19 nt, Human
agucucaugccuugagauc

SEQ ID NO: 1581812 - RNA, 16 nt, Human
ugugccacaggcuuag

SEQ ID NO: 1581813 - RNA, 12 nt, Human
ugugccacaggc

SEQ ID NO: 1581814 - RNA, 20 nt, Human
uuuacuucuaagucauucau

SEQ ID NO: 1581815 - RNA, 23 nt, Human
uuuaggauguguauuucauuuau

SEQ ID NO: 1581816 - RNA, 12 nt, Human
uuuuugauauau

SEQ ID NO: 1581817 - RNA, 16 nt, Human
auuauaaaguuuucua

SEQ ID NO: 1581818 - RNA, 13 nt, Human
auuauaaaguuuu

SEQ ID NO: 1581819 - RNA, 16 nt, Human
auuauaacucauuugu

SEQ ID NO: 1581820 - RNA, 21 nt, Human
uuugacacuuauagauugaaa

SEQ ID NO: 1581821 - RNA, 18 nt, Human
uuuuccaaucauuugacu

SEQ ID NO: 1581822 - RNA, 16 nt, Human
caccagacggggcugg

SEQ ID NO: 1581823 - RNA, 17 nt, Human
caccagacggggcugga

SEQ ID NO: 1581824 - RNA, 21 nt, Human
ccacaggcuuagggacaggac

SEQ ID NO: 1581825 - RNA, 19 nt, Human
ccacaggcuuagggacagg

SEQ ID NO: 1581826 - RNA, 18 nt, Human
ccacaggcuuagggacag

SEQ ID NO: 1581827 - RNA, 15 nt, Human
ccacaggcuuaggga

SEQ ID NO: 1581828 - RNA, 12 nt, Human
cccaggggccgg

SEQ ID NO: 1581829 - RNA, 16 nt, Human
cccaggugauauuuuu

SEQ ID NO: 1581830 - RNA, 9 nt, Human
cccagcucc

SEQ ID NO: 1581831 - RNA, 19 nt, Human
ccccaggagggaggcaggg

SEQ ID NO: 1581832 - RNA, 18 nt, Human
ccccaggagggaggcagg

SEQ ID NO: 1581833 - RNA, 22 nt, Human
ccgagggcugagccugguccca

SEQ ID NO: 1581834 - RNA, 16 nt, Human
ccgagggcugagccug

SEQ ID NO: 1581835 - RNA, 13 nt, Human
ccgagggcugagc

SEQ ID NO: 1581836 - RNA, 16 nt, Human
ccugaagaacuauuuu

SEQ ID NO: 1581837 - RNA, 21 nt, Human
cgggcaggguguggggccaug

SEQ ID NO: 1581838 - RNA, 15 nt, Human
cgucgguccuggugc

SEQ ID NO: 1581839 - RNA, 24 nt, Human
cuuacuugcauaccaaguugauac

SEQ ID NO: 1581840 - RNA, 18 nt, Human
gacagggccagugcaguu

SEQ ID NO: 1581841 - RNA, 16 nt, Human
gaaggugauuuauucu

SEQ ID NO: 1581842 - RNA, 19 nt, Human
gaauaaucaaauacauuuu

SEQ ID NO: 1581843 - RNA, 16 nt, Human
gaagcccaggggccgg

SEQ ID NO: 1581844 - RNA, 19 nt, Human
gcaagcucuuuuauaugcu

SEQ ID NO: 1581845 - RNA, 15 nt, Human
gcaugcaccacgggc

SEQ ID NO: 1581846 - RNA, 14 nt, Human
gcaugcaccacggg

SEQ ID NO: 1581847 - RNA, 15 nt, Human
gcaccacgggcccgg

SEQ ID NO: 1581848 - RNA, 13 nt, Human
gcagccugcagga

SEQ ID NO: 1581849 - RNA, 16 nt, Human
gcagccugcaggaccu

SEQ ID NO: 1581850 - RNA, 15 nt, Human
gcaggaccucgugcc

SEQ ID NO: 1581851 - RNA, 22 nt, Human
gcggucccagcucccuggcucc

SEQ ID NO: 1581852 - RNA, 18 nt, Human
gcggucccagcucccugg

SEQ ID NO: 1581853 - RNA, 14 nt, Human
gcggucccagcucc

SEQ ID NO: 1581854 - RNA, 13 nt, Human
gcggucccagcuc

SEQ ID NO: 1581855 - RNA, 23 nt, Human
gccugcaggaccucgugccaccc

SEQ ID NO: 1581856 - RNA, 18 nt, Human
gccugcaggaccucgugc

SEQ ID NO: 1581857 - RNA, 17 nt, Human
gccugcaggaccucgug

SEQ ID NO: 1581858 - RNA, 13 nt, Human
gccugcaggaccu

SEQ ID NO: 1581859 - RNA, 17 nt, Human
gccgggcaggguguggg

SEQ ID NO: 1581860 - RNA, 13 nt, Human
ggaccucgugcca

SEQ ID NO: 1581861 - RNA, 19 nt, Human
ggagccgaagcccaggggc

SEQ ID NO: 1581862 - RNA, 17 nt, Human
ggagccgaagcccaggg

SEQ ID NO: 1581863 - RNA, 15 nt, Human
ggagccgaagcccag

SEQ ID NO: 1581864 - RNA, 22 nt, Human
ggagccgaagcccaggggccgg

SEQ ID NO: 1581865 - RNA, 11 nt, Human
ggcugagccug

SEQ ID NO: 1581866 - RNA, 19 nt, Human
ggucaccagacggggcugg

SEQ ID NO: 1581867 - RNA, 21 nt, Human
gggugcggcggucccagcucc

SEQ ID NO: 1581868 - RNA, 20 nt, Human
ggggugcggcggucccagcu

SEQ ID NO: 1581869 - RNA, 22 nt, Human
ggggugcggcggucccagcucc

SEQ ID NO: 1581870 - RNA, 20 nt, Human
uacuugaauaaccaucugaa

SEQ ID NO: 1581871 - RNA, 18 nt, Human
uacuugaauaaccaucug

SEQ ID NO: 1581872 - RNA, 16 nt, Human
uacagaaauauccaug

SEQ ID NO: 1581873 - RNA, 16 nt, Human
uaagagguugauuaua

SEQ ID NO: 1581874 - RNA, 14 nt, Human
guuuucuaaauuua

SEQ ID NO: 1581875 - RNA, 22 nt, Human
uccuggugcccuggaugcccag

SEQ ID NO: 1581876 - RNA, 13 nt, Human
uccuggugcccug

SEQ ID NO: 1581877 - RNA, 12 nt, Human
uccuggugcccu

SEQ ID NO: 1581878 - RNA, 18 nt, Human
ugccaccccgagggcuga

SEQ ID NO: 1581879 - RNA, 17 nt, Human
ugccaccccgagggcug

SEQ ID NO: 1581880 - RNA, 21 nt, Human
ugggucaccagacggggcugg

SEQ ID NO: 1581881 - RNA, 13 nt, Human
uggaugcccagga

SEQ ID NO: 1581882 - RNA, 14 nt, Human
uggaugcccaggaa

SEQ ID NO: 1581883 - RNA, 19 nt, Human
uggaugauauuuuuuauca

SEQ ID NO: 1581884 - RNA, 14 nt, Human
uguguaguuccagc

SEQ ID NO: 1581885 - RNA, 15 nt, Human
uguuguuuuuggaug

SEQ ID NO: 1581886 - RNA, 23 nt, Human
uguggggccaugccuccucagga

SEQ ID NO: 1581887 - RNA, 17 nt, Human
ugugaggguccugcagc

SEQ ID NO: 1581888 - RNA, 22 nt, Human
uuccccagcaugcaccacgggc

SEQ ID NO: 1581889 - RNA, 14 nt, Human
uuugauauaugaaa

SEQ ID NO: 1581890 - RNA, 19 nt, Human adenovirus F
cagacgaacacaauauuua

SEQ ID NO: 1581891 - RNA, 18 nt, Human adenovirus F
gacgacagccaggcagag

SEQ ID NO: 1581892 - RNA, 11 nt, Human adenovirus F
uggaggcagcu

SEQ ID NO: 1581893 - RNA, 18 nt, Human adenovirus F
gccuuuuauuaaccgccu

SEQ ID NO: 1581894 - RNA, 20 nt, Human adenovirus F
cagguucccgugucaccugc

SEQ ID NO: 1581895 - RNA, 17 nt, Human adenovirus F
acaacguggcucaaugu

SEQ ID NO: 1581896 - RNA, 16 nt, Human adenovirus F
cacucuuaacagcauu

SEQ ID NO: 1581897 - RNA, 19 nt, Human adenovirus F
gaagaugaggaggacuaug

SEQ ID NO: 1581898 - RNA, 19 nt, Human adenovirus F
aguccacuuaacagcuccu

SEQ ID NO: 1581899 - RNA, 12 nt, Human adenovirus F
cucucuccggag

SEQ ID NO: 1581900 - RNA, 18 nt, Human adenovirus F
auuuauaccauuaagaag

SEQ ID NO: 1581901 - RNA, 12 nt, Human adenovirus F
cucaagcggguu

SEQ ID NO: 1581902 - RNA, 23 nt, Human adenovirus F
ccgccaugacugccgcucgggcg

SEQ ID NO: 1581903 - RNA, 21 nt, Human adenovirus F
gcacggcccccaucucugugc

SEQ ID NO: 1581904 - RNA, 14 nt, Human adenovirus F
aggacguggaggaa

SEQ ID NO: 1581905 - RNA, 14 nt, Human adenovirus F
ugcggagccugagg

SEQ ID NO: 1581906 - RNA, 14 nt, Human adenovirus F
gacuuccugguccu

SEQ ID NO: 1581907 - RNA, 17 nt, Human adenovirus F
guuggcuucugccagaa

SEQ ID NO: 1581908 - RNA, 17 nt, Human adenovirus F
guagcaccccaauguaa

SEQ ID NO: 1581909 - RNA, 24 nt, Human adenovirus F
gccuccuguguuacgccagagagc

SEQ ID NO: 1581910 - RNA, 21 nt, Human adenovirus F
uguggacgacagccagcuguu

SEQ ID NO: 1581911 - RNA, 14 nt, Human adenovirus F
gcggacccgucucc

SEQ ID NO: 1581912 - RNA, 18 nt, Human adenovirus F
gagcgcaauuagcgggcg

SEQ ID NO: 1581913 - RNA, 18 nt, Human adenovirus F
ucccgccccugccaccgc

SEQ ID NO: 1581914 - RNA, 19 nt, Human adenovirus F
aggacgguggcaugaggga

SEQ ID NO: 1581915 - RNA, 16 nt, Human adenovirus F
ucacaacaccgcuucc

SEQ ID NO: 1581916 - RNA, 13 nt, Human adenovirus F
agacuaaaaacua

SEQ ID NO: 1581917 - RNA, 18 nt, Human adenovirus F
ugaaaagaaccagaauug

SEQ ID NO: 1581918 - RNA, 12 nt, Human adenovirus F
cucauccaaauc

SEQ ID NO: 1581919 - RNA, 21 nt, Human adenovirus F
ggcucugcagcagcgcccgcc

SEQ ID NO: 1581920 - RNA, 18 nt, Human adenovirus F
gucauauacuuuaaacaa

SEQ ID NO: 1581921 - RNA, 23 nt, Human adenovirus F
cacguuacuuaggcauacaggcu

SEQ ID NO: 1581922 - RNA, 20 nt, Human adenovirus F
caugagucuguuuggugggc

SEQ ID NO: 1581923 - RNA, 14 nt, Human adenovirus F
accccuuugugccc

SEQ ID NO: 1581924 - RNA, 14 nt, Human adenovirus F
gcagcgcccgccuc

SEQ ID NO: 1581925 - RNA, 14 nt, Human adenovirus F
acugcauacaacuc

SEQ ID NO: 1581926 - RNA, 13 nt, Human adenovirus F
ugcugacagcugg

SEQ ID NO: 1581927 - RNA, 15 nt, Human adenovirus F
caagguggcggccau

SEQ ID NO: 1581928 - RNA, 19 nt, Human adenovirus F
accgccuuggccagcagcc

SEQ ID NO: 1581929 - RNA, 15 nt, Human adenovirus F
gcugcgcccccaccg

SEQ ID NO: 1581930 - RNA, 13 nt, Human adenovirus F
cucccuuuccccc

SEQ ID NO: 1581931 - RNA, 22 nt, Human adenovirus F
agacauucuugagcaggccgcc

SEQ ID NO: 1581932 - RNA, 13 nt, Human adenovirus F
uuccacuggcaac

SEQ ID NO: 1581933 - RNA, 13 nt, Human adenovirus F
auugccacccgcc

SEQ ID NO: 1581934 - RNA, 20 nt, Human adenovirus F
guuggacuaccucagcgauc

SEQ ID NO: 1581935 - RNA, 15 nt, Human adenovirus F
aaguccuggccaacu

SEQ ID NO: 1581936 - RNA, 14 nt, Human adenovirus F
agccuucaggcagc

SEQ ID NO: 1581937 - RNA, 19 nt, Human adenovirus F
agcaagccgcugacggcgc

SEQ ID NO: 1581938 - RNA, 17 nt, Human adenovirus F
gagcccugaucagccag

SEQ ID NO: 1581939 - RNA, 17 nt, Human adenovirus F
cugggcggcggccaugg

SEQ ID NO: 1581940 - RNA, 14 nt, Human adenovirus F
ggcggaggagcaga

SEQ ID NO: 1581941 - RNA, 15 nt, Human adenovirus F
uucuccugcuugucu

SEQ ID NO: 1581942 - RNA, 15 nt, Human adenovirus F
ugaccggcgcuggga

SEQ ID NO: 1581943 - RNA, 17 nt, Human adenovirus F
gccggugauggcguacg

SEQ ID NO: 1581944 - RNA, 20 nt, Human adenovirus F
cucgacucgggugcuccuuu

SEQ ID NO: 1581945 - RNA, 19 nt, Human adenovirus F
aaaucuuccucccaaagua

SEQ ID NO: 1581946 - RNA, 14 nt, Human adenovirus F
auuggcaugagugg

SEQ ID NO: 1581947 - RNA, 22 nt, Human adenovirus F
ugaugccgcaauggucuuacau

SEQ ID NO: 1581948 - RNA, 14 nt, Human adenovirus F
caugaacacuuccg

SEQ ID NO: 1581949 - RNA, 20 nt, Human adenovirus F
cugucauacgcaggcacacc

SEQ ID NO: 1581950 - RNA, 16 nt, Human adenovirus F
ccgcaaugcuggucug

SEQ ID NO: 1581951 - RNA, 18 nt, Human adenovirus F
ugucaggcucugagagug

SEQ ID NO: 1581952 - RNA, 13 nt, Human adenovirus F
cugcccuuccucc

SEQ ID NO: 1581953 - RNA, 15 nt, Human adenovirus F
uuccuauuacagccc

SEQ ID NO: 1581954 - RNA, 15 nt, Human adenovirus F
ccugaaacgccgccg

SEQ ID NO: 1581955 - RNA, 13 nt, Human adenovirus F
cccaacucugagg

SEQ ID NO: 1581956 - RNA, 21 nt, Human adenovirus F
cuacguugcgauacugcaaac

SEQ ID NO: 1581957 - RNA, 14 nt, Human adenovirus F
agguccacacuggu

SEQ ID NO: 1581958 - RNA, 16 nt, Human adenovirus F
gguguguuuuuucaaa

SEQ ID NO: 1581959 - RNA, 13 nt, Human adenovirus F
gcaauggcucugu

SEQ ID NO: 1581960 - RNA, 16 nt, Human adenovirus F
cgccgucggaccugcc

SEQ ID NO: 1581961 - RNA, 17 nt, Human adenovirus F
agucccccuuacagccu

SEQ ID NO: 1581962 - RNA, 15 nt, Human adenovirus F
gauggcgauggggcc

SEQ ID NO: 1581963 - RNA, 17 nt, Human adenovirus F
cggaacccugccgcugc

SEQ ID NO: 1581964 - RNA, 12 nt, Human adenovirus F
aggcaaagcaac

SEQ ID NO: 1581965 - RNA, 15 nt, Human adenovirus F
gcggaguaacacaaa

SEQ ID NO: 1581966 - RNA, 20 nt, Human adenovirus F
aacacgcugccaacaaaugu

SEQ ID NO: 1581967 - RNA, 20 nt, Human adenovirus F
ucgcaaacaaagaaguacau

SEQ ID NO: 1581968 - RNA, 15 nt, Human adenovirus F
gccgcccgucaggcc

SEQ ID NO: 1581969 - RNA, 13 nt, Human adenovirus F
aaacacaaacaua

SEQ ID NO: 1581970 - RNA, 16 nt, Human adenovirus F
agccggaggagugggc

SEQ ID NO: 1581971 - RNA, 17 nt, Human adenovirus F
cagauggaaacugucag

SEQ ID NO: 1581972 - RNA, 22 nt, Human adenovirus F
ccagcuguuuaccaaaggcucc

SEQ ID NO: 1581973 - RNA, 17 nt, Human adenovirus F
cauggcagcagauuuug

SEQ ID NO: 1581974 - RNA, 22 nt, Human adenovirus F
ugccuccguguuuuuugaugcg

SEQ ID NO: 1581975 - RNA, 17 nt, Human adenovirus F
gaaggaaacgcugugag

SEQ ID NO: 1581976 - RNA, 16 nt, Human adenovirus F
guauaguccagcguuc

SEQ ID NO: 1581977 - RNA, 13 nt, Human adenovirus F
cauagcuggaggg

SEQ ID NO: 1581978 - RNA, 19 nt, Human adenovirus F
uuucaccgccuuggccagc

SEQ ID NO: 1581979 - RNA, 20 nt, Human adenovirus F
gucugccaaaauggcucugc

SEQ ID NO: 1581980 - RNA, 15 nt, Human adenovirus F
uggcccuggccugga

SEQ ID NO: 1581981 - RNA, 11 nt, Human adenovirus F
gggagccagga

SEQ ID NO: 1581982 - RNA, 16 nt, Human adenovirus F
aggauacaacguggcu

SEQ ID NO: 1581983 - RNA, 13 nt, Human adenovirus F
gugacacccucag

SEQ ID NO: 1581984 - RNA, 15 nt, Human adenovirus F
accugaaccacacuu

SEQ ID NO: 1581985 - RNA, 20 nt, Human adenovirus F
cuggacgucuuuugacgagc

SEQ ID NO: 1581986 - RNA, 19 nt, Human adenovirus F
gcuaaagggaacugccagu

SEQ ID NO: 1581987 - RNA, 18 nt, Human adenovirus F
ggcccaguugagggaagc

SEQ ID NO: 1581988 - RNA, 22 nt, Human adenovirus F
gggaaggauacaacguggcuca

SEQ ID NO: 1581989 - RNA, 14 nt, Human adenovirus F
uuagguuggcaaug

SEQ ID NO: 1581990 - RNA, 22 nt, Human adenovirus F
cggcugcuucugccagugcagg

SEQ ID NO: 1581991 - RNA, 12 nt, Human adenovirus F
gcucugcuuaac

SEQ ID NO: 1581992 - RNA, 18 nt, Human adenovirus F
aggacagucugccaacac

SEQ ID NO: 1581993 - RNA, 16 nt, Human adenovirus F
uaucuugcaaaacuuu

SEQ ID NO: 1581994 - RNA, 15 nt, Human adenovirus F
cagguuugacagcau

SEQ ID NO: 1581995 - RNA, 21 nt, Human adenovirus F
caggccgcccuaaccucuacc

SEQ ID NO: 1581996 - RNA, 18 nt, Human adenovirus F
cgcucaccgcccagggaa

SEQ ID NO: 1581997 - RNA, 14 nt, Human adenovirus F
agggaaggcgugga

SEQ ID NO: 1581998 - RNA, 23 nt, Human adenovirus F
gcccuccuuugcgcgaacagagu

SEQ ID NO: 1581999 - RNA, 19 nt, Human adenovirus F
gccucaaguggggcagacg

SEQ ID NO: 1582000 - RNA, 15 nt, Human adenovirus F
uuuugcaaacuauuc

SEQ ID NO: 1582001 - RNA, 22 nt, Human adenovirus F
aggacagucugccaacacuaac

SEQ ID NO: 1582002 - RNA, 19 nt, Human adenovirus F
uggcgguggucacucucag

SEQ ID NO: 1582003 - RNA, 16 nt, Human adenovirus F
cuauuacagcccccac

SEQ ID NO: 1582004 - RNA, 14 nt, Human adenovirus F
ucacccgcagcugc

SEQ ID NO: 1582005 - RNA, 18 nt, Human adenovirus F
gaucggcaccagccagcu

SEQ ID NO: 1582006 - RNA, 15 nt, Human adenovirus F
ccucaaggaaugcac

SEQ ID NO: 1582007 - RNA, 23 nt, Human adenovirus F
agggcacaguaaucaaggguuuc

SEQ ID NO: 1582008 - RNA, 16 nt, Human adenovirus F
ucaugcugcuguuuuu

SEQ ID NO: 1582009 - RNA, 17 nt, Human adenovirus F
ccgccaugacugccgcu

SEQ ID NO: 1582010 - RNA, 16 nt, Human adenovirus F
gccauagcuggagggc

SEQ ID NO: 1582011 - RNA, 19 nt, Human adenovirus F
aacaucccucacuaccauu

SEQ ID NO: 1582012 - RNA, 16 nt, Human adenovirus F
cccccggcggcgggug

SEQ ID NO: 1582013 - RNA, 16 nt, Human adenovirus F
gauggcgauggggccu

SEQ ID NO: 1582014 - RNA, 23 nt, Human adenovirus F
uuuaauauugcuuuauugccacc

SEQ ID NO: 1582015 - RNA, 17 nt, Human adenovirus F
gacugggcggcggccau

SEQ ID NO: 1582016 - RNA, 13 nt, Human adenovirus F
caggaagcagcuc

SEQ ID NO: 1582017 - RNA, 15 nt, Human adenovirus F
caguuuggcaaugga

SEQ ID NO: 1582018 - RNA, 14 nt, Human adenovirus F
uggaaucagcaucu

SEQ ID NO: 1582019 - RNA, 13 nt, Human adenovirus F
gcaguccacuuaa

SEQ ID NO: 1582020 - RNA, 18 nt, Human adenovirus F
gaggagcgcaacuuucag

SEQ ID NO: 1582021 - RNA, 18 nt, Human adenovirus F
cuccaguuuguggaggag

SEQ ID NO: 1582022 - RNA, 13 nt, Human adenovirus F
cuaaacucugagg

SEQ ID NO: 1582023 - RNA, 15 nt, Human adenovirus F
gacaggucgcagcga

SEQ ID NO: 1582024 - RNA, 17 nt, Human adenovirus F
cgucaugcucuggggug

SEQ ID NO: 1582025 - RNA, 21 nt, Human adenovirus F
uggaagagggcgaggggcugg

SEQ ID NO: 1582026 - RNA, 15 nt, Human adenovirus F
cgaccucccaaaguc

SEQ ID NO: 1582027 - RNA, 13 nt, Human adenovirus F
cggagccaaccuc

SEQ ID NO: 1582028 - RNA, 16 nt, Human adenovirus F
aagcccggguccaggc

SEQ ID NO: 1582029 - RNA, 15 nt, Human adenovirus F
accgcugcagcugcu

SEQ ID NO: 1582030 - RNA, 11 nt, Human adenovirus F
cuaguacgagc

SEQ ID NO: 1582031 - RNA, 16 nt, Human adenovirus F
accagugggcucccau

SEQ ID NO: 1582032 - RNA, 16 nt, Human adenovirus F
uugcugcacugccauc

SEQ ID NO: 1582033 - RNA, 23 nt, Human adenovirus F
ugccuuaacauuuaugcccaaca

SEQ ID NO: 1582034 - RNA, 15 nt, Human adenovirus F
aucgccaacagcccc

SEQ ID NO: 1582035 - RNA, 22 nt, Human adenovirus F
ccuggcaacaucggcaccccuc

SEQ ID NO: 1582036 - RNA, 19 nt, Human adenovirus F
uaaaaaugccaggcagcag

SEQ ID NO: 1582037 - RNA, 18 nt, Human adenovirus F
uggcaacccugaggagga

SEQ ID NO: 1582038 - RNA, 17 nt, Human adenovirus F
cccaccgaguuccugcg

SEQ ID NO: 1582039 - RNA, 14 nt, Human adenovirus F
gcccuggccuggaa

SEQ ID NO: 1582040 - RNA, 17 nt, Human adenovirus F
gcuggcccuggccugga

SEQ ID NO: 1582041 - RNA, 20 nt, Human adenovirus F
agacgcucaccgcccaggga

SEQ ID NO: 1582042 - RNA, 15 nt, Human adenovirus F
cugaaauacacugau

SEQ ID NO: 1582043 - RNA, 17 nt, Human adenovirus F
cuuucccccuguaccac

SEQ ID NO: 1582044 - RNA, 17 nt, Human adenovirus F
cuaaaucuuccucccaa

SEQ ID NO: 1582045 - RNA, 21 nt, Human adenovirus F
agccagcucaacgggggcgcu

SEQ ID NO: 1582046 - RNA, 17 nt, Human adenovirus F
uucaccgccuuggccag

SEQ ID NO: 1582047 - RNA, 15 nt, Human adenovirus F
ugcgcacccuggugg

SEQ ID NO: 1582048 - RNA, 14 nt, Human adenovirus F
cccgcccgccgccc

SEQ ID NO: 1582049 - RNA, 20 nt, Human adenovirus F
cccggcggcgggugcagugg

SEQ ID NO: 1582050 - RNA, 15 nt, Human adenovirus F
gcaauguugccaccg

SEQ ID NO: 1582051 - RNA, 20 nt, Human adenovirus F
aacagccuuuguaacaacug

SEQ ID NO: 1582052 - RNA, 20 nt, Human adenovirus F
ugcguggguguauaaaaggg

SEQ ID NO: 1582053 - RNA, 20 nt, Human adenovirus F
aucauuuccacaaaugucuu

SEQ ID NO: 1582054 - RNA, 14 nt, Human adenovirus F
ucacuuugccagag

SEQ ID NO: 1582055 - RNA, 20 nt, Human adenovirus F
uugcacgcucugcaucucuu

SEQ ID NO: 1582056 - RNA, 19 nt, Human adenovirus F
caguaccgcuccaucaagc

SEQ ID NO: 1582057 - RNA, 20 nt, Human adenovirus F
ggcguggccuccguggccuu

SEQ ID NO: 1582058 - RNA, 12 nt, Human adenovirus F
uccucccaaagu

SEQ ID NO: 1582059 - RNA, 14 nt, Human adenovirus F
cgcuaugugcagca

SEQ ID NO: 1582060 - RNA, 20 nt, Human adenovirus F
cgaguuccugcgcugcuacu

SEQ ID NO: 1582061 - RNA, 21 nt, Human adenovirus F
caugccacccaagggaaacaa

SEQ ID NO: 1582062 - RNA, 13 nt, Human adenovirus F
cacccgcagcugc

SEQ ID NO: 1582063 - RNA, 14 nt, Human adenovirus F
guaugaagcuaacc

SEQ ID NO: 1582064 - RNA, 22 nt, Human adenovirus F
gggauucuaagggaggcagcag

SEQ ID NO: 1582065 - RNA, 13 nt, Human adenovirus F
cccaaguggcccu

SEQ ID NO: 1582066 - RNA, 16 nt, Human adenovirus F
ucaaguuugguagcaa

SEQ ID NO: 1582067 - RNA, 20 nt, Human adenovirus F
gaggccgguacccagaccau

SEQ ID NO: 1582068 - RNA, 14 nt, Human adenovirus F
cccagcugguaagc

SEQ ID NO: 1582069 - RNA, 20 nt, Human adenovirus F
ggucaaucucuucguccugg

SEQ ID NO: 1582070 - RNA, 19 nt, Human adenovirus F
gccuuguaugggcagcauc

SEQ ID NO: 1582071 - RNA, 18 nt, Human adenovirus F
caccgcaaugcuggucug

SEQ ID NO: 1582072 - RNA, 17 nt, Human adenovirus F
cgcaggacuuggcagaa

SEQ ID NO: 1582073 - RNA, 14 nt, Human adenovirus F
ugggacgacagcca

SEQ ID NO: 1582074 - RNA, 18 nt, Human adenovirus F
ugcaggaagaggaggagg

SEQ ID NO: 1582075 - RNA, 10 nt, Human adenovirus F
ugaaauuaau

SEQ ID NO: 1582076 - RNA, 20 nt, Human adenovirus F
gaccugugggucgcagcagg

SEQ ID NO: 1582077 - RNA, 23 nt, Human adenovirus F
ucauuaucauauuggcucguuuc

SEQ ID NO: 1582078 - RNA, 17 nt, Human adenovirus F
uauacaccucccuuucc

SEQ ID NO: 1582079 - RNA, 19 nt, Human adenovirus F
ucuaccacuucuauugcac

SEQ ID NO: 1582080 - RNA, 17 nt, Human adenovirus F
gaaaaccuacgcccagg

SEQ ID NO: 1582081 - RNA, 12 nt, Human adenovirus F
gggcgcgguggu

SEQ ID NO: 1582082 - RNA, 22 nt, Human adenovirus F
uccauaccagaguaacuuuugc

SEQ ID NO: 1582083 - RNA, 23 nt, Human adenovirus F
ugagauuuguaguggagggauuu

SEQ ID NO: 1582084 - RNA, 18 nt, Human adenovirus F
agcugggacagcggaggc

SEQ ID NO: 1582085 - RNA, 14 nt, Human adenovirus F
aaacacacaucacu

SEQ ID NO: 1582086 - RNA, 22 nt, Human adenovirus F
agauggcgugggaguuggagga

SEQ ID NO: 1582087 - RNA, 21 nt, Human adenovirus F
uaccaccguugaugacgucau

SEQ ID NO: 1582088 - RNA, 18 nt, Human adenovirus F
cucuucaucccagccucg

SEQ ID NO: 1582089 - RNA, 18 nt, Human adenovirus F
aaugcaaacaacgaacuu

SEQ ID NO: 1582090 - RNA, 12 nt, Human adenovirus F
ucaggcagcagc

SEQ ID NO: 1582091 - RNA, 21 nt, Human adenovirus F
augccacccaagggaaacaag

SEQ ID NO: 1582092 - RNA, 18 nt, Human adenovirus F
ucgaggaaagcuuccagc

SEQ ID NO: 1582093 - RNA, 12 nt, Human adenovirus F
ugucgccccugu

SEQ ID NO: 1582094 - RNA, 13 nt, Human adenovirus F
aaacuuucuccac

SEQ ID NO: 1582095 - RNA, 19 nt, Human adenovirus F
gaggccauccuggaccugg

SEQ ID NO: 1582096 - RNA, 15 nt, Human adenovirus F
gccacgcaggagcuc

SEQ ID NO: 1582097 - RNA, 11 nt, Human adenovirus F
uugucugucug

SEQ ID NO: 1582098 - RNA, 22 nt, Human adenovirus F
cuggccguacgguuucugggcu

SEQ ID NO: 1582099 - RNA, 14 nt, Human adenovirus F
guuuaccaaaggcu

SEQ ID NO: 1582100 - RNA, 14 nt, Human adenovirus F
cagcaccgcacaga

SEQ ID NO: 1582101 - RNA, 21 nt, Human adenovirus F
ccaaagacaaaaucacuguuu

SEQ ID NO: 1582102 - RNA, 14 nt, Human adenovirus F
gcucaaggcgcacg

SEQ ID NO: 1582103 - RNA, 17 nt, Human adenovirus F
caaccgcacaugccagc

SEQ ID NO: 1582104 - RNA, 17 nt, Human adenovirus F
accccgucacucuccgc

SEQ ID NO: 1582105 - RNA, 16 nt, Human adenovirus F
gcuagcauaaaagaag

SEQ ID NO: 1582106 - RNA, 16 nt, Human adenovirus F
uuuggaagaugaguuu

SEQ ID NO: 1582107 - RNA, 15 nt, Human adenovirus F
guucguugucgcccc

SEQ ID NO: 1582108 - RNA, 20 nt, Human adenovirus F
gagcccccgugggggaccga

SEQ ID NO: 1582109 - RNA, 17 nt, Human adenovirus F
gguuucggguggagggu

SEQ ID NO: 1582110 - RNA, 11 nt, Human adenovirus F
cgccuccacca

SEQ ID NO: 1582111 - RNA, 19 nt, Human adenovirus F
gcaagauaugucugccaaa

SEQ ID NO: 1582112 - RNA, 14 nt, Human adenovirus F
ccuggaguuugggg

SEQ ID NO: 1582113 - RNA, 14 nt, Human adenovirus F
agggccggccugga

SEQ ID NO: 1582114 - RNA, 14 nt, Human adenovirus F
ccggcacugaugcc

SEQ ID NO: 1582115 - RNA, 14 nt, Human adenovirus F
caccuacucuggcu

SEQ ID NO: 1582116 - RNA, 12 nt, Human adenovirus F
aaauucuggaau

SEQ ID NO: 1582117 - RNA, 13 nt, Human adenovirus F
acuggccgcgucu

SEQ ID NO: 1582118 - RNA, 21 nt, Human adenovirus F
gguggucacucucagcugcua

SEQ ID NO: 1582119 - RNA, 21 nt, Human adenovirus F
agucggccaaguagcauuuua

SEQ ID NO: 1582120 - RNA, 23 nt, Human adenovirus F
cacauaucgucacuuccgccgca

SEQ ID NO: 1582121 - RNA, 21 nt, Human adenovirus F
aacagcagguuaaagccaacu

SEQ ID NO: 1582122 - RNA, 17 nt, Human adenovirus F
acugugcauuugggagc

SEQ ID NO: 1582123 - RNA, 17 nt, Human adenovirus F
ccauaguaacuuucaaa

SEQ ID NO: 1582124 - RNA, 23 nt, Human adenovirus F
cgcugucguuaguggaggcagcu

SEQ ID NO: 1582125 - RNA, 23 nt, Human adenovirus F
agaaaccccaccguggcucccac

SEQ ID NO: 1582126 - RNA, 15 nt, Human adenovirus F
ugggucgcagcaggu

SEQ ID NO: 1582127 - RNA, 13 nt, Human adenovirus F
cagugggacgagg

SEQ ID NO: 1582128 - RNA, 13 nt, Human adenovirus F
cacagaucacgga

SEQ ID NO: 1582129 - RNA, 18 nt, Human adenovirus F
aacggcggaugguggcaa

SEQ ID NO: 1582130 - RNA, 15 nt, Human adenovirus F
ucuaggcauaaaguu

SEQ ID NO: 1582131 - RNA, 23 nt, Human adenovirus F
ggcgacgacggauuuuuguggga

SEQ ID NO: 1582132 - RNA, 20 nt, Human adenovirus F
gcuaaacaugagcuuacuuu

SEQ ID NO: 1582133 - RNA, 22 nt, Human adenovirus F
uuagcccguuuugcauuuuugg

SEQ ID NO: 1582134 - RNA, 18 nt, Human adenovirus F
cccccguuugcuuccucc

SEQ ID NO: 1582135 - RNA, 13 nt, Human adenovirus F
caguggagcaagg

SEQ ID NO: 1582136 - RNA, 22 nt, Human adenovirus F
gucauacauuucgugggaaggg

SEQ ID NO: 1582137 - RNA, 18 nt, Human adenovirus F
uaacccuggaauuuuugc

SEQ ID NO: 1582138 - RNA, 16 nt, Human adenovirus F
aucccgcgcuaaaucu

SEQ ID NO: 1582139 - RNA, 18 nt, Human adenovirus F
ucuuaaguuauacaguga

SEQ ID NO: 1582140 - RNA, 14 nt, Human adenovirus F
gugaccgagcagcu

SEQ ID NO: 1582141 - RNA, 17 nt, Human adenovirus F
cucgucguggcauguuu

SEQ ID NO: 1582142 - RNA, 18 nt, Human adenovirus F
gcuaaggacgguggcaug

SEQ ID NO: 1582143 - RNA, 23 nt, Human adenovirus F
ucggacucggaaccugaaagaga

SEQ ID NO: 1582144 - RNA, 16 nt, Human adenovirus F
ugccugacucuuacaa

SEQ ID NO: 1582145 - RNA, 21 nt, Human adenovirus F
cgucacuuccgccgcaccgcg

SEQ ID NO: 1582146 - RNA, 21 nt, Human adenovirus F
caaaugucuuguggcugguga

SEQ ID NO: 1582147 - RNA, 16 nt, Human adenovirus F
gacaagacauggaaga

SEQ ID NO: 1582148 - RNA, 23 nt, Human adenovirus F
uuggaaaucgugcccguggaaaa

SEQ ID NO: 1582149 - RNA, 15 nt, Human adenovirus F
auaagaagccagcca

SEQ ID NO: 1582150 - RNA, 14 nt, Human adenovirus F
uaaaaaaaagggaa

SEQ ID NO: 1582151 - RNA, 16 nt, Human adenovirus F
ccacaauaagcagcuu

SEQ ID NO: 1582152 - RNA, 17 nt, Human adenovirus F
cucgcugucuggaacca

SEQ ID NO: 1582153 - RNA, 14 nt, Human adenovirus F
cuacucuggcuccg

SEQ ID NO: 1582154 - RNA, 17 nt, Human adenovirus F
cacccccaacucugagg

SEQ ID NO: 1582155 - RNA, 13 nt, Human adenovirus F
cggcgggaagagg

SEQ ID NO: 1582156 - RNA, 22 nt, Human adenovirus F
gucagcaacuacccuguagugg

SEQ ID NO: 1582157 - RNA, 17 nt, Human adenovirus F
cugugcagauggaaacu

SEQ ID NO: 1582158 - RNA, 23 nt, Human adenovirus F
gagggauucuaagggaggcagca

SEQ ID NO: 1582159 - RNA, 14 nt, Human adenovirus F
ccaccaaauuaaau

SEQ ID NO: 1582160 - RNA, 19 nt, Human adenovirus F
ucgaagguugacuugcagg

SEQ ID NO: 1582161 - RNA, 20 nt, Human adenovirus F
gacaacggacgugagagagg

SEQ ID NO: 1582162 - RNA, 15 nt, Human adenovirus F
gcgccauagcuggag

SEQ ID NO: 1582163 - RNA, 17 nt, Human adenovirus F
uaccacagaaaugucca

SEQ ID NO: 1582164 - RNA, 12 nt, Human adenovirus F
ccgucgucaggc

SEQ ID NO: 1582165 - RNA, 17 nt, Human adenovirus F
caaagcggcaaaagcuu

SEQ ID NO: 1582166 - RNA, 16 nt, Human adenovirus F
uucgcauuucuuuuuu

SEQ ID NO: 1582167 - RNA, 19 nt, Human adenovirus F
cucguuguuuuccucugac

SEQ ID NO: 1582168 - RNA, 15 nt, Human adenovirus F
agugaugcaccucuu

SEQ ID NO: 1582169 - RNA, 15 nt, Human adenovirus F
ugaaguuucacacuu

SEQ ID NO: 1582170 - RNA, 16 nt, Human adenovirus F
caguaccgcuccauca

SEQ ID NO: 1582171 - RNA, 15 nt, Human adenovirus F
cccguuugcuuccuc

SEQ ID NO: 1582172 - RNA, 15 nt, Human adenovirus F
ggauccauagagggc

SEQ ID NO: 1582173 - RNA, 19 nt, Human adenovirus F
accauuguacgagaagccc

SEQ ID NO: 1582174 - RNA, 20 nt, Human adenovirus F
cuuccggaaggauguuaaca

SEQ ID NO: 1582175 - RNA, 12 nt, Human adenovirus F
aauacaauuuuu

SEQ ID NO: 1582176 - RNA, 21 nt, Human adenovirus F
cauaaugcgggcucugauaau

SEQ ID NO: 1582177 - RNA, 22 nt, Human adenovirus F
auccaaaucucgccuaacauca

SEQ ID NO: 1582178 - RNA, 14 nt, Human adenovirus F
cacuuaccagagcc

SEQ ID NO: 1582179 - RNA, 18 nt, Human adenovirus F
ggcgucaugcucuggggu

SEQ ID NO: 1582180 - RNA, 13 nt, Human adenovirus F
gagcagcugcgua

SEQ ID NO: 1582181 - RNA, 13 nt, Human adenovirus F
acugccaccucca

SEQ ID NO: 1582182 - RNA, 17 nt, Human adenovirus F
guggauauagccaacca

SEQ ID NO: 1582183 - RNA, 17 nt, Human adenovirus F
gcaaacggugaacgagg

SEQ ID NO: 1582184 - RNA, 18 nt, Human adenovirus F
aaauccuucgagcaagcc

SEQ ID NO: 1582185 - RNA, 22 nt, Human adenovirus F
uagcuacuuucaucuuaacucu

SEQ ID NO: 1582186 - RNA, 20 nt, Human adenovirus F
aaccacgcccaugcagccau

SEQ ID NO: 1582187 - RNA, 15 nt, Human adenovirus F
gcaacccugaggagg

SEQ ID NO: 1582188 - RNA, 22 nt, Human adenovirus F
aacacagguucuuugcuggcaa

SEQ ID NO: 1582189 - RNA, 15 nt, Human adenovirus F
acugauccacuuaca

SEQ ID NO: 1582190 - RNA, 15 nt, Human adenovirus F
ccuacgugcacaaag

SEQ ID NO: 1582191 - RNA, 20 nt, Human adenovirus F
gaauuuggggcaucacucau

SEQ ID NO: 1582192 - RNA, 20 nt, Human adenovirus F
ccgccuuuucucaucacuga

SEQ ID NO: 1582193 - RNA, 18 nt, Human adenovirus F
cuagaaugucacugccgu

SEQ ID NO: 1582194 - RNA, 20 nt, Human adenovirus F
uauaccauuaagaagacugu

SEQ ID NO: 1582195 - RNA, 23 nt, Human adenovirus F
ugcagaggcguacaugccacaga

SEQ ID NO: 1582196 - RNA, 15 nt, Human adenovirus F
aagacaucaauuuug

SEQ ID NO: 1582197 - RNA, 18 nt, Human adenovirus F
cgcgaggaaaccgccuac

SEQ ID NO: 1582198 - RNA, 12 nt, Human adenovirus F
aacauuuaugcc

SEQ ID NO: 1582199 - RNA, 13 nt, Human adenovirus F
gaaucauuuccag

SEQ ID NO: 1582200 - RNA, 22 nt, Human adenovirus F
cucagggucgauggagccagcg

SEQ ID NO: 1582201 - RNA, 20 nt, Human adenovirus F
gcugaauauugcggagccug

SEQ ID NO: 1582202 - RNA, 14 nt, Human adenovirus F
aaagucggccaagu

SEQ ID NO: 1582203 - RNA, 22 nt, Human adenovirus F
gacucggaaccugaaagagagu

SEQ ID NO: 1582204 - RNA, 15 nt, Human adenovirus F
agucauccaaaucau

SEQ ID NO: 1582205 - RNA, 14 nt, Human adenovirus F
cgagcgccaucccc

SEQ ID NO: 1582206 - RNA, 19 nt, Human adenovirus F
gguuguaaagcgagccaaa

SEQ ID NO: 1582207 - RNA, 24 nt, Human adenovirus F
gcgcaacggcaaucccagcagaaa

SEQ ID NO: 1582208 - RNA, 19 nt, Human adenovirus F
gauucuucugugacaaaau

SEQ ID NO: 1582209 - RNA, 12 nt, Human adenovirus F
guguauaaaagg

SEQ ID NO: 1582210 - RNA, 23 nt, Human adenovirus F
guuaaagugcgccccauuaaaga

SEQ ID NO: 1582211 - RNA, 14 nt, Human adenovirus F
uguacucaaaugua

SEQ ID NO: 1582212 - RNA, 23 nt, Human adenovirus F
guagcauuuuaacaugagaucau

SEQ ID NO: 1582213 - RNA, 23 nt, Human adenovirus F
ccuccgguggcucugcagcagcg

SEQ ID NO: 1582214 - RNA, 20 nt, Human adenovirus F
acugcuagaaugucacugcc

SEQ ID NO: 1582215 - RNA, 15 nt, Human adenovirus F
cccgcaacggcgcag

SEQ ID NO: 1582216 - RNA, 16 nt, Human adenovirus F
ucgcaacguccucuac

SEQ ID NO: 1582217 - RNA, 14 nt, Human adenovirus F
ccuggccuggaacc

SEQ ID NO: 1582218 - RNA, 20 nt, Human adenovirus F
ccacuguuucuccuccccuu

SEQ ID NO: 1582219 - RNA, 15 nt, Human adenovirus F
cgucauccgccucca

SEQ ID NO: 1582220 - RNA, 14 nt, Human adenovirus F
ccgcgucugcugcu

SEQ ID NO: 1582221 - RNA, 20 nt, Human adenovirus F
gcugagcguucucgcucgcu

SEQ ID NO: 1582222 - RNA, 21 nt, Human adenovirus F
gaccgacuacuuacucccaac

SEQ ID NO: 1582223 - RNA, 15 nt, Human adenovirus F
ugcgucgcuggcucc

SEQ ID NO: 1582224 - RNA, 20 nt, Human adenovirus F
caccaguagcuuggaagcca

SEQ ID NO: 1582225 - RNA, 12 nt, Human adenovirus F
ucgcuggcuccg

SEQ ID NO: 1582226 - RNA, 17 nt, Human adenovirus F
guagcucuuccaagcug

SEQ ID NO: 1582227 - RNA, 13 nt, Human adenovirus F
acgacuaccucug

SEQ ID NO: 1582228 - RNA, 15 nt, Human adenovirus F
cggcgggaagaggac

SEQ ID NO: 1582229 - RNA, 21 nt, Human adenovirus F
ugugcccauagacaaggaggu

SEQ ID NO: 1582230 - RNA, 14 nt, Human adenovirus F
uguuucacauaucg

SEQ ID NO: 1582231 - RNA, 17 nt, Human adenovirus F
cagccccaggccaaccg

SEQ ID NO: 1582232 - RNA, 13 nt, Human adenovirus F
ugguaagcagccu

SEQ ID NO: 1582233 - RNA, 19 nt, Human adenovirus F
gaaaauagccgccagccuc

SEQ ID NO: 1582234 - RNA, 22 nt, Human adenovirus F
aaacuuuauggauguuuuccaa

SEQ ID NO: 1582235 - RNA, 14 nt, Human adenovirus F
guucgccuggagag

SEQ ID NO: 1582236 - RNA, 17 nt, Human adenovirus F
ucccucagagcugcaag

SEQ ID NO: 1582237 - RNA, 19 nt, Human adenovirus F
caauaagcagcuugaagaa

SEQ ID NO: 1582238 - RNA, 23 nt, Human adenovirus F
ucgaccgcgaggaaaccgccuac

SEQ ID NO: 1582239 - RNA, 18 nt, Human adenovirus F
ugcauccucccaacaacc

SEQ ID NO: 1582240 - RNA, 22 nt, Human adenovirus F
gcagguuuuacgcggggcagga

SEQ ID NO: 1582241 - RNA, 18 nt, Human adenovirus F
accuccgacgcuugcugg

SEQ ID NO: 1582242 - RNA, 15 nt, Human adenovirus F
acggguucucgccuc

SEQ ID NO: 1582243 - RNA, 23 nt, Human adenovirus F
ccgcaaccauguucacugaaagc

SEQ ID NO: 1582244 - RNA, 12 nt, Human adenovirus F
ugaaccacgcug

SEQ ID NO: 1582245 - RNA, 20 nt, Human adenovirus F
ccccagcugguaagcagccu

SEQ ID NO: 1582246 - RNA, 19 nt, Human adenovirus F
caccgcgcggcggccauga

SEQ ID NO: 1582247 - RNA, 16 nt, Human adenovirus F
ucgcagaaucuccugc

SEQ ID NO: 1582248 - RNA, 15 nt, Human adenovirus F
agaccaucaauuuug

SEQ ID NO: 1582249 - RNA, 15 nt, Human adenovirus F
ccaaacuucacggca

SEQ ID NO: 1582250 - RNA, 14 nt, Human adenovirus F
agcuucucagcuca

SEQ ID NO: 1582251 - RNA, 20 nt, Human adenovirus F
agcacuagaugcagcgcugc

SEQ ID NO: 1582252 - RNA, 14 nt, Human adenovirus F
aaagccaacuccaa

SEQ ID NO: 1582253 - RNA, 17 nt, Human adenovirus F
cccuuuuccagcaacuu

SEQ ID NO: 1582254 - RNA, 11 nt, Human adenovirus F
cuucugccaga

SEQ ID NO: 1582255 - RNA, 21 nt, Human adenovirus F
aacgggcggcaaaugcucugc

SEQ ID NO: 1582256 - RNA, 19 nt, Human adenovirus F
cugccaacucgacaacccu

SEQ ID NO: 1582257 - RNA, 16 nt, Human adenovirus F
gauaccgcugcagcug

SEQ ID NO: 1582258 - RNA, 14 nt, Human adenovirus F
auagcuggagggca

SEQ ID NO: 1582259 - RNA, 19 nt, Human adenovirus F
cugaaugcauguacacuau

SEQ ID NO: 1582260 - RNA, 19 nt, Human adenovirus F
gaacucaaaguaaaaaacc

SEQ ID NO: 1582261 - RNA, 21 nt, Human adenovirus F
ccguggcuggcgggcaaagcu

SEQ ID NO: 1582262 - RNA, 13 nt, Human adenovirus F
gauguuuuccaag

SEQ ID NO: 1582263 - RNA, 14 nt, Human adenovirus F
acggaaacaaaaaa

SEQ ID NO: 1582264 - RNA, 15 nt, Human adenovirus F
auuguguccugcaac

SEQ ID NO: 1582265 - RNA, 15 nt, Human adenovirus F
cgggcggcgccagac

SEQ ID NO: 1582266 - RNA, 14 nt, Human adenovirus F
uuuaauacagugac

SEQ ID NO: 1582267 - RNA, 22 nt, Human adenovirus F
cgcaaggaugaggcgggacuga

SEQ ID NO: 1582268 - RNA, 18 nt, Human adenovirus F
gaauggagcuguggugcg

SEQ ID NO: 1582269 - RNA, 14 nt, Human adenovirus F
cagccgugaagcca

SEQ ID NO: 1582270 - RNA, 23 nt, Human adenovirus F
gaagcacauagcgcgacagagca

SEQ ID NO: 1582271 - RNA, 23 nt, Human adenovirus F
caccuacuuugacauccgcggcg

SEQ ID NO: 1582272 - RNA, 16 nt, Human adenovirus F
aaagacguuaaagcug

SEQ ID NO: 1582273 - RNA, 14 nt, Human adenovirus F
cucaaacaacaaaa

SEQ ID NO: 1582274 - RNA, 22 nt, Human adenovirus F
ccaaagucccccuuacagccug

SEQ ID NO: 1582275 - RNA, 22 nt, Human adenovirus F
auauuuauacacucccuuugcc

SEQ ID NO: 1582276 - RNA, 10 nt, Human adenovirus F
cuuccaaauu

SEQ ID NO: 1582277 - RNA, 19 nt, Human adenovirus F
gugccuaugugcuggggaa

SEQ ID NO: 1582278 - RNA, 16 nt, Human adenovirus F
cgggcaguggccgccg

SEQ ID NO: 1582279 - RNA, 19 nt, Human adenovirus F
gaaguucagaacauggcuc

SEQ ID NO: 1582280 - RNA, 19 nt, Human adenovirus F
cgucugagccuuuguuccu

SEQ ID NO: 1582281 - RNA, 13 nt, Human adenovirus F
cccuagucccucc

SEQ ID NO: 1582282 - RNA, 19 nt, Human adenovirus F
ggcuccgacgcuuggcacc

SEQ ID NO: 1582283 - RNA, 22 nt, Human adenovirus F
ugcugaauauugcggagccuga

SEQ ID NO: 1582284 - RNA, 14 nt, Human adenovirus F
ggcuacccccgccc

SEQ ID NO: 1582285 - RNA, 23 nt, Human adenovirus F
caaaacaugcuguacgccaacuc

SEQ ID NO: 1582286 - RNA, 13 nt, Human adenovirus F
cuggcccgcuugg

SEQ ID NO: 1582287 - RNA, 19 nt, Human adenovirus F
cuaaaaaaacuccacccaa

SEQ ID NO: 1582288 - RNA, 19 nt, Human adenovirus F
cgcccaccaaauuaaauuu

SEQ ID NO: 1582289 - RNA, 18 nt, Human adenovirus F
gcgggaagagaggcagcc

SEQ ID NO: 1582290 - RNA, 14 nt, Human adenovirus F
uaacucucuuacau

SEQ ID NO: 1582291 - RNA, 14 nt, Human adenovirus F
uaacuuucuuacac

SEQ ID NO: 1582292 - RNA, 20 nt, Human adenovirus F
cuugccacccgcgcaacaca

SEQ ID NO: 1582293 - RNA, 17 nt, Human adenovirus F
ugcucccaaagugcugu

SEQ ID NO: 1582294 - RNA, 18 nt, Human adenovirus F
gagacgugcggugggagu

SEQ ID NO: 1582295 - RNA, 14 nt, Human adenovirus F
uagccaaccaggcc

SEQ ID NO: 1582296 - RNA, 22 nt, Human adenovirus F
gaacguguugguagagcuggag

SEQ ID NO: 1582297 - RNA, 22 nt, Human adenovirus F
agccccccucguacgagcaggc

SEQ ID NO: 1582298 - RNA, 16 nt, Human adenovirus F
acaccaguagcuugga

SEQ ID NO: 1582299 - RNA, 22 nt, Human adenovirus F
gguggaccccauggaugagccc

SEQ ID NO: 1582300 - RNA, 20 nt, Human adenovirus F
cgugagagaggcgguggcgc

SEQ ID NO: 1582301 - RNA, 13 nt, Human adenovirus F
cacacaucacugu

SEQ ID NO: 1582302 - RNA, 21 nt, Human adenovirus F
cgguuguuuuccaccaggggg

SEQ ID NO: 1582303 - RNA, 22 nt, Human adenovirus F
uucccugucguugccagccggu

SEQ ID NO: 1582304 - RNA, 14 nt, Human adenovirus F
cgcggucggcacgc

SEQ ID NO: 1582305 - RNA, 14 nt, Human adenovirus F
ucaacucagaauug

SEQ ID NO: 1582306 - RNA, 18 nt, Human adenovirus F
uaaaaacaaccaacuuca

SEQ ID NO: 1582307 - RNA, 12 nt, Human adenovirus F
aaugggcaaagg

SEQ ID NO: 1582308 - RNA, 13 nt, Human adenovirus F
ccggguccaggcu

SEQ ID NO: 1582309 - RNA, 20 nt, Human adenovirus F
cuuggaaucauccaccuggc

SEQ ID NO: 1582310 - RNA, 13 nt, Human adenovirus F
cacugauccacuu

SEQ ID NO: 1582311 - RNA, 12 nt, Human adenovirus F
cuucgcugcuuu

SEQ ID NO: 1582312 - RNA, 22 nt, Human adenovirus F
cagaucacggaacccugccgcu

SEQ ID NO: 1582313 - RNA, 12 nt, Human adenovirus F
aggaagcagcuc

SEQ ID NO: 1582314 - RNA, 19 nt, Human adenovirus F
agucacuacaauauuggcu

SEQ ID NO: 1582315 - RNA, 17 nt, Human adenovirus F
uaugcagacaagacaug

SEQ ID NO: 1582316 - RNA, 17 nt, Human adenovirus F
uaugcgcguugaaaggu

SEQ ID NO: 1582317 - RNA, 22 nt, Human adenovirus F
cugggcuggaugcauccuccca

SEQ ID NO: 1582318 - RNA, 18 nt, Human adenovirus F
gcgcacgugucggcggcc

SEQ ID NO: 1582319 - RNA, 19 nt, Human adenovirus F
cgacggaacguggaggaaa

SEQ ID NO: 1582320 - RNA, 17 nt, Human adenovirus F
gucgcgaacucuggacg

SEQ ID NO: 1582321 - RNA, 14 nt, Human adenovirus F
caaucccagcagaa

SEQ ID NO: 1582322 - RNA, 24 nt, Human adenovirus F
gauggagagcugggacagccuaga

SEQ ID NO: 1582323 - RNA, 13 nt, Human adenovirus F
ugguacaggagcg

SEQ ID NO: 1582324 - RNA, 12 nt, Human adenovirus F
cccaugcagcca

SEQ ID NO: 1582325 - RNA, 16 nt, Human adenovirus F
uccgccauugccaccc

SEQ ID NO: 1582326 - RNA, 17 nt, Human adenovirus F
gcuacuacuuuaacucu

SEQ ID NO: 1582327 - RNA, 21 nt, Human adenovirus F
cuuuauugccaccgcaaaaaa

SEQ ID NO: 1582328 - RNA, 18 nt, Human adenovirus F
acccucaaacacugcgca

SEQ ID NO: 1582329 - RNA, 17 nt, Human adenovirus F
uugguaacaaggccugg

SEQ ID NO: 1582330 - RNA, 15 nt, Human adenovirus F
cguugucgccccugu

SEQ ID NO: 1582331 - RNA, 23 nt, Human adenovirus F
ccaagcaagcccauucugccagu

SEQ ID NO: 1582332 - RNA, 14 nt, Human adenovirus F
ccgcugcagcugcu

SEQ ID NO: 1582333 - RNA, 17 nt, Human adenovirus F
acugucaggcucugaga

SEQ ID NO: 1582334 - RNA, 15 nt, Human adenovirus F
gcguccaguggagca

SEQ ID NO: 1582335 - RNA, 14 nt, Human adenovirus F
caacccgaccuaaa

SEQ ID NO: 1582336 - RNA, 15 nt, Human adenovirus F
gaauguggugggguc

SEQ ID NO: 1582337 - RNA, 15 nt, Human adenovirus F
agcgcccgggcccug

SEQ ID NO: 1582338 - RNA, 14 nt, Human adenovirus F
cgucaacuccucuu

SEQ ID NO: 1582339 - RNA, 19 nt, Human adenovirus F
auaauacagacgucucaag

SEQ ID NO: 1582340 - RNA, 23 nt, Human adenovirus F
agagugagguguaccaguccggg

SEQ ID NO: 1582341 - RNA, 14 nt, Human adenovirus F
acacaggagcuuua

SEQ ID NO: 1582342 - RNA, 16 nt, Human adenovirus F
gcaaacagugccacau

SEQ ID NO: 1582343 - RNA, 15 nt, Human adenovirus F
cggggcaggagcugc

SEQ ID NO: 1582344 - RNA, 21 nt, Human adenovirus F
auccauuaaaauuucuuguaa

SEQ ID NO: 1582345 - RNA, 15 nt, Human adenovirus F
gccuccgguggcucu

SEQ ID NO: 1582346 - RNA, 14 nt, Human adenovirus F
ucgccgcagucucc

SEQ ID NO: 1582347 - RNA, 15 nt, Human adenovirus F
gccucaaguggggca

SEQ ID NO: 1582348 - RNA, 18 nt, Human adenovirus F
auuagguggcucuaaguu

SEQ ID NO: 1582349 - RNA, 22 nt, Human adenovirus F
ccuggccguacgguuucugggc

SEQ ID NO: 1582350 - RNA, 16 nt, Human adenovirus F
aaugcagagcuugggc

SEQ ID NO: 1582351 - RNA, 20 nt, Human adenovirus F
gauaccuacuucagccuggg

SEQ ID NO: 1582352 - RNA, 18 nt, Human adenovirus F
ucacgcuguaccaggagg

SEQ ID NO: 1582353 - RNA, 23 nt, Human adenovirus F
cccacaaaagcuuucacuuuaau

SEQ ID NO: 1582354 - RNA, 23 nt, Human adenovirus F
caaguagggagugauggugggga

SEQ ID NO: 1582355 - RNA, 16 nt, Human adenovirus F
cgagaucggcaccagc

SEQ ID NO: 1582356 - RNA, 14 nt, Human adenovirus F
uggagccgacuuca

SEQ ID NO: 1582357 - RNA, 18 nt, Human adenovirus F
uaauuccauaacuaaaaa

SEQ ID NO: 1582358 - RNA, 17 nt, Human adenovirus F
uacuggauacuggcaag

SEQ ID NO: 1582359 - RNA, 18 nt, Human adenovirus F
uuucuuacacuagccauu

SEQ ID NO: 1582360 - RNA, 15 nt, Human adenovirus F
gaguuguggagugag

SEQ ID NO: 1582361 - RNA, 20 nt, Human adenovirus F
acuaucccguguuugacaac

SEQ ID NO: 1582362 - RNA, 15 nt, Human adenovirus F
gugccugagggcgac

SEQ ID NO: 1582363 - RNA, 23 nt, Human adenovirus F
acuuuuuuuguggccauuuucca

SEQ ID NO: 1582364 - RNA, 13 nt, Human adenovirus F
aggggcggagccu

SEQ ID NO: 1582365 - RNA, 20 nt, Human adenovirus F
ugugcaacacagccgggaca

SEQ ID NO: 1582366 - RNA, 18 nt, Human adenovirus F
ccaaaguaucuugcaaaa

SEQ ID NO: 1582367 - RNA, 15 nt, Human adenovirus F
caagcacauccaggg

SEQ ID NO: 1582368 - RNA, 20 nt, Human adenovirus F
cggcaaugcuuuugauggug

SEQ ID NO: 1582369 - RNA, 23 nt, Human adenovirus F
gcagagcccauugauccccaaca

SEQ ID NO: 1582370 - RNA, 18 nt, Human adenovirus F
cauuucuccgcgacggcg

SEQ ID NO: 1582371 - RNA, 16 nt, Human adenovirus F
ugccagaacuuccagc

SEQ ID NO: 1582372 - RNA, 15 nt, Human adenovirus F
ugugagcuggccugg

SEQ ID NO: 1582373 - RNA, 16 nt, Human adenovirus F
cguacaaguugcaaag

SEQ ID NO: 1582374 - RNA, 22 nt, Human adenovirus F
uccaggcuaaaacaaaggaggc

SEQ ID NO: 1582375 - RNA, 18 nt, Human adenovirus F
gcauggcgcuaaaggugu

SEQ ID NO: 1582376 - RNA, 19 nt, Human adenovirus F
cauuccauuuauuacaccc

SEQ ID NO: 1582377 - RNA, 22 nt, Human adenovirus F
auacuuuuucccaaaaaaagaa

SEQ ID NO: 1582378 - RNA, 16 nt, Human adenovirus F
cgcagaaacaugccac

SEQ ID NO: 1582379 - RNA, 22 nt, Human adenovirus F
uacuaccacuaccccuaccacc

SEQ ID NO: 1582380 - RNA, 17 nt, Human adenovirus F
ggaacuuccggaaggau

SEQ ID NO: 1582381 - RNA, 19 nt, Human adenovirus F
gauugugcaacacagccgg

SEQ ID NO: 1582382 - RNA, 22 nt, Human adenovirus F
gguacucucgaaacuuuuugcc

SEQ ID NO: 1582383 - RNA, 15 nt, Human adenovirus F
uuauacaccucccuu

SEQ ID NO: 1582384 - RNA, 23 nt, Human adenovirus F
gcucugguagaaagcaaagccau

SEQ ID NO: 1582385 - RNA, 15 nt, Human adenovirus F
augcuggucugcgcu

SEQ ID NO: 1582386 - RNA, 12 nt, Human adenovirus F
ccgcccgccucu

SEQ ID NO: 1582387 - RNA, 22 nt, Human adenovirus F
caggccuccaauuugacaauaa

SEQ ID NO: 1582388 - RNA, 20 nt, Human adenovirus F
augugccgcgcgggcaggag

SEQ ID NO: 1582389 - RNA, 14 nt, Human adenovirus F
ggcaccggcacuga

SEQ ID NO: 1582390 - RNA, 17 nt, Human adenovirus F
ucacugcuaccuccucc

SEQ ID NO: 1582391 - RNA, 14 nt, Human adenovirus F
aagagccaccuugu

SEQ ID NO: 1582392 - RNA, 14 nt, Human adenovirus F
auuaugagcaaaga

SEQ ID NO: 1582393 - RNA, 20 nt, Human adenovirus F
auacuuuaaacaagcaaaga

SEQ ID NO: 1582394 - RNA, 16 nt, Human adenovirus F
cuggccaacugccacc

SEQ ID NO: 1582395 - RNA, 14 nt, Human adenovirus F
cuuucaacaaaaag

SEQ ID NO: 1582396 - RNA, 15 nt, Human adenovirus F
guugcucucuccgga

SEQ ID NO: 1582397 - RNA, 17 nt, Human adenovirus F
acgaucgcuccaggugg

SEQ ID NO: 1582398 - RNA, 17 nt, Human adenovirus F
gcgucaugcucuggggu

SEQ ID NO: 1582399 - RNA, 10 nt, Human adenovirus F
cuugggcagg

SEQ ID NO: 1582400 - RNA, 15 nt, Human adenovirus F
gcacacagaacaaaa

SEQ ID NO: 1582401 - RNA, 20 nt, Human adenovirus F
ucuuaccgcgacaaagcaca

SEQ ID NO: 1582402 - RNA, 17 nt, Human adenovirus F
cgcauuaccauuaguaa

SEQ ID NO: 1582403 - RNA, 17 nt, Human adenovirus F
aggcccuugugccugaa

SEQ ID NO: 1582404 - RNA, 20 nt, Human adenovirus F
guagggauugagugggaagc

SEQ ID NO: 1582405 - RNA, 12 nt, Human adenovirus F
ucgggcgcgggu

SEQ ID NO: 1582406 - RNA, 15 nt, Human adenovirus F
caaaugcucugcaaa

SEQ ID NO: 1582407 - RNA, 22 nt, Human adenovirus F
gccaguuggggauuggcggcua

SEQ ID NO: 1582408 - RNA, 21 nt, Human adenovirus F
uuucagggcaacguucagcca

SEQ ID NO: 1582409 - RNA, 15 nt, Human adenovirus F
ccggccuggacccuu

SEQ ID NO: 1582410 - RNA, 21 nt, Human adenovirus F
gauuccugggguagggugucu

SEQ ID NO: 1582411 - RNA, 15 nt, Human adenovirus F
uugccgcagccagug

SEQ ID NO: 1582412 - RNA, 19 nt, Human adenovirus F
acaacacaggagcuuuaca

SEQ ID NO: 1582413 - RNA, 15 nt, Human adenovirus F
auagccaaccaggcc

SEQ ID NO: 1582414 - RNA, 13 nt, Human adenovirus F
gucuggaaccacu

SEQ ID NO: 1582415 - RNA, 15 nt, Human adenovirus F
cccuuuuccagcaac

SEQ ID NO: 1582416 - RNA, 23 nt, Human adenovirus F
ggaucccagcguugagccggaag

SEQ ID NO: 1582417 - RNA, 18 nt, Human adenovirus F
uguacguuuguugcaugu

SEQ ID NO: 1582418 - RNA, 15 nt, Human adenovirus F
gcuuggauuaggaag

SEQ ID NO: 1582419 - RNA, 16 nt, Human adenovirus F
caacaaaaauacauau

SEQ ID NO: 1582420 - RNA, 13 nt, Human adenovirus F
ggucauugggcuu

SEQ ID NO: 1582421 - RNA, 22 nt, Human adenovirus F
ggagccggcgguggcaacccug

SEQ ID NO: 1582422 - RNA, 18 nt, Human adenovirus F
cuugcucggugcagccgu

SEQ ID NO: 1582423 - RNA, 19 nt, Human adenovirus F
ucacaacaccgcuuccacc

SEQ ID NO: 1582424 - RNA, 15 nt, Human adenovirus F
ucuccccacagccgu

SEQ ID NO: 1582425 - RNA, 20 nt, Human adenovirus F
gcuaauuuuucaccaaaggu

SEQ ID NO: 1582426 - RNA, 15 nt, Human adenovirus F
auauaggacaaaaaa

SEQ ID NO: 1582427 - RNA, 13 nt, Human adenovirus F
gccauugccaccc

SEQ ID NO: 1582428 - RNA, 22 nt, Human adenovirus F
agcccgcaacggcgcagcagau

SEQ ID NO: 1582429 - RNA, 19 nt, Human adenovirus F
augcuacacaacaaaucau

SEQ ID NO: 1582430 - RNA, 17 nt, Human adenovirus F
cagauggagagcuggga

SEQ ID NO: 1582431 - RNA, 18 nt, Human adenovirus F
gcaaguuucgcaaaagcu

SEQ ID NO: 1582432 - RNA, 20 nt, Human adenovirus F
aacggcgugguggauauagc

SEQ ID NO: 1582433 - RNA, 13 nt, Human adenovirus F
agcaaaaccucca

SEQ ID NO: 1582434 - RNA, 13 nt, Human adenovirus F
cgugguaaaaggg

SEQ ID NO: 1582435 - RNA, 17 nt, Human adenovirus F
uuguacaaagucaucca

SEQ ID NO: 1582436 - RNA, 20 nt, Human adenovirus F
gccgcgccaaccguacacgc

SEQ ID NO: 1582437 - RNA, 17 nt, Human adenovirus F
gggaguaaaaagccuga

SEQ ID NO: 1582438 - RNA, 14 nt, Human adenovirus F
cuccaacguagagc

SEQ ID NO: 1582439 - RNA, 19 nt, Human adenovirus F
aguuaaccuugaguuuaau

SEQ ID NO: 1582440 - RNA, 17 nt, Human adenovirus F
aagaccaacugcagcgc

SEQ ID NO: 1582441 - RNA, 21 nt, Human adenovirus F
cuugcaggagccgaauugccu

SEQ ID NO: 1582442 - RNA, 18 nt, Human adenovirus F
uacaauauuggcuaccag

SEQ ID NO: 1582443 - RNA, 17 nt, Human adenovirus F
uccuccuucacaaaguc

SEQ ID NO: 1582444 - RNA, 14 nt, Human adenovirus F
aauguaacucuccc

SEQ ID NO: 1582445 - RNA, 12 nt, Human adenovirus F
gaaaaccccgcc

SEQ ID NO: 1582446 - RNA, 20 nt, Human adenovirus F
agaacuggaguaacacaaug

SEQ ID NO: 1582447 - RNA, 13 nt, Human adenovirus F
augcuauuuucca

SEQ ID NO: 1582448 - RNA, 14 nt, Human adenovirus F
ucgcuccagguggg

SEQ ID NO: 1582449 - RNA, 14 nt, Human adenovirus F
uacagcccaacacc

SEQ ID NO: 1582450 - RNA, 22 nt, Human adenovirus F
ccugagaucguuucuuuagaag

SEQ ID NO: 1582451 - RNA, 15 nt, Human adenovirus F
agauccguggagccg

SEQ ID NO: 1582452 - RNA, 14 nt, Human adenovirus F
ugggacgaggagga

SEQ ID NO: 1582453 - RNA, 21 nt, Human adenovirus F
ucaccgccuuggccagcagcc

SEQ ID NO: 1582454 - RNA, 13 nt, Human adenovirus F
uauucaccaccuu

SEQ ID NO: 1582455 - RNA, 19 nt, Human adenovirus F
ugucaugcaacuuggaagg

SEQ ID NO: 1582456 - RNA, 21 nt, Human adenovirus F
uagcaccaacgugcaggccaa

SEQ ID NO: 1582457 - RNA, 13 nt, Human adenovirus F
guagcguguugga

SEQ ID NO: 1582458 - RNA, 16 nt, Human adenovirus F
caauuugcuaacacua

SEQ ID NO: 1582459 - RNA, 20 nt, Human adenovirus F
caaucucuucguccuggagu

SEQ ID NO: 1582460 - RNA, 14 nt, Human adenovirus F
gaacguuuugacau

SEQ ID NO: 1582461 - RNA, 15 nt, Human adenovirus F
gaccgagcagcugcg

SEQ ID NO: 1582462 - RNA, 20 nt, Human adenovirus F
augugucuccgcugggagaa

SEQ ID NO: 1582463 - RNA, 19 nt, Human adenovirus F
ugggaacuguccagggagu

SEQ ID NO: 1582464 - RNA, 19 nt, Human adenovirus F
agcgucggcgccacacugu

SEQ ID NO: 1582465 - RNA, 23 nt, Human adenovirus F
acgugcggugggagugccgccgg

SEQ ID NO: 1582466 - RNA, 13 nt, Human adenovirus F
cgccccugugagu

SEQ ID NO: 1582467 - RNA, 17 nt, Human adenovirus F
guagcguguuggacuug

SEQ ID NO: 1582468 - RNA, 22 nt, Human adenovirus F
cuguguuaucacccaaagccaa

SEQ ID NO: 1582469 - RNA, 13 nt, Human adenovirus F
uggaggcggcugg

SEQ ID NO: 1582470 - RNA, 22 nt, Human adenovirus F
ccuagcugcuuuaaucgcugga

SEQ ID NO: 1582471 - RNA, 15 nt, Human adenovirus F
augugccgcgcgggc

SEQ ID NO: 1582472 - RNA, 19 nt, Human adenovirus F
aucuuaagcugcagccaga

SEQ ID NO: 1582473 - RNA, 14 nt, Human adenovirus F
cggagacgagcugc

SEQ ID NO: 1582474 - RNA, 14 nt, Human adenovirus F
aaaugacuaacucc

SEQ ID NO: 1582475 - RNA, 18 nt, Human adenovirus F
ugccaccgcaaccauguu

SEQ ID NO: 1582476 - RNA, 17 nt, Human adenovirus F
ucccagucugccaucgc

SEQ ID NO: 1582477 - RNA, 15 nt, Human adenovirus F
gccugacucuuacaa

SEQ ID NO: 1582478 - RNA, 19 nt, Human adenovirus F
gaggcuuuccgcgaggcca

SEQ ID NO: 1582479 - RNA, 16 nt, Human adenovirus F
gguuaauaagcugggu

SEQ ID NO: 1582480 - RNA, 20 nt, Human adenovirus F
cgaccuuuucuaggguguga

SEQ ID NO: 1582481 - RNA, 23 nt, Human adenovirus F
uccugaaugugucuccgcuggga

SEQ ID NO: 1582482 - RNA, 15 nt, Human adenovirus F
aggaagggcaaaggu

SEQ ID NO: 1582483 - RNA, 14 nt, Human adenovirus F
gacaaaaucacugu

SEQ ID NO: 1582484 - RNA, 21 nt, Human adenovirus F
cgucaggccgcccgucaggcc

SEQ ID NO: 1582485 - RNA, 21 nt, Human adenovirus F
gguucgaguucacuuugccag

SEQ ID NO: 1582486 - RNA, 15 nt, Human adenovirus F
guagccccuugguga

SEQ ID NO: 1582487 - RNA, 23 nt, Human adenovirus F
guuaaaaagcgagaaaaaaaaga

SEQ ID NO: 1582488 - RNA, 17 nt, Human adenovirus F
ggcgaggggcuggcccg

SEQ ID NO: 1582489 - RNA, 16 nt, Human adenovirus F
caggcagcagccccag

SEQ ID NO: 1582490 - RNA, 19 nt, Human adenovirus F
uugauuuucuuugccaccu

SEQ ID NO: 1582491 - RNA, 15 nt, Human adenovirus F
ugauuucauuuacca

SEQ ID NO: 1582492 - RNA, 20 nt, Human adenovirus F
ggagugccgccggugauggc

SEQ ID NO: 1582493 - RNA, 10 nt, Human adenovirus F
ccauuuccaa

SEQ ID NO: 1582494 - RNA, 23 nt, Human adenovirus F
gaugguaaaaaugccaggcagca

SEQ ID NO: 1582495 - RNA, 13 nt, Human adenovirus F
uggccccuaccag

SEQ ID NO: 1582496 - RNA, 20 nt, Human adenovirus F
caccuuguguuuaagccaga

SEQ ID NO: 1582497 - RNA, 15 nt, Human adenovirus F
caugaaacuggaaga

SEQ ID NO: 1582498 - RNA, 12 nt, Human adenovirus F
ggaagggaaggc

SEQ ID NO: 1582499 - RNA, 16 nt, Human adenovirus F
cggguuuaccuggugg

SEQ ID NO: 1582500 - RNA, 17 nt, Human adenovirus F
aaaagacccauuuccaa

SEQ ID NO: 1582501 - RNA, 11 nt, Human adenovirus F
ccgagggcuuc

SEQ ID NO: 1582502 - RNA, 23 nt, Human adenovirus F
ggcguugauaugaugaaaguaga

SEQ ID NO: 1582503 - RNA, 20 nt, Human adenovirus F
ccguuucucgccccaccgcc

SEQ ID NO: 1582504 - RNA, 20 nt, Human adenovirus F
ugccuuuucacauccaagug

SEQ ID NO: 1582505 - RNA, 17 nt, Human adenovirus F
aaugcuccgggauaagc

SEQ ID NO: 1582506 - RNA, 16 nt, Human adenovirus F
ugcauacaacucccug

SEQ ID NO: 1582507 - RNA, 16 nt, Human adenovirus F
gcuugcccuuggaaau

SEQ ID NO: 1582508 - RNA, 15 nt, Human adenovirus F
augcaacuuggaagg

SEQ ID NO: 1582509 - RNA, 16 nt, Human adenovirus F
gcgucggcgccacacu

SEQ ID NO: 1582510 - RNA, 14 nt, Human adenovirus F
caccaacugcucuu

SEQ ID NO: 1582511 - RNA, 22 nt, Human adenovirus F
acagaccgcaggacuuggcaga

SEQ ID NO: 1582512 - RNA, 20 nt, Human adenovirus F
aggcguggaaaaacuuggaa

SEQ ID NO: 1582513 - RNA, 18 nt, Human adenovirus F
uagggugucugccagagg

SEQ ID NO: 1582514 - RNA, 21 nt, Human adenovirus F
acacagaacaaaacacacucc

SEQ ID NO: 1582515 - RNA, 18 nt, Human adenovirus F
uucuccuccccuuacaaa

SEQ ID NO: 1582516 - RNA, 17 nt, Human adenovirus F
gagcaugaaacuggaag

SEQ ID NO: 1582517 - RNA, 14 nt, Human adenovirus F
gugcuuccagccuc

SEQ ID NO: 1582518 - RNA, 21 nt, Human adenovirus F
uuuucagguggggggucggcg

SEQ ID NO: 1582519 - RNA, 16 nt, Human adenovirus F
cuagccaacuauuugg

SEQ ID NO: 1582520 - RNA, 12 nt, Human adenovirus F
uccagccucaaa

SEQ ID NO: 1582521 - RNA, 19 nt, Human adenovirus F
uacaagcuauucagcaggc

SEQ ID NO: 1582522 - RNA, 15 nt, Human adenovirus F
gaagccuucaggcag

SEQ ID NO: 1582523 - RNA, 18 nt, Human adenovirus F
ugcaccgcgcggcggcca

SEQ ID NO: 1582524 - RNA, 13 nt, Human adenovirus F
uggaccuggaaga

SEQ ID NO: 1582525 - RNA, 12 nt, Human adenovirus F
uucacugaaagc

SEQ ID NO: 1582526 - RNA, 20 nt, Human adenovirus F
gguggauaccgcugcagcug

SEQ ID NO: 1582527 - RNA, 19 nt, Human adenovirus F
acugccguugcaaccucug

SEQ ID NO: 1582528 - RNA, 14 nt, Human adenovirus F
aggccagucggcag

SEQ ID NO: 1582529 - RNA, 13 nt, Human adenovirus F
aacaaggccugga

SEQ ID NO: 1582530 - RNA, 14 nt, Human adenovirus F
gcucuuccaagcug

SEQ ID NO: 1582531 - RNA, 12 nt, Human adenovirus F
caacgcaguggu

SEQ ID NO: 1582532 - RNA, 18 nt, Human adenovirus F
gcuuacucuuucuuacaa

SEQ ID NO: 1582533 - RNA, 14 nt, Human adenovirus F
aaaugccuaccucu

SEQ ID NO: 1582534 - RNA, 12 nt, Human adenovirus F
caaaaugagugg

SEQ ID NO: 1582535 - RNA, 23 nt, Human adenovirus F
agcaaaaauguuaucgggguggg

SEQ ID NO: 1582536 - RNA, 12 nt, Human adenovirus F
ccuccgacccca

SEQ ID NO: 1582537 - RNA, 17 nt, Human adenovirus F
acagaugucauaaacgu

SEQ ID NO: 1582538 - RNA, 15 nt, Human adenovirus F
gguucucuucaggcu

SEQ ID NO: 1582539 - RNA, 13 nt, Human adenovirus F
augugcucgcaaa

SEQ ID NO: 1582540 - RNA, 17 nt, Human adenovirus F
gcgguggucacucucag

SEQ ID NO: 1582541 - RNA, 22 nt, Human adenovirus F
acugcuaaagggaacugccagu

SEQ ID NO: 1582542 - RNA, 16 nt, Human adenovirus F
cgucacuuccgccgca

SEQ ID NO: 1582543 - RNA, 16 nt, Human adenovirus F
cccugucguugccagc

SEQ ID NO: 1582544 - RNA, 19 nt, Human adenovirus F
cccagguuuaauacaguga

SEQ ID NO: 1582545 - RNA, 15 nt, Human adenovirus F
ucccgcccucacaga

SEQ ID NO: 1582546 - RNA, 14 nt, Human adenovirus F
cacgcucugcaucu

SEQ ID NO: 1582547 - RNA, 12 nt, Human adenovirus F
cccuaacauggc

SEQ ID NO: 1582548 - RNA, 23 nt, Human adenovirus F
ucucguuuaauccgugcgcugcc

SEQ ID NO: 1582549 - RNA, 21 nt, Human adenovirus F
gaacgaccauaguaacuuuca

SEQ ID NO: 1582550 - RNA, 22 nt, Human adenovirus F
aggauccauagagggcguugga

SEQ ID NO: 1582551 - RNA, 22 nt, Human adenovirus F
caccguuagcacugcgguggag

SEQ ID NO: 1582552 - RNA, 16 nt, Human adenovirus F
ugaccgagcagcugcg

SEQ ID NO: 1582553 - RNA, 22 nt, Human adenovirus F
gagcccugaucagccagguggu

SEQ ID NO: 1582554 - RNA, 17 nt, Human adenovirus F
gaaacacacaucacugu

SEQ ID NO: 1582555 - RNA, 23 nt, Human adenovirus F
cucuacgucaccuuacaccaccc

SEQ ID NO: 1582556 - RNA, 18 nt, Human adenovirus F
gccguugcucucuccgga

SEQ ID NO: 1582557 - RNA, 19 nt, Human adenovirus F
ugauuuucuuugccaccuu

SEQ ID NO: 1582558 - RNA, 13 nt, Human adenovirus F
agugcaggaagag

SEQ ID NO: 1582559 - RNA, 14 nt, Human adenovirus F
ccuaugacaccucc

SEQ ID NO: 1582560 - RNA, 19 nt, Human adenovirus F
aguucgcgguucaggaggu

SEQ ID NO: 1582561 - RNA, 19 nt, Human adenovirus F
gacggccguaccaagccug

SEQ ID NO: 1582562 - RNA, 16 nt, Human adenovirus F
cuaacuggcagagcac

SEQ ID NO: 1582563 - RNA, 17 nt, Human adenovirus F
acucauccauaaugaug

SEQ ID NO: 1582564 - RNA, 13 nt, Human adenovirus F
auucugaagagga

SEQ ID NO: 1582565 - RNA, 18 nt, Human adenovirus F
cuaucaggaagcagcuca

SEQ ID NO: 1582566 - RNA, 20 nt, Human adenovirus F
cccccggcggcgggugcagu

SEQ ID NO: 1582567 - RNA, 16 nt, Human adenovirus F
caggaucccucagagc

SEQ ID NO: 1582568 - RNA, 18 nt, Human adenovirus F
gacauucuugagcaggcc

SEQ ID NO: 1582569 - RNA, 12 nt, Human adenovirus F
uugacuugcagg

SEQ ID NO: 1582570 - RNA, 23 nt, Human adenovirus F
uggcagcccagcgcccgggcccu

SEQ ID NO: 1582571 - RNA, 20 nt, Human adenovirus F
gcgcggaagaagaugaggag

SEQ ID NO: 1582572 - RNA, 11 nt, Human adenovirus F
cagggcacagu

SEQ ID NO: 1582573 - RNA, 15 nt, Human adenovirus F
cagaccccauggaca

SEQ ID NO: 1582574 - RNA, 22 nt, Human adenovirus F
uagucauacauuucgugggaag

SEQ ID NO: 1582575 - RNA, 12 nt, Human adenovirus F
aauccuuuuugg

SEQ ID NO: 1582576 - RNA, 17 nt, Human adenovirus F
gagaucacgucuggggu

SEQ ID NO: 1582577 - RNA, 23 nt, Human adenovirus F
gggccccugaggcagcgacaggg

SEQ ID NO: 1582578 - RNA, 20 nt, Human adenovirus F
uuaacacuggcagaggcuua

SEQ ID NO: 1582579 - RNA, 21 nt, Human adenovirus F
gguaaaaaugccaggcagcag

SEQ ID NO: 1582580 - RNA, 17 nt, Human adenovirus F
gcggcaaugcuuuugau

SEQ ID NO: 1582581 - RNA, 22 nt, Human adenovirus F
cagacggccguaccaagccuga

SEQ ID NO: 1582582 - RNA, 21 nt, Human adenovirus F
caccguuccgcccaugccggc

SEQ ID NO: 1582583 - RNA, 19 nt, Human adenovirus F
ugauuuccauuggugaguu

SEQ ID NO: 1582584 - RNA, 24 nt, Human adenovirus F
aaaucuucaaacauuaagcugcaa

SEQ ID NO: 1582585 - RNA, 19 nt, Human adenovirus F
cuaccucugcgcugcaaac

SEQ ID NO: 1582586 - RNA, 12 nt, Human adenovirus F
acgcccaggagc

SEQ ID NO: 1582587 - RNA, 22 nt, Human adenovirus F
cgagccacagguccagaccuca

SEQ ID NO: 1582588 - RNA, 14 nt, Human adenovirus F
ccgaaguccaaaug

SEQ ID NO: 1582589 - RNA, 14 nt, Human adenovirus F
agacccauuuccaa

SEQ ID NO: 1582590 - RNA, 17 nt, Human adenovirus F
caugcacaucgccgggc

SEQ ID NO: 1582591 - RNA, 18 nt, Human adenovirus F
gccgccaggugguagaca

SEQ ID NO: 1582592 - RNA, 13 nt, Human adenovirus F
agccccaggccaa

SEQ ID NO: 1582593 - RNA, 19 nt, Human adenovirus F
ccucauacaaaugcucagu

SEQ ID NO: 1582594 - RNA, 21 nt, Human adenovirus F
acauagcaaaagcauuuuccu

SEQ ID NO: 1582595 - RNA, 17 nt, Human adenovirus F
guacgguuucugggcuu

SEQ ID NO: 1582596 - RNA, 24 nt, Human adenovirus F
auuccugggguagggugucugcca

SEQ ID NO: 1582597 - RNA, 17 nt, Human adenovirus F
ugggggcgccauccccc

SEQ ID NO: 1582598 - RNA, 17 nt, Human adenovirus F
cacucuccgccgccgcu

SEQ ID NO: 1582599 - RNA, 17 nt, Human adenovirus F
cagccaaugggcuccag

SEQ ID NO: 1582600 - RNA, 14 nt, Human adenovirus F
guaaacugauuuga

SEQ ID NO: 1582601 - RNA, 20 nt, Human adenovirus F
cgggcgguacuaaggcgggc

SEQ ID NO: 1582602 - RNA, 22 nt, Human adenovirus F
aaguucaacaucaaccagugca

SEQ ID NO: 1582603 - RNA, 23 nt, Human adenovirus F
gccuuguaugggcagcauccuuu

SEQ ID NO: 1582604 - RNA, 21 nt, Human adenovirus F
ucuaagggaacuucuccccuu

SEQ ID NO: 1582605 - RNA, 14 nt, Human adenovirus F
ccagccggaggagu

SEQ ID NO: 1582606 - RNA, 14 nt, Human adenovirus F
ucacugaaagccag

SEQ ID NO: 1582607 - RNA, 16 nt, Human adenovirus F
gcagccuguggagugg

SEQ ID NO: 1582608 - RNA, 16 nt, Human adenovirus F
cugaggaggaggccau

SEQ ID NO: 1582609 - RNA, 20 nt, Human adenovirus F
aacggcggaugguggcaagg

SEQ ID NO: 1582610 - RNA, 14 nt, Human adenovirus F
gccaucugcagcau

SEQ ID NO: 1582611 - RNA, 20 nt, Human adenovirus F
augggagugcuggccgggca

SEQ ID NO: 1582612 - RNA, 21 nt, Human adenovirus F
gcacuuggggaauuugucaug

SEQ ID NO: 1582613 - RNA, 17 nt, Human adenovirus F
cauucccuuuuccagca

SEQ ID NO: 1582614 - RNA, 14 nt, Human adenovirus F
cuuuaccccgacag

SEQ ID NO: 1582615 - RNA, 21 nt, Human adenovirus F
accagcacacagggauacugg

SEQ ID NO: 1582616 - RNA, 15 nt, Human adenovirus F
gcuccuggguaacgg

SEQ ID NO: 1582617 - RNA, 19 nt, Human adenovirus F
aggagcagauggagagcug

SEQ ID NO: 1582618 - RNA, 23 nt, Human adenovirus F
cuccgauuuugucccccucugcu

SEQ ID NO: 1582619 - RNA, 22 nt, Human adenovirus F
caggucgggcccgucgucaggc

SEQ ID NO: 1582620 - RNA, 14 nt, Human adenovirus F
uuagauguggaaaa

SEQ ID NO: 1582621 - RNA, 23 nt, Human adenovirus F
accgcuaauuuuucaccaaaggu

SEQ ID NO: 1582622 - RNA, 18 nt, Human adenovirus F
aaaaugugcagcaaaaac

SEQ ID NO: 1582623 - RNA, 22 nt, Human adenovirus F
guuggaggagauggugggccgc

SEQ ID NO: 1582624 - RNA, 15 nt, Human adenovirus F
agucuguuugguggg

SEQ ID NO: 1582625 - RNA, 16 nt, Human adenovirus F
ccacugccacugaaac

SEQ ID NO: 1582626 - RNA, 12 nt, Human adenovirus F
agaauuuaugcc

SEQ ID NO: 1582627 - RNA, 21 nt, Human adenovirus F
cguagggauugagugggaagc

SEQ ID NO: 1582628 - RNA, 14 nt, Human adenovirus F
cuacccuucugugc

SEQ ID NO: 1582629 - RNA, 17 nt, Human adenovirus F
gacagcaaggaaagaag

SEQ ID NO: 1582630 - RNA, 17 nt, Human adenovirus F
caagcgcaaguucaaag

SEQ ID NO: 1582631 - RNA, 19 nt, Human adenovirus F
aaccaggccuugcaaaacc

SEQ ID NO: 1582632 - RNA, 15 nt, Human adenovirus F
cgugcuccugaagca

SEQ ID NO: 1582633 - RNA, 14 nt, Human adenovirus F
cuccgccggcaugu

SEQ ID NO: 1582634 - RNA, 17 nt, Human adenovirus F
gccacguccaccgugga

SEQ ID NO: 1582635 - RNA, 16 nt, Human adenovirus F
caguccuucugccacg

SEQ ID NO: 1582636 - RNA, 16 nt, Human adenovirus F
aaggaauguggggcgu

SEQ ID NO: 1582637 - RNA, 13 nt, Human adenovirus F
accaauuugcuaa

SEQ ID NO: 1582638 - RNA, 19 nt, Human adenovirus F
cguagaguuugggagccag

SEQ ID NO: 1582639 - RNA, 24 nt, Human adenovirus F
cgucagaacggcgugcuggaaagc

SEQ ID NO: 1582640 - RNA, 13 nt, Human adenovirus F
gacaagacaugga

SEQ ID NO: 1582641 - RNA, 18 nt, Human adenovirus F
aaaucguagguuuaaauu

SEQ ID NO: 1582642 - RNA, 16 nt, Human adenovirus F
accggcuccugugcag

SEQ ID NO: 1582643 - RNA, 22 nt, Human adenovirus F
uauuucuuugucuaacuaaaaa

SEQ ID NO: 1582644 - RNA, 22 nt, Human adenovirus F
cggcgugguggauauagccaac

SEQ ID NO: 1582645 - RNA, 20 nt, Human adenovirus F
cucgucauaggccauuuuga

SEQ ID NO: 1582646 - RNA, 23 nt, Human adenovirus F
ccuuugacaaucagggaaauuua

SEQ ID NO: 1582647 - RNA, 15 nt, Human adenovirus F
aaaucuucaaacauu

SEQ ID NO: 1582648 - RNA, 14 nt, Human adenovirus F
cgagccggagaggg

SEQ ID NO: 1582649 - RNA, 21 nt, Human adenovirus F
caaaucucgccuaacaucacc

SEQ ID NO: 1582650 - RNA, 22 nt, Human adenovirus F
agcccccgugggggaccgagcc

SEQ ID NO: 1582651 - RNA, 21 nt, Human adenovirus F
agaacguguugguagagcugg

SEQ ID NO: 1582652 - RNA, 11 nt, Human adenovirus F
gcaccuucagu

SEQ ID NO: 1582653 - RNA, 14 nt, Human adenovirus F
cccaugagccgcca

SEQ ID NO: 1582654 - RNA, 22 nt, Human adenovirus F
caacaaaaucaggaacuguuca

SEQ ID NO: 1582655 - RNA, 20 nt, Human adenovirus F
aaaagcucgcgcacagcuuc

SEQ ID NO: 1582656 - RNA, 21 nt, Human adenovirus F
cagggcgcuaacugugcaucu

SEQ ID NO: 1582657 - RNA, 15 nt, Human adenovirus F
ucccgccccugccac

SEQ ID NO: 1582658 - RNA, 22 nt, Human adenovirus F
agggcaacguucagccacuccu

SEQ ID NO: 1582659 - RNA, 13 nt, Human adenovirus F
cugucgccccugc

SEQ ID NO: 1582660 - RNA, 16 nt, Human adenovirus F
uguacugugcauuugg

SEQ ID NO: 1582661 - RNA, 18 nt, Human adenovirus F
accaaagagcuugaacau

SEQ ID NO: 1582662 - RNA, 18 nt, Human adenovirus F
cggaagggcggaacagca

SEQ ID NO: 1582663 - RNA, 16 nt, Human adenovirus F
caaacgcaccauugaa

SEQ ID NO: 1582664 - RNA, 18 nt, Human adenovirus F
aacaacgaaauuuccauu

SEQ ID NO: 1582665 - RNA, 18 nt, Human adenovirus F
cuacuucagccuggggaa

SEQ ID NO: 1582666 - RNA, 17 nt, Human adenovirus F
caccgcgcggcggccau

SEQ ID NO: 1582667 - RNA, 21 nt, Human adenovirus F
cugcgcaaagucgaggagucc

SEQ ID NO: 1582668 - RNA, 22 nt, Human adenovirus F
ugggauuugccgcagccagugg

SEQ ID NO: 1582669 - RNA, 13 nt, Human adenovirus F
uagacgaggagga

SEQ ID NO: 1582670 - RNA, 22 nt, Human adenovirus F
cgauuuugucccccucugcuac

SEQ ID NO: 1582671 - RNA, 14 nt, Human adenovirus F
acuccucuuccucc

SEQ ID NO: 1582672 - RNA, 16 nt, Human adenovirus F
gcucaucugcggccuc

SEQ ID NO: 1582673 - RNA, 16 nt, Human adenovirus F
uggaauuacugccagu

SEQ ID NO: 1582674 - RNA, 19 nt, Human adenovirus F
gauacuggauacuggcaag

SEQ ID NO: 1582675 - RNA, 16 nt, Human adenovirus F
acccgaccuaaacucu

SEQ ID NO: 1582676 - RNA, 16 nt, Human adenovirus F
gucgcauaacccugga

SEQ ID NO: 1582677 - RNA, 13 nt, Human adenovirus F
aucacccaaagcc

SEQ ID NO: 1582678 - RNA, 14 nt, Human adenovirus F
aaacaacaaaauca

SEQ ID NO: 1582679 - RNA, 20 nt, Human adenovirus F
gaccucccaaagucccccuu

SEQ ID NO: 1582680 - RNA, 19 nt, Human adenovirus F
cuuucaccgccuuggccag

SEQ ID NO: 1582681 - RNA, 22 nt, Human adenovirus F
ccugggguagggugucugccag

SEQ ID NO: 1582682 - RNA, 22 nt, Human adenovirus F
aaguauacauuugaacagcuga

SEQ ID NO: 1582683 - RNA, 12 nt, Human adenovirus F
cccgccagcugg

SEQ ID NO: 1582684 - RNA, 19 nt, Human adenovirus F
guuaugccccacaauguaa

SEQ ID NO: 1582685 - RNA, 18 nt, Human adenovirus F
gcuugggggcgccauccc

SEQ ID NO: 1582686 - RNA, 15 nt, Human adenovirus F
ugccugaagcacugg

SEQ ID NO: 1582687 - RNA, 20 nt, Human adenovirus F
ucgcggccguuuaugggcac

SEQ ID NO: 1582688 - RNA, 13 nt, Human adenovirus F
aauucugaagagg

SEQ ID NO: 1582689 - RNA, 12 nt, Human adenovirus F
cuccauuauuuu

SEQ ID NO: 1582690 - RNA, 22 nt, Human adenovirus F
acaugggggcggaccugcaaug

SEQ ID NO: 1582691 - RNA, 15 nt, Human adenovirus F
uaacucucuuacauu

SEQ ID NO: 1582692 - RNA, 19 nt, Human adenovirus F
gcgcacugguaaaccagca

SEQ ID NO: 1582693 - RNA, 19 nt, Human adenovirus F
cccuauucgggcacugcau

SEQ ID NO: 1582694 - RNA, 16 nt, Human adenovirus F
uggagccgacuucaag

SEQ ID NO: 1582695 - RNA, 20 nt, Human adenovirus F
acacgcauguaaauuuugca

SEQ ID NO: 1582696 - RNA, 23 nt, Human adenovirus F
gagauucaagggccagagcaaca

SEQ ID NO: 1582697 - RNA, 13 nt, Human adenovirus F
aacuuuguuauga

SEQ ID NO: 1582698 - RNA, 15 nt, Human adenovirus F
cacuucuauugcacu

SEQ ID NO: 1582699 - RNA, 15 nt, Human adenovirus F
uuaaccauggagcua

SEQ ID NO: 1582700 - RNA, 22 nt, Human adenovirus F
accguucccacuguuucuccuc

SEQ ID NO: 1582701 - RNA, 16 nt, Human adenovirus F
gguagaaguggaggaa

SEQ ID NO: 1582702 - RNA, 13 nt, Human adenovirus F
acucucagcugcu

SEQ ID NO: 1582703 - RNA, 15 nt, Human adenovirus F
gagcaaguggagcaa

SEQ ID NO: 1582704 - RNA, 15 nt, Human adenovirus F
cuugcaagcagcucg

SEQ ID NO: 1582705 - RNA, 17 nt, Human adenovirus F
uaaagggaacugccagu

SEQ ID NO: 1582706 - RNA, 20 nt, Human adenovirus F
gaaauuugcugacagcuggg

SEQ ID NO: 1582707 - RNA, 13 nt, Human adenovirus F
cacuaccacccuc

SEQ ID NO: 1582708 - RNA, 15 nt, Human adenovirus F
aggaaacgcugugag

SEQ ID NO: 1582709 - RNA, 18 nt, Human adenovirus F
agaggguacuagcagugg

SEQ ID NO: 1582710 - RNA, 13 nt, Human adenovirus F
accugaaaaccau

SEQ ID NO: 1582711 - RNA, 22 nt, Human adenovirus F
gagaguugggacucuugcugga

SEQ ID NO: 1582712 - RNA, 14 nt, Human adenovirus F
aguccuucugccac

SEQ ID NO: 1582713 - RNA, 13 nt, Human adenovirus F
agcagagcucugc

SEQ ID NO: 1582714 - RNA, 22 nt, Human adenovirus F
cucagcgaacccaacuauuugg

SEQ ID NO: 1582715 - RNA, 17 nt, Human adenovirus F
gccucagggucaacugg

SEQ ID NO: 1582716 - RNA, 22 nt, Human adenovirus F
uuggaagggaaggcguggaaaa

SEQ ID NO: 1582717 - RNA, 20 nt, Human adenovirus F
gugcccauagacaaggaggu

SEQ ID NO: 1582718 - RNA, 19 nt, Human adenovirus F
ucugcaccugcacgcucuu

SEQ ID NO: 1582719 - RNA, 16 nt, Human adenovirus F
ccgcgaacuaaugcac

SEQ ID NO: 1582720 - RNA, 16 nt, Human adenovirus F
aucguaccauguggcg

SEQ ID NO: 1582721 - RNA, 14 nt, Human adenovirus F
gccauucuucucuu

SEQ ID NO: 1582722 - RNA, 14 nt, Human adenovirus F
guagacgcuggaag

SEQ ID NO: 1582723 - RNA, 18 nt, Human adenovirus F
agugacacgucaccgcca

SEQ ID NO: 1582724 - RNA, 21 nt, Human adenovirus F
uguagccuuuaacugcgcaau

SEQ ID NO: 1582725 - RNA, 19 nt, Human adenovirus F
cagcgggaagagaggcagc

SEQ ID NO: 1582726 - RNA, 17 nt, Human adenovirus F
cuggaggacgccgaggc

SEQ ID NO: 1582727 - RNA, 18 nt, Human adenovirus F
ugggaggggaggacgacg

SEQ ID NO: 1582728 - RNA, 14 nt, Human adenovirus F
ugacaaacaagcug

SEQ ID NO: 1582729 - RNA, 18 nt, Human adenovirus F
gcugacccuucccaacgc

SEQ ID NO: 1582730 - RNA, 17 nt, Human adenovirus F
agcccgcaacggcgcag

SEQ ID NO: 1582731 - RNA, 17 nt, Human adenovirus F
agggauugagugggaag

SEQ ID NO: 1582732 - RNA, 23 nt, Human adenovirus F
ccucagccugaaauacacugauc

SEQ ID NO: 1582733 - RNA, 16 nt, Human adenovirus F
cagccaaugggcucca

SEQ ID NO: 1582734 - RNA, 23 nt, Human adenovirus F
uugcgguacucucgaaacuuuuu

SEQ ID NO: 1582735 - RNA, 12 nt, Human adenovirus F
ugauggcagcag

SEQ ID NO: 1582736 - RNA, 17 nt, Human adenovirus F
uguuaucacccaaagcc

SEQ ID NO: 1582737 - RNA, 15 nt, Human adenovirus F
ccgcagucucccacc

SEQ ID NO: 1582738 - RNA, 16 nt, Human adenovirus F
cagaaacaugccaccc

SEQ ID NO: 1582739 - RNA, 14 nt, Human adenovirus F
gcgaaugcccccca

SEQ ID NO: 1582740 - RNA, 16 nt, Human adenovirus F
agccgcugacggcgca

SEQ ID NO: 1582741 - RNA, 22 nt, Human adenovirus F
cauucugagacaaaagcccggg

SEQ ID NO: 1582742 - RNA, 20 nt, Human adenovirus F
aacgggguggaaagccuggu

SEQ ID NO: 1582743 - RNA, 12 nt, Human adenovirus F
uuauugccaccg

SEQ ID NO: 1582744 - RNA, 22 nt, Human adenovirus F
caaccaggccuugcaaaaccaa

SEQ ID NO: 1582745 - RNA, 14 nt, Human adenovirus F
uacuaaaacaaacc

SEQ ID NO: 1582746 - RNA, 20 nt, Human adenovirus F
acggcaaucccagcagaaac

SEQ ID NO: 1582747 - RNA, 13 nt, Human adenovirus F
cugaacuuuuugc

SEQ ID NO: 1582748 - RNA, 19 nt, Human adenovirus F
ugacacgggcacucuucgc

SEQ ID NO: 1582749 - RNA, 16 nt, Human adenovirus F
ccuaaggacuucaccu

SEQ ID NO: 1582750 - RNA, 17 nt, Human adenovirus F
ccccacuguugccgugg

SEQ ID NO: 1582751 - RNA, 17 nt, Human adenovirus F
aaucuugaauaauuccc

SEQ ID NO: 1582752 - RNA, 19 nt, Human adenovirus F
aucgcuguggacgacagcc

SEQ ID NO: 1582753 - RNA, 23 nt, Human adenovirus F
ucuccauaccagaguaacuuuug

SEQ ID NO: 1582754 - RNA, 17 nt, Human adenovirus F
ccucuacgucaccuuac

SEQ ID NO: 1582755 - RNA, 19 nt, Human adenovirus F
caauggcagcccagcgccc

SEQ ID NO: 1582756 - RNA, 23 nt, Human adenovirus F
accgcggcuugucgcagaaucuc

SEQ ID NO: 1582757 - RNA, 24 nt, Human adenovirus F
uccagcaaaggcgcccuccuuugc

SEQ ID NO: 1582758 - RNA, 17 nt, Human adenovirus F
guucacuuugccagagg

SEQ ID NO: 1582759 - RNA, 17 nt, Human adenovirus F
guccuuugccccccggc

SEQ ID NO: 1582760 - RNA, 15 nt, Human adenovirus F
ugccuccagcacugc

SEQ ID NO: 1582761 - RNA, 14 nt, Human adenovirus F
aguaaaaagccuga

SEQ ID NO: 1582762 - RNA, 17 nt, Human adenovirus F
ugugcagauggaaacug

SEQ ID NO: 1582763 - RNA, 21 nt, Human adenovirus F
cauuguguccugcaacaaaaa

SEQ ID NO: 1582764 - RNA, 22 nt, Human adenovirus F
cugcagcgcacgcuggaggacg

SEQ ID NO: 1582765 - RNA, 17 nt, Human adenovirus F
uauaaguauuacaaaug

SEQ ID NO: 1582766 - RNA, 18 nt, Human adenovirus F
acaugcugguuuucuuua

SEQ ID NO: 1582767 - RNA, 16 nt, Human adenovirus F
cugugagcuggccugg

SEQ ID NO: 1582768 - RNA, 19 nt, Human adenovirus F
ccagccuccgguggcucug

SEQ ID NO: 1582769 - RNA, 16 nt, Human adenovirus F
ccgcacuggaugccac

SEQ ID NO: 1582770 - RNA, 15 nt, Human adenovirus F
ucacauccaagugcc

SEQ ID NO: 1582771 - RNA, 12 nt, Human adenovirus F
cguucuggacuc

SEQ ID NO: 1582772 - RNA, 23 nt, Human adenovirus F
gcaagcccauucugccaguuggg

SEQ ID NO: 1582773 - RNA, 14 nt, Human adenovirus F
ccuaugugcugggg

SEQ ID NO: 1582774 - RNA, 15 nt, Human adenovirus F
cgcgaggagguggcc

SEQ ID NO: 1582775 - RNA, 13 nt, Human adenovirus F
cacaugaacacuu

SEQ ID NO: 1582776 - RNA, 13 nt, Human adenovirus F
uacuuuaaacaag

SEQ ID NO: 1582777 - RNA, 22 nt, Human adenovirus F
uggcgcauucccuuuuccagca

SEQ ID NO: 1582778 - RNA, 18 nt, Human adenovirus F
agguuacucagcaauccg

SEQ ID NO: 1582779 - RNA, 21 nt, Human adenovirus F
gagcaugaaacuggaagaugu

SEQ ID NO: 1582780 - RNA, 13 nt, Human adenovirus F
cccuggccuguuu

SEQ ID NO: 1582781 - RNA, 15 nt, Human adenovirus F
gccuccagcacugcc

SEQ ID NO: 1582782 - RNA, 23 nt, Human adenovirus F
uaugagcggaguaacacaaacau

SEQ ID NO: 1582783 - RNA, 21 nt, Human adenovirus F
agaguaaaaaaaagggaaguu

SEQ ID NO: 1582784 - RNA, 19 nt, Human adenovirus F
acugacuuccugguccuga

SEQ ID NO: 1582785 - RNA, 20 nt, Human adenovirus F
aguucuacgugucuugcaaa

SEQ ID NO: 1582786 - RNA, 20 nt, Human adenovirus F
caguaggacgucagaacggc

SEQ ID NO: 1582787 - RNA, 18 nt, Human adenovirus F
ccuguuacuauuaaugca

SEQ ID NO: 1582788 - RNA, 13 nt, Human adenovirus F
gucugcguacuga

SEQ ID NO: 1582789 - RNA, 16 nt, Human adenovirus F
cugaccgaccuggggc

SEQ ID NO: 1582790 - RNA, 21 nt, Human adenovirus F
gugagucgggcucuuggucag

SEQ ID NO: 1582791 - RNA, 14 nt, Human adenovirus F
aaccaggcagugga

SEQ ID NO: 1582792 - RNA, 19 nt, Human adenovirus F
gccagcgacaaggcaccau

SEQ ID NO: 1582793 - RNA, 12 nt, Human adenovirus F
gccaggcagagg

SEQ ID NO: 1582794 - RNA, 19 nt, Human adenovirus F
aaacgucccaucauuucca

SEQ ID NO: 1582795 - RNA, 22 nt, Human adenovirus F
uggaagagguaguugagcgugg

SEQ ID NO: 1582796 - RNA, 19 nt, Human adenovirus F
agggcgugcaagugggcuc

SEQ ID NO: 1582797 - RNA, 22 nt, Human adenovirus F
cagcagguuaaagccaacucca

SEQ ID NO: 1582798 - RNA, 15 nt, Human adenovirus F
uugcaagauaugucu

SEQ ID NO: 1582799 - RNA, 20 nt, Human adenovirus F
agcagaaacuacaaaagcag

SEQ ID NO: 1582800 - RNA, 15 nt, Human adenovirus F
cagccaagucaaaaa

SEQ ID NO: 1582801 - RNA, 18 nt, Human adenovirus F
cauuguuuugcuaccugg

SEQ ID NO: 1582802 - RNA, 13 nt, Human adenovirus F
gauuaagaaccac

SEQ ID NO: 1582803 - RNA, 14 nt, Human adenovirus F
ggcucagccccgcc

SEQ ID NO: 1582804 - RNA, 13 nt, Human adenovirus F
cccuggccuggaa

SEQ ID NO: 1582805 - RNA, 13 nt, Human adenovirus F
cucuuacaccucc

SEQ ID NO: 1582806 - RNA, 16 nt, Human adenovirus F
cuaaaaacggagcuca

SEQ ID NO: 1582807 - RNA, 23 nt, Human adenovirus F
uuuccagcauaauaacucuggcu

SEQ ID NO: 1582808 - RNA, 19 nt, Human adenovirus F
cagcgcccuggauacauac

SEQ ID NO: 1582809 - RNA, 17 nt, Human adenovirus F
caguaccgcuccaucaa

SEQ ID NO: 1582810 - RNA, 23 nt, Human adenovirus F
gucauauacuuuaaacaagcaaa

SEQ ID NO: 1582811 - RNA, 12 nt, Human adenovirus F
acacgcugccaa

SEQ ID NO: 1582812 - RNA, 21 nt, Human adenovirus F
accauguggcgcauucccuuu

SEQ ID NO: 1582813 - RNA, 23 nt, Human adenovirus F
cugaagcccgcaacggcgcagca

SEQ ID NO: 1582814 - RNA, 15 nt, Human adenovirus F
cugaagaggaacgua

SEQ ID NO: 1582815 - RNA, 15 nt, Human adenovirus F
ucgaaggcugccggc

SEQ ID NO: 1582816 - RNA, 13 nt, Human adenovirus F
gaguuaaccuuga

SEQ ID NO: 1582817 - RNA, 14 nt, Human adenovirus F
cagcgggaagagag

SEQ ID NO: 1582818 - RNA, 15 nt, Human adenovirus F
cuugggaggauuuug

SEQ ID NO: 1582819 - RNA, 20 nt, Human adenovirus F
ucuccuccccuuacaaacag

SEQ ID NO: 1582820 - RNA, 21 nt, Human adenovirus F
cguucccgcccucacagauca

SEQ ID NO: 1582821 - RNA, 20 nt, Human adenovirus F
uccugucgccccugccaacu

SEQ ID NO: 1582822 - RNA, 22 nt, Human adenovirus F
uggaggaaacccuaguugugga

SEQ ID NO: 1582823 - RNA, 16 nt, Human adenovirus F
cacuuuacuuaaaccc

SEQ ID NO: 1582824 - RNA, 20 nt, Human adenovirus F
ucaaaaagguuuccaaauca

SEQ ID NO: 1582825 - RNA, 13 nt, Human adenovirus F
gggccuggugcag

SEQ ID NO: 1582826 - RNA, 19 nt, Human adenovirus F
acgaacacgcugccaacaa

SEQ ID NO: 1582827 - RNA, 18 nt, Human adenovirus F
cuucgaagugaugcaccu

SEQ ID NO: 1582828 - RNA, 19 nt, Human adenovirus F
gagcuauuuaaagugguga

SEQ ID NO: 1582829 - RNA, 17 nt, Human adenovirus F
ugugagcgccagccgcc

SEQ ID NO: 1582830 - RNA, 19 nt, Human adenovirus F
uuggggaauuugucaugca

SEQ ID NO: 1582831 - RNA, 21 nt, Human adenovirus F
gcggggcaccuucagcuugag

SEQ ID NO: 1582832 - RNA, 18 nt, Human adenovirus F
ccggacgggcagccgguc

SEQ ID NO: 1582833 - RNA, 22 nt, Human adenovirus F
uucccacuguuucuccuccccu

SEQ ID NO: 1582834 - RNA, 20 nt, Human adenovirus F
ccaucugcagcauugccacu

SEQ ID NO: 1582835 - RNA, 17 nt, Human adenovirus F
aguuggagcagccugug

SEQ ID NO: 1582836 - RNA, 18 nt, Human adenovirus F
guacgagaaaucggagag

SEQ ID NO: 1582837 - RNA, 20 nt, Human adenovirus F
gccauggugguagaagguca

SEQ ID NO: 1582838 - RNA, 22 nt, Human adenovirus F
acucauuuuuucaagaaauugu

SEQ ID NO: 1582839 - RNA, 17 nt, Human adenovirus F
gucguuaguggaggcag

SEQ ID NO: 1582840 - RNA, 18 nt, Human adenovirus F
ccagcagcaccaccugcc

SEQ ID NO: 1582841 - RNA, 23 nt, Human adenovirus F
auguaacgccccccgaggacggc

SEQ ID NO: 1582842 - RNA, 15 nt, Human adenovirus F
ccacuccugcaauac

SEQ ID NO: 1582843 - RNA, 16 nt, Human adenovirus F
cuagccaacacccugu

SEQ ID NO: 1582844 - RNA, 12 nt, Human adenovirus F
ggcauggcagca

SEQ ID NO: 1582845 - RNA, 16 nt, Human adenovirus F
cgcuccagguggggcg

SEQ ID NO: 1582846 - RNA, 16 nt, Human adenovirus F
cguaccaagccugacu

SEQ ID NO: 1582847 - RNA, 16 nt, Human adenovirus F
agguuacucagcaauc

SEQ ID NO: 1582848 - RNA, 21 nt, Human adenovirus F
agcauaauaacucuggcuuug

SEQ ID NO: 1582849 - RNA, 13 nt, Human adenovirus F
caaaguaaaaaac

SEQ ID NO: 1582850 - RNA, 20 nt, Human adenovirus F
cguggaaaaacuuggaaacc

SEQ ID NO: 1582851 - RNA, 18 nt, Human adenovirus F
aaucuaccacagaaaugu

SEQ ID NO: 1582852 - RNA, 14 nt, Human adenovirus F
aacuuuacaaaaug

SEQ ID NO: 1582853 - RNA, 18 nt, Human adenovirus F
gacgcuugcuggaguugg

SEQ ID NO: 1582854 - RNA, 13 nt, Human adenovirus F
guguccgaaagca

SEQ ID NO: 1582855 - RNA, 17 nt, Human adenovirus F
guugauguuaugcccca

SEQ ID NO: 1582856 - RNA, 22 nt, Human adenovirus F
gcugccagaggccguagcccgu

SEQ ID NO: 1582857 - RNA, 21 nt, Human adenovirus F
auggcagcccagcgcccgggc

SEQ ID NO: 1582858 - RNA, 12 nt, Human adenovirus F
ccugaaaaccau

SEQ ID NO: 1582859 - RNA, 18 nt, Human adenovirus F
aucacccaaagccaaauu

SEQ ID NO: 1582860 - RNA, 22 nt, Human adenovirus F
cccaccggcuccugugcagcgc

SEQ ID NO: 1582861 - RNA, 18 nt, Human adenovirus F
ccuggccaacugccaccu

SEQ ID NO: 1582862 - RNA, 22 nt, Human adenovirus F
uucuggacucgucuccugcaag

SEQ ID NO: 1582863 - RNA, 13 nt, Human adenovirus F
cuacgccuccacc

SEQ ID NO: 1582864 - RNA, 20 nt, Human adenovirus F
aacuccucuuccuccacagc

SEQ ID NO: 1582865 - RNA, 15 nt, Human adenovirus F
cauugggcugaugca

SEQ ID NO: 1582866 - RNA, 21 nt, Human adenovirus F
accuucaagcccuacaccaau

SEQ ID NO: 1582867 - RNA, 15 nt, Human adenovirus F
gcucuguccgccgcc

SEQ ID NO: 1582868 - RNA, 22 nt, Human adenovirus F
agcaagccgcugacggcgcagc

SEQ ID NO: 1582869 - RNA, 21 nt, Human adenovirus F
auucugauggaguuguggagu

SEQ ID NO: 1582870 - RNA, 12 nt, Human adenovirus F
aggcagcagggu

SEQ ID NO: 1582871 - RNA, 18 nt, Human adenovirus F
gucaggccgcccgucagg

SEQ ID NO: 1582872 - RNA, 15 nt, Human adenovirus F
cagccuagacgagga

SEQ ID NO: 1582873 - RNA, 15 nt, Human adenovirus F
augugcuggggaaug

SEQ ID NO: 1582874 - RNA, 12 nt, Human adenovirus F
ccuggaagaggg

SEQ ID NO: 1582875 - RNA, 21 nt, Human adenovirus F
uccuuaacaagggcuuccucc

SEQ ID NO: 1582876 - RNA, 15 nt, Human adenovirus F
cagauggaaacuguc

SEQ ID NO: 1582877 - RNA, 16 nt, Human adenovirus F
augccuccagcacugc

SEQ ID NO: 1582878 - RNA, 14 nt, Human adenovirus F
accgcugcagcugc

SEQ ID NO: 1582879 - RNA, 15 nt, Human adenovirus F
ugggauggguaagug

SEQ ID NO: 1582880 - RNA, 22 nt, Human adenovirus F
caggguuuuugagcaugaaacu

SEQ ID NO: 1582881 - RNA, 20 nt, Human adenovirus F
augcacagccugcgucgggc

SEQ ID NO: 1582882 - RNA, 13 nt, Human adenovirus F
ucguuggcgccgg

SEQ ID NO: 1582883 - RNA, 19 nt, Human adenovirus F
gccaucgcugaccagcagc

SEQ ID NO: 1582884 - RNA, 17 nt, Human adenovirus F
cccccacuagcgccccu

SEQ ID NO: 1582885 - RNA, 11 nt, Human adenovirus F
ugcuaccuggu

SEQ ID NO: 1582886 - RNA, 24 nt, Human adenovirus F
cuucccuuugacaaucagggaaau

SEQ ID NO: 1582887 - RNA, 12 nt, Human adenovirus F
gggccggccugg

SEQ ID NO: 1582888 - RNA, 21 nt, Human adenovirus F
gcgucucgguuaagagaagaa

SEQ ID NO: 1582889 - RNA, 18 nt, Human adenovirus F
acagccuagacgaggagg

SEQ ID NO: 1582890 - RNA, 23 nt, Human adenovirus F
ccgcgaacuaaugcacagccugc

SEQ ID NO: 1582891 - RNA, 13 nt, Human adenovirus F
ggaggcagcagag

SEQ ID NO: 1582892 - RNA, 22 nt, Human adenovirus F
guacggaccaccagaugauguc

SEQ ID NO: 1582893 - RNA, 18 nt, Human adenovirus F
cgucggcucuggacauga

SEQ ID NO: 1582894 - RNA, 14 nt, Human adenovirus F
gucguugccagccg

SEQ ID NO: 1582895 - RNA, 16 nt, Human adenovirus F
ugccuaccucugacaa

SEQ ID NO: 1582896 - RNA, 19 nt, Human adenovirus F
ugccgguuucgcauucccg

SEQ ID NO: 1582897 - RNA, 17 nt, Human adenovirus F
ugcacacaugcuuuucc

SEQ ID NO: 1582898 - RNA, 20 nt, Human adenovirus F
uaaaaacaaccaacuucaac

SEQ ID NO: 1582899 - RNA, 18 nt, Human adenovirus F
guaaugucuuuccagggu

SEQ ID NO: 1582900 - RNA, 16 nt, Human adenovirus F
ccuugcaaaaccaaau

SEQ ID NO: 1582901 - RNA, 15 nt, Human adenovirus F
ugcuccugcccgggu

SEQ ID NO: 1582902 - RNA, 20 nt, Human adenovirus F
cggcggaugguggcaaggag

SEQ ID NO: 1582903 - RNA, 14 nt, Human adenovirus F
uaaaaaugccaggc

SEQ ID NO: 1582904 - RNA, 13 nt, Human adenovirus F
gcgcggcggccau

SEQ ID NO: 1582905 - RNA, 19 nt, Human adenovirus F
agaggaacguauuuugcgc

SEQ ID NO: 1582906 - RNA, 20 nt, Human adenovirus F
gaggguacuagcagugggca

SEQ ID NO: 1582907 - RNA, 14 nt, Human adenovirus F
agccgccagccucc

SEQ ID NO: 1582908 - RNA, 18 nt, Human adenovirus F
ggccuugggaugcagccu

SEQ ID NO: 1582909 - RNA, 21 nt, Human adenovirus F
cagcgugagucgggcucuugg

SEQ ID NO: 1582910 - RNA, 19 nt, Human adenovirus F
agugcggauuugggaacug

SEQ ID NO: 1582911 - RNA, 13 nt, Human adenovirus F
ugcuaaagggaac

SEQ ID NO: 1582912 - RNA, 20 nt, Human adenovirus F
ccucugugagcuggccuggu

SEQ ID NO: 1582913 - RNA, 18 nt, Human adenovirus F
gcauacuguuucacauau

SEQ ID NO: 1582914 - RNA, 14 nt, Human adenovirus F
caucucuacagccc

SEQ ID NO: 1582915 - RNA, 15 nt, Human adenovirus F
uuauauuuuaauuuu

SEQ ID NO: 1582916 - RNA, 17 nt, Human adenovirus F
gcgcuucgccuccuggu

SEQ ID NO: 1582917 - RNA, 12 nt, Human adenovirus F
aaaccgccacau

SEQ ID NO: 1582918 - RNA, 16 nt, Human adenovirus F
aggaggaccuagagga

SEQ ID NO: 1582919 - RNA, 21 nt, Human adenovirus F
ccgaucacuccguucgcucac

SEQ ID NO: 1582920 - RNA, 14 nt, Human adenovirus F
acaaaugccucccu

SEQ ID NO: 1582921 - RNA, 17 nt, Human adenovirus F
cuuaaguuauacaguga

SEQ ID NO: 1582922 - RNA, 15 nt, Human adenovirus F
ggcgcagcgggaacg

SEQ ID NO: 1582923 - RNA, 14 nt, Human adenovirus F
ucauacaaaugcuc

SEQ ID NO: 1582924 - RNA, 16 nt, Human adenovirus F
aauucguggccccuac

SEQ ID NO: 1582925 - RNA, 19 nt, Human adenovirus F
ucaagaaacacaaacauag

SEQ ID NO: 1582926 - RNA, 14 nt, Human adenovirus F
ugcgccccauuaaa

SEQ ID NO: 1582927 - RNA, 18 nt, Human adenovirus F
gcaugccacaauuuacaa

SEQ ID NO: 1582928 - RNA, 19 nt, Human adenovirus F
aacgauucuucugugacaa

SEQ ID NO: 1582929 - RNA, 16 nt, Human adenovirus F
cgguggcucugcagca

SEQ ID NO: 1582930 - RNA, 16 nt, Human adenovirus F
gcuuucaguuggagca

SEQ ID NO: 1582931 - RNA, 20 nt, Human adenovirus F
cgcagcaguaucaguggagu

SEQ ID NO: 1582932 - RNA, 11 nt, Human adenovirus F
uauggaggagg

SEQ ID NO: 1582933 - RNA, 17 nt, Human adenovirus F
ggugacgguaaaggggc

SEQ ID NO: 1582934 - RNA, 16 nt, Human adenovirus F
acaugcuuuucccauu

SEQ ID NO: 1582935 - RNA, 15 nt, Human adenovirus F
ugauaugaugaaagu

SEQ ID NO: 1582936 - RNA, 19 nt, Human adenovirus F
aaaguccuggccaacugcc

SEQ ID NO: 1582937 - RNA, 15 nt, Human adenovirus F
aaagaagcacaggag

SEQ ID NO: 1582938 - RNA, 18 nt, Human adenovirus F
ugggcucagacuccaaca

SEQ ID NO: 1582939 - RNA, 20 nt, Human adenovirus F
cagccguccacgcucccgga

SEQ ID NO: 1582940 - RNA, 15 nt, Human adenovirus F
ccgucccugggaugc

SEQ ID NO: 1582941 - RNA, 16 nt, Human adenovirus F
cgcuggcuccgcggca

SEQ ID NO: 1582942 - RNA, 22 nt, Human adenovirus F
aguucuugcugacggccggcca

SEQ ID NO: 1582943 - RNA, 17 nt, Human adenovirus F
gucacagccuguuacua

SEQ ID NO: 1582944 - RNA, 16 nt, Human adenovirus F
cauguauuuuuacagc

SEQ ID NO: 1582945 - RNA, 15 nt, Human adenovirus F
guggcaaggagagug

SEQ ID NO: 1582946 - RNA, 18 nt, Human adenovirus F
cgccgcaccgcgcccguc

SEQ ID NO: 1582947 - RNA, 23 nt, Human adenovirus F
uaccaggaggcuauuggccagac

SEQ ID NO: 1582948 - RNA, 14 nt, Human adenovirus F
cagaacaaaacaca

SEQ ID NO: 1582949 - RNA, 22 nt, Human adenovirus F
uggaggagauggugggccgcug

SEQ ID NO: 1582950 - RNA, 20 nt, Human adenovirus F
gaccugcaauggcagcccag

SEQ ID NO: 1582951 - RNA, 12 nt, Human adenovirus F
aauaagcugggu

SEQ ID NO: 1582952 - RNA, 18 nt, Human adenovirus F
agcagcuuauccuugcuc

SEQ ID NO: 1582953 - RNA, 17 nt, Human adenovirus F
caaggaaugcacacaga

SEQ ID NO: 1582954 - RNA, 21 nt, Human adenovirus F
ccaagccucauugagcgaguc

SEQ ID NO: 1582955 - RNA, 22 nt, Human adenovirus F
ucagucuuucaacgacuaccuc

SEQ ID NO: 1582956 - RNA, 13 nt, Human adenovirus F
gcgaacagagugg

SEQ ID NO: 1582957 - RNA, 12 nt, Human adenovirus F
uuacaaaaagag

SEQ ID NO: 1582958 - RNA, 11 nt, Human adenovirus F
gguuaaacaag

SEQ ID NO: 1582959 - RNA, 15 nt, Human adenovirus F
cgaccugaaaaccau

SEQ ID NO: 1582960 - RNA, 18 nt, Human adenovirus F
acugauguaacagcuuug

SEQ ID NO: 1582961 - RNA, 18 nt, Human adenovirus F
gccaacagccccagcugg

SEQ ID NO: 1582962 - RNA, 22 nt, Human adenovirus F
ucugccaauuaucuacgccucc

SEQ ID NO: 1582963 - RNA, 19 nt, Human adenovirus F
cauugggcugaugcauuug

SEQ ID NO: 1582964 - RNA, 18 nt, Human adenovirus F
auccagugcaggaagagg

SEQ ID NO: 1582965 - RNA, 13 nt, Human adenovirus F
gccucccuuugcc

SEQ ID NO: 1582966 - RNA, 17 nt, Human adenovirus F
ggccguuuaugggcacc

SEQ ID NO: 1582967 - RNA, 23 nt, Human adenovirus F
agaccacgucgccaacaguguuu

SEQ ID NO: 1582968 - RNA, 17 nt, Human adenovirus F
ugacggagucuuucagc

SEQ ID NO: 1582969 - RNA, 15 nt, Human adenovirus F
guagaguuugggagc

SEQ ID NO: 1582970 - RNA, 20 nt, Human adenovirus F
aguucacuuugccagagggc

SEQ ID NO: 1582971 - RNA, 13 nt, Human adenovirus F
cguaggugacaaa

SEQ ID NO: 1582972 - RNA, 16 nt, Human adenovirus F
ucuaaugccuuaacau

SEQ ID NO: 1582973 - RNA, 15 nt, Human adenovirus F
uggcgggcaguggcc

SEQ ID NO: 1582974 - RNA, 13 nt, Human adenovirus F
ccucuuacaauuu

SEQ ID NO: 1582975 - RNA, 16 nt, Human adenovirus F
cccguagucucagacg

SEQ ID NO: 1582976 - RNA, 15 nt, Human adenovirus F
agccaacuauuuggc

SEQ ID NO: 1582977 - RNA, 19 nt, Human adenovirus F
caaugguaccacgcaggcg

SEQ ID NO: 1582978 - RNA, 13 nt, Human adenovirus F
aacugcuccaucu

SEQ ID NO: 1582979 - RNA, 23 nt, Human adenovirus F
gccgccaugacugccgcucgggc

SEQ ID NO: 1582980 - RNA, 15 nt, Human adenovirus F
gucaccgccaagagc

SEQ ID NO: 1582981 - RNA, 15 nt, Human adenovirus F
ugcuccugaagcaca

SEQ ID NO: 1582982 - RNA, 20 nt, Human adenovirus F
uaaagguguuaacgcugagu

SEQ ID NO: 1582983 - RNA, 19 nt, Human adenovirus F
guaugguaacuccucuucu

SEQ ID NO: 1582984 - RNA, 15 nt, Human adenovirus F
gacagucugccaaca

SEQ ID NO: 1582985 - RNA, 16 nt, Human adenovirus F
cuccgucuagccaacu

SEQ ID NO: 1582986 - RNA, 22 nt, Human adenovirus F
aagaaguuacaaucuccuagag

SEQ ID NO: 1582987 - RNA, 16 nt, Human adenovirus F
ccaggcgagcucaggg

SEQ ID NO: 1582988 - RNA, 14 nt, Human adenovirus F
uuccagcauaauaa

SEQ ID NO: 1582989 - RNA, 15 nt, Human adenovirus F
gcagcgcccgccucc

SEQ ID NO: 1582990 - RNA, 14 nt, Human adenovirus F
ucucaucuucaccu

SEQ ID NO: 1582991 - RNA, 18 nt, Human adenovirus F
aggaguuuguacccuccg

SEQ ID NO: 1582992 - RNA, 16 nt, Human adenovirus F
ccuacaccaaugcaaa

SEQ ID NO: 1582993 - RNA, 22 nt, Human adenovirus F
cgcagguuuuacgcggggcagg

SEQ ID NO: 1582994 - RNA, 19 nt, Human adenovirus F
cggcaaaugcucugcaaaa

SEQ ID NO: 1582995 - RNA, 17 nt, Human adenovirus F
ggcuacccccgcccgcc

SEQ ID NO: 1582996 - RNA, 20 nt, Human adenovirus F
ugcagcauugccacuuuuuu

SEQ ID NO: 1582997 - RNA, 20 nt, Human adenovirus F
cucuuacauuggccaccgcc

SEQ ID NO: 1582998 - RNA, 19 nt, Human adenovirus F
ccgccgcucaaggcgcacg

SEQ ID NO: 1582999 - RNA, 17 nt, Human adenovirus F
caaaaaaagaauuacuu

SEQ ID NO: 1583000 - RNA, 15 nt, Human adenovirus F
ccuacggaagggcgg

SEQ ID NO: 1583001 - RNA, 21 nt, Human adenovirus F
guugcguagacgcuggaagag

SEQ ID NO: 1583002 - RNA, 14 nt, Human adenovirus F
agggugucugccag

SEQ ID NO: 1583003 - RNA, 13 nt, Human adenovirus F
gguggcaaggaga

SEQ ID NO: 1583004 - RNA, 13 nt, Human adenovirus F
caugccuccagca

SEQ ID NO: 1583005 - RNA, 13 nt, Human adenovirus F
guugggagggaug

SEQ ID NO: 1583006 - RNA, 23 nt, Human adenovirus F
cuuccaagcgguccauugccucg

SEQ ID NO: 1583007 - RNA, 20 nt, Human adenovirus F
ccuuagaacuaccuccaccc

SEQ ID NO: 1583008 - RNA, 23 nt, Human adenovirus F
cugguuaaacaagcugaacuuug

SEQ ID NO: 1583009 - RNA, 13 nt, Human adenovirus F
acaugauucucca

SEQ ID NO: 1583010 - RNA, 14 nt, Human adenovirus F
cacuuacaaccaaa

SEQ ID NO: 1583011 - RNA, 17 nt, Human adenovirus F
cugaacaauaaaaucau

SEQ ID NO: 1583012 - RNA, 20 nt, Human adenovirus F
agaaccguaccugcuaccuc

SEQ ID NO: 1583013 - RNA, 16 nt, Human adenovirus F
cucuccccaccgcugc

SEQ ID NO: 1583014 - RNA, 17 nt, Human adenovirus F
gcaccaauaugcccaac

SEQ ID NO: 1583015 - RNA, 17 nt, Human adenovirus F
caaguuuuuccagcagc

SEQ ID NO: 1583016 - RNA, 19 nt, Human adenovirus F
accacucaauuaaccuugc

SEQ ID NO: 1583017 - RNA, 19 nt, Human adenovirus F
uuuaauggaaacugaugcu

SEQ ID NO: 1583018 - RNA, 20 nt, Human adenovirus F
gcucauccaaguuuuuacaa

SEQ ID NO: 1583019 - RNA, 20 nt, Human adenovirus F
cagugaaaacguucccgccc

SEQ ID NO: 1583020 - RNA, 23 nt, Human adenovirus F
ggcggaggagcagauggagagcu

SEQ ID NO: 1583021 - RNA, 18 nt, Human adenovirus F
aggaucccucagagcugc

SEQ ID NO: 1583022 - RNA, 19 nt, Human adenovirus F
gcauacguuacucggagcu

SEQ ID NO: 1583023 - RNA, 23 nt, Human adenovirus F
caagaucuccaacguagagcuca

SEQ ID NO: 1583024 - RNA, 16 nt, Human adenovirus F
uuaccgcgacaaagca

SEQ ID NO: 1583025 - RNA, 15 nt, Human adenovirus F
agaucacaccucucc

SEQ ID NO: 1583026 - RNA, 14 nt, Human adenovirus F
uaacccgccuuuuc

SEQ ID NO: 1583027 - RNA, 18 nt, Human adenovirus F
gauacugcuccuggcgag

SEQ ID NO: 1583028 - RNA, 14 nt, Human adenovirus F
gcgcgaacugggcu

SEQ ID NO: 1583029 - RNA, 21 nt, Human adenovirus F
caccaacgugcaggccaaccu

SEQ ID NO: 1583030 - RNA, 19 nt, Human adenovirus F
cagacggccguaccaagcc

SEQ ID NO: 1583031 - RNA, 16 nt, Human adenovirus F
uaggcuuuaacaacac

SEQ ID NO: 1583032 - RNA, 15 nt, Human adenovirus F
cagugggacgaggag

SEQ ID NO: 1583033 - RNA, 13 nt, Human adenovirus F
ggggaccagcugu

SEQ ID NO: 1583034 - RNA, 17 nt, Human adenovirus F
cugccaaaauggcucug

SEQ ID NO: 1583035 - RNA, 13 nt, Human adenovirus F
cagcuggcaaacc

SEQ ID NO: 1583036 - RNA, 14 nt, Human adenovirus F
cauuauugcacuuu

SEQ ID NO: 1583037 - RNA, 21 nt, Human adenovirus F
guuacaguggaauuggaaugc

SEQ ID NO: 1583038 - RNA, 14 nt, Human adenovirus F
gugcagacggugga

SEQ ID NO: 1583039 - RNA, 18 nt, Human adenovirus F
accccuaugacaccuccu

SEQ ID NO: 1583040 - RNA, 13 nt, Human adenovirus F
caacaaccuaccc

SEQ ID NO: 1583041 - RNA, 13 nt, Human adenovirus F
acugguaaaccag

SEQ ID NO: 1583042 - RNA, 21 nt, Human adenovirus F
ggcgggcguccggaggcagug

SEQ ID NO: 1583043 - RNA, 14 nt, Human adenovirus F
ucuccuaacgccac

SEQ ID NO: 1583044 - RNA, 13 nt, Human adenovirus F
acauccauuucca

SEQ ID NO: 1583045 - RNA, 16 nt, Human adenovirus F
cugacaguaagcaaca

SEQ ID NO: 1583046 - RNA, 19 nt, Human adenovirus F
uaaaaaggauuuugccggc

SEQ ID NO: 1583047 - RNA, 20 nt, Human adenovirus F
gaacauuggggcgcgguggu

SEQ ID NO: 1583048 - RNA, 15 nt, Human adenovirus F
caaagacaaaaucac

SEQ ID NO: 1583049 - RNA, 13 nt, Human adenovirus F
gaaacgcugugag

SEQ ID NO: 1583050 - RNA, 14 nt, Human adenovirus F
accaagggcucugc

SEQ ID NO: 1583051 - RNA, 14 nt, Human adenovirus F
uugcaaaaccaaau

SEQ ID NO: 1583052 - RNA, 16 nt, Human adenovirus F
cuggcagcuggagcuu

SEQ ID NO: 1583053 - RNA, 21 nt, Human adenovirus F
aggagcugucucagcaguugc

SEQ ID NO: 1583054 - RNA, 17 nt, Human adenovirus F
gaggguacuagcagugg

SEQ ID NO: 1583055 - RNA, 21 nt, Human adenovirus F
uggagggcggcaacauuccug

SEQ ID NO: 1583056 - RNA, 14 nt, Human adenovirus F
uaauuucugagggg

SEQ ID NO: 1583057 - RNA, 23 nt, Human adenovirus F
uuugcaucucaaagcuggagcuc

SEQ ID NO: 1583058 - RNA, 14 nt, Human adenovirus F
gacgugugugugag

SEQ ID NO: 1583059 - RNA, 24 nt, Human adenovirus F
gaaccacuucgggagacggaggca

SEQ ID NO: 1583060 - RNA, 15 nt, Human adenovirus F
agauggaaacuguca

SEQ ID NO: 1583061 - RNA, 15 nt, Human adenovirus F
cuuaauaaagacaca

SEQ ID NO: 1583062 - RNA, 22 nt, Human adenovirus F
ggccguuuaugggcaccuggaa

SEQ ID NO: 1583063 - RNA, 14 nt, Human adenovirus F
aacuaacaaugccg

SEQ ID NO: 1583064 - RNA, 16 nt, Human adenovirus F
gcugcagccagacucc

SEQ ID NO: 1583065 - RNA, 21 nt, Human adenovirus F
gcagagcuugggcccugggcu

SEQ ID NO: 1583066 - RNA, 16 nt, Human adenovirus F
ugugcagcaaaaacuc

SEQ ID NO: 1583067 - RNA, 15 nt, Human adenovirus F
caauauaaaaacaac

SEQ ID NO: 1583068 - RNA, 15 nt, Human adenovirus F
aagugggcucagacu

SEQ ID NO: 1583069 - RNA, 19 nt, Human adenovirus F
cgaagcuagcauaaaagaa

SEQ ID NO: 1583070 - RNA, 21 nt, Human adenovirus F
aaacuaucccguguuugacaa

SEQ ID NO: 1583071 - RNA, 19 nt, Human adenovirus F
ccaguagcuuggaagccac

SEQ ID NO: 1583072 - RNA, 20 nt, Human adenovirus F
accuacuaccacuaccccua

SEQ ID NO: 1583073 - RNA, 16 nt, Human adenovirus F
aguucuugcugacggc

SEQ ID NO: 1583074 - RNA, 19 nt, Human adenovirus F
aaucaaccaacuaacacug

SEQ ID NO: 1583075 - RNA, 22 nt, Human adenovirus F
acaaaggaggcgauuugggagg

SEQ ID NO: 1583076 - RNA, 21 nt, Human adenovirus F
ggaggagauggugggccgcug

SEQ ID NO: 1583077 - RNA, 22 nt, Human adenovirus F
guggcaacccugaggaggaggc

SEQ ID NO: 1583078 - RNA, 16 nt, Human adenovirus F
aaaaguccacaaaaac

SEQ ID NO: 1583079 - RNA, 19 nt, Human adenovirus F
gcacuucaagaaacacaaa

SEQ ID NO: 1583080 - RNA, 21 nt, Human adenovirus F
cgacaaagcacacagaacaaa

SEQ ID NO: 1583081 - RNA, 22 nt, Human adenovirus F
uauucggcuugcauaaaagcuu

SEQ ID NO: 1583082 - RNA, 21 nt, Human adenovirus F
gguggggccccugaggcagcg

SEQ ID NO: 1583083 - RNA, 20 nt, Human adenovirus F
cugucguuaguggaggcagc

SEQ ID NO: 1583084 - RNA, 19 nt, Human adenovirus F
cucaucuucaccucuguuu

SEQ ID NO: 1583085 - RNA, 14 nt, Human adenovirus F
gcuguacugugcau

SEQ ID NO: 1583086 - RNA, 15 nt, Human adenovirus F
cucuucguccuggag

SEQ ID NO: 1583087 - RNA, 15 nt, Human adenovirus F
gcaagcgcggccgcu

SEQ ID NO: 1583088 - RNA, 13 nt, Human adenovirus F
cgagaaaaacaga

SEQ ID NO: 1583089 - RNA, 23 nt, Human adenovirus F
uggcaacccugaggaggaggcca

SEQ ID NO: 1583090 - RNA, 23 nt, Human adenovirus F
ggagagcgguccgucacgcgggc

SEQ ID NO: 1583091 - RNA, 12 nt, Human adenovirus F
agucugccaacg

SEQ ID NO: 1583092 - RNA, 18 nt, Human adenovirus F
uggagaucuuucuucaga

SEQ ID NO: 1583093 - RNA, 21 nt, Human adenovirus F
cauauuucaccuacucuggcu

SEQ ID NO: 1583094 - RNA, 16 nt, Human adenovirus F
accuuguauuuguaua

SEQ ID NO: 1583095 - RNA, 19 nt, Human adenovirus F
ucgcaagguaagcuaagga

SEQ ID NO: 1583096 - RNA, 20 nt, Human adenovirus F
ugucuuaccaguuaaugcuu

SEQ ID NO: 1583097 - RNA, 22 nt, Human adenovirus F
agggucgauggagccagcguca

SEQ ID NO: 1583098 - RNA, 22 nt, Human adenovirus F
gagguguaccaguccgggccag

SEQ ID NO: 1583099 - RNA, 15 nt, Human adenovirus F
cccgcacuggaugcc

SEQ ID NO: 1583100 - RNA, 12 nt, Human adenovirus F
gaccaucacuga

SEQ ID NO: 1583101 - RNA, 20 nt, Human adenovirus F
cuccauguggaaccaggcag

SEQ ID NO: 1583102 - RNA, 18 nt, Human adenovirus F
gcaacugccaucuucccg

SEQ ID NO: 1583103 - RNA, 22 nt, Human adenovirus F
cccaauccucaagacuuggaaa

SEQ ID NO: 1583104 - RNA, 14 nt, Human adenovirus F
gcauggcucagccc

SEQ ID NO: 1583105 - RNA, 19 nt, Human adenovirus F
cucaucugucgcaggguua

SEQ ID NO: 1583106 - RNA, 20 nt, Human adenovirus F
uacgccgaggguccuccucc

SEQ ID NO: 1583107 - RNA, 17 nt, Human adenovirus F
ccaguggccgcacucag

SEQ ID NO: 1583108 - RNA, 12 nt, Human adenovirus F
gccaaagugcaa

SEQ ID NO: 1583109 - RNA, 22 nt, Human adenovirus F
ugcaaaucuauuucuuugucua

SEQ ID NO: 1583110 - RNA, 18 nt, Human adenovirus F
acgucccaucauuuccac

SEQ ID NO: 1583111 - RNA, 23 nt, Human adenovirus F
caccucuuguucgaaggcugccg

SEQ ID NO: 1583112 - RNA, 20 nt, Human adenovirus F
uaguuuaaggagaugcaacu

SEQ ID NO: 1583113 - RNA, 14 nt, Human adenovirus F
cuaauuuuucacca

SEQ ID NO: 1583114 - RNA, 16 nt, Human adenovirus F
uuuggacccccaaacc

SEQ ID NO: 1583115 - RNA, 12 nt, Human adenovirus F
guucggagccaa

SEQ ID NO: 1583116 - RNA, 14 nt, Human adenovirus F
gccugagggcgacg

SEQ ID NO: 1583117 - RNA, 14 nt, Human adenovirus F
accacgcaggcgag

SEQ ID NO: 1583118 - RNA, 19 nt, Human adenovirus F
cagccgccgucgcgagcuu

SEQ ID NO: 1583119 - RNA, 16 nt, Human adenovirus F
gcaacucgcaggccag

SEQ ID NO: 1583120 - RNA, 23 nt, Human adenovirus F
gagcagcgggaagagaggcagcc

SEQ ID NO: 1583121 - RNA, 16 nt, Human adenovirus F
acauaucgucacuucc

SEQ ID NO: 1583122 - RNA, 20 nt, Human adenovirus F
acaucaggggcucaggaacc

SEQ ID NO: 1583123 - RNA, 16 nt, Human adenovirus F
gacgacugggcggcgg

SEQ ID NO: 1583124 - RNA, 21 nt, Human adenovirus F
ccaacugcagcgcacgcugga

SEQ ID NO: 1583125 - RNA, 16 nt, Human adenovirus F
accccgucuaccccua

SEQ ID NO: 1583126 - RNA, 21 nt, Human adenovirus F
ccuaggaucccaaguggcccu

SEQ ID NO: 1583127 - RNA, 14 nt, Human adenovirus F
agcuuggaagccac

SEQ ID NO: 1583128 - RNA, 21 nt, Human adenovirus F
ggaagaauacuaaaacaaacc

SEQ ID NO: 1583129 - RNA, 21 nt, Human adenovirus F
aaacugucaggcucugagagu

SEQ ID NO: 1583130 - RNA, 13 nt, Human adenovirus F
ccaacgcuacuag

SEQ ID NO: 1583131 - RNA, 17 nt, Human adenovirus F
agaacaaaacacacucc

SEQ ID NO: 1583132 - RNA, 18 nt, Human adenovirus F
agcggcuuaugcaaacau

SEQ ID NO: 1583133 - RNA, 19 nt, Human adenovirus F
gcauaaaagaagcacagga

SEQ ID NO: 1583134 - RNA, 22 nt, Human adenovirus F
uaugugcuggggaauggagcug

SEQ ID NO: 1583135 - RNA, 12 nt, Human adenovirus F
ggagucacugcu

SEQ ID NO: 1583136 - RNA, 18 nt, Human adenovirus F
aggaggcuauuggccaga

SEQ ID NO: 1583137 - RNA, 10 nt, Human adenovirus F
cgccuggaga

SEQ ID NO: 1583138 - RNA, 19 nt, Human adenovirus F
acgucauccgccuccaccc

SEQ ID NO: 1583139 - RNA, 20 nt, Human adenovirus F
acgagcaggcuuugaaagag

SEQ ID NO: 1583140 - RNA, 15 nt, Human adenovirus F
cagcagcagcagcgg

SEQ ID NO: 1583141 - RNA, 17 nt, Human adenovirus F
gccugagcugccagagg

SEQ ID NO: 1583142 - RNA, 13 nt, Human adenovirus F
cugggcuugcuuu

SEQ ID NO: 1583143 - RNA, 13 nt, Human adenovirus F
gacaaagaggcgu

SEQ ID NO: 1583144 - RNA, 18 nt, Human adenovirus F
aauugccucggcuacagu

SEQ ID NO: 1583145 - RNA, 20 nt, Human adenovirus F
gcgggaagagaggcagcccc

SEQ ID NO: 1583146 - RNA, 21 nt, Human adenovirus F
caagaaggugcuuccagccuc

SEQ ID NO: 1583147 - RNA, 14 nt, Human adenovirus F
ggacauggccagca

SEQ ID NO: 1583148 - RNA, 9 nt, Human adenovirus F
agccgccgc

SEQ ID NO: 1583149 - RNA, 13 nt, Human adenovirus F
ugccggcccccac

SEQ ID NO: 1583150 - RNA, 13 nt, Human adenovirus F
gccagaaaaaacc

SEQ ID NO: 1583151 - RNA, 16 nt, Human adenovirus F
acgcuucagagcucuu

SEQ ID NO: 1583152 - RNA, 20 nt, Human adenovirus F
ccauauuauuuaaauaaaac

SEQ ID NO: 1583153 - RNA, 16 nt, Human adenovirus F
gcccauaucugacaac

SEQ ID NO: 1583154 - RNA, 20 nt, Human adenovirus F
cuccucaacucccagcauuc

SEQ ID NO: 1583155 - RNA, 16 nt, Human adenovirus F
acugacuuccuggucc

SEQ ID NO: 1583156 - RNA, 16 nt, Human adenovirus F
agccugaagcccgcaa

SEQ ID NO: 1583157 - RNA, 14 nt, Human adenovirus F
cgcgcaaccagugg

SEQ ID NO: 1583158 - RNA, 17 nt, Human adenovirus F
gagacugccaagccuca

SEQ ID NO: 1583159 - RNA, 23 nt, Human adenovirus F
gauauagccaaccaggccuugca

SEQ ID NO: 1583160 - RNA, 14 nt, Human adenovirus F
uaauccaaugcaaa

SEQ ID NO: 1583161 - RNA, 18 nt, Human adenovirus F
cucagggucgauggagcc

SEQ ID NO: 1583162 - RNA, 22 nt, Human adenovirus F
acacuccgcagacgaacacaau

SEQ ID NO: 1583163 - RNA, 23 nt, Human adenovirus F
gcccuuucaaaaagguuuccaaa

SEQ ID NO: 1583164 - RNA, 15 nt, Human adenovirus F
guugacuugcaggag

SEQ ID NO: 1583165 - RNA, 17 nt, Human adenovirus F
ccugaucccgaagaggg

SEQ ID NO: 1583166 - RNA, 12 nt, Human adenovirus F
cgcccugaaagu

SEQ ID NO: 1583167 - RNA, 21 nt, Human adenovirus F
gcaaggguaaugucuuuccag

SEQ ID NO: 1583168 - RNA, 20 nt, Human adenovirus F
caacucgacaacccuuaccu

SEQ ID NO: 1583169 - RNA, 13 nt, Human adenovirus F
cauuggcuggagg

SEQ ID NO: 1583170 - RNA, 21 nt, Human adenovirus F
acugcauacaacucccuggcc

SEQ ID NO: 1583171 - RNA, 13 nt, Human adenovirus F
cugaacacuuuug

SEQ ID NO: 1583172 - RNA, 19 nt, Human adenovirus F
aaucacgaccucccaaagu

SEQ ID NO: 1583173 - RNA, 21 nt, Human adenovirus F
guuccauggcccgaccuguau

SEQ ID NO: 1583174 - RNA, 17 nt, Human adenovirus F
acacuaaaguuuuaaug

SEQ ID NO: 1583175 - RNA, 14 nt, Human adenovirus F
ggaccuuggccacc

SEQ ID NO: 1583176 - RNA, 17 nt, Human adenovirus F
auuacauggcaauggcu

SEQ ID NO: 1583177 - RNA, 23 nt, Human adenovirus F
acgggcggcaaaugcucugcaaa

SEQ ID NO: 1583178 - RNA, 19 nt, Human adenovirus F
caagcccaauccucaagac

SEQ ID NO: 1583179 - RNA, 19 nt, Human adenovirus F
aggccgcccuaaccucuac

SEQ ID NO: 1583180 - RNA, 16 nt, Human adenovirus F
ugcguggauuccuggg

SEQ ID NO: 1583181 - RNA, 13 nt, Human adenovirus F
ggcacccccccug

SEQ ID NO: 1583182 - RNA, 22 nt, Human adenovirus F
ugcagacaagacauggaagaca

SEQ ID NO: 1583183 - RNA, 20 nt, Human adenovirus F
caggcagcagccccaggcca

SEQ ID NO: 1583184 - RNA, 13 nt, Human adenovirus F
gugcaggaagagg

SEQ ID NO: 1583185 - RNA, 17 nt, Human adenovirus F
aagaagagcugcuggag

SEQ ID NO: 1583186 - RNA, 14 nt, Human adenovirus F
ugacggcgcagcug

SEQ ID NO: 1583187 - RNA, 22 nt, Human adenovirus F
ugcgccgagcggcugcuucugc

SEQ ID NO: 1583188 - RNA, 16 nt, Human adenovirus F
cugacgguggaggaau

SEQ ID NO: 1583189 - RNA, 16 nt, Human adenovirus F
uacugcuaaagggaac

SEQ ID NO: 1583190 - RNA, 14 nt, Human adenovirus F
uagcucugaacacu

SEQ ID NO: 1583191 - RNA, 22 nt, Human adenovirus F
ccgccagccuccgguggcucug

SEQ ID NO: 1583192 - RNA, 19 nt, Human adenovirus F
agcgcgacagagcaccauu

SEQ ID NO: 1583193 - RNA, 19 nt, Human adenovirus F
auagcaaaagcauuuuccu

SEQ ID NO: 1583194 - RNA, 19 nt, Human adenovirus F
ucgcagaaacaugccaccc

SEQ ID NO: 1583195 - RNA, 13 nt, Human adenovirus F
ggaaacugaugcu

SEQ ID NO: 1583196 - RNA, 18 nt, Human adenovirus F
acuacaauauuggcuacc

SEQ ID NO: 1583197 - RNA, 14 nt, Human adenovirus F
ccagcaaaggcgcc

SEQ ID NO: 1583198 - RNA, 15 nt, Human adenovirus F
uaaaaauggagaucu

SEQ ID NO: 1583199 - RNA, 18 nt, Human adenovirus F
gaaaaaccgccacaugaa

SEQ ID NO: 1583200 - RNA, 18 nt, Human adenovirus F
ccacaaaagcuuucacuu

SEQ ID NO: 1583201 - RNA, 18 nt, Human adenovirus F
ugccacccgcgcaacaca

SEQ ID NO: 1583202 - RNA, 16 nt, Human adenovirus F
uggccaacugccaccu

SEQ ID NO: 1583203 - RNA, 22 nt, Human adenovirus F
aaucuuacuuugacaugggggc

SEQ ID NO: 1583204 - RNA, 15 nt, Human adenovirus F
cccugaucagccagg

SEQ ID NO: 1583205 - RNA, 20 nt, Human adenovirus F
uuacauugguuuuagggaca

SEQ ID NO: 1583206 - RNA, 17 nt, Human adenovirus F
ccgucggaccugccccu

SEQ ID NO: 1583207 - RNA, 23 nt, Human adenovirus F
ccaaaucaaucagcggcuggaaa

SEQ ID NO: 1583208 - RNA, 20 nt, Human adenovirus F
ugccuuggaaucauccaccu

SEQ ID NO: 1583209 - RNA, 22 nt, Human adenovirus F
uugcuauugaaaauaacucacu

SEQ ID NO: 1583210 - RNA, 17 nt, Human adenovirus F
gaggagaaccugagggc

SEQ ID NO: 1583211 - RNA, 15 nt, Human adenovirus F
gcaguaucaguggag

SEQ ID NO: 1583212 - RNA, 11 nt, Human adenovirus F
ugaagaccaau

SEQ ID NO: 1583213 - RNA, 18 nt, Human adenovirus F
gcggguuaaaaagcgaga

SEQ ID NO: 1583214 - RNA, 15 nt, Human adenovirus F
acccaacuauuuggg

SEQ ID NO: 1583215 - RNA, 17 nt, Human adenovirus F
acugcuaaagggaacug

SEQ ID NO: 1583216 - RNA, 16 nt, Human adenovirus F
acuucauugguuugau

SEQ ID NO: 1583217 - RNA, 17 nt, Human adenovirus F
aaacaguaacaacuccu

SEQ ID NO: 1583218 - RNA, 13 nt, Human adenovirus F
aaguuucgggcgc

SEQ ID NO: 1583219 - RNA, 17 nt, Human adenovirus F
guaacagcuuuggaagu

SEQ ID NO: 1583220 - RNA, 12 nt, Human adenovirus F
auggggaaggau

SEQ ID NO: 1583221 - RNA, 23 nt, Human adenovirus F
gcuacucaacagaaaccucuucc

SEQ ID NO: 1583222 - RNA, 17 nt, Human adenovirus F
acugcuaccuccuccgu

SEQ ID NO: 1583223 - RNA, 17 nt, Human adenovirus F
cacuaccccuaccaccc

SEQ ID NO: 1583224 - RNA, 21 nt, Human adenovirus F
cugccguugcaaccucugcac

SEQ ID NO: 1583225 - RNA, 20 nt, Human adenovirus F
gccauuuaccaauagcagca

SEQ ID NO: 1583226 - RNA, 19 nt, Human adenovirus F
ugccgccaugacugccgcu

SEQ ID NO: 1583227 - RNA, 12 nt, Human adenovirus F
guuucuccuccc

SEQ ID NO: 1583228 - RNA, 14 nt, Human adenovirus F
caugcgcuccaaca

SEQ ID NO: 1583229 - RNA, 18 nt, Human adenovirus F
agugcaggaagaggagga

SEQ ID NO: 1583230 - RNA, 18 nt, Human adenovirus F
gcccgucgucaggccgcc

SEQ ID NO: 1583231 - RNA, 23 nt, Human adenovirus F
cuggucaaucucuucguccugga

SEQ ID NO: 1583232 - RNA, 23 nt, Human adenovirus F
cagugggaccguaaaugacccca

SEQ ID NO: 1583233 - RNA, 20 nt, Human adenovirus F
gcuaaccugugcagauggaa

SEQ ID NO: 1583234 - RNA, 12 nt, Human adenovirus F
gcuggugugaaa

SEQ ID NO: 1583235 - RNA, 15 nt, Human adenovirus F
cgcuagaccaacaaa

SEQ ID NO: 1583236 - RNA, 16 nt, Human adenovirus F
cauaaccuugaggaau

SEQ ID NO: 1583237 - RNA, 22 nt, Human adenovirus F
gccggagaggggaggaaguagg

SEQ ID NO: 1583238 - RNA, 19 nt, Human adenovirus F
cuagcgccccugcagccgu

SEQ ID NO: 1583239 - RNA, 16 nt, Human adenovirus F
uggagcagccugugga

SEQ ID NO: 1583240 - RNA, 22 nt, Human adenovirus F
accacugauguaacagcuuugg

SEQ ID NO: 1583241 - RNA, 19 nt, Human adenovirus F
cagacuuugucagccaaag

SEQ ID NO: 1583242 - RNA, 18 nt, Human adenovirus F
cacaggagauccguggag

SEQ ID NO: 1583243 - RNA, 19 nt, Human adenovirus F
gccccgguugugcaguguu

SEQ ID NO: 1583244 - RNA, 13 nt, Human adenovirus F
cucuugggcagga

SEQ ID NO: 1583245 - RNA, 19 nt, Human adenovirus F
aaugcuggucugcgcuacc

SEQ ID NO: 1583246 - RNA, 17 nt, Human adenovirus F
aaaagucaaaugucugu

SEQ ID NO: 1583247 - RNA, 14 nt, Human adenovirus F
aaagacacaauugg

SEQ ID NO: 1583248 - RNA, 22 nt, Human adenovirus F
ugucugccaauuaucuacgccu

SEQ ID NO: 1583249 - RNA, 12 nt, Human adenovirus F
cugcgcccccac

SEQ ID NO: 1583250 - RNA, 16 nt, Human adenovirus F
guuggcggcccugcaa

SEQ ID NO: 1583251 - RNA, 16 nt, Human adenovirus F
gcaacguucagccacu

SEQ ID NO: 1583252 - RNA, 19 nt, Human adenovirus F
ggggcguguccgggcucuu

SEQ ID NO: 1583253 - RNA, 19 nt, Human adenovirus F
ucccugucguugccagccg

SEQ ID NO: 1583254 - RNA, 13 nt, Human adenovirus F
ggcgccggacggg

SEQ ID NO: 1583255 - RNA, 14 nt, Human adenovirus F
aacagccccagcug

SEQ ID NO: 1583256 - RNA, 16 nt, Human adenovirus F
uagggugucugccaga

SEQ ID NO: 1583257 - RNA, 13 nt, Human adenovirus F
guuaaucccuuua

SEQ ID NO: 1583258 - RNA, 13 nt, Human adenovirus F
cgaaugcccccca

SEQ ID NO: 1583259 - RNA, 11 nt, Human adenovirus F
aacucugaaga

SEQ ID NO: 1583260 - RNA, 16 nt, Human adenovirus F
guugcauuauggccau

SEQ ID NO: 1583261 - RNA, 20 nt, Human adenovirus F
cggguuuuauggcaccgcau

SEQ ID NO: 1583262 - RNA, 23 nt, Human adenovirus F
uccagguggggcggcgaccugaa

SEQ ID NO: 1583263 - RNA, 22 nt, Human adenovirus F
ccuccucgcugucuggaaccac

SEQ ID NO: 1583264 - RNA, 14 nt, Human adenovirus F
auuuguuuagaaaa

SEQ ID NO: 1583265 - RNA, 17 nt, Human adenovirus F
cggcuggggcagaacgu

SEQ ID NO: 1583266 - RNA, 22 nt, Human adenovirus F
auggagcuauuuaaagugguga

SEQ ID NO: 1583267 - RNA, 19 nt, Human adenovirus F
gaaauugugaucagaaauu

SEQ ID NO: 1583268 - RNA, 23 nt, Human adenovirus F
agggaucgcagcgggcaggagcc

SEQ ID NO: 1583269 - RNA, 21 nt, Human adenovirus F
cauuccauuuauuacaccccc

SEQ ID NO: 1583270 - RNA, 16 nt, Human adenovirus F
ugaauaauucccaaau

SEQ ID NO: 1583271 - RNA, 17 nt, Human adenovirus F
ugggcguccaguggagc

SEQ ID NO: 1583272 - RNA, 14 nt, Human adenovirus F
ccugucgccccugc

SEQ ID NO: 1583273 - RNA, 21 nt, Human adenovirus F
uggcaaugugcucgcaaacaa

SEQ ID NO: 1583274 - RNA, 21 nt, Human adenovirus F
guugugcaguguuauaagguc

SEQ ID NO: 1583275 - RNA, 21 nt, Human adenovirus F
uuuaucuguaaaacuucccuu

SEQ ID NO: 1583276 - RNA, 18 nt, Human adenovirus F
cgcagccugagcugccag

SEQ ID NO: 1583277 - RNA, 14 nt, Human adenovirus F
ugcucguggcaugg

SEQ ID NO: 1583278 - RNA, 17 nt, Human adenovirus F
ugaccaucacugacgcc

SEQ ID NO: 1583279 - RNA, 21 nt, Human adenovirus F
gaccugcaauggcagcccagc

SEQ ID NO: 1583280 - RNA, 15 nt, Human adenovirus F
ggagcagauggagag

SEQ ID NO: 1583281 - RNA, 18 nt, Human adenovirus F
agaaauugauuuucugcc

SEQ ID NO: 1583282 - RNA, 16 nt, Human adenovirus F
gcaugccuccagcacu

SEQ ID NO: 1583283 - RNA, 16 nt, Human adenovirus F
ggcugcuucugccagu

SEQ ID NO: 1583284 - RNA, 14 nt, Human adenovirus F
caaguuggugaugc

SEQ ID NO: 1583285 - RNA, 17 nt, Human adenovirus F
auuaggaagggcaaagg

SEQ ID NO: 1583286 - RNA, 13 nt, Human adenovirus F
aacacaaugcaaa

SEQ ID NO: 1583287 - RNA, 15 nt, Human adenovirus F
gccccuaccagccgu

SEQ ID NO: 1583288 - RNA, 13 nt, Human adenovirus F
cucaucacugacu

SEQ ID NO: 1583289 - RNA, 13 nt, Human adenovirus F
cagacgcaaugga

SEQ ID NO: 1583290 - RNA, 23 nt, Human adenovirus F
auggcaauggcucuguggagaac

SEQ ID NO: 1583291 - RNA, 20 nt, Human adenovirus F
ccacacuuuuaaaaaggugu

SEQ ID NO: 1583292 - RNA, 17 nt, Human adenovirus F
agagggaaguugagaaa

SEQ ID NO: 1583293 - RNA, 16 nt, Human adenovirus F
aguauuacaaaugccu

SEQ ID NO: 1583294 - RNA, 14 nt, Human adenovirus F
cccgacagaggccg

SEQ ID NO: 1583295 - RNA, 19 nt, Human adenovirus F
ggugccugaagcacuggcu

SEQ ID NO: 1583296 - RNA, 18 nt, Human adenovirus F
uaaagcauaacaugauuu

SEQ ID NO: 1583297 - RNA, 17 nt, Human adenovirus F
ggaaagacaguggcgcg

SEQ ID NO: 1583298 - RNA, 23 nt, Human adenovirus F
augguucuuucuccccaucgccg

SEQ ID NO: 1583299 - RNA, 12 nt, Human adenovirus F
cuauuuaaagug

SEQ ID NO: 1583300 - RNA, 15 nt, Human adenovirus F
uuuggcucaacuuua

SEQ ID NO: 1583301 - RNA, 18 nt, Human adenovirus F
ccgucacucuccgccgcc

SEQ ID NO: 1583302 - RNA, 16 nt, Human adenovirus F
aacucuuuauuuuucu

SEQ ID NO: 1583303 - RNA, 15 nt, Human adenovirus F
uugaggguacgcugu

SEQ ID NO: 1583304 - RNA, 15 nt, Human adenovirus F
agauccgggcuaugu

SEQ ID NO: 1583305 - RNA, 21 nt, Human adenovirus F
gucguacaaguugcaaagcuc

SEQ ID NO: 1583306 - RNA, 21 nt, Human adenovirus F
acugcuagaaugucacugccg

SEQ ID NO: 1583307 - RNA, 15 nt, Human adenovirus F
accuuggcucgacuc

SEQ ID NO: 1583308 - RNA, 21 nt, Human adenovirus F
acugcuacuacuuuaacucuu

SEQ ID NO: 1583309 - RNA, 23 nt, Human adenovirus F
gucacuacaauauuggcuaccag

SEQ ID NO: 1583310 - RNA, 21 nt, Human adenovirus F
ucuuugggguccggguuugau

SEQ ID NO: 1583311 - RNA, 11 nt, Human adenovirus F
uuuccagcaga

SEQ ID NO: 1583312 - RNA, 13 nt, Human adenovirus F
acccucaaacacu

SEQ ID NO: 1583313 - RNA, 21 nt, Human adenovirus F
guccugucgccccugccaacu

SEQ ID NO: 1583314 - RNA, 13 nt, Human adenovirus F
caacuccucuugc

SEQ ID NO: 1583315 - RNA, 17 nt, Human adenovirus F
cucauuuucuuauguaa

SEQ ID NO: 1583316 - RNA, 11 nt, Human adenovirus F
ugguuggaaaa

SEQ ID NO: 1583317 - RNA, 18 nt, Human adenovirus F
ccaccgguuuuguaccac

SEQ ID NO: 1583318 - RNA, 17 nt, Human adenovirus F
uccuucacaaaguccug

SEQ ID NO: 1583319 - RNA, 17 nt, Human adenovirus F
cuguacugugcauuugg

SEQ ID NO: 1583320 - RNA, 20 nt, Human adenovirus F
uuugccacacuaaaguuuua

SEQ ID NO: 1583321 - RNA, 22 nt, Human adenovirus F
auguacuacaauuccacuggca

SEQ ID NO: 1583322 - RNA, 13 nt, Human adenovirus F
agaaugucacugc

SEQ ID NO: 1583323 - RNA, 16 nt, Human adenovirus F
cagugcaggaagagga

SEQ ID NO: 1583324 - RNA, 13 nt, Human adenovirus F
caggccgcggcgg

SEQ ID NO: 1583325 - RNA, 18 nt, Human adenovirus F
ucauuuaccaccccagca

SEQ ID NO: 1583326 - RNA, 21 nt, Human adenovirus F
acggaauuguaacugagccug

SEQ ID NO: 1583327 - RNA, 18 nt, Human adenovirus F
agcaaguuucgcaaaagc

SEQ ID NO: 1583328 - RNA, 22 nt, Human adenovirus F
agcuuuauuuccuuugucaugu

SEQ ID NO: 1583329 - RNA, 13 nt, Human adenovirus F
ccucuucugcacc

SEQ ID NO: 1583330 - RNA, 15 nt, Human adenovirus F
agucaaaaguguuua

SEQ ID NO: 1583331 - RNA, 19 nt, Human adenovirus F
ccacccuauggaccaccgc

SEQ ID NO: 1583332 - RNA, 21 nt, Human adenovirus F
cgagcaaacggugaacgagga

SEQ ID NO: 1583333 - RNA, 18 nt, Human adenovirus F
uggcuacuuaucacaucu

SEQ ID NO: 1583334 - RNA, 19 nt, Human adenovirus F
aagguauuaacaaaucgau

SEQ ID NO: 1583335 - RNA, 16 nt, Human adenovirus F
acgcuguaccaggagg

SEQ ID NO: 1583336 - RNA, 13 nt, Human adenovirus F
ugccaggcagcag

SEQ ID NO: 1583337 - RNA, 13 nt, Human adenovirus F
aaaccuguucuaa

SEQ ID NO: 1583338 - RNA, 17 nt, Human adenovirus F
uugcgucgcuggcuccg

SEQ ID NO: 1583339 - RNA, 16 nt, Human adenovirus F
caccgcauaagcuggc

SEQ ID NO: 1583340 - RNA, 13 nt, Human adenovirus F
ucuuauggaagac

SEQ ID NO: 1583341 - RNA, 19 nt, Human adenovirus F
aacgguuguuuuccaccag

SEQ ID NO: 1583342 - RNA, 15 nt, Human adenovirus F
cuucaccaaugccau

SEQ ID NO: 1583343 - RNA, 14 nt, Human adenovirus F
gcggagccugaggg

SEQ ID NO: 1583344 - RNA, 19 nt, Human adenovirus F
acaaucagggaaauuuacu

SEQ ID NO: 1583345 - RNA, 13 nt, Human adenovirus F
ugguagcaguguc

SEQ ID NO: 1583346 - RNA, 12 nt, Human adenovirus F
cccauucugcca

SEQ ID NO: 1583347 - RNA, 23 nt, Human adenovirus F
agccccuacgaaacguuuggaga

SEQ ID NO: 1583348 - RNA, 18 nt, Human adenovirus F
ccgucuccuaacgccacu

SEQ ID NO: 1583349 - RNA, 18 nt, Human adenovirus F
ugccaauuaucuacgccu

SEQ ID NO: 1583350 - RNA, 22 nt, Human adenovirus F
cagcaggugaaucccgcuaugu

SEQ ID NO: 1583351 - RNA, 21 nt, Human adenovirus F
gcccuuaaguauucaccaccu

SEQ ID NO: 1583352 - RNA, 11 nt, Human adenovirus F
ggccaccgccg

SEQ ID NO: 1583353 - RNA, 13 nt, Human adenovirus F
uaaaggaccaaaa

SEQ ID NO: 1583354 - RNA, 23 nt, Human adenovirus F
uaaccuguaugccaacuuuuucc

SEQ ID NO: 1583355 - RNA, 21 nt, Human adenovirus F
gcaaguuucgcaaaagcuggg

SEQ ID NO: 1583356 - RNA, 17 nt, Human adenovirus F
gccccgguugugcagug

SEQ ID NO: 1583357 - RNA, 20 nt, Human adenovirus F
gcugcugccucuacugcucg

SEQ ID NO: 1583358 - RNA, 13 nt, Human adenovirus F
agcguguucccaa

SEQ ID NO: 1583359 - RNA, 23 nt, Human adenovirus F
agccaguggacaaaccaaaacaa

SEQ ID NO: 1583360 - RNA, 17 nt, Human adenovirus F
cucccaacaaccuaccc

SEQ ID NO: 1583361 - RNA, 16 nt, Human adenovirus F
ccgcuccaucaagccc

SEQ ID NO: 1583362 - RNA, 14 nt, Human adenovirus F
ccaaaacuuucaac

SEQ ID NO: 1583363 - RNA, 19 nt, Human adenovirus F
gccguuuaugggcaccugg

SEQ ID NO: 1583364 - RNA, 10 nt, Human adenovirus F
cacaggaaga

SEQ ID NO: 1583365 - RNA, 22 nt, Human adenovirus F
aaagaaauccacuuaccagagc

SEQ ID NO: 1583366 - RNA, 19 nt, Human adenovirus F
augcaacuuggaagggaag

SEQ ID NO: 1583367 - RNA, 13 nt, Human adenovirus F
uauggaggaggau

SEQ ID NO: 1583368 - RNA, 23 nt, Human adenovirus F
acaccaccccuagucccuccucc

SEQ ID NO: 1583369 - RNA, 22 nt, Human adenovirus F
ugcaguucgcccgugccaccga

SEQ ID NO: 1583370 - RNA, 22 nt, Human adenovirus F
augaauuggcuuagugccggcc

SEQ ID NO: 1583371 - RNA, 17 nt, Human adenovirus F
aaauguucacacucuaa

SEQ ID NO: 1583372 - RNA, 18 nt, Human adenovirus F
acacggggucuauuugga

SEQ ID NO: 1583373 - RNA, 15 nt, Human adenovirus F
ucacccgcagcugcu

SEQ ID NO: 1583374 - RNA, 12 nt, Human adenovirus F
cuggcagcagug

SEQ ID NO: 1583375 - RNA, 17 nt, Human adenovirus F
ggacggcaaggaaccag

SEQ ID NO: 1583376 - RNA, 17 nt, Human adenovirus F
augcacaucgccgggca

SEQ ID NO: 1583377 - RNA, 17 nt, Human adenovirus F
agccuccgguggcucug

SEQ ID NO: 1583378 - RNA, 15 nt, Human adenovirus F
gaggauuaaggguaa

SEQ ID NO: 1583379 - RNA, 21 nt, Human adenovirus F
gcuggggaauggagcuguggu

SEQ ID NO: 1583380 - RNA, 14 nt, Human adenovirus F
uaguaacuuucaaa

SEQ ID NO: 1583381 - RNA, 19 nt, Human adenovirus F
ucaaguuuuuccagcagca

SEQ ID NO: 1583382 - RNA, 20 nt, Human adenovirus F
ccgcaaaugggccuggcagc

SEQ ID NO: 1583383 - RNA, 15 nt, Human adenovirus F
cugugccugucauga

SEQ ID NO: 1583384 - RNA, 14 nt, Human adenovirus F
uacggaggaagagg

SEQ ID NO: 1583385 - RNA, 18 nt, Human adenovirus F
agcagccccaggccaacc

SEQ ID NO: 1583386 - RNA, 18 nt, Human adenovirus F
ggauccagugcaggaaga

SEQ ID NO: 1583387 - RNA, 23 nt, Human adenovirus F
agcaucuuaggaagggggccauc

SEQ ID NO: 1583388 - RNA, 23 nt, Human adenovirus F
aaagcaaagccauccgcaaggau

SEQ ID NO: 1583389 - RNA, 18 nt, Human adenovirus F
guagggugucugccagag

SEQ ID NO: 1583390 - RNA, 21 nt, Human adenovirus F
acggaagggcggaacagcaua

SEQ ID NO: 1583391 - RNA, 18 nt, Human adenovirus F
gcaaaaugugcagcaaaa

SEQ ID NO: 1583392 - RNA, 21 nt, Human adenovirus F
gaccauuaccaccgucaguga

SEQ ID NO: 1583393 - RNA, 20 nt, Human adenovirus F
acacuaugguaaaaacccug

SEQ ID NO: 1583394 - RNA, 15 nt, Human adenovirus F
cuuacuuucugggca

SEQ ID NO: 1583395 - RNA, 19 nt, Human adenovirus F
cugccaaaauggcucugcu

SEQ ID NO: 1583396 - RNA, 14 nt, Human adenovirus F
caggacuuggcaga

SEQ ID NO: 1583397 - RNA, 17 nt, Human adenovirus F
cacacgucauccgccuc

SEQ ID NO: 1583398 - RNA, 22 nt, Human adenovirus F
aucuccugcacgucgccagagu

SEQ ID NO: 1583399 - RNA, 13 nt, Human adenovirus F
uagcaaacagugc

SEQ ID NO: 1583400 - RNA, 19 nt, Human adenovirus F
caaaaguccacaaaaacuc

SEQ ID NO: 1583401 - RNA, 11 nt, Human adenovirus F
guaccaggagg

SEQ ID NO: 1583402 - RNA, 14 nt, Human adenovirus F
gguccagcaaaggc

SEQ ID NO: 1583403 - RNA, 13 nt, Human adenovirus F
aggaggaggccau

SEQ ID NO: 1583404 - RNA, 13 nt, Human adenovirus F
ccugagcccgggc

SEQ ID NO: 1583405 - RNA, 16 nt, Human adenovirus F
cuucgggagacggagg

SEQ ID NO: 1583406 - RNA, 14 nt, Human adenovirus F
gaugauggcagcag

SEQ ID NO: 1583407 - RNA, 14 nt, Human adenovirus F
uggagcagccugug

SEQ ID NO: 1583408 - RNA, 20 nt, Human adenovirus F
ucaaacaaccagcgcucuac

SEQ ID NO: 1583409 - RNA, 18 nt, Human adenovirus F
augcuguagaauuuaugc

SEQ ID NO: 1583410 - RNA, 20 nt, Human adenovirus F
cccuuacgaacacuacaauc

SEQ ID NO: 1583411 - RNA, 18 nt, Human adenovirus F
aagcuucuuguacucaaa

SEQ ID NO: 1583412 - RNA, 19 nt, Human adenovirus F
ugaaguuaccaaagacaaa

SEQ ID NO: 1583413 - RNA, 21 nt, Human adenovirus F
caaucagaccacaacaacaaa

SEQ ID NO: 1583414 - RNA, 19 nt, Human adenovirus F
gcacugguaaaccagcaca

SEQ ID NO: 1583415 - RNA, 17 nt, Human adenovirus F
aucuauuucuuugucua

SEQ ID NO: 1583416 - RNA, 23 nt, Human adenovirus F
acauuggcuggaggcuugggagg

SEQ ID NO: 1583417 - RNA, 22 nt, Human adenovirus F
acuaagccucucgcucugcaaa

SEQ ID NO: 1583418 - RNA, 23 nt, Human adenovirus F
ugaagaccaaucacgaccuccca

SEQ ID NO: 1583419 - RNA, 21 nt, Human adenovirus F
gccagcuaaugugccgcgcgg

SEQ ID NO: 1583420 - RNA, 20 nt, Human adenovirus F
cagaaacuacaaaagcagug

SEQ ID NO: 1583421 - RNA, 12 nt, Human adenovirus F
augccuagcucu

SEQ ID NO: 1583422 - RNA, 15 nt, Human adenovirus F
gcgagcuuagcgacc

SEQ ID NO: 1583423 - RNA, 22 nt, Human adenovirus F
ccauggaucgcauccuggcccu

SEQ ID NO: 1583424 - RNA, 13 nt, Human adenovirus F
cuacucuggcucc

SEQ ID NO: 1583425 - RNA, 16 nt, Human adenovirus F
ucggcaccagccagcu

SEQ ID NO: 1583426 - RNA, 21 nt, Human adenovirus F
cugaccgaccuggggcaaaac

SEQ ID NO: 1583427 - RNA, 12 nt, Human adenovirus F
uuuuaugaagac

SEQ ID NO: 1583428 - RNA, 13 nt, Human adenovirus F
acugauccacuua

SEQ ID NO: 1583429 - RNA, 23 nt, Human adenovirus F
uugggacucuugcuggaccaaag

SEQ ID NO: 1583430 - RNA, 12 nt, Human adenovirus F
caggccgcggcg

SEQ ID NO: 1583431 - RNA, 20 nt, Human adenovirus F
gcagcgccacucgggaaaga

SEQ ID NO: 1583432 - RNA, 20 nt, Human adenovirus F
aacgugaccgagcagcugcg

SEQ ID NO: 1583433 - RNA, 21 nt, Human adenovirus F
cagcugguaagcagccuaagc

SEQ ID NO: 1583434 - RNA, 18 nt, Human adenovirus F
ugcuacacaacaaaucau

SEQ ID NO: 1583435 - RNA, 17 nt, Human adenovirus F
auuuaugcccaacagua

SEQ ID NO: 1583436 - RNA, 15 nt, Human adenovirus F
gucgcuggcuccgcg

SEQ ID NO: 1583437 - RNA, 12 nt, Human adenovirus F
guggaggcagcu

SEQ ID NO: 1583438 - RNA, 14 nt, Human adenovirus F
uccuauuacagccc

SEQ ID NO: 1583439 - RNA, 16 nt, Human adenovirus F
uggcacagcaaacaca

SEQ ID NO: 1583440 - RNA, 18 nt, Human adenovirus F
ggaggucaagccaagcug

SEQ ID NO: 1583441 - RNA, 17 nt, Human adenovirus F
agggaggcagcagagga

SEQ ID NO: 1583442 - RNA, 18 nt, Human adenovirus F
agugcugucuagccgcac

SEQ ID NO: 1583443 - RNA, 23 nt, Human adenovirus F
uauguuagcgaaaacggaaacaa

SEQ ID NO: 1583444 - RNA, 11 nt, Human adenovirus F
uuuaauacagu

SEQ ID NO: 1583445 - RNA, 21 nt, Human adenovirus F
guguugacccgcuuggaggag

SEQ ID NO: 1583446 - RNA, 15 nt, Human adenovirus F
ccagcgcccgggccc

SEQ ID NO: 1583447 - RNA, 14 nt, Human adenovirus F
gggguggaaagccu

SEQ ID NO: 1583448 - RNA, 20 nt, Human adenovirus F
ucugcaaaaacaaauacagu

SEQ ID NO: 1583449 - RNA, 19 nt, Human adenovirus F
uggcggcccugcaaagcca

SEQ ID NO: 1583450 - RNA, 23 nt, Human adenovirus F
gucgccccugugaguguggagcu

SEQ ID NO: 1583451 - RNA, 13 nt, Human adenovirus F
accacgcugcgcc

SEQ ID NO: 1583452 - RNA, 17 nt, Human adenovirus F
gaaaacucaaacaacaa

SEQ ID NO: 1583453 - RNA, 17 nt, Human adenovirus F
aggacuucaccuacaac

SEQ ID NO: 1583454 - RNA, 13 nt, Human adenovirus F
cgcagcagauccu

SEQ ID NO: 1583455 - RNA, 21 nt, Human adenovirus F
ggccgcggcggcuauugccag

SEQ ID NO: 1583456 - RNA, 15 nt, Human adenovirus F
ggcaacguucagcca

SEQ ID NO: 1583457 - RNA, 14 nt, Human adenovirus F
gugccugaagcacu

SEQ ID NO: 1583458 - RNA, 14 nt, Human adenovirus F
auuggucaaaaacu

SEQ ID NO: 1583459 - RNA, 15 nt, Human adenovirus F
augcuuuaccccaua

SEQ ID NO: 1583460 - RNA, 14 nt, Human adenovirus F
ucccaaagugcugu

SEQ ID NO: 1583461 - RNA, 22 nt, Human adenovirus F
gcaaaaaaacgaaaccgagaau

SEQ ID NO: 1583462 - RNA, 19 nt, Human adenovirus F
ucaaucagcggcuggaaaa

SEQ ID NO: 1583463 - RNA, 18 nt, Human adenovirus F
guggacgacagccagcug

SEQ ID NO: 1583464 - RNA, 15 nt, Human adenovirus F
gaaaaauuacagcca

SEQ ID NO: 1583465 - RNA, 16 nt, Human adenovirus F
gcagacaagacaugga

SEQ ID NO: 1583466 - RNA, 23 nt, Human adenovirus F
cugcacugccaucugcagcauug

SEQ ID NO: 1583467 - RNA, 21 nt, Human adenovirus F
caggcguuuaaaaacuugcaa

SEQ ID NO: 1583468 - RNA, 23 nt, Human adenovirus F
cggugcguuuuuuugagcuugga

SEQ ID NO: 1583469 - RNA, 21 nt, Human adenovirus F
gccucuacugcucguggcaug

SEQ ID NO: 1583470 - RNA, 14 nt, Human adenovirus F
cuaucugcaaaaaa

SEQ ID NO: 1583471 - RNA, 17 nt, Human adenovirus F
gcaacauaacuuuacaa

SEQ ID NO: 1583472 - RNA, 21 nt, Human adenovirus F
cuuaacccucccgcuaauacu

SEQ ID NO: 1583473 - RNA, 13 nt, Human adenovirus F
cccuuuccagcau

SEQ ID NO: 1583474 - RNA, 19 nt, Human adenovirus F
ggcacaguaaucaaggguu

SEQ ID NO: 1583475 - RNA, 19 nt, Human adenovirus F
uguggaaucccgcgagccc

SEQ ID NO: 1583476 - RNA, 19 nt, Human adenovirus F
auauaaaaacaaccaacuu

SEQ ID NO: 1583477 - RNA, 21 nt, Human adenovirus F
guccaggcuaaaacaaaggag

SEQ ID NO: 1583478 - RNA, 18 nt, Human adenovirus F
cggcaucggaacccucca

SEQ ID NO: 1583479 - RNA, 16 nt, Human adenovirus F
caaggaaugcacacag

SEQ ID NO: 1583480 - RNA, 19 nt, Human adenovirus F
cuuuuauugauucaaaaaa

SEQ ID NO: 1583481 - RNA, 16 nt, Human adenovirus F
ccagcauggcucagcc

SEQ ID NO: 1583482 - RNA, 13 nt, Human adenovirus F
cgauaacauuacu

SEQ ID NO: 1583483 - RNA, 20 nt, Human adenovirus F
cuggagggcgucaugcucug

SEQ ID NO: 1583484 - RNA, 18 nt, Human adenovirus F
uacgugucuugcaaagac

SEQ ID NO: 1583485 - RNA, 15 nt, Human adenovirus F
aagacaaaaucacug

SEQ ID NO: 1583486 - RNA, 13 nt, Human adenovirus F
cuaaaacaaacca

SEQ ID NO: 1583487 - RNA, 21 nt, Human adenovirus F
ccgacgcgcuuugcgcaggcg

SEQ ID NO: 1583488 - RNA, 17 nt, Human adenovirus F
gucccugggaugcaggu

SEQ ID NO: 1583489 - RNA, 22 nt, Human adenovirus F
gaggaucuuaagcugcagccag

SEQ ID NO: 1583490 - RNA, 15 nt, Human adenovirus F
ucgauggagccagcg

SEQ ID NO: 1583491 - RNA, 22 nt, Human adenovirus F
uucagacgaggaggcggaggag

SEQ ID NO: 1583492 - RNA, 17 nt, Human adenovirus F
acgcuguaccaggaggc

SEQ ID NO: 1583493 - RNA, 21 nt, Human adenovirus F
cgggcgcacgugucggcggcc

SEQ ID NO: 1583494 - RNA, 15 nt, Human adenovirus F
acuaccucugcgcug

SEQ ID NO: 1583495 - RNA, 23 nt, Human adenovirus F
aagugaaccggaaaaccaacgcu

SEQ ID NO: 1583496 - RNA, 17 nt, Human adenovirus F
gacaaagcacacagaac

SEQ ID NO: 1583497 - RNA, 20 nt, Human adenovirus F
gacuuuaccccgacagaggc

SEQ ID NO: 1583498 - RNA, 18 nt, Human adenovirus F
uccucgcugucuggaacc

SEQ ID NO: 1583499 - RNA, 15 nt, Human adenovirus F
gcgcacccugguggc

SEQ ID NO: 1583500 - RNA, 12 nt, Human adenovirus F
accauggagcua

SEQ ID NO: 1583501 - RNA, 22 nt, Human adenovirus F
ugcacuuuuggccuuugucugu

SEQ ID NO: 1583502 - RNA, 21 nt, Human adenovirus F
agcauaaaggggaccagcugu

SEQ ID NO: 1583503 - RNA, 24 nt, Human adenovirus F
gugccgagcuuuuacugggacagc

SEQ ID NO: 1583504 - RNA, 20 nt, Human adenovirus F
ccacauaagaagccagccaa

SEQ ID NO: 1583505 - RNA, 21 nt, Human adenovirus F
gccagccguaggugggacacc

SEQ ID NO: 1583506 - RNA, 13 nt, Human adenovirus F
ccucugacggggg

SEQ ID NO: 1583507 - RNA, 22 nt, Human adenovirus F
ccguccccagcgcccuggauac

SEQ ID NO: 1583508 - RNA, 13 nt, Human adenovirus F
cgcagcuguuuuu

SEQ ID NO: 1583509 - RNA, 19 nt, Human adenovirus F
cuaucccguguuugacaac

SEQ ID NO: 1583510 - RNA, 14 nt, Human adenovirus F
gcaucuaucuuuuc

SEQ ID NO: 1583511 - RNA, 19 nt, Human adenovirus F
ugcauuuuggccugaauuu

SEQ ID NO: 1583512 - RNA, 12 nt, Human adenovirus F
augcucugcaaa

SEQ ID NO: 1583513 - RNA, 22 nt, Human adenovirus F
agcauaaaagaagcacaggaga

SEQ ID NO: 1583514 - RNA, 18 nt, Human adenovirus F
uuagcaguaggacgucag

SEQ ID NO: 1583515 - RNA, 21 nt, Human adenovirus F
uccuagccaguggacaaacca

SEQ ID NO: 1583516 - RNA, 22 nt, Human adenovirus F
ggcaccuuuuaccugaaccaca

SEQ ID NO: 1583517 - RNA, 19 nt, Human adenovirus F
aagcucgcgcacagcuucg

SEQ ID NO: 1583518 - RNA, 14 nt, Human adenovirus F
gagucuggcagcag

SEQ ID NO: 1583519 - RNA, 19 nt, Human adenovirus F
caucucaaagcuggagcuc

SEQ ID NO: 1583520 - RNA, 22 nt, Human adenovirus F
gcuggagggcaaaaugggcuug

SEQ ID NO: 1583521 - RNA, 18 nt, Human adenovirus F
caauagcauacagaagac

SEQ ID NO: 1583522 - RNA, 20 nt, Human adenovirus F
ccucagggucaacugggucg

SEQ ID NO: 1583523 - RNA, 23 nt, Human adenovirus F
cccaacuauuugggaggggagga

SEQ ID NO: 1583524 - RNA, 13 nt, Human adenovirus F
ucuuugccaccuu

SEQ ID NO: 1583525 - RNA, 13 nt, Human adenovirus F
ccaggcagcaggg

SEQ ID NO: 1583526 - RNA, 20 nt, Human adenovirus F
gucccuccccguuaccuggg

SEQ ID NO: 1583527 - RNA, 15 nt, Human adenovirus F
auauacguaaaugug

SEQ ID NO: 1583528 - RNA, 21 nt, Human adenovirus F
cugggauuugccgcagccagu

SEQ ID NO: 1583529 - RNA, 16 nt, Human adenovirus F
acgcuagaccaacaaa

SEQ ID NO: 1583530 - RNA, 13 nt, Human adenovirus F
acaaaaacuccaa

SEQ ID NO: 1583531 - RNA, 12 nt, Human adenovirus F
guaccaggaggc

SEQ ID NO: 1583532 - RNA, 17 nt, Human adenovirus F
cugagcugccagaggcc

SEQ ID NO: 1583533 - RNA, 16 nt, Human adenovirus F
gauggacuaucugcac

SEQ ID NO: 1583534 - RNA, 12 nt, Human adenovirus F
cuacgucaccuu

SEQ ID NO: 1583535 - RNA, 21 nt, Human adenovirus F
agcucuuccaagcugcggaaa

SEQ ID NO: 1583536 - RNA, 13 nt, Human adenovirus F
caaacaacaaaau

SEQ ID NO: 1583537 - RNA, 18 nt, Human adenovirus F
ccuucaggcagcagcccc

SEQ ID NO: 1583538 - RNA, 19 nt, Human adenovirus F
cccuuaaguauucaccacc

SEQ ID NO: 1583539 - RNA, 12 nt, Human adenovirus F
cagcgggcacag

SEQ ID NO: 1583540 - RNA, 21 nt, Human adenovirus F
gaggagcugucucagcaguug

SEQ ID NO: 1583541 - RNA, 24 nt, Human adenovirus F
gcgggcaggagcccgaagagauga

SEQ ID NO: 1583542 - RNA, 13 nt, Human adenovirus F
aauauuaaugccc

SEQ ID NO: 1583543 - RNA, 15 nt, Human adenovirus F
cggcaccagccagcu

SEQ ID NO: 1583544 - RNA, 13 nt, Human adenovirus F
aagaucagguucc

SEQ ID NO: 1583545 - RNA, 14 nt, Human adenovirus F
caggaucccucaga

SEQ ID NO: 1583546 - RNA, 17 nt, Human adenovirus F
cggaguaccugagcccg

SEQ ID NO: 1583547 - RNA, 22 nt, Human adenovirus F
acagcuaugacccagacgugag

SEQ ID NO: 1583548 - RNA, 15 nt, Human adenovirus F
ccuuacgucagcuac

SEQ ID NO: 1583549 - RNA, 23 nt, Human adenovirus F
aaagugcaagucacgaagaucac

SEQ ID NO: 1583550 - RNA, 20 nt, Human adenovirus F
ccgcgucugcugcugccucu

SEQ ID NO: 1583551 - RNA, 17 nt, Human adenovirus F
aguccucauucuucuca

SEQ ID NO: 1583552 - RNA, 18 nt, Human adenovirus F
cuugcugacuuaucucau

SEQ ID NO: 1583553 - RNA, 18 nt, Human adenovirus F
uaccagaguaacuuuugc

SEQ ID NO: 1583554 - RNA, 12 nt, Human adenovirus F
acuuuuucccca

SEQ ID NO: 1583555 - RNA, 21 nt, Human adenovirus F
ugcccgccagcuggcaaaccu

SEQ ID NO: 1583556 - RNA, 15 nt, Human adenovirus F
caccaccgaaauaaa

SEQ ID NO: 1583557 - RNA, 15 nt, Human adenovirus F
cucgggcgcuccugg

SEQ ID NO: 1583558 - RNA, 17 nt, Human adenovirus F
ggcauggcgggcagugg

SEQ ID NO: 1583559 - RNA, 18 nt, Human adenovirus F
gcagccgugaagccaaau

SEQ ID NO: 1583560 - RNA, 17 nt, Human adenovirus F
uaccaaucacggcuucc

SEQ ID NO: 1583561 - RNA, 16 nt, Human adenovirus F
cgguggcggacggguc

SEQ ID NO: 1583562 - RNA, 17 nt, Human adenovirus F
gccgucccugggaugca

SEQ ID NO: 1583563 - RNA, 17 nt, Human adenovirus F
aaauuacagccaaguca

SEQ ID NO: 1583564 - RNA, 21 nt, Human adenovirus F
gccgcugucguuaguggaggc

SEQ ID NO: 1583565 - RNA, 20 nt, Human adenovirus F
ucugccaccagccggaggag

SEQ ID NO: 1583566 - RNA, 13 nt, Human adenovirus F
aaucgcuggaaaa

SEQ ID NO: 1583567 - RNA, 22 nt, Human adenovirus F
uggauaccgcugcagcugcugc

SEQ ID NO: 1583568 - RNA, 17 nt, Human adenovirus F
guuuccucgauuuccau

SEQ ID NO: 1583569 - RNA, 21 nt, Human adenovirus F
gauggaaacugucaggcucug

SEQ ID NO: 1583570 - RNA, 18 nt, Human adenovirus F
cuccauguggaaccaggc

SEQ ID NO: 1583571 - RNA, 21 nt, Human adenovirus F
cgucuuugcggugccugaagc

SEQ ID NO: 1583572 - RNA, 22 nt, Human adenovirus F
uugacccgcuuggaggagcugu

SEQ ID NO: 1583573 - RNA, 15 nt, Human adenovirus F
ggagucuggcagcag

SEQ ID NO: 1583574 - RNA, 22 nt, Human adenovirus F
cuacguucgucaggccugcaag

SEQ ID NO: 1583575 - RNA, 20 nt, Human adenovirus F
cacugccguugcaaccucug

SEQ ID NO: 1583576 - RNA, 14 nt, Human adenovirus F
uaccacagaaaugu

SEQ ID NO: 1583577 - RNA, 18 nt, Human adenovirus F
gccaccagccggaggagu

SEQ ID NO: 1583578 - RNA, 20 nt, Human adenovirus F
aacgccccgcgagccacagg

SEQ ID NO: 1583579 - RNA, 13 nt, Human adenovirus F
ccuaacacaggcg

SEQ ID NO: 1583580 - RNA, 15 nt, Human adenovirus F
acguucuucacugca

SEQ ID NO: 1583581 - RNA, 18 nt, Human adenovirus F
augauguaacccaacagg

SEQ ID NO: 1583582 - RNA, 23 nt, Human adenovirus F
cacugauguaacagcuuuggaag

SEQ ID NO: 1583583 - RNA, 15 nt, Human adenovirus F
cacugcgguggaggc

SEQ ID NO: 1583584 - RNA, 16 nt, Human adenovirus F
agccacauccgcuccu

SEQ ID NO: 1583585 - RNA, 18 nt, Human adenovirus F
caauggcagcccagcgcc

SEQ ID NO: 1583586 - RNA, 14 nt, Human adenovirus F
gauucaagggccag

SEQ ID NO: 1583587 - RNA, 13 nt, Human adenovirus F
acaccccccgccu

SEQ ID NO: 1583588 - RNA, 19 nt, Human adenovirus F
aaaaucuaccacagaaaug

SEQ ID NO: 1583589 - RNA, 12 nt, Human adenovirus F
aggcaguggugg

SEQ ID NO: 1583590 - RNA, 23 nt, Human adenovirus F
cggaacccugccgcugcgcagca

SEQ ID NO: 1583591 - RNA, 16 nt, Human adenovirus F
gucucagcaguugcaa

SEQ ID NO: 1583592 - RNA, 15 nt, Human adenovirus F
ucuugucguaaccaa

SEQ ID NO: 1583593 - RNA, 15 nt, Human adenovirus F
cuaucccgccccugc

SEQ ID NO: 1583594 - RNA, 14 nt, Human adenovirus F
agaaaaaacccuua

SEQ ID NO: 1583595 - RNA, 23 nt, Human adenovirus F
gauucgccauaaugcgggcucug

SEQ ID NO: 1583596 - RNA, 16 nt, Human adenovirus F
cuuuauugccaccgca

SEQ ID NO: 1583597 - RNA, 16 nt, Human adenovirus F
caccuugcaaggggag

SEQ ID NO: 1583598 - RNA, 24 nt, Human adenovirus F
uccaaauuuuuaugaaacacacau

SEQ ID NO: 1583599 - RNA, 20 nt, Human adenovirus F
ucuauagagcuaaggaggag

SEQ ID NO: 1583600 - RNA, 17 nt, Human adenovirus F
cguggaaaaacuuggaa

SEQ ID NO: 1583601 - RNA, 21 nt, Human adenovirus F
accuccaccggcccaccgagu

SEQ ID NO: 1583602 - RNA, 15 nt, Human adenovirus F
augcgcuccaacacu

SEQ ID NO: 1583603 - RNA, 13 nt, Human adenovirus F
aagaagugugugu

SEQ ID NO: 1583604 - RNA, 13 nt, Human adenovirus F
gagauuuguagug

SEQ ID NO: 1583605 - RNA, 13 nt, Human adenovirus F
caauggcagccca

SEQ ID NO: 1583606 - RNA, 15 nt, Human adenovirus F
cacuccucgccaggc

SEQ ID NO: 1583607 - RNA, 18 nt, Human adenovirus F
cauaaugcgggcucugau

SEQ ID NO: 1583608 - RNA, 16 nt, Human adenovirus F
ccaaaaacggggcuuu

SEQ ID NO: 1583609 - RNA, 20 nt, Human adenovirus F
cauuaauaguggcacagcaa

SEQ ID NO: 1583610 - RNA, 20 nt, Human adenovirus F
cuuaugcgcuguacugugca

SEQ ID NO: 1583611 - RNA, 16 nt, Human adenovirus F
aauggagcuguggugc

SEQ ID NO: 1583612 - RNA, 19 nt, Human adenovirus F
uccacguaccagaaagcua

SEQ ID NO: 1583613 - RNA, 12 nt, Human adenovirus F
cucuugcaggag

SEQ ID NO: 1583614 - RNA, 20 nt, Human adenovirus F
uggugaauaagcgucggcgc

SEQ ID NO: 1583615 - RNA, 15 nt, Human adenovirus F
ugggacgaggaggag

SEQ ID NO: 1583616 - RNA, 20 nt, Human adenovirus F
accaggccuugcaaaaccaa

SEQ ID NO: 1583617 - RNA, 18 nt, Human adenovirus F
gucaucucuacagccccu

SEQ ID NO: 1583618 - RNA, 16 nt, Human adenovirus F
gaaccaggcaguggac

SEQ ID NO: 1583619 - RNA, 14 nt, Human adenovirus F
gagcagccugugga

SEQ ID NO: 1583620 - RNA, 19 nt, Human adenovirus F
gcucgcaaacaauaaaaga

SEQ ID NO: 1583621 - RNA, 18 nt, Human adenovirus F
aaacacugcgcaaagucg

SEQ ID NO: 1583622 - RNA, 14 nt, Human adenovirus F
agagcacccucuac

SEQ ID NO: 1583623 - RNA, 21 nt, Human adenovirus F
aaagcugugagcgccagccgc

SEQ ID NO: 1583624 - RNA, 14 nt, Human adenovirus F
ccccggcguacgac

SEQ ID NO: 1583625 - RNA, 13 nt, Human adenovirus F
ccgcacuggaugc

SEQ ID NO: 1583626 - RNA, 14 nt, Human adenovirus F
caacacaggagcuu

SEQ ID NO: 1583627 - RNA, 22 nt, Human adenovirus F
ucaaaauugcagcgguaucugc

SEQ ID NO: 1583628 - RNA, 21 nt, Human adenovirus F
ugcgcaccaauaugcccaaca

SEQ ID NO: 1583629 - RNA, 20 nt, Human adenovirus F
gcgguggcaacccugaggag

SEQ ID NO: 1583630 - RNA, 19 nt, Human adenovirus F
agcaccaccugcccuuccu

SEQ ID NO: 1583631 - RNA, 22 nt, Human adenovirus F
ugccucuacugcucguggcaug

SEQ ID NO: 1583632 - RNA, 21 nt, Human adenovirus F
aagaguuuuuacaacgagcag

SEQ ID NO: 1583633 - RNA, 13 nt, Human adenovirus F
uaaccucuacccc

SEQ ID NO: 1583634 - RNA, 15 nt, Human adenovirus F
ggacagcuaugaccc

SEQ ID NO: 1583635 - RNA, 13 nt, Human adenovirus F
ugcauguuggaaa

SEQ ID NO: 1583636 - RNA, 19 nt, Human adenovirus F
cuucugugccugucaugaa

SEQ ID NO: 1583637 - RNA, 21 nt, Human adenovirus F
acggccguaccaagccugacu

SEQ ID NO: 1583638 - RNA, 17 nt, Human adenovirus F
guaagguaaucaggaga

SEQ ID NO: 1583639 - RNA, 15 nt, Human adenovirus F
acugucaggcucuga

SEQ ID NO: 1583640 - RNA, 19 nt, Human adenovirus F
ccaccgccgcaccacugac

SEQ ID NO: 1583641 - RNA, 19 nt, Human adenovirus F
cagccgugaagccaaaucg

SEQ ID NO: 1583642 - RNA, 20 nt, Human adenovirus F
uucgcucacccgcagcugcu

SEQ ID NO: 1583643 - RNA, 16 nt, Human adenovirus F
ucaaaaguccacaaaa

SEQ ID NO: 1583644 - RNA, 17 nt, Human adenovirus F
ugacacgggcacucuuc

SEQ ID NO: 1583645 - RNA, 14 nt, Human adenovirus F
ugcaacuuggaagg

SEQ ID NO: 1583646 - RNA, 15 nt, Human adenovirus F
agaaagauggaaaac

SEQ ID NO: 1583647 - RNA, 21 nt, Human adenovirus F
ucuucggcaggaaagccacgc

SEQ ID NO: 1583648 - RNA, 19 nt, Human adenovirus F
cggcguucuagccaacacc

SEQ ID NO: 1583649 - RNA, 13 nt, Human adenovirus F
gucguaacaaaua

SEQ ID NO: 1583650 - RNA, 15 nt, Human adenovirus F
ccguucuaugcuccu

SEQ ID NO: 1583651 - RNA, 21 nt, Human adenovirus F
aucuugcaaaacuuucgcucc

SEQ ID NO: 1583652 - RNA, 21 nt, Human adenovirus F
gcguagcaccccaauguaagu

SEQ ID NO: 1583653 - RNA, 18 nt, Human adenovirus F
aacuuuuugcccaccgcc

SEQ ID NO: 1583654 - RNA, 13 nt, Human adenovirus F
gguuuaaacuuuu

SEQ ID NO: 1583655 - RNA, 22 nt, Human adenovirus F
ggcgagaaaauauggaggagga

SEQ ID NO: 1583656 - RNA, 23 nt, Human adenovirus F
caaaacuuucgcuccuuuguacu

SEQ ID NO: 1583657 - RNA, 22 nt, Human adenovirus F
aaccagcuuaguauuaacacug

SEQ ID NO: 1583658 - RNA, 19 nt, Human adenovirus F
gcagcucgcaaacaauaaa

SEQ ID NO: 1583659 - RNA, 13 nt, Human adenovirus F
gggcggcggccau

SEQ ID NO: 1583660 - RNA, 21 nt, Human adenovirus F
gcagcgcccgccucccaaagu

SEQ ID NO: 1583661 - RNA, 15 nt, Human adenovirus F
auggugguagaaggu

SEQ ID NO: 1583662 - RNA, 19 nt, Human adenovirus F
cuucacaaaguccuggcca

SEQ ID NO: 1583663 - RNA, 18 nt, Human adenovirus F
ccaaucguagcaggguuu

SEQ ID NO: 1583664 - RNA, 16 nt, Human adenovirus F
gcuauugccagcaugg

SEQ ID NO: 1583665 - RNA, 21 nt, Human adenovirus F
caggccuugcaaaaccaaauc

SEQ ID NO: 1583666 - RNA, 22 nt, Human adenovirus F
uagguggggccccugaggcagc

SEQ ID NO: 1583667 - RNA, 22 nt, Human adenovirus F
uagcauaaaggggaccagcugu

SEQ ID NO: 1583668 - RNA, 18 nt, Human adenovirus F
auuugugggacuuuaugg

SEQ ID NO: 1583669 - RNA, 13 nt, Human adenovirus F
ucuuuacccagac

SEQ ID NO: 1583670 - RNA, 13 nt, Human adenovirus F
cggcgccuccaac

SEQ ID NO: 1583671 - RNA, 23 nt, Human adenovirus F
cgaggagguagaaguggaggaaa

SEQ ID NO: 1583672 - RNA, 15 nt, Human adenovirus F
caugcuuagccucgg

SEQ ID NO: 1583673 - RNA, 12 nt, Human adenovirus F
ccgcgaaugccc

SEQ ID NO: 1583674 - RNA, 14 nt, Human adenovirus F
ccugagcugccaga

SEQ ID NO: 1583675 - RNA, 23 nt, Human adenovirus F
ugcuacucaacagaaaccucuuc

SEQ ID NO: 1583676 - RNA, 23 nt, Human adenovirus F
acucucuuacauuggccaccgcc

SEQ ID NO: 1583677 - RNA, 18 nt, Human adenovirus F
uaacccucaaacacugcg

SEQ ID NO: 1583678 - RNA, 13 nt, Human adenovirus F
cucugcagcagcg

SEQ ID NO: 1583679 - RNA, 12 nt, Human adenovirus F
accggcgccgcu

SEQ ID NO: 1583680 - RNA, 20 nt, Human adenovirus F
uauccauuaaagcucaaaaa

SEQ ID NO: 1583681 - RNA, 23 nt, Human adenovirus F
cccaaguaaucgguaccuuugag

SEQ ID NO: 1583682 - RNA, 21 nt, Human adenovirus F
aaccuugaguuuaaugucucg

SEQ ID NO: 1583683 - RNA, 18 nt, Human adenovirus F
cagagccauagcaacagc

SEQ ID NO: 1583684 - RNA, 20 nt, Human adenovirus F
agaacguguugguagagcug

SEQ ID NO: 1583685 - RNA, 18 nt, Human adenovirus F
aauuguaacugagccuga

SEQ ID NO: 1583686 - RNA, 22 nt, Human adenovirus F
cuuacauaucgcuugccacugg

SEQ ID NO: 1583687 - RNA, 14 nt, Human adenovirus F
aaacagugccacau

SEQ ID NO: 1583688 - RNA, 18 nt, Human adenovirus F
augccuuaacauuuaugc

SEQ ID NO: 1583689 - RNA, 21 nt, Human adenovirus F
ccgcugucguuaguggaggca

SEQ ID NO: 1583690 - RNA, 18 nt, Human adenovirus F
cccaacacuuucaccgcc

SEQ ID NO: 1583691 - RNA, 20 nt, Human adenovirus F
cguggccuugcaagcagcuc

SEQ ID NO: 1583692 - RNA, 17 nt, Human adenovirus F
agcuguuuaccaaaggc

SEQ ID NO: 1583693 - RNA, 21 nt, Human adenovirus F
gucagcuacaagauuccacca

SEQ ID NO: 1583694 - RNA, 21 nt, Human adenovirus F
uggcaugagggauucuaaggg

SEQ ID NO: 1583695 - RNA, 18 nt, Human adenovirus F
guggaaaaacuuggaaac

SEQ ID NO: 1583696 - RNA, 19 nt, Human adenovirus F
ggaucccucagagcugcaa

SEQ ID NO: 1583697 - RNA, 19 nt, Human adenovirus F
aggcauuaggccgucccug

SEQ ID NO: 1583698 - RNA, 17 nt, Human adenovirus F
gcaccagccagcucaac

SEQ ID NO: 1583699 - RNA, 20 nt, Human adenovirus F
acaaacacgcauguaaauuu

SEQ ID NO: 1583700 - RNA, 14 nt, Human adenovirus F
aacuacaaaagcag

SEQ ID NO: 1583701 - RNA, 13 nt, Human adenovirus F
uuggggaauuugu

SEQ ID NO: 1583702 - RNA, 14 nt, Human adenovirus F
caugagcugggaga

SEQ ID NO: 1583703 - RNA, 13 nt, Human adenovirus F
uuuccccauggcu

SEQ ID NO: 1583704 - RNA, 22 nt, Human adenovirus F
ccggcauuaacggcguggugga

SEQ ID NO: 1583705 - RNA, 20 nt, Human adenovirus F
uggggcagaacguucuucac

SEQ ID NO: 1583706 - RNA, 16 nt, Human adenovirus F
ugccucguagaaguca

SEQ ID NO: 1583707 - RNA, 16 nt, Human adenovirus F
agugucgcgcaccaua

SEQ ID NO: 1583708 - RNA, 18 nt, Human adenovirus F
guaguccucauucuucuc

SEQ ID NO: 1583709 - RNA, 18 nt, Human adenovirus F
cccucgucgcccucuucu

SEQ ID NO: 1583710 - RNA, 20 nt, Human adenovirus F
aauugauuuucugccaccag

SEQ ID NO: 1583711 - RNA, 14 nt, Human adenovirus F
ccuuuugcaucuca

SEQ ID NO: 1583712 - RNA, 23 nt, Human adenovirus F
ggcguguacaccaacgaggccuu

SEQ ID NO: 1583713 - RNA, 18 nt, Human adenovirus F
cgugcgcacccugguggc

SEQ ID NO: 1583714 - RNA, 13 nt, Human adenovirus F
cacaucacuguua

SEQ ID NO: 1583715 - RNA, 17 nt, Human adenovirus F
cacauccagggcacagu

SEQ ID NO: 1583716 - RNA, 17 nt, Human adenovirus F
gcagaacguucuucacu

SEQ ID NO: 1583717 - RNA, 19 nt, Human adenovirus F
guggcucugcagcagcgcc

SEQ ID NO: 1583718 - RNA, 22 nt, Human adenovirus F
uuucacguaguaucucaucccc

SEQ ID NO: 1583719 - RNA, 20 nt, Human adenovirus F
ccaaagagcuugaacauaac

SEQ ID NO: 1583720 - RNA, 15 nt, Human adenovirus F
gccguccacgcuccc

SEQ ID NO: 1583721 - RNA, 13 nt, Human adenovirus F
cagaaaacacauu

SEQ ID NO: 1583722 - RNA, 17 nt, Human adenovirus F
aacgagggggaggacuu

SEQ ID NO: 1583723 - RNA, 19 nt, Human adenovirus F
gcuuuccucuuaaugggca

SEQ ID NO: 1583724 - RNA, 19 nt, Human adenovirus F
gcaaagcucccaaaagguc

SEQ ID NO: 1583725 - RNA, 22 nt, Human adenovirus F
gaugcauuugugggacuuuaug

SEQ ID NO: 1583726 - RNA, 23 nt, Human adenovirus F
gaaggcguggaaaaacuuggaaa

SEQ ID NO: 1583727 - RNA, 12 nt, Human adenovirus F
aaaguccuggcc

SEQ ID NO: 1583728 - RNA, 21 nt, Human adenovirus F
gcucaggaaccaccaccgaaa

SEQ ID NO: 1583729 - RNA, 23 nt, Human adenovirus F
caggguuuuugagcaugaaacug

SEQ ID NO: 1583730 - RNA, 13 nt, Human adenovirus F
gagaguugggggu

SEQ ID NO: 1583731 - RNA, 14 nt, Human adenovirus F
uguucgggugagua

SEQ ID NO: 1583732 - RNA, 17 nt, Human adenovirus F
uccggguuuuauggcac

SEQ ID NO: 1583733 - RNA, 14 nt, Human adenovirus F
agggugugaaggca

SEQ ID NO: 1583734 - RNA, 14 nt, Human adenovirus F
gcuggcccuggccu

SEQ ID NO: 1583735 - RNA, 16 nt, Human adenovirus F
gccgccgugccagaaa

SEQ ID NO: 1583736 - RNA, 16 nt, Human adenovirus F
gaacacuuuugccaaa

SEQ ID NO: 1583737 - RNA, 13 nt, Human adenovirus F
cugccagagggug

SEQ ID NO: 1583738 - RNA, 14 nt, Human adenovirus F
cgggcagccgguca

SEQ ID NO: 1583739 - RNA, 15 nt, Human adenovirus F
uguacgagaagcccu

SEQ ID NO: 1583740 - RNA, 22 nt, Human adenovirus F
accacccggguuuaccuggugg

SEQ ID NO: 1583741 - RNA, 21 nt, Human adenovirus F
acgccucggaguaccugagcc

SEQ ID NO: 1583742 - RNA, 13 nt, Human adenovirus F
gccagacgcaggu

SEQ ID NO: 1583743 - RNA, 20 nt, Human adenovirus F
cuggcccuaaccacccgcaa

SEQ ID NO: 1583744 - RNA, 22 nt, Human adenovirus F
ccggaggcagugguggaugggg

SEQ ID NO: 1583745 - RNA, 16 nt, Human adenovirus F
aacuuucuccacgucc

SEQ ID NO: 1583746 - RNA, 18 nt, Human adenovirus F
ucauccaaguuuuuacaa

SEQ ID NO: 1583747 - RNA, 22 nt, Human adenovirus F
cgacgcuguaugcuauuuucca

SEQ ID NO: 1583748 - RNA, 15 nt, Human adenovirus F
cgcugaccagcagca

SEQ ID NO: 1583749 - RNA, 11 nt, Human adenovirus F
caggagcugcg

SEQ ID NO: 1583750 - RNA, 12 nt, Human adenovirus F
gcgggaagagga

SEQ ID NO: 1583751 - RNA, 14 nt, Human adenovirus F
cucaaguacacuga

SEQ ID NO: 1583752 - RNA, 19 nt, Human adenovirus F
cguugcacgcucugcaucu

SEQ ID NO: 1583753 - RNA, 20 nt, Human adenovirus F
agcucgcaaacaauaaaaga

SEQ ID NO: 1583754 - RNA, 20 nt, Human adenovirus F
acacauccauuaaaauuucu

SEQ ID NO: 1583755 - RNA, 19 nt, Human adenovirus F
uacaaggacaggauguacu

SEQ ID NO: 1583756 - RNA, 21 nt, Human adenovirus F
ucugauggaguuguggaguga

SEQ ID NO: 1583757 - RNA, 13 nt, Human adenovirus F
aaagcgagccaaa

SEQ ID NO: 1583758 - RNA, 18 nt, Human adenovirus F
cgccaucccccgagcgcc

SEQ ID NO: 1583759 - RNA, 22 nt, Human adenovirus F
cgaacacgcugccaacaaaugu

SEQ ID NO: 1583760 - RNA, 18 nt, Human adenovirus F
agccacaauaagcagcuu

SEQ ID NO: 1583761 - RNA, 18 nt, Human adenovirus F
cucaggauuacuccaguc

SEQ ID NO: 1583762 - RNA, 17 nt, Human adenovirus F
auuacgucauugacauu

SEQ ID NO: 1583763 - RNA, 14 nt, Human adenovirus F
gaaacgagccagau

SEQ ID NO: 1583764 - RNA, 17 nt, Human adenovirus F
gguugcccgccagcugg

SEQ ID NO: 1583765 - RNA, 19 nt, Human adenovirus F
acgugggacgacagccagg

SEQ ID NO: 1583766 - RNA, 20 nt, Human adenovirus F
auuugguaacaaggccugga

SEQ ID NO: 1583767 - RNA, 22 nt, Human adenovirus F
ccaggcguacguaccgccucag

SEQ ID NO: 1583768 - RNA, 18 nt, Human adenovirus F
gcgucgcguaacccgccg

SEQ ID NO: 1583769 - RNA, 17 nt, Human adenovirus F
cagcguagcacucccuc

SEQ ID NO: 1583770 - RNA, 15 nt, Human adenovirus F
gucgucggcucugga

SEQ ID NO: 1583771 - RNA, 19 nt, Human adenovirus F
uuacaaaaagagaaucuaa

SEQ ID NO: 1583772 - RNA, 16 nt, Human adenovirus F
ggcagcgacagggcgc

SEQ ID NO: 1583773 - RNA, 21 nt, Human adenovirus F
caaucagcggcuggaaaauag

SEQ ID NO: 1583774 - RNA, 12 nt, Human adenovirus F
uaugaugaguca

SEQ ID NO: 1583775 - RNA, 19 nt, Human adenovirus F
ggauaccgcugcagcugcu

SEQ ID NO: 1583776 - RNA, 20 nt, Human adenovirus F
ccaaggcguaaagacugaca

SEQ ID NO: 1583777 - RNA, 16 nt, Human adenovirus F
aucucauucgcacggc

SEQ ID NO: 1583778 - RNA, 17 nt, Human adenovirus F
gaugaugucgugucugc

SEQ ID NO: 1583779 - RNA, 22 nt, Human adenovirus F
gcaaacggugaacgaggagcgc

SEQ ID NO: 1583780 - RNA, 15 nt, Human adenovirus F
agaaaacgaaaacuu

SEQ ID NO: 1583781 - RNA, 14 nt, Human adenovirus F
ucagaccacaacaa

SEQ ID NO: 1583782 - RNA, 12 nt, Human adenovirus F
ugccagugcagg

SEQ ID NO: 1583783 - RNA, 21 nt, Human adenovirus F
cuuuauuuccuuugucaugua

SEQ ID NO: 1583784 - RNA, 18 nt, Human adenovirus F
uaagggaggcagcagagg

SEQ ID NO: 1583785 - RNA, 18 nt, Human adenovirus F
cagcaguaucaguggagu

SEQ ID NO: 1583786 - RNA, 20 nt, Human adenovirus F
guaugguaacuccucuucuc

SEQ ID NO: 1583787 - RNA, 21 nt, Human adenovirus F
acuccucugugagcuggccug

SEQ ID NO: 1583788 - RNA, 17 nt, Human adenovirus F
acagcagguuaaagcca

SEQ ID NO: 1583789 - RNA, 16 nt, Human adenovirus F
uccccgaaacaaaacc

SEQ ID NO: 1583790 - RNA, 16 nt, Human adenovirus F
guaucagaauguaacu

SEQ ID NO: 1583791 - RNA, 14 nt, Human adenovirus F
cuaauggccagagg

SEQ ID NO: 1583792 - RNA, 18 nt, Human adenovirus F
ucaaauacauaggcauua

SEQ ID NO: 1583793 - RNA, 23 nt, Human adenovirus F
aucgcuggacuuuacaaaaagag

SEQ ID NO: 1583794 - RNA, 21 nt, Human adenovirus F
cagcagugcuuggaagagcaa

SEQ ID NO: 1583795 - RNA, 12 nt, Human adenovirus F
uaugggcagcau

SEQ ID NO: 1583796 - RNA, 22 nt, Human adenovirus F
ucaaccaacuaacacugcgauu

SEQ ID NO: 1583797 - RNA, 18 nt, Human adenovirus F
ccaacggcuugcaagaaa

SEQ ID NO: 1583798 - RNA, 23 nt, Human adenovirus F
cagaggaaguuucagacgaggag

SEQ ID NO: 1583799 - RNA, 17 nt, Human adenovirus F
cuugcgcaacuucuuuu

SEQ ID NO: 1583800 - RNA, 22 nt, Human adenovirus F
cauaacuaaaaaaacuccaccc

SEQ ID NO: 1583801 - RNA, 13 nt, Human adenovirus F
auugagugggaag

SEQ ID NO: 1583802 - RNA, 17 nt, Human adenovirus F
ccaaccaagaaauacaa

SEQ ID NO: 1583803 - RNA, 21 nt, Human adenovirus F
caggagcccgaagagaugagg

SEQ ID NO: 1583804 - RNA, 22 nt, Human adenovirus F
gggccagacuacuuuuuccaaa

SEQ ID NO: 1583805 - RNA, 21 nt, Human adenovirus F
agcccucaaggaaugcacaca

SEQ ID NO: 1583806 - RNA, 19 nt, Human adenovirus F
aaugugucuccgcugggag

SEQ ID NO: 1583807 - RNA, 14 nt, Human adenovirus F
ccugcaagaucucc

SEQ ID NO: 1583808 - RNA, 21 nt, Human adenovirus F
aguauacauuugaacagcuga

SEQ ID NO: 1583809 - RNA, 21 nt, Human adenovirus F
aaucacgaccucccaaagucc

SEQ ID NO: 1583810 - RNA, 18 nt, Human adenovirus F
gaccgcuagggcgcgcuc

SEQ ID NO: 1583811 - RNA, 15 nt, Human adenovirus F
gccuugcaagcagcu

SEQ ID NO: 1583812 - RNA, 16 nt, Human adenovirus F
ugacaacggacgugag

SEQ ID NO: 1583813 - RNA, 16 nt, Human adenovirus F
aggaaugcacacagac

SEQ ID NO: 1583814 - RNA, 14 nt, Human adenovirus F
uaaccuucgcugcu

SEQ ID NO: 1583815 - RNA, 15 nt, Human adenovirus F
acguaaccuuguauu

SEQ ID NO: 1583816 - RNA, 20 nt, Human adenovirus F
aaauuaauugcacuaacucc

SEQ ID NO: 1583817 - RNA, 16 nt, Human adenovirus F
gcuacacgcggcccgu

SEQ ID NO: 1583818 - RNA, 23 nt, Human adenovirus F
caccguucccacuguuucuccuc

SEQ ID NO: 1583819 - RNA, 19 nt, Human adenovirus F
aucgcagcgggcaggagcc

SEQ ID NO: 1583820 - RNA, 15 nt, Human adenovirus F
ccaacugccaccucc

SEQ ID NO: 1583821 - RNA, 15 nt, Human adenovirus F
gacaguggcgcgcuc

SEQ ID NO: 1583822 - RNA, 15 nt, Human adenovirus F
gguuugccagacuuu

SEQ ID NO: 1583823 - RNA, 17 nt, Human adenovirus F
gccgagcuuuuacuggg

SEQ ID NO: 1583824 - RNA, 16 nt, Human adenovirus F
uugcacuuaacuguuc

SEQ ID NO: 1583825 - RNA, 17 nt, Human adenovirus F
agcaugcuuagccucgg

SEQ ID NO: 1583826 - RNA, 20 nt, Human adenovirus F
ccuccguggccuugcaagca

SEQ ID NO: 1583827 - RNA, 14 nt, Human adenovirus F
auuucgugggaagg

SEQ ID NO: 1583828 - RNA, 19 nt, Human adenovirus F
ugaccccaaugacaggcug

SEQ ID NO: 1583829 - RNA, 13 nt, Human adenovirus F
ggcagcagggugc

SEQ ID NO: 1583830 - RNA, 20 nt, Human adenovirus F
ccaaaaggucaggugcagaa

SEQ ID NO: 1583831 - RNA, 17 nt, Human adenovirus F
gcuguuuaccaaaggcu

SEQ ID NO: 1583832 - RNA, 22 nt, Human adenovirus F
ugccaaagcggcaaaagcuuga

SEQ ID NO: 1583833 - RNA, 17 nt, Human adenovirus F
gcuggccgugggcgaca

SEQ ID NO: 1583834 - RNA, 14 nt, Human adenovirus F
agcuucccaacacu

SEQ ID NO: 1583835 - RNA, 17 nt, Human adenovirus F
uguugcauguuggaaag

SEQ ID NO: 1583836 - RNA, 16 nt, Human adenovirus F
agccauccgcaaggau

SEQ ID NO: 1583837 - RNA, 22 nt, Human adenovirus F
gcguggccuccguggccuugca

SEQ ID NO: 1583838 - RNA, 20 nt, Human adenovirus F
aaguuaccaaagacaaaauc

SEQ ID NO: 1583839 - RNA, 19 nt, Human adenovirus F
acugaccccauuacuacca

SEQ ID NO: 1583840 - RNA, 13 nt, Human adenovirus F
gccgcggcggcua

SEQ ID NO: 1583841 - RNA, 16 nt, Human adenovirus F
aagguaaucaggagaa

SEQ ID NO: 1583842 - RNA, 22 nt, Human adenovirus F
uguaacaucccucacuaccauu

SEQ ID NO: 1583843 - RNA, 14 nt, Human adenovirus F
caauggaacauuaa

SEQ ID NO: 1583844 - RNA, 21 nt, Human adenovirus F
cgucaaugccaauaccagcaa

SEQ ID NO: 1583845 - RNA, 18 nt, Human adenovirus F
uauugcuuuauugccacc

SEQ ID NO: 1583846 - RNA, 18 nt, Human adenovirus F
cccggacuuggcgugcag

SEQ ID NO: 1583847 - RNA, 17 nt, Human adenovirus F
agcggaauaaguccggc

SEQ ID NO: 1583848 - RNA, 22 nt, Human adenovirus F
caccaggucguaaugaggacau

SEQ ID NO: 1583849 - RNA, 16 nt, Human adenovirus F
gcacgugucggcggcc

SEQ ID NO: 1583850 - RNA, 19 nt, Human adenovirus F
ccccggcggcgggugcagu

SEQ ID NO: 1583851 - RNA, 18 nt, Human adenovirus F
gcaacgcugcaggcgcuc

SEQ ID NO: 1583852 - RNA, 23 nt, Human adenovirus F
uagcucuaaauaugucacagccu

SEQ ID NO: 1583853 - RNA, 16 nt, Human adenovirus F
gcauaacccuggaauu

SEQ ID NO: 1583854 - RNA, 14 nt, Human adenovirus F
uuauacacucccuu

SEQ ID NO: 1583855 - RNA, 15 nt, Human adenovirus F
cagcaguccgucagc

SEQ ID NO: 1583856 - RNA, 20 nt, Human adenovirus F
cagagcucugcaaaaacaaa

SEQ ID NO: 1583857 - RNA, 18 nt, Human adenovirus F
gcaccauuguacgagaag

SEQ ID NO: 1583858 - RNA, 21 nt, Human adenovirus F
uacccuuacgaacacuacaau

SEQ ID NO: 1583859 - RNA, 12 nt, Human adenovirus F
uuuccaccaggg

SEQ ID NO: 1583860 - RNA, 21 nt, Human adenovirus F
ucccgaagccuucaggcagca

SEQ ID NO: 1583861 - RNA, 15 nt, Human adenovirus F
cugagggccggccug

SEQ ID NO: 1583862 - RNA, 19 nt, Human adenovirus F
gaaacugaugcuuuuucuc

SEQ ID NO: 1583863 - RNA, 19 nt, Human adenovirus F
uggaggcuugggaggauuu

SEQ ID NO: 1583864 - RNA, 16 nt, Human adenovirus F
ccugcaaagccaaccu

SEQ ID NO: 1583865 - RNA, 17 nt, Human adenovirus F
aaacgcaccauugaagu

SEQ ID NO: 1583866 - RNA, 16 nt, Human adenovirus F
cugucaggcucugaga

SEQ ID NO: 1583867 - RNA, 18 nt, Human adenovirus F
uagugcguccgcccgcuc

SEQ ID NO: 1583868 - RNA, 14 nt, Human adenovirus F
cugcuccuggcgag

SEQ ID NO: 1583869 - RNA, 18 nt, Human adenovirus F
caccaauaugcccaacau

SEQ ID NO: 1583870 - RNA, 21 nt, Human adenovirus F
cguggagccgacuucaagccc

SEQ ID NO: 1583871 - RNA, 22 nt, Human adenovirus F
uuagcacugcgguggaggccau

SEQ ID NO: 1583872 - RNA, 23 nt, Human adenovirus F
ccguuaaucucccuccccccuuc

SEQ ID NO: 1583873 - RNA, 23 nt, Human adenovirus F
caagacccgguacaggugggcuu

SEQ ID NO: 1583874 - RNA, 17 nt, Human adenovirus F
cucugaucuuauggaag

SEQ ID NO: 1583875 - RNA, 13 nt, Human adenovirus F
gcccuggccugga

SEQ ID NO: 1583876 - RNA, 22 nt, Human adenovirus F
ucgagguguaacaucccucacu

SEQ ID NO: 1583877 - RNA, 22 nt, Human adenovirus F
agaccucauccgccauugccac

SEQ ID NO: 1583878 - RNA, 20 nt, Human adenovirus F
gcuuaucccgcgcuaaaucu

SEQ ID NO: 1583879 - RNA, 20 nt, Human adenovirus F
gcagcaccaccugcccuucc

SEQ ID NO: 1583880 - RNA, 13 nt, Human adenovirus F
gugcuggggaaug

SEQ ID NO: 1583881 - RNA, 21 nt, Human adenovirus F
uguguuuuuuacugcuaaagg

SEQ ID NO: 1583882 - RNA, 21 nt, Human adenovirus F
ggcgcuuucaguuggagcagc

SEQ ID NO: 1583883 - RNA, 16 nt, Human adenovirus F
agacgacugggcggcg

SEQ ID NO: 1583884 - RNA, 20 nt, Human adenovirus F
ccccgugggggaccgagcca

SEQ ID NO: 1583885 - RNA, 14 nt, Human adenovirus F
gugagguaugauga

SEQ ID NO: 1583886 - RNA, 15 nt, Human adenovirus F
ggaggcagcagagga

SEQ ID NO: 1583887 - RNA, 21 nt, Human adenovirus F
aaaccgcgccauagcuggagg

SEQ ID NO: 1583888 - RNA, 18 nt, Human adenovirus F
caacugccaccuccaccg

SEQ ID NO: 1583889 - RNA, 16 nt, Human adenovirus F
ccagugcaggaagagg

SEQ ID NO: 1583890 - RNA, 14 nt, Human adenovirus F
aacaccgcuuccac

SEQ ID NO: 1583891 - RNA, 17 nt, Human adenovirus F
gagaggcgguggcgcag

SEQ ID NO: 1583892 - RNA, 18 nt, Human adenovirus F
cgguggcucugcagcagc

SEQ ID NO: 1583893 - RNA, 20 nt, Human adenovirus F
uggcgccggcgggaagagga

SEQ ID NO: 1583894 - RNA, 22 nt, Human adenovirus F
aacucgcaggccagucggcagg

SEQ ID NO: 1583895 - RNA, 14 nt, Human adenovirus F
cgcgcaccucuugu

SEQ ID NO: 1583896 - RNA, 13 nt, Human adenovirus F
uaacugagccuga

SEQ ID NO: 1583897 - RNA, 16 nt, Human adenovirus F
acacaaugcaaaaugu

SEQ ID NO: 1583898 - RNA, 16 nt, Human adenovirus F
ucaagaaacacaaaca

SEQ ID NO: 1583899 - RNA, 19 nt, Human adenovirus F
caucgcugaccagcagcag

SEQ ID NO: 1583900 - RNA, 14 nt, Human adenovirus F
ugauccacuuacaa

SEQ ID NO: 1583901 - RNA, 22 nt, Human adenovirus F
agccguccacgcucccggaaau

SEQ ID NO: 1583902 - RNA, 15 nt, Human adenovirus F
ugaccaaggacuggu

SEQ ID NO: 1583903 - RNA, 16 nt, Human adenovirus F
auuucacgcaaagucg

SEQ ID NO: 1583904 - RNA, 20 nt, Human adenovirus F
ccccaccguggcucccaccc

SEQ ID NO: 1583905 - RNA, 13 nt, Human adenovirus F
cugccagugcagg

SEQ ID NO: 1583906 - RNA, 15 nt, Human adenovirus F
agggucgcaggguuc

SEQ ID NO: 1583907 - RNA, 14 nt, Human adenovirus F
cugcagcauugcca

SEQ ID NO: 1583908 - RNA, 15 nt, Human adenovirus F
ccaaagcagagcucu

SEQ ID NO: 1583909 - RNA, 18 nt, Human adenovirus F
gccggcaacgcugcaggc

SEQ ID NO: 1583910 - RNA, 11 nt, Human adenovirus F
ggccugcaaga

SEQ ID NO: 1583911 - RNA, 22 nt, Human adenovirus F
auggcagcagauuuuggacugu

SEQ ID NO: 1583912 - RNA, 19 nt, Human adenovirus F
caaccuacccagauuuccu

SEQ ID NO: 1583913 - RNA, 11 nt, Human adenovirus F
gucugccaaaa

SEQ ID NO: 1583914 - RNA, 19 nt, Human adenovirus F
uuaaucucccuccccccuu

SEQ ID NO: 1583915 - RNA, 22 nt, Human adenovirus F
aucccgcgcuaaaucuuccucc

SEQ ID NO: 1583916 - RNA, 23 nt, Human adenovirus F
cggcgaugaaacuugauuuccau

SEQ ID NO: 1583917 - RNA, 14 nt, Human adenovirus F
gaaagcgugaugga

SEQ ID NO: 1583918 - RNA, 12 nt, Human adenovirus F
aacacaaacacg

SEQ ID NO: 1583919 - RNA, 14 nt, Human adenovirus F
cguggcugcaaggu

SEQ ID NO: 1583920 - RNA, 13 nt, Human adenovirus F
aaguuacaaaaug

SEQ ID NO: 1583921 - RNA, 21 nt, Human adenovirus F
cgcccucuucugcaccugcac

SEQ ID NO: 1583922 - RNA, 16 nt, Human adenovirus F
gaagguugacuugcag

SEQ ID NO: 1583923 - RNA, 23 nt, Human adenovirus F
cucucagcugcuaaccugugcag

SEQ ID NO: 1583924 - RNA, 21 nt, Human adenovirus F
uuggauccagugcaggaagag

SEQ ID NO: 1583925 - RNA, 18 nt, Human adenovirus F
caacggacgugagagagg

SEQ ID NO: 1583926 - RNA, 13 nt, Human adenovirus F
cucccauucauug

SEQ ID NO: 1583927 - RNA, 16 nt, Human adenovirus F
ccuucaggcagcagcc

SEQ ID NO: 1583928 - RNA, 17 nt, Human adenovirus F
ccaagaaauacaaaggc

SEQ ID NO: 1583929 - RNA, 15 nt, Human adenovirus F
ucaaggaaacaacag

SEQ ID NO: 1583930 - RNA, 13 nt, Human adenovirus F
ugaacccacccuc

SEQ ID NO: 1583931 - RNA, 15 nt, Human adenovirus F
cauguacacuauggu

SEQ ID NO: 1583932 - RNA, 14 nt, Human adenovirus F
agaauguaacucuc

SEQ ID NO: 1583933 - RNA, 14 nt, Human adenovirus F
gcggggcaggagcu

SEQ ID NO: 1583934 - RNA, 24 nt, Human adenovirus F
aaaaucguagguuuaaauuacacu

SEQ ID NO: 1583935 - RNA, 12 nt, Human adenovirus F
acaaggccugga

SEQ ID NO: 1583936 - RNA, 18 nt, Human adenovirus F
cuggcuccgcggcacggc

SEQ ID NO: 1583937 - RNA, 21 nt, Human adenovirus F
gaggcuuuccgcgaggccaug

SEQ ID NO: 1583938 - RNA, 11 nt, Human adenovirus F
cuucagcacuu

SEQ ID NO: 1583939 - RNA, 18 nt, Human adenovirus F
caaaucgcgcaaccagug

SEQ ID NO: 1583940 - RNA, 17 nt, Human adenovirus F
ccccagcgcccuggaua

SEQ ID NO: 1583941 - RNA, 20 nt, Human adenovirus F
cgccaauuuuucggggguca

SEQ ID NO: 1583942 - RNA, 22 nt, Human adenovirus F
gaugcgccucaugagcugggag

SEQ ID NO: 1583943 - RNA, 18 nt, Human adenovirus F
acuaaaaaaacuccaccc

SEQ ID NO: 1583944 - RNA, 18 nt, Human adenovirus F
gcaucucuugaaugaggu

SEQ ID NO: 1583945 - RNA, 22 nt, Human adenovirus F
cgaggccaaacccccguuccca

SEQ ID NO: 1583946 - RNA, 13 nt, Human adenovirus F
aacugccaccucc

SEQ ID NO: 1583947 - RNA, 20 nt, Human adenovirus F
ccagucgcaugaauuggcuu

SEQ ID NO: 1583948 - RNA, 22 nt, Human adenovirus F
uggccugaauuuuuagguuggc

SEQ ID NO: 1583949 - RNA, 16 nt, Human adenovirus F
uacuuuuacagaauuc

SEQ ID NO: 1583950 - RNA, 12 nt, Human adenovirus F
acaacaaaucau

SEQ ID NO: 1583951 - RNA, 14 nt, Human adenovirus F
uacacaacaaauca

SEQ ID NO: 1583952 - RNA, 20 nt, Human adenovirus F
ccaggcguggccuccguggc

SEQ ID NO: 1583953 - RNA, 15 nt, Human adenovirus F
gugggcguccagugg

SEQ ID NO: 1583954 - RNA, 21 nt, Human adenovirus F
uaucuacgccuccaccaccuu

SEQ ID NO: 1583955 - RNA, 16 nt, Human adenovirus F
ucuuaaguuauacagu

SEQ ID NO: 1583956 - RNA, 17 nt, Human adenovirus F
acgucauccgccuccac

SEQ ID NO: 1583957 - RNA, 21 nt, Human adenovirus F
ccgcagcugcuuguaucacag

SEQ ID NO: 1583958 - RNA, 15 nt, Human adenovirus F
ccugcaaagccaacc

SEQ ID NO: 1583959 - RNA, 23 nt, Human adenovirus F
ccucuacuauuaccgucaucucu

SEQ ID NO: 1583960 - RNA, 17 nt, Human adenovirus F
agcagauggagagcugg

SEQ ID NO: 1583961 - RNA, 22 nt, Human adenovirus F
gaaucccgcuauguuggcggcc

SEQ ID NO: 1583962 - RNA, 20 nt, Human adenovirus F
cugcaaaaaagccgucugag

SEQ ID NO: 1583963 - RNA, 13 nt, Human adenovirus F
gacucuggugaau

SEQ ID NO: 1583964 - RNA, 22 nt, Human adenovirus F
ccggcuggggacuuugcuccgc

SEQ ID NO: 1583965 - RNA, 14 nt, Human adenovirus F
cucaacuuuaacua

SEQ ID NO: 1583966 - RNA, 21 nt, Human adenovirus F
uaagcuggguggaaagcaagu

SEQ ID NO: 1583967 - RNA, 17 nt, Human adenovirus F
ucgucgcccucuucugc

SEQ ID NO: 1583968 - RNA, 23 nt, Human adenovirus F
cugaggaggaggccauccuggac

SEQ ID NO: 1583969 - RNA, 20 nt, Human adenovirus F
caagcaaagacagagcuuua

SEQ ID NO: 1583970 - RNA, 21 nt, Human adenovirus F
aggguguacguuuguugcaug

SEQ ID NO: 1583971 - RNA, 15 nt, Human adenovirus F
caaaaugaguggcuu

SEQ ID NO: 1583972 - RNA, 16 nt, Human adenovirus F
ucgccaucaugagucu

SEQ ID NO: 1583973 - RNA, 20 nt, Human adenovirus F
gauggggguucgccuggaga

SEQ ID NO: 1583974 - RNA, 23 nt, Human adenovirus F
uucaaagacgccgccuugcaugc

SEQ ID NO: 1583975 - RNA, 13 nt, Human adenovirus F
cacaauaagcagc

SEQ ID NO: 1583976 - RNA, 13 nt, Human adenovirus F
cugggacagccua

SEQ ID NO: 1583977 - RNA, 18 nt, Human adenovirus F
ccugaccgaccuggggca

SEQ ID NO: 1583978 - RNA, 17 nt, Human adenovirus F
ggcggaggugccccaga

SEQ ID NO: 1583979 - RNA, 13 nt, Human adenovirus F
acggcaccugcga

SEQ ID NO: 1583980 - RNA, 21 nt, Human adenovirus F
auuauccguuggaauuuuccu

SEQ ID NO: 1583981 - RNA, 22 nt, Human adenovirus F
gagcaguuuggcaauggaacgc

SEQ ID NO: 1583982 - RNA, 12 nt, Human adenovirus F
cuuuacaaaaag

SEQ ID NO: 1583983 - RNA, 20 nt, Human adenovirus F
ucccugggaugcagguagga

SEQ ID NO: 1583984 - RNA, 22 nt, Human adenovirus F
cgggcacugcauacaacucccu

SEQ ID NO: 1583985 - RNA, 19 nt, Human adenovirus F
ugggcacguuugacaaacg

SEQ ID NO: 1583986 - RNA, 16 nt, Human adenovirus F
acggcguucuagccaa

SEQ ID NO: 1583987 - RNA, 15 nt, Human adenovirus F
cuacggaggaagagg

SEQ ID NO: 1583988 - RNA, 15 nt, Human adenovirus F
gcucgucguggcaug

SEQ ID NO: 1583989 - RNA, 15 nt, Human adenovirus F
guggauggggaagga

SEQ ID NO: 1583990 - RNA, 18 nt, Human adenovirus F
uccgcccaugccggcucc

SEQ ID NO: 1583991 - RNA, 14 nt, Human adenovirus F
cuuauacaccuccc

SEQ ID NO: 1583992 - RNA, 15 nt, Human adenovirus F
ggcgccggcgggaag

SEQ ID NO: 1583993 - RNA, 13 nt, Human adenovirus F
gcacagcaaacac

SEQ ID NO: 1583994 - RNA, 22 nt, Human adenovirus F
gguguugacccgcuuggaggag

SEQ ID NO: 1583995 - RNA, 17 nt, Human adenovirus F
cauaacugaacaauaaa

SEQ ID NO: 1583996 - RNA, 13 nt, Human adenovirus F
cugccacugaaac

SEQ ID NO: 1583997 - RNA, 21 nt, Human adenovirus F
aucacuaaaaccaacaaaauc

SEQ ID NO: 1583998 - RNA, 18 nt, Human adenovirus F
aggacgucgggccaugcg

SEQ ID NO: 1583999 - RNA, 15 nt, Human adenovirus F
cggaaggaaacgcug

SEQ ID NO: 1584000 - RNA, 22 nt, Human adenovirus F
caagauaugucugccaaaaugg

SEQ ID NO: 1584001 - RNA, 17 nt, Human adenovirus F
gcgugcaagugggcuca

SEQ ID NO: 1584002 - RNA, 16 nt, Human adenovirus F
aucgcugaccagcagc

SEQ ID NO: 1584003 - RNA, 19 nt, Human adenovirus F
auucuugagcaggccgccc

SEQ ID NO: 1584004 - RNA, 18 nt, Human adenovirus F
agacauucuugagcaggc

SEQ ID NO: 1584005 - RNA, 22 nt, Human adenovirus F
cagaggaaguuucagacgagga

SEQ ID NO: 1584006 - RNA, 13 nt, Human adenovirus F
cagaauguggugg

SEQ ID NO: 1584007 - RNA, 23 nt, Human adenovirus F
ucgcgcaacggcaaucccagcag

SEQ ID NO: 1584008 - RNA, 18 nt, Human adenovirus F
caaaacuuucaacaaaaa

SEQ ID NO: 1584009 - RNA, 20 nt, Human adenovirus F
ccuaguaaaggcgaaaagcg

SEQ ID NO: 1584010 - RNA, 23 nt, Human adenovirus F
cucuguuugcugcacugccaucu

SEQ ID NO: 1584011 - RNA, 21 nt, Human adenovirus F
cguguagccuuuaacugcgca

SEQ ID NO: 1584012 - RNA, 15 nt, Human adenovirus F
cucccaaagugcugu

SEQ ID NO: 1584013 - RNA, 16 nt, Human adenovirus F
caucaggggcucagga

SEQ ID NO: 1584014 - RNA, 23 nt, Human adenovirus F
cgacgagcuugcucgcuggcuag

SEQ ID NO: 1584015 - RNA, 22 nt, Human adenovirus F
acaguggaauuggaaugccugc

SEQ ID NO: 1584016 - RNA, 20 nt, Human adenovirus F
ucgccccugugaguguggag

SEQ ID NO: 1584017 - RNA, 23 nt, Human adenovirus F
cagcagguuaaagccaacuccaa

SEQ ID NO: 1584018 - RNA, 15 nt, Human adenovirus F
aaguauuacaaaugc

SEQ ID NO: 1584019 - RNA, 21 nt, Human adenovirus F
ugggauuugccgcagccagug

SEQ ID NO: 1584020 - RNA, 14 nt, Human adenovirus F
cacuuugccagagg

SEQ ID NO: 1584021 - RNA, 17 nt, Human adenovirus F
cagacgucucaagcaac

SEQ ID NO: 1584022 - RNA, 22 nt, Human adenovirus F
guucucgcucgcuacauccauu

SEQ ID NO: 1584023 - RNA, 14 nt, Human adenovirus F
uggccaacugccac

SEQ ID NO: 1584024 - RNA, 21 nt, Human adenovirus F
gcagugucaauagcauacaga

SEQ ID NO: 1584025 - RNA, 23 nt, Human adenovirus F
cuggauacuggcaagagccaccu

SEQ ID NO: 1584026 - RNA, 11 nt, Human adenovirus F
uauaagcaggu

SEQ ID NO: 1584027 - RNA, 20 nt, Human adenovirus F
aauggaacauuaauccaaug

SEQ ID NO: 1584028 - RNA, 17 nt, Human adenovirus F
gaccacaacaacaaacg

SEQ ID NO: 1584029 - RNA, 23 nt, Human adenovirus F
auaacgcuuuaucuguaaaacuu

SEQ ID NO: 1584030 - RNA, 15 nt, Human adenovirus F
cccacgccaagccug

SEQ ID NO: 1584031 - RNA, 14 nt, Human adenovirus F
ggaaaucagaugca

SEQ ID NO: 1584032 - RNA, 20 nt, Human adenovirus F
caguguaaagcauaacauga

SEQ ID NO: 1584033 - RNA, 17 nt, Human adenovirus F
aauauugcggagccuga

SEQ ID NO: 1584034 - RNA, 17 nt, Human adenovirus F
gacgaauugcagcccac

SEQ ID NO: 1584035 - RNA, 21 nt, Human adenovirus F
guacgaagcuagcauaaaaga

SEQ ID NO: 1584036 - RNA, 14 nt, Human adenovirus F
gcuggaccaaagca

SEQ ID NO: 1584037 - RNA, 20 nt, Human adenovirus F
auacgggguuagcgcacugg

SEQ ID NO: 1584038 - RNA, 15 nt, Human adenovirus F
uuggagaacaugaaa

SEQ ID NO: 1584039 - RNA, 20 nt, Human adenovirus F
gcagcgggaagagaggcagc

SEQ ID NO: 1584040 - RNA, 21 nt, Human adenovirus F
ggcgcagcguccgcacgguuu

SEQ ID NO: 1584041 - RNA, 21 nt, Human adenovirus F
ccugacuauuuuaugcagaca

SEQ ID NO: 1584042 - RNA, 18 nt, Human adenovirus F
agcgugguaaaagggugc

SEQ ID NO: 1584043 - RNA, 12 nt, Human adenovirus F
agguuuccaaau

SEQ ID NO: 1584044 - RNA, 14 nt, Human adenovirus F
cugagccugauccc

SEQ ID NO: 1584045 - RNA, 24 nt, Human adenovirus F
gaucagguucccgugucaccugca

SEQ ID NO: 1584046 - RNA, 13 nt, Human adenovirus F
ggggaauggagcu

SEQ ID NO: 1584047 - RNA, 20 nt, Human adenovirus F
agggcaaaagugucgcgcac

SEQ ID NO: 1584048 - RNA, 15 nt, Human adenovirus F
acacuuucaccgccu

SEQ ID NO: 1584049 - RNA, 18 nt, Human adenovirus F
ugggcauaguugcuccca

SEQ ID NO: 1584050 - RNA, 14 nt, Human adenovirus F
gccccccggcggcg

SEQ ID NO: 1584051 - RNA, 17 nt, Human adenovirus F
cuaaugccuuaacauuu

SEQ ID NO: 1584052 - RNA, 16 nt, Human adenovirus F
uggggcggcgaccuga

SEQ ID NO: 1584053 - RNA, 18 nt, Human adenovirus F
gauuucauuuaccacccc

SEQ ID NO: 1584054 - RNA, 20 nt, Human adenovirus F
aagguugacuugcaggagac

SEQ ID NO: 1584055 - RNA, 17 nt, Human adenovirus F
gaaaaccauuuugcgca

SEQ ID NO: 1584056 - RNA, 20 nt, Human adenovirus F
aguccaaagcagagcucugc

SEQ ID NO: 1584057 - RNA, 20 nt, Human adenovirus F
uugcccgccagcuggcaaac

SEQ ID NO: 1584058 - RNA, 17 nt, Human adenovirus F
cauggcgggcaguggcc

SEQ ID NO: 1584059 - RNA, 17 nt, Human adenovirus F
gccuccguguuuuuuga

SEQ ID NO: 1584060 - RNA, 20 nt, Human adenovirus F
gcucugcagcagcgcccgcc

SEQ ID NO: 1584061 - RNA, 21 nt, Human adenovirus F
ccuaucacuaaaaccaacaaa

SEQ ID NO: 1584062 - RNA, 12 nt, Human adenovirus F
ggcaggagcccg

SEQ ID NO: 1584063 - RNA, 12 nt, Human adenovirus F
cuuuaucuguaa

SEQ ID NO: 1584064 - RNA, 19 nt, Human adenovirus F
ucgcuccagguggggcggc

SEQ ID NO: 1584065 - RNA, 15 nt, Human adenovirus F
ucagcaugagcaagc

SEQ ID NO: 1584066 - RNA, 14 nt, Human adenovirus F
uggaguuguggagu

SEQ ID NO: 1584067 - RNA, 14 nt, Human adenovirus F
auuaaguugggagg

SEQ ID NO: 1584068 - RNA, 14 nt, Human adenovirus F
cccugaucagccag

SEQ ID NO: 1584069 - RNA, 18 nt, Human adenovirus F
ggccauccuggaccugga

SEQ ID NO: 1584070 - RNA, 12 nt, Human adenovirus F
uacagccccuac

SEQ ID NO: 1584071 - RNA, 12 nt, Human adenovirus F
ccggaaaaccaa

SEQ ID NO: 1584072 - RNA, 20 nt, Human adenovirus F
acgccuuacauguggagcua

SEQ ID NO: 1584073 - RNA, 22 nt, Human adenovirus F
cuugcaaaacuuucgcuccuuu

SEQ ID NO: 1584074 - RNA, 21 nt, Human adenovirus F
gcacaguaaucaaggguuuca

SEQ ID NO: 1584075 - RNA, 19 nt, Human adenovirus F
acggcggaugguggcaagg

SEQ ID NO: 1584076 - RNA, 12 nt, Human adenovirus F
gaugugccaacg

SEQ ID NO: 1584077 - RNA, 15 nt, Human adenovirus F
agcauaauaacucug

SEQ ID NO: 1584078 - RNA, 23 nt, Human adenovirus F
gccacacugugcacacacgguuu

SEQ ID NO: 1584079 - RNA, 20 nt, Human adenovirus F
gauauagccaaccaggccuu

SEQ ID NO: 1584080 - RNA, 18 nt, Human adenovirus F
caggcagcagccccaggc

SEQ ID NO: 1584081 - RNA, 13 nt, Human adenovirus F
auucuccaaagca

SEQ ID NO: 1584082 - RNA, 17 nt, Human adenovirus F
ccacuucuauugcacuu

SEQ ID NO: 1584083 - RNA, 14 nt, Human adenovirus F
aucacuguuaaugg

SEQ ID NO: 1584084 - RNA, 17 nt, Human adenovirus F
aaauacagucaagcucu

SEQ ID NO: 1584085 - RNA, 11 nt, Human adenovirus F
uuagcucugaa

SEQ ID NO: 1584086 - RNA, 16 nt, Human adenovirus F
ccgagcagcugcguac

SEQ ID NO: 1584087 - RNA, 19 nt, Human adenovirus F
gggaacuguccagggaguc

SEQ ID NO: 1584088 - RNA, 14 nt, Human adenovirus F
ugcauuuuggccug

SEQ ID NO: 1584089 - RNA, 14 nt, Human adenovirus F
cuggucccuucccg

SEQ ID NO: 1584090 - RNA, 13 nt, Human adenovirus F
ggucgcaggguuc

SEQ ID NO: 1584091 - RNA, 16 nt, Human adenovirus F
cuaaugcacagccugc

SEQ ID NO: 1584092 - RNA, 18 nt, Human adenovirus F
agggugugaaggcaaagg

SEQ ID NO: 1584093 - RNA, 13 nt, Human adenovirus F
cuuccuucacucc

SEQ ID NO: 1584094 - RNA, 21 nt, Human adenovirus F
cgagaucacgucugggguuca

SEQ ID NO: 1584095 - RNA, 17 nt, Human adenovirus F
augccuccagcacugcc

SEQ ID NO: 1584096 - RNA, 16 nt, Human adenovirus F
augagcugggagaaag

SEQ ID NO: 1584097 - RNA, 15 nt, Human adenovirus F
aguaaucccugucuc

SEQ ID NO: 1584098 - RNA, 21 nt, Human adenovirus F
aagcuucuuguacucaaaugu

SEQ ID NO: 1584099 - RNA, 12 nt, Human adenovirus F
ggccgguaacgc

SEQ ID NO: 1584100 - RNA, 14 nt, Human adenovirus F
gaaacgaacacgcu

SEQ ID NO: 1584101 - RNA, 13 nt, Human adenovirus F
aauggaaacugau

SEQ ID NO: 1584102 - RNA, 14 nt, Human adenovirus F
ggaugauggaggga

SEQ ID NO: 1584103 - RNA, 14 nt, Human adenovirus F
ccucguuaagccac

SEQ ID NO: 1584104 - RNA, 14 nt, Human adenovirus F
cauaagaagccagc

SEQ ID NO: 1584105 - RNA, 15 nt, Human adenovirus F
gauaccgcugcagcu

SEQ ID NO: 1584106 - RNA, 17 nt, Human adenovirus F
gugucuccgcugggaga

SEQ ID NO: 1584107 - RNA, 13 nt, Human adenovirus F
gacagccagcugu

SEQ ID NO: 1584108 - RNA, 20 nt, Human adenovirus F
cauuaagucauuugguaaca

SEQ ID NO: 1584109 - RNA, 19 nt, Human adenovirus F
accaaucacgaccucccaa

SEQ ID NO: 1584110 - RNA, 14 nt, Human adenovirus F
gcucaucugcggcc

SEQ ID NO: 1584111 - RNA, 20 nt, Human adenovirus F
cagcgcccgggcccuggagg

SEQ ID NO: 1584112 - RNA, 21 nt, Human adenovirus F
ccguucccacuguuucuccuc

SEQ ID NO: 1584113 - RNA, 21 nt, Human adenovirus F
gccuuucacccucgucgcccu

SEQ ID NO: 1584114 - RNA, 22 nt, Human adenovirus F
ucuuccaccgguccuagaccug

SEQ ID NO: 1584115 - RNA, 21 nt, Human adenovirus F
guaguugagcgugguggcaau

SEQ ID NO: 1584116 - RNA, 22 nt, Human adenovirus F
guuagguacuauaacaauuaaa

SEQ ID NO: 1584117 - RNA, 19 nt, Human adenovirus F
ccuacccacgaaaaggugu

SEQ ID NO: 1584118 - RNA, 21 nt, Human adenovirus F
ucaucgaagccguugauguua

SEQ ID NO: 1584119 - RNA, 18 nt, Human adenovirus F
gauuuucuuugccaccuu

SEQ ID NO: 1584120 - RNA, 17 nt, Human adenovirus F
gcagcaguccgucagcu

SEQ ID NO: 1584121 - RNA, 17 nt, Human adenovirus F
ccugcccuuccucccaa

SEQ ID NO: 1584122 - RNA, 15 nt, Human adenovirus F
cuagacgaggaggac

SEQ ID NO: 1584123 - RNA, 18 nt, Human adenovirus F
aguuagcucugaacacuu

SEQ ID NO: 1584124 - RNA, 15 nt, Human adenovirus F
ggcaauaggcacaga

SEQ ID NO: 1584125 - RNA, 12 nt, Human adenovirus F
ccagcacugccg

SEQ ID NO: 1584126 - RNA, 16 nt, Human adenovirus F
gagcaaguggagcaag

SEQ ID NO: 1584127 - RNA, 21 nt, Human adenovirus F
gugggcugauuuggaagauga

SEQ ID NO: 1584128 - RNA, 19 nt, Human adenovirus F
accaccccuagucccuccu

SEQ ID NO: 1584129 - RNA, 18 nt, Human adenovirus F
gccuuguaugggcagcau

SEQ ID NO: 1584130 - RNA, 14 nt, Human adenovirus F
agaggaaaaggagg

SEQ ID NO: 1584131 - RNA, 16 nt, Human adenovirus F
cuacguccgcgacugc

SEQ ID NO: 1584132 - RNA, 23 nt, Human adenovirus F
agcaccaacgugcaggccaaccu

SEQ ID NO: 1584133 - RNA, 14 nt, Human adenovirus F
aagcgagcagagcc

SEQ ID NO: 1584134 - RNA, 21 nt, Human adenovirus F
caaguucaaagaagagcugcu

SEQ ID NO: 1584135 - RNA, 15 nt, Human adenovirus F
cacaauuuacaauuu

SEQ ID NO: 1584136 - RNA, 20 nt, Human adenovirus F
ucaauagcauacagaagacc

SEQ ID NO: 1584137 - RNA, 19 nt, Human adenovirus F
gucacucuccgccgccgcu

SEQ ID NO: 1584138 - RNA, 22 nt, Human adenovirus F
uugcacuuaacuguucuugucg

SEQ ID NO: 1584139 - RNA, 23 nt, Human adenovirus F
gguggaccccauggaugagccca

SEQ ID NO: 1584140 - RNA, 19 nt, Human adenovirus F
uaaagcauaacaugauuug

SEQ ID NO: 1584141 - RNA, 12 nt, Human adenovirus F
uuguaccaccuu

SEQ ID NO: 1584142 - RNA, 15 nt, Human adenovirus F
cuagcauaaagggga

SEQ ID NO: 1584143 - RNA, 20 nt, Human adenovirus F
cgacgacgcggcgguugagg

SEQ ID NO: 1584144 - RNA, 14 nt, Human adenovirus F
gauguuuuccaaga

SEQ ID NO: 1584145 - RNA, 18 nt, Human adenovirus F
caugcgcuccaacacuau

SEQ ID NO: 1584146 - RNA, 12 nt, Human adenovirus F
ucaccuacaacc

SEQ ID NO: 1584147 - RNA, 19 nt, Human adenovirus F
aagcuucuuguacucaaau

SEQ ID NO: 1584148 - RNA, 23 nt, Human adenovirus F
agaggcguucgacgcgaggauga

SEQ ID NO: 1584149 - RNA, 15 nt, Human adenovirus F
agguugacuugcagg

SEQ ID NO: 1584150 - RNA, 22 nt, Human adenovirus F
ggcuugucgcagaaucuccugc

SEQ ID NO: 1584151 - RNA, 22 nt, Human adenovirus F
cuguaguugauaguuuaaggag

SEQ ID NO: 1584152 - RNA, 18 nt, Human adenovirus F
auccagggcacaguaauc

SEQ ID NO: 1584153 - RNA, 17 nt, Human adenovirus F
cccucagacgacugggc

SEQ ID NO: 1584154 - RNA, 18 nt, Human adenovirus F
accuuagaacuaccucca

SEQ ID NO: 1584155 - RNA, 18 nt, Human adenovirus F
auccaucacgccaacgcc

SEQ ID NO: 1584156 - RNA, 15 nt, Human adenovirus F
gugagauuuguagug

SEQ ID NO: 1584157 - RNA, 15 nt, Human adenovirus F
cgcacuggaugccac

SEQ ID NO: 1584158 - RNA, 14 nt, Human adenovirus F
auggaacuaacugg

SEQ ID NO: 1584159 - RNA, 17 nt, Human adenovirus F
aguaaaaaaaagggaag

SEQ ID NO: 1584160 - RNA, 23 nt, Human adenovirus F
gcuccggguugggcgcuugccag

SEQ ID NO: 1584161 - RNA, 14 nt, Human adenovirus F
uaaccacuaccacc

SEQ ID NO: 1584162 - RNA, 21 nt, Human adenovirus F
ugccaucgcugaccagcagca

SEQ ID NO: 1584163 - RNA, 12 nt, Human adenovirus F
acuccucuugca

SEQ ID NO: 1584164 - RNA, 12 nt, Human adenovirus F
acggacaacccg

SEQ ID NO: 1584165 - RNA, 15 nt, Human adenovirus F
uauuuuaaaaugguu

SEQ ID NO: 1584166 - RNA, 20 nt, Human adenovirus F
guccuggccaacugccaccu

SEQ ID NO: 1584167 - RNA, 18 nt, Human adenovirus F
gaggcgauuugggaggga

SEQ ID NO: 1584168 - RNA, 10 nt, Human adenovirus F
uuacaaacag

SEQ ID NO: 1584169 - RNA, 17 nt, Human adenovirus F
agcaugaaacuggaaga

SEQ ID NO: 1584170 - RNA, 19 nt, Human adenovirus F
ucugauaauguguguuuuu

SEQ ID NO: 1584171 - RNA, 16 nt, Human adenovirus F
uuggaaugccugcagc

SEQ ID NO: 1584172 - RNA, 18 nt, Human adenovirus F
cggguuuuauggcaccgc

SEQ ID NO: 1584173 - RNA, 18 nt, Human adenovirus F
gagggaaaacaaagacga

SEQ ID NO: 1584174 - RNA, 19 nt, Human adenovirus F
aucgaggccgucuaccugc

SEQ ID NO: 1584175 - RNA, 20 nt, Human adenovirus F
caaggaaugcacacagacuc

SEQ ID NO: 1584176 - RNA, 22 nt, Human adenovirus F
gguuacucagcaauccggccca

SEQ ID NO: 1584177 - RNA, 21 nt, Human adenovirus F
gacaguaagcaacaaccagcu

SEQ ID NO: 1584178 - RNA, 17 nt, Human adenovirus F
gcggaggugccccagag

SEQ ID NO: 1584179 - RNA, 13 nt, Human adenovirus F
aggagacguggga

SEQ ID NO: 1584180 - RNA, 19 nt, Human adenovirus F
ccuuuugcaucucaaagcu

SEQ ID NO: 1584181 - RNA, 17 nt, Human adenovirus F
gcaaacgucaacuccuc

SEQ ID NO: 1584182 - RNA, 22 nt, Human adenovirus F
cccaccguuguggagucacugc

SEQ ID NO: 1584183 - RNA, 14 nt, Human adenovirus F
gcccaggagcagcg

SEQ ID NO: 1584184 - RNA, 12 nt, Human adenovirus F
acaggagcgcag

SEQ ID NO: 1584185 - RNA, 21 nt, Human adenovirus F
aagcugggauuugccgcagcc

SEQ ID NO: 1584186 - RNA, 16 nt, Human adenovirus F
uacgaacacuacaauc

SEQ ID NO: 1584187 - RNA, 21 nt, Human adenovirus F
agauggugggccgcugaaaga

SEQ ID NO: 1584188 - RNA, 19 nt, Human adenovirus F
gaccguauucacaaagcug

SEQ ID NO: 1584189 - RNA, 12 nt, Human adenovirus F
cgcuggcuccgc

SEQ ID NO: 1584190 - RNA, 23 nt, Human adenovirus F
cacguacgagaaaucggagaggg

SEQ ID NO: 1584191 - RNA, 14 nt, Human adenovirus F
ucccaaaaaaagaa

SEQ ID NO: 1584192 - RNA, 18 nt, Human adenovirus F
augugcuggggaauggag

SEQ ID NO: 1584193 - RNA, 22 nt, Human adenovirus F
gaaaaacgggcggcaaaugcuc

SEQ ID NO: 1584194 - RNA, 20 nt, Human adenovirus F
accuccgacgcuugcuggag

SEQ ID NO: 1584195 - RNA, 21 nt, Human adenovirus F
uccuggcgagcccauaaaagc

SEQ ID NO: 1584196 - RNA, 14 nt, Human adenovirus F
cccgugucaccugc

SEQ ID NO: 1584197 - RNA, 19 nt, Human adenovirus F
gcgggggcgucccuggagu

SEQ ID NO: 1584198 - RNA, 16 nt, Human adenovirus F
gcagucucgguaacga

SEQ ID NO: 1584199 - RNA, 21 nt, Human adenovirus F
cuuauuggcaugaguggggua

SEQ ID NO: 1584200 - RNA, 18 nt, Human adenovirus F
uuuccaugcacucaucca

SEQ ID NO: 1584201 - RNA, 17 nt, Human adenovirus F
guaggugacaaagaggc

SEQ ID NO: 1584202 - RNA, 15 nt, Human adenovirus F
cacagccgccgcucc

SEQ ID NO: 1584203 - RNA, 18 nt, Human adenovirus F
gcuggcuuuuggaccugg

SEQ ID NO: 1584204 - RNA, 20 nt, Human adenovirus F
ugcuacggaggaagaggguc

SEQ ID NO: 1584205 - RNA, 15 nt, Human adenovirus F
aguuuaaaaacggug

SEQ ID NO: 1584206 - RNA, 21 nt, Human adenovirus F
ggaguucuccguguccugcgc

SEQ ID NO: 1584207 - RNA, 20 nt, Human adenovirus F
gcguggccuccguggccuug

SEQ ID NO: 1584208 - RNA, 15 nt, Human adenovirus F
agcuagcauaaaaga

SEQ ID NO: 1584209 - RNA, 19 nt, Human adenovirus F
aaacagcagguuaaagcca

SEQ ID NO: 1584210 - RNA, 13 nt, Human adenovirus F
uuggccuuugucu

SEQ ID NO: 1584211 - RNA, 14 nt, Human adenovirus F
ccgucuccaucgcc

SEQ ID NO: 1584212 - RNA, 22 nt, Human adenovirus F
ggugggcugauuuggaagauga

SEQ ID NO: 1584213 - RNA, 17 nt, Human adenovirus F
ccgacuacuuacuccca

SEQ ID NO: 1584214 - RNA, 23 nt, Human adenovirus F
caagcccaauccucaagacuugg

SEQ ID NO: 1584215 - RNA, 18 nt, Human adenovirus F
aggagaggcauggcgggc

SEQ ID NO: 1584216 - RNA, 21 nt, Human adenovirus F
uccaguaaucuucggcaggaa

SEQ ID NO: 1584217 - RNA, 14 nt, Human adenovirus F
caggcacaccuuca

SEQ ID NO: 1584218 - RNA, 13 nt, Human adenovirus F
uggaugagcccac

SEQ ID NO: 1584219 - RNA, 20 nt, Human adenovirus F
aauguuaucggggugggaaa

SEQ ID NO: 1584220 - RNA, 21 nt, Human adenovirus F
caaggaugaggcgggacugau

SEQ ID NO: 1584221 - RNA, 13 nt, Human adenovirus F
gccagagggcaac

SEQ ID NO: 1584222 - RNA, 19 nt, Human adenovirus F
uggggggaaccggcgccgc

SEQ ID NO: 1584223 - RNA, 13 nt, Human adenovirus F
aauauuggcuacc

SEQ ID NO: 1584224 - RNA, 20 nt, Human adenovirus F
uaacacugccuaccgcagcu

SEQ ID NO: 1584225 - RNA, 15 nt, Human adenovirus F
ggcgccggacgggca

SEQ ID NO: 1584226 - RNA, 20 nt, Human adenovirus F
ucagacggccguaccaagcc

SEQ ID NO: 1584227 - RNA, 22 nt, Human adenovirus F
agaguuuuuacaacgagcaggc

SEQ ID NO: 1584228 - RNA, 17 nt, Human adenovirus F
gcagucuaagccuggcc

SEQ ID NO: 1584229 - RNA, 14 nt, Human adenovirus F
uacgcccaggagca

SEQ ID NO: 1584230 - RNA, 16 nt, Human adenovirus F
aaguggaucccagcgu

SEQ ID NO: 1584231 - RNA, 13 nt, Human adenovirus F
gacgacagccagg

SEQ ID NO: 1584232 - RNA, 14 nt, Human adenovirus F
auggaaacugucag

SEQ ID NO: 1584233 - RNA, 22 nt, Human adenovirus F
uaaugcgggcucugauaaugug

SEQ ID NO: 1584234 - RNA, 19 nt, Human adenovirus F
ggcggacauugccucccug

SEQ ID NO: 1584235 - RNA, 15 nt, Human adenovirus F
aggucaucuucuucu

SEQ ID NO: 1584236 - RNA, 21 nt, Human adenovirus F
ggcagaacguucuucacugca

SEQ ID NO: 1584237 - RNA, 13 nt, Human adenovirus F
uagaaguaaccaa

SEQ ID NO: 1584238 - RNA, 15 nt, Human adenovirus F
ggcccuggccuggaa

SEQ ID NO: 1584239 - RNA, 23 nt, Human adenovirus F
acgugagagaggcgguggcgcag

SEQ ID NO: 1584240 - RNA, 12 nt, Human adenovirus F
caagggcuuccu

SEQ ID NO: 1584241 - RNA, 16 nt, Human adenovirus F
gcaaucugaucucuua

SEQ ID NO: 1584242 - RNA, 13 nt, Human adenovirus F
gcuugggaggauu

SEQ ID NO: 1584243 - RNA, 17 nt, Human adenovirus F
caggagcagcgggaaga

SEQ ID NO: 1584244 - RNA, 22 nt, Human adenovirus F
cgguggcggacgggucgcagca

SEQ ID NO: 1584245 - RNA, 22 nt, Human adenovirus F
cgguggcaacccugaggaggag

SEQ ID NO: 1584246 - RNA, 11 nt, Human adenovirus F
gccaacucgac

SEQ ID NO: 1584247 - RNA, 13 nt, Human adenovirus F
ccagcaagcugcc

SEQ ID NO: 1584248 - RNA, 14 nt, Human adenovirus F
cgagaggaccacuu

SEQ ID NO: 1584249 - RNA, 14 nt, Human adenovirus F
aagacaccaguagc

SEQ ID NO: 1584250 - RNA, 15 nt, Human adenovirus F
cgccggacgggcagc

SEQ ID NO: 1584251 - RNA, 22 nt, Human adenovirus F
ccgucuucccucuugggcagga

SEQ ID NO: 1584252 - RNA, 19 nt, Human adenovirus F
accuguauacgggaaggaa

SEQ ID NO: 1584253 - RNA, 22 nt, Human adenovirus F
cuucaucacuuucuuccgcauc

SEQ ID NO: 1584254 - RNA, 17 nt, Human adenovirus F
uugcuacggaggaagag

SEQ ID NO: 1584255 - RNA, 15 nt, Human adenovirus F
aacgaaaaaggaggu

SEQ ID NO: 1584256 - RNA, 17 nt, Human adenovirus F
aaugugcagcaaaaacu

SEQ ID NO: 1584257 - RNA, 16 nt, Human adenovirus F
aacuguucuugucgua

SEQ ID NO: 1584258 - RNA, 17 nt, Human adenovirus F
acggcaaggaaccagug

SEQ ID NO: 1584259 - RNA, 13 nt, Human adenovirus F
aacuucuaccauu

SEQ ID NO: 1584260 - RNA, 21 nt, Human adenovirus F
ucaaccuucaagcccuacacc

SEQ ID NO: 1584261 - RNA, 19 nt, Human adenovirus F
cgaggccuuucacccagac

SEQ ID NO: 1584262 - RNA, 17 nt, Human adenovirus F
gcaucucaaagcuggag

SEQ ID NO: 1584263 - RNA, 18 nt, Human adenovirus F
uacaauccccuugacauu

SEQ ID NO: 1584264 - RNA, 15 nt, Human adenovirus F
gcgcaacgcaagaga

SEQ ID NO: 1584265 - RNA, 18 nt, Human adenovirus F
gcaggguuauacucugga

SEQ ID NO: 1584266 - RNA, 16 nt, Human adenovirus F
cagccgcaccgcggcg

SEQ ID NO: 1584267 - RNA, 14 nt, Human adenovirus F
gcccgugccaccga

SEQ ID NO: 1584268 - RNA, 13 nt, Human adenovirus F
aaguuaccaaaga

SEQ ID NO: 1584269 - RNA, 14 nt, Human adenovirus F
uuagcgaaaacgga

SEQ ID NO: 1584270 - RNA, 16 nt, Human adenovirus F
ugcaaaacaauucucu

SEQ ID NO: 1584271 - RNA, 20 nt, Human adenovirus F
cacaccucuccccaccgcug

SEQ ID NO: 1584272 - RNA, 13 nt, Human adenovirus F
uggaaagccuggu

SEQ ID NO: 1584273 - RNA, 18 nt, Human adenovirus F
caaacauuaagcugcaau

SEQ ID NO: 1584274 - RNA, 15 nt, Human adenovirus F
cgcuguacugugcau

SEQ ID NO: 1584275 - RNA, 22 nt, Human adenovirus F
cuucaaacggcggaugguggca

SEQ ID NO: 1584276 - RNA, 15 nt, Human adenovirus F
ugaagcuaaccuguu

SEQ ID NO: 1584277 - RNA, 15 nt, Human adenovirus F
agacuuugucagcca

SEQ ID NO: 1584278 - RNA, 15 nt, Human adenovirus F
agguuuccaaaucau

SEQ ID NO: 1584279 - RNA, 23 nt, Human adenovirus F
cugugaguuuugaggguggggug

SEQ ID NO: 1584280 - RNA, 22 nt, Human adenovirus F
ugacuacgaauccagcgaugag

SEQ ID NO: 1584281 - RNA, 16 nt, Human adenovirus F
cgccagccuccggugg

SEQ ID NO: 1584282 - RNA, 15 nt, Human adenovirus F
cuucaguugaaccac

SEQ ID NO: 1584283 - RNA, 21 nt, Human adenovirus F
auagcugugucagcuaacucu

SEQ ID NO: 1584284 - RNA, 14 nt, Human adenovirus F
cacauugccagcua

SEQ ID NO: 1584285 - RNA, 17 nt, Human adenovirus F
uuggcagcaacauaacu

SEQ ID NO: 1584286 - RNA, 22 nt, Human adenovirus F
cagcgucagguuugacagcauu

SEQ ID NO: 1584287 - RNA, 23 nt, Human adenovirus F
cgcggggcaggagcugcgggccg

SEQ ID NO: 1584288 - RNA, 21 nt, Human adenovirus F
ggaaucccgcgagccccccuc

SEQ ID NO: 1584289 - RNA, 20 nt, Human adenovirus F
gcacugcgguggaggccaug

SEQ ID NO: 1584290 - RNA, 13 nt, Human adenovirus F
gccagcuggcaaa

SEQ ID NO: 1584291 - RNA, 11 nt, Human adenovirus F
gcuucugccag

SEQ ID NO: 1584292 - RNA, 15 nt, Human adenovirus F
gcccugaucagccag

SEQ ID NO: 1584293 - RNA, 16 nt, Human adenovirus F
aggcaaaacuggaacg

SEQ ID NO: 1584294 - RNA, 20 nt, Human adenovirus F
cgcuggcuuuuggaccuggu

SEQ ID NO: 1584295 - RNA, 21 nt, Human adenovirus F
cgcgcaacuuuugcaccaggg

SEQ ID NO: 1584296 - RNA, 17 nt, Human adenovirus F
acgggcggcaaaugcuc

SEQ ID NO: 1584297 - RNA, 18 nt, Human adenovirus F
augcaacuuggaagggaa

SEQ ID NO: 1584298 - RNA, 21 nt, Human adenovirus F
ccauccuggaccuggaagagg

SEQ ID NO: 1584299 - RNA, 20 nt, Human adenovirus F
uuugguaacaaggccuggaa

SEQ ID NO: 1584300 - RNA, 19 nt, Human adenovirus F
cguuaguggaggcagcuuc

SEQ ID NO: 1584301 - RNA, 16 nt, Human adenovirus F
aaaguagcucuuccaa

SEQ ID NO: 1584302 - RNA, 14 nt, Human adenovirus F
ucccaggcggaaac

SEQ ID NO: 1584303 - RNA, 13 nt, Human adenovirus F
cucugaggacgga

SEQ ID NO: 1584304 - RNA, 16 nt, Human adenovirus F
gggcggcgguaacaag

SEQ ID NO: 1584305 - RNA, 19 nt, Human adenovirus F
cagggaucgcagcgggcag

SEQ ID NO: 1584306 - RNA, 16 nt, Human adenovirus F
caauuccacuggcaac

SEQ ID NO: 1584307 - RNA, 21 nt, Human adenovirus F
caggaucccucagagcugcaa

SEQ ID NO: 1584308 - RNA, 21 nt, Human adenovirus F
cgaagacuaucacgcccacca

SEQ ID NO: 1584309 - RNA, 21 nt, Human adenovirus F
cuucgccgcagucucccaccu

SEQ ID NO: 1584310 - RNA, 23 nt, Human adenovirus F
aagugucccacugcaacucgcag

SEQ ID NO: 1584311 - RNA, 18 nt, Human adenovirus F
uggaggaggaucuuaagc

SEQ ID NO: 1584312 - RNA, 15 nt, Human adenovirus F
cgcgucugcugcugc

SEQ ID NO: 1584313 - RNA, 20 nt, Human adenovirus F
acuuuugagguggaccccau

SEQ ID NO: 1584314 - RNA, 13 nt, Human adenovirus F
ugccaacaaaugu

SEQ ID NO: 1584315 - RNA, 13 nt, Human adenovirus F
gaggcgggacuga

SEQ ID NO: 1584316 - RNA, 17 nt, Human adenovirus F
aacucaaacaacaaaau

SEQ ID NO: 1584317 - RNA, 16 nt, Human adenovirus F
gaaaauccucaguguc

SEQ ID NO: 1584318 - RNA, 21 nt, Human adenovirus F
agcugugguuaaauuuaaugg

SEQ ID NO: 1584319 - RNA, 19 nt, Human adenovirus F
ggugggcguccaguggagc

SEQ ID NO: 1584320 - RNA, 22 nt, Human adenovirus F
uauccuugcucggcgaaaacuc

SEQ ID NO: 1584321 - RNA, 18 nt, Human adenovirus F
agggcgucaugcucuggg

SEQ ID NO: 1584322 - RNA, 17 nt, Human adenovirus F
cggcgggugcaguggcg

SEQ ID NO: 1584323 - RNA, 19 nt, Human adenovirus F
gcacuuagagugucaguuu

SEQ ID NO: 1584324 - RNA, 18 nt, Human adenovirus F
auggguaagugcagaggc

SEQ ID NO: 1584325 - RNA, 20 nt, Human adenovirus F
acuaaacauugauaaaaaug

SEQ ID NO: 1584326 - RNA, 19 nt, Human adenovirus F
agaacuggaguaacacaau

SEQ ID NO: 1584327 - RNA, 22 nt, Human adenovirus F
cauaacaccuauguuaggcuuu

SEQ ID NO: 1584328 - RNA, 13 nt, Human adenovirus F
cuggcagcuggag

SEQ ID NO: 1584329 - RNA, 13 nt, Human adenovirus F
uuucuccuccccu

SEQ ID NO: 1584330 - RNA, 16 nt, Human adenovirus F
cacaaaguccuggcca

SEQ ID NO: 1584331 - RNA, 15 nt, Human adenovirus F
aacuggucucagaau

SEQ ID NO: 1584332 - RNA, 12 nt, Human adenovirus F
ggaacuguucaa

SEQ ID NO: 1584333 - RNA, 20 nt, Human adenovirus F
cgcaacuucuuuuugggagg

SEQ ID NO: 1584334 - RNA, 11 nt, Human adenovirus F
augccugcagc

SEQ ID NO: 1584335 - RNA, 21 nt, Human adenovirus F
cgcuuggaggagcugucucag

SEQ ID NO: 1584336 - RNA, 16 nt, Human adenovirus F
caauccuaacaaaaac

SEQ ID NO: 1584337 - RNA, 17 nt, Human adenovirus F
ccaacagccccagcugg

SEQ ID NO: 1584338 - RNA, 15 nt, Human adenovirus F
caggagcugcgggcc

SEQ ID NO: 1584339 - RNA, 23 nt, Human adenovirus F
caggaggcuauuggccagacgca

SEQ ID NO: 1584340 - RNA, 23 nt, Human adenovirus F
ugcgcgguaagaacccagcaugu

SEQ ID NO: 1584341 - RNA, 22 nt, Human adenovirus F
ugaacccgguguacaccaccuc

SEQ ID NO: 1584342 - RNA, 21 nt, Human adenovirus F
ucgggaaagacaguggcgcgc

SEQ ID NO: 1584343 - RNA, 18 nt, Human adenovirus F
gaugaaaguagaagucuc

SEQ ID NO: 1584344 - RNA, 17 nt, Human adenovirus F
ucucagcaguugcaaga

SEQ ID NO: 1584345 - RNA, 19 nt, Human adenovirus F
cagcauaauaacucuggcu

SEQ ID NO: 1584346 - RNA, 15 nt, Human adenovirus F
cccgcccgccucuac

SEQ ID NO: 1584347 - RNA, 20 nt, Human adenovirus F
gccaucuucccgcaaaagcg

SEQ ID NO: 1584348 - RNA, 12 nt, Human adenovirus F
ccgagcagcugc

SEQ ID NO: 1584349 - RNA, 14 nt, Human adenovirus F
ucugagaguguuuc

SEQ ID NO: 1584350 - RNA, 19 nt, Human adenovirus F
uucgucaggccugcaagau

SEQ ID NO: 1584351 - RNA, 15 nt, Human adenovirus F
aacaauaaaaucauu

SEQ ID NO: 1584352 - RNA, 14 nt, Human adenovirus F
uucccacuguuucu

SEQ ID NO: 1584353 - RNA, 18 nt, Human adenovirus F
gaacgugaccgagcagcu

SEQ ID NO: 1584354 - RNA, 17 nt, Human adenovirus F
gccccgcccacugaccg

SEQ ID NO: 1584355 - RNA, 11 nt, Human adenovirus F
agguagaaugg

SEQ ID NO: 1584356 - RNA, 16 nt, Human adenovirus F
acgggaugugccaacg

SEQ ID NO: 1584357 - RNA, 13 nt, Human adenovirus F
gcgaaugcccuuu

SEQ ID NO: 1584358 - RNA, 17 nt, Human adenovirus F
gccgggacaacgaggcu

SEQ ID NO: 1584359 - RNA, 16 nt, Human adenovirus F
cccuggaauuuuugcu

SEQ ID NO: 1584360 - RNA, 13 nt, Human adenovirus F
gagcuggccuggu

SEQ ID NO: 1584361 - RNA, 21 nt, Human adenovirus F
cggguuuuggacauggccagc

SEQ ID NO: 1584362 - RNA, 14 nt, Human adenovirus F
aaaaagagaaucua

SEQ ID NO: 1584363 - RNA, 17 nt, Human adenovirus F
cuggagggcgucaugcu

SEQ ID NO: 1584364 - RNA, 18 nt, Human adenovirus F
auuucaccuacucuggcu

SEQ ID NO: 1584365 - RNA, 17 nt, Human adenovirus F
auuuugcgucgcuggcu

SEQ ID NO: 1584366 - RNA, 13 nt, Human adenovirus F
guguuuagcccau

SEQ ID NO: 1584367 - RNA, 11 nt, Human adenovirus F
auugacgccga

SEQ ID NO: 1584368 - RNA, 17 nt, Human adenovirus F
uugaacagcugaagaca

SEQ ID NO: 1584369 - RNA, 12 nt, Human adenovirus F
auacccagcugu

SEQ ID NO: 1584370 - RNA, 16 nt, Human adenovirus F
cguggcauggcagcag

SEQ ID NO: 1584371 - RNA, 17 nt, Human adenovirus F
cuaguuuaauauugcuu

SEQ ID NO: 1584372 - RNA, 19 nt, Human adenovirus F
gcagccugagcugccagag

SEQ ID NO: 1584373 - RNA, 21 nt, Human adenovirus F
guacggaccaccagaugaugu

SEQ ID NO: 1584374 - RNA, 21 nt, Human adenovirus F
aaaucacuguuuuuaacuauu

SEQ ID NO: 1584375 - RNA, 16 nt, Human adenovirus F
gcccuggaggcggcug

SEQ ID NO: 1584376 - RNA, 17 nt, Human adenovirus F
cuacugccgccaugacu

SEQ ID NO: 1584377 - RNA, 18 nt, Human adenovirus F
gcuccuuuguacucgagc

SEQ ID NO: 1584378 - RNA, 15 nt, Human adenovirus F
ggcaguggccgccga

SEQ ID NO: 1584379 - RNA, 19 nt, Human adenovirus F
gacuugccgguuucgcauu

SEQ ID NO: 1584380 - RNA, 23 nt, Human adenovirus F
gcauccucccaacaaccuaccca

SEQ ID NO: 1584381 - RNA, 14 nt, Human adenovirus F
gaucguagacaacu

SEQ ID NO: 1584382 - RNA, 13 nt, Human adenovirus F
gggaauggagcug

SEQ ID NO: 1584383 - RNA, 14 nt, Human adenovirus F
cuucucgaggccaa

SEQ ID NO: 1584384 - RNA, 21 nt, Human adenovirus F
agggcgcgcucguagggauug

SEQ ID NO: 1584385 - RNA, 15 nt, Human adenovirus F
gcagugguggauggg

SEQ ID NO: 1584386 - RNA, 16 nt, Human adenovirus F
cuacccuucugugccu

SEQ ID NO: 1584387 - RNA, 13 nt, Human adenovirus F
gcuguaccaggag

SEQ ID NO: 1584388 - RNA, 15 nt, Human adenovirus F
acuucagccugggga

SEQ ID NO: 1584389 - RNA, 21 nt, Human adenovirus F
cgcugagugacgaucuggggg

SEQ ID NO: 1584390 - RNA, 14 nt, Human adenovirus F
uacguaccgccuca

SEQ ID NO: 1584391 - RNA, 22 nt, Human adenovirus F
cguggccuugcaagcagcucgc

SEQ ID NO: 1584392 - RNA, 13 nt, Human adenovirus F
guguuuauuucuu

SEQ ID NO: 1584393 - RNA, 14 nt, Human adenovirus F
uaagcaacaaccag

SEQ ID NO: 1584394 - RNA, 12 nt, Human adenovirus F
agaacaaaacac

SEQ ID NO: 1584395 - RNA, 23 nt, Human adenovirus F
augguaaaaaugccaggcagcag

SEQ ID NO: 1584396 - RNA, 21 nt, Human adenovirus F
aagucauuugguaacaaggcc

SEQ ID NO: 1584397 - RNA, 21 nt, Human adenovirus F
caauccugaaugcauguacac

SEQ ID NO: 1584398 - RNA, 15 nt, Human adenovirus F
aguguaccaauccug

SEQ ID NO: 1584399 - RNA, 15 nt, Human adenovirus F
cuuccucccaaagua

SEQ ID NO: 1584400 - RNA, 15 nt, Human adenovirus F
cgccaucaugagucu

SEQ ID NO: 1584401 - RNA, 16 nt, Human adenovirus F
gcaaaucuauuucuuu

SEQ ID NO: 1584402 - RNA, 15 nt, Human adenovirus F
gaggcggaggagcag

SEQ ID NO: 1584403 - RNA, 16 nt, Human adenovirus F
cgccguaggagaggca

SEQ ID NO: 1584404 - RNA, 16 nt, Human adenovirus F
ggcccuaaccacccgc

SEQ ID NO: 1584405 - RNA, 12 nt, Human adenovirus F
accaaagguggu

SEQ ID NO: 1584406 - RNA, 16 nt, Human adenovirus F
cagaagugaagaccaa

SEQ ID NO: 1584407 - RNA, 17 nt, Human adenovirus F
cagcguugagccggaag

SEQ ID NO: 1584408 - RNA, 21 nt, Human adenovirus F
uguucacugaaagccagccgu

SEQ ID NO: 1584409 - RNA, 19 nt, Human adenovirus F
cuucgggagacggaggcaa

SEQ ID NO: 1584410 - RNA, 14 nt, Human adenovirus F
agcacugcggugga

SEQ ID NO: 1584411 - RNA, 16 nt, Human adenovirus F
gcuuaguauuaacacu

SEQ ID NO: 1584412 - RNA, 19 nt, Human adenovirus F
gcaucucuugaaugaggug

SEQ ID NO: 1584413 - RNA, 15 nt, Human adenovirus F
agagucgucgcaggc

SEQ ID NO: 1584414 - RNA, 15 nt, Human adenovirus F
cuuuuucccaaaaaa

SEQ ID NO: 1584415 - RNA, 20 nt, Human adenovirus F
acuggcuggcccuggccugg

SEQ ID NO: 1584416 - RNA, 18 nt, Human adenovirus F
gauaccgcugcagcugcu

SEQ ID NO: 1584417 - RNA, 14 nt, Human adenovirus F
ggaucaauggagcg

SEQ ID NO: 1584418 - RNA, 13 nt, Human adenovirus F
agccacuccugca

SEQ ID NO: 1584419 - RNA, 17 nt, Human adenovirus F
gcagaaacaugccaccc

SEQ ID NO: 1584420 - RNA, 16 nt, Human adenovirus F
uaccccuaccacccua

SEQ ID NO: 1584421 - RNA, 22 nt, Human adenovirus F
cccaccuuguguuuaagccaga

SEQ ID NO: 1584422 - RNA, 13 nt, Human adenovirus F
cagcaaacacaaa

SEQ ID NO: 1584423 - RNA, 19 nt, Human adenovirus F
cugguaaaccagcacacag

SEQ ID NO: 1584424 - RNA, 16 nt, Human adenovirus F
cccggguccuacaccu

SEQ ID NO: 1584425 - RNA, 15 nt, Human adenovirus F
cccaggaucccucag

SEQ ID NO: 1584426 - RNA, 14 nt, Human adenovirus F
uacacaccaaacuc

SEQ ID NO: 1584427 - RNA, 21 nt, Human adenovirus F
aagcaauauugucgcaugccu

SEQ ID NO: 1584428 - RNA, 12 nt, Human adenovirus F
gagacaaaagcc

SEQ ID NO: 1584429 - RNA, 14 nt, Human adenovirus F
uacauguggagcua

SEQ ID NO: 1584430 - RNA, 20 nt, Human adenovirus F
uggaguuggcuucugccaga

SEQ ID NO: 1584431 - RNA, 19 nt, Human adenovirus F
auacgggagggacaagcuu

SEQ ID NO: 1584432 - RNA, 21 nt, Human adenovirus F
aaacuaucccgccccugccac

SEQ ID NO: 1584433 - RNA, 17 nt, Human adenovirus F
aaggggcgcgcuccggg

SEQ ID NO: 1584434 - RNA, 21 nt, Human adenovirus F
gaagaacuggaguaacacaau

SEQ ID NO: 1584435 - RNA, 13 nt, Human adenovirus F
agcuuuaaacccu

SEQ ID NO: 1584436 - RNA, 16 nt, Human adenovirus F
ugaaccggaaaaccaa

SEQ ID NO: 1584437 - RNA, 16 nt, Human adenovirus F
accaaucuaucccuug

SEQ ID NO: 1584438 - RNA, 19 nt, Human adenovirus F
caaaagcccggguccaggc

SEQ ID NO: 1584439 - RNA, 13 nt, Human adenovirus F
aaucaggagaaaa

SEQ ID NO: 1584440 - RNA, 16 nt, Human adenovirus F
gucacucucagcugcu

SEQ ID NO: 1584441 - RNA, 22 nt, Human adenovirus F
acuaaggcuggcacacgcacuu

SEQ ID NO: 1584442 - RNA, 18 nt, Human adenovirus F
uacuucuuaauaaagaca

SEQ ID NO: 1584443 - RNA, 17 nt, Human adenovirus F
gcucacccgcagcugcu

SEQ ID NO: 1584444 - RNA, 18 nt, Human adenovirus F
cugauccacuuacaacca

SEQ ID NO: 1584445 - RNA, 15 nt, Human adenovirus F
cgguaacgaccucag

SEQ ID NO: 1584446 - RNA, 11 nt, Human adenovirus F
gacgagcccug

SEQ ID NO: 1584447 - RNA, 20 nt, Human adenovirus F
ugucugccaaaauggcucug

SEQ ID NO: 1584448 - RNA, 22 nt, Human adenovirus F
cgguacaagauuugacgaaaga

SEQ ID NO: 1584449 - RNA, 17 nt, Human adenovirus F
uccugacuauuuuaugc

SEQ ID NO: 1584450 - RNA, 21 nt, Human adenovirus F
aaaguucaacaucaaccagug

SEQ ID NO: 1584451 - RNA, 22 nt, Human adenovirus F
ccauguggaaccaggcagugga

SEQ ID NO: 1584452 - RNA, 14 nt, Human adenovirus F
gagcgugguggcaa

SEQ ID NO: 1584453 - RNA, 20 nt, Human adenovirus F
gguaaugucuuuccaggguc

SEQ ID NO: 1584454 - RNA, 17 nt, Human adenovirus F
ugccuccagcacugccg

SEQ ID NO: 1584455 - RNA, 18 nt, Human adenovirus F
gggggcauuaaugggcaa

SEQ ID NO: 1584456 - RNA, 22 nt, Human adenovirus F
cgaggaaagcuuccagccaauc

SEQ ID NO: 1584457 - RNA, 15 nt, Human adenovirus F
auccuuccaguaauc

SEQ ID NO: 1584458 - RNA, 20 nt, Human adenovirus F
gagcaagccgcugacggcgc

SEQ ID NO: 1584459 - RNA, 15 nt, Human adenovirus F
uuuaaaacuuuaugg

SEQ ID NO: 1584460 - RNA, 13 nt, Human adenovirus F
aggucaaaugcuc

SEQ ID NO: 1584461 - RNA, 15 nt, Human adenovirus F
ggacagcaggccgcu

SEQ ID NO: 1584462 - RNA, 14 nt, Human adenovirus F
guccaccugagggg

SEQ ID NO: 1584463 - RNA, 20 nt, Human adenovirus F
ggaggaaguagguggggccc

SEQ ID NO: 1584464 - RNA, 21 nt, Human adenovirus F
uacgacuccacguaggcucuc

SEQ ID NO: 1584465 - RNA, 17 nt, Human adenovirus F
aggccauccuggaccug

SEQ ID NO: 1584466 - RNA, 21 nt, Human adenovirus F
uccuuauucucaccuggcaaa

SEQ ID NO: 1584467 - RNA, 15 nt, Human adenovirus F
caaucccagcagaaa

SEQ ID NO: 1584468 - RNA, 19 nt, Human adenovirus F
ucaagaaccaacgcauucc

SEQ ID NO: 1584469 - RNA, 22 nt, Human adenovirus F
gaugaaucgcuggaaaaccuac

SEQ ID NO: 1584470 - RNA, 20 nt, Human adenovirus F
gcuguuguugauagcgccau

SEQ ID NO: 1584471 - RNA, 13 nt, Human adenovirus F
gaaaggaguaaag

SEQ ID NO: 1584472 - RNA, 20 nt, Human adenovirus F
auguguguuuuuuacugcua

SEQ ID NO: 1584473 - RNA, 21 nt, Human adenovirus F
aaaaaucuaccacagaaaugu

SEQ ID NO: 1584474 - RNA, 14 nt, Human adenovirus F
uccacgcucccgga

SEQ ID NO: 1584475 - RNA, 16 nt, Human adenovirus F
gcggcaaaagcuugag

SEQ ID NO: 1584476 - RNA, 22 nt, Human adenovirus F
gcuccuuuaacgcccgcugagc

SEQ ID NO: 1584477 - RNA, 17 nt, Human adenovirus F
gcaaucccagcagaaac

SEQ ID NO: 1584478 - RNA, 18 nt, Human adenovirus F
ggcaauggcucuguggag

SEQ ID NO: 1584479 - RNA, 14 nt, Human adenovirus F
aucacccaaagcca

SEQ ID NO: 1584480 - RNA, 15 nt, Human adenovirus F
cucggaccauucuga

SEQ ID NO: 1584481 - RNA, 15 nt, Human adenovirus F
gacagcugggacagc

SEQ ID NO: 1584482 - RNA, 18 nt, Human adenovirus F
caagcggguuaaaaagcg

SEQ ID NO: 1584483 - RNA, 22 nt, Human adenovirus F
aaugcuccgggauaagcuaaag

SEQ ID NO: 1584484 - RNA, 16 nt, Human adenovirus F
cauggcgggcaguggc

SEQ ID NO: 1584485 - RNA, 13 nt, Human adenovirus F
ggcaccagccagc

SEQ ID NO: 1584486 - RNA, 16 nt, Human adenovirus F
cuauuaaugcaaacaa

SEQ ID NO: 1584487 - RNA, 14 nt, Human adenovirus F
gccuacucuuacaa

SEQ ID NO: 1584488 - RNA, 19 nt, Human adenovirus F
acucucccuuuccagcaua

SEQ ID NO: 1584489 - RNA, 13 nt, Human adenovirus F
ggagugccgccgg

SEQ ID NO: 1584490 - RNA, 12 nt, Human adenovirus F
acugaaagccag

SEQ ID NO: 1584491 - RNA, 22 nt, Human adenovirus F
cacugauccacuuacaaccaaa

SEQ ID NO: 1584492 - RNA, 11 nt, Human adenovirus F
cuuuacaauua

SEQ ID NO: 1584493 - RNA, 22 nt, Human adenovirus F
gaugcagguaggaccacuggag

SEQ ID NO: 1584494 - RNA, 17 nt, Human adenovirus F
cugaccgaccuggggca

SEQ ID NO: 1584495 - RNA, 15 nt, Human adenovirus F
gaagagcugcuggag

SEQ ID NO: 1584496 - RNA, 14 nt, Human adenovirus F
uuugggagccagga

SEQ ID NO: 1584497 - RNA, 18 nt, Human adenovirus F
cacauuggcuggaggcuu

SEQ ID NO: 1584498 - RNA, 11 nt, Human adenovirus F
ccaggcagcag

SEQ ID NO: 1584499 - RNA, 15 nt, Human adenovirus F
ucaggcagcagcccc

SEQ ID NO: 1584500 - RNA, 16 nt, Human adenovirus F
uaccaaagacaaaauc

SEQ ID NO: 1584501 - RNA, 21 nt, Human adenovirus F
acugcuaaagggaacugccag

SEQ ID NO: 1584502 - RNA, 15 nt, Human adenovirus F
auccccaacaacccg

SEQ ID NO: 1584503 - RNA, 22 nt, Human adenovirus F
gccccuuggugaagguauuaac

SEQ ID NO: 1584504 - RNA, 20 nt, Human adenovirus F
gugccgcgcgggcaggagga

SEQ ID NO: 1584505 - RNA, 16 nt, Human adenovirus F
augcgccgagcggcug

SEQ ID NO: 1584506 - RNA, 20 nt, Human adenovirus F
cggcuccugugcagcgcgcu

SEQ ID NO: 1584507 - RNA, 17 nt, Human adenovirus F
uggggccuacggaaggg

SEQ ID NO: 1584508 - RNA, 14 nt, Human adenovirus F
ggaccacuggaggg

SEQ ID NO: 1584509 - RNA, 13 nt, Human adenovirus F
aaaguccagcgcg

SEQ ID NO: 1584510 - RNA, 16 nt, Human adenovirus F
cgcagccugagcugcc

SEQ ID NO: 1584511 - RNA, 17 nt, Human adenovirus F
gggcuuauuggcaugag

SEQ ID NO: 1584512 - RNA, 12 nt, Human adenovirus F
uauggaggagga

SEQ ID NO: 1584513 - RNA, 15 nt, Human adenovirus F
accaaacagguauaa

SEQ ID NO: 1584514 - RNA, 17 nt, Human adenovirus F
ggacucgucuccugcaa

SEQ ID NO: 1584515 - RNA, 20 nt, Human adenovirus F
aaaaccuguucuaaaaccaa

SEQ ID NO: 1584516 - RNA, 14 nt, Human adenovirus F
uggauacuggcaag

SEQ ID NO: 1584517 - RNA, 21 nt, Human adenovirus F
cuccaacguagagcucagcaa

SEQ ID NO: 1584518 - RNA, 15 nt, Human adenovirus F
uaaccaacucguuca

SEQ ID NO: 1584519 - RNA, 19 nt, Human adenovirus F
uugcuucuuugaauuuggg

SEQ ID NO: 1584520 - RNA, 12 nt, Human adenovirus F
ggacggcgccaa

SEQ ID NO: 1584521 - RNA, 14 nt, Human adenovirus F
ggacgggaucagag

SEQ ID NO: 1584522 - RNA, 22 nt, Human adenovirus F
acggagaugcagagaaaggagu

SEQ ID NO: 1584523 - RNA, 20 nt, Human adenovirus F
aagcuacaaggacaggaugu

SEQ ID NO: 1584524 - RNA, 21 nt, Human adenovirus F
cggcccugcaaagccaaccuu

SEQ ID NO: 1584525 - RNA, 19 nt, Human adenovirus F
caccucuguuugcugcacu

SEQ ID NO: 1584526 - RNA, 19 nt, Human adenovirus F
gccacagguccagaccuca

SEQ ID NO: 1584527 - RNA, 14 nt, Human adenovirus F
cucagacgacgagc

SEQ ID NO: 1584528 - RNA, 19 nt, Human adenovirus F
ggaggccauccuggaccug

SEQ ID NO: 1584529 - RNA, 20 nt, Human adenovirus F
uaaccaacggaggaaaacuc

SEQ ID NO: 1584530 - RNA, 17 nt, Human adenovirus F
cagcucaacgcaguggu

SEQ ID NO: 1584531 - RNA, 20 nt, Human adenovirus F
cgaauucguggccccuacca

SEQ ID NO: 1584532 - RNA, 14 nt, Human adenovirus F
aagagaaagaugga

SEQ ID NO: 1584533 - RNA, 12 nt, Human adenovirus F
aaacaaaaaacu

SEQ ID NO: 1584534 - RNA, 18 nt, Human adenovirus F
agcgggaacgcuuuaugc

SEQ ID NO: 1584535 - RNA, 16 nt, Human adenovirus F
uccagcaacuuuaugu

SEQ ID NO: 1584536 - RNA, 17 nt, Human adenovirus F
caaucgaccuaauuaca

SEQ ID NO: 1584537 - RNA, 21 nt, Human adenovirus F
acaaaacccccuaugugccca

SEQ ID NO: 1584538 - RNA, 22 nt, Human adenovirus F
gagaugcgccucaugagcuggg

SEQ ID NO: 1584539 - RNA, 18 nt, Human adenovirus F
gggugucugccagagggu

SEQ ID NO: 1584540 - RNA, 21 nt, Human adenovirus F
ucugcaucucuugaaugaggu

SEQ ID NO: 1584541 - RNA, 18 nt, Human adenovirus F
uacucauuaaaauucacc

SEQ ID NO: 1584542 - RNA, 17 nt, Human adenovirus F
uugauuuucugccacca

SEQ ID NO: 1584543 - RNA, 17 nt, Human adenovirus F
gcugugguuaaauuuaa

SEQ ID NO: 1584544 - RNA, 15 nt, Human adenovirus F
gcacugguaaaccag

SEQ ID NO: 1584545 - RNA, 19 nt, Human adenovirus F
cccccaccggcuccugugc

SEQ ID NO: 1584546 - RNA, 22 nt, Human adenovirus F
gcgcccgggcccuggaggcggc

SEQ ID NO: 1584547 - RNA, 14 nt, Human adenovirus F
ggcaugagggauuc

SEQ ID NO: 1584548 - RNA, 14 nt, Human adenovirus F
gcauccauaaaggu

SEQ ID NO: 1584549 - RNA, 20 nt, Human adenovirus F
ccgcauacuguuucacauau

SEQ ID NO: 1584550 - RNA, 21 nt, Human adenovirus F
uuugcgcaggcgaauaaaagg

SEQ ID NO: 1584551 - RNA, 22 nt, Human adenovirus F
ugcuacuacuuuaacucuuaca

SEQ ID NO: 1584552 - RNA, 23 nt, Human adenovirus F
cuugcaggagccgaauugccucg

SEQ ID NO: 1584553 - RNA, 13 nt, Human adenovirus F
gcgcgggcaggag

SEQ ID NO: 1584554 - RNA, 14 nt, Human adenovirus F
caacggcaauccca

SEQ ID NO: 1584555 - RNA, 14 nt, Human adenovirus F
caugcaacuuggaa

SEQ ID NO: 1584556 - RNA, 20 nt, Human adenovirus F
gauauuuguaaaagcgggcg

SEQ ID NO: 1584557 - RNA, 19 nt, Human adenovirus F
uccaaaucauugcauauaa

SEQ ID NO: 1584558 - RNA, 20 nt, Human adenovirus F
accugaaaaccauuuugcgc

SEQ ID NO: 1584559 - RNA, 19 nt, Human adenovirus F
gacagucugccaacacuaa

SEQ ID NO: 1584560 - RNA, 15 nt, Human adenovirus F
uaagggaggcagcag

SEQ ID NO: 1584561 - RNA, 15 nt, Human adenovirus F
auuuggagggcggca

SEQ ID NO: 1584562 - RNA, 16 nt, Human adenovirus F
cugacggcgcagcugu

SEQ ID NO: 1584563 - RNA, 20 nt, Human adenovirus F
gucgcguaacccgccgugga

SEQ ID NO: 1584564 - RNA, 14 nt, Human adenovirus F
acugaaagccagcc

SEQ ID NO: 1584565 - RNA, 18 nt, Human adenovirus F
accaccccuagucccucc

SEQ ID NO: 1584566 - RNA, 14 nt, Human adenovirus F
agcccgggccuggu

SEQ ID NO: 1584567 - RNA, 18 nt, Human adenovirus F
ugagugggguaacuuuua

SEQ ID NO: 1584568 - RNA, 15 nt, Human adenovirus F
gaggcgauuugggag

SEQ ID NO: 1584569 - RNA, 21 nt, Human adenovirus F
caaacaacgaacuuucucucu

SEQ ID NO: 1584570 - RNA, 19 nt, Human adenovirus F
ggugcagccgugaagccaa

SEQ ID NO: 1584571 - RNA, 12 nt, Human adenovirus F
accucccaaagu

SEQ ID NO: 1584572 - RNA, 13 nt, Human adenovirus F
cagcgcccgccuc

SEQ ID NO: 1584573 - RNA, 21 nt, Human adenovirus F
agcauugugguacaggagcgc

SEQ ID NO: 1584574 - RNA, 19 nt, Human adenovirus F
gacuccgugguagccgaug

SEQ ID NO: 1584575 - RNA, 19 nt, Human adenovirus F
caaggcguaaagacugaca

SEQ ID NO: 1584576 - RNA, 17 nt, Human adenovirus F
auguccuuaaggaggag

SEQ ID NO: 1584577 - RNA, 19 nt, Human adenovirus F
ccugcaauggcagcccagc

SEQ ID NO: 1584578 - RNA, 20 nt, Human adenovirus F
ucacauaucgucacuuccgc

SEQ ID NO: 1584579 - RNA, 18 nt, Human adenovirus F
uggaagugcuaggcucuu

SEQ ID NO: 1584580 - RNA, 24 nt, Human adenovirus F
ccccgggaguuuuagcacucaagu

SEQ ID NO: 1584581 - RNA, 15 nt, Human adenovirus F
ccacucgggaaagac

SEQ ID NO: 1584582 - RNA, 17 nt, Human adenovirus F
gaggaggccauccugga

SEQ ID NO: 1584583 - RNA, 19 nt, Human adenovirus F
agcguacgguugcccgcca

SEQ ID NO: 1584584 - RNA, 19 nt, Human adenovirus F
ugauucuccaaagcagucu

SEQ ID NO: 1584585 - RNA, 23 nt, Human adenovirus F
gguucugaaguucagaacauggc

SEQ ID NO: 1584586 - RNA, 16 nt, Human adenovirus F
uucucaccuggcaaac

SEQ ID NO: 1584587 - RNA, 14 nt, Human adenovirus F
gugcuuggaagagc

SEQ ID NO: 1584588 - RNA, 15 nt, Human adenovirus F
uggaccuggaagagg

SEQ ID NO: 1584589 - RNA, 20 nt, Human adenovirus F
ccaucgugcgcgaacugggc

SEQ ID NO: 1584590 - RNA, 23 nt, Human adenovirus F
aagacguuaagguaaagccacaa

SEQ ID NO: 1584591 - RNA, 17 nt, Human adenovirus F
uucuccugcuugucugu

SEQ ID NO: 1584592 - RNA, 18 nt, Human adenovirus F
gaacagaccuuccaggaa

SEQ ID NO: 1584593 - RNA, 18 nt, Human adenovirus F
auuaguuguacaaaguca

SEQ ID NO: 1584594 - RNA, 18 nt, Human adenovirus F
caaggcguaaagacugac

SEQ ID NO: 1584595 - RNA, 14 nt, Human adenovirus F
aaaugccucccuuu

SEQ ID NO: 1584596 - RNA, 18 nt, Human adenovirus F
guaguuuugcuccagggu

SEQ ID NO: 1584597 - RNA, 18 nt, Human adenovirus F
ggcucaauguaacaugac

SEQ ID NO: 1584598 - RNA, 15 nt, Human adenovirus F
ugcauuauggccaug

SEQ ID NO: 1584599 - RNA, 17 nt, Human adenovirus F
cagcgguaucugcgugg

SEQ ID NO: 1584600 - RNA, 21 nt, Human adenovirus F
cuuaccgcgacaaagcacaca

SEQ ID NO: 1584601 - RNA, 18 nt, Human adenovirus F
gaguucuugcugacggcc

SEQ ID NO: 1584602 - RNA, 19 nt, Human adenovirus F
gcacucgcuccacccgccg

SEQ ID NO: 1584603 - RNA, 19 nt, Human adenovirus F
guuucgcacuccacuaacc

SEQ ID NO: 1584604 - RNA, 16 nt, Human adenovirus F
ggcgcuugccaggguu

SEQ ID NO: 1584605 - RNA, 20 nt, Human adenovirus F
gcagugggacgaggaggaga

SEQ ID NO: 1584606 - RNA, 18 nt, Human adenovirus F
uauucaccaccuuuaaaa

SEQ ID NO: 1584607 - RNA, 21 nt, Human adenovirus F
auaaaagcuucuaucugcaaa

SEQ ID NO: 1584608 - RNA, 13 nt, Human adenovirus F
aggagcagaugga

SEQ ID NO: 1584609 - RNA, 21 nt, Human adenovirus F
uccagcguucaaaaccucuua

SEQ ID NO: 1584610 - RNA, 18 nt, Human adenovirus F
ugagcaaagacauuccca

SEQ ID NO: 1584611 - RNA, 19 nt, Human adenovirus F
uguuaucggggugggaaac

SEQ ID NO: 1584612 - RNA, 14 nt, Human adenovirus F
auacguuagagugg

SEQ ID NO: 1584613 - RNA, 22 nt, Human adenovirus F
ccgugauugauagugugguggc

SEQ ID NO: 1584614 - RNA, 19 nt, Human adenovirus F
agccuucaggcagcagccc

SEQ ID NO: 1584615 - RNA, 22 nt, Human adenovirus F
uugugaucagaaauuuagauuu

SEQ ID NO: 1584616 - RNA, 13 nt, Human adenovirus F
cacaggaagaggg

SEQ ID NO: 1584617 - RNA, 14 nt, Human adenovirus F
cugcacuaugccuu

SEQ ID NO: 1584618 - RNA, 20 nt, Human adenovirus F
agcacaggcggaccuuuuac

SEQ ID NO: 1584619 - RNA, 14 nt, Human adenovirus F
cgggugcaguggcg

SEQ ID NO: 1584620 - RNA, 16 nt, Human adenovirus F
uucugagucuaccacu

SEQ ID NO: 1584621 - RNA, 16 nt, Human adenovirus F
aagucauccaaaucau

SEQ ID NO: 1584622 - RNA, 20 nt, Human adenovirus F
auuuugacgaucgcuccagg

SEQ ID NO: 1584623 - RNA, 21 nt, Human adenovirus F
ucccuucccgacaugaugcaa

SEQ ID NO: 1584624 - RNA, 21 nt, Human adenovirus F
gcccccaaaggugcucccaau

SEQ ID NO: 1584625 - RNA, 22 nt, Human adenovirus F
guccuggccaacugccaccucc

SEQ ID NO: 1584626 - RNA, 20 nt, Human adenovirus F
aaaguagcucuuccaagcug

SEQ ID NO: 1584627 - RNA, 17 nt, Human adenovirus F
aaaaccuacgcccagga

SEQ ID NO: 1584628 - RNA, 22 nt, Human adenovirus F
cagugcuuggaagagcaaaacc

SEQ ID NO: 1584629 - RNA, 22 nt, Human adenovirus F
uucacaaaauggacgaagacug

SEQ ID NO: 1584630 - RNA, 14 nt, Human adenovirus F
ccaucgccagcgac

SEQ ID NO: 1584631 - RNA, 21 nt, Human adenovirus F
aggccagucggcaggcuuccu

SEQ ID NO: 1584632 - RNA, 18 nt, Human adenovirus F
cagccauguuauggguca

SEQ ID NO: 1584633 - RNA, 18 nt, Human adenovirus F
uacucggagcuggcgccu

SEQ ID NO: 1584634 - RNA, 22 nt, Human adenovirus F
agcauuuauaaucaugcaauag

SEQ ID NO: 1584635 - RNA, 20 nt, Human adenovirus F
gaagguugacuugcaggaga

SEQ ID NO: 1584636 - RNA, 20 nt, Human adenovirus F
ccacggaugugaccuguggg

SEQ ID NO: 1584637 - RNA, 13 nt, Human adenovirus F
gucugucugccaa

SEQ ID NO: 1584638 - RNA, 15 nt, Human adenovirus F
acaccgcuuccaccu

SEQ ID NO: 1584639 - RNA, 22 nt, Human adenovirus F
ggaggauuuugaguuagcucug

SEQ ID NO: 1584640 - RNA, 20 nt, Human adenovirus F
cuaucccgccccugccaccg

SEQ ID NO: 1584641 - RNA, 23 nt, Human adenovirus F
gccgcccuaaccucuaccccgcg

SEQ ID NO: 1584642 - RNA, 23 nt, Human adenovirus F
cuaaggacgguggcaugagggau

SEQ ID NO: 1584643 - RNA, 12 nt, Human adenovirus F
acaacuacggag

SEQ ID NO: 1584644 - RNA, 23 nt, Human adenovirus F
gcuucucagcucaacgcaguggu

SEQ ID NO: 1584645 - RNA, 15 nt, Human adenovirus F
gcuguaccaggaggc

SEQ ID NO: 1584646 - RNA, 14 nt, Human adenovirus F
gccccuuggugaag

SEQ ID NO: 1584647 - RNA, 17 nt, Human adenovirus F
augggggcggaccugca

SEQ ID NO: 1584648 - RNA, 21 nt, Human adenovirus F
agacgaggaggcggaggagca

SEQ ID NO: 1584649 - RNA, 11 nt, Human adenovirus F
ccaaaccaaau

SEQ ID NO: 1584650 - RNA, 15 nt, Human adenovirus F
gagccacagguccag

SEQ ID NO: 1584651 - RNA, 16 nt, Human adenovirus F
cuuaacccuaagcaca

SEQ ID NO: 1584652 - RNA, 14 nt, Human adenovirus F
ucuucaucccagcc

SEQ ID NO: 1584653 - RNA, 20 nt, Human adenovirus F
ggacaaagagaaagauggaa

SEQ ID NO: 1584654 - RNA, 14 nt, Human adenovirus F
cgucauccgccucc

SEQ ID NO: 1584655 - RNA, 20 nt, Human adenovirus F
gaggcauuuuagggcguaga

SEQ ID NO: 1584656 - RNA, 23 nt, Human adenovirus F
acgcugccaacaaauguucgcaa

SEQ ID NO: 1584657 - RNA, 18 nt, Human adenovirus F
aacucaaacaacaaaauc

SEQ ID NO: 1584658 - RNA, 21 nt, Human adenovirus F
aagaaauccacuuaccagagc

SEQ ID NO: 1584659 - RNA, 19 nt, Human adenovirus F
aaaccuacgcccaggagca

SEQ ID NO: 1584660 - RNA, 15 nt, Human adenovirus F
ugccggcucuaggca

SEQ ID NO: 1584661 - RNA, 13 nt, Human adenovirus F
ggaucauguccac

SEQ ID NO: 1584662 - RNA, 19 nt, Human adenovirus F
gaauguaacucucccuuuc

SEQ ID NO: 1584663 - RNA, 20 nt, Human adenovirus F
uaccgucaucucuacagccc

SEQ ID NO: 1584664 - RNA, 18 nt, Human adenovirus F
cauuuaugcccaacagua

SEQ ID NO: 1584665 - RNA, 14 nt, Human adenovirus F
guuuuaauggaaac

SEQ ID NO: 1584666 - RNA, 19 nt, Human adenovirus F
acgacggggauacugcucc

SEQ ID NO: 1584667 - RNA, 19 nt, Human adenovirus F
cuuaacucugaagaugucu

SEQ ID NO: 1584668 - RNA, 14 nt, Human adenovirus F
cauccauccaucac

SEQ ID NO: 1584669 - RNA, 24 nt, Human adenovirus F
uguucaccuuuuuacccugaccca

SEQ ID NO: 1584670 - RNA, 19 nt, Human adenovirus F
gacucguaccuuggucauc

SEQ ID NO: 1584671 - RNA, 16 nt, Human adenovirus F
guccaggaaggccucg

SEQ ID NO: 1584672 - RNA, 17 nt, Human adenovirus F
cggacgggucgcagcag

SEQ ID NO: 1584673 - RNA, 22 nt, Human adenovirus F
cgcccaggagcagcgggaagag

SEQ ID NO: 1584674 - RNA, 19 nt, Human adenovirus F
acuguuucuccuccccuua

SEQ ID NO: 1584675 - RNA, 23 nt, Human adenovirus F
auaugucacagccuguuacuauu

SEQ ID NO: 1584676 - RNA, 14 nt, Human adenovirus F
gguuuagccacauc

SEQ ID NO: 1584677 - RNA, 14 nt, Human adenovirus F
gcaaggaaccagug

SEQ ID NO: 1584678 - RNA, 17 nt, Human adenovirus F
acuggaguaacacaaug

SEQ ID NO: 1584679 - RNA, 13 nt, Human adenovirus F
ccgagcggcugcu

SEQ ID NO: 1584680 - RNA, 20 nt, Human adenovirus F
uggaggagauggugggccgc

SEQ ID NO: 1584681 - RNA, 22 nt, Human adenovirus F
accuuaaccacccccaacucug

SEQ ID NO: 1584682 - RNA, 19 nt, Human adenovirus F
caaccuucaaacccagccg

SEQ ID NO: 1584683 - RNA, 17 nt, Human adenovirus F
acaacccgucuucccuc

SEQ ID NO: 1584684 - RNA, 21 nt, Human adenovirus F
gcaugcccgagccggagaggg

SEQ ID NO: 1584685 - RNA, 23 nt, Human adenovirus F
ccagcguucaaaaccucuuacaa

SEQ ID NO: 1584686 - RNA, 20 nt, Human adenovirus F
ccuguuacuauuaaugcaaa

SEQ ID NO: 1584687 - RNA, 17 nt, Human adenovirus F
acccgcacuggaugcca

SEQ ID NO: 1584688 - RNA, 15 nt, Human adenovirus F
cacugaccggcaccu

SEQ ID NO: 1584689 - RNA, 20 nt, Human adenovirus F
cgucgcgaacucuggacguc

SEQ ID NO: 1584690 - RNA, 14 nt, Human adenovirus F
cgacagccagcugu

SEQ ID NO: 1584691 - RNA, 20 nt, Human adenovirus F
uuuugaugaagcgugguaaa

SEQ ID NO: 1584692 - RNA, 16 nt, Human adenovirus F
gaggcuauuggccaga

SEQ ID NO: 1584693 - RNA, 18 nt, Human adenovirus F
ggugauaucauuaaaaag

SEQ ID NO: 1584694 - RNA, 22 nt, Human adenovirus F
cgagcuuuuacugggacagcag

SEQ ID NO: 1584695 - RNA, 16 nt, Human adenovirus F
gcgcgaacugggcugc

SEQ ID NO: 1584696 - RNA, 19 nt, Human adenovirus F
gucgccaucaugagucugu

SEQ ID NO: 1584697 - RNA, 21 nt, Human adenovirus F
ggacgccgaggcacuguucaa

SEQ ID NO: 1584698 - RNA, 17 nt, Human adenovirus F
cacuagcgccccugcag

SEQ ID NO: 1584699 - RNA, 17 nt, Human adenovirus F
cuuugucagccaaagua

SEQ ID NO: 1584700 - RNA, 15 nt, Human adenovirus F
cugaaguucagaaca

SEQ ID NO: 1584701 - RNA, 15 nt, Human adenovirus F
ucuaagggaggcagc

SEQ ID NO: 1584702 - RNA, 23 nt, Human adenovirus F
gaccucagggucgauggagccag

SEQ ID NO: 1584703 - RNA, 17 nt, Human adenovirus F
augagacgugcgguggg

SEQ ID NO: 1584704 - RNA, 16 nt, Human adenovirus F
ccgccguggacgcacg

SEQ ID NO: 1584705 - RNA, 14 nt, Human adenovirus F
agcuaucagccgca

SEQ ID NO: 1584706 - RNA, 15 nt, Human adenovirus F
ucacucucagcugcu

SEQ ID NO: 1584707 - RNA, 15 nt, Human adenovirus F
ccaacgugcaggcca

SEQ ID NO: 1584708 - RNA, 16 nt, Human adenovirus F
aauggcagcccagcgc

SEQ ID NO: 1584709 - RNA, 12 nt, Human adenovirus F
cgccgccccugg

SEQ ID NO: 1584710 - RNA, 14 nt, Human adenovirus F
cggcgggaagagga

SEQ ID NO: 1584711 - RNA, 15 nt, Human adenovirus F
cuaugaguggaacuu

SEQ ID NO: 1584712 - RNA, 17 nt, Human adenovirus F
auucccuuuuccagcaa

SEQ ID NO: 1584713 - RNA, 11 nt, Human adenovirus F
cuauugccagc

SEQ ID NO: 1584714 - RNA, 21 nt, Human adenovirus F
agcucuaaauaugucacagcc

SEQ ID NO: 1584715 - RNA, 15 nt, Human adenovirus F
agagcuaaggaggag

SEQ ID NO: 1584716 - RNA, 22 nt, Human adenovirus F
gaccuuccaggaaaucaccagc

SEQ ID NO: 1584717 - RNA, 20 nt, Human adenovirus F
aacaaaaaaaaaauauuaau

SEQ ID NO: 1584718 - RNA, 16 nt, Human adenovirus F
cagccccaggccaacc

SEQ ID NO: 1584719 - RNA, 20 nt, Human adenovirus F
uccauguggaaccaggcagu

SEQ ID NO: 1584720 - RNA, 21 nt, Human adenovirus F
aagugcagaggcguacaugcc

SEQ ID NO: 1584721 - RNA, 22 nt, Human adenovirus F
ccaccuugauacggauugucuu

SEQ ID NO: 1584722 - RNA, 12 nt, Human adenovirus F
uccggaggcagu

SEQ ID NO: 1584723 - RNA, 18 nt, Human adenovirus F
augguugaaaaagaucag

SEQ ID NO: 1584724 - RNA, 13 nt, Human adenovirus F
agaccucaccucg

SEQ ID NO: 1584725 - RNA, 16 nt, Human adenovirus F
cagcagccccaggcca

SEQ ID NO: 1584726 - RNA, 21 nt, Human adenovirus F
aagaauacuaaaacaaaccac

SEQ ID NO: 1584727 - RNA, 23 nt, Human adenovirus F
agguuugacagcauuaaccugua

SEQ ID NO: 1584728 - RNA, 18 nt, Human adenovirus F
gccuugggaugcagccuu

SEQ ID NO: 1584729 - RNA, 15 nt, Human adenovirus F
aucuaucccuugauu

SEQ ID NO: 1584730 - RNA, 22 nt, Human adenovirus F
gcaguguuauaagguccacacu

SEQ ID NO: 1584731 - RNA, 22 nt, Human adenovirus F
uaaagacguuaagguaaagcca

SEQ ID NO: 1584732 - RNA, 21 nt, Human adenovirus F
auaacuuucuuacacuagcca

SEQ ID NO: 1584733 - RNA, 15 nt, Human adenovirus F
acugacgcugcgcuu

SEQ ID NO: 1584734 - RNA, 16 nt, Human adenovirus F
aagauggcgugggagu

SEQ ID NO: 1584735 - RNA, 19 nt, Human adenovirus F
uccaaaggucagaaaaacc

SEQ ID NO: 1584736 - RNA, 18 nt, Human adenovirus F
cgcucccaaucgaccuaa

SEQ ID NO: 1584737 - RNA, 14 nt, Human adenovirus F
caacgcugcaggcg

SEQ ID NO: 1584738 - RNA, 20 nt, Human adenovirus F
uaaccacccccaacucugag

SEQ ID NO: 1584739 - RNA, 13 nt, Human adenovirus F
gcaucucaaagcu

SEQ ID NO: 1584740 - RNA, 22 nt, Human adenovirus F
acagaauucuaaccguuaaucu

SEQ ID NO: 1584741 - RNA, 22 nt, Human adenovirus F
agacauuguuuugcuaccuggu

SEQ ID NO: 1584742 - RNA, 15 nt, Human adenovirus F
ugccgcggacgucaa

SEQ ID NO: 1584743 - RNA, 23 nt, Human adenovirus F
cgucuaccccuaugacaccuccu

SEQ ID NO: 1584744 - RNA, 18 nt, Human adenovirus F
acgagguagugagcucuu

SEQ ID NO: 1584745 - RNA, 18 nt, Human adenovirus F
uugccggcaacgcugcag

SEQ ID NO: 1584746 - RNA, 16 nt, Human adenovirus F
agaugcgauuuuccaa

SEQ ID NO: 1584747 - RNA, 21 nt, Human adenovirus F
gcaacucauggugccaaagcg

SEQ ID NO: 1584748 - RNA, 16 nt, Human adenovirus F
cgcaugccuccagcac

SEQ ID NO: 1584749 - RNA, 19 nt, Human adenovirus F
agcuacguugcgauacugc

SEQ ID NO: 1584750 - RNA, 20 nt, Human adenovirus F
gccugaucccgaagagggua

SEQ ID NO: 1584751 - RNA, 22 nt, Human adenovirus F
agggggaggacuuuuuaaagga

SEQ ID NO: 1584752 - RNA, 12 nt, Human adenovirus F
aacgagcaggcc

SEQ ID NO: 1584753 - RNA, 17 nt, Human adenovirus F
cacggggucuauuugga

SEQ ID NO: 1584754 - RNA, 17 nt, Human adenovirus F
uggcuuuuggaccuggu

SEQ ID NO: 1584755 - RNA, 13 nt, Human adenovirus F
auuacagguauaa

SEQ ID NO: 1584756 - RNA, 17 nt, Human adenovirus F
uaaaacuuuauggaugu

SEQ ID NO: 1584757 - RNA, 17 nt, Human adenovirus F
cggacuuggcgugcaga

SEQ ID NO: 1584758 - RNA, 12 nt, Human adenovirus F
acgcacgcugac

SEQ ID NO: 1584759 - RNA, 23 nt, Human adenovirus F
agaccucaacgcggggcaccuuc

SEQ ID NO: 1584760 - RNA, 13 nt, Human adenovirus F
gaggccauccugg

SEQ ID NO: 1584761 - RNA, 21 nt, Human adenovirus F
gucagaacggcgugcuggaaa

SEQ ID NO: 1584762 - RNA, 23 nt, Human adenovirus F
agaugcgccucaugagcugggag

SEQ ID NO: 1584763 - RNA, 14 nt, Human adenovirus F
ggucuuacaugcac

SEQ ID NO: 1584764 - RNA, 19 nt, Human adenovirus F
aggcccuugugccugaaau

SEQ ID NO: 1584765 - RNA, 15 nt, Human adenovirus F
ccguuaaucucccuc

SEQ ID NO: 1584766 - RNA, 16 nt, Human adenovirus F
accuccucaacuccca

SEQ ID NO: 1584767 - RNA, 18 nt, Human adenovirus F
uaggacgucagaacggcg

SEQ ID NO: 1584768 - RNA, 16 nt, Human adenovirus F
agggaucgcagcgggc

SEQ ID NO: 1584769 - RNA, 17 nt, Human adenovirus F
uccgcugggagaaaacc

SEQ ID NO: 1584770 - RNA, 19 nt, Human adenovirus F
caagugucccacugcaacu

SEQ ID NO: 1584771 - RNA, 23 nt, Human adenovirus F
cuggaacgagaucggcaccagcc

SEQ ID NO: 1584772 - RNA, 17 nt, Human adenovirus F
acaaucgcgauguguuu

SEQ ID NO: 1584773 - RNA, 21 nt, Human adenovirus F
ugaaaaccauuuugcgcacca

SEQ ID NO: 1584774 - RNA, 14 nt, Human adenovirus F
gaggacgagcccug

SEQ ID NO: 1584775 - RNA, 19 nt, Human adenovirus F
accgcugcagcugcugccg

SEQ ID NO: 1584776 - RNA, 14 nt, Human adenovirus F
ugacgugccugagg

SEQ ID NO: 1584777 - RNA, 15 nt, Human adenovirus F
uuccugcgcugcuac

SEQ ID NO: 1584778 - RNA, 17 nt, Human adenovirus F
ugggagucuggcagcag

SEQ ID NO: 1584779 - RNA, 12 nt, Human adenovirus F
gccccaccgccc

SEQ ID NO: 1584780 - RNA, 19 nt, Human adenovirus F
aggccauccuggaccugga

SEQ ID NO: 1584781 - RNA, 13 nt, Human adenovirus F
agcuggagggcaa

SEQ ID NO: 1584782 - RNA, 18 nt, Human adenovirus F
accggaguaugccuugca

SEQ ID NO: 1584783 - RNA, 13 nt, Human adenovirus F
cugacccuuccca

SEQ ID NO: 1584784 - RNA, 13 nt, Human adenovirus F
ucaacgcaguggu

SEQ ID NO: 1584785 - RNA, 12 nt, Human adenovirus F
uccgcccgcucc

SEQ ID NO: 1584786 - RNA, 17 nt, Human adenovirus F
caacugcagcgcacgcu

SEQ ID NO: 1584787 - RNA, 23 nt, Human adenovirus F
gaaucuaaccacuaccacccucc

SEQ ID NO: 1584788 - RNA, 14 nt, Human adenovirus F
aaacaugaggagga

SEQ ID NO: 1584789 - RNA, 15 nt, Human adenovirus F
gagaggcgguggcgc

SEQ ID NO: 1584790 - RNA, 18 nt, Human adenovirus F
cguauucacaaagcugug

SEQ ID NO: 1584791 - RNA, 20 nt, Human adenovirus F
uccagcauaauaacucuggc

SEQ ID NO: 1584792 - RNA, 18 nt, Human adenovirus F
ggcgauggggccuuggga

SEQ ID NO: 1584793 - RNA, 23 nt, Human adenovirus F
guuucgcacuccacuaaccaggc

SEQ ID NO: 1584794 - RNA, 15 nt, Human adenovirus F
auuggucaaaaacuc

SEQ ID NO: 1584795 - RNA, 16 nt, Human adenovirus F
ccagaugucaacggca

SEQ ID NO: 1584796 - RNA, 23 nt, Human adenovirus F
cucgauuuccauaaacuccucuu

SEQ ID NO: 1584797 - RNA, 15 nt, Human adenovirus F
acaaaagcaguggga

SEQ ID NO: 1584798 - RNA, 16 nt, Human adenovirus F
acggcgcagcagaucc

SEQ ID NO: 1584799 - RNA, 20 nt, Human adenovirus F
aggcauaaaguugcggguga

SEQ ID NO: 1584800 - RNA, 17 nt, Human adenovirus F
ugacgaagacauucuug

SEQ ID NO: 1584801 - RNA, 22 nt, Human adenovirus F
uaucacuaaaaccaacaaaauc

SEQ ID NO: 1584802 - RNA, 16 nt, Human adenovirus F
gcuacggaggaagagg

SEQ ID NO: 1584803 - RNA, 21 nt, Human adenovirus F
uggccgcacucagcgaaccca

SEQ ID NO: 1584804 - RNA, 14 nt, Human adenovirus F
caguucgcccgugc

SEQ ID NO: 1584805 - RNA, 21 nt, Human adenovirus F
ggaguggcauuaaaaacuuug

SEQ ID NO: 1584806 - RNA, 21 nt, Human adenovirus F
gcaaacgagaggaccacuuaa

SEQ ID NO: 1584807 - RNA, 18 nt, Human adenovirus F
cguccaguggagcaaggg

SEQ ID NO: 1584808 - RNA, 11 nt, Human adenovirus F
ccuuccacuuu

SEQ ID NO: 1584809 - RNA, 12 nt, Human adenovirus F
auggaguugugg

SEQ ID NO: 1584810 - RNA, 16 nt, Human adenovirus F
acuggagggcgucaug

SEQ ID NO: 1584811 - RNA, 19 nt, Human adenovirus F
aucaugcuucugacaugcu

SEQ ID NO: 1584812 - RNA, 16 nt, Human adenovirus F
aaagcuggagcucaca

SEQ ID NO: 1584813 - RNA, 20 nt, Human adenovirus F
ggacccuucaacggaauugu

SEQ ID NO: 1584814 - RNA, 21 nt, Human adenovirus F
caccucuguuugcugcacugc

SEQ ID NO: 1584815 - RNA, 23 nt, Human adenovirus F
cuuccucguuguuuuccucugac

SEQ ID NO: 1584816 - RNA, 18 nt, Human adenovirus F
cgcggcggcuauugccag

SEQ ID NO: 1584817 - RNA, 16 nt, Human adenovirus F
gguaggaacuugaagc

SEQ ID NO: 1584818 - RNA, 20 nt, Human adenovirus F
ggcgugggaguuggaggaga

SEQ ID NO: 1584819 - RNA, 23 nt, Human adenovirus F
gacgacugggcggcggccaugga

SEQ ID NO: 1584820 - RNA, 12 nt, Human adenovirus F
cgggccuggugc

SEQ ID NO: 1584821 - RNA, 21 nt, Human adenovirus F
cgaguucacuuugccagaggg

SEQ ID NO: 1584822 - RNA, 18 nt, Human adenovirus F
caaucagcggcuggaaaa

SEQ ID NO: 1584823 - RNA, 17 nt, Human adenovirus F
guuggugaugcccggcg

SEQ ID NO: 1584824 - RNA, 16 nt, Human adenovirus F
cuacauccauuuccac

SEQ ID NO: 1584825 - RNA, 13 nt, Human adenovirus F
uaaacccacagcu

SEQ ID NO: 1584826 - RNA, 16 nt, Human adenovirus F
ucaaccaacuaacacu

SEQ ID NO: 1584827 - RNA, 14 nt, Human adenovirus F
gcagcgggcaggag

SEQ ID NO: 1584828 - RNA, 20 nt, Human adenovirus F
agggauacuagcaaacagug

SEQ ID NO: 1584829 - RNA, 16 nt, Human adenovirus F
augggcaccuggaacg

SEQ ID NO: 1584830 - RNA, 15 nt, Human adenovirus F
gguagugagcucuuc

SEQ ID NO: 1584831 - RNA, 23 nt, Human adenovirus F
gccaauuaucuacgccuccacca

SEQ ID NO: 1584832 - RNA, 19 nt, Human adenovirus F
gcauaguugcucccaaagu

SEQ ID NO: 1584833 - RNA, 12 nt, Human adenovirus F
cggggugggaaa

SEQ ID NO: 1584834 - RNA, 21 nt, Human adenovirus F
gacagggcgcuaacugugcau

SEQ ID NO: 1584835 - RNA, 17 nt, Human adenovirus F
uaaaaacuugcaaggaa

SEQ ID NO: 1584836 - RNA, 23 nt, Human adenovirus F
ucuggaaucagcaucuuaggaag

SEQ ID NO: 1584837 - RNA, 21 nt, Human adenovirus F
gccuaagugugacauuacuuc

SEQ ID NO: 1584838 - RNA, 14 nt, Human adenovirus F
cucugaacacuuuu

SEQ ID NO: 1584839 - RNA, 17 nt, Human adenovirus F
ccauauuauuuaaauaa

SEQ ID NO: 1584840 - RNA, 15 nt, Human adenovirus F
cgagauaaacagugg

SEQ ID NO: 1584841 - RNA, 21 nt, Human adenovirus F
aaagagaguucaacagaauca

SEQ ID NO: 1584842 - RNA, 15 nt, Human adenovirus F
auggcccgaccugua

SEQ ID NO: 1584843 - RNA, 14 nt, Human adenovirus F
gacagcaaggaaag

SEQ ID NO: 1584844 - RNA, 19 nt, Human adenovirus F
ccucuucuccugcuugucu

SEQ ID NO: 1584845 - RNA, 18 nt, Human adenovirus F
cuaaggacuucaccuaca

SEQ ID NO: 1584846 - RNA, 20 nt, Human adenovirus F
acaaggacagucugccaaca

SEQ ID NO: 1584847 - RNA, 21 nt, Human adenovirus F
gaacacgcugccaacaaaugu

SEQ ID NO: 1584848 - RNA, 21 nt, Human adenovirus F
uacacugauccacuuacaacc

SEQ ID NO: 1584849 - RNA, 18 nt, Human adenovirus F
uucggcuugcauaaaagc

SEQ ID NO: 1584850 - RNA, 22 nt, Human adenovirus F
ccgagcuuuuacugggacagca

SEQ ID NO: 1584851 - RNA, 15 nt, Human adenovirus F
acgagcuugcucgcu

SEQ ID NO: 1584852 - RNA, 15 nt, Human adenovirus F
acagccccagcuggu

SEQ ID NO: 1584853 - RNA, 13 nt, Human adenovirus F
gugcaacacagcc

SEQ ID NO: 1584854 - RNA, 14 nt, Human adenovirus F
ugaacguugcauua

SEQ ID NO: 1584855 - RNA, 22 nt, Human adenovirus F
gcuacaguuucgcgcaccucuu

SEQ ID NO: 1584856 - RNA, 19 nt, Human adenovirus F
ggccauggucauuuuuuca

SEQ ID NO: 1584857 - RNA, 22 nt, Human adenovirus F
ggcuccgacgcuuggcaccgcc

SEQ ID NO: 1584858 - RNA, 16 nt, Human adenovirus F
caacgcagugguggac

SEQ ID NO: 1584859 - RNA, 17 nt, Human adenovirus F
cgauggagccagcguca

SEQ ID NO: 1584860 - RNA, 17 nt, Human adenovirus F
ugcugaauauugcggag

SEQ ID NO: 1584861 - RNA, 13 nt, Human adenovirus F
uuuaugaaucacu

SEQ ID NO: 1584862 - RNA, 21 nt, Human adenovirus F
aggcgagaaaauauggaggag

SEQ ID NO: 1584863 - RNA, 12 nt, Human adenovirus F
cuuucuuacaac

SEQ ID NO: 1584864 - RNA, 18 nt, Human adenovirus F
gguggaauuacugccagu

SEQ ID NO: 1584865 - RNA, 17 nt, Human adenovirus F
uugacauuccuccgccu

SEQ ID NO: 1584866 - RNA, 19 nt, Human adenovirus F
aaaucuaccacagaaaugu

SEQ ID NO: 1584867 - RNA, 13 nt, Human adenovirus F
gcgggaagagagg

SEQ ID NO: 1584868 - RNA, 18 nt, Human adenovirus F
gcauacguuacucggagc

SEQ ID NO: 1584869 - RNA, 12 nt, Human adenovirus F
ggcccuggaggc

SEQ ID NO: 1584870 - RNA, 21 nt, Human adenovirus F
agaacugggaguugcgcgccg

SEQ ID NO: 1584871 - RNA, 13 nt, Human adenovirus F
cagcaccauuagc

SEQ ID NO: 1584872 - RNA, 14 nt, Human adenovirus F
cuguucuaaaacca

SEQ ID NO: 1584873 - RNA, 14 nt, Human adenovirus F
caucuucaccucug

SEQ ID NO: 1584874 - RNA, 21 nt, Human adenovirus F
aaaagugaaccggaaaaccaa

SEQ ID NO: 1584875 - RNA, 16 nt, Human adenovirus F
ccaggcguggccuccg

SEQ ID NO: 1584876 - RNA, 18 nt, Human adenovirus F
gcugugucagcuaacucu

SEQ ID NO: 1584877 - RNA, 16 nt, Human adenovirus F
guguaccugucgccca

SEQ ID NO: 1584878 - RNA, 20 nt, Human adenovirus F
ggacacggggucuauuugga

SEQ ID NO: 1584879 - RNA, 12 nt, Human adenovirus F
agaugaggagga

SEQ ID NO: 1584880 - RNA, 22 nt, Human adenovirus F
aggccgagguauccagcucaac

SEQ ID NO: 1584881 - RNA, 16 nt, Human adenovirus F
aaaaaggcuaaucauu

SEQ ID NO: 1584882 - RNA, 20 nt, Human adenovirus F
uaaaccaauuugcuaacacu

SEQ ID NO: 1584883 - RNA, 23 nt, Human adenovirus F
auuuaauggcacaguguuugcuu

SEQ ID NO: 1584884 - RNA, 18 nt, Human adenovirus F
gaagcuugcccuuggaaa

SEQ ID NO: 1584885 - RNA, 12 nt, Human adenovirus F
gagcgccauccc

SEQ ID NO: 1584886 - RNA, 14 nt, Human adenovirus F
gcuaaccugugcag

SEQ ID NO: 1584887 - RNA, 18 nt, Human adenovirus F
agaguuugggagccagga

SEQ ID NO: 1584888 - RNA, 17 nt, Human adenovirus F
ucacggaacccugccgc

SEQ ID NO: 1584889 - RNA, 18 nt, Human adenovirus F
cuaccgcgaaugcccccc

SEQ ID NO: 1584890 - RNA, 18 nt, Human adenovirus F
gcggggcgucaagaggga

SEQ ID NO: 1584891 - RNA, 14 nt, Human adenovirus F
gcuaugugcagcag

SEQ ID NO: 1584892 - RNA, 20 nt, Human adenovirus F
cuaagggaggcagcagagga

SEQ ID NO: 1584893 - RNA, 15 nt, Human adenovirus F
agcccaacaccacca

SEQ ID NO: 1584894 - RNA, 19 nt, Human adenovirus F
accuuuuuacccugaccca

SEQ ID NO: 1584895 - RNA, 22 nt, Human adenovirus F
caugcugcuguuuuuacuuugc

SEQ ID NO: 1584896 - RNA, 17 nt, Human adenovirus F
acagcguagcacucccu

SEQ ID NO: 1584897 - RNA, 19 nt, Human adenovirus F
uuaccacugccacugaaac

SEQ ID NO: 1584898 - RNA, 16 nt, Human adenovirus F
agacgacuucaacccc

SEQ ID NO: 1584899 - RNA, 16 nt, Human adenovirus F
gugcaguggcggggac

SEQ ID NO: 1584900 - RNA, 21 nt, Human adenovirus F
caguuggagcagccuguggag

SEQ ID NO: 1584901 - RNA, 13 nt, Human adenovirus F
cacugacuuccug

SEQ ID NO: 1584902 - RNA, 17 nt, Human adenovirus F
cauguucacugaaagcc

SEQ ID NO: 1584903 - RNA, 23 nt, Human adenovirus F
caugaccaaaccuauugguucca

SEQ ID NO: 1584904 - RNA, 11 nt, Human adenovirus F
cagcaagcugc

SEQ ID NO: 1584905 - RNA, 23 nt, Human adenovirus F
uccucgauuuccauaaacuccuc

SEQ ID NO: 1584906 - RNA, 15 nt, Human adenovirus F
ccuggaccuggaaga

SEQ ID NO: 1584907 - RNA, 17 nt, Human adenovirus F
ggagucuuucagcuugg

SEQ ID NO: 1584908 - RNA, 20 nt, Human adenovirus F
cguagagcucagcaaucuga

SEQ ID NO: 1584909 - RNA, 14 nt, Human adenovirus F
ucaagaaauuguga

SEQ ID NO: 1584910 - RNA, 22 nt, Human adenovirus F
aacguacucuuuugccacgcag

SEQ ID NO: 1584911 - RNA, 15 nt, Human adenovirus F
ucagagcugcaagag

SEQ ID NO: 1584912 - RNA, 12 nt, Human adenovirus F
caaccauguuca

SEQ ID NO: 1584913 - RNA, 19 nt, Human adenovirus F
uggugaguugguagcagug

SEQ ID NO: 1584914 - RNA, 15 nt, Human adenovirus F
aacucuuacaccucc

SEQ ID NO: 1584915 - RNA, 13 nt, Human adenovirus F
agaguuugggagc

SEQ ID NO: 1584916 - RNA, 14 nt, Human adenovirus F
gcagcugcguacgg

SEQ ID NO: 1584917 - RNA, 21 nt, Human adenovirus F
cggccuacugccgccaugacu

SEQ ID NO: 1584918 - RNA, 13 nt, Human adenovirus F
cgggcaccggcac

SEQ ID NO: 1584919 - RNA, 23 nt, Human adenovirus F
gggagccaggaagacggacucug

SEQ ID NO: 1584920 - RNA, 14 nt, Human adenovirus F
ccgccccugccacc

SEQ ID NO: 1584921 - RNA, 19 nt, Human adenovirus F
uauuacaaaugccucccuu

SEQ ID NO: 1584922 - RNA, 21 nt, Human adenovirus F
gcguucgacgcgaggaugaga

SEQ ID NO: 1584923 - RNA, 15 nt, Human adenovirus F
aauagacgccccacu

SEQ ID NO: 1584924 - RNA, 15 nt, Human adenovirus F
gcccaccacucugau

SEQ ID NO: 1584925 - RNA, 16 nt, Human adenovirus F
cagggucgauggagcc

SEQ ID NO: 1584926 - RNA, 14 nt, Human adenovirus F
gugcacuuggggaa

SEQ ID NO: 1584927 - RNA, 16 nt, Human adenovirus F
cgaaugcccuuucaaa

SEQ ID NO: 1584928 - RNA, 16 nt, Human adenovirus F
gcggggcuaacuggca

SEQ ID NO: 1584929 - RNA, 21 nt, Human adenovirus F
cagcgcccgggcccuggaggc

SEQ ID NO: 1584930 - RNA, 17 nt, Human adenovirus F
aaagcgagccaaagugc

SEQ ID NO: 1584931 - RNA, 16 nt, Human adenovirus F
uacuucuucagcucua

SEQ ID NO: 1584932 - RNA, 17 nt, Human adenovirus F
gcaaacaacgaacuuuc

SEQ ID NO: 1584933 - RNA, 22 nt, Human adenovirus F
ugcgcuguacugugcauuuggg

SEQ ID NO: 1584934 - RNA, 15 nt, Human adenovirus F
aggguacuagcagug

SEQ ID NO: 1584935 - RNA, 12 nt, Human adenovirus F
gccccugccaac

SEQ ID NO: 1584936 - RNA, 16 nt, Human adenovirus F
guaacagaacaauaaa

SEQ ID NO: 1584937 - RNA, 15 nt, Human adenovirus F
ccaacugcagcgcac

SEQ ID NO: 1584938 - RNA, 19 nt, Human adenovirus F
uuauuguucaaggaaacaa

SEQ ID NO: 1584939 - RNA, 16 nt, Human adenovirus F
auuucaccuacucugg

SEQ ID NO: 1584940 - RNA, 20 nt, Human adenovirus F
uguuucuccuccccuuacaa

SEQ ID NO: 1584941 - RNA, 20 nt, Human adenovirus F
ucugccaucgcugaccagca

SEQ ID NO: 1584942 - RNA, 24 nt, Human adenovirus F
cuagccaacuauuuggcccaccac

SEQ ID NO: 1584943 - RNA, 19 nt, Human adenovirus F
agcggcacgucggcgugga

SEQ ID NO: 1584944 - RNA, 21 nt, Human adenovirus F
agggaucgcagcgggcaggag

SEQ ID NO: 1584945 - RNA, 16 nt, Human adenovirus F
aaggacgguggcauga

SEQ ID NO: 1584946 - RNA, 22 nt, Human adenovirus F
ugagcuuggauuaggaagggca

SEQ ID NO: 1584947 - RNA, 22 nt, Human adenovirus F
gagcuauuacuuuagcacuaga

SEQ ID NO: 1584948 - RNA, 23 nt, Human adenovirus F
auaauuuccgcuaguuuaauauu

SEQ ID NO: 1584949 - RNA, 15 nt, Human adenovirus F
cugcacgcucuugcu

SEQ ID NO: 1584950 - RNA, 20 nt, Human adenovirus F
cagguaggaccacuggaggg

SEQ ID NO: 1584951 - RNA, 14 nt, Human adenovirus F
caucuuucaaaaaa

SEQ ID NO: 1584952 - RNA, 15 nt, Human adenovirus F
ugaccgagcagcugc

SEQ ID NO: 1584953 - RNA, 19 nt, Human adenovirus F
gcggaggugccccagagug

SEQ ID NO: 1584954 - RNA, 18 nt, Human adenovirus F
uggcauggcagcagauuu

SEQ ID NO: 1584955 - RNA, 22 nt, Human adenovirus F
cguggauuccugggguagggug

SEQ ID NO: 1584956 - RNA, 16 nt, Human adenovirus F
agaccuuccaggaaau

SEQ ID NO: 1584957 - RNA, 14 nt, Human adenovirus F
cgcuguacugugca

SEQ ID NO: 1584958 - RNA, 16 nt, Human adenovirus F
ucagcucuaagacugu

SEQ ID NO: 1584959 - RNA, 17 nt, Human adenovirus F
gccaucgcugaccagca

SEQ ID NO: 1584960 - RNA, 15 nt, Human adenovirus F
uauacacucccuuug

SEQ ID NO: 1584961 - RNA, 14 nt, Human adenovirus F
ugggacagcaggcc

SEQ ID NO: 1584962 - RNA, 21 nt, Human adenovirus F
aaagcagugggacgaggagga

SEQ ID NO: 1584963 - RNA, 23 nt, Human adenovirus F
agcuuuuacugggacagcaggcc

SEQ ID NO: 1584964 - RNA, 14 nt, Human adenovirus F
cccgauacccaccu

SEQ ID NO: 1584965 - RNA, 20 nt, Human adenovirus F
auggggccuugggaugcagc

SEQ ID NO: 1584966 - RNA, 20 nt, Human adenovirus F
uucucccaggcggaaaccaa

SEQ ID NO: 1584967 - RNA, 19 nt, Human adenovirus F
ugcaauauaaaaacaacca

SEQ ID NO: 1584968 - RNA, 17 nt, Human adenovirus F
cacaugaacacuuccgc

SEQ ID NO: 1584969 - RNA, 17 nt, Human adenovirus F
agguagaaguggaggaa

SEQ ID NO: 1584970 - RNA, 21 nt, Human adenovirus F
acuggcuggcccuggccugga

SEQ ID NO: 1584971 - RNA, 13 nt, Human adenovirus F
uaugucugccaaa

SEQ ID NO: 1584972 - RNA, 20 nt, Human adenovirus F
auguggaaccaggcagugga

SEQ ID NO: 1584973 - RNA, 22 nt, Human adenovirus F
uacugggacagcaggccgcucc

SEQ ID NO: 1584974 - RNA, 11 nt, Human adenovirus F
ccagaccccau

SEQ ID NO: 1584975 - RNA, 17 nt, Human adenovirus F
ggggcccguucuggacu

SEQ ID NO: 1584976 - RNA, 15 nt, Human adenovirus F
aauagauagcuuuua

SEQ ID NO: 1584977 - RNA, 21 nt, Human adenovirus F
cguagacgcuggaagagguag

SEQ ID NO: 1584978 - RNA, 13 nt, Human adenovirus F
acaaaagcuuuca

SEQ ID NO: 1584979 - RNA, 18 nt, Human adenovirus F
cgggaagaauacuaaaac

SEQ ID NO: 1584980 - RNA, 18 nt, Human adenovirus F
caugaaaguuccucuucu

SEQ ID NO: 1584981 - RNA, 14 nt, Human adenovirus F
agucuaagccuggc

SEQ ID NO: 1584982 - RNA, 22 nt, Human adenovirus F
agaugcguccgacggcgccucc

SEQ ID NO: 1584983 - RNA, 22 nt, Human adenovirus F
aaauagagccgaucccagagcu

SEQ ID NO: 1584984 - RNA, 17 nt, Human adenovirus F
cucgcccuauuccuccg

SEQ ID NO: 1584985 - RNA, 22 nt, Human adenovirus F
gaaggguauaggcuugugcggc

SEQ ID NO: 1584986 - RNA, 14 nt, Human adenovirus F
gguuuuugagcaug

SEQ ID NO: 1584987 - RNA, 13 nt, Human adenovirus F
aucccccgagcgc

SEQ ID NO: 1584988 - RNA, 16 nt, Human adenovirus F
ccaaucguagcagggu

SEQ ID NO: 1584989 - RNA, 14 nt, Human adenovirus F
aaggacagucugcc

SEQ ID NO: 1584990 - RNA, 22 nt, Human adenovirus F
ggguagaguaaaaaaaagggaa

SEQ ID NO: 1584991 - RNA, 12 nt, Human adenovirus F
caaaacacuaaa

SEQ ID NO: 1584992 - RNA, 16 nt, Human adenovirus F
agccgaugcccaacgc

SEQ ID NO: 1584993 - RNA, 16 nt, Human adenovirus F
guucgccuggagaggc

SEQ ID NO: 1584994 - RNA, 18 nt, Human adenovirus F
aaauaauaauuuagcucu

SEQ ID NO: 1584995 - RNA, 17 nt, Human adenovirus F
ggugacccuaacauggc

SEQ ID NO: 1584996 - RNA, 16 nt, Human adenovirus F
gcccugaucagccagg

SEQ ID NO: 1584997 - RNA, 19 nt, Human adenovirus F
gacaugggggcggaccugc

SEQ ID NO: 1584998 - RNA, 16 nt, Human adenovirus F
gaaacaaaagucaaau

SEQ ID NO: 1584999 - RNA, 14 nt, Human adenovirus F
uacgugccuuuuca

SEQ ID NO: 1585000 - RNA, 16 nt, Human adenovirus F
cauauacuuuaaacaa

SEQ ID NO: 1585001 - RNA, 14 nt, Human adenovirus F
ccgcccgcuccgac

SEQ ID NO: 1585002 - RNA, 17 nt, Human adenovirus F
aaucuuccucccaaagu

SEQ ID NO: 1585003 - RNA, 18 nt, Human adenovirus F
cugcaauggcagcccagc

SEQ ID NO: 1585004 - RNA, 15 nt, Human adenovirus F
cucuuggucagcaag

SEQ ID NO: 1585005 - RNA, 20 nt, Human adenovirus F
cuggccaacugccaccucca

SEQ ID NO: 1585006 - RNA, 16 nt, Human adenovirus F
caccuuacaccacccc

SEQ ID NO: 1585007 - RNA, 13 nt, Human adenovirus F
cggcaaggaacca

SEQ ID NO: 1585008 - RNA, 20 nt, Human adenovirus F
gccagcauggcucagccccg

SEQ ID NO: 1585009 - RNA, 14 nt, Human adenovirus F
uugccuucuuuucu

SEQ ID NO: 1585010 - RNA, 12 nt, Human adenovirus F
agugagcucuuc

SEQ ID NO: 1585011 - RNA, 17 nt, Human adenovirus F
acucuuuauuuuucuga

SEQ ID NO: 1585012 - RNA, 19 nt, Human adenovirus F
uacgagaaaucggagaggg

SEQ ID NO: 1585013 - RNA, 22 nt, Human adenovirus F
aaggcuggcacacgcacuucaa

SEQ ID NO: 1585014 - RNA, 18 nt, Human adenovirus F
ucccaucaucgccgccgc

SEQ ID NO: 1585015 - RNA, 21 nt, Human adenovirus F
cuccacaugauacuuuuccau

SEQ ID NO: 1585016 - RNA, 13 nt, Human adenovirus F
ugccugcagcgcu

SEQ ID NO: 1585017 - RNA, 20 nt, Human adenovirus F
uucccgguccauacuugugc

SEQ ID NO: 1585018 - RNA, 14 nt, Human adenovirus F
gcuuacacccgcgg

SEQ ID NO: 1585019 - RNA, 21 nt, Human adenovirus F
ugaacgugaccgagcagcugc

SEQ ID NO: 1585020 - RNA, 12 nt, Human adenovirus F
ccuuacagccug

SEQ ID NO: 1585021 - RNA, 16 nt, Human adenovirus F
ggugaaaugaauuugu

SEQ ID NO: 1585022 - RNA, 12 nt, Human adenovirus F
cgcgcgggcagg

SEQ ID NO: 1585023 - RNA, 19 nt, Human adenovirus F
caggagcagcgggaagaga

SEQ ID NO: 1585024 - RNA, 17 nt, Human adenovirus F
gcggccguuuaugggca

SEQ ID NO: 1585025 - RNA, 14 nt, Human adenovirus F
cgcaaaagcuggga

SEQ ID NO: 1585026 - RNA, 13 nt, Human adenovirus F
aaaaccgccacau

SEQ ID NO: 1585027 - RNA, 12 nt, Human adenovirus F
gcgccccugcag

SEQ ID NO: 1585028 - RNA, 16 nt, Human adenovirus F
acggcccccaucucug

SEQ ID NO: 1585029 - RNA, 15 nt, Human adenovirus F
caaaucgacgguuuc

SEQ ID NO: 1585030 - RNA, 15 nt, Human adenovirus F
ccuacccagauuucc

SEQ ID NO: 1585031 - RNA, 20 nt, Human adenovirus F
caccauugaaguuucacacu

SEQ ID NO: 1585032 - RNA, 15 nt, Human adenovirus F
uaucaggaagcagcu

SEQ ID NO: 1585033 - RNA, 19 nt, Human adenovirus F
cuccaauuugacaauaacg

SEQ ID NO: 1585034 - RNA, 14 nt, Human adenovirus F
acgccaagccugaa

SEQ ID NO: 1585035 - RNA, 15 nt, Human adenovirus F
ggaccacuggagggc

SEQ ID NO: 1585036 - RNA, 18 nt, Human adenovirus F
uaucccgcgcuaaaucuu

SEQ ID NO: 1585037 - RNA, 19 nt, Human adenovirus F
cugcaacaaaaaaaaaaua

SEQ ID NO: 1585038 - RNA, 20 nt, Human adenovirus F
ggcgagaaaauauggaggag

SEQ ID NO: 1585039 - RNA, 23 nt, Human adenovirus F
ugucaugcaacuuggaagggaag

SEQ ID NO: 1585040 - RNA, 23 nt, Human adenovirus F
acccccguucccagucugccauc

SEQ ID NO: 1585041 - RNA, 19 nt, Human adenovirus F
auucuucaguugaaccacg

SEQ ID NO: 1585042 - RNA, 17 nt, Human adenovirus F
aaucagcggcuggaaaa

SEQ ID NO: 1585043 - RNA, 16 nt, Human adenovirus F
guuuguggguauauaa

SEQ ID NO: 1585044 - RNA, 14 nt, Human adenovirus F
accacgcugcgccc

SEQ ID NO: 1585045 - RNA, 22 nt, Human adenovirus F
gcguuacgcgcaacgcaagaga

SEQ ID NO: 1585046 - RNA, 13 nt, Human adenovirus F
cccucagagcugc

SEQ ID NO: 1585047 - RNA, 20 nt, Human adenovirus F
auauuauuuaaauaaaacau

SEQ ID NO: 1585048 - RNA, 14 nt, Human adenovirus F
cugugagcgccagc

SEQ ID NO: 1585049 - RNA, 21 nt, Human adenovirus F
gcagguaggaccacuggaggg

SEQ ID NO: 1585050 - RNA, 15 nt, Human adenovirus F
ugacaaacaagcugu

SEQ ID NO: 1585051 - RNA, 19 nt, Human adenovirus F
gucaaucucuucguccugg

SEQ ID NO: 1585052 - RNA, 16 nt, Human adenovirus F
ugcucggugcagccgu

SEQ ID NO: 1585053 - RNA, 16 nt, Human adenovirus F
ucgcucuguccgccgc

SEQ ID NO: 1585054 - RNA, 19 nt, Human adenovirus F
gaaauugaaguaggcgguc

SEQ ID NO: 1585055 - RNA, 16 nt, Human adenovirus F
acgccacuuuuuauga

SEQ ID NO: 1585056 - RNA, 14 nt, Human adenovirus F
uugcugacagcugg

SEQ ID NO: 1585057 - RNA, 17 nt, Human adenovirus F
ggguuucacgcaccagg

SEQ ID NO: 1585058 - RNA, 13 nt, Human adenovirus F
uuaucuguaaaac

SEQ ID NO: 1585059 - RNA, 20 nt, Human adenovirus F
aagacauucuugagcaggcc

SEQ ID NO: 1585060 - RNA, 20 nt, Human adenovirus F
gcugucucaccuacuaccac

SEQ ID NO: 1585061 - RNA, 23 nt, Human adenovirus F
cacacgucauccgccuccacccu

SEQ ID NO: 1585062 - RNA, 21 nt, Human adenovirus F
cggugcgaagccgucccccuc

SEQ ID NO: 1585063 - RNA, 18 nt, Human adenovirus F
caggguuugcaaacugua

SEQ ID NO: 1585064 - RNA, 18 nt, Human adenovirus F
cugcggcaaugcuuuuga

SEQ ID NO: 1585065 - RNA, 17 nt, Human adenovirus F
aucgcucacuggucugu

SEQ ID NO: 1585066 - RNA, 19 nt, Human adenovirus F
auuuuaauuuucaaucuug

SEQ ID NO: 1585067 - RNA, 18 nt, Human adenovirus F
uggcgcauucccuuuucc

SEQ ID NO: 1585068 - RNA, 12 nt, Human adenovirus F
uagcauaaaaga

SEQ ID NO: 1585069 - RNA, 16 nt, Human adenovirus F
auggguuacuuucggc

SEQ ID NO: 1585070 - RNA, 20 nt, Human adenovirus F
ccauagcaacagcguccguc

SEQ ID NO: 1585071 - RNA, 14 nt, Human adenovirus F
gaugguggcaagga

SEQ ID NO: 1585072 - RNA, 17 nt, Human adenovirus F
gcuuuccgcgaggccau

SEQ ID NO: 1585073 - RNA, 17 nt, Human adenovirus F
gaaaaaaaauuuuccca

SEQ ID NO: 1585074 - RNA, 15 nt, Human adenovirus F
ggacuuugcuccgcc

SEQ ID NO: 1585075 - RNA, 11 nt, Human adenovirus F
ucacuguuuuu

SEQ ID NO: 1585076 - RNA, 22 nt, Human adenovirus F
agccaaaucgcgcaaccagugg

SEQ ID NO: 1585077 - RNA, 20 nt, Human adenovirus F
gcaagccgcugacggcgcag

SEQ ID NO: 1585078 - RNA, 18 nt, Human adenovirus F
aguauuacaaaugccucc

SEQ ID NO: 1585079 - RNA, 17 nt, Human adenovirus F
ugucguugccagccggu

SEQ ID NO: 1585080 - RNA, 14 nt, Human adenovirus F
cugacgaagacauu

SEQ ID NO: 1585081 - RNA, 19 nt, Human adenovirus F
ggcaucacucauuuuuuca

SEQ ID NO: 1585082 - RNA, 12 nt, Human adenovirus F
ccaaaacaaaac

SEQ ID NO: 1585083 - RNA, 21 nt, Human adenovirus F
caaagacgaauugcagcccac

SEQ ID NO: 1585084 - RNA, 23 nt, Human adenovirus F
aggugaugcugcugaugaggaaa

SEQ ID NO: 1585085 - RNA, 17 nt, Human adenovirus F
guacguaccgccucaga

SEQ ID NO: 1585086 - RNA, 13 nt, Human adenovirus F
cgcugcaggcgcu

SEQ ID NO: 1585087 - RNA, 13 nt, Human adenovirus F
ggcauguuuucuc

SEQ ID NO: 1585088 - RNA, 16 nt, Human adenovirus F
ggagggcaaaaugggc

SEQ ID NO: 1585089 - RNA, 23 nt, Human adenovirus F
agacuccgcugacgguggaggaa

SEQ ID NO: 1585090 - RNA, 12 nt, Human adenovirus F
ucguacuucugu

SEQ ID NO: 1585091 - RNA, 22 nt, Human adenovirus F
ugccagaacuuccagcuguugg

SEQ ID NO: 1585092 - RNA, 15 nt, Human adenovirus F
aagucguggacgggc

SEQ ID NO: 1585093 - RNA, 22 nt, Human adenovirus F
gaaccuccgacgcuugcuggag

SEQ ID NO: 1585094 - RNA, 18 nt, Human adenovirus F
uguuuugggucaaaaacc

SEQ ID NO: 1585095 - RNA, 20 nt, Human adenovirus F
cuggaggcccuugugccuga

SEQ ID NO: 1585096 - RNA, 14 nt, Human adenovirus F
gcugacggccggcc

SEQ ID NO: 1585097 - RNA, 15 nt, Human adenovirus F
aagagaaucuaacca

SEQ ID NO: 1585098 - RNA, 15 nt, Human adenovirus F
aaagggggcgugucc

SEQ ID NO: 1585099 - RNA, 15 nt, Human adenovirus F
caauagcagcaccau

SEQ ID NO: 1585100 - RNA, 23 nt, Human adenovirus F
aagcaaucaaccaacuaacacug

SEQ ID NO: 1585101 - RNA, 14 nt, Human adenovirus F
gaggaggagaaccu

SEQ ID NO: 1585102 - RNA, 17 nt, Human adenovirus F
uaagcgagcagagccca

SEQ ID NO: 1585103 - RNA, 19 nt, Human adenovirus F
ucagaucagcgggcacaga

SEQ ID NO: 1585104 - RNA, 21 nt, Human adenovirus F
ugcagcccaccaugcaacuca

SEQ ID NO: 1585105 - RNA, 18 nt, Human adenovirus F
gugccgcgcgggcaggag

SEQ ID NO: 1585106 - RNA, 11 nt, Human adenovirus F
cgagccacagg

SEQ ID NO: 1585107 - RNA, 22 nt, Human adenovirus F
gacuccgcugacgguggaggaa

SEQ ID NO: 1585108 - RNA, 17 nt, Human adenovirus F
gcuguacugugcauuug

SEQ ID NO: 1585109 - RNA, 19 nt, Human adenovirus F
gcacacgcacuucaagaaa

SEQ ID NO: 1585110 - RNA, 19 nt, Human adenovirus F
cagcgcccgccucccaaag

SEQ ID NO: 1585111 - RNA, 14 nt, Human adenovirus F
gcugcaggcgcucc

SEQ ID NO: 1585112 - RNA, 20 nt, Human adenovirus F
aauuuugcgucgcuggcucc

SEQ ID NO: 1585113 - RNA, 15 nt, Human adenovirus F
uccgccauugccacc

SEQ ID NO: 1585114 - RNA, 14 nt, Human adenovirus F
ggcggcugguuaug

SEQ ID NO: 1585115 - RNA, 15 nt, Human adenovirus F
ggcaaaugcucugca

SEQ ID NO: 1585116 - RNA, 19 nt, Human adenovirus F
ccuguaccaccgcaaacaa

SEQ ID NO: 1585117 - RNA, 21 nt, Human adenovirus F
augcagcgcugccuuugcaau

SEQ ID NO: 1585118 - RNA, 22 nt, Human adenovirus F
aggggaaaucagaugcauuuug

SEQ ID NO: 1585119 - RNA, 15 nt, Human adenovirus F
ggccuuucacccaga

SEQ ID NO: 1585120 - RNA, 22 nt, Human adenovirus F
ggcauuaaugggcaaaggggga

SEQ ID NO: 1585121 - RNA, 20 nt, Human adenovirus F
cuggaggcuugggaggauuu

SEQ ID NO: 1585122 - RNA, 18 nt, Human adenovirus F
ugcuguacgccaacuccg

SEQ ID NO: 1585123 - RNA, 19 nt, Human adenovirus F
ucacugccguugcaaccuc

SEQ ID NO: 1585124 - RNA, 17 nt, Human adenovirus F
cacgcuguaccaggagg

SEQ ID NO: 1585125 - RNA, 18 nt, Human adenovirus F
cccagcacuuggauuaca

SEQ ID NO: 1585126 - RNA, 21 nt, Human adenovirus F
gcucaacuuuaacuaauguaa

SEQ ID NO: 1585127 - RNA, 15 nt, Human adenovirus F
aacuuuuuuaccacu

SEQ ID NO: 1585128 - RNA, 21 nt, Human adenovirus F
gcggaaaccaagggcucugcc

SEQ ID NO: 1585129 - RNA, 14 nt, Human adenovirus F
uuccaaacuucacg

SEQ ID NO: 1585130 - RNA, 15 nt, Human adenovirus F
gcucgucgggaagca

SEQ ID NO: 1585131 - RNA, 18 nt, Human adenovirus F
uaucccgccccugccacc

SEQ ID NO: 1585132 - RNA, 21 nt, Human adenovirus F
gauguccuuaaggaggaggcu

SEQ ID NO: 1585133 - RNA, 19 nt, Human adenovirus F
gcgcgcuucgccuccuggu

SEQ ID NO: 1585134 - RNA, 23 nt, Human adenovirus F
agagccgcggucaacagcuggaa

SEQ ID NO: 1585135 - RNA, 15 nt, Human adenovirus F
acccguucggagcca

SEQ ID NO: 1585136 - RNA, 17 nt, Human adenovirus F
ugcacuaacuccaaaua

SEQ ID NO: 1585137 - RNA, 15 nt, Human adenovirus F
agcgucagguuugac

SEQ ID NO: 1585138 - RNA, 19 nt, Human adenovirus F
uagcacuagaugcagcgcu

SEQ ID NO: 1585139 - RNA, 15 nt, Human adenovirus F
gacaagguggcggcc

SEQ ID NO: 1585140 - RNA, 21 nt, Human adenovirus F
cguucccguaaaaaggagggc

SEQ ID NO: 1585141 - RNA, 16 nt, Human adenovirus F
cagguccagaccucaa

SEQ ID NO: 1585142 - RNA, 16 nt, Human adenovirus F
ugcccauuauugcacu

SEQ ID NO: 1585143 - RNA, 20 nt, Human adenovirus F
ccccugugaguguggagcua

SEQ ID NO: 1585144 - RNA, 14 nt, Human adenovirus F
cauccuggaccugg

SEQ ID NO: 1585145 - RNA, 17 nt, Human adenovirus F
gcagcuugaagaacugg

SEQ ID NO: 1585146 - RNA, 22 nt, Human adenovirus F
uugcaugcccgagccggagagg

SEQ ID NO: 1585147 - RNA, 20 nt, Human adenovirus F
auuacauugguuuuagggac

SEQ ID NO: 1585148 - RNA, 12 nt, Human adenovirus F
cuuaacagcauu

SEQ ID NO: 1585149 - RNA, 12 nt, Human adenovirus F
gggaccagcugu

SEQ ID NO: 1585150 - RNA, 17 nt, Human adenovirus F
cagcaguccgucagcuu

SEQ ID NO: 1585151 - RNA, 16 nt, Human adenovirus F
gcgauccggcacuuga

SEQ ID NO: 1585152 - RNA, 21 nt, Human adenovirus F
gagcgguccgucacgcgggcc

SEQ ID NO: 1585153 - RNA, 17 nt, Human adenovirus F
uugcaugguguguuuuu

SEQ ID NO: 1585154 - RNA, 16 nt, Human adenovirus F
cagcaccaccugcccu

SEQ ID NO: 1585155 - RNA, 14 nt, Human adenovirus F
uaaaaucaacauua

SEQ ID NO: 1585156 - RNA, 19 nt, Human adenovirus F
gccauggaucgcauccugg

SEQ ID NO: 1585157 - RNA, 21 nt, Human adenovirus F
aagacgacuucaaccccgucu

SEQ ID NO: 1585158 - RNA, 17 nt, Human adenovirus F
ggcgcuugccaggguuc

SEQ ID NO: 1585159 - RNA, 18 nt, Human adenovirus F
gcuggaacucaaaguaaa

SEQ ID NO: 1585160 - RNA, 19 nt, Human adenovirus F
cagucucgguaacgaccuc

SEQ ID NO: 1585161 - RNA, 15 nt, Human adenovirus F
cuugccacuggccuu

SEQ ID NO: 1585162 - RNA, 18 nt, Human adenovirus F
uccauaaacuccucuucc

SEQ ID NO: 1585163 - RNA, 15 nt, Human adenovirus F
gcaauggucuuacau

SEQ ID NO: 1585164 - RNA, 13 nt, Human adenovirus F
ucaggguguuuug

SEQ ID NO: 1585165 - RNA, 16 nt, Human adenovirus F
gcauguacggcggcgc

SEQ ID NO: 1585166 - RNA, 19 nt, Human adenovirus F
aguagcucuuccaagcugc

SEQ ID NO: 1585167 - RNA, 23 nt, Human adenovirus F
cagguucccgugucaccugcagu

SEQ ID NO: 1585168 - RNA, 22 nt, Human adenovirus F
acuucacggcaggguuugcaaa

SEQ ID NO: 1585169 - RNA, 16 nt, Human adenovirus F
agaugacuucaacccc

SEQ ID NO: 1585170 - RNA, 22 nt, Human adenovirus F
gacaacgaggcuuuccgcgagg

SEQ ID NO: 1585171 - RNA, 18 nt, Human adenovirus F
ggaguuggcuucugccag

SEQ ID NO: 1585172 - RNA, 20 nt, Human adenovirus F
acaacgaagggauacuagca

SEQ ID NO: 1585173 - RNA, 14 nt, Human adenovirus F
ccgguacagguggg

SEQ ID NO: 1585174 - RNA, 17 nt, Human adenovirus F
ccugcagcgcuucuuug

SEQ ID NO: 1585175 - RNA, 22 nt, Human adenovirus F
gugacagaaaucaagcggggcg

SEQ ID NO: 1585176 - RNA, 17 nt, Human adenovirus F
ugcaucuaucuuuuccu

SEQ ID NO: 1585177 - RNA, 13 nt, Human adenovirus F
uucaaggaaacaa

SEQ ID NO: 1585178 - RNA, 16 nt, Human adenovirus F
gcaaguucaaagaaga

SEQ ID NO: 1585179 - RNA, 21 nt, Human adenovirus F
agcagccuaagcgcgcacgac

SEQ ID NO: 1585180 - RNA, 22 nt, Human adenovirus F
gcuguggugcgguuucaaacau

SEQ ID NO: 1585181 - RNA, 20 nt, Human adenovirus F
cauauaagcucugucaguuc

SEQ ID NO: 1585182 - RNA, 22 nt, Human adenovirus F
auguucgacuccucugugagcu

SEQ ID NO: 1585183 - RNA, 18 nt, Human adenovirus F
ugagcaagcgcaaguuca

SEQ ID NO: 1585184 - RNA, 15 nt, Human adenovirus F
gcauggcagcagauu

SEQ ID NO: 1585185 - RNA, 18 nt, Human adenovirus F
acccaacuauuugggagg

SEQ ID NO: 1585186 - RNA, 18 nt, Human adenovirus F
ccaaaaaagcagccuaac

SEQ ID NO: 1585187 - RNA, 16 nt, Human adenovirus F
ugccaaaguggcucuu

SEQ ID NO: 1585188 - RNA, 17 nt, Human adenovirus F
agugcacugagcagcuu

SEQ ID NO: 1585189 - RNA, 17 nt, Human adenovirus F
cagacuccgcugacggu

SEQ ID NO: 1585190 - RNA, 21 nt, Human adenovirus F
gauucgccauaaugcgggcuc

SEQ ID NO: 1585191 - RNA, 13 nt, Human adenovirus F
ggugaaggugaga

SEQ ID NO: 1585192 - RNA, 23 nt, Human adenovirus F
uuaugaaacacacaucacuguua

SEQ ID NO: 1585193 - RNA, 22 nt, Human adenovirus F
ucuguaacaccgagcuucuuag

SEQ ID NO: 1585194 - RNA, 13 nt, Human adenovirus F
gcagcuggagcuu

SEQ ID NO: 1585195 - RNA, 23 nt, Human adenovirus F
cuguguuacgccagagagccgag

SEQ ID NO: 1585196 - RNA, 17 nt, Human adenovirus F
caacugccaccuccacc

SEQ ID NO: 1585197 - RNA, 20 nt, Human adenovirus F
ugucacugccguugcaaccu

SEQ ID NO: 1585198 - RNA, 22 nt, Human adenovirus F
aagcuucuaucugcaaaaaagc

SEQ ID NO: 1585199 - RNA, 12 nt, Human adenovirus F
aaggcgaaaagc

SEQ ID NO: 1585200 - RNA, 15 nt, Human adenovirus F
caggcucugagagug

SEQ ID NO: 1585201 - RNA, 21 nt, Human adenovirus F
agguuuuacgcggggcaggag

SEQ ID NO: 1585202 - RNA, 22 nt, Human adenovirus F
caucuucaccucuguuugcugc

SEQ ID NO: 1585203 - RNA, 23 nt, Human adenovirus F
uccaucgccggaucgccaacagc

SEQ ID NO: 1585204 - RNA, 18 nt, Human adenovirus F
gaaugugucuccgcuggg

SEQ ID NO: 1585205 - RNA, 14 nt, Human adenovirus F
uaaaaaucuccugc

SEQ ID NO: 1585206 - RNA, 16 nt, Human adenovirus F
gcaaccagugggcucc

SEQ ID NO: 1585207 - RNA, 13 nt, Human adenovirus F
gggauggguaagu

SEQ ID NO: 1585208 - RNA, 22 nt, Human adenovirus F
cuuugcgcgaacagaguggggg

SEQ ID NO: 1585209 - RNA, 16 nt, Human adenovirus F
cauggcaauggcucug

SEQ ID NO: 1585210 - RNA, 20 nt, Human adenovirus F
agcuagugaaacaugaggag

SEQ ID NO: 1585211 - RNA, 14 nt, Human adenovirus F
ugaugcaccucuug

SEQ ID NO: 1585212 - RNA, 17 nt, Human adenovirus F
cagcugaacccacccuc

SEQ ID NO: 1585213 - RNA, 14 nt, Human adenovirus F
uauuuucaacuuua

SEQ ID NO: 1585214 - RNA, 17 nt, Human adenovirus F
uugcucggcgaaaacuc

SEQ ID NO: 1585215 - RNA, 20 nt, Human adenovirus F
cuacaauccccuugacauuc

SEQ ID NO: 1585216 - RNA, 17 nt, Human adenovirus F
auaugucugccaaaaug

SEQ ID NO: 1585217 - RNA, 12 nt, Human adenovirus F
aguguggagcua

SEQ ID NO: 1585218 - RNA, 14 nt, Human adenovirus F
uccaaaccaaauaa

SEQ ID NO: 1585219 - RNA, 16 nt, Human adenovirus F
accaagggcucugccu

SEQ ID NO: 1585220 - RNA, 16 nt, Human adenovirus F
cuggaccuggaagagg

SEQ ID NO: 1585221 - RNA, 13 nt, Human adenovirus F
gcggcggccauga

SEQ ID NO: 1585222 - RNA, 17 nt, Human adenovirus F
gcauaaaagcuucuauc

SEQ ID NO: 1585223 - RNA, 22 nt, Human adenovirus F
cauuacuuuacccgacaacaaa

SEQ ID NO: 1585224 - RNA, 15 nt, Human adenovirus F
uucaugcaugcagac

SEQ ID NO: 1585225 - RNA, 12 nt, Human adenovirus F
aacacaaacaua

SEQ ID NO: 1585226 - RNA, 22 nt, Human adenovirus F
uaaagcucaaaaaggcacuuua

SEQ ID NO: 1585227 - RNA, 15 nt, Human adenovirus F
uaccagagccauagc

SEQ ID NO: 1585228 - RNA, 14 nt, Human adenovirus F
caaguacacugacc

SEQ ID NO: 1585229 - RNA, 18 nt, Human adenovirus F
cugggcuuauuggcauga

SEQ ID NO: 1585230 - RNA, 13 nt, Human adenovirus F
uacucuggcuccg

SEQ ID NO: 1585231 - RNA, 13 nt, Human adenovirus F
ggacgguggcaug

SEQ ID NO: 1585232 - RNA, 13 nt, Human adenovirus F
aaucuucggcagg

SEQ ID NO: 1585233 - RNA, 16 nt, Human adenovirus F
ucccuuucccccugua

SEQ ID NO: 1585234 - RNA, 14 nt, Human adenovirus F
auuaauuacagcau

SEQ ID NO: 1585235 - RNA, 15 nt, Human adenovirus F
cugcccuuccuccca

SEQ ID NO: 1585236 - RNA, 17 nt, Human adenovirus F
cacugccuaccgcagcu

SEQ ID NO: 1585237 - RNA, 22 nt, Human adenovirus F
aacauagcaaaagcauuuuccu

SEQ ID NO: 1585238 - RNA, 23 nt, Human adenovirus F
ucuagauaauaacuuucuuacac

SEQ ID NO: 1585239 - RNA, 19 nt, Human adenovirus F
acuggcuggcccuggccug

SEQ ID NO: 1585240 - RNA, 21 nt, Human adenovirus F
ccgucuagccaacuauuuggc

SEQ ID NO: 1585241 - RNA, 18 nt, Human adenovirus F
uuaaugggcaaaggggga

SEQ ID NO: 1585242 - RNA, 21 nt, Human adenovirus F
acacuggcuggcccuggccug

SEQ ID NO: 1585243 - RNA, 22 nt, Human adenovirus F
ccaagccuuaauuucugagggg

SEQ ID NO: 1585244 - RNA, 19 nt, Human adenovirus F
gggugcuacgcgccgaaga

SEQ ID NO: 1585245 - RNA, 18 nt, Human adenovirus F
cucggaguaccugagccc

SEQ ID NO: 1585246 - RNA, 15 nt, Human adenovirus F
gggcaaaaugggcuu

SEQ ID NO: 1585247 - RNA, 20 nt, Human adenovirus F
cuggacucgucuccugcaag

SEQ ID NO: 1585248 - RNA, 15 nt, Human adenovirus F
ccguuaccuggggcc

SEQ ID NO: 1585249 - RNA, 15 nt, Human adenovirus F
aucucugugcgucgc

SEQ ID NO: 1585250 - RNA, 18 nt, Human adenovirus F
gcaagcuucucagcucaa

SEQ ID NO: 1585251 - RNA, 15 nt, Human adenovirus F
ccaguccgggccaga

SEQ ID NO: 1585252 - RNA, 22 nt, Human adenovirus F
gaccauucugagacaaaagccc

SEQ ID NO: 1585253 - RNA, 13 nt, Human adenovirus F
ucaaacaggaaga

SEQ ID NO: 1585254 - RNA, 23 nt, Human adenovirus F
gugcucgcaaacaaagaaguaca

SEQ ID NO: 1585255 - RNA, 17 nt, Human adenovirus F
cucaggaaccaccaccg

SEQ ID NO: 1585256 - RNA, 23 nt, Human adenovirus F
gacaaccggguuuuggacauggc

SEQ ID NO: 1585257 - RNA, 13 nt, Human adenovirus F
agcguaggagcua

SEQ ID NO: 1585258 - RNA, 18 nt, Human adenovirus F
ccaacgugcaggccaacc

SEQ ID NO: 1585259 - RNA, 14 nt, Human adenovirus F
gaggaggccauccu

SEQ ID NO: 1585260 - RNA, 11 nt, Human adenovirus F
gcgggcucuga

SEQ ID NO: 1585261 - RNA, 17 nt, Human adenovirus F
ucucgccccaccgcccc

SEQ ID NO: 1585262 - RNA, 23 nt, Human adenovirus F
cuagcauaaaggggaccagcugu

SEQ ID NO: 1585263 - RNA, 22 nt, Human adenovirus F
aggccauggaaacgcagccuga

SEQ ID NO: 1585264 - RNA, 21 nt, Human adenovirus F
cacugccguugcaaccucugc

SEQ ID NO: 1585265 - RNA, 19 nt, Human adenovirus F
augagggauucuaagggag

SEQ ID NO: 1585266 - RNA, 16 nt, Human adenovirus F
ccuugcaaggggaggc

SEQ ID NO: 1585267 - RNA, 16 nt, Human adenovirus F
acuggaguaacacaau

SEQ ID NO: 1585268 - RNA, 15 nt, Human adenovirus F
aaccaagggcucugc

SEQ ID NO: 1585269 - RNA, 16 nt, Human adenovirus F
cagcgacggaacgugg

SEQ ID NO: 1585270 - RNA, 21 nt, Human adenovirus F
ccaaagcagagcucugcaaaa

SEQ ID NO: 1585271 - RNA, 20 nt, Human adenovirus F
cucccuccccccuuccacuu

SEQ ID NO: 1585272 - RNA, 15 nt, Human adenovirus F
aucgacguucucucc

SEQ ID NO: 1585273 - RNA, 21 nt, Human adenovirus F
gggaacugccaguguaaagca

SEQ ID NO: 1585274 - RNA, 23 nt, Human adenovirus F
acgagcccugaucagccaggugg

SEQ ID NO: 1585275 - RNA, 22 nt, Human adenovirus F
caggcggaaaccaagggcucug

SEQ ID NO: 1585276 - RNA, 17 nt, Human adenovirus F
cuggauuacauggcaau

SEQ ID NO: 1585277 - RNA, 17 nt, Human adenovirus F
gaacccaacuauuuggg

SEQ ID NO: 1585278 - RNA, 15 nt, Human adenovirus F
cugccguugcaaccu

SEQ ID NO: 1585279 - RNA, 14 nt, Human adenovirus F
cgaggggcuggccc

SEQ ID NO: 1585280 - RNA, 13 nt, Human adenovirus F
ccgagagaugcau

SEQ ID NO: 1585281 - RNA, 14 nt, Human adenovirus F
ccugggcuggaugc

SEQ ID NO: 1585282 - RNA, 21 nt, Human adenovirus F
cgcugugaguuuugagggugg

SEQ ID NO: 1585283 - RNA, 15 nt, Human adenovirus F
gcuagcauaaaagaa

SEQ ID NO: 1585284 - RNA, 17 nt, Human adenovirus F
aucccaugaccaaaccu

SEQ ID NO: 1585285 - RNA, 20 nt, Human adenovirus F
cgaggcuuuccgcgaggcca

SEQ ID NO: 1585286 - RNA, 14 nt, Human adenovirus F
agcgugagucgggc

SEQ ID NO: 1585287 - RNA, 23 nt, Human adenovirus F
uuccagcagcaccaccugcccuu

SEQ ID NO: 1585288 - RNA, 16 nt, Human adenovirus F
cgcauaacccuggaau

SEQ ID NO: 1585289 - RNA, 20 nt, Human adenovirus F
caugcccgagccggagaggg

SEQ ID NO: 1585290 - RNA, 22 nt, Human adenovirus F
cugagccugaucccgaagaggg

SEQ ID NO: 1585291 - RNA, 19 nt, Human adenovirus F
gaaacugucaggcucugag

SEQ ID NO: 1585292 - RNA, 12 nt, Human adenovirus F
cgucccuggagu

SEQ ID NO: 1585293 - RNA, 22 nt, Human adenovirus F
cccagcugugguuaaauuuaau

SEQ ID NO: 1585294 - RNA, 21 nt, Human adenovirus F
uuggagagcaguuuggcaaug

SEQ ID NO: 1585295 - RNA, 20 nt, Human adenovirus F
gaaccacugauguaacagcu

SEQ ID NO: 1585296 - RNA, 20 nt, Human adenovirus F
agcccauaucugacaacccg

SEQ ID NO: 1585297 - RNA, 22 nt, Human adenovirus F
acaaaucgauuaaguugggagg

SEQ ID NO: 1585298 - RNA, 21 nt, Human adenovirus F
auugccucccugaacuaccag

SEQ ID NO: 1585299 - RNA, 22 nt, Human adenovirus F
ggcggggacguaaaguccagcg

SEQ ID NO: 1585300 - RNA, 15 nt, Human adenovirus F
gcccggguccaggcu

SEQ ID NO: 1585301 - RNA, 12 nt, Human adenovirus F
gacagcaggccg

SEQ ID NO: 1585302 - RNA, 15 nt, Human adenovirus F
cuguacugugcauuu

SEQ ID NO: 1585303 - RNA, 12 nt, Human adenovirus F
uuugacagcauu

SEQ ID NO: 1585304 - RNA, 15 nt, Human adenovirus F
caggccuugcaaaac

SEQ ID NO: 1585305 - RNA, 13 nt, Human adenovirus F
ccgcugaaagacg

SEQ ID NO: 1585306 - RNA, 12 nt, Human adenovirus F
agcggcuggaaa

SEQ ID NO: 1585307 - RNA, 17 nt, Human adenovirus F
agcgcccgggcccugga

SEQ ID NO: 1585308 - RNA, 22 nt, Human adenovirus F
cuaaggacgguggcaugaggga

SEQ ID NO: 1585309 - RNA, 16 nt, Human adenovirus F
ccuuuuugggauuaca

SEQ ID NO: 1585310 - RNA, 17 nt, Human adenovirus F
uaaaucuuccucccaaa

SEQ ID NO: 1585311 - RNA, 21 nt, Human adenovirus F
caccugcccuuccucccaacu

SEQ ID NO: 1585312 - RNA, 22 nt, Human adenovirus F
guugcauguuggaaaggggugg

SEQ ID NO: 1585313 - RNA, 19 nt, Human adenovirus F
gcagggugcgauugaaaua

SEQ ID NO: 1585314 - RNA, 17 nt, Human adenovirus F
acaccuccucaacuccc

SEQ ID NO: 1585315 - RNA, 22 nt, Human adenovirus F
caccguuguggagucacugcua

SEQ ID NO: 1585316 - RNA, 23 nt, Human adenovirus F
cugcuaaagggaacugccagugu

SEQ ID NO: 1585317 - RNA, 20 nt, Human adenovirus F
ugccgcgcgggcaggaggac

SEQ ID NO: 1585318 - RNA, 15 nt, Human adenovirus F
ccaaaggugcuccca

SEQ ID NO: 1585319 - RNA, 23 nt, Human adenovirus F
auccgccuccacccuuucccacc

SEQ ID NO: 1585320 - RNA, 22 nt, Human adenovirus F
aauugauuuucugccaccagcc

SEQ ID NO: 1585321 - RNA, 13 nt, Human adenovirus F
caccuccucaacu

SEQ ID NO: 1585322 - RNA, 18 nt, Human adenovirus F
auggcaccgcauaagcug

SEQ ID NO: 1585323 - RNA, 13 nt, Human adenovirus F
cuugcugacuuau

SEQ ID NO: 1585324 - RNA, 16 nt, Human adenovirus F
ggaagaugaguuuaaa

SEQ ID NO: 1585325 - RNA, 22 nt, Human adenovirus F
agugccgagcuuuuacugggac

SEQ ID NO: 1585326 - RNA, 13 nt, Human adenovirus F
uugcuacauaacu

SEQ ID NO: 1585327 - RNA, 18 nt, Human adenovirus F
gaggugccccagagugag

SEQ ID NO: 1585328 - RNA, 16 nt, Human adenovirus F
cagccuagacgaggag

SEQ ID NO: 1585329 - RNA, 17 nt, Human adenovirus F
cauaguugcucccaaag

SEQ ID NO: 1585330 - RNA, 19 nt, Human adenovirus F
agaaccuugcuacggagga

SEQ ID NO: 1585331 - RNA, 11 nt, Human adenovirus F
guaugggcagc

SEQ ID NO: 1585332 - RNA, 15 nt, Human adenovirus F
cccgucacucuccgc

SEQ ID NO: 1585333 - RNA, 15 nt, Human adenovirus F
caacaaaaucaggaa

SEQ ID NO: 1585334 - RNA, 12 nt, Human adenovirus F
cgagcgccucaa

SEQ ID NO: 1585335 - RNA, 18 nt, Human adenovirus F
guacacgcggugacggcc

SEQ ID NO: 1585336 - RNA, 22 nt, Human adenovirus F
gccgcacucgcuccacccgccg

SEQ ID NO: 1585337 - RNA, 13 nt, Human adenovirus F
ggcgguugagguc

SEQ ID NO: 1585338 - RNA, 16 nt, Human adenovirus F
cguagcacucccucuu

SEQ ID NO: 1585339 - RNA, 14 nt, Human adenovirus F
accacggugguaca

SEQ ID NO: 1585340 - RNA, 14 nt, Human adenovirus F
cuagcgugcccauu

SEQ ID NO: 1585341 - RNA, 23 nt, Human adenovirus F
gcuguaguugauaguuuaaggag

SEQ ID NO: 1585342 - RNA, 23 nt, Human adenovirus F
ccagcauaauaacucuggcuuug

SEQ ID NO: 1585343 - RNA, 17 nt, Human adenovirus F
gcuagaaugucacugcc

SEQ ID NO: 1585344 - RNA, 20 nt, Human adenovirus F
cuuaggaagggggccaucga

SEQ ID NO: 1585345 - RNA, 16 nt, Human adenovirus F
cgcaggagcucagaaa

SEQ ID NO: 1585346 - RNA, 18 nt, Human adenovirus F
agaccacaacaacaaacg

SEQ ID NO: 1585347 - RNA, 21 nt, Human adenovirus F
gaacgaggagcgcaacuuuca

SEQ ID NO: 1585348 - RNA, 17 nt, Human adenovirus F
cucguuguuuuccucug

SEQ ID NO: 1585349 - RNA, 14 nt, Human adenovirus F
gccauuuuggaagc

SEQ ID NO: 1585350 - RNA, 18 nt, Human adenovirus F
augauuuguggcgguggu

SEQ ID NO: 1585351 - RNA, 19 nt, Human adenovirus F
uaacacaggucaaaugcuc

SEQ ID NO: 1585352 - RNA, 17 nt, Human adenovirus F
gauccagugcaggaaga

SEQ ID NO: 1585353 - RNA, 17 nt, Human adenovirus F
ccaacggcuugcaagaa

SEQ ID NO: 1585354 - RNA, 19 nt, Human adenovirus F
uuggucaaaaacucuguga

SEQ ID NO: 1585355 - RNA, 15 nt, Human adenovirus F
cugacaguaagcaac

SEQ ID NO: 1585356 - RNA, 17 nt, Human adenovirus F
cgugggaaggggccagc

SEQ ID NO: 1585357 - RNA, 14 nt, Human adenovirus F
gauucuccaaagca

SEQ ID NO: 1585358 - RNA, 12 nt, Human adenovirus F
accugccccuac

SEQ ID NO: 1585359 - RNA, 22 nt, Human adenovirus F
cgcccaaacucaucugucgcag

SEQ ID NO: 1585360 - RNA, 18 nt, Human adenovirus F
ugaugcugcugaugagga

SEQ ID NO: 1585361 - RNA, 23 nt, Human adenovirus F
cuucaggcagcagccccaggcca

SEQ ID NO: 1585362 - RNA, 14 nt, Human adenovirus F
aaugcgggcucuga

SEQ ID NO: 1585363 - RNA, 14 nt, Human adenovirus F
ggcuuauuggcaug

SEQ ID NO: 1585364 - RNA, 16 nt, Human adenovirus F
uccucguuguuuuccu

SEQ ID NO: 1585365 - RNA, 22 nt, Human adenovirus F
gcagccugagcugccagaggcc

SEQ ID NO: 1585366 - RNA, 17 nt, Human adenovirus F
acggcaaucccagcaga

SEQ ID NO: 1585367 - RNA, 13 nt, Human adenovirus F
ucuaccacagaaa

SEQ ID NO: 1585368 - RNA, 21 nt, Human adenovirus F
ugaguugguagcagugucaau

SEQ ID NO: 1585369 - RNA, 22 nt, Human adenovirus F
ugcguucccguaaaaaggaggg

SEQ ID NO: 1585370 - RNA, 23 nt, Human adenovirus F
ugcagagcuugggcccugggcuu

SEQ ID NO: 1585371 - RNA, 20 nt, Human adenovirus F
ugaugcuacacaacaaauca

SEQ ID NO: 1585372 - RNA, 19 nt, Human adenovirus F
ccguucggagccaaccucc

SEQ ID NO: 1585373 - RNA, 15 nt, Human adenovirus F
ugagggucgcuggcu

SEQ ID NO: 1585374 - RNA, 13 nt, Human adenovirus F
aacaaauacaguc

SEQ ID NO: 1585375 - RNA, 20 nt, Human adenovirus F
cuaccguucuaugcuccugg

SEQ ID NO: 1585376 - RNA, 15 nt, Human adenovirus F
auguaaccacagaca

SEQ ID NO: 1585377 - RNA, 18 nt, Human adenovirus F
acaccugggaaaaccugu

SEQ ID NO: 1585378 - RNA, 14 nt, Human adenovirus F
cuuccaacccauga

SEQ ID NO: 1585379 - RNA, 22 nt, Human adenovirus F
gaaggauacaacguggcucaau

SEQ ID NO: 1585380 - RNA, 24 nt, Human adenovirus F
aagaagcacaggagauccguggag

SEQ ID NO: 1585381 - RNA, 17 nt, Human adenovirus F
agaggcgguggcgcagc

SEQ ID NO: 1585382 - RNA, 18 nt, Human adenovirus F
uccuggccaacugccacc

SEQ ID NO: 1585383 - RNA, 18 nt, Human adenovirus F
agggugcccgacuggggu

SEQ ID NO: 1585384 - RNA, 13 nt, Human adenovirus F
agacagcaaggaa

SEQ ID NO: 1585385 - RNA, 17 nt, Human adenovirus F
cacgcugacccuuccca

SEQ ID NO: 1585386 - RNA, 13 nt, Human adenovirus F
ccaucauuuccac

SEQ ID NO: 1585387 - RNA, 13 nt, Human adenovirus F
uagccaaccaggc

SEQ ID NO: 1585388 - RNA, 21 nt, Human adenovirus F
ccgcggcggcuauugccagca

SEQ ID NO: 1585389 - RNA, 18 nt, Human adenovirus F
auucagggaucgcagcgg

SEQ ID NO: 1585390 - RNA, 18 nt, Human adenovirus F
cagguuaaagccaacucc

SEQ ID NO: 1585391 - RNA, 18 nt, Human adenovirus F
ucaggagguacuccucgc

SEQ ID NO: 1585392 - RNA, 18 nt, Human adenovirus F
ucacugacgcccgccguc

SEQ ID NO: 1585393 - RNA, 20 nt, Human adenovirus F
ugccaucugcagcauugcca

SEQ ID NO: 1585394 - RNA, 23 nt, Human adenovirus F
caucguaguuuugcuccagggua

SEQ ID NO: 1585395 - RNA, 16 nt, Human adenovirus F
uuaccgucaucucuac

SEQ ID NO: 1585396 - RNA, 18 nt, Human adenovirus F
ucccuggcccccaaaggu

SEQ ID NO: 1585397 - RNA, 20 nt, Human adenovirus F
accgucaucucuacagcccc

SEQ ID NO: 1585398 - RNA, 19 nt, Human adenovirus F
gaucuuaagcugcagccag

SEQ ID NO: 1585399 - RNA, 14 nt, Human adenovirus F
caaacauugcaaaa

SEQ ID NO: 1585400 - RNA, 15 nt, Human adenovirus F
cauacccgccaacgc

SEQ ID NO: 1585401 - RNA, 20 nt, Human adenovirus F
caucaugcuucugacaugcu

SEQ ID NO: 1585402 - RNA, 21 nt, Human adenovirus F
ugcgcaacuucuuuuugggag

SEQ ID NO: 1585403 - RNA, 15 nt, Human adenovirus F
ggaggaggaggagaa

SEQ ID NO: 1585404 - RNA, 14 nt, Human adenovirus F
gacaggcuguaguu

SEQ ID NO: 1585405 - RNA, 14 nt, Human adenovirus F
cuauugccagcaug

SEQ ID NO: 1585406 - RNA, 22 nt, Human adenovirus F
uauuccuccggcucuauaaaaa

SEQ ID NO: 1585407 - RNA, 18 nt, Human adenovirus F
cuccucaacucccagcau

SEQ ID NO: 1585408 - RNA, 19 nt, Human adenovirus F
gaugaaacuugauuuccau

SEQ ID NO: 1585409 - RNA, 17 nt, Human adenovirus F
gguagggugucugccag

SEQ ID NO: 1585410 - RNA, 17 nt, Human adenovirus F
ccggggcaauaucucau

SEQ ID NO: 1585411 - RNA, 14 nt, Human adenovirus F
ucaugcaugcagac

SEQ ID NO: 1585412 - RNA, 15 nt, Human adenovirus F
gaaccaggcagugga

SEQ ID NO: 1585413 - RNA, 19 nt, Human adenovirus F
ggccgaugccaggcggcga

SEQ ID NO: 1585414 - RNA, 19 nt, Human adenovirus F
gaaaguagcucuuccaagc

SEQ ID NO: 1585415 - RNA, 15 nt, Human adenovirus F
gugaguguggagcua

SEQ ID NO: 1585416 - RNA, 14 nt, Human adenovirus F
gcuagcauaaaaga

SEQ ID NO: 1585417 - RNA, 17 nt, Human adenovirus F
ugcugccucuacugcuc

SEQ ID NO: 1585418 - RNA, 13 nt, Human adenovirus F
cacuggaugccac

SEQ ID NO: 1585419 - RNA, 23 nt, Human adenovirus F
gccacacuaaaguuuuaauggaa

SEQ ID NO: 1585420 - RNA, 23 nt, Human adenovirus F
ccaaagagcuugaacauaacacc

SEQ ID NO: 1585421 - RNA, 15 nt, Human adenovirus F
cacugcuaccuccuc

SEQ ID NO: 1585422 - RNA, 20 nt, Human adenovirus F
gugcagauggaaacugucag

SEQ ID NO: 1585423 - RNA, 19 nt, Human adenovirus F
cuaucccgccccugccacc

SEQ ID NO: 1585424 - RNA, 17 nt, Human adenovirus F
accauuaagaagacugu

SEQ ID NO: 1585425 - RNA, 22 nt, Human adenovirus F
ucuuacaaagugcgcuuuacgc

SEQ ID NO: 1585426 - RNA, 20 nt, Human adenovirus F
agagccgcggucaacagcug

SEQ ID NO: 1585427 - RNA, 14 nt, Human adenovirus F
augccuacaugaac

SEQ ID NO: 1585428 - RNA, 14 nt, Human adenovirus F
uuaaaccaauuugc

SEQ ID NO: 1585429 - RNA, 14 nt, Human adenovirus F
ucccaggcguggcc

SEQ ID NO: 1585430 - RNA, 15 nt, Human adenovirus F
ugcaauauaaaaaca

SEQ ID NO: 1585431 - RNA, 21 nt, Human adenovirus F
ccgcuugggggcgccaucccc

SEQ ID NO: 1585432 - RNA, 19 nt, Human adenovirus F
ggcuucggugacaaacaag

SEQ ID NO: 1585433 - RNA, 18 nt, Human adenovirus F
agcaaccgcacaugccag

SEQ ID NO: 1585434 - RNA, 22 nt, Human adenovirus F
aaagcaaguuucgcaaaagcug

SEQ ID NO: 1585435 - RNA, 16 nt, Human adenovirus F
ugcccaacaguacagu

SEQ ID NO: 1585436 - RNA, 12 nt, Human adenovirus F
uaucuugcaaaa

SEQ ID NO: 1585437 - RNA, 15 nt, Human adenovirus F
cagcgcgcuccauca

SEQ ID NO: 1585438 - RNA, 14 nt, Human adenovirus F
uguaguugauaguu

SEQ ID NO: 1585439 - RNA, 14 nt, Human adenovirus F
uccgaccccacacg

SEQ ID NO: 1585440 - RNA, 13 nt, Human adenovirus F
aacuuuacaaaau

SEQ ID NO: 1585441 - RNA, 17 nt, Human adenovirus F
gagcaguuuggcaaugg

SEQ ID NO: 1585442 - RNA, 18 nt, Human adenovirus F
auaggcauuaggccgucc

SEQ ID NO: 1585443 - RNA, 18 nt, Human adenovirus F
acaucaauuuugcgucgc

SEQ ID NO: 1585444 - RNA, 15 nt, Human adenovirus F
caccugcccuuccuc

SEQ ID NO: 1585445 - RNA, 22 nt, Human adenovirus F
cacgucauccgccuccacccuu

SEQ ID NO: 1585446 - RNA, 14 nt, Human adenovirus F
ggcgcaaucuucgc

SEQ ID NO: 1585447 - RNA, 16 nt, Human adenovirus F
gcucauugguccagca

SEQ ID NO: 1585448 - RNA, 16 nt, Human adenovirus F
uccaagcgucuuacau

SEQ ID NO: 1585449 - RNA, 16 nt, Human adenovirus F
uuuguaacaacuguac

SEQ ID NO: 1585450 - RNA, 12 nt, Human adenovirus F
uugucuguuuuu

SEQ ID NO: 1585451 - RNA, 14 nt, Human adenovirus F
cggagaggggagga

SEQ ID NO: 1585452 - RNA, 18 nt, Human adenovirus F
ucccaacaaccuacccag

SEQ ID NO: 1585453 - RNA, 21 nt, Human adenovirus F
ugguuccucauacaaaugcuc

SEQ ID NO: 1585454 - RNA, 20 nt, Human adenovirus F
ucgccaacagccccagcugg

SEQ ID NO: 1585455 - RNA, 14 nt, Human adenovirus F
agauuuuggacugu

SEQ ID NO: 1585456 - RNA, 18 nt, Human adenovirus F
accaucuuucaaaaaacc

SEQ ID NO: 1585457 - RNA, 15 nt, Human adenovirus F
uucaagcccuacacc

SEQ ID NO: 1585458 - RNA, 15 nt, Human adenovirus F
acucccuggccccca

SEQ ID NO: 1585459 - RNA, 16 nt, Human adenovirus F
cuaagggaggcagcag

SEQ ID NO: 1585460 - RNA, 17 nt, Human adenovirus F
uugaagacgacuucaac

SEQ ID NO: 1585461 - RNA, 14 nt, Human adenovirus F
ccaggcagcagggu

SEQ ID NO: 1585462 - RNA, 21 nt, Human adenovirus F
aaugcuagcccgaacauaguc

SEQ ID NO: 1585463 - RNA, 15 nt, Human adenovirus F
uacaacgagcaggcc

SEQ ID NO: 1585464 - RNA, 21 nt, Human adenovirus F
acuccauuauuuuuauuuuga

SEQ ID NO: 1585465 - RNA, 21 nt, Human adenovirus F
uuaaccacccccaacucugag

SEQ ID NO: 1585466 - RNA, 16 nt, Human adenovirus F
cuagaccaacaaacga

SEQ ID NO: 1585467 - RNA, 18 nt, Human adenovirus F
caugcgccgagcggcugc

SEQ ID NO: 1585468 - RNA, 17 nt, Human adenovirus F
cgcuaugugcagcaguc

SEQ ID NO: 1585469 - RNA, 16 nt, Human adenovirus F
aucaggaacuguucaa

SEQ ID NO: 1585470 - RNA, 15 nt, Human adenovirus F
gaagaagaugcccug

SEQ ID NO: 1585471 - RNA, 22 nt, Human adenovirus F
caccagcgugagucgggcucuu

SEQ ID NO: 1585472 - RNA, 22 nt, Human adenovirus F
uggauccagugcaggaagagga

SEQ ID NO: 1585473 - RNA, 18 nt, Human adenovirus F
cccucagacgacugggcg

SEQ ID NO: 1585474 - RNA, 20 nt, Human adenovirus F
cugccuaugccgccgugcca

SEQ ID NO: 1585475 - RNA, 19 nt, Human adenovirus F
cgcuaucaggaagcagcuc

SEQ ID NO: 1585476 - RNA, 17 nt, Human adenovirus F
gaggcacaccuuugggc

SEQ ID NO: 1585477 - RNA, 19 nt, Human adenovirus F
agccgcggucaacagcugg

SEQ ID NO: 1585478 - RNA, 19 nt, Human adenovirus F
auuuggucagaaaauacaa

SEQ ID NO: 1585479 - RNA, 14 nt, Human adenovirus F
uguccgccgccgcu

SEQ ID NO: 1585480 - RNA, 16 nt, Human adenovirus F
uaacaacacaggagcu

SEQ ID NO: 1585481 - RNA, 16 nt, Human adenovirus F
ccaucuuucaaaaaac

SEQ ID NO: 1585482 - RNA, 11 nt, Human adenovirus F
guuggaggaga

SEQ ID NO: 1585483 - RNA, 22 nt, Human adenovirus F
augguaaaaaugccaggcagca

SEQ ID NO: 1585484 - RNA, 19 nt, Human adenovirus F
acgcauguaaauuuugcac

SEQ ID NO: 1585485 - RNA, 18 nt, Human adenovirus F
aacacugcgauuagaaaa

SEQ ID NO: 1585486 - RNA, 22 nt, Human adenovirus F
cugggacagcggaggcauuuua

SEQ ID NO: 1585487 - RNA, 17 nt, Human adenovirus F
gaagcuagcauaaaaga

SEQ ID NO: 1585488 - RNA, 15 nt, Human adenovirus F
caauucucucuccuu

SEQ ID NO: 1585489 - RNA, 22 nt, Human adenovirus F
cacugacuuccugguccugacu

SEQ ID NO: 1585490 - RNA, 23 nt, Human adenovirus F
caaacaugugaccguguagccuu

SEQ ID NO: 1585491 - RNA, 13 nt, Human adenovirus F
gcugaagacacau

SEQ ID NO: 1585492 - RNA, 23 nt, Human adenovirus F
ccagacuccgaaaccuuaaccac

SEQ ID NO: 1585493 - RNA, 14 nt, Human adenovirus F
cagcugaagacaca

SEQ ID NO: 1585494 - RNA, 21 nt, Human adenovirus F
ugccaggcggcgaugaaacuu

SEQ ID NO: 1585495 - RNA, 23 nt, Human adenovirus F
aguccaaagcagagcucugcaaa

SEQ ID NO: 1585496 - RNA, 16 nt, Human adenovirus F
cucuuucuuacaacgc

SEQ ID NO: 1585497 - RNA, 17 nt, Human adenovirus F
cuguucuaaaaccaaac

SEQ ID NO: 1585498 - RNA, 13 nt, Human adenovirus F
uccaccugagggg

SEQ ID NO: 1585499 - RNA, 23 nt, Human adenovirus F
ccuagccaguggacaaaccaaaa

SEQ ID NO: 1585500 - RNA, 20 nt, Human adenovirus F
caccacauaagaagccagcc

SEQ ID NO: 1585501 - RNA, 17 nt, Human adenovirus F
acuuccagcuguuggag

SEQ ID NO: 1585502 - RNA, 22 nt, Human adenovirus F
cgcgaacuaaugcacagccugc

SEQ ID NO: 1585503 - RNA, 23 nt, Human adenovirus F
cagcgaguacuucaccaaugcca

SEQ ID NO: 1585504 - RNA, 23 nt, Human adenovirus F
gcggaugguggcaaggagaguga

SEQ ID NO: 1585505 - RNA, 15 nt, Human adenovirus F
ucgccgcgcaggggc

SEQ ID NO: 1585506 - RNA, 16 nt, Human adenovirus F
cacauccagggcacag

SEQ ID NO: 1585507 - RNA, 15 nt, Human adenovirus F
ccagggucgcagggu

SEQ ID NO: 1585508 - RNA, 19 nt, Human adenovirus F
ccagacuuugucagccaaa

SEQ ID NO: 1585509 - RNA, 20 nt, Human adenovirus F
guauaaguauuacaaaugcc

SEQ ID NO: 1585510 - RNA, 15 nt, Human adenovirus F
cacuuaccagagcca

SEQ ID NO: 1585511 - RNA, 14 nt, Human adenovirus F
accagccgcaccgc

SEQ ID NO: 1585512 - RNA, 13 nt, Human adenovirus F
ccacaacaacaaa

SEQ ID NO: 1585513 - RNA, 14 nt, Human adenovirus F
ccuugcaaaaccaa

SEQ ID NO: 1585514 - RNA, 19 nt, Human adenovirus F
acaucaauuuugcgucgcu

SEQ ID NO: 1585515 - RNA, 14 nt, Human adenovirus F
agaaaccaucgcca

SEQ ID NO: 1585516 - RNA, 20 nt, Human adenovirus F
caccguuguggagucacugc

SEQ ID NO: 1585517 - RNA, 13 nt, Human adenovirus F
ccuccagcacugc

SEQ ID NO: 1585518 - RNA, 15 nt, Human adenovirus F
ucgcaugccuccagc

SEQ ID NO: 1585519 - RNA, 20 nt, Human adenovirus F
gacauguuugucuuuaaaaa

SEQ ID NO: 1585520 - RNA, 17 nt, Human adenovirus F
aucacgcccaccaaauu

SEQ ID NO: 1585521 - RNA, 11 nt, Human adenovirus F
ccucugacggg

SEQ ID NO: 1585522 - RNA, 18 nt, Human adenovirus F
cuuggaaucauccaccug

SEQ ID NO: 1585523 - RNA, 15 nt, Human adenovirus F
cuuguccgcggggag

SEQ ID NO: 1585524 - RNA, 22 nt, Human adenovirus F
uguacaaagucauccaaaucau

SEQ ID NO: 1585525 - RNA, 18 nt, Human adenovirus F
acugcuagaaugucacug

SEQ ID NO: 1585526 - RNA, 22 nt, Human adenovirus F
ggaggcagugguggaugggggu

SEQ ID NO: 1585527 - RNA, 13 nt, Human adenovirus F
acuuuuuugcaag

SEQ ID NO: 1585528 - RNA, 11 nt, Human adenovirus F
caacgccaggc

SEQ ID NO: 1585529 - RNA, 17 nt, Human adenovirus F
aucuuaagcugcagcca

SEQ ID NO: 1585530 - RNA, 21 nt, Human adenovirus F
aaacuggcgccauguaauuca

SEQ ID NO: 1585531 - RNA, 16 nt, Human adenovirus F
ugccgcgcgggcagga

SEQ ID NO: 1585532 - RNA, 22 nt, Human adenovirus F
cuaguagguuuucagguggggg

SEQ ID NO: 1585533 - RNA, 23 nt, Human adenovirus F
aaucagggcgugcaagugggcuc

SEQ ID NO: 1585534 - RNA, 23 nt, Human adenovirus F
aacaacgggguggaaagccuggu

SEQ ID NO: 1585535 - RNA, 15 nt, Human adenovirus F
cagguauaaguauua

SEQ ID NO: 1585536 - RNA, 19 nt, Human adenovirus F
agacuuugucagccaaagu

SEQ ID NO: 1585537 - RNA, 14 nt, Human adenovirus F
uggcuuuacacauu

SEQ ID NO: 1585538 - RNA, 17 nt, Human adenovirus F
gccgcacucgcuccacc

SEQ ID NO: 1585539 - RNA, 21 nt, Human adenovirus F
aaaguagcucuuccaagcugc

SEQ ID NO: 1585540 - RNA, 19 nt, Human adenovirus F
auuuccauaaacuccucuu

SEQ ID NO: 1585541 - RNA, 21 nt, Human adenovirus F
caucgugcgcgaacugggcug

SEQ ID NO: 1585542 - RNA, 21 nt, Human adenovirus F
ugugccgcgcgggcaggagga

SEQ ID NO: 1585543 - RNA, 17 nt, Human adenovirus F
caggccgcccuaaccuc

SEQ ID NO: 1585544 - RNA, 15 nt, Human adenovirus F
aggguaaugucuuuc

SEQ ID NO: 1585545 - RNA, 20 nt, Human adenovirus F
agcaccaacgugcaggccaa

SEQ ID NO: 1585546 - RNA, 22 nt, Human adenovirus F
gcuuucaguuggagcagccugu

SEQ ID NO: 1585547 - RNA, 18 nt, Human adenovirus F
accucuucuucuuccucc

SEQ ID NO: 1585548 - RNA, 17 nt, Human adenovirus F
cagcccaacaccaccau

SEQ ID NO: 1585549 - RNA, 15 nt, Human adenovirus F
agaacaaaacacacu

SEQ ID NO: 1585550 - RNA, 16 nt, Human adenovirus F
ugggacagcggaggca

SEQ ID NO: 1585551 - RNA, 16 nt, Human adenovirus F
cugauccacuuacaac

SEQ ID NO: 1585552 - RNA, 16 nt, Human adenovirus F
ggcggcaacauuccug

SEQ ID NO: 1585553 - RNA, 13 nt, Human adenovirus F
uagcuggagggca

SEQ ID NO: 1585554 - RNA, 23 nt, Human adenovirus F
guggauggggguucgccuggaga

SEQ ID NO: 1585555 - RNA, 18 nt, Human adenovirus F
cgagccaccaucuccagc

SEQ ID NO: 1585556 - RNA, 23 nt, Human adenovirus F
aaaucgugcccguggaaaaagac

SEQ ID NO: 1585557 - RNA, 19 nt, Human adenovirus F
accgccaaaaaagcagccu

SEQ ID NO: 1585558 - RNA, 13 nt, Human adenovirus F
gaaucgcuggaaa

SEQ ID NO: 1585559 - RNA, 22 nt, Human adenovirus F
gaagccaaaucgcgcaaccagu

SEQ ID NO: 1585560 - RNA, 17 nt, Human adenovirus F
gaccuaaacucugagga

SEQ ID NO: 1585561 - RNA, 18 nt, Human adenovirus F
ggaugcaugcgaggggaa

SEQ ID NO: 1585562 - RNA, 15 nt, Human adenovirus F
gggagggaugcaugc

SEQ ID NO: 1585563 - RNA, 19 nt, Human adenovirus F
ggaaacugucaggcucuga

SEQ ID NO: 1585564 - RNA, 22 nt, Human adenovirus F
aacguucuucacugcaccuugc

SEQ ID NO: 1585565 - RNA, 13 nt, Human adenovirus F
gagcagccugugg

SEQ ID NO: 1585566 - RNA, 23 nt, Human adenovirus F
agcaagcccauucugccaguugg

SEQ ID NO: 1585567 - RNA, 14 nt, Human adenovirus F
aaagacagcaagga

SEQ ID NO: 1585568 - RNA, 18 nt, Human adenovirus F
cacgcgcucgacaugacu

SEQ ID NO: 1585569 - RNA, 18 nt, Human adenovirus F
uugugguacaggagcgca

SEQ ID NO: 1585570 - RNA, 18 nt, Human adenovirus F
gccucaugagcugggaga

SEQ ID NO: 1585571 - RNA, 13 nt, Human adenovirus F
cacaacaaaucau

SEQ ID NO: 1585572 - RNA, 14 nt, Human adenovirus F
ugcacugagcagcu

SEQ ID NO: 1585573 - RNA, 18 nt, Human adenovirus F
gucggcgucgaugguaaa

SEQ ID NO: 1585574 - RNA, 21 nt, Human adenovirus F
gcuaggcucuucuuccucguu

SEQ ID NO: 1585575 - RNA, 17 nt, Human adenovirus F
ggcuugcauaaaagcuu

SEQ ID NO: 1585576 - RNA, 21 nt, Human adenovirus F
ggcuaugaguugugcuuugcc

SEQ ID NO: 1585577 - RNA, 20 nt, Human adenovirus F
ucgcggggcuaacuggcaga

SEQ ID NO: 1585578 - RNA, 16 nt, Human adenovirus F
gaagagacccagguuu

SEQ ID NO: 1585579 - RNA, 19 nt, Human adenovirus F
auacguuacucggagcugg

SEQ ID NO: 1585580 - RNA, 15 nt, Human adenovirus F
aaagacagcaaggaa

SEQ ID NO: 1585581 - RNA, 12 nt, Human adenovirus F
ucacccacccac

SEQ ID NO: 1585582 - RNA, 21 nt, Human adenovirus F
gcugucguuaguggaggcagc

SEQ ID NO: 1585583 - RNA, 21 nt, Human adenovirus F
cacucgggaaagacaguggcg

SEQ ID NO: 1585584 - RNA, 19 nt, Human adenovirus F
ccaaaucaaucagcggcug

SEQ ID NO: 1585585 - RNA, 14 nt, Human adenovirus F
aggccgcggcggcu

SEQ ID NO: 1585586 - RNA, 23 nt, Human adenovirus F
cugauccguaauggaaaugaaac

SEQ ID NO: 1585587 - RNA, 13 nt, Human adenovirus F
acaaggccuggaa

SEQ ID NO: 1585588 - RNA, 21 nt, Human adenovirus F
uaccaaagacaaaaucacugu

SEQ ID NO: 1585589 - RNA, 23 nt, Human adenovirus F
gcauacguuacucggagcuggcg

SEQ ID NO: 1585590 - RNA, 17 nt, Human adenovirus F
acagccaagucaaaaaa

SEQ ID NO: 1585591 - RNA, 16 nt, Human adenovirus F
cuuacaugggcauucu

SEQ ID NO: 1585592 - RNA, 17 nt, Human adenovirus F
acgugcacaaagcucug

SEQ ID NO: 1585593 - RNA, 15 nt, Human adenovirus F
acuuggggaauuugu

SEQ ID NO: 1585594 - RNA, 13 nt, Human adenovirus F
gucgucgcaggcg

SEQ ID NO: 1585595 - RNA, 14 nt, Human adenovirus F
uuauaaucaugcaa

SEQ ID NO: 1585596 - RNA, 22 nt, Human adenovirus F
ggguaacuuuuaugaaugugag

SEQ ID NO: 1585597 - RNA, 18 nt, Human adenovirus F
ccugcaauggcagcccag

SEQ ID NO: 1585598 - RNA, 18 nt, Human adenovirus F
cauugguccagcaaaggc

SEQ ID NO: 1585599 - RNA, 19 nt, Human adenovirus F
gcucaucugcggccucagg

SEQ ID NO: 1585600 - RNA, 15 nt, Human adenovirus F
uguuacgccagagag

SEQ ID NO: 1585601 - RNA, 12 nt, Human adenovirus F
aguggccgccga

SEQ ID NO: 1585602 - RNA, 15 nt, Human adenovirus F
gugaccgagcagcug

SEQ ID NO: 1585603 - RNA, 17 nt, Human adenovirus F
agcucuucaucccagcc

SEQ ID NO: 1585604 - RNA, 14 nt, Human adenovirus F
uccauaaugauggc

SEQ ID NO: 1585605 - RNA, 15 nt, Human adenovirus F
ugccgcgcgggcagg

SEQ ID NO: 1585606 - RNA, 15 nt, Human adenovirus F
cccagauuuccuggu

SEQ ID NO: 1585607 - RNA, 19 nt, Human adenovirus F
cauuuaccaccccagcacu

SEQ ID NO: 1585608 - RNA, 13 nt, Human adenovirus F
auacgggaaggaa

SEQ ID NO: 1585609 - RNA, 22 nt, Human adenovirus F
cuaccacuaccccuaccacccu

SEQ ID NO: 1585610 - RNA, 15 nt, Human adenovirus F
guuccuuccgagaaa

SEQ ID NO: 1585611 - RNA, 14 nt, Human adenovirus F
gaggcagcagagga

SEQ ID NO: 1585612 - RNA, 22 nt, Human adenovirus F
aacgagaucggcaccagccagc

SEQ ID NO: 1585613 - RNA, 18 nt, Human adenovirus F
ucagggucgauggagcca

SEQ ID NO: 1585614 - RNA, 16 nt, Human adenovirus F
acgcgcucgacaugac

SEQ ID NO: 1585615 - RNA, 15 nt, Human adenovirus F
agucgucgcaggcgc

SEQ ID NO: 1585616 - RNA, 21 nt, Human adenovirus F
aguugugcuuugcccuccgau

SEQ ID NO: 1585617 - RNA, 19 nt, Human adenovirus F
gcuaccguucuaugcuccu

SEQ ID NO: 1585618 - RNA, 15 nt, Human adenovirus F
uuccucuucucuguc

SEQ ID NO: 1585619 - RNA, 21 nt, Human adenovirus F
uguccauauuauuuaaauaaa

SEQ ID NO: 1585620 - RNA, 22 nt, Human adenovirus F
ccgugcaaaacaauucucucuc

SEQ ID NO: 1585621 - RNA, 22 nt, Human adenovirus F
uaacgcuucagagcucuucauc

SEQ ID NO: 1585622 - RNA, 19 nt, Human adenovirus F
gaaaccccuuugugcccuc

SEQ ID NO: 1585623 - RNA, 17 nt, Human adenovirus F
auguccaccugaggggc

SEQ ID NO: 1585624 - RNA, 19 nt, Human adenovirus F
aguggacaaaccaaaacaa

SEQ ID NO: 1585625 - RNA, 18 nt, Human adenovirus F
gauuuguaguggagggau

SEQ ID NO: 1585626 - RNA, 23 nt, Human adenovirus F
uagaaggcuacucauuaaaauuc

SEQ ID NO: 1585627 - RNA, 15 nt, Human adenovirus F
aaguuaccaaagaca

SEQ ID NO: 1585628 - RNA, 19 nt, Human adenovirus F
aaaacguucccgcccucac

SEQ ID NO: 1585629 - RNA, 11 nt, Human adenovirus F
uaaacucugag

SEQ ID NO: 1585630 - RNA, 16 nt, Human adenovirus F
ccucgcugucuggaac

SEQ ID NO: 1585631 - RNA, 22 nt, Human adenovirus F
aggucguaaugaggacauugcu

SEQ ID NO: 1585632 - RNA, 16 nt, Human adenovirus F
uaagguaaagccacaa

SEQ ID NO: 1585633 - RNA, 16 nt, Human adenovirus F
agcccgcaacggcgca

SEQ ID NO: 1585634 - RNA, 14 nt, Human adenovirus F
uguaugggcagcau

SEQ ID NO: 1585635 - RNA, 13 nt, Human adenovirus F
ggaggccauccug

SEQ ID NO: 1585636 - RNA, 14 nt, Human adenovirus F
ucaccuacucuggc

SEQ ID NO: 1585637 - RNA, 23 nt, Human adenovirus F
ugcagcagcgcccgccucccaaa

SEQ ID NO: 1585638 - RNA, 18 nt, Human adenovirus F
aaaacuuggcagcaacau

SEQ ID NO: 1585639 - RNA, 16 nt, Human adenovirus F
gcuagaccaacaaacg

SEQ ID NO: 1585640 - RNA, 22 nt, Human adenovirus F
ccggcggcgggugcaguggcgg

SEQ ID NO: 1585641 - RNA, 14 nt, Human adenovirus F
auggugguagaagg

SEQ ID NO: 1585642 - RNA, 20 nt, Human adenovirus F
cucagccugaaauacacuga

SEQ ID NO: 1585643 - RNA, 17 nt, Human adenovirus F
cacauaagaagccagcc

SEQ ID NO: 1585644 - RNA, 13 nt, Human adenovirus F
cguugugcgcauc

SEQ ID NO: 1585645 - RNA, 12 nt, Human adenovirus F
uacauuggccac

SEQ ID NO: 1585646 - RNA, 23 nt, Human adenovirus F
gauuccugggguagggugucugc

SEQ ID NO: 1585647 - RNA, 20 nt, Human adenovirus F
aaguccacaaaaacuccaaa

SEQ ID NO: 1585648 - RNA, 14 nt, Human adenovirus F
cucggguauggugg

SEQ ID NO: 1585649 - RNA, 22 nt, Human adenovirus F
accaacgaggccuuucacccag

SEQ ID NO: 1585650 - RNA, 16 nt, Human adenovirus F
gcgcgaacagaguggg

SEQ ID NO: 1585651 - RNA, 18 nt, Human adenovirus F
cacauccaagugccccag

SEQ ID NO: 1585652 - RNA, 14 nt, Human adenovirus F
cauugccucccuga

SEQ ID NO: 1585653 - RNA, 13 nt, Human adenovirus F
aggaggcggagga

SEQ ID NO: 1585654 - RNA, 14 nt, Human adenovirus F
caccucgcucacau

SEQ ID NO: 1585655 - RNA, 21 nt, Human adenovirus F
ugugccauuguuaacacggcg

SEQ ID NO: 1585656 - RNA, 14 nt, Human adenovirus F
gucagguuugacag

SEQ ID NO: 1585657 - RNA, 15 nt, Human adenovirus F
ucgcauccuggcccu

SEQ ID NO: 1585658 - RNA, 22 nt, Human adenovirus F
agguaaucaggagaaaaaagac

SEQ ID NO: 1585659 - RNA, 15 nt, Human adenovirus F
cugaccagcagcagc

SEQ ID NO: 1585660 - RNA, 18 nt, Human adenovirus F
cuacaauuccacuggcaa

SEQ ID NO: 1585661 - RNA, 23 nt, Human adenovirus F
gacgugccugagggcgacgacgg

SEQ ID NO: 1585662 - RNA, 17 nt, Human adenovirus F
ugcuccuggcgagccca

SEQ ID NO: 1585663 - RNA, 14 nt, Human adenovirus F
uaugccaacuuuuu

SEQ ID NO: 1585664 - RNA, 12 nt, Human adenovirus F
acugccaccucc

SEQ ID NO: 1585665 - RNA, 14 nt, Human adenovirus F
cuagucccuccucc

SEQ ID NO: 1585666 - RNA, 22 nt, Human adenovirus F
cagcuaacucucuuacauuggc

SEQ ID NO: 1585667 - RNA, 21 nt, Human adenovirus F
ccgaagccuucaggcagcagc

SEQ ID NO: 1585668 - RNA, 14 nt, Human adenovirus F
ggcgcugggacggg

SEQ ID NO: 1585669 - RNA, 19 nt, Human adenovirus F
agccgacuucaagcccaau

SEQ ID NO: 1585670 - RNA, 19 nt, Human adenovirus F
cccaucaucgccgccgcca

SEQ ID NO: 1585671 - RNA, 22 nt, Human adenovirus F
uguaccgccaaaaaagcagccu

SEQ ID NO: 1585672 - RNA, 17 nt, Human adenovirus F
ccauuggcaauguguuu

SEQ ID NO: 1585673 - RNA, 18 nt, Human adenovirus F
acagcguagcacucccuc

SEQ ID NO: 1585674 - RNA, 22 nt, Human adenovirus F
ucccgccccccacuagcgcccc

SEQ ID NO: 1585675 - RNA, 18 nt, Human adenovirus F
caauggaacgcaguguuu

SEQ ID NO: 1585676 - RNA, 15 nt, Human adenovirus F
cgguuucaaacaugu

SEQ ID NO: 1585677 - RNA, 16 nt, Human adenovirus F
aagcagagcucugcaa

SEQ ID NO: 1585678 - RNA, 15 nt, Human adenovirus F
uuccucccaacuuuc

SEQ ID NO: 1585679 - RNA, 13 nt, Human adenovirus F
aaccuugaggaau

SEQ ID NO: 1585680 - RNA, 16 nt, Human adenovirus F
cggcacgggcgcacgu

SEQ ID NO: 1585681 - RNA, 22 nt, Human adenovirus F
guuaacaugauucuccaaagca

SEQ ID NO: 1585682 - RNA, 13 nt, Human adenovirus F
caccagaugaugu

SEQ ID NO: 1585683 - RNA, 16 nt, Human adenovirus F
aucggcaccagccagc

SEQ ID NO: 1585684 - RNA, 13 nt, Human adenovirus F
cccgaggacggca

SEQ ID NO: 1585685 - RNA, 17 nt, Human adenovirus F
acggaaggaaacgcugu

SEQ ID NO: 1585686 - RNA, 18 nt, Human adenovirus F
ugcucuuuuugaaucauu

SEQ ID NO: 1585687 - RNA, 23 nt, Human adenovirus F
agaagaugcccuguccguggugu

SEQ ID NO: 1585688 - RNA, 22 nt, Human adenovirus F
auggaaacugucaggcucugag

SEQ ID NO: 1585689 - RNA, 17 nt, Human adenovirus F
cccaccgcccccacugu

SEQ ID NO: 1585690 - RNA, 15 nt, Human adenovirus F
cgaaacuuccaaccc

SEQ ID NO: 1585691 - RNA, 15 nt, Human adenovirus F
gucguugccagccgg

SEQ ID NO: 1585692 - RNA, 17 nt, Human adenovirus F
caggucguaaugaggac

SEQ ID NO: 1585693 - RNA, 18 nt, Human adenovirus F
ccgagguauccagcucaa

SEQ ID NO: 1585694 - RNA, 22 nt, Human adenovirus F
cuugcauaaaagcuucuaucug

SEQ ID NO: 1585695 - RNA, 19 nt, Human adenovirus F
accaaaacaaaacaaacuc

SEQ ID NO: 1585696 - RNA, 19 nt, Human adenovirus F
cgcagcgggcaggagcccg

SEQ ID NO: 1585697 - RNA, 20 nt, Human adenovirus F
ucugcagcagcgcccgccuc

SEQ ID NO: 1585698 - RNA, 19 nt, Human adenovirus F
agagcuugggcccugggcu

SEQ ID NO: 1585699 - RNA, 18 nt, Human adenovirus F
acgacaaucagaccacaa

SEQ ID NO: 1585700 - RNA, 20 nt, Human adenovirus F
accaauaugcccaacaucaa

SEQ ID NO: 1585701 - RNA, 15 nt, Human adenovirus F
ucacgaccucccaaa

SEQ ID NO: 1585702 - RNA, 19 nt, Human adenovirus F
aagcugcggaaaugcuuua

SEQ ID NO: 1585703 - RNA, 16 nt, Human adenovirus F
aucaguuguuugucaa

SEQ ID NO: 1585704 - RNA, 16 nt, Human adenovirus F
cagcagauccuucccg

SEQ ID NO: 1585705 - RNA, 18 nt, Human adenovirus F
ucagcgcgcuucgccucc

SEQ ID NO: 1585706 - RNA, 16 nt, Human adenovirus F
gcaguguuauaagguc

SEQ ID NO: 1585707 - RNA, 20 nt, Human adenovirus F
cacaguguuugcuucuacca

SEQ ID NO: 1585708 - RNA, 18 nt, Human adenovirus F
cguuuccucgauuuccau

SEQ ID NO: 1585709 - RNA, 12 nt, Human adenovirus F
cguacacuggcu

SEQ ID NO: 1585710 - RNA, 19 nt, Human adenovirus F
cuugggaggauuuugaguu

SEQ ID NO: 1585711 - RNA, 14 nt, Human adenovirus F
gaccuggaagaggg

SEQ ID NO: 1585712 - RNA, 19 nt, Human adenovirus F
aaaucaaggccaaaguuca

SEQ ID NO: 1585713 - RNA, 13 nt, Human adenovirus F
ucaaucagcggcu

SEQ ID NO: 1585714 - RNA, 13 nt, Human adenovirus F
aggcaguggugga

SEQ ID NO: 1585715 - RNA, 16 nt, Human adenovirus F
uggcgcgcgaggaggu

SEQ ID NO: 1585716 - RNA, 18 nt, Human adenovirus F
aggagcagcgggaagaga

SEQ ID NO: 1585717 - RNA, 20 nt, Human adenovirus F
ugcaaacgagaggaccacuu

SEQ ID NO: 1585718 - RNA, 21 nt, Human adenovirus F
cauuaauaguggcacagcaaa

SEQ ID NO: 1585719 - RNA, 15 nt, Human adenovirus F
cccaggcggaaacca

SEQ ID NO: 1585720 - RNA, 21 nt, Human adenovirus F
uuucauuuaccaccccagcac

SEQ ID NO: 1585721 - RNA, 21 nt, Human adenovirus F
cgucgguggauaccgcugcag

SEQ ID NO: 1585722 - RNA, 21 nt, Human adenovirus F
ggaaccaggcaguggacagcu

SEQ ID NO: 1585723 - RNA, 17 nt, Human adenovirus F
uagccaguggacaaacc

SEQ ID NO: 1585724 - RNA, 15 nt, Human adenovirus F
acaugcgcuccaaca

SEQ ID NO: 1585725 - RNA, 18 nt, Human adenovirus F
agcucccuauauaggaca

SEQ ID NO: 1585726 - RNA, 22 nt, Human adenovirus F
gcggaaaccaagggcucugccu

SEQ ID NO: 1585727 - RNA, 20 nt, Human adenovirus F
cuucucuucggccuccacau

SEQ ID NO: 1585728 - RNA, 16 nt, Human adenovirus F
gcgccgagcggcugcu

SEQ ID NO: 1585729 - RNA, 14 nt, Human adenovirus F
acuucagccugggg

SEQ ID NO: 1585730 - RNA, 15 nt, Human adenovirus F
augccucccuuugcc

SEQ ID NO: 1585731 - RNA, 15 nt, Human adenovirus F
gacgcgaggaugaga

SEQ ID NO: 1585732 - RNA, 14 nt, Human adenovirus F
uggacgggcuggcu

SEQ ID NO: 1585733 - RNA, 19 nt, Human adenovirus F
ccgccaugacugccgcucg

SEQ ID NO: 1585734 - RNA, 14 nt, Human adenovirus F
ggucaacagcugga

SEQ ID NO: 1585735 - RNA, 15 nt, Human adenovirus F
gccaggcggcgauga

SEQ ID NO: 1585736 - RNA, 12 nt, Human adenovirus F
agcgggcaggag

SEQ ID NO: 1585737 - RNA, 17 nt, Human adenovirus F
guuacaaaaugaguggc

SEQ ID NO: 1585738 - RNA, 13 nt, Human adenovirus F
gcuccuggcgagc

SEQ ID NO: 1585739 - RNA, 18 nt, Human adenovirus F
guggauaccgcugcagcu

SEQ ID NO: 1585740 - RNA, 14 nt, Human adenovirus F
ugggagugcuggcc

SEQ ID NO: 1585741 - RNA, 19 nt, Human adenovirus F
aaagaaccagaauugaaga

SEQ ID NO: 1585742 - RNA, 18 nt, Human adenovirus F
acuaucccgccccugcca

SEQ ID NO: 1585743 - RNA, 15 nt, Human adenovirus F
cuacaagauuccacc

SEQ ID NO: 1585744 - RNA, 21 nt, Human adenovirus F
cccuuacgaacacuacaaucc

SEQ ID NO: 1585745 - RNA, 20 nt, Human adenovirus F
gaccucauccgccauugcca

SEQ ID NO: 1585746 - RNA, 15 nt, Human adenovirus F
uagagacugccaagc

SEQ ID NO: 1585747 - RNA, 20 nt, Human adenovirus F
gucagcuaacucucuuacau

SEQ ID NO: 1585748 - RNA, 13 nt, Human adenovirus F
caaacaacugcaa

SEQ ID NO: 1585749 - RNA, 19 nt, Human adenovirus F
ggcggcgaccugaaaacca

SEQ ID NO: 1585750 - RNA, 15 nt, Human adenovirus F
cgggucgcagcaggu

SEQ ID NO: 1585751 - RNA, 14 nt, Human adenovirus F
cugauuugagggua

SEQ ID NO: 1585752 - RNA, 14 nt, Human adenovirus F
agguggggcggcga

SEQ ID NO: 1585753 - RNA, 21 nt, Human adenovirus F
caacucguucaguggcgcgcu

SEQ ID NO: 1585754 - RNA, 19 nt, Human adenovirus F
cuacaaaaggcgcacaaga

SEQ ID NO: 1585755 - RNA, 18 nt, Human adenovirus F
ccccgcgacgucagcuga

SEQ ID NO: 1585756 - RNA, 16 nt, Human adenovirus F
uucuuuuugggaggaa

SEQ ID NO: 1585757 - RNA, 13 nt, Human adenovirus F
caaacacaaacac

SEQ ID NO: 1585758 - RNA, 22 nt, Human adenovirus F
gccagacuuugucagccaaagu

SEQ ID NO: 1585759 - RNA, 11 nt, Human adenovirus F
auaagcugggu

SEQ ID NO: 1585760 - RNA, 15 nt, Human adenovirus F
ggacguggaggaaga

SEQ ID NO: 1585761 - RNA, 14 nt, Human adenovirus F
ccguccccagcgcc

SEQ ID NO: 1585762 - RNA, 14 nt, Human adenovirus F
aaaagucaaaagug

SEQ ID NO: 1585763 - RNA, 18 nt, Human adenovirus F
ccucuugggcaggagugc

SEQ ID NO: 1585764 - RNA, 22 nt, Human adenovirus F
cgccguggcuggcgggcaaagc

SEQ ID NO: 1585765 - RNA, 19 nt, Human adenovirus F
cuagaggacguggaggaag

SEQ ID NO: 1585766 - RNA, 15 nt, Human adenovirus F
acccgccgucgucgc

SEQ ID NO: 1585767 - RNA, 15 nt, Human adenovirus F
aaagcgggggcgucc

SEQ ID NO: 1585768 - RNA, 15 nt, Human adenovirus F
auauuggcuaccagg

SEQ ID NO: 1585769 - RNA, 16 nt, Human adenovirus F
ugccaucugcagcauu

SEQ ID NO: 1585770 - RNA, 17 nt, Human adenovirus F
aaugccaggcagcaggg

SEQ ID NO: 1585771 - RNA, 18 nt, Human adenovirus F
gugauaucauuaaaaagg

SEQ ID NO: 1585772 - RNA, 15 nt, Human adenovirus F
aaucaaggccaaagu

SEQ ID NO: 1585773 - RNA, 17 nt, Human adenovirus F
aggaggaggagaaccug

SEQ ID NO: 1585774 - RNA, 22 nt, Human adenovirus F
gugguggccaacgccaggcguu

SEQ ID NO: 1585775 - RNA, 15 nt, Human adenovirus F
ccuacucuggcuccg

SEQ ID NO: 1585776 - RNA, 19 nt, Human adenovirus F
aggauuuacacaacgauuc

SEQ ID NO: 1585777 - RNA, 22 nt, Human adenovirus F
gagcaagcgcaaguucaaagaa

SEQ ID NO: 1585778 - RNA, 23 nt, Human adenovirus F
cagucggugggcguccaguggag

SEQ ID NO: 1585779 - RNA, 18 nt, Human adenovirus F
augccuccagcacugccg

SEQ ID NO: 1585780 - RNA, 14 nt, Human adenovirus F
gcuaaaucuuccuc

SEQ ID NO: 1585781 - RNA, 16 nt, Human adenovirus F
ggccccugaggcagcg

SEQ ID NO: 1585782 - RNA, 17 nt, Human adenovirus F
uggccccuaccagccgu

SEQ ID NO: 1585783 - RNA, 14 nt, Human adenovirus F
ccuggccaacugcc

SEQ ID NO: 1585784 - RNA, 18 nt, Human adenovirus F
uuaccccgacagaggccg

SEQ ID NO: 1585785 - RNA, 14 nt, Human adenovirus F
acauccauuuccac

SEQ ID NO: 1585786 - RNA, 16 nt, Human adenovirus F
aggaggccauccugga

SEQ ID NO: 1585787 - RNA, 21 nt, Human adenovirus F
acguaccaaccggagccucaa

SEQ ID NO: 1585788 - RNA, 12 nt, Human adenovirus F
cagccaguggga

SEQ ID NO: 1585789 - RNA, 20 nt, Human adenovirus F
acuaaggcgggcacaaagga

SEQ ID NO: 1585790 - RNA, 12 nt, Human adenovirus F
cugggacagccu

SEQ ID NO: 1585791 - RNA, 13 nt, Human adenovirus F
ucuuacaauuuga

SEQ ID NO: 1585792 - RNA, 19 nt, Human adenovirus F
aauuuaugccuagcucuaa

SEQ ID NO: 1585793 - RNA, 23 nt, Human adenovirus F
aggagugcgucagaauguggugg

SEQ ID NO: 1585794 - RNA, 13 nt, Human adenovirus F
cguuguggacuuc

SEQ ID NO: 1585795 - RNA, 15 nt, Human adenovirus F
gcaccagccagcuca

SEQ ID NO: 1585796 - RNA, 16 nt, Human adenovirus F
acagcugaagacacau

SEQ ID NO: 1585797 - RNA, 12 nt, Human adenovirus F
caguuggagcag

SEQ ID NO: 1585798 - RNA, 22 nt, Human adenovirus F
ccgucguacaaguugcaaagcu

SEQ ID NO: 1585799 - RNA, 16 nt, Human adenovirus F
gccuugcaagcagcuc

SEQ ID NO: 1585800 - RNA, 20 nt, Human adenovirus F
ccgcacucgcuccacccgcc

SEQ ID NO: 1585801 - RNA, 21 nt, Human adenovirus F
cagcuucucgaggccaaaccc

SEQ ID NO: 1585802 - RNA, 13 nt, Human adenovirus F
gcgcaaugcagag

SEQ ID NO: 1585803 - RNA, 21 nt, Human adenovirus F
uguacaaagucauccaaauca

SEQ ID NO: 1585804 - RNA, 15 nt, Human adenovirus F
ggaggaagagggucu

SEQ ID NO: 1585805 - RNA, 23 nt, Human adenovirus F
aucuucaaacauuaagcugcaau

SEQ ID NO: 1585806 - RNA, 19 nt, Human adenovirus F
auuaaacgucaaugccaau

SEQ ID NO: 1585807 - RNA, 19 nt, Human adenovirus F
ccgccgucgucgcucuguc

SEQ ID NO: 1585808 - RNA, 21 nt, Human adenovirus F
gaaucuaaccacuaccacccu

SEQ ID NO: 1585809 - RNA, 12 nt, Human adenovirus F
uuuacuuaaaaa

SEQ ID NO: 1585810 - RNA, 17 nt, Human adenovirus F
gauuuacaaaacccccu

SEQ ID NO: 1585811 - RNA, 20 nt, Human adenovirus F
ucuucaaucguuuuccugag

SEQ ID NO: 1585812 - RNA, 15 nt, Human adenovirus F
aaugguaccacgcag

SEQ ID NO: 1585813 - RNA, 12 nt, Human adenovirus F
acugaccccauu

SEQ ID NO: 1585814 - RNA, 16 nt, Human adenovirus F
cgcaacggcgcagcag

SEQ ID NO: 1585815 - RNA, 12 nt, Human adenovirus F
agagcuggaggg

SEQ ID NO: 1585816 - RNA, 20 nt, Human adenovirus F
gucagcaagacaccaguagc

SEQ ID NO: 1585817 - RNA, 12 nt, Human adenovirus F
ggaugguggcaa

SEQ ID NO: 1585818 - RNA, 14 nt, Human adenovirus F
ggugcgguuucaaa

SEQ ID NO: 1585819 - RNA, 19 nt, Human adenovirus F
cccgaagccuucaggcagc

SEQ ID NO: 1585820 - RNA, 21 nt, Human adenovirus F
guguuaucacccaaagccaaa

SEQ ID NO: 1585821 - RNA, 16 nt, Human adenovirus F
cucgagguguaacauc

SEQ ID NO: 1585822 - RNA, 19 nt, Human adenovirus F
uugcacgcucugcaucucu

SEQ ID NO: 1585823 - RNA, 18 nt, Human adenovirus F
aacggacgcauuaccauu

SEQ ID NO: 1585824 - RNA, 14 nt, Human adenovirus F
aguuccucuucucu

SEQ ID NO: 1585825 - RNA, 11 nt, Human adenovirus F
cugucuggaac

SEQ ID NO: 1585826 - RNA, 14 nt, Human adenovirus F
accacuucgggaga

SEQ ID NO: 1585827 - RNA, 15 nt, Human adenovirus F
uggcccaccacucug

SEQ ID NO: 1585828 - RNA, 21 nt, Human adenovirus F
gauaccgcugcagcugcugcc

SEQ ID NO: 1585829 - RNA, 19 nt, Human adenovirus F
cuagaccaacaaacgaaaa

SEQ ID NO: 1585830 - RNA, 21 nt, Human adenovirus F
aagcgggcgcaauacucgcag

SEQ ID NO: 1585831 - RNA, 14 nt, Human adenovirus F
gcuuggaggagcug

SEQ ID NO: 1585832 - RNA, 15 nt, Human adenovirus F
acugccacugaaacc

SEQ ID NO: 1585833 - RNA, 15 nt, Human adenovirus F
gaagagcaaaaccuc

SEQ ID NO: 1585834 - RNA, 23 nt, Human adenovirus F
ucccaaagucccccuuacagccu

SEQ ID NO: 1585835 - RNA, 15 nt, Human adenovirus F
caauccuaacaaaaa

SEQ ID NO: 1585836 - RNA, 14 nt, Human adenovirus F
uugcaucucaaagc

SEQ ID NO: 1585837 - RNA, 19 nt, Human adenovirus F
cacuagcgccccugcagcc

SEQ ID NO: 1585838 - RNA, 17 nt, Human adenovirus F
uacgcccaggagcagcg

SEQ ID NO: 1585839 - RNA, 23 nt, Human adenovirus F
augugccgcgcgggcaggaggac

SEQ ID NO: 1585840 - RNA, 15 nt, Human adenovirus F
cucauccgccauugc

SEQ ID NO: 1585841 - RNA, 19 nt, Human adenovirus F
accggguuuuggacauggc

SEQ ID NO: 1585842 - RNA, 23 nt, Human adenovirus F
agcgucuuacauaucgcuugcca

SEQ ID NO: 1585843 - RNA, 12 nt, Human adenovirus F
ugugacaaaauc

SEQ ID NO: 1585844 - RNA, 17 nt, Human adenovirus F
agacacauuggcuggag

SEQ ID NO: 1585845 - RNA, 16 nt, Human adenovirus F
gcaagccgcugacggc

SEQ ID NO: 1585846 - RNA, 13 nt, Human adenovirus F
caugaggaggaaa

SEQ ID NO: 1585847 - RNA, 23 nt, Human adenovirus F
auggucauuuuuucaagggauug

SEQ ID NO: 1585848 - RNA, 21 nt, Human adenovirus F
cuuuaacaacacaggagcuuu

SEQ ID NO: 1585849 - RNA, 14 nt, Human adenovirus F
gccaacuauuuggc

SEQ ID NO: 1585850 - RNA, 12 nt, Human adenovirus F
aaccggcggcgu

SEQ ID NO: 1585851 - RNA, 13 nt, Human adenovirus F
gagcuauuacuuu

SEQ ID NO: 1585852 - RNA, 17 nt, Human adenovirus F
accucuucuucuuccuc

SEQ ID NO: 1585853 - RNA, 21 nt, Human adenovirus F
gcagccguugcucucuccgga

SEQ ID NO: 1585854 - RNA, 18 nt, Human adenovirus F
gaccacuggagggcguca

SEQ ID NO: 1585855 - RNA, 21 nt, Human adenovirus F
ccuccgacgcuugcuggaguu

SEQ ID NO: 1585856 - RNA, 20 nt, Human adenovirus F
cgcagcguugcacgcucugc

SEQ ID NO: 1585857 - RNA, 15 nt, Human adenovirus F
aauaccccgucacuc

SEQ ID NO: 1585858 - RNA, 14 nt, Human adenovirus F
acagccaggcagag

SEQ ID NO: 1585859 - RNA, 21 nt, Human adenovirus F
cgugggaaggggccagcaagc

SEQ ID NO: 1585860 - RNA, 16 nt, Human adenovirus F
caguaagcaacaacca

SEQ ID NO: 1585861 - RNA, 12 nt, Human adenovirus F
aucuucaaacau

SEQ ID NO: 1585862 - RNA, 15 nt, Human adenovirus F
aaacaagcaaagaca

SEQ ID NO: 1585863 - RNA, 16 nt, Human adenovirus F
ucaaacacugcgcaaa

SEQ ID NO: 1585864 - RNA, 16 nt, Human adenovirus F
cuuaauucuucaugua

SEQ ID NO: 1585865 - RNA, 13 nt, Human adenovirus F
auucucucuccuu

SEQ ID NO: 1585866 - RNA, 17 nt, Human adenovirus F
ccagucggcaggcuucc

SEQ ID NO: 1585867 - RNA, 12 nt, Human adenovirus F
agucaagcucuc

SEQ ID NO: 1585868 - RNA, 20 nt, Human adenovirus F
guucucgcucgcuacaucca

SEQ ID NO: 1585869 - RNA, 20 nt, Human adenovirus F
cuugcgcaacuucuuuuugg

SEQ ID NO: 1585870 - RNA, 20 nt, Human adenovirus F
uaccgcgcccccuggggggc

SEQ ID NO: 1585871 - RNA, 14 nt, Human adenovirus F
augagcugggagaa

SEQ ID NO: 1585872 - RNA, 15 nt, Human adenovirus F
guuugggagccagga

SEQ ID NO: 1585873 - RNA, 17 nt, Human adenovirus F
agaaauagggcccggac

SEQ ID NO: 1585874 - RNA, 13 nt, Human adenovirus F
agcuugaggaggu

SEQ ID NO: 1585875 - RNA, 21 nt, Human adenovirus F
gcaagcgcaaguucaaagaag

SEQ ID NO: 1585876 - RNA, 17 nt, Human adenovirus F
gaacggcgugcuggaaa

SEQ ID NO: 1585877 - RNA, 22 nt, Human adenovirus F
cugcaccccucaucgcucacug

SEQ ID NO: 1585878 - RNA, 23 nt, Human adenovirus F
gcggcugguuauguuggcgcgga

SEQ ID NO: 1585879 - RNA, 21 nt, Human adenovirus F
cggacgugagagaggcggugg

SEQ ID NO: 1585880 - RNA, 18 nt, Human adenovirus F
gcguagaguuugggagcc

SEQ ID NO: 1585881 - RNA, 16 nt, Human adenovirus F
auaccgcugcagcugc

SEQ ID NO: 1585882 - RNA, 19 nt, Human adenovirus F
cucuguuugcugcacugcc

SEQ ID NO: 1585883 - RNA, 14 nt, Human adenovirus F
gaaauugaaguagg

SEQ ID NO: 1585884 - RNA, 13 nt, Human adenovirus F
ggccuguuuuuga

SEQ ID NO: 1585885 - RNA, 21 nt, Human adenovirus F
auccccuauugcgaccggccc

SEQ ID NO: 1585886 - RNA, 18 nt, Human adenovirus F
cagccccaggccaaccgc

SEQ ID NO: 1585887 - RNA, 15 nt, Human adenovirus F
ucuguccgccgccgc

SEQ ID NO: 1585888 - RNA, 18 nt, Human adenovirus F
ugcacugccaucugcagc

SEQ ID NO: 1585889 - RNA, 19 nt, Human adenovirus F
agaaacuacaaaagcagug

SEQ ID NO: 1585890 - RNA, 20 nt, Human adenovirus F
ggcacuugaacauucuugcg

SEQ ID NO: 1585891 - RNA, 18 nt, Human adenovirus F
cgucuacccuuacgaaca

SEQ ID NO: 1585892 - RNA, 15 nt, Human adenovirus F
aaugcagagcuuggg

SEQ ID NO: 1585893 - RNA, 22 nt, Human adenovirus F
aagcugugagcgccagccgccg

SEQ ID NO: 1585894 - RNA, 15 nt, Human adenovirus F
cgacagccaggcaga

SEQ ID NO: 1585895 - RNA, 21 nt, Human adenovirus F
accaccucuucuucuuccucc

SEQ ID NO: 1585896 - RNA, 16 nt, Human adenovirus F
cucuauacgacaccac

SEQ ID NO: 1585897 - RNA, 20 nt, Human adenovirus F
uuaaugcuuuucugagcaca

SEQ ID NO: 1585898 - RNA, 18 nt, Human adenovirus F
uuuuugagcaugaaacug

SEQ ID NO: 1585899 - RNA, 16 nt, Human adenovirus F
caaaacaauucucucu

SEQ ID NO: 1585900 - RNA, 20 nt, Human adenovirus F
cugccagaacuuccagcugu

SEQ ID NO: 1585901 - RNA, 21 nt, Human adenovirus F
aaacccguucggagccaaccu

SEQ ID NO: 1585902 - RNA, 20 nt, Human adenovirus F
gccggcucuaggcauaaagu

SEQ ID NO: 1585903 - RNA, 22 nt, Human adenovirus F
cuaccgccuuuggagguggcac

SEQ ID NO: 1585904 - RNA, 18 nt, Human adenovirus F
ccugaggaggaggccauc

SEQ ID NO: 1585905 - RNA, 18 nt, Human adenovirus F
cugaccgaccuggggcaa

SEQ ID NO: 1585906 - RNA, 12 nt, Human adenovirus F
cgauggagccag

SEQ ID NO: 1585907 - RNA, 15 nt, Human adenovirus F
ggggauuggcggcua

SEQ ID NO: 1585908 - RNA, 17 nt, Human adenovirus F
ccgcuuggaggagcugu

SEQ ID NO: 1585909 - RNA, 21 nt, Human adenovirus F
cucagcuuauucgccagucca

SEQ ID NO: 1585910 - RNA, 13 nt, Human adenovirus F
aauuuagcucuaa

SEQ ID NO: 1585911 - RNA, 13 nt, Human adenovirus F
ggaguuggaggag

SEQ ID NO: 1585912 - RNA, 17 nt, Human adenovirus F
uacaaacaguaacaacu

SEQ ID NO: 1585913 - RNA, 13 nt, Human adenovirus F
ccuacugccgcca

SEQ ID NO: 1585914 - RNA, 13 nt, Human adenovirus F
caugacugccgcu

SEQ ID NO: 1585915 - RNA, 18 nt, Human adenovirus F
caccucuucuucuuccuc

SEQ ID NO: 1585916 - RNA, 13 nt, Human adenovirus F
gacauuguuuugc

SEQ ID NO: 1585917 - RNA, 19 nt, Human adenovirus F
cugucaggcucugagagug

SEQ ID NO: 1585918 - RNA, 19 nt, Human adenovirus F
acgagcuugcucgcuggcu

SEQ ID NO: 1585919 - RNA, 21 nt, Human adenovirus F
gcugcguucgacggcgguggc

SEQ ID NO: 1585920 - RNA, 17 nt, Human adenovirus F
cucccaauccuagccag

SEQ ID NO: 1585921 - RNA, 21 nt, Human adenovirus F
uccagugcaggaagaggagga

SEQ ID NO: 1585922 - RNA, 22 nt, Human adenovirus F
caccgcaaugcuggucugcgcu

SEQ ID NO: 1585923 - RNA, 19 nt, Human adenovirus F
aaccggucguaacaaauac

SEQ ID NO: 1585924 - RNA, 21 nt, Human adenovirus F
aaaacgucccaucauuuccac

SEQ ID NO: 1585925 - RNA, 12 nt, Human adenovirus F
ugacucuuacaa

SEQ ID NO: 1585926 - RNA, 20 nt, Human adenovirus F
acgcugagugacgaucuggg

SEQ ID NO: 1585927 - RNA, 14 nt, Human adenovirus F
ggucggcacgcucc

SEQ ID NO: 1585928 - RNA, 22 nt, Human adenovirus F
cccaccgaguuccugcgcugcu

SEQ ID NO: 1585929 - RNA, 20 nt, Human adenovirus F
accucgccgcgcaggggcuc

SEQ ID NO: 1585930 - RNA, 14 nt, Human adenovirus F
ucaacuccucuugc

SEQ ID NO: 1585931 - RNA, 13 nt, Human adenovirus F
gcagaggagguga

SEQ ID NO: 1585932 - RNA, 15 nt, Human adenovirus F
agcagugggcaaagg

SEQ ID NO: 1585933 - RNA, 18 nt, Human adenovirus F
agauucaagggccagagc

SEQ ID NO: 1585934 - RNA, 16 nt, Human adenovirus F
aagccugacucagaaa

SEQ ID NO: 1585935 - RNA, 13 nt, Human adenovirus F
gcucauccugcug

SEQ ID NO: 1585936 - RNA, 20 nt, Human adenovirus F
aaacagcagguuaaagccaa

SEQ ID NO: 1585937 - RNA, 18 nt, Human adenovirus F
caccuacucuggcuccgu

SEQ ID NO: 1585938 - RNA, 16 nt, Human adenovirus F
ugggaacuguccaggg

SEQ ID NO: 1585939 - RNA, 22 nt, Human adenovirus F
gacggaggcaaaacuggaacgc

SEQ ID NO: 1585940 - RNA, 16 nt, Human adenovirus F
cagcucaacgggggcg

SEQ ID NO: 1585941 - RNA, 18 nt, Human adenovirus F
cuggccaacugccaccuc

SEQ ID NO: 1585942 - RNA, 22 nt, Human adenovirus F
aguagguggggccccugaggca

SEQ ID NO: 1585943 - RNA, 14 nt, Human adenovirus F
ugguggggaguucu

SEQ ID NO: 1585944 - RNA, 19 nt, Human adenovirus F
gcgcagcaccgcacagaaa

SEQ ID NO: 1585945 - RNA, 18 nt, Human adenovirus F
acgcggggcaggagcugc

SEQ ID NO: 1585946 - RNA, 13 nt, Human adenovirus F
aauauccuucaga

SEQ ID NO: 1585947 - RNA, 17 nt, Human adenovirus F
caacuuuugcaccaggg

SEQ ID NO: 1585948 - RNA, 16 nt, Human adenovirus F
gccacccaagggaaac

SEQ ID NO: 1585949 - RNA, 18 nt, Human adenovirus F
gcuuccuuaacaagggcu

SEQ ID NO: 1585950 - RNA, 11 nt, Human adenovirus F
aaacuggaaga

SEQ ID NO: 1585951 - RNA, 14 nt, Human adenovirus F
gcagcgggaagaga

SEQ ID NO: 1585952 - RNA, 19 nt, Human adenovirus F
ggagccucaaguggggcag

SEQ ID NO: 1585953 - RNA, 13 nt, Human adenovirus F
cugacagcuggga

SEQ ID NO: 1585954 - RNA, 23 nt, Human adenovirus F
guggucuaagggaacuucucccc

SEQ ID NO: 1585955 - RNA, 17 nt, Human adenovirus F
gcgccauagcuggaggg

SEQ ID NO: 1585956 - RNA, 21 nt, Human adenovirus F
uauaagcagguagaaugguuu

SEQ ID NO: 1585957 - RNA, 12 nt, Human adenovirus F
cggcggccauga

SEQ ID NO: 1585958 - RNA, 12 nt, Human adenovirus F
agucaaaugucu

SEQ ID NO: 1585959 - RNA, 16 nt, Human adenovirus F
gcauaacuucagcacu

SEQ ID NO: 1585960 - RNA, 14 nt, Human adenovirus F
aucaucgccgccgc

SEQ ID NO: 1585961 - RNA, 16 nt, Human adenovirus F
ccccuguaccaccgca

SEQ ID NO: 1585962 - RNA, 21 nt, Human adenovirus F
aaauuuauucccgaagacuau

SEQ ID NO: 1585963 - RNA, 15 nt, Human adenovirus F
ucuuacauuggccac

SEQ ID NO: 1585964 - RNA, 13 nt, Human adenovirus F
ugaggacgagccc

SEQ ID NO: 1585965 - RNA, 23 nt, Human adenovirus F
gcccgaccuguauacgggaagga

SEQ ID NO: 1585966 - RNA, 13 nt, Human adenovirus F
cuaaccacuacca

SEQ ID NO: 1585967 - RNA, 15 nt, Human adenovirus F
uacuaaaacaaacca

SEQ ID NO: 1585968 - RNA, 17 nt, Human adenovirus F
ggaacgcgauccggcac

SEQ ID NO: 1585969 - RNA, 22 nt, Human adenovirus F
gcccguccuccgaccccacacg

SEQ ID NO: 1585970 - RNA, 14 nt, Human adenovirus F
ugggcaaaggggga

SEQ ID NO: 1585971 - RNA, 23 nt, Human adenovirus F
cagacucgagguguaacaucccu

SEQ ID NO: 1585972 - RNA, 17 nt, Human adenovirus F
ugacacgcgcaacuucc

SEQ ID NO: 1585973 - RNA, 16 nt, Human adenovirus F
cagugguggacuuaca

SEQ ID NO: 1585974 - RNA, 20 nt, Human adenovirus F
auacuucuccauguggaacc

SEQ ID NO: 1585975 - RNA, 16 nt, Human adenovirus F
ggaagacgagcucccc

SEQ ID NO: 1585976 - RNA, 17 nt, Human adenovirus F
agacguuaaagcuggcu

SEQ ID NO: 1585977 - RNA, 20 nt, Human adenovirus F
gcccguggaaaaagacagca

SEQ ID NO: 1585978 - RNA, 15 nt, Human adenovirus F
guucuccguguccug

SEQ ID NO: 1585979 - RNA, 23 nt, Human adenovirus F
acgauaacgcuuuaucuguaaaa

SEQ ID NO: 1585980 - RNA, 15 nt, Human adenovirus F
ucggccuacugccgc

SEQ ID NO: 1585981 - RNA, 16 nt, Human adenovirus F
gcagcgggcaggagcc

SEQ ID NO: 1585982 - RNA, 13 nt, Human adenovirus F
gucagaauguggu

SEQ ID NO: 1585983 - RNA, 19 nt, Human adenovirus F
uggcacaguguuugcuucu

SEQ ID NO: 1585984 - RNA, 17 nt, Human adenovirus F
caccaacgugcaggcca

SEQ ID NO: 1585985 - RNA, 15 nt, Human adenovirus F
ccgggccagacuacu

SEQ ID NO: 1585986 - RNA, 18 nt, Human adenovirus F
gucgggcgugcgggugcc

SEQ ID NO: 1585987 - RNA, 20 nt, Human adenovirus F
gcgugcuuagacccggcacu

SEQ ID NO: 1585988 - RNA, 16 nt, Human adenovirus F
agcccauaaaagcaau

SEQ ID NO: 1585989 - RNA, 19 nt, Human adenovirus F
gccgcaccgcgcccguccu

SEQ ID NO: 1585990 - RNA, 19 nt, Human adenovirus F
accguuguggagucacugc

SEQ ID NO: 1585991 - RNA, 19 nt, Human adenovirus F
caaugggcuccagcgagca

SEQ ID NO: 1585992 - RNA, 15 nt, Human adenovirus F
agucggcaggcuucc

SEQ ID NO: 1585993 - RNA, 16 nt, Human adenovirus F
aacgucaacuccucuu

SEQ ID NO: 1585994 - RNA, 22 nt, Human adenovirus F
ucauccauaaugauggcgaugg

SEQ ID NO: 1585995 - RNA, 18 nt, Human adenovirus F
acggugaacgaggagcgc

SEQ ID NO: 1585996 - RNA, 21 nt, Human adenovirus F
gucugggguucauguugugca

SEQ ID NO: 1585997 - RNA, 17 nt, Human adenovirus F
ccacugacaguaagcaa

SEQ ID NO: 1585998 - RNA, 17 nt, Human adenovirus F
aacaucggcaccccucu

SEQ ID NO: 1585999 - RNA, 16 nt, Human adenovirus F
gcaaggaauguggggc

SEQ ID NO: 1586000 - RNA, 23 nt, Human adenovirus F
cccugaggaggaggccauccugg

SEQ ID NO: 1586001 - RNA, 12 nt, Human adenovirus F
aaucccagcaga

SEQ ID NO: 1586002 - RNA, 22 nt, Human adenovirus F
caccaacgugcaggccaaccua

SEQ ID NO: 1586003 - RNA, 22 nt, Human adenovirus F
gcuaucaggaagcagcucaggu

SEQ ID NO: 1586004 - RNA, 18 nt, Human adenovirus F
caaagcugugagcgccag

SEQ ID NO: 1586005 - RNA, 14 nt, Human adenovirus F
aggagucccugcac

SEQ ID NO: 1586006 - RNA, 18 nt, Human adenovirus F
cacauaagaagccagcca

SEQ ID NO: 1586007 - RNA, 22 nt, Human adenovirus F
agcuacuuucaucuuaacucug

SEQ ID NO: 1586008 - RNA, 20 nt, Human adenovirus F
caggcguggccuccguggcc

SEQ ID NO: 1586009 - RNA, 13 nt, Human adenovirus F
cuacaccaaugca

SEQ ID NO: 1586010 - RNA, 16 nt, Human adenovirus F
aggcucucaaaaaacg

SEQ ID NO: 1586011 - RNA, 14 nt, Human adenovirus F
ccauuauugcacuu

SEQ ID NO: 1586012 - RNA, 22 nt, Human adenovirus F
aacuccgacauguuugucuuua

SEQ ID NO: 1586013 - RNA, 19 nt, Human adenovirus F
cuuaauaccccgucacucu

SEQ ID NO: 1586014 - RNA, 15 nt, Human adenovirus F
gaccccauggacaac

SEQ ID NO: 1586015 - RNA, 17 nt, Human adenovirus F
cgccgccccuggccugu

SEQ ID NO: 1586016 - RNA, 17 nt, Human adenovirus F
aucucauucgcacggcg

SEQ ID NO: 1586017 - RNA, 19 nt, Human adenovirus F
gccuacggcaagcgcggcc

SEQ ID NO: 1586018 - RNA, 13 nt, Human adenovirus F
uccuuaaggagga

SEQ ID NO: 1586019 - RNA, 13 nt, Human adenovirus F
cgcgucugcugcu

SEQ ID NO: 1586020 - RNA, 21 nt, Human adenovirus F
gcagagcucugcaaaaacaaa

SEQ ID NO: 1586021 - RNA, 17 nt, Human adenovirus F
gccaccagccggaggag

SEQ ID NO: 1586022 - RNA, 19 nt, Human adenovirus F
gucuuacauaucgcuugcc

SEQ ID NO: 1586023 - RNA, 23 nt, Human adenovirus F
caguggaauuggaaugccugcag

SEQ ID NO: 1586024 - RNA, 14 nt, Human adenovirus F
ggaagcagcucagg

SEQ ID NO: 1586025 - RNA, 18 nt, Human adenovirus F
ggauuuugaguuagcucu

SEQ ID NO: 1586026 - RNA, 19 nt, Human adenovirus F
gcggacgggucgcagcagg

SEQ ID NO: 1586027 - RNA, 17 nt, Human adenovirus F
uacgcggggcaggagcu

SEQ ID NO: 1586028 - RNA, 14 nt, Human adenovirus F
ccacguaccagaaa

SEQ ID NO: 1586029 - RNA, 14 nt, Human adenovirus F
cauccgccuccacc

SEQ ID NO: 1586030 - RNA, 21 nt, Human adenovirus F
cugccaucgcugaccagcagc

SEQ ID NO: 1586031 - RNA, 15 nt, Human adenovirus F
acauaacuuuacaaa

SEQ ID NO: 1586032 - RNA, 18 nt, Human adenovirus F
aacucugaagaugucuga

SEQ ID NO: 1586033 - RNA, 21 nt, Human adenovirus F
agcuuacuuuaaaacuuggca

SEQ ID NO: 1586034 - RNA, 20 nt, Human adenovirus F
cggacucggaaccugaaaga

SEQ ID NO: 1586035 - RNA, 16 nt, Human adenovirus F
auccccgccgccccug

SEQ ID NO: 1586036 - RNA, 16 nt, Human adenovirus F
gaggccguagcccgug

SEQ ID NO: 1586037 - RNA, 20 nt, Human adenovirus F
ucuaagggaggcagcagagg

SEQ ID NO: 1586038 - RNA, 23 nt, Human adenovirus F
uacuucuucagcucuaagacugu

SEQ ID NO: 1586039 - RNA, 21 nt, Human adenovirus F
ggaaaaccuacgcccaggagc

SEQ ID NO: 1586040 - RNA, 14 nt, Human adenovirus F
ucgugucugcguac

SEQ ID NO: 1586041 - RNA, 13 nt, Human adenovirus F
aagaagcacagga

SEQ ID NO: 1586042 - RNA, 15 nt, Human adenovirus F
gcacagcaaacacaa

SEQ ID NO: 1586043 - RNA, 22 nt, Human adenovirus F
cuuuaacaacacaggagcuuua

SEQ ID NO: 1586044 - RNA, 17 nt, Human adenovirus F
ucaacuccucuugcagg

SEQ ID NO: 1586045 - RNA, 17 nt, Human adenovirus F
ccacaccugggaaaacc

SEQ ID NO: 1586046 - RNA, 15 nt, Human adenovirus F
cacuggcuggcccug

SEQ ID NO: 1586047 - RNA, 13 nt, Human adenovirus F
cacaaaaacucca

SEQ ID NO: 1586048 - RNA, 17 nt, Human adenovirus F
ucccaacaacggggugg

SEQ ID NO: 1586049 - RNA, 16 nt, Human adenovirus F
uacgugccuuuucaca

SEQ ID NO: 1586050 - RNA, 15 nt, Human adenovirus F
aucucccuccccccu

SEQ ID NO: 1586051 - RNA, 21 nt, Human adenovirus F
ggacagccuagacgaggagga

SEQ ID NO: 1586052 - RNA, 18 nt, Human adenovirus F
ccaccgccgcaccacuga

SEQ ID NO: 1586053 - RNA, 20 nt, Human adenovirus F
cucuuuuugaaucauuucca

SEQ ID NO: 1586054 - RNA, 20 nt, Human adenovirus F
cgagcuuuuacugggacagc

SEQ ID NO: 1586055 - RNA, 15 nt, Human adenovirus F
gagcugggacagccu

SEQ ID NO: 1586056 - RNA, 17 nt, Human adenovirus F
ccuucagcuugagagca

SEQ ID NO: 1586057 - RNA, 18 nt, Human adenovirus F
uaauaacuuucuuacacu

SEQ ID NO: 1586058 - RNA, 15 nt, Human adenovirus F
acuuccagcuguugg

SEQ ID NO: 1586059 - RNA, 18 nt, Human adenovirus F
gcaaccccacgccaagcc

SEQ ID NO: 1586060 - RNA, 20 nt, Human adenovirus F
accuucaaacccagccgcac

SEQ ID NO: 1586061 - RNA, 16 nt, Human adenovirus F
guggcucugcagcagc

SEQ ID NO: 1586062 - RNA, 19 nt, Human adenovirus F
ggcaggaaagccacgcucg

SEQ ID NO: 1586063 - RNA, 18 nt, Human adenovirus F
cucugucuuauccuccuu

SEQ ID NO: 1586064 - RNA, 15 nt, Human adenovirus F
aaguccacaaaaacu

SEQ ID NO: 1586065 - RNA, 17 nt, Human adenovirus F
gaaaucggagagggaag

SEQ ID NO: 1586066 - RNA, 16 nt, Human adenovirus F
cgccgcucaaggcgca

SEQ ID NO: 1586067 - RNA, 22 nt, Human adenovirus F
cgcagcugcuuguaucacagaa

SEQ ID NO: 1586068 - RNA, 18 nt, Human adenovirus F
caguggacaaaccaaaac

SEQ ID NO: 1586069 - RNA, 20 nt, Human adenovirus F
uccaaaggucagaaaaaccg

SEQ ID NO: 1586070 - RNA, 17 nt, Human adenovirus F
ugcgagaugcgucgggc

SEQ ID NO: 1586071 - RNA, 16 nt, Human adenovirus F
uugcucucuccggagc

SEQ ID NO: 1586072 - RNA, 23 nt, Human adenovirus F
cacuuuacuuaaacccacagcua

SEQ ID NO: 1586073 - RNA, 17 nt, Human adenovirus F
uuccagcagcaccaccu

SEQ ID NO: 1586074 - RNA, 18 nt, Human adenovirus F
gaaccaggcaguggacag

SEQ ID NO: 1586075 - RNA, 15 nt, Human adenovirus F
gcaguguuauaaggu

SEQ ID NO: 1586076 - RNA, 20 nt, Human adenovirus F
ccucuguuugcugcacugcc

SEQ ID NO: 1586077 - RNA, 17 nt, Human adenovirus F
cgugaccgagcagcugc

SEQ ID NO: 1586078 - RNA, 18 nt, Human adenovirus F
ugagcaggccgcccaaca

SEQ ID NO: 1586079 - RNA, 18 nt, Human adenovirus F
cccugucguugccagccg

SEQ ID NO: 1586080 - RNA, 15 nt, Human adenovirus F
gccuccaacacagcc

SEQ ID NO: 1586081 - RNA, 19 nt, Human adenovirus F
cauuaagguuacucagcaa

SEQ ID NO: 1586082 - RNA, 22 nt, Human adenovirus F
acuuuugccacacuaaaguuuu

SEQ ID NO: 1586083 - RNA, 20 nt, Human adenovirus F
gucuuccuucacuccucgcc

SEQ ID NO: 1586084 - RNA, 15 nt, Human adenovirus F
uaaugcccacaccug

SEQ ID NO: 1586085 - RNA, 17 nt, Human adenovirus F
acaguuucgcgcaccuc

SEQ ID NO: 1586086 - RNA, 12 nt, Human adenovirus F
agcuggccuggu

SEQ ID NO: 1586087 - RNA, 23 nt, Human adenovirus F
acccuucaacggaauuguaacug

SEQ ID NO: 1586088 - RNA, 18 nt, Human adenovirus F
cuccaaaggucagaaaaa

SEQ ID NO: 1586089 - RNA, 16 nt, Human adenovirus F
cacaauauuuauacac

SEQ ID NO: 1586090 - RNA, 19 nt, Human adenovirus F
auacagucaagcucuccac

SEQ ID NO: 1586091 - RNA, 22 nt, Human adenovirus F
aagacuaucacgcccaccaaau

SEQ ID NO: 1586092 - RNA, 19 nt, Human adenovirus F
aagccuucaggcagcagcc

SEQ ID NO: 1586093 - RNA, 14 nt, Human adenovirus F
gaacauuaauccaa

SEQ ID NO: 1586094 - RNA, 15 nt, Human adenovirus F
agaauacuaaaacaa

SEQ ID NO: 1586095 - RNA, 16 nt, Human adenovirus F
aagccuucaggcagca

SEQ ID NO: 1586096 - RNA, 19 nt, Human adenovirus F
uucugacaugcugguuuuc

SEQ ID NO: 1586097 - RNA, 14 nt, Human adenovirus F
ugcugcacugccau

SEQ ID NO: 1586098 - RNA, 21 nt, Human adenovirus F
gagcucaggguguuuuggguc

SEQ ID NO: 1586099 - RNA, 14 nt, Human adenovirus F
cuugcuggaccaaa

SEQ ID NO: 1586100 - RNA, 24 nt, Human adenovirus F
aaaacaaaccacgcccaugcagcc

SEQ ID NO: 1586101 - RNA, 17 nt, Human adenovirus F
aggaucccucagagcug

SEQ ID NO: 1586102 - RNA, 23 nt, Human adenovirus F
uucacccacccaccgcuguauuu

SEQ ID NO: 1586103 - RNA, 20 nt, Human adenovirus F
acacaauugguuggaaaagu

SEQ ID NO: 1586104 - RNA, 20 nt, Human adenovirus F
ggcugaugcauuugugggac

SEQ ID NO: 1586105 - RNA, 13 nt, Human adenovirus F
ugcgggcucugau

SEQ ID NO: 1586106 - RNA, 13 nt, Human adenovirus F
uggacauggccag

SEQ ID NO: 1586107 - RNA, 12 nt, Human adenovirus F
ggacgggcagcc

SEQ ID NO: 1586108 - RNA, 22 nt, Human adenovirus F
cugaacccgguguacaccaccu

SEQ ID NO: 1586109 - RNA, 19 nt, Human adenovirus F
gggggcccugaccgaccug

SEQ ID NO: 1586110 - RNA, 20 nt, Human adenovirus F
agucaaaugucuguaaagaa

SEQ ID NO: 1586111 - RNA, 21 nt, Human adenovirus F
aaaggaggucaagccaagcug

SEQ ID NO: 1586112 - RNA, 19 nt, Human adenovirus F
cagcuuauucgccagucca

SEQ ID NO: 1586113 - RNA, 17 nt, Human adenovirus F
gacgaagacauucuuga

SEQ ID NO: 1586114 - RNA, 17 nt, Human adenovirus F
gugaccgagcagcugcg

SEQ ID NO: 1586115 - RNA, 16 nt, Human adenovirus F
uggaaaacgaggggga

SEQ ID NO: 1586116 - RNA, 13 nt, Human adenovirus F
cgcaugccuccag

SEQ ID NO: 1586117 - RNA, 16 nt, Human adenovirus F
acuuaaacccacagcu

SEQ ID NO: 1586118 - RNA, 23 nt, Human adenovirus F
gcuaccguucuaugcuccugggu

SEQ ID NO: 1586119 - RNA, 19 nt, Human adenovirus F
agaaauuuagauuuuucuu

SEQ ID NO: 1586120 - RNA, 22 nt, Human adenovirus F
ccauuaaaaaucuccugcuccu

SEQ ID NO: 1586121 - RNA, 17 nt, Human adenovirus F
gaagcaggguugcuaga

SEQ ID NO: 1586122 - RNA, 15 nt, Human adenovirus F
uauaaaaacaaccaa

SEQ ID NO: 1586123 - RNA, 16 nt, Human adenovirus F
acgacggggauacugc

SEQ ID NO: 1586124 - RNA, 21 nt, Human adenovirus F
uuguuguuuuuuguagaugca

SEQ ID NO: 1586125 - RNA, 14 nt, Human adenovirus F
cgcagcgacugacg

SEQ ID NO: 1586126 - RNA, 15 nt, Human adenovirus F
cugacuuccuggucc

SEQ ID NO: 1586127 - RNA, 23 nt, Human adenovirus F
cccacgccuuacauguggagcua

SEQ ID NO: 1586128 - RNA, 13 nt, Human adenovirus F
gaaucuccugcac

SEQ ID NO: 1586129 - RNA, 19 nt, Human adenovirus F
ccaccuuggaagcaaugcu

SEQ ID NO: 1586130 - RNA, 21 nt, Human adenovirus F
ccaacgggcggcaaacuuucu

SEQ ID NO: 1586131 - RNA, 17 nt, Human adenovirus F
acaaaauggguuacuuu

SEQ ID NO: 1586132 - RNA, 18 nt, Human adenovirus F
cggcggccauggaucgca

SEQ ID NO: 1586133 - RNA, 13 nt, Human adenovirus F
agacaaaacacua

SEQ ID NO: 1586134 - RNA, 20 nt, Human adenovirus F
aaaugcucugcaaaaaaacg

SEQ ID NO: 1586135 - RNA, 13 nt, Human adenovirus F
caggaucccucag

SEQ ID NO: 1586136 - RNA, 22 nt, Human adenovirus F
ggccuacggaagggcggaacag

SEQ ID NO: 1586137 - RNA, 17 nt, Human adenovirus F
gcacaagugccgagcuu

SEQ ID NO: 1586138 - RNA, 23 nt, Human adenovirus F
ggccgcgaccggaucuggaggaa

SEQ ID NO: 1586139 - RNA, 18 nt, Human adenovirus F
cccugccgcugcgcagca

SEQ ID NO: 1586140 - RNA, 13 nt, Human adenovirus F
cucccacccacga

SEQ ID NO: 1586141 - RNA, 14 nt, Human adenovirus F
cucuuggacuagua

SEQ ID NO: 1586142 - RNA, 21 nt, Human adenovirus F
ggaucgcagcgggcaggagcc

SEQ ID NO: 1586143 - RNA, 16 nt, Human adenovirus F
gcaggccgcucccaau

SEQ ID NO: 1586144 - RNA, 22 nt, Human adenovirus F
augccuaccucugacaaacacg

SEQ ID NO: 1586145 - RNA, 16 nt, Human adenovirus F
uggauguuuuccaaga

SEQ ID NO: 1586146 - RNA, 13 nt, Human adenovirus F
uccaccagccgca

SEQ ID NO: 1586147 - RNA, 17 nt, Human adenovirus F
gugguacaggagcgcag

SEQ ID NO: 1586148 - RNA, 20 nt, Human adenovirus F
ggcuugugcggcuuuucgca

SEQ ID NO: 1586149 - RNA, 16 nt, Human adenovirus F
gucaaaaaagaugcga

SEQ ID NO: 1586150 - RNA, 14 nt, Human adenovirus F
cccuggccuggaac

SEQ ID NO: 1586151 - RNA, 16 nt, Human adenovirus F
gcaccagccagcucaa

SEQ ID NO: 1586152 - RNA, 15 nt, Human adenovirus F
cuacaaaagcagugg

SEQ ID NO: 1586153 - RNA, 15 nt, Human adenovirus F
cuccaacacagccgc

SEQ ID NO: 1586154 - RNA, 21 nt, Human adenovirus F
cagcaacuacccuguaguggg

SEQ ID NO: 1586155 - RNA, 12 nt, Human adenovirus F
ucgucacuuccg

SEQ ID NO: 1586156 - RNA, 18 nt, Human adenovirus F
cuggauacuggcaagagc

SEQ ID NO: 1586157 - RNA, 23 nt, Human adenovirus F
gcauaaaguugcgggugauuuug

SEQ ID NO: 1586158 - RNA, 22 nt, Human adenovirus F
cccucuccgugcaaaacaauuc

SEQ ID NO: 1586159 - RNA, 21 nt, Human adenovirus F
cccucgcccuauuccuccggc

SEQ ID NO: 1586160 - RNA, 17 nt, Human adenovirus F
aaucaggaacuguucaa

SEQ ID NO: 1586161 - RNA, 16 nt, Human adenovirus F
ccaccaagcuccucau

SEQ ID NO: 1586162 - RNA, 20 nt, Human adenovirus F
cgucagaauguggugggguc

SEQ ID NO: 1586163 - RNA, 21 nt, Human adenovirus F
gggauaagcuaaaggaccaaa

SEQ ID NO: 1586164 - RNA, 23 nt, Human adenovirus F
aucacuccguucgcucacccgca

SEQ ID NO: 1586165 - RNA, 13 nt, Human adenovirus F
guagcuuggaagc

SEQ ID NO: 1586166 - RNA, 20 nt, Human adenovirus F
uucgcagaaacaugccaccc

SEQ ID NO: 1586167 - RNA, 11 nt, Human adenovirus F
ggagucacugc

SEQ ID NO: 1586168 - RNA, 21 nt, Human adenovirus F
aaaaguccacaaaaacuccaa

SEQ ID NO: 1586169 - RNA, 14 nt, Human adenovirus F
gcaacguucagcca

SEQ ID NO: 1586170 - RNA, 16 nt, Human adenovirus F
ucccagcagaaacuac

SEQ ID NO: 1586171 - RNA, 18 nt, Human adenovirus F
gauacuuaaaaucagagu

SEQ ID NO: 1586172 - RNA, 14 nt, Human adenovirus F
ugcuuagacccggc

SEQ ID NO: 1586173 - RNA, 18 nt, Human adenovirus F
uuucuuaccucguguuuc

SEQ ID NO: 1586174 - RNA, 20 nt, Human adenovirus F
uuuacugcuaaagggaacug

SEQ ID NO: 1586175 - RNA, 17 nt, Human adenovirus F
aagcuacaaggacagga

SEQ ID NO: 1586176 - RNA, 13 nt, Human adenovirus F
ggcuucugccaga

SEQ ID NO: 1586177 - RNA, 18 nt, Human adenovirus F
ccugagcccgggccuggu

SEQ ID NO: 1586178 - RNA, 17 nt, Human adenovirus F
uuaggccaucggccaug

SEQ ID NO: 1586179 - RNA, 18 nt, Human adenovirus F
gccgcugacggcgcagcu

SEQ ID NO: 1586180 - RNA, 22 nt, Human adenovirus F
caaacauuaaacgucaaugcca

SEQ ID NO: 1586181 - RNA, 21 nt, Human adenovirus F
cuaguuuuaguaaaaugcaac

SEQ ID NO: 1586182 - RNA, 13 nt, Human adenovirus F
gcagcgggcagga

SEQ ID NO: 1586183 - RNA, 18 nt, Human adenovirus F
gaguguggagcuaaucau

SEQ ID NO: 1586184 - RNA, 14 nt, Human adenovirus F
aggagcugucucag

SEQ ID NO: 1586185 - RNA, 19 nt, Human adenovirus F
cuucaagcccuacaccaau

SEQ ID NO: 1586186 - RNA, 21 nt, Human adenovirus F
agcaguuuugguuacagugga

SEQ ID NO: 1586187 - RNA, 17 nt, Human adenovirus F
agccagccaaugggcuc

SEQ ID NO: 1586188 - RNA, 21 nt, Human adenovirus F
cacugcauacaacucccuggc

SEQ ID NO: 1586189 - RNA, 15 nt, Human adenovirus F
ucccagcagaaacua

SEQ ID NO: 1586190 - RNA, 14 nt, Human adenovirus F
cugucugugucucc

SEQ ID NO: 1586191 - RNA, 16 nt, Human adenovirus F
ccacuuaccagagcca

SEQ ID NO: 1586192 - RNA, 20 nt, Human adenovirus F
uggaagagcaaaaccuccag

SEQ ID NO: 1586193 - RNA, 16 nt, Human adenovirus F
auuuuccaugcacuca

SEQ ID NO: 1586194 - RNA, 17 nt, Human adenovirus F
acuggcuggcccuggcc

SEQ ID NO: 1586195 - RNA, 23 nt, Human adenovirus F
agaacuuccagcuguuggagaau

SEQ ID NO: 1586196 - RNA, 16 nt, Human adenovirus F
gaacugggcugcggac

SEQ ID NO: 1586197 - RNA, 11 nt, Human adenovirus F
cuagcugcuuu

SEQ ID NO: 1586198 - RNA, 18 nt, Human adenovirus F
cccugaggaggaggccau

SEQ ID NO: 1586199 - RNA, 18 nt, Human adenovirus F
gaggccuuucacccagac

SEQ ID NO: 1586200 - RNA, 14 nt, Human adenovirus F
cuuacaaacaguaa

SEQ ID NO: 1586201 - RNA, 16 nt, Human adenovirus F
aucugcaaaaaagccg

SEQ ID NO: 1586202 - RNA, 19 nt, Human adenovirus F
gauacuggcaagagccacc

SEQ ID NO: 1586203 - RNA, 20 nt, Human adenovirus F
cuguaguauuuacucccgga

SEQ ID NO: 1586204 - RNA, 23 nt, Human adenovirus F
ggggcgcuuucaguuggagcagc

SEQ ID NO: 1586205 - RNA, 22 nt, Human adenovirus F
ccauucuuauuucgcccgacaa

SEQ ID NO: 1586206 - RNA, 21 nt, Human adenovirus F
ccgagugacacgucaccgcca

SEQ ID NO: 1586207 - RNA, 19 nt, Human adenovirus F
agguucguugucgccccug

SEQ ID NO: 1586208 - RNA, 19 nt, Human adenovirus F
caccacauaagaagccagc

SEQ ID NO: 1586209 - RNA, 21 nt, Human adenovirus F
gugaccugugggucgcagcag

SEQ ID NO: 1586210 - RNA, 17 nt, Human adenovirus F
ucuucgcccugaaaguc

SEQ ID NO: 1586211 - RNA, 13 nt, Human adenovirus F
gcgggcaggagcc

SEQ ID NO: 1586212 - RNA, 15 nt, Human adenovirus F
caucuaucuuuuccu

SEQ ID NO: 1586213 - RNA, 14 nt, Human adenovirus F
caauggcagcccag

SEQ ID NO: 1586214 - RNA, 20 nt, Human adenovirus F
agcuccucagcccguggaga

SEQ ID NO: 1586215 - RNA, 14 nt, Human adenovirus F
uccuucugccacgc

SEQ ID NO: 1586216 - RNA, 21 nt, Human adenovirus F
gccgccccuggccuguuuuug

SEQ ID NO: 1586217 - RNA, 17 nt, Human adenovirus F
aggagcagcgggaagag

SEQ ID NO: 1586218 - RNA, 22 nt, Human adenovirus F
gaucaggccuccaauuugacaa

SEQ ID NO: 1586219 - RNA, 21 nt, Human adenovirus F
aaggaggaggcuaauggccag

SEQ ID NO: 1586220 - RNA, 13 nt, Human adenovirus F
ccuuacaaacagu

SEQ ID NO: 1586221 - RNA, 16 nt, Human adenovirus F
aguuuaaaaacgguga

SEQ ID NO: 1586222 - RNA, 13 nt, Human adenovirus F
cacacuccgcaga

SEQ ID NO: 1586223 - RNA, 12 nt, Human adenovirus F
ccgcgcgggcag

SEQ ID NO: 1586224 - RNA, 17 nt, Human adenovirus F
uugauauuuaucugccc

SEQ ID NO: 1586225 - RNA, 22 nt, Human adenovirus F
gcucugaacacuuuugccaaag

SEQ ID NO: 1586226 - RNA, 15 nt, Human adenovirus F
ugcaaagcucccaaa

SEQ ID NO: 1586227 - RNA, 12 nt, Human adenovirus F
guuuccacaaac

SEQ ID NO: 1586228 - RNA, 21 nt, Human adenovirus F
cccaggagcagcgggaagaga

SEQ ID NO: 1586229 - RNA, 17 nt, Human adenovirus F
gaguaacuuuugccaca

SEQ ID NO: 1586230 - RNA, 17 nt, Human adenovirus F
gacggcuuuggcuguac

SEQ ID NO: 1586231 - RNA, 15 nt, Human adenovirus F
gagcagccuguggag

SEQ ID NO: 1586232 - RNA, 12 nt, Human adenovirus F
ccucuacugcuc

SEQ ID NO: 1586233 - RNA, 13 nt, Human adenovirus F
acggaggaagagg

SEQ ID NO: 1586234 - RNA, 15 nt, Human adenovirus F
ggcggaugguggcaa

SEQ ID NO: 1586235 - RNA, 15 nt, Human adenovirus F
cacuaccacccuccu

SEQ ID NO: 1586236 - RNA, 15 nt, Human adenovirus F
ugauguaacagcuuu

SEQ ID NO: 1586237 - RNA, 15 nt, Human adenovirus F
caggcagcagggugc

SEQ ID NO: 1586238 - RNA, 13 nt, Human adenovirus F
uccacaaaaacuc

SEQ ID NO: 1586239 - RNA, 15 nt, Human adenovirus F
ccuaugugcugggga

SEQ ID NO: 1586240 - RNA, 16 nt, Human adenovirus F
cggaguaccugagccc

SEQ ID NO: 1586241 - RNA, 13 nt, Human adenovirus F
gcuguagaauuua

SEQ ID NO: 1586242 - RNA, 16 nt, Human adenovirus F
caugcgcuccaacacu

SEQ ID NO: 1586243 - RNA, 17 nt, Human adenovirus F
cccacuguugccguggc

SEQ ID NO: 1586244 - RNA, 18 nt, Human adenovirus F
gggcucauugguccagca

SEQ ID NO: 1586245 - RNA, 22 nt, Human adenovirus F
gcacgcucuugcugugggugga

SEQ ID NO: 1586246 - RNA, 14 nt, Human adenovirus F
uuuuuaugaaacac

SEQ ID NO: 1586247 - RNA, 21 nt, Human adenovirus F
cacuaaccaggcgagcucagg

SEQ ID NO: 1586248 - RNA, 20 nt, Human adenovirus F
accucuucuucuuccuccuc

SEQ ID NO: 1586249 - RNA, 16 nt, Human adenovirus F
accuacgcccaggagc

SEQ ID NO: 1586250 - RNA, 15 nt, Human adenovirus F
gaccggcgcugggac

SEQ ID NO: 1586251 - RNA, 16 nt, Human adenovirus F
cuauuuaaagugguga

SEQ ID NO: 1586252 - RNA, 15 nt, Human adenovirus F
gccggacgggcagcc

SEQ ID NO: 1586253 - RNA, 14 nt, Human adenovirus F
ccccagcgcccugg

SEQ ID NO: 1586254 - RNA, 22 nt, Human adenovirus F
agcgcgcuauaauagcaccaac

SEQ ID NO: 1586255 - RNA, 18 nt, Human adenovirus F
guacucaaacgcaccauu

SEQ ID NO: 1586256 - RNA, 15 nt, Human adenovirus F
gcggggcaggagcug

SEQ ID NO: 1586257 - RNA, 19 nt, Human adenovirus F
cuucuuaauaaagacacaa

SEQ ID NO: 1586258 - RNA, 20 nt, Human adenovirus F
cgcaucaccacuugugcaau

SEQ ID NO: 1586259 - RNA, 13 nt, Human adenovirus F
ggacuuggcagaa

SEQ ID NO: 1586260 - RNA, 14 nt, Human adenovirus F
uaucacgcccacca

SEQ ID NO: 1586261 - RNA, 23 nt, Human adenovirus F
aguggggguggaauuacugccag

SEQ ID NO: 1586262 - RNA, 21 nt, Human adenovirus F
uuuaauugaaauuaauugcac

SEQ ID NO: 1586263 - RNA, 12 nt, Human adenovirus F
aacuccuuugga

SEQ ID NO: 1586264 - RNA, 13 nt, Human adenovirus F
cacugcgguggag

SEQ ID NO: 1586265 - RNA, 19 nt, Human adenovirus F
gcccgggccuggugcaguu

SEQ ID NO: 1586266 - RNA, 17 nt, Human adenovirus F
ugaucccgaagagggua

SEQ ID NO: 1586267 - RNA, 13 nt, Human adenovirus F
gaaaaagacagca

SEQ ID NO: 1586268 - RNA, 16 nt, Human adenovirus F
ccgcgacugcaucuau

SEQ ID NO: 1586269 - RNA, 12 nt, Human adenovirus F
caacucugaggu

SEQ ID NO: 1586270 - RNA, 16 nt, Human adenovirus F
ucgccccugugagugu

SEQ ID NO: 1586271 - RNA, 16 nt, Human adenovirus F
gcuggcgggcaaagcu

SEQ ID NO: 1586272 - RNA, 16 nt, Human adenovirus F
aagauuccaccaaagg

SEQ ID NO: 1586273 - RNA, 15 nt, Human adenovirus F
gcauauaagcucugu

SEQ ID NO: 1586274 - RNA, 16 nt, Human adenovirus F
cgcggacgucaagccc

SEQ ID NO: 1586275 - RNA, 17 nt, Human adenovirus F
cauucuuaacccgcacu

SEQ ID NO: 1586276 - RNA, 16 nt, Human adenovirus F
cgguugugcaguguua

SEQ ID NO: 1586277 - RNA, 14 nt, Human adenovirus F
ugcacacagacucc

SEQ ID NO: 1586278 - RNA, 17 nt, Human adenovirus F
accaccugcccuuccuc

SEQ ID NO: 1586279 - RNA, 15 nt, Human adenovirus F
cugcuagaaugucac

SEQ ID NO: 1586280 - RNA, 16 nt, Human adenovirus F
ucagccacuccugcag

SEQ ID NO: 1586281 - RNA, 16 nt, Human adenovirus F
caccuacucuggcucc

SEQ ID NO: 1586282 - RNA, 12 nt, Human adenovirus F
caaagccaaccu

SEQ ID NO: 1586283 - RNA, 13 nt, Human adenovirus F
gugcuuggaagag

SEQ ID NO: 1586284 - RNA, 18 nt, Human adenovirus F
ggccgcuacgugccuuuu

SEQ ID NO: 1586285 - RNA, 21 nt, Human adenovirus F
gauuuugaguuagcucugaac

SEQ ID NO: 1586286 - RNA, 22 nt, Human adenovirus F
guggcacagcaaacacaaacac

SEQ ID NO: 1586287 - RNA, 13 nt, Human adenovirus F
ggcccuagaccac

SEQ ID NO: 1586288 - RNA, 17 nt, Human adenovirus F
auugugguacaggagcg

SEQ ID NO: 1586289 - RNA, 22 nt, Human adenovirus F
ucuacaacgagauaaacagugg

SEQ ID NO: 1586290 - RNA, 20 nt, Human adenovirus F
guucacugaaagccagccgu

SEQ ID NO: 1586291 - RNA, 11 nt, Human adenovirus F
augcccacacc

SEQ ID NO: 1586292 - RNA, 21 nt, Human adenovirus F
gcccaggagcagcgggaagag

SEQ ID NO: 1586293 - RNA, 15 nt, Human adenovirus F
acucuuacaaaauaa

SEQ ID NO: 1586294 - RNA, 17 nt, Human adenovirus F
cuggccuuuugaacgac

SEQ ID NO: 1586295 - RNA, 18 nt, Human adenovirus F
aacccugaggaggaggcc

SEQ ID NO: 1586296 - RNA, 19 nt, Human adenovirus F
cuuggaaaucgugcccgug

SEQ ID NO: 1586297 - RNA, 17 nt, Human adenovirus F
ccuguacuugccugacu

SEQ ID NO: 1586298 - RNA, 17 nt, Human adenovirus F
agggcgucaugcucugg

SEQ ID NO: 1586299 - RNA, 19 nt, Human adenovirus F
ccacgucgccaacaguguu

SEQ ID NO: 1586300 - RNA, 20 nt, Human adenovirus F
gucguggcauguuuucucca

SEQ ID NO: 1586301 - RNA, 19 nt, Human adenovirus F
cuucgcccggacacuauuu

SEQ ID NO: 1586302 - RNA, 20 nt, Human adenovirus F
cauauacuuuaaacaagcaa

SEQ ID NO: 1586303 - RNA, 15 nt, Human adenovirus F
aaacuugauuuccau

SEQ ID NO: 1586304 - RNA, 21 nt, Human adenovirus F
guuaauaagcuggguggaaag

SEQ ID NO: 1586305 - RNA, 23 nt, Human adenovirus F
cuauuugggaggggaggacgacg

SEQ ID NO: 1586306 - RNA, 14 nt, Human adenovirus F
ggucguaaugagga

SEQ ID NO: 1586307 - RNA, 18 nt, Human adenovirus F
ucggaaccugaaagagag

SEQ ID NO: 1586308 - RNA, 15 nt, Human adenovirus F
guccccgucagcaug

SEQ ID NO: 1586309 - RNA, 15 nt, Human adenovirus F
gcgcugcuacucaac

SEQ ID NO: 1586310 - RNA, 20 nt, Human adenovirus F
cgaaaaaugaugauggcagc

SEQ ID NO: 1586311 - RNA, 21 nt, Human adenovirus F
aacacaauauuuauacacucc

SEQ ID NO: 1586312 - RNA, 21 nt, Human adenovirus F
ucagugaaaacguucccgccc

SEQ ID NO: 1586313 - RNA, 15 nt, Human adenovirus F
cugucaggcucugag

SEQ ID NO: 1586314 - RNA, 20 nt, Human adenovirus F
gauucuaagggaggcagcag

SEQ ID NO: 1586315 - RNA, 13 nt, Human adenovirus F
uguuuaagccaga

SEQ ID NO: 1586316 - RNA, 17 nt, Human adenovirus F
acaguccuucugccacg

SEQ ID NO: 1586317 - RNA, 17 nt, Human adenovirus F
cacauaucgucacuucc

SEQ ID NO: 1586318 - RNA, 17 nt, Human adenovirus F
ccaucaucgccgccgcc

SEQ ID NO: 1586319 - RNA, 14 nt, Human adenovirus F
guggagaaccuugc

SEQ ID NO: 1586320 - RNA, 21 nt, Human adenovirus F
gcccgcugagcguucucgcuc

SEQ ID NO: 1586321 - RNA, 15 nt, Human adenovirus F
acauuucgugggaag

SEQ ID NO: 1586322 - RNA, 18 nt, Human adenovirus F
ucccaaagucccccuuac

SEQ ID NO: 1586323 - RNA, 13 nt, Human adenovirus F
caggaaggccucg

SEQ ID NO: 1586324 - RNA, 15 nt, Human adenovirus F
ucacugaaagccagc

SEQ ID NO: 1586325 - RNA, 13 nt, Human adenovirus F
acaaaaacuuaca

SEQ ID NO: 1586326 - RNA, 18 nt, Human adenovirus F
agaauuuaugccuagcuc

SEQ ID NO: 1586327 - RNA, 18 nt, Human adenovirus F
cuccucguuaagccacgu

SEQ ID NO: 1586328 - RNA, 18 nt, Human adenovirus F
uguuguagucugccaacg

SEQ ID NO: 1586329 - RNA, 15 nt, Human adenovirus F
cuuugccgucaaaag

SEQ ID NO: 1586330 - RNA, 20 nt, Human adenovirus F
cggccuuguaugggcagcau

SEQ ID NO: 1586331 - RNA, 13 nt, Human adenovirus F
augggcaccugga

SEQ ID NO: 1586332 - RNA, 16 nt, Human adenovirus F
uugugggucugggagu

SEQ ID NO: 1586333 - RNA, 13 nt, Human adenovirus F
ucaggaacuguuc

SEQ ID NO: 1586334 - RNA, 15 nt, Human adenovirus F
ccacaaucuucaucu

SEQ ID NO: 1586335 - RNA, 20 nt, Human adenovirus F
uauaaguauuacaaaugccu

SEQ ID NO: 1586336 - RNA, 15 nt, Human adenovirus F
ugaugauggcagcag

SEQ ID NO: 1586337 - RNA, 18 nt, Human adenovirus F
gcgguaagaacccagcau

SEQ ID NO: 1586338 - RNA, 19 nt, Human adenovirus F
gacugggcggcggccaugg

SEQ ID NO: 1586339 - RNA, 17 nt, Human adenovirus F
uggacgacagccagcug

SEQ ID NO: 1586340 - RNA, 14 nt, Human adenovirus F
auuuuaaaaugguu

SEQ ID NO: 1586341 - RNA, 17 nt, Human adenovirus F
ucugcuuaacccucccg

SEQ ID NO: 1586342 - RNA, 23 nt, Human adenovirus F
gccgcggacgucaagcccgacau

SEQ ID NO: 1586343 - RNA, 17 nt, Human adenovirus F
cuaugaggacgagcccu

SEQ ID NO: 1586344 - RNA, 16 nt, Human adenovirus F
acuucuccauguggaa

SEQ ID NO: 1586345 - RNA, 21 nt, Human adenovirus F
gggaaaucagaugcauuuugg

SEQ ID NO: 1586346 - RNA, 21 nt, Human adenovirus F
cagccugagcugccagaggcc

SEQ ID NO: 1586347 - RNA, 22 nt, Human adenovirus F
cauuguguccugcaacaaaaaa

SEQ ID NO: 1586348 - RNA, 20 nt, Human adenovirus F
aggaagaaaccaucgccagc

SEQ ID NO: 1586349 - RNA, 19 nt, Human adenovirus F
uggaaacugucaggcucug

SEQ ID NO: 1586350 - RNA, 18 nt, Human adenovirus F
cccugaccgaccuggggc

SEQ ID NO: 1586351 - RNA, 18 nt, Human adenovirus F
agccuguguuaucaccca

SEQ ID NO: 1586352 - RNA, 15 nt, Human adenovirus F
gaacacaauauuuau

SEQ ID NO: 1586353 - RNA, 21 nt, Human adenovirus F
ccgagcggcugcuucugccag

SEQ ID NO: 1586354 - RNA, 18 nt, Human adenovirus F
ugaccuuagaacuaccuc

SEQ ID NO: 1586355 - RNA, 12 nt, Human adenovirus F
aaacacugcgca

SEQ ID NO: 1586356 - RNA, 21 nt, Human adenovirus F
cuggaacgagaucggcaccag

SEQ ID NO: 1586357 - RNA, 15 nt, Human adenovirus F
cgcagcgggaacgcu

SEQ ID NO: 1586358 - RNA, 22 nt, Human adenovirus F
cggaacaaccuucaaacccagc

SEQ ID NO: 1586359 - RNA, 15 nt, Human adenovirus F
cuucuaucugcaaaa

SEQ ID NO: 1586360 - RNA, 21 nt, Human adenovirus F
cuggccgacaagguggcggcc

SEQ ID NO: 1586361 - RNA, 19 nt, Human adenovirus F
gacgugugugugagggcaa

SEQ ID NO: 1586362 - RNA, 14 nt, Human adenovirus F
cgcagcgggcagga

SEQ ID NO: 1586363 - RNA, 13 nt, Human adenovirus F
cgcgcgggcagga

SEQ ID NO: 1586364 - RNA, 22 nt, Human adenovirus F
agcugugagcgccagccgccgu

SEQ ID NO: 1586365 - RNA, 17 nt, Human adenovirus F
cgaaaaccggcuggggc

SEQ ID NO: 1586366 - RNA, 17 nt, Human adenovirus F
uguaccaguccgggcca

SEQ ID NO: 1586367 - RNA, 15 nt, Human adenovirus F
ucgccuaacaucacc

SEQ ID NO: 1586368 - RNA, 14 nt, Human adenovirus F
uccucccaacuuuc

SEQ ID NO: 1586369 - RNA, 14 nt, Human adenovirus F
aaacccagccgcac

SEQ ID NO: 1586370 - RNA, 22 nt, Human adenovirus F
cggcuggaaaauagccgccagc

SEQ ID NO: 1586371 - RNA, 17 nt, Human adenovirus F
caagcgguccauugccu

SEQ ID NO: 1586372 - RNA, 23 nt, Human adenovirus F
aucuugcaaaacuuucgcuccuu

SEQ ID NO: 1586373 - RNA, 18 nt, Human adenovirus F
gaaaaguacgaagcuagc

SEQ ID NO: 1586374 - RNA, 14 nt, Human adenovirus F
ggcaccagccagcu

SEQ ID NO: 1586375 - RNA, 13 nt, Human adenovirus F
gcaaccagugggc

SEQ ID NO: 1586376 - RNA, 23 nt, Human adenovirus F
ccaggugguagacacuaccaccu

SEQ ID NO: 1586377 - RNA, 13 nt, Human adenovirus F
uaccugcuaccuc

SEQ ID NO: 1586378 - RNA, 17 nt, Human adenovirus F
ccaaaacaaaacaaacu

SEQ ID NO: 1586379 - RNA, 20 nt, Human adenovirus F
cguucucuccccacagccgu

SEQ ID NO: 1586380 - RNA, 19 nt, Human adenovirus F
gaggguacuagcagugggc

SEQ ID NO: 1586381 - RNA, 17 nt, Human adenovirus F
agccacuccugcagucc

SEQ ID NO: 1586382 - RNA, 19 nt, Human adenovirus F
ggaaaccaagggcucugcc

SEQ ID NO: 1586383 - RNA, 14 nt, Human adenovirus F
cacaggucaaaugc

SEQ ID NO: 1586384 - RNA, 23 nt, Human adenovirus F
agugaugguggggaguucuugcu

SEQ ID NO: 1586385 - RNA, 15 nt, Human adenovirus F
uacaccaacgaggcc

SEQ ID NO: 1586386 - RNA, 16 nt, Human adenovirus F
cguggcucaauguaac

SEQ ID NO: 1586387 - RNA, 11 nt, Human adenovirus F
cguagcagggu

SEQ ID NO: 1586388 - RNA, 14 nt, Human adenovirus F
uaacuaaaaacgga

SEQ ID NO: 1586389 - RNA, 18 nt, Human adenovirus F
gcuuccaccuuggaagca

SEQ ID NO: 1586390 - RNA, 22 nt, Human adenovirus F
caucaauuuugcgucgcuggcu

SEQ ID NO: 1586391 - RNA, 15 nt, Human adenovirus F
ugcucggugcagccg

SEQ ID NO: 1586392 - RNA, 15 nt, Human adenovirus F
cccagcugguaagca

SEQ ID NO: 1586393 - RNA, 17 nt, Human adenovirus F
auccaaucguagcaggg

SEQ ID NO: 1586394 - RNA, 24 nt, Human adenovirus F
gugccguucgcagaaacaugccac

SEQ ID NO: 1586395 - RNA, 23 nt, Human adenovirus F
uccaggaaaucaccagcgugagu

SEQ ID NO: 1586396 - RNA, 22 nt, Human adenovirus F
cgguacuaaggcgggcacaaag

SEQ ID NO: 1586397 - RNA, 16 nt, Human adenovirus F
ccggcauguacggcgg

SEQ ID NO: 1586398 - RNA, 15 nt, Human adenovirus F
caaacccagccgcac

SEQ ID NO: 1586399 - RNA, 23 nt, Human adenovirus F
gagguguuggagaacaugaaagu

SEQ ID NO: 1586400 - RNA, 20 nt, Human adenovirus F
agcagggugcgauugaaaua

SEQ ID NO: 1586401 - RNA, 17 nt, Human adenovirus F
caccguucccacuguuu

SEQ ID NO: 1586402 - RNA, 21 nt, Human adenovirus F
ucccacuguuucuccuccccu

SEQ ID NO: 1586403 - RNA, 13 nt, Human adenovirus F
gcaaagccauccg

SEQ ID NO: 1586404 - RNA, 17 nt, Human adenovirus F
ccaauccuagccagugg

SEQ ID NO: 1586405 - RNA, 21 nt, Human adenovirus F
uacggaccaccagaugauguc

SEQ ID NO: 1586406 - RNA, 21 nt, Human adenovirus F
cgaauugcagcccaccaugca

SEQ ID NO: 1586407 - RNA, 16 nt, Human adenovirus F
acacugccuaccgcag

SEQ ID NO: 1586408 - RNA, 13 nt, Human adenovirus F
uccgcaaggauga

SEQ ID NO: 1586409 - RNA, 14 nt, Human adenovirus F
gcaacucgcaggcc

SEQ ID NO: 1586410 - RNA, 17 nt, Human adenovirus F
auaugaugaaaguagaa

SEQ ID NO: 1586411 - RNA, 18 nt, Human adenovirus F
aggaggcuaauggccaga

SEQ ID NO: 1586412 - RNA, 22 nt, Human adenovirus F
cgccuccaacacagccgccgcu

SEQ ID NO: 1586413 - RNA, 17 nt, Human adenovirus F
auaccgcugcagcugcu

SEQ ID NO: 1586414 - RNA, 15 nt, Human adenovirus F
cccccaucucugugc

SEQ ID NO: 1586415 - RNA, 12 nt, Human adenovirus F
aaucauuuccag

SEQ ID NO: 1586416 - RNA, 22 nt, Human adenovirus F
ugggcguguuuguggguauaua

SEQ ID NO: 1586417 - RNA, 20 nt, Human adenovirus F
aucgugcgcgaacugggcug

SEQ ID NO: 1586418 - RNA, 17 nt, Human adenovirus F
cuauauaggacaaaaaa

SEQ ID NO: 1586419 - RNA, 18 nt, Human adenovirus F
ggcggaugguggcaagga

SEQ ID NO: 1586420 - RNA, 22 nt, Human adenovirus F
cuagcauaaaggggaccagcug

SEQ ID NO: 1586421 - RNA, 21 nt, Human adenovirus F
auaagcuaaaggaccaaaacu

SEQ ID NO: 1586422 - RNA, 19 nt, Human adenovirus F
aggcuuuccgcgaggccau

SEQ ID NO: 1586423 - RNA, 18 nt, Human adenovirus F
acucggagcuggcgccuc

SEQ ID NO: 1586424 - RNA, 14 nt, Human adenovirus F
caaccuucaagccc

SEQ ID NO: 1586425 - RNA, 18 nt, Human adenovirus F
gguccgaccgcugggguu

SEQ ID NO: 1586426 - RNA, 17 nt, Human adenovirus F
aguuugguagcaaagga

SEQ ID NO: 1586427 - RNA, 13 nt, Human adenovirus F
accgccaauuuuu

SEQ ID NO: 1586428 - RNA, 19 nt, Human adenovirus F
ccugcggauuaagaaccac

SEQ ID NO: 1586429 - RNA, 13 nt, Human adenovirus F
acgcccaggagca

SEQ ID NO: 1586430 - RNA, 15 nt, Human adenovirus F
uacauccauuuccac

SEQ ID NO: 1586431 - RNA, 16 nt, Human adenovirus F
ugagaauuauugaaaa

SEQ ID NO: 1586432 - RNA, 16 nt, Human adenovirus F
uucaaacccagccgca

SEQ ID NO: 1586433 - RNA, 18 nt, Human adenovirus F
ugccauuguuaacacggc

SEQ ID NO: 1586434 - RNA, 22 nt, Human adenovirus F
gcgaguuugacgugccugaggg

SEQ ID NO: 1586435 - RNA, 11 nt, Human adenovirus F
gauggaguugu

SEQ ID NO: 1586436 - RNA, 13 nt, Human adenovirus F
cagcgggcacaga

SEQ ID NO: 1586437 - RNA, 20 nt, Human adenovirus F
ccggcggcgggugcaguggc

SEQ ID NO: 1586438 - RNA, 16 nt, Human adenovirus F
ggagguagaaguggag

SEQ ID NO: 1586439 - RNA, 22 nt, Human adenovirus F
cuuccgacggguuacaggaaaa

SEQ ID NO: 1586440 - RNA, 16 nt, Human adenovirus F
uaccccgacagaggcc

SEQ ID NO: 1586441 - RNA, 12 nt, Human adenovirus F
auaaacuccucu

SEQ ID NO: 1586442 - RNA, 23 nt, Human adenovirus F
uugcaugcccgagccggagaggg

SEQ ID NO: 1586443 - RNA, 13 nt, Human adenovirus F
caagagccaccuu

SEQ ID NO: 1586444 - RNA, 19 nt, Human adenovirus F
acucuuacaaagugcgcuu

SEQ ID NO: 1586445 - RNA, 15 nt, Human adenovirus F
cgcagccugagcugc

SEQ ID NO: 1586446 - RNA, 12 nt, Human adenovirus F
cuaucuuuuccu

SEQ ID NO: 1586447 - RNA, 23 nt, Human adenovirus F
ggaggccauccuggaccuggaag

SEQ ID NO: 1586448 - RNA, 22 nt, Human adenovirus F
ugaccugugggucgcagcaggu

SEQ ID NO: 1586449 - RNA, 22 nt, Human adenovirus F
gcuauuaaaauggaaccaagcu

SEQ ID NO: 1586450 - RNA, 21 nt, Human adenovirus F
aaauucaugcaugcagacuuu

SEQ ID NO: 1586451 - RNA, 15 nt, Human adenovirus F
ugcuacacaacaaau

SEQ ID NO: 1586452 - RNA, 14 nt, Human adenovirus F
uggacauggccagc

SEQ ID NO: 1586453 - RNA, 20 nt, Human adenovirus F
agccugagcugccagaggcc

SEQ ID NO: 1586454 - RNA, 19 nt, Human adenovirus F
cggcguacacuggcuggcc

SEQ ID NO: 1586455 - RNA, 21 nt, Human adenovirus F
ccgcgcuaaaucuuccuccca

SEQ ID NO: 1586456 - RNA, 23 nt, Human adenovirus F
cucugugagcuggccugguaacg

SEQ ID NO: 1586457 - RNA, 15 nt, Human adenovirus F
acgugcaggccaacc

SEQ ID NO: 1586458 - RNA, 18 nt, Human adenovirus F
uugccuucuuuucugcuc

SEQ ID NO: 1586459 - RNA, 15 nt, Human adenovirus F
gcaacgcaagagacg

SEQ ID NO: 1586460 - RNA, 18 nt, Human adenovirus F
ucaaagacgccgccuugc

SEQ ID NO: 1586461 - RNA, 17 nt, Human adenovirus F
augugcagcaaaaacuc

SEQ ID NO: 1586462 - RNA, 15 nt, Human adenovirus F
cauuucgugggaagg

SEQ ID NO: 1586463 - RNA, 18 nt, Human adenovirus F
cucgagguguaacauccc

SEQ ID NO: 1586464 - RNA, 20 nt, Human adenovirus F
ggagcagauggagagcuggg

SEQ ID NO: 1586465 - RNA, 14 nt, Human adenovirus F
aguugguagcagug

SEQ ID NO: 1586466 - RNA, 20 nt, Human adenovirus F
gugccgagcuuuuacuggga

SEQ ID NO: 1586467 - RNA, 12 nt, Human adenovirus F
cccagccgcacu

SEQ ID NO: 1586468 - RNA, 13 nt, Human adenovirus F
gacaaaacacuaa

SEQ ID NO: 1586469 - RNA, 18 nt, Human adenovirus F
accgacuacuuacuccca

SEQ ID NO: 1586470 - RNA, 18 nt, Human adenovirus F
cggguuagaaguaaccaa

SEQ ID NO: 1586471 - RNA, 18 nt, Human adenovirus F
cggaagccgaaguccaaa

SEQ ID NO: 1586472 - RNA, 22 nt, Human adenovirus F
auugcagcgguaucugcgugga

SEQ ID NO: 1586473 - RNA, 12 nt, Human adenovirus F
cuggaaccacuu

SEQ ID NO: 1586474 - RNA, 18 nt, Human adenovirus F
gccagccuccgguggcuc

SEQ ID NO: 1586475 - RNA, 17 nt, Human adenovirus F
uacgccuccaccaccuu

SEQ ID NO: 1586476 - RNA, 13 nt, Human adenovirus F
uaagcugcagcca

SEQ ID NO: 1586477 - RNA, 17 nt, Human adenovirus F
ucgcucuguccgccgcc

SEQ ID NO: 1586478 - RNA, 19 nt, Human adenovirus F
cugcuacucaacagaaacc

SEQ ID NO: 1586479 - RNA, 13 nt, Human adenovirus F
cgccaugacugcc

SEQ ID NO: 1586480 - RNA, 14 nt, Human adenovirus F
cgguuccucgcaac

SEQ ID NO: 1586481 - RNA, 14 nt, Human adenovirus F
guggcugcaagguc

SEQ ID NO: 1586482 - RNA, 16 nt, Human adenovirus F
cuagauaauaacuuuc

SEQ ID NO: 1586483 - RNA, 13 nt, Human adenovirus F
uguccuuaaggag

SEQ ID NO: 1586484 - RNA, 20 nt, Human adenovirus F
ucagggucgauggagccagc

SEQ ID NO: 1586485 - RNA, 17 nt, Human adenovirus F
gcucugcaucucuugaa

SEQ ID NO: 1586486 - RNA, 23 nt, Human adenovirus F
agccuguguuaucacccaaagcc

SEQ ID NO: 1586487 - RNA, 14 nt, Human adenovirus F
gaguaugccuugca

SEQ ID NO: 1586488 - RNA, 20 nt, Human adenovirus F
augcuuuuacguuuaaaugg

SEQ ID NO: 1586489 - RNA, 12 nt, Human adenovirus F
ugcagcccacca

SEQ ID NO: 1586490 - RNA, 22 nt, Human adenovirus F
cggaccugccccuacgugcaca

SEQ ID NO: 1586491 - RNA, 18 nt, Human adenovirus F
acuuuaaacaagcaaaga

SEQ ID NO: 1586492 - RNA, 14 nt, Human adenovirus F
gaagcacaggagau

SEQ ID NO: 1586493 - RNA, 15 nt, Human adenovirus F
cuucacuccucgcca

SEQ ID NO: 1586494 - RNA, 15 nt, Human adenovirus F
uacugcuaaagggaa

SEQ ID NO: 1586495 - RNA, 16 nt, Human adenovirus F
caauuggggcacaccg

SEQ ID NO: 1586496 - RNA, 18 nt, Human adenovirus F
agugcguaagaccucauc

SEQ ID NO: 1586497 - RNA, 14 nt, Human adenovirus F
gaaccggcgccgcu

SEQ ID NO: 1586498 - RNA, 17 nt, Human adenovirus F
cuuguucgaaggcugcc

SEQ ID NO: 1586499 - RNA, 15 nt, Human adenovirus F
ggcuuccuuaacaag

SEQ ID NO: 1586500 - RNA, 20 nt, Human adenovirus F
uggggcgcgguggucuccag

SEQ ID NO: 1586501 - RNA, 15 nt, Human adenovirus F
gaaaucacaguuggg

SEQ ID NO: 1586502 - RNA, 12 nt, Human adenovirus F
aaccauggagcu

SEQ ID NO: 1586503 - RNA, 20 nt, Human adenovirus F
caaacggcguucuagccaac

SEQ ID NO: 1586504 - RNA, 19 nt, Human adenovirus F
caauuuugcgucgcuggcu

SEQ ID NO: 1586505 - RNA, 12 nt, Human adenovirus F
ugugagauuugu

SEQ ID NO: 1586506 - RNA, 12 nt, Human adenovirus F
ugcuuuuucacg

SEQ ID NO: 1586507 - RNA, 11 nt, Human adenovirus F
aauggcucugc

SEQ ID NO: 1586508 - RNA, 11 nt, Human adenovirus F
agcugcuggag

SEQ ID NO: 1586509 - RNA, 19 nt, Human adenovirus F
gcguucaaaaccucuuaca

SEQ ID NO: 1586510 - RNA, 15 nt, Human adenovirus F
ggcgcauucccuuuu

SEQ ID NO: 1586511 - RNA, 23 nt, Human adenovirus F
cguguccgggcucuucaucacuu

SEQ ID NO: 1586512 - RNA, 16 nt, Human adenovirus F
augcaugcgaggggaa

SEQ ID NO: 1586513 - RNA, 11 nt, Human adenovirus F
cgcgccaaccg

SEQ ID NO: 1586514 - RNA, 13 nt, Human adenovirus F
uucuuugccaccu

SEQ ID NO: 1586515 - RNA, 18 nt, Human adenovirus F
gcagcagccccaggccaa

SEQ ID NO: 1586516 - RNA, 21 nt, Human adenovirus F
gagcucugcaaaaacaaauac

SEQ ID NO: 1586517 - RNA, 21 nt, Human adenovirus F
caagcaaagacagagcuuuau

SEQ ID NO: 1586518 - RNA, 16 nt, Human adenovirus F
cuuuccgcgaggccau

SEQ ID NO: 1586519 - RNA, 13 nt, Human adenovirus F
ugcagcugcugcc

SEQ ID NO: 1586520 - RNA, 15 nt, Human adenovirus F
ggcugcuucugccag

SEQ ID NO: 1586521 - RNA, 16 nt, Human adenovirus F
uccgaaacuuccaacc

SEQ ID NO: 1586522 - RNA, 23 nt, Human adenovirus F
cgaaacuuccaacccaugagccg

SEQ ID NO: 1586523 - RNA, 18 nt, Human adenovirus F
cagccgguccccgucagc

SEQ ID NO: 1586524 - RNA, 12 nt, Human adenovirus F
uuucccagaguu

SEQ ID NO: 1586525 - RNA, 18 nt, Human adenovirus F
cacccucagacgacuggg

SEQ ID NO: 1586526 - RNA, 13 nt, Human adenovirus F
ggcucuuggucag

SEQ ID NO: 1586527 - RNA, 20 nt, Human adenovirus F
ggguguacguuuguugcaug

SEQ ID NO: 1586528 - RNA, 19 nt, Human adenovirus F
ugcaaacaacgaacuuucu

SEQ ID NO: 1586529 - RNA, 20 nt, Human adenovirus F
ugacacgucaccgccaagag

SEQ ID NO: 1586530 - RNA, 17 nt, Human adenovirus F
cgcuucgccuccuggug

SEQ ID NO: 1586531 - RNA, 13 nt, Human adenovirus F
cgcacccuggugg

SEQ ID NO: 1586532 - RNA, 15 nt, Human adenovirus F
aggguguacguuugu

SEQ ID NO: 1586533 - RNA, 16 nt, Human adenovirus F
ugcccaccguuccgcc

SEQ ID NO: 1586534 - RNA, 18 nt, Human adenovirus F
ucgcaaacaaagaaguac

SEQ ID NO: 1586535 - RNA, 18 nt, Human adenovirus F
cuuuacccgacaacaaaa

SEQ ID NO: 1586536 - RNA, 11 nt, Human adenovirus F
gagggcuucca

SEQ ID NO: 1586537 - RNA, 18 nt, Human adenovirus F
ccaaaucaaucagcggcu

SEQ ID NO: 1586538 - RNA, 16 nt, Human adenovirus F
ccuagacgaggaggac

SEQ ID NO: 1586539 - RNA, 23 nt, Human adenovirus F
gaagugcuaggcucuucuuccuc

SEQ ID NO: 1586540 - RNA, 14 nt, Human adenovirus F
acauggccagcacc

SEQ ID NO: 1586541 - RNA, 18 nt, Human adenovirus F
gugacaaacaagcugucu

SEQ ID NO: 1586542 - RNA, 11 nt, Human adenovirus F
cuagcaaacag

SEQ ID NO: 1586543 - RNA, 22 nt, Human adenovirus F
gcugacgaagacauucuugagc

SEQ ID NO: 1586544 - RNA, 18 nt, Human adenovirus F
cgucccaucauuuccaca

SEQ ID NO: 1586545 - RNA, 23 nt, Human adenovirus F
ggccauggaaacgcagccugagc

SEQ ID NO: 1586546 - RNA, 17 nt, Human adenovirus F
caggagccgaauugccu

SEQ ID NO: 1586547 - RNA, 21 nt, Human adenovirus F
aaccggcggcguacacuggcu

SEQ ID NO: 1586548 - RNA, 15 nt, Human adenovirus F
cgaggggcuggcccg

SEQ ID NO: 1586549 - RNA, 16 nt, Human adenovirus F
gagauccguggagccg

SEQ ID NO: 1586550 - RNA, 22 nt, Human adenovirus F
cccgcaaucccgaagccuucag

SEQ ID NO: 1586551 - RNA, 17 nt, Human adenovirus F
gaagccuucaggcagca

SEQ ID NO: 1586552 - RNA, 12 nt, Human adenovirus F
accagugggcuc

SEQ ID NO: 1586553 - RNA, 17 nt, Human adenovirus F
caucuucuucugcaucc

SEQ ID NO: 1586554 - RNA, 20 nt, Human adenovirus F
gaucccucagagcugcaaga

SEQ ID NO: 1586555 - RNA, 20 nt, Human adenovirus F
cguuuaugggcaccuggaac

SEQ ID NO: 1586556 - RNA, 21 nt, Human adenovirus F
agucgcaagguaagcuaagga

SEQ ID NO: 1586557 - RNA, 22 nt, Human adenovirus F
auauuucaccuacucuggcucc

SEQ ID NO: 1586558 - RNA, 15 nt, Human adenovirus F
aauggaaccaagcua

SEQ ID NO: 1586559 - RNA, 15 nt, Human adenovirus F
uacucuuucuuacaa

SEQ ID NO: 1586560 - RNA, 21 nt, Human adenovirus F
ggauucuaagggaggcagcag

SEQ ID NO: 1586561 - RNA, 22 nt, Human adenovirus F
acgaagcuagcauaaaagaagc

SEQ ID NO: 1586562 - RNA, 16 nt, Human adenovirus F
caccguuguggaguca

SEQ ID NO: 1586563 - RNA, 20 nt, Human adenovirus F
agccgaucccagagcucggu

SEQ ID NO: 1586564 - RNA, 23 nt, Human adenovirus F
cgcgcaacggcaaucccagcaga

SEQ ID NO: 1586565 - RNA, 21 nt, Human adenovirus F
ugggaaggggccagcaagcug

SEQ ID NO: 1586566 - RNA, 13 nt, Human adenovirus F
cuaacaaaaacuu

SEQ ID NO: 1586567 - RNA, 15 nt, Human adenovirus F
uaugggagucuggca

SEQ ID NO: 1586568 - RNA, 13 nt, Human adenovirus F
cgccauagcugga

SEQ ID NO: 1586569 - RNA, 17 nt, Human adenovirus F
cagcuggagcuucucag

SEQ ID NO: 1586570 - RNA, 16 nt, Human adenovirus F
accuuauacaccuccc

SEQ ID NO: 1586571 - RNA, 14 nt, Human adenovirus F
gugacaaagaggcg

SEQ ID NO: 1586572 - RNA, 15 nt, Human adenovirus F
cagguguacuggucc

SEQ ID NO: 1586573 - RNA, 18 nt, Human adenovirus F
gcuagaaugucacugccg

SEQ ID NO: 1586574 - RNA, 20 nt, Human adenovirus F
cagccuaacggcaccugcga

SEQ ID NO: 1586575 - RNA, 13 nt, Human adenovirus F
uuacgucagcuac

SEQ ID NO: 1586576 - RNA, 22 nt, Human adenovirus F
gccuacaacuacggagaugcag

SEQ ID NO: 1586577 - RNA, 17 nt, Human adenovirus F
uuccucauacaaaugcu

SEQ ID NO: 1586578 - RNA, 15 nt, Human adenovirus F
guaaagcgagccaaa

SEQ ID NO: 1586579 - RNA, 18 nt, Human adenovirus F
gauuuuucuucuccuggc

SEQ ID NO: 1586580 - RNA, 20 nt, Human adenovirus F
uggaacauuaauccaaugca

SEQ ID NO: 1586581 - RNA, 12 nt, Human adenovirus F
auauccaaaucc

SEQ ID NO: 1586582 - RNA, 17 nt, Human adenovirus F
cagaaacaugccaccca

SEQ ID NO: 1586583 - RNA, 17 nt, Human adenovirus F
ggccguaccaagccuga

SEQ ID NO: 1586584 - RNA, 22 nt, Human adenovirus F
ccggguugggcgcuugccaggg

SEQ ID NO: 1586585 - RNA, 16 nt, Human adenovirus F
uuuuccagcaacuuua

SEQ ID NO: 1586586 - RNA, 18 nt, Human adenovirus F
cuaucacuaaaaccaaca

SEQ ID NO: 1586587 - RNA, 17 nt, Human adenovirus F
aacacaaugcaaaaugu

SEQ ID NO: 1586588 - RNA, 13 nt, Human adenovirus F
cugccagaggccg

SEQ ID NO: 1586589 - RNA, 19 nt, Human adenovirus F
uaccaaagacaaaaucacu

SEQ ID NO: 1586590 - RNA, 21 nt, Human adenovirus F
uuggcaauguguuugccaugg

SEQ ID NO: 1586591 - RNA, 24 nt, Human adenovirus F
ggcgaaaaaugaugauggcagcag

SEQ ID NO: 1586592 - RNA, 17 nt, Human adenovirus F
gacuuugcuccgccggc

SEQ ID NO: 1586593 - RNA, 17 nt, Human adenovirus F
cucauccgccauugcca

SEQ ID NO: 1586594 - RNA, 12 nt, Human adenovirus F
uauuacaaaugc

SEQ ID NO: 1586595 - RNA, 14 nt, Human adenovirus F
gaggccauccugga

SEQ ID NO: 1586596 - RNA, 18 nt, Human adenovirus F
aaauguagcccuguacuu

SEQ ID NO: 1586597 - RNA, 21 nt, Human adenovirus F
cccucaaacacugcgcaaagu

SEQ ID NO: 1586598 - RNA, 14 nt, Human adenovirus F
ucacgaccucccaa

SEQ ID NO: 1586599 - RNA, 12 nt, Human adenovirus F
ucuuucuuacaa

SEQ ID NO: 1586600 - RNA, 12 nt, Human adenovirus F
aaaaccaaauca

SEQ ID NO: 1586601 - RNA, 21 nt, Human adenovirus F
agguacagcccaacaccacca

SEQ ID NO: 1586602 - RNA, 21 nt, Human adenovirus F
gacggggcccguucuggacuc

SEQ ID NO: 1586603 - RNA, 12 nt, Human adenovirus F
gaaucauuucca

SEQ ID NO: 1586604 - RNA, 16 nt, Human adenovirus F
uggagggcgucaugcu

SEQ ID NO: 1586605 - RNA, 20 nt, Human adenovirus F
accccgccccgaccacaguc

SEQ ID NO: 1586606 - RNA, 21 nt, Human adenovirus F
cagccccaggccaaccgcuuu

SEQ ID NO: 1586607 - RNA, 20 nt, Human adenovirus F
acgacugggcggcggccaug

SEQ ID NO: 1586608 - RNA, 15 nt, Human adenovirus F
gaugauggagggaac

SEQ ID NO: 1586609 - RNA, 23 nt, Human adenovirus F
aucgcuugccacuggccuuuuga

SEQ ID NO: 1586610 - RNA, 16 nt, Human adenovirus F
cacugcaccuugcaag

SEQ ID NO: 1586611 - RNA, 20 nt, Human adenovirus F
aaggucagaaaaaccgccac

SEQ ID NO: 1586612 - RNA, 18 nt, Human adenovirus F
ugcgcuguacugugcauu

SEQ ID NO: 1586613 - RNA, 22 nt, Human adenovirus F
uacaaaugucuaauggagcuau

SEQ ID NO: 1586614 - RNA, 14 nt, Human adenovirus F
ccccugccaccgca

SEQ ID NO: 1586615 - RNA, 15 nt, Human adenovirus F
ggaaaucagaugcau

SEQ ID NO: 1586616 - RNA, 15 nt, Human adenovirus F
aauuuuucgaggaaa

SEQ ID NO: 1586617 - RNA, 15 nt, Human adenovirus F
gguacaggugggcuu

SEQ ID NO: 1586618 - RNA, 17 nt, Human adenovirus F
cgccggcgggaagagga

SEQ ID NO: 1586619 - RNA, 18 nt, Human adenovirus F
aaauuacagccaagucaa

SEQ ID NO: 1586620 - RNA, 16 nt, Human adenovirus F
ggcuuuuggaccuggu

SEQ ID NO: 1586621 - RNA, 21 nt, Human adenovirus F
ccacgcaggcgagaguugggg

SEQ ID NO: 1586622 - RNA, 22 nt, Human adenovirus F
auccccgccgccccuggccugu

SEQ ID NO: 1586623 - RNA, 14 nt, Human adenovirus F
cuugucguaaccaa

SEQ ID NO: 1586624 - RNA, 16 nt, Human adenovirus F
guagcucuuccaagcu

SEQ ID NO: 1586625 - RNA, 15 nt, Human adenovirus F
ggccuggcagcugga

SEQ ID NO: 1586626 - RNA, 16 nt, Human adenovirus F
gaggagucccugcacu

SEQ ID NO: 1586627 - RNA, 18 nt, Human adenovirus F
aacuaccucgccgcgcag

SEQ ID NO: 1586628 - RNA, 18 nt, Human adenovirus F
ccauauccauuaaagcuc

SEQ ID NO: 1586629 - RNA, 21 nt, Human adenovirus F
cagaacguucuucacugcacc

SEQ ID NO: 1586630 - RNA, 19 nt, Human adenovirus F
auugccucguagaagucaa

SEQ ID NO: 1586631 - RNA, 16 nt, Human adenovirus F
cuggaguuggcuucug

SEQ ID NO: 1586632 - RNA, 20 nt, Human adenovirus F
aagcgguugcgguacucucg

SEQ ID NO: 1586633 - RNA, 18 nt, Human adenovirus F
gacguuaagguaaagcca

SEQ ID NO: 1586634 - RNA, 16 nt, Human adenovirus F
ccacgucccuccccgu

SEQ ID NO: 1586635 - RNA, 19 nt, Human adenovirus F
aguggcuucacggaaggaa

SEQ ID NO: 1586636 - RNA, 17 nt, Human adenovirus F
uugaagaugacuucaac

SEQ ID NO: 1586637 - RNA, 19 nt, Human adenovirus F
gaagaccgauaguacggcc

SEQ ID NO: 1586638 - RNA, 18 nt, Human adenovirus F
uggcggcuaacuugugga

SEQ ID NO: 1586639 - RNA, 15 nt, Human adenovirus F
gcuucagagcucuuc

SEQ ID NO: 1586640 - RNA, 14 nt, Human adenovirus F
cucccuuuccagca

SEQ ID NO: 1586641 - RNA, 19 nt, Human adenovirus F
ccugccgcugcgcagcagu

SEQ ID NO: 1586642 - RNA, 19 nt, Human adenovirus F
gaguugucuugguaggcaa

SEQ ID NO: 1586643 - RNA, 14 nt, Human adenovirus F
acuagcauaaaggg

SEQ ID NO: 1586644 - RNA, 18 nt, Human adenovirus F
ccgcaaccauguucacug

SEQ ID NO: 1586645 - RNA, 17 nt, Human adenovirus F
uuuggccugaauuuuua

SEQ ID NO: 1586646 - RNA, 20 nt, Human adenovirus F
ggagaggcgguagcggcacg

SEQ ID NO: 1586647 - RNA, 13 nt, Human adenovirus F
ggcucuggacaug

SEQ ID NO: 1586648 - RNA, 16 nt, Human adenovirus F
aggcgauagucggugc

SEQ ID NO: 1586649 - RNA, 24 nt, Human adenovirus F
aucauuuuaaaccaauuugcuaac

SEQ ID NO: 1586650 - RNA, 23 nt, Human adenovirus F
gguccuuugccccccggcggcgg

SEQ ID NO: 1586651 - RNA, 21 nt, Human adenovirus F
cuugucgcagaaucuccugca

SEQ ID NO: 1586652 - RNA, 15 nt, Human adenovirus F
caccccucuccgugc

SEQ ID NO: 1586653 - RNA, 13 nt, Human adenovirus F
auccguggagccg

SEQ ID NO: 1586654 - RNA, 15 nt, Human adenovirus F
ggagauccguggagc

SEQ ID NO: 1586655 - RNA, 19 nt, Human adenovirus F
ccugucgccccugccaacu

SEQ ID NO: 1586656 - RNA, 13 nt, Human adenovirus F
uccuggaccugga

SEQ ID NO: 1586657 - RNA, 20 nt, Human adenovirus F
ccagcugguaagcagccuaa

SEQ ID NO: 1586658 - RNA, 20 nt, Human adenovirus F
cagauugccuccguguuuuu

SEQ ID NO: 1586659 - RNA, 19 nt, Human adenovirus F
gccauggaaacgcagccug

SEQ ID NO: 1586660 - RNA, 19 nt, Human adenovirus F
gucgccagaguugucuugg

SEQ ID NO: 1586661 - RNA, 15 nt, Human adenovirus F
uguacaccaccucuu

SEQ ID NO: 1586662 - RNA, 17 nt, Human adenovirus F
ggcacagaauccucaga

SEQ ID NO: 1586663 - RNA, 19 nt, Human adenovirus F
gcgucaggaauuucuuuua

SEQ ID NO: 1586664 - RNA, 17 nt, Human adenovirus F
cauggaucgcauccugg

SEQ ID NO: 1586665 - RNA, 22 nt, Human adenovirus F
gaagccacgcugaacuuuuugc

SEQ ID NO: 1586666 - RNA, 21 nt, Human adenovirus F
gcauuaggccgucccugggau

SEQ ID NO: 1586667 - RNA, 20 nt, Human adenovirus F
cugagggccggccuggaccc

SEQ ID NO: 1586668 - RNA, 16 nt, Human adenovirus F
ugcacuuaacuguucu

SEQ ID NO: 1586669 - RNA, 21 nt, Human adenovirus F
cuccgauuuugucccccucug

SEQ ID NO: 1586670 - RNA, 17 nt, Human adenovirus F
ggucuuagguugcuugc

SEQ ID NO: 1586671 - RNA, 19 nt, Human adenovirus F
auccuccuucacaaagucc

SEQ ID NO: 1586672 - RNA, 22 nt, Human adenovirus F
uggccuuuugaacgaccugcac

SEQ ID NO: 1586673 - RNA, 22 nt, Human adenovirus F
ggaaacugucaggcucugagag

SEQ ID NO: 1586674 - RNA, 16 nt, Human adenovirus F
cccgguacaggugggc

SEQ ID NO: 1586675 - RNA, 21 nt, Human adenovirus F
cagcgggaagagaggcagccc

SEQ ID NO: 1586676 - RNA, 21 nt, Human adenovirus F
cauggugguagaaggucaggc

SEQ ID NO: 1586677 - RNA, 18 nt, Human adenovirus F
ucaccuacucuggcuccg

SEQ ID NO: 1586678 - RNA, 16 nt, Human adenovirus F
cuugcucggugcagcc

SEQ ID NO: 1586679 - RNA, 20 nt, Human adenovirus F
aggguaaggggcggagccua

SEQ ID NO: 1586680 - RNA, 13 nt, Human adenovirus F
acaugagcuuacu

SEQ ID NO: 1586681 - RNA, 16 nt, Human adenovirus F
gagcuuuuacugggac

SEQ ID NO: 1586682 - RNA, 22 nt, Human adenovirus F
gcaguccacuuaacagcuccuc

SEQ ID NO: 1586683 - RNA, 12 nt, Human adenovirus F
agccuguggagu

SEQ ID NO: 1586684 - RNA, 11 nt, Human adenovirus F
cagaacauggc

SEQ ID NO: 1586685 - RNA, 15 nt, Human adenovirus F
cuuacaaacaguaac

SEQ ID NO: 1586686 - RNA, 10 nt, Human adenovirus F
acgagcugcc

SEQ ID NO: 1586687 - RNA, 18 nt, Human adenovirus F
cauccgccauugccaccc

SEQ ID NO: 1586688 - RNA, 20 nt, Human adenovirus F
auuuggaagaugaguuuaaa

SEQ ID NO: 1586689 - RNA, 19 nt, Human adenovirus F
guaacacaggucaaaugcu

SEQ ID NO: 1586690 - RNA, 20 nt, Human adenovirus F
aggccauccuggaccuggaa

SEQ ID NO: 1586691 - RNA, 20 nt, Human adenovirus F
ggcacaguaaucaaggguuu

SEQ ID NO: 1586692 - RNA, 17 nt, Human adenovirus F
ugggaguugcgcgccgc

SEQ ID NO: 1586693 - RNA, 14 nt, Human adenovirus F
uugggggccuuuug

SEQ ID NO: 1586694 - RNA, 17 nt, Human adenovirus F
aaaacaaaacaaacucc

SEQ ID NO: 1586695 - RNA, 20 nt, Human adenovirus F
caguuggagcagccugugga

SEQ ID NO: 1586696 - RNA, 15 nt, Human adenovirus F
gcccaccaaauuaaa

SEQ ID NO: 1586697 - RNA, 16 nt, Human adenovirus F
gcagcaacauaacuuu

SEQ ID NO: 1586698 - RNA, 19 nt, Human adenovirus F
uauuuguauaaucuuaaaa

SEQ ID NO: 1586699 - RNA, 12 nt, Human adenovirus F
cuccacccuuuc

SEQ ID NO: 1586700 - RNA, 23 nt, Human adenovirus F
ucgccagcgacaaggcaccaucu

SEQ ID NO: 1586701 - RNA, 12 nt, Human adenovirus F
agcgggcacaga

SEQ ID NO: 1586702 - RNA, 15 nt, Human adenovirus F
accacccccaacucu

SEQ ID NO: 1586703 - RNA, 15 nt, Human adenovirus F
gucuuuuuugucugg

SEQ ID NO: 1586704 - RNA, 12 nt, Human adenovirus F
accucugcaccc

SEQ ID NO: 1586705 - RNA, 15 nt, Human adenovirus F
cacccaaagccaaau

SEQ ID NO: 1586706 - RNA, 16 nt, Human adenovirus F
ugacauuccuccgccu

SEQ ID NO: 1586707 - RNA, 16 nt, Human adenovirus F
cguucucuccccacag

SEQ ID NO: 1586708 - RNA, 22 nt, Human adenovirus F
ucuccugcacgucgccagaguu

SEQ ID NO: 1586709 - RNA, 14 nt, Human adenovirus F
cagcccccaccgcc

SEQ ID NO: 1586710 - RNA, 13 nt, Human adenovirus F
agccaaugggcuc

SEQ ID NO: 1586711 - RNA, 22 nt, Human adenovirus F
gccauggaaacgcagccugagc

SEQ ID NO: 1586712 - RNA, 17 nt, Human adenovirus F
gaagagaggcagccccg

SEQ ID NO: 1586713 - RNA, 15 nt, Human adenovirus F
ggccauccuggaccu

SEQ ID NO: 1586714 - RNA, 23 nt, Human adenovirus F
ucagaaccuccgacgcuugcugg

SEQ ID NO: 1586715 - RNA, 23 nt, Human adenovirus F
aauguagcccuguacuugccuga

SEQ ID NO: 1586716 - RNA, 14 nt, Human adenovirus F
cuuuugcaccaggg

SEQ ID NO: 1586717 - RNA, 14 nt, Human adenovirus F
aaaccuggcaacau

SEQ ID NO: 1586718 - RNA, 16 nt, Human adenovirus F
guggacgacagccagc

SEQ ID NO: 1586719 - RNA, 14 nt, Human adenovirus F
uggccugccgccca

SEQ ID NO: 1586720 - RNA, 19 nt, Human adenovirus F
ccguuggaauuuuccugcg

SEQ ID NO: 1586721 - RNA, 17 nt, Human adenovirus F
cgccuuuucucaucacu

SEQ ID NO: 1586722 - RNA, 17 nt, Human adenovirus F
cuaugacaccuccucaa

SEQ ID NO: 1586723 - RNA, 23 nt, Human adenovirus F
ccuaucacuaaaaccaacaaaau

SEQ ID NO: 1586724 - RNA, 19 nt, Human adenovirus F
gggcaacguucagccacuc

SEQ ID NO: 1586725 - RNA, 17 nt, Human adenovirus F
aacggcgugcuggaaag

SEQ ID NO: 1586726 - RNA, 14 nt, Human adenovirus F
gucugguuaaacaa

SEQ ID NO: 1586727 - RNA, 17 nt, Human adenovirus F
gccucgcgugcucaagc

SEQ ID NO: 1586728 - RNA, 20 nt, Human adenovirus F
cuauucugggacgcucuuau

SEQ ID NO: 1586729 - RNA, 20 nt, Human adenovirus F
accuccgggaguccucagcc

SEQ ID NO: 1586730 - RNA, 15 nt, Human adenovirus F
acuucuucagcucua

SEQ ID NO: 1586731 - RNA, 17 nt, Human adenovirus F
cccauagacaaggaggu

SEQ ID NO: 1586732 - RNA, 15 nt, Human adenovirus F
uugcgcgaacagagu

SEQ ID NO: 1586733 - RNA, 23 nt, Human adenovirus F
agguaguccucauucuucucaua

SEQ ID NO: 1586734 - RNA, 16 nt, Human adenovirus F
uggcucugcagcagcg

SEQ ID NO: 1586735 - RNA, 19 nt, Human adenovirus F
cagccugagcugccagagg

SEQ ID NO: 1586736 - RNA, 23 nt, Human adenovirus F
cccguaaccaaguuggugaugcc

SEQ ID NO: 1586737 - RNA, 15 nt, Human adenovirus F
gaccccauggaugag

SEQ ID NO: 1586738 - RNA, 17 nt, Human adenovirus F
gaguuugugcgguccuu

SEQ ID NO: 1586739 - RNA, 14 nt, Human adenovirus F
ugugaguguggagc

SEQ ID NO: 1586740 - RNA, 19 nt, Human adenovirus F
aguaucagaauguaacucu

SEQ ID NO: 1586741 - RNA, 12 nt, Human adenovirus F
ccccaccguggc

SEQ ID NO: 1586742 - RNA, 12 nt, Human adenovirus F
uaacgccccccg

SEQ ID NO: 1586743 - RNA, 14 nt, Human adenovirus F
acagagcuuuauga

SEQ ID NO: 1586744 - RNA, 22 nt, Human adenovirus F
gcuagaaaaccgcgccauagcu

SEQ ID NO: 1586745 - RNA, 17 nt, Human adenovirus F
cgcacuucaagaaacac

SEQ ID NO: 1586746 - RNA, 14 nt, Human adenovirus F
ugccuccagcacug

SEQ ID NO: 1586747 - RNA, 17 nt, Human adenovirus F
uugcgcuaugugcagca

SEQ ID NO: 1586748 - RNA, 13 nt, Human adenovirus F
ccgacaacaaaaa

SEQ ID NO: 1586749 - RNA, 13 nt, Human adenovirus F
uacgcccaggagc

SEQ ID NO: 1586750 - RNA, 19 nt, Human adenovirus F
gcggaagaagaugaggagg

SEQ ID NO: 1586751 - RNA, 21 nt, Human adenovirus F
cuugaggagguguuggagaac

SEQ ID NO: 1586752 - RNA, 22 nt, Human adenovirus F
ggcauuaaaaacuuuggguccu

SEQ ID NO: 1586753 - RNA, 19 nt, Human adenovirus F
uggcgccggcgggaagagg

SEQ ID NO: 1586754 - RNA, 14 nt, Human adenovirus F
cauaggccauuuug

SEQ ID NO: 1586755 - RNA, 20 nt, Human adenovirus F
uuaauauccuucagagcauu

SEQ ID NO: 1586756 - RNA, 18 nt, Human adenovirus F
aacagcguagcacucccu

SEQ ID NO: 1586757 - RNA, 17 nt, Human adenovirus F
agcgacaaggcaccauc

SEQ ID NO: 1586758 - RNA, 17 nt, Human adenovirus F
uuagcgcacugguaaac

SEQ ID NO: 1586759 - RNA, 15 nt, Human adenovirus F
gucugccagagggug

SEQ ID NO: 1586760 - RNA, 14 nt, Human adenovirus F
acgggcuggcuucc

SEQ ID NO: 1586761 - RNA, 14 nt, Human adenovirus F
cgcccgccucccaa

SEQ ID NO: 1586762 - RNA, 13 nt, Human adenovirus F
cuguccagggagu

SEQ ID NO: 1586763 - RNA, 22 nt, Human adenovirus F
ggcggccauggaucgcauccug

SEQ ID NO: 1586764 - RNA, 16 nt, Human adenovirus F
gcaggacuuggcagaa

SEQ ID NO: 1586765 - RNA, 11 nt, Human adenovirus F
cuucugccagu

SEQ ID NO: 1586766 - RNA, 14 nt, Human adenovirus F
acaugaacacuucc

SEQ ID NO: 1586767 - RNA, 12 nt, Human adenovirus F
auuacugccagu

SEQ ID NO: 1586768 - RNA, 19 nt, Human adenovirus F
ucaaaaucuucaaacauua

SEQ ID NO: 1586769 - RNA, 16 nt, Human adenovirus F
ccgaggcacuguucaa

SEQ ID NO: 1586770 - RNA, 15 nt, Human adenovirus F
guggcauggcagcag

SEQ ID NO: 1586771 - RNA, 18 nt, Human adenovirus F
cgugugccauuguuaaca

SEQ ID NO: 1586772 - RNA, 21 nt, Human adenovirus F
caggagcagcgggaagagagg

SEQ ID NO: 1586773 - RNA, 11 nt, Human adenovirus F
ucgauuuccau

SEQ ID NO: 1586774 - RNA, 21 nt, Human adenovirus F
uacccagcugugguuaaauuu

SEQ ID NO: 1586775 - RNA, 13 nt, Human adenovirus F
gcguaacccgccg

SEQ ID NO: 1586776 - RNA, 19 nt, Human adenovirus F
cuggaguuggcuucugcca

SEQ ID NO: 1586777 - RNA, 22 nt, Human adenovirus F
gcagaggaaguuucagacgagg

SEQ ID NO: 1586778 - RNA, 12 nt, Human adenovirus F
gcucuguggaga

SEQ ID NO: 1586779 - RNA, 14 nt, Human adenovirus F
ccagccgcacucgc

SEQ ID NO: 1586780 - RNA, 11 nt, Human adenovirus F
cggaccugcaa

SEQ ID NO: 1586781 - RNA, 15 nt, Human adenovirus F
cgcgcacgacgggga

SEQ ID NO: 1586782 - RNA, 13 nt, Human adenovirus F
gucugcugcugcc

SEQ ID NO: 1586783 - RNA, 14 nt, Human adenovirus F
aguaacacaaacau

SEQ ID NO: 1586784 - RNA, 22 nt, Human adenovirus F
uucuguuauggaucaagugcuu

SEQ ID NO: 1586785 - RNA, 13 nt, Human adenovirus F
auacugcuccugg

SEQ ID NO: 1586786 - RNA, 12 nt, Human adenovirus F
acaugccacaga

SEQ ID NO: 1586787 - RNA, 21 nt, Human adenovirus F
ccaccagccggaggagugggc

SEQ ID NO: 1586788 - RNA, 17 nt, Human adenovirus F
ccggagagcgguccguc

SEQ ID NO: 1586789 - RNA, 16 nt, Human adenovirus F
ugccacucgaaaccaa

SEQ ID NO: 1586790 - RNA, 12 nt, Human adenovirus F
gaucagaaauuu

SEQ ID NO: 1586791 - RNA, 15 nt, Human adenovirus F
ugcagcgcacgcugg

SEQ ID NO: 1586792 - RNA, 14 nt, Human adenovirus F
ggcccugcaaagcc

SEQ ID NO: 1586793 - RNA, 21 nt, Human adenovirus F
ggcccugggcuuauuggcaug

SEQ ID NO: 1586794 - RNA, 18 nt, Human adenovirus F
gcacaggagauccgugga

SEQ ID NO: 1586795 - RNA, 18 nt, Human adenovirus F
aguccaaaugacuaacuc

SEQ ID NO: 1586796 - RNA, 16 nt, Human adenovirus F
ggaucgucgguggaua

SEQ ID NO: 1586797 - RNA, 20 nt, Human adenovirus F
cgcuguggacgacagccagc

SEQ ID NO: 1586798 - RNA, 23 nt, Human adenovirus F
guggauaccgcugcagcugcugc

SEQ ID NO: 1586799 - RNA, 14 nt, Human adenovirus F
agugcaggaagagg

SEQ ID NO: 1586800 - RNA, 17 nt, Human adenovirus F
cgucacuuccgccgcac

SEQ ID NO: 1586801 - RNA, 21 nt, Human adenovirus F
cggcacgcuccuuggcgguga

SEQ ID NO: 1586802 - RNA, 18 nt, Human adenovirus F
aagugaagaccaacugca

SEQ ID NO: 1586803 - RNA, 19 nt, Human adenovirus F
uccccagcgcccuggauac

SEQ ID NO: 1586804 - RNA, 20 nt, Human adenovirus F
uucggugacaaacaagcugu

SEQ ID NO: 1586805 - RNA, 19 nt, Human adenovirus F
cggggcuaacuggcagagc

SEQ ID NO: 1586806 - RNA, 12 nt, Human adenovirus F
auacacucccuu

SEQ ID NO: 1586807 - RNA, 14 nt, Human adenovirus F
uuuaauggaaacug

SEQ ID NO: 1586808 - RNA, 21 nt, Human adenovirus F
ccuuuucacccacccaccgcu

SEQ ID NO: 1586809 - RNA, 13 nt, Human adenovirus F
gccuucaggcagc

SEQ ID NO: 1586810 - RNA, 22 nt, Human adenovirus F
acgcaccaggucguaaugagga

SEQ ID NO: 1586811 - RNA, 13 nt, Human adenovirus F
uaaaaacaaccaa

SEQ ID NO: 1586812 - RNA, 12 nt, Human adenovirus F
acuagcgccccu

SEQ ID NO: 1586813 - RNA, 19 nt, Human adenovirus F
acaauuaaaggucuuaaag

SEQ ID NO: 1586814 - RNA, 14 nt, Human adenovirus F
cgggcaggagcccg

SEQ ID NO: 1586815 - RNA, 19 nt, Human adenovirus F
aacccacagcuagcuuuau

SEQ ID NO: 1586816 - RNA, 17 nt, Human adenovirus F
cgggcucuuggucagca

SEQ ID NO: 1586817 - RNA, 16 nt, Human adenovirus F
cucagacuccaacaau

SEQ ID NO: 1586818 - RNA, 16 nt, Human adenovirus F
ggaucuuaagcugcag

SEQ ID NO: 1586819 - RNA, 14 nt, Human adenovirus F
ucaccuacuaccac

SEQ ID NO: 1586820 - RNA, 19 nt, Human adenovirus F
ggaggugccccagagugag

SEQ ID NO: 1586821 - RNA, 22 nt, Human adenovirus F
ggaccuagaggacguggaggaa

SEQ ID NO: 1586822 - RNA, 12 nt, Human adenovirus F
acaaccagcgcu

SEQ ID NO: 1586823 - RNA, 14 nt, Human adenovirus F
gaacuugaagccau

SEQ ID NO: 1586824 - RNA, 16 nt, Human adenovirus F
ugggcauaacuucagc

SEQ ID NO: 1586825 - RNA, 15 nt, Human adenovirus F
acuuucuccacgucc

SEQ ID NO: 1586826 - RNA, 19 nt, Human adenovirus F
acccuccaguuuguggagg

SEQ ID NO: 1586827 - RNA, 21 nt, Human adenovirus F
acggccuuguaugggcagcau

SEQ ID NO: 1586828 - RNA, 13 nt, Human adenovirus F
ggacaagcucccu

SEQ ID NO: 1586829 - RNA, 17 nt, Human adenovirus F
guacgaacucagucugc

SEQ ID NO: 1586830 - RNA, 22 nt, Human adenovirus F
gcacuucaagaaacacaaacau

SEQ ID NO: 1586831 - RNA, 17 nt, Human adenovirus F
auaaaauauuguuauuu

SEQ ID NO: 1586832 - RNA, 22 nt, Human adenovirus F
caugagaucauaguugaggguu

SEQ ID NO: 1586833 - RNA, 19 nt, Human adenovirus F
acagcgaagauguuaacuu

SEQ ID NO: 1586834 - RNA, 18 nt, Human adenovirus F
cgaaccaaugcguucccg

SEQ ID NO: 1586835 - RNA, 14 nt, Human adenovirus F
gcguugcacgcucu

SEQ ID NO: 1586836 - RNA, 17 nt, Human adenovirus F
agacccgguacaggugg

SEQ ID NO: 1586837 - RNA, 23 nt, Human adenovirus F
ggacgucagaacggcgugcugga

SEQ ID NO: 1586838 - RNA, 20 nt, Human adenovirus F
cgugcgcacccugguggcgc

SEQ ID NO: 1586839 - RNA, 22 nt, Human adenovirus F
gucaaucucuucguccuggagu

SEQ ID NO: 1586840 - RNA, 14 nt, Human adenovirus F
cgggucgcagcagg

SEQ ID NO: 1586841 - RNA, 22 nt, Human adenovirus F
cuuuaaaaauagaaaacgaaaa

SEQ ID NO: 1586842 - RNA, 20 nt, Human adenovirus F
ccgcggucaacagcuggaac

SEQ ID NO: 1586843 - RNA, 23 nt, Human adenovirus F
gcggaccugcaauggcagcccag

SEQ ID NO: 1586844 - RNA, 17 nt, Human adenovirus F
cugccgcugcgcagcag

SEQ ID NO: 1586845 - RNA, 20 nt, Human adenovirus F
ccccuuacaaacaguaacaa

SEQ ID NO: 1586846 - RNA, 13 nt, Human adenovirus F
gaaauugauuuuc

SEQ ID NO: 1586847 - RNA, 13 nt, Human adenovirus F
cuccugcaauacu

SEQ ID NO: 1586848 - RNA, 15 nt, Human adenovirus F
aacgucaaugccaau

SEQ ID NO: 1586849 - RNA, 20 nt, Human adenovirus F
cgaagccuucaggcagcagc

SEQ ID NO: 1586850 - RNA, 18 nt, Human adenovirus F
ucgcucacccgcagcugc

SEQ ID NO: 1586851 - RNA, 12 nt, Human adenovirus F
gucucccaccuu

SEQ ID NO: 1586852 - RNA, 18 nt, Human adenovirus F
cagcugguaagcagccua

SEQ ID NO: 1586853 - RNA, 20 nt, Human adenovirus F
gcauaaaggggaccagcugu

SEQ ID NO: 1586854 - RNA, 14 nt, Human adenovirus F
uaggcauacaggcu

SEQ ID NO: 1586855 - RNA, 21 nt, Human adenovirus F
cucgcggccguuuaugggcac

SEQ ID NO: 1586856 - RNA, 21 nt, Human adenovirus F
uacccuccguuuacuucaacc

SEQ ID NO: 1586857 - RNA, 14 nt, Human adenovirus F
ucgcagcgggcagg

SEQ ID NO: 1586858 - RNA, 16 nt, Human adenovirus F
gggcacaguaaucaag

SEQ ID NO: 1586859 - RNA, 18 nt, Human adenovirus F
aaagacccauuuccaagc

SEQ ID NO: 1586860 - RNA, 18 nt, Human adenovirus F
ugaaaucacaguugggac

SEQ ID NO: 1586861 - RNA, 15 nt, Human adenovirus F
aucauauuagguuau

SEQ ID NO: 1586862 - RNA, 20 nt, Human adenovirus F
ugaucccgaagaggguacua

SEQ ID NO: 1586863 - RNA, 20 nt, Human adenovirus F
aauuaaccuugcauggugug

SEQ ID NO: 1586864 - RNA, 20 nt, Human adenovirus F
cuagggugugaaggcaaagg

SEQ ID NO: 1586865 - RNA, 13 nt, Human adenovirus F
gggugucugccag

SEQ ID NO: 1586866 - RNA, 21 nt, Human adenovirus F
cccacgauguaaccacagaca

SEQ ID NO: 1586867 - RNA, 16 nt, Human adenovirus F
guuuaaggagaugcaa

SEQ ID NO: 1586868 - RNA, 21 nt, Human adenovirus F
aguacucuucgcgguuugcug

SEQ ID NO: 1586869 - RNA, 13 nt, Human adenovirus F
agcucugaacacu

SEQ ID NO: 1586870 - RNA, 19 nt, Human adenovirus F
gguuaagagaagaagaugc

SEQ ID NO: 1586871 - RNA, 23 nt, Human adenovirus F
gacaccacccggguuuaccuggu

SEQ ID NO: 1586872 - RNA, 18 nt, Human adenovirus F
ccgcgcuaaaucuuccuc

SEQ ID NO: 1586873 - RNA, 17 nt, Human adenovirus F
caaaaaaaucaaggcca

SEQ ID NO: 1586874 - RNA, 16 nt, Human adenovirus F
auuucuuuuaaaaaaa

SEQ ID NO: 1586875 - RNA, 15 nt, Human adenovirus F
aguaacuuuugccac

SEQ ID NO: 1586876 - RNA, 24 nt, Human adenovirus F
caccuacacggaguaucagaaugu

SEQ ID NO: 1586877 - RNA, 21 nt, Human adenovirus F
cgcuugccacccgcgcaacac

SEQ ID NO: 1586878 - RNA, 21 nt, Human adenovirus F
cggaggcaaaacuggaacgcg

SEQ ID NO: 1586879 - RNA, 21 nt, Human adenovirus F
acaagcaaagacagagcuuua

SEQ ID NO: 1586880 - RNA, 15 nt, Human adenovirus F
caaaacaaacuccuu

SEQ ID NO: 1586881 - RNA, 13 nt, Human adenovirus F
uguuggcggcccu

SEQ ID NO: 1586882 - RNA, 22 nt, Human adenovirus F
cguuguggagucacugcuaccu

SEQ ID NO: 1586883 - RNA, 21 nt, Human adenovirus F
acacuaugguaaaaacccugu

SEQ ID NO: 1586884 - RNA, 16 nt, Human adenovirus F
gguacaggugggcuug

SEQ ID NO: 1586885 - RNA, 23 nt, Human adenovirus F
gccaugcugaauauugcggagcc

SEQ ID NO: 1586886 - RNA, 21 nt, Human adenovirus F
acuucuuaauaaagacacaau

SEQ ID NO: 1586887 - RNA, 18 nt, Human adenovirus F
uaaagcuuaccuuaaauu

SEQ ID NO: 1586888 - RNA, 20 nt, Human adenovirus F
ccuccaguuuguggaggagu

SEQ ID NO: 1586889 - RNA, 20 nt, Human adenovirus F
cuuauuucgcccgacaacaa

SEQ ID NO: 1586890 - RNA, 20 nt, Human adenovirus F
agguagccccuuggugaagg

SEQ ID NO: 1586891 - RNA, 15 nt, Human adenovirus F
cgagccaaagugcaa

SEQ ID NO: 1586892 - RNA, 12 nt, Human adenovirus F
gggaggcagcag

SEQ ID NO: 1586893 - RNA, 16 nt, Human adenovirus F
ggcggaugguggcaag

SEQ ID NO: 1586894 - RNA, 17 nt, Human adenovirus F
cccggcggcgggugcag

SEQ ID NO: 1586895 - RNA, 22 nt, Human adenovirus F
gagcuuggauuaggaagggcaa

SEQ ID NO: 1586896 - RNA, 19 nt, Human adenovirus F
ugucgguuacuucuucagc

SEQ ID NO: 1586897 - RNA, 16 nt, Human adenovirus F
uggcaacaugggagug

SEQ ID NO: 1586898 - RNA, 18 nt, Human adenovirus F
cgcaugccuccagcacug

SEQ ID NO: 1586899 - RNA, 13 nt, Human adenovirus F
aggccuggaacag

SEQ ID NO: 1586900 - RNA, 16 nt, Human adenovirus F
gucgagcuagugaaac

SEQ ID NO: 1586901 - RNA, 19 nt, Human adenovirus F
uagugaaacaugaggagga

SEQ ID NO: 1586902 - RNA, 14 nt, Human adenovirus F
guaacugagccuga

SEQ ID NO: 1586903 - RNA, 14 nt, Human adenovirus F
gaccauauccauua

SEQ ID NO: 1586904 - RNA, 18 nt, Human adenovirus F
guugcccgccagcuggca

SEQ ID NO: 1586905 - RNA, 19 nt, Human adenovirus F
acccgguacaggugggcuu

SEQ ID NO: 1586906 - RNA, 17 nt, Human adenovirus F
gauggcgugggaguugg

SEQ ID NO: 1586907 - RNA, 17 nt, Human adenovirus F
gccagccaaugggcucc

SEQ ID NO: 1586908 - RNA, 19 nt, Human adenovirus F
gccagcauggcucagcccc

SEQ ID NO: 1586909 - RNA, 22 nt, Human adenovirus F
cauuacuucacguuacuuaggc

SEQ ID NO: 1586910 - RNA, 21 nt, Human adenovirus F
cccccaccggcuccugugcag

SEQ ID NO: 1586911 - RNA, 18 nt, Human adenovirus F
aaucgguaccuuugagau

SEQ ID NO: 1586912 - RNA, 14 nt, Human adenovirus F
gcuguacuccauua

SEQ ID NO: 1586913 - RNA, 13 nt, Human adenovirus F
cauggcucagccc

SEQ ID NO: 1586914 - RNA, 24 nt, Human adenovirus F
aauguaacaugaccaaggacuggu

SEQ ID NO: 1586915 - RNA, 18 nt, Human adenovirus F
acaccgucuccaucgccg

SEQ ID NO: 1586916 - RNA, 15 nt, Human adenovirus F
gcucgcuacauccau

SEQ ID NO: 1586917 - RNA, 17 nt, Human adenovirus F
ugaagcccgcaacggcg

SEQ ID NO: 1586918 - RNA, 21 nt, Human adenovirus F
accguucuaugcuccugggua

SEQ ID NO: 1586919 - RNA, 22 nt, Human adenovirus F
ucacaaagcugugagcgccagc

SEQ ID NO: 1586920 - RNA, 14 nt, Human adenovirus F
ccagcauggcucag

SEQ ID NO: 1586921 - RNA, 16 nt, Human adenovirus F
agcugcugccgcgucu

SEQ ID NO: 1586922 - RNA, 13 nt, Human adenovirus F
cugggcggcggcc

SEQ ID NO: 1586923 - RNA, 17 nt, Human adenovirus F
ccuucgccgcagucucc

SEQ ID NO: 1586924 - RNA, 14 nt, Human adenovirus F
cguuguggacuucc

SEQ ID NO: 1586925 - RNA, 17 nt, Human adenovirus F
gcagacgcaauggaaca

SEQ ID NO: 1586926 - RNA, 21 nt, Human adenovirus F
cugaauuuuuagguuggcaau

SEQ ID NO: 1586927 - RNA, 20 nt, Human adenovirus F
aaauuugcugacagcuggga

SEQ ID NO: 1586928 - RNA, 19 nt, Human adenovirus F
ugacaaacgcuuuccgggu

SEQ ID NO: 1586929 - RNA, 13 nt, Human adenovirus F
ggccugguaacga

SEQ ID NO: 1586930 - RNA, 19 nt, Human adenovirus F
ccuaacggcaccugcgaaa

SEQ ID NO: 1586931 - RNA, 19 nt, Human adenovirus F
ggaagccccacggcauggg

SEQ ID NO: 1586932 - RNA, 17 nt, Human adenovirus F
ucugcagcauugccacu

SEQ ID NO: 1586933 - RNA, 17 nt, Human adenovirus F
aaaaacuuacaaucauu

SEQ ID NO: 1586934 - RNA, 17 nt, Human adenovirus F
cagugcuuggaagagca

SEQ ID NO: 1586935 - RNA, 19 nt, Human adenovirus F
ucuucaaacauuaagcugc

SEQ ID NO: 1586936 - RNA, 18 nt, Human adenovirus F
ugacccacaaucuucauc

SEQ ID NO: 1586937 - RNA, 23 nt, Human adenovirus F
accucugcgcugcaaacaugcuu

SEQ ID NO: 1586938 - RNA, 15 nt, Human adenovirus F
uucgcgcaacuuuug

SEQ ID NO: 1586939 - RNA, 15 nt, Human adenovirus F
ugagcgccagccgcc

SEQ ID NO: 1586940 - RNA, 15 nt, Human adenovirus F
gacugggcggcggcc

SEQ ID NO: 1586941 - RNA, 14 nt, Human adenovirus F
agcgcagcaccgca

SEQ ID NO: 1586942 - RNA, 21 nt, Human adenovirus F
cuguuccaacggugugccucu

SEQ ID NO: 1586943 - RNA, 22 nt, Human adenovirus F
auggggguaccaacuugcaaaa

SEQ ID NO: 1586944 - RNA, 13 nt, Human adenovirus F
ccgagguauccag

SEQ ID NO: 1586945 - RNA, 17 nt, Human adenovirus F
caaaaacucugugaagu

SEQ ID NO: 1586946 - RNA, 14 nt, Human adenovirus F
gccacaauuuacaa

SEQ ID NO: 1586947 - RNA, 14 nt, Human adenovirus F
uuuaaccuuaaaau

SEQ ID NO: 1586948 - RNA, 15 nt, Human adenovirus F
gaucauguccaccug

SEQ ID NO: 1586949 - RNA, 20 nt, Human adenovirus F
ugaauauugcggagccugag

SEQ ID NO: 1586950 - RNA, 15 nt, Human adenovirus F
ggcugaccggcgcug

SEQ ID NO: 1586951 - RNA, 17 nt, Human adenovirus F
uaaggaggaggcuaaug

SEQ ID NO: 1586952 - RNA, 20 nt, Human adenovirus F
ugcaaaaugugcagcaaaaa

SEQ ID NO: 1586953 - RNA, 17 nt, Human adenovirus F
uaugcuauuuuccagca

SEQ ID NO: 1586954 - RNA, 21 nt, Human adenovirus F
gaguuuaaugucucgucgcca

SEQ ID NO: 1586955 - RNA, 17 nt, Human adenovirus F
cccagcgcccgggcccu

SEQ ID NO: 1586956 - RNA, 16 nt, Human adenovirus F
ggugccuucaccuggg

SEQ ID NO: 1586957 - RNA, 16 nt, Human adenovirus F
gcaucggaacccucca

SEQ ID NO: 1586958 - RNA, 22 nt, Human adenovirus F
ccuuggccaccacgggaguugc

SEQ ID NO: 1586959 - RNA, 15 nt, Human adenovirus F
cuuuugaugguggcu

SEQ ID NO: 1586960 - RNA, 13 nt, Human adenovirus F
aauuccacuggca

SEQ ID NO: 1586961 - RNA, 14 nt, Human adenovirus F
gccguggacgcacg

SEQ ID NO: 1586962 - RNA, 16 nt, Human adenovirus F
cggaaacaaaaaacuu

SEQ ID NO: 1586963 - RNA, 14 nt, Human adenovirus F
ccaauaccagcaaa

SEQ ID NO: 1586964 - RNA, 24 nt, Human adenovirus F
caccgcccccacuguugccguggc

SEQ ID NO: 1586965 - RNA, 16 nt, Human adenovirus F
gaggaacguauuuugc

SEQ ID NO: 1586966 - RNA, 21 nt, Human adenovirus F
cucacguguuagguacuauaa

SEQ ID NO: 1586967 - RNA, 14 nt, Human adenovirus F
acggauuuuugugg

SEQ ID NO: 1586968 - RNA, 15 nt, Human adenovirus F
cuauaauagcaccaa

SEQ ID NO: 1586969 - RNA, 18 nt, Human adenovirus F
ggcacaccuuugggcucc

SEQ ID NO: 1586970 - RNA, 19 nt, Human adenovirus F
ggcaggagcugcgggccgg

SEQ ID NO: 1586971 - RNA, 19 nt, Human adenovirus F
gguaaaaaugccaggcagc

SEQ ID NO: 1586972 - RNA, 17 nt, Human adenovirus F
agccgaugcccaacgcu

SEQ ID NO: 1586973 - RNA, 19 nt, Human adenovirus F
guagacgcuggaagaggua

SEQ ID NO: 1586974 - RNA, 13 nt, Human adenovirus F
gcagcaguccguc

SEQ ID NO: 1586975 - RNA, 18 nt, Human adenovirus F
cggccaaguagcauuuua

SEQ ID NO: 1586976 - RNA, 22 nt, Human adenovirus F
ggucccuucuggaccuggggcg

SEQ ID NO: 1586977 - RNA, 17 nt, Human adenovirus F
gcccgggcacaucagaa

SEQ ID NO: 1586978 - RNA, 19 nt, Human adenovirus F
auucccaaauaauuuuccg

SEQ ID NO: 1586979 - RNA, 19 nt, Human adenovirus F
gcgcgcucgucgggaagca

SEQ ID NO: 1586980 - RNA, 18 nt, Human adenovirus F
gaaaaccggcuggggcag

SEQ ID NO: 1586981 - RNA, 18 nt, Human adenovirus F
aaccccuuugugcccucc

SEQ ID NO: 1586982 - RNA, 17 nt, Human adenovirus F
aacaguaacaacuccuu

SEQ ID NO: 1586983 - RNA, 16 nt, Human adenovirus F
aggcagcagccccagg

SEQ ID NO: 1586984 - RNA, 14 nt, Human adenovirus F
uuucuccuccccuu

SEQ ID NO: 1586985 - RNA, 14 nt, Human adenovirus F
agagcuaaggagga

SEQ ID NO: 1586986 - RNA, 15 nt, Human adenovirus F
gcucuuccaagcugc

SEQ ID NO: 1586987 - RNA, 18 nt, Human adenovirus F
gcaggguuuuugagcaug

SEQ ID NO: 1586988 - RNA, 20 nt, Human adenovirus F
uuuuacgcggggcaggagcu

SEQ ID NO: 1586989 - RNA, 16 nt, Human adenovirus F
accaaggacugguucc

SEQ ID NO: 1586990 - RNA, 12 nt, Human adenovirus F
gaucagcgggca

SEQ ID NO: 1586991 - RNA, 18 nt, Human adenovirus F
guaccgccaaaaaagcag

SEQ ID NO: 1586992 - RNA, 23 nt, Human adenovirus F
uuuaaaacuuuauggauguuuuc

SEQ ID NO: 1586993 - RNA, 20 nt, Human adenovirus F
ccuggaagagggcgaggggc

SEQ ID NO: 1586994 - RNA, 19 nt, Human adenovirus F
acugcgucgucggcucugg

SEQ ID NO: 1586995 - RNA, 13 nt, Human adenovirus F
auggaacuaacug

SEQ ID NO: 1586996 - RNA, 14 nt, Human adenovirus F
gcgagcagagccca

SEQ ID NO: 1586997 - RNA, 18 nt, Human adenovirus F
uguggggcgugcgagccc

SEQ ID NO: 1586998 - RNA, 19 nt, Human adenovirus F
ggccuuguaugggcagcau

SEQ ID NO: 1586999 - RNA, 13 nt, Human adenovirus F
cccuucccgacau

SEQ ID NO: 1587000 - RNA, 22 nt, Human adenovirus F
aacaaccuucaaacccagccgc

SEQ ID NO: 1587001 - RNA, 18 nt, Human adenovirus F
ccuguucuaaaaccaaac

SEQ ID NO: 1587002 - RNA, 16 nt, Human adenovirus F
cuagcaaacagugcca

SEQ ID NO: 1587003 - RNA, 21 nt, Human adenovirus F
gccucaugagcugggagaaag

SEQ ID NO: 1587004 - RNA, 16 nt, Human adenovirus F
cgcggaagaagaugag

SEQ ID NO: 1587005 - RNA, 15 nt, Human adenovirus F
gagucuggcagcagu

SEQ ID NO: 1587006 - RNA, 14 nt, Human adenovirus F
agcgggcaggagcc

SEQ ID NO: 1587007 - RNA, 20 nt, Human adenovirus F
cucuuauuguucaaggaaac

SEQ ID NO: 1587008 - RNA, 13 nt, Human adenovirus F
cguuaggcuuuaa

SEQ ID NO: 1587009 - RNA, 18 nt, Human adenovirus F
acgccgaggcacuguuca

SEQ ID NO: 1587010 - RNA, 21 nt, Human adenovirus F
uuucacguaguaucucauccc

SEQ ID NO: 1587011 - RNA, 17 nt, Human adenovirus F
gcggaugguggcaagga

SEQ ID NO: 1587012 - RNA, 21 nt, Human adenovirus F
agauguccuuaaggaggaggc

SEQ ID NO: 1587013 - RNA, 20 nt, Human adenovirus F
uucaccuuuuuacccugacc

SEQ ID NO: 1587014 - RNA, 20 nt, Human adenovirus F
uacggcggcgccaaacggcg

SEQ ID NO: 1587015 - RNA, 13 nt, Human adenovirus F
gcacguuugacaa

SEQ ID NO: 1587016 - RNA, 22 nt, Human adenovirus F
uaugaugaaaguagaagucucu

SEQ ID NO: 1587017 - RNA, 22 nt, Human adenovirus F
uggccgacaagguggcggccau

SEQ ID NO: 1587018 - RNA, 13 nt, Human adenovirus F
gacagucugccaa

SEQ ID NO: 1587019 - RNA, 18 nt, Human adenovirus F
uaagggccgaugccaggc

SEQ ID NO: 1587020 - RNA, 23 nt, Human adenovirus F
ccugggguagggugucugccaga

SEQ ID NO: 1587021 - RNA, 19 nt, Human adenovirus F
ugggaggaagugacggggc

SEQ ID NO: 1587022 - RNA, 23 nt, Human adenovirus F
cauuaaaaaucuccugcuccugc

SEQ ID NO: 1587023 - RNA, 16 nt, Human adenovirus F
acacuuuugccaaagu

SEQ ID NO: 1587024 - RNA, 15 nt, Human adenovirus F
cucauucgcacggcg

SEQ ID NO: 1587025 - RNA, 16 nt, Human adenovirus F
gcuggggaauggagcu

SEQ ID NO: 1587026 - RNA, 14 nt, Human adenovirus F
gcuguaccaggagg

SEQ ID NO: 1587027 - RNA, 14 nt, Human adenovirus F
cagcgacagggcgc

SEQ ID NO: 1587028 - RNA, 14 nt, Human adenovirus F
ccacucgaaaccaa

SEQ ID NO: 1587029 - RNA, 14 nt, Human adenovirus F
uggcucuguggaga

SEQ ID NO: 1587030 - RNA, 13 nt, Human adenovirus F
guaagcuaaggac

SEQ ID NO: 1587031 - RNA, 12 nt, Human adenovirus F
agaauaauacag

SEQ ID NO: 1587032 - RNA, 15 nt, Human adenovirus F
uucgccuggagaggc

SEQ ID NO: 1587033 - RNA, 18 nt, Human adenovirus F
ucugaccaacuagaaauc

SEQ ID NO: 1587034 - RNA, 20 nt, Human adenovirus F
ugcaauggcagcccagcgcc

SEQ ID NO: 1587035 - RNA, 17 nt, Human adenovirus F
accccuaugacaccucc

SEQ ID NO: 1587036 - RNA, 16 nt, Human adenovirus F
ccuugcaagcagcucg

SEQ ID NO: 1587037 - RNA, 15 nt, Human adenovirus F
caggcaguggacagc

SEQ ID NO: 1587038 - RNA, 17 nt, Human adenovirus F
acuguugccguggcuac

SEQ ID NO: 1587039 - RNA, 14 nt, Human adenovirus F
ucaucgccgccgcc

SEQ ID NO: 1587040 - RNA, 17 nt, Human adenovirus F
cagcaugagcaagcgca

SEQ ID NO: 1587041 - RNA, 15 nt, Human adenovirus F
agauaugucugccaa

SEQ ID NO: 1587042 - RNA, 16 nt, Human adenovirus F
uaccacuaccccuacc

SEQ ID NO: 1587043 - RNA, 22 nt, Human adenovirus F
cuacgugcacaaagcucugggc

SEQ ID NO: 1587044 - RNA, 22 nt, Human adenovirus F
ccgacauguuugucuuuaaaaa

SEQ ID NO: 1587045 - RNA, 23 nt, Human adenovirus F
aaccuauugguuccauggcccga

SEQ ID NO: 1587046 - RNA, 22 nt, Human adenovirus F
ucaagcccuacaccaaugcaaa

SEQ ID NO: 1587047 - RNA, 17 nt, Human adenovirus F
agguggccauugggcug

SEQ ID NO: 1587048 - RNA, 19 nt, Human adenovirus F
ucggagccaaccuccgaaa

SEQ ID NO: 1587049 - RNA, 14 nt, Human adenovirus F
cuuuauugccaccg

SEQ ID NO: 1587050 - RNA, 18 nt, Human adenovirus F
cgcagcagauccuucccg

SEQ ID NO: 1587051 - RNA, 21 nt, Human adenovirus F
cugacgggggaggcacaccuu

SEQ ID NO: 1587052 - RNA, 22 nt, Human adenovirus F
gcgguugcggccacgcgagaga

SEQ ID NO: 1587053 - RNA, 17 nt, Human adenovirus F
acacgaaaaccggcugg

SEQ ID NO: 1587054 - RNA, 20 nt, Human adenovirus F
gccuguggaguggcauuaaa

SEQ ID NO: 1587055 - RNA, 14 nt, Human adenovirus F
gcuggaggcccuug

SEQ ID NO: 1587056 - RNA, 21 nt, Human adenovirus F
accucugacaaacacgcuccc

SEQ ID NO: 1587057 - RNA, 15 nt, Human adenovirus F
cagucugccaacacu

SEQ ID NO: 1587058 - RNA, 15 nt, Human adenovirus F
auuuauuucuuuugc

SEQ ID NO: 1587059 - RNA, 17 nt, Human adenovirus F
gguguauaaaagggggc

SEQ ID NO: 1587060 - RNA, 21 nt, Human adenovirus F
uggaggaagaaaccaucgcca

SEQ ID NO: 1587061 - RNA, 17 nt, Human adenovirus F
ugcccaccguuccgccc

SEQ ID NO: 1587062 - RNA, 19 nt, Human adenovirus F
ccgucaucucuacagcccc

SEQ ID NO: 1587063 - RNA, 15 nt, Human adenovirus F
aucggcaccagccag

SEQ ID NO: 1587064 - RNA, 22 nt, Human adenovirus F
cagccaaugggcuccagcgagc

SEQ ID NO: 1587065 - RNA, 14 nt, Human adenovirus F
gcgggcggcgccag

SEQ ID NO: 1587066 - RNA, 14 nt, Human adenovirus F
uuacagcccccacc

SEQ ID NO: 1587067 - RNA, 22 nt, Human adenovirus F
agaaaauccucagugucuugcc

SEQ ID NO: 1587068 - RNA, 19 nt, Human adenovirus F
agucuguuuggugggcuga

SEQ ID NO: 1587069 - RNA, 17 nt, Human adenovirus F
cccgcaacggcgcagca

SEQ ID NO: 1587070 - RNA, 18 nt, Human adenovirus F
acgccuuacauguggagc

SEQ ID NO: 1587071 - RNA, 13 nt, Human adenovirus F
caacgugcaggcc

SEQ ID NO: 1587072 - RNA, 22 nt, Human adenovirus F
acaugcuuaugcgcuguacugu

SEQ ID NO: 1587073 - RNA, 14 nt, Human adenovirus F
ugcuaacccucaaa

SEQ ID NO: 1587074 - RNA, 20 nt, Human adenovirus F
caggaggacuaugucagcuu

SEQ ID NO: 1587075 - RNA, 16 nt, Human adenovirus F
acgcaagcgaaugccc

SEQ ID NO: 1587076 - RNA, 20 nt, Human adenovirus F
uauuuguauaaucuuaaaac

SEQ ID NO: 1587077 - RNA, 14 nt, Human adenovirus F
ggagugccgccggu

SEQ ID NO: 1587078 - RNA, 13 nt, Human adenovirus F
cucaccuggcaaa

SEQ ID NO: 1587079 - RNA, 14 nt, Human adenovirus F
aaacggugaaauga

SEQ ID NO: 1587080 - RNA, 19 nt, Human adenovirus F
gugggccgcugaaagacgu

SEQ ID NO: 1587081 - RNA, 20 nt, Human adenovirus F
gggcaucgucauucuucagu

SEQ ID NO: 1587082 - RNA, 16 nt, Human adenovirus F
agauuccaccaaaggu

SEQ ID NO: 1587083 - RNA, 17 nt, Human adenovirus F
cagcugcguacggacca

SEQ ID NO: 1587084 - RNA, 18 nt, Human adenovirus F
uggcgccggcgggaagag

SEQ ID NO: 1587085 - RNA, 12 nt, Human adenovirus F
agccaaugggcu

SEQ ID NO: 1587086 - RNA, 13 nt, Human adenovirus F
ccgcugcagcugc

SEQ ID NO: 1587087 - RNA, 23 nt, Human adenovirus F
uuuccagcagcaccaccugcccu

SEQ ID NO: 1587088 - RNA, 20 nt, Human adenovirus F
gcuaaaggaccaaaacuuuc

SEQ ID NO: 1587089 - RNA, 21 nt, Human adenovirus F
cacaaagcugugagcgccagc

SEQ ID NO: 1587090 - RNA, 9 nt, Human adenovirus F
gaggaggag

SEQ ID NO: 1587091 - RNA, 16 nt, Human adenovirus F
aaucagaugcauuuug

SEQ ID NO: 1587092 - RNA, 20 nt, Human adenovirus F
accugugggucgcagcaggu

SEQ ID NO: 1587093 - RNA, 16 nt, Human adenovirus F
ucaggcagcagcccca

SEQ ID NO: 1587094 - RNA, 18 nt, Human adenovirus F
aacgcccgcuagcucuau

SEQ ID NO: 1587095 - RNA, 17 nt, Human adenovirus F
ccgcggacgucaagccc

SEQ ID NO: 1587096 - RNA, 20 nt, Human adenovirus F
uguauuuguauaaucuuaaa

SEQ ID NO: 1587097 - RNA, 16 nt, Human adenovirus F
guagggauugaguggg

SEQ ID NO: 1587098 - RNA, 22 nt, Human adenovirus F
guggaaccaggcaguggacagc

SEQ ID NO: 1587099 - RNA, 20 nt, Human adenovirus F
gcagcagauccuucccguga

SEQ ID NO: 1587100 - RNA, 23 nt, Human adenovirus F
gcuuuaacaacacaggagcuuua

SEQ ID NO: 1587101 - RNA, 17 nt, Human adenovirus F
augggccuggcagcugg

SEQ ID NO: 1587102 - RNA, 11 nt, Human adenovirus F
ucccaaagucg

SEQ ID NO: 1587103 - RNA, 15 nt, Human adenovirus F
cauagcugucucacc

SEQ ID NO: 1587104 - RNA, 16 nt, Human adenovirus F
acauuaugagcaaaga

SEQ ID NO: 1587105 - RNA, 16 nt, Human adenovirus F
uaccaccccagcacuu

SEQ ID NO: 1587106 - RNA, 15 nt, Human adenovirus F
caagaaauacaaagg

SEQ ID NO: 1587107 - RNA, 19 nt, Human adenovirus F
acgugaccgagcagcugcg

SEQ ID NO: 1587108 - RNA, 22 nt, Human adenovirus F
ucaaucagcggcuggaaaauag

SEQ ID NO: 1587109 - RNA, 16 nt, Human adenovirus F
ugccuuucucccaggc

SEQ ID NO: 1587110 - RNA, 13 nt, Human adenovirus F
gcccgccagcugg

SEQ ID NO: 1587111 - RNA, 14 nt, Human adenovirus F
ggcgguggcgcagc

SEQ ID NO: 1587112 - RNA, 12 nt, Human adenovirus F
acguucucuccc

SEQ ID NO: 1587113 - RNA, 18 nt, Human adenovirus F
cagauccuucccgugaca

SEQ ID NO: 1587114 - RNA, 16 nt, Human adenovirus F
accaguccgggccaga

SEQ ID NO: 1587115 - RNA, 20 nt, Human adenovirus F
auagccggugcacuugggga

SEQ ID NO: 1587116 - RNA, 19 nt, Human adenovirus F
uuuaagaaacgaacacgcu

SEQ ID NO: 1587117 - RNA, 18 nt, Human adenovirus F
cagcgcgugaccaucacu

SEQ ID NO: 1587118 - RNA, 22 nt, Human adenovirus F
aacuccuuggguuuagccacau

SEQ ID NO: 1587119 - RNA, 17 nt, Human adenovirus F
auuaacauuaggcucaa

SEQ ID NO: 1587120 - RNA, 18 nt, Human adenovirus F
uuaaguauucaccaccuu

SEQ ID NO: 1587121 - RNA, 19 nt, Human adenovirus F
cagccugcgucgggcucua

SEQ ID NO: 1587122 - RNA, 22 nt, Human adenovirus F
uggaagagggcgaggggcuggc

SEQ ID NO: 1587123 - RNA, 17 nt, Human adenovirus F
cguuggagagcaguuug

SEQ ID NO: 1587124 - RNA, 19 nt, Human adenovirus F
guggauaccgcugcagcug

SEQ ID NO: 1587125 - RNA, 18 nt, Human adenovirus F
cagucgcagcgcaucacc

SEQ ID NO: 1587126 - RNA, 17 nt, Human adenovirus F
ucuggaaucagcaucuu

SEQ ID NO: 1587127 - RNA, 23 nt, Human adenovirus F
cgcaauggucuuacaugcacauc

SEQ ID NO: 1587128 - RNA, 23 nt, Human adenovirus F
auccuucccgugacagaaaucaa

SEQ ID NO: 1587129 - RNA, 13 nt, Human adenovirus F
ggaucuggaggaa

SEQ ID NO: 1587130 - RNA, 15 nt, Human adenovirus F
gcgcuuugcgcaggc

SEQ ID NO: 1587131 - RNA, 17 nt, Human adenovirus F
cgugucaccugcaguuc

SEQ ID NO: 1587132 - RNA, 11 nt, Human adenovirus F
guacacuggcu

SEQ ID NO: 1587133 - RNA, 19 nt, Human adenovirus F
guggggccccugaggcagc

SEQ ID NO: 1587134 - RNA, 11 nt, Human adenovirus F
ucuuugccacc

SEQ ID NO: 1587135 - RNA, 14 nt, Human adenovirus F
gcugcagccagacu

SEQ ID NO: 1587136 - RNA, 22 nt, Human adenovirus F
cgguggcucugcagcagcgccc

SEQ ID NO: 1587137 - RNA, 18 nt, Human adenovirus F
aaaccuguucuaaaacca

SEQ ID NO: 1587138 - RNA, 19 nt, Human adenovirus F
cuggccaacugccaccucc

SEQ ID NO: 1587139 - RNA, 15 nt, Human adenovirus F
caauuugcuaacacu

SEQ ID NO: 1587140 - RNA, 23 nt, Human adenovirus F
uucccaaaaaaagaauuacuuuu

SEQ ID NO: 1587141 - RNA, 23 nt, Human adenovirus F
cuacaccccccgccuuacauuga

SEQ ID NO: 1587142 - RNA, 23 nt, Human adenovirus F
gagcuagugaaacaugaggagga

SEQ ID NO: 1587143 - RNA, 19 nt, Human adenovirus F
aaggugggcauaacuucag

SEQ ID NO: 1587144 - RNA, 23 nt, Human adenovirus F
uucagacgaggaggcggaggagc

SEQ ID NO: 1587145 - RNA, 23 nt, Human adenovirus F
cuauuauccguuggaauuuuccu

SEQ ID NO: 1587146 - RNA, 20 nt, Human adenovirus F
aauguaacaugaccaaggac

SEQ ID NO: 1587147 - RNA, 23 nt, Human adenovirus F
auuaauaaagcuuaccuuaaauu

SEQ ID NO: 1587148 - RNA, 21 nt, Human adenovirus F
aaaaauuacagccaagucaaa

SEQ ID NO: 1587149 - RNA, 14 nt, Human adenovirus F
aaaacucaacguua

SEQ ID NO: 1587150 - RNA, 15 nt, Human adenovirus F
auaaucuuaaaacug

SEQ ID NO: 1587151 - RNA, 21 nt, Human adenovirus F
aacaagaaggugcuuccagcc

SEQ ID NO: 1587152 - RNA, 22 nt, Human adenovirus F
cuauuugggaggggaggacgac

SEQ ID NO: 1587153 - RNA, 18 nt, Human adenovirus F
ccaagcugcggaaaugcu

SEQ ID NO: 1587154 - RNA, 15 nt, Human adenovirus F
acgggagggacaagc

SEQ ID NO: 1587155 - RNA, 19 nt, Human adenovirus F
caaggacagucugccaaca

SEQ ID NO: 1587156 - RNA, 23 nt, Human adenovirus F
acaaccagcuuaguauuaacacu

SEQ ID NO: 1587157 - RNA, 21 nt, Human adenovirus F
ggaucccucagagcugcaaga

SEQ ID NO: 1587158 - RNA, 14 nt, Human adenovirus F
gucacucuccgccg

SEQ ID NO: 1587159 - RNA, 16 nt, Human adenovirus F
uccacguaccagaaag

SEQ ID NO: 1587160 - RNA, 16 nt, Human adenovirus F
aaaaagguucugaagu

SEQ ID NO: 1587161 - RNA, 15 nt, Human adenovirus F
auacguaaaugugcc

SEQ ID NO: 1587162 - RNA, 16 nt, Human adenovirus F
aaaaacuugcaaggaa

SEQ ID NO: 1587163 - RNA, 20 nt, Human adenovirus F
ccugucaugaaaguuccucu

SEQ ID NO: 1587164 - RNA, 18 nt, Human adenovirus F
ccccggcggcgggugcag

SEQ ID NO: 1587165 - RNA, 19 nt, Human adenovirus F
gguauaggcuugugcggcu

SEQ ID NO: 1587166 - RNA, 23 nt, Human adenovirus F
ucaugucccaccacauuggccac

SEQ ID NO: 1587167 - RNA, 16 nt, Human adenovirus F
cugacgggggaggcac

SEQ ID NO: 1587168 - RNA, 22 nt, Human adenovirus F
aaugccuaccucugacaaacac

SEQ ID NO: 1587169 - RNA, 21 nt, Human adenovirus F
cgguauagccggugcacuugg

SEQ ID NO: 1587170 - RNA, 17 nt, Human adenovirus F
ggcauguacggcggcgc

SEQ ID NO: 1587171 - RNA, 21 nt, Human adenovirus F
ugcaccgcgcggcggccauga

SEQ ID NO: 1587172 - RNA, 15 nt, Human adenovirus F
uuugccuucuuuucu

SEQ ID NO: 1587173 - RNA, 18 nt, Human adenovirus F
acaauccuaacaaaaacu

SEQ ID NO: 1587174 - RNA, 21 nt, Human adenovirus F
gcauguuuucuccauaccaga

SEQ ID NO: 1587175 - RNA, 17 nt, Human adenovirus F
auccagcaacucugaac

SEQ ID NO: 1587176 - RNA, 19 nt, Human adenovirus F
aaccgggaaaaccuuuuca

SEQ ID NO: 1587177 - RNA, 13 nt, Human adenovirus F
cuuaccagagcca

SEQ ID NO: 1587178 - RNA, 17 nt, Human adenovirus F
ucaaacaacaaaaucag

SEQ ID NO: 1587179 - RNA, 21 nt, Human adenovirus F
ugcaguccacuuaacagcucc

SEQ ID NO: 1587180 - RNA, 16 nt, Human adenovirus F
aucuuaagcugcagcc

SEQ ID NO: 1587181 - RNA, 15 nt, Human adenovirus F
gcugcaaucuugaau

SEQ ID NO: 1587182 - RNA, 19 nt, Human adenovirus F
cauaacuaaaaaaacucca

SEQ ID NO: 1587183 - RNA, 19 nt, Human adenovirus F
gucauacgcuagaccaaca

SEQ ID NO: 1587184 - RNA, 13 nt, Human adenovirus F
ggagggauuuaau

SEQ ID NO: 1587185 - RNA, 23 nt, Human adenovirus F
ugacagcauuaaccuguaugcca

SEQ ID NO: 1587186 - RNA, 19 nt, Human adenovirus F
gcgcaacuuuugcaccagg

SEQ ID NO: 1587187 - RNA, 17 nt, Human adenovirus F
aggaggcuauuggccag

SEQ ID NO: 1587188 - RNA, 18 nt, Human adenovirus F
guuccucuucucugucuu

SEQ ID NO: 1587189 - RNA, 13 nt, Human adenovirus F
accaggccuugca

SEQ ID NO: 1587190 - RNA, 19 nt, Human adenovirus F
aucauguccaccugagggg

SEQ ID NO: 1587191 - RNA, 15 nt, Human adenovirus F
cgcuggcuccgcggc

SEQ ID NO: 1587192 - RNA, 18 nt, Human adenovirus F
aaucagggcgugcaagug

SEQ ID NO: 1587193 - RNA, 22 nt, Human adenovirus F
gaaggggccagcaagcugccgc

SEQ ID NO: 1587194 - RNA, 12 nt, Human adenovirus F
gaauuuuugcuu

SEQ ID NO: 1587195 - RNA, 18 nt, Human adenovirus F
ccuggcccccaaaggugc

SEQ ID NO: 1587196 - RNA, 23 nt, Human adenovirus F
cgucgguggauaccgcugcagcu

SEQ ID NO: 1587197 - RNA, 12 nt, Human adenovirus F
ccugaggaggag

SEQ ID NO: 1587198 - RNA, 19 nt, Human adenovirus F
caccagccagcucaacggg

SEQ ID NO: 1587199 - RNA, 23 nt, Human adenovirus F
accaggaggcuauuggccagacg

SEQ ID NO: 1587200 - RNA, 12 nt, Human adenovirus F
caauacuacaaa

SEQ ID NO: 1587201 - RNA, 19 nt, Human adenovirus F
guaccaguccgggccagac

SEQ ID NO: 1587202 - RNA, 23 nt, Human adenovirus F
uccaaaucucgccuaacaucacc

SEQ ID NO: 1587203 - RNA, 17 nt, Human adenovirus F
gcgccacucgggaaaga

SEQ ID NO: 1587204 - RNA, 18 nt, Human adenovirus F
ccgcggucaacagcugga

SEQ ID NO: 1587205 - RNA, 19 nt, Human adenovirus F
aaucucuucguccuggagu

SEQ ID NO: 1587206 - RNA, 20 nt, Human adenovirus F
ccugagggccggccuggacc

SEQ ID NO: 1587207 - RNA, 19 nt, Human adenovirus F
aaaccccgaucccgaaucu

SEQ ID NO: 1587208 - RNA, 16 nt, Human adenovirus F
ggcggcgggugcagug

SEQ ID NO: 1587209 - RNA, 18 nt, Human adenovirus F
acaaaguccuggccaacu

SEQ ID NO: 1587210 - RNA, 16 nt, Human adenovirus F
uauuaaugcccacacc

SEQ ID NO: 1587211 - RNA, 21 nt, Human adenovirus F
gcccgugcgguugcggccacg

SEQ ID NO: 1587212 - RNA, 16 nt, Human adenovirus F
aacuaccgccuuugga

SEQ ID NO: 1587213 - RNA, 20 nt, Human adenovirus F
cgguggauaccgcugcagcu

SEQ ID NO: 1587214 - RNA, 17 nt, Human adenovirus F
cccuccccccuuccacu

SEQ ID NO: 1587215 - RNA, 21 nt, Human adenovirus F
aaggauuuugccggcucuagg

SEQ ID NO: 1587216 - RNA, 16 nt, Human adenovirus F
ccagcgcccgggcccu

SEQ ID NO: 1587217 - RNA, 13 nt, Human adenovirus F
uaaauaaaacauc

SEQ ID NO: 1587218 - RNA, 23 nt, Human adenovirus F
ggagggacaagcuuaccccgcca

SEQ ID NO: 1587219 - RNA, 13 nt, Human adenovirus F
ggcgaauaaaagg

SEQ ID NO: 1587220 - RNA, 22 nt, Human adenovirus F
guucuucacugcaccuugcaag

SEQ ID NO: 1587221 - RNA, 21 nt, Human adenovirus F
uccauccaucacgccaacgcc

SEQ ID NO: 1587222 - RNA, 16 nt, Human adenovirus F
uaccauuaagaagacu

SEQ ID NO: 1587223 - RNA, 23 nt, Human adenovirus F
acucugaagaugucugaccaacu

SEQ ID NO: 1587224 - RNA, 17 nt, Human adenovirus F
ccacaguccuucugcca

SEQ ID NO: 1587225 - RNA, 17 nt, Human adenovirus F
auccuccuucacaaagu

SEQ ID NO: 1587226 - RNA, 19 nt, Human adenovirus F
ccgccacaugaacacuucc

SEQ ID NO: 1587227 - RNA, 17 nt, Human adenovirus F
uuacaaccaaaaacggg

SEQ ID NO: 1587228 - RNA, 13 nt, Human adenovirus F
ccuggcagcugga

SEQ ID NO: 1587229 - RNA, 17 nt, Human adenovirus F
gacggcaaggaaccagu

SEQ ID NO: 1587230 - RNA, 14 nt, Human adenovirus F
acgucaacuccucu

SEQ ID NO: 1587231 - RNA, 22 nt, Human adenovirus F
gcacagccugcgucgggcucua

SEQ ID NO: 1587232 - RNA, 13 nt, Human adenovirus F
gcucuucuuccuc

SEQ ID NO: 1587233 - RNA, 21 nt, Human adenovirus F
uguaacucucccuuuccagca

SEQ ID NO: 1587234 - RNA, 17 nt, Human adenovirus F
uucgcccggacacuauu

SEQ ID NO: 1587235 - RNA, 22 nt, Human adenovirus F
ggcaggcuuccuuaacaagggc

SEQ ID NO: 1587236 - RNA, 20 nt, Human adenovirus F
agcugugucagcuaacucuc

SEQ ID NO: 1587237 - RNA, 17 nt, Human adenovirus F
uaaccacuaccacccuc

SEQ ID NO: 1587238 - RNA, 18 nt, Human adenovirus F
cgccguuucucgccccac

SEQ ID NO: 1587239 - RNA, 13 nt, Human adenovirus F
auguaaaguucua

SEQ ID NO: 1587240 - RNA, 24 nt, Human adenovirus F
agacgugugugugagggcaaaagu

SEQ ID NO: 1587241 - RNA, 17 nt, Human adenovirus F
ccugcuccugcccgggu

SEQ ID NO: 1587242 - RNA, 20 nt, Human adenovirus F
gaaaaccuacgcccaggagc

SEQ ID NO: 1587243 - RNA, 12 nt, Human adenovirus F
aucccagccucg

SEQ ID NO: 1587244 - RNA, 19 nt, Human adenovirus F
aagcgcggccgcuacggag

SEQ ID NO: 1587245 - RNA, 11 nt, Human adenovirus F
auagccaacca

SEQ ID NO: 1587246 - RNA, 15 nt, Human adenovirus F
ccacuugugcaaugu

SEQ ID NO: 1587247 - RNA, 20 nt, Human adenovirus F
uaaauggaauucgugccacu

SEQ ID NO: 1587248 - RNA, 16 nt, Human adenovirus F
gcagcgcacgcuggag

SEQ ID NO: 1587249 - RNA, 23 nt, Human adenovirus F
gagacccagguuuaauacaguga

SEQ ID NO: 1587250 - RNA, 12 nt, Human adenovirus F
gcugcagcugcu

SEQ ID NO: 1587251 - RNA, 18 nt, Human adenovirus F
cugaccccauuacuacca

SEQ ID NO: 1587252 - RNA, 19 nt, Human adenovirus F
cauacgcuagaccaacaaa

SEQ ID NO: 1587253 - RNA, 13 nt, Human adenovirus F
agguggggcggcg

SEQ ID NO: 1587254 - RNA, 16 nt, Human adenovirus F
gaguuuguacccuccg

SEQ ID NO: 1587255 - RNA, 14 nt, Human adenovirus F
ugcaauggcagccc

SEQ ID NO: 1587256 - RNA, 17 nt, Human adenovirus F
acguuugacaaacgcuu

SEQ ID NO: 1587257 - RNA, 15 nt, Human adenovirus F
acagucaagcucucc

SEQ ID NO: 1587258 - RNA, 19 nt, Human adenovirus F
acggccguaccaagccuga

SEQ ID NO: 1587259 - RNA, 19 nt, Human adenovirus F
gucauccgccuccacccuu

SEQ ID NO: 1587260 - RNA, 14 nt, Human adenovirus F
cguucagccacucc

SEQ ID NO: 1587261 - RNA, 23 nt, Human adenovirus F
aacagcagguuaaagccaacucc

SEQ ID NO: 1587262 - RNA, 20 nt, Human adenovirus F
gcgcugcuacucaacagaaa

SEQ ID NO: 1587263 - RNA, 22 nt, Human adenovirus F
caacaagaaggugcuuccagcc

SEQ ID NO: 1587264 - RNA, 16 nt, Human adenovirus F
cgccucaugagcuggg

SEQ ID NO: 1587265 - RNA, 15 nt, Human adenovirus F
aggagguacuccucg

SEQ ID NO: 1587266 - RNA, 20 nt, Human adenovirus F
cugguuuccuauuacagccc

SEQ ID NO: 1587267 - RNA, 15 nt, Human adenovirus F
aacagauuuaccagu

SEQ ID NO: 1587268 - RNA, 19 nt, Human adenovirus F
uccuguguuacgccagaga

SEQ ID NO: 1587269 - RNA, 12 nt, Human adenovirus F
cugguuaaacaa

SEQ ID NO: 1587270 - RNA, 14 nt, Human adenovirus F
cacagaacaaaaca

SEQ ID NO: 1587271 - RNA, 13 nt, Human adenovirus F
ggugugaaggcaa

SEQ ID NO: 1587272 - RNA, 13 nt, Human adenovirus F
uguuuuccucuga

SEQ ID NO: 1587273 - RNA, 14 nt, Human adenovirus F
caguuggagcagcc

SEQ ID NO: 1587274 - RNA, 13 nt, Human adenovirus F
cugaucagccagg

SEQ ID NO: 1587275 - RNA, 19 nt, Human adenovirus F
gccccugugaguguggagc

SEQ ID NO: 1587276 - RNA, 9 nt, Human adenovirus F
aggacacgg

SEQ ID NO: 1587277 - RNA, 15 nt, Human adenovirus F
cacuuacaaccaaaa

SEQ ID NO: 1587278 - RNA, 20 nt, Human adenovirus F
cagcucacgucuucuacaca

SEQ ID NO: 1587279 - RNA, 21 nt, Human adenovirus F
ccagccccgguugugcagugu

SEQ ID NO: 1587280 - RNA, 17 nt, Human adenovirus F
aaagccauccgcaagga

SEQ ID NO: 1587281 - RNA, 14 nt, Human adenovirus F
acaccggugggcuu

SEQ ID NO: 1587282 - RNA, 18 nt, Human adenovirus F
uucagccacuccugcagu

SEQ ID NO: 1587283 - RNA, 17 nt, Human adenovirus F
caguggccgcacucagc

SEQ ID NO: 1587284 - RNA, 21 nt, Human adenovirus F
gucugggaguaaaaagccuga

SEQ ID NO: 1587285 - RNA, 18 nt, Human adenovirus F
cauccccgccgccccugg

SEQ ID NO: 1587286 - RNA, 20 nt, Human adenovirus F
agcugcugccgcgucugcug

SEQ ID NO: 1587287 - RNA, 14 nt, Human adenovirus F
cacucgcuccaccc

SEQ ID NO: 1587288 - RNA, 14 nt, Human adenovirus F
gcgcuugccagggu

SEQ ID NO: 1587289 - RNA, 19 nt, Human adenovirus F
gccaaugggcuccagcgag

SEQ ID NO: 1587290 - RNA, 17 nt, Human adenovirus F
gcgcgacagagcaccau

SEQ ID NO: 1587291 - RNA, 13 nt, Human adenovirus F
acaacaacgggca

SEQ ID NO: 1587292 - RNA, 17 nt, Human adenovirus F
gugcuccugaagcacau

SEQ ID NO: 1587293 - RNA, 17 nt, Human adenovirus F
gguaagugcagaggcgu

SEQ ID NO: 1587294 - RNA, 14 nt, Human adenovirus F
ugucaggcucugag

SEQ ID NO: 1587295 - RNA, 19 nt, Human adenovirus F
cuggacucgucuccugcaa

SEQ ID NO: 1587296 - RNA, 13 nt, Human adenovirus F
ugucaacggcaca

SEQ ID NO: 1587297 - RNA, 14 nt, Human adenovirus F
gcugccaacaaaug

SEQ ID NO: 1587298 - RNA, 18 nt, Human adenovirus F
uuugccacacuaaaguuu

SEQ ID NO: 1587299 - RNA, 22 nt, Human adenovirus F
ugagcaaagacauucccacgcc

SEQ ID NO: 1587300 - RNA, 13 nt, Human adenovirus F
ugccuccagcacu

SEQ ID NO: 1587301 - RNA, 17 nt, Human adenovirus F
aagaucacaccucuccc

SEQ ID NO: 1587302 - RNA, 16 nt, Human adenovirus F
cguucuaugcuccugg

SEQ ID NO: 1587303 - RNA, 21 nt, Human adenovirus F
acugggugcgagaugcgucgg

SEQ ID NO: 1587304 - RNA, 13 nt, Human adenovirus F
ccgcgucugcugc

SEQ ID NO: 1587305 - RNA, 19 nt, Human adenovirus F
augguaacuccucuucucc

SEQ ID NO: 1587306 - RNA, 17 nt, Human adenovirus F
gcuggcuuuuggaccug

SEQ ID NO: 1587307 - RNA, 13 nt, Human adenovirus F
augcgauuuucca

SEQ ID NO: 1587308 - RNA, 18 nt, Human adenovirus F
uggaaugccugcagcgcu

SEQ ID NO: 1587309 - RNA, 22 nt, Human adenovirus F
gucgcaggguuauacucuggau

SEQ ID NO: 1587310 - RNA, 18 nt, Human adenovirus F
ggcacggcucgcggccgu

SEQ ID NO: 1587311 - RNA, 17 nt, Human adenovirus F
ggucacucucagcugcu

SEQ ID NO: 1587312 - RNA, 18 nt, Human adenovirus F
ggcggauuuuugcccgcg

SEQ ID NO: 1587313 - RNA, 21 nt, Human adenovirus F
ccugcuugucugucugccaau

SEQ ID NO: 1587314 - RNA, 15 nt, Human adenovirus F
ugcgaccggcccgga

SEQ ID NO: 1587315 - RNA, 15 nt, Human adenovirus F
agcuugcccuuggaa

SEQ ID NO: 1587316 - RNA, 15 nt, Human adenovirus F
gacagccaggcagag

SEQ ID NO: 1587317 - RNA, 14 nt, Human adenovirus F
uggaacgcaguguu

SEQ ID NO: 1587318 - RNA, 17 nt, Human adenovirus F
accaguccgggccagac

SEQ ID NO: 1587319 - RNA, 18 nt, Human adenovirus F
ggcgcaaucccaggcgug

SEQ ID NO: 1587320 - RNA, 14 nt, Human adenovirus F
cagcuccucagccc

SEQ ID NO: 1587321 - RNA, 16 nt, Human adenovirus F
aaacuguaaaccuaac

SEQ ID NO: 1587322 - RNA, 14 nt, Human adenovirus F
aggcagcagggugc

SEQ ID NO: 1587323 - RNA, 13 nt, Human adenovirus F
ccgcgcgggcagg

SEQ ID NO: 1587324 - RNA, 21 nt, Human adenovirus F
cuggaguuggcuucugccaga

SEQ ID NO: 1587325 - RNA, 22 nt, Human adenovirus F
gggcuggcccgcuugggggcgc

SEQ ID NO: 1587326 - RNA, 13 nt, Human adenovirus F
ggagucccugcac

SEQ ID NO: 1587327 - RNA, 20 nt, Human adenovirus F
caagggaaacaagcauccca

SEQ ID NO: 1587328 - RNA, 18 nt, Human adenovirus F
aaucccgaagccuucagg

SEQ ID NO: 1587329 - RNA, 20 nt, Human adenovirus F
uggcuggaggcuugggagga

SEQ ID NO: 1587330 - RNA, 15 nt, Human adenovirus F
guuggagcagccugu

SEQ ID NO: 1587331 - RNA, 13 nt, Human adenovirus F
gcgcaccucuugu

SEQ ID NO: 1587332 - RNA, 20 nt, Human adenovirus F
ccacccuauggaccaccgcg

SEQ ID NO: 1587333 - RNA, 13 nt, Human adenovirus F
cuaaaaccaacaa

SEQ ID NO: 1587334 - RNA, 14 nt, Human adenovirus F
auguuauugacauu

SEQ ID NO: 1587335 - RNA, 15 nt, Human adenovirus F
cacccuuucccaccc

SEQ ID NO: 1587336 - RNA, 14 nt, Human adenovirus F
aagggcucugccug

SEQ ID NO: 1587337 - RNA, 22 nt, Human adenovirus F
acagcuucguacuucuguuuua

SEQ ID NO: 1587338 - RNA, 17 nt, Human adenovirus F
acgacgagcuugcucgc

SEQ ID NO: 1587339 - RNA, 15 nt, Human adenovirus F
cucuuccaagcugcg

SEQ ID NO: 1587340 - RNA, 15 nt, Human adenovirus F
ucacuuugccagagg

SEQ ID NO: 1587341 - RNA, 19 nt, Human adenovirus F
caacaugggagugcuggcc

SEQ ID NO: 1587342 - RNA, 16 nt, Human adenovirus F
uuguagucugccaacg

SEQ ID NO: 1587343 - RNA, 23 nt, Human adenovirus F
auuugguaacaaggccuggaaca

SEQ ID NO: 1587344 - RNA, 14 nt, Human adenovirus F
uccgccauugccac

SEQ ID NO: 1587345 - RNA, 18 nt, Human adenovirus F
gguggcgcgcgaggaggu

SEQ ID NO: 1587346 - RNA, 19 nt, Human adenovirus F
uggaacgagaucggcacca

SEQ ID NO: 1587347 - RNA, 18 nt, Human adenovirus F
ucugagcacauugccagc

SEQ ID NO: 1587348 - RNA, 23 nt, Human adenovirus F
gccguggcuggcgggcaaagcua

SEQ ID NO: 1587349 - RNA, 20 nt, Human adenovirus F
uuggaaaucgugcccgugga

SEQ ID NO: 1587350 - RNA, 19 nt, Human adenovirus F
accugcaauggcagcccag

SEQ ID NO: 1587351 - RNA, 15 nt, Human adenovirus F
caacccgucuucccu

SEQ ID NO: 1587352 - RNA, 16 nt, Human adenovirus F
ucuugcaaagacggcg

SEQ ID NO: 1587353 - RNA, 19 nt, Human adenovirus F
agggugugaaggcaaaggu

SEQ ID NO: 1587354 - RNA, 18 nt, Human adenovirus F
cuaagugugacauuacuu

SEQ ID NO: 1587355 - RNA, 13 nt, Human adenovirus F
gcacgggcgcacg

SEQ ID NO: 1587356 - RNA, 22 nt, Human adenovirus F
ugcuuaucccgcgcuaaaucuu

SEQ ID NO: 1587357 - RNA, 21 nt, Human adenovirus F
ccagacuacuuuuuccaaacu

SEQ ID NO: 1587358 - RNA, 16 nt, Human adenovirus F
uggaauuuuugcuucu

SEQ ID NO: 1587359 - RNA, 15 nt, Human adenovirus F
auuaccgucaucucu

SEQ ID NO: 1587360 - RNA, 16 nt, Human adenovirus F
agcuucuaucugcaaa

SEQ ID NO: 1587361 - RNA, 22 nt, Human adenovirus F
ugcucgcaaacaaagaaguaca

SEQ ID NO: 1587362 - RNA, 20 nt, Human adenovirus F
gcgcuuuuuuuaggcgccaa

SEQ ID NO: 1587363 - RNA, 18 nt, Human adenovirus F
gcucuggacaugacggca

SEQ ID NO: 1587364 - RNA, 16 nt, Human adenovirus F
ucagcugaacccaccc

SEQ ID NO: 1587365 - RNA, 22 nt, Human adenovirus F
aacccaugagccgccagguggu

SEQ ID NO: 1587366 - RNA, 18 nt, Human adenovirus F
ggccuguuuuugagcaca

SEQ ID NO: 1587367 - RNA, 18 nt, Human adenovirus F
uuaacagcuccucagccc

SEQ ID NO: 1587368 - RNA, 24 nt, Human adenovirus F
cacgcaagucagcaacuacccugu

SEQ ID NO: 1587369 - RNA, 13 nt, Human adenovirus F
gcuaucagccgca

SEQ ID NO: 1587370 - RNA, 14 nt, Human adenovirus F
accacccuagcauu

SEQ ID NO: 1587371 - RNA, 20 nt, Human adenovirus F
accugcaguucauuuaaaag

SEQ ID NO: 1587372 - RNA, 13 nt, Human adenovirus F
aacuuuuugccca

SEQ ID NO: 1587373 - RNA, 18 nt, Human adenovirus F
acuaugccuuccgucaug

SEQ ID NO: 1587374 - RNA, 18 nt, Human adenovirus F
ugcuucugccagugcagg

SEQ ID NO: 1587375 - RNA, 19 nt, Human adenovirus F
cgcacugguaaaccagcac

SEQ ID NO: 1587376 - RNA, 17 nt, Human adenovirus F
gcuggggaauggagcug

SEQ ID NO: 1587377 - RNA, 20 nt, Human adenovirus F
ggcgcuuucaguuggagcag

SEQ ID NO: 1587378 - RNA, 18 nt, Human adenovirus F
ggugugaaggcaaagguc

SEQ ID NO: 1587379 - RNA, 18 nt, Human adenovirus F
cgcggacauuaccgcgcc

SEQ ID NO: 1587380 - RNA, 15 nt, Human adenovirus F
aucgacgggcagugc

SEQ ID NO: 1587381 - RNA, 17 nt, Human adenovirus F
cuagaaugucacugccg

SEQ ID NO: 1587382 - RNA, 20 nt, Human adenovirus F
gagcauugugguacaggagc

SEQ ID NO: 1587383 - RNA, 17 nt, Human adenovirus F
caaaaacggggcuuuaa

SEQ ID NO: 1587384 - RNA, 18 nt, Human adenovirus F
ggccaucggccaugguca

SEQ ID NO: 1587385 - RNA, 14 nt, Human adenovirus F
cgccccuaucacua

SEQ ID NO: 1587386 - RNA, 15 nt, Human adenovirus F
gagggcguuggagag

SEQ ID NO: 1587387 - RNA, 16 nt, Human adenovirus F
agccugaaauacacug

SEQ ID NO: 1587388 - RNA, 16 nt, Human adenovirus F
aacaguuaccaaggcg

SEQ ID NO: 1587389 - RNA, 16 nt, Human adenovirus F
cgcugaccagcagcag

SEQ ID NO: 1587390 - RNA, 16 nt, Human adenovirus F
gaugguggcaaggaga

SEQ ID NO: 1587391 - RNA, 22 nt, Human adenovirus F
caauaagcagcuugaagaacug

SEQ ID NO: 1587392 - RNA, 13 nt, Human adenovirus F
uggaggagcuguc

SEQ ID NO: 1587393 - RNA, 17 nt, Human adenovirus F
gacggcgguggcggacg

SEQ ID NO: 1587394 - RNA, 23 nt, Human adenovirus F
agcgccgcuugcaagauggccac

SEQ ID NO: 1587395 - RNA, 13 nt, Human adenovirus F
cgcugggagaaaa

SEQ ID NO: 1587396 - RNA, 18 nt, Human adenovirus F
uaaucucccuccccccuu

SEQ ID NO: 1587397 - RNA, 18 nt, Human adenovirus F
cuggcuuccggcauuaac

SEQ ID NO: 1587398 - RNA, 13 nt, Human adenovirus F
gagcugggacagc

SEQ ID NO: 1587399 - RNA, 23 nt, Human adenovirus F
uccggguugggcgcuugccaggg

SEQ ID NO: 1587400 - RNA, 10 nt, Human adenovirus F
cccuaccacc

SEQ ID NO: 1587401 - RNA, 22 nt, Human adenovirus F
caucugcagcauugccacuuuu

SEQ ID NO: 1587402 - RNA, 14 nt, Human adenovirus F
gcggcggccaugga

SEQ ID NO: 1587403 - RNA, 18 nt, Human adenovirus F
guugaggguuucggcagc

SEQ ID NO: 1587404 - RNA, 15 nt, Human adenovirus F
caccauuguacgaga

SEQ ID NO: 1587405 - RNA, 15 nt, Human adenovirus F
gccgccgcucaaggc

SEQ ID NO: 1587406 - RNA, 21 nt, Human adenovirus F
gccuuuugcaucucaaagcug

SEQ ID NO: 1587407 - RNA, 18 nt, Human adenovirus F
accucugcaccccucauc

SEQ ID NO: 1587408 - RNA, 18 nt, Human adenovirus F
ccucagacgacugggcgg

SEQ ID NO: 1587409 - RNA, 21 nt, Human adenovirus F
ugagcggaguaacacaaacau

SEQ ID NO: 1587410 - RNA, 22 nt, Human adenovirus F
uauuaccgucaucucuacagcc

SEQ ID NO: 1587411 - RNA, 15 nt, Human adenovirus F
ucaaaugcuccggga

SEQ ID NO: 1587412 - RNA, 16 nt, Human adenovirus F
cucuguggagaaccuu

SEQ ID NO: 1587413 - RNA, 18 nt, Human adenovirus F
accgcuguauuuugcuac

SEQ ID NO: 1587414 - RNA, 21 nt, Human adenovirus F
gucuuauccuccuucacaaag

SEQ ID NO: 1587415 - RNA, 19 nt, Human adenovirus F
caccgccaagagcgccgcu

SEQ ID NO: 1587416 - RNA, 21 nt, Human adenovirus F
cagcgcccgccucccaaaguc

SEQ ID NO: 1587417 - RNA, 23 nt, Human adenovirus F
uuagaaguaaccaacggaggaaa

SEQ ID NO: 1587418 - RNA, 18 nt, Human adenovirus F
ucaaaaaggcacuuuacu

SEQ ID NO: 1587419 - RNA, 19 nt, Human adenovirus F
guaguuuugcuccagggua

SEQ ID NO: 1587420 - RNA, 20 nt, Human adenovirus F
gaugaugucgugucugcgua

SEQ ID NO: 1587421 - RNA, 15 nt, Human adenovirus F
uucuucacugcaccu

SEQ ID NO: 1587422 - RNA, 21 nt, Human adenovirus F
aucccaaguggcccuuaaugc

SEQ ID NO: 1587423 - RNA, 23 nt, Human adenovirus F
caaccagcgcucuacaauauaau

SEQ ID NO: 1587424 - RNA, 16 nt, Human adenovirus F
ggcaggagcccgaaga

SEQ ID NO: 1587425 - RNA, 17 nt, Human adenovirus F
augagguuuacgcugac

SEQ ID NO: 1587426 - RNA, 22 nt, Human adenovirus F
gcguagcaccccaauguaaguu

SEQ ID NO: 1587427 - RNA, 16 nt, Human adenovirus F
cggcuggggcagaacg

SEQ ID NO: 1587428 - RNA, 22 nt, Human adenovirus F
aaaccgccgacccaggcaacau

SEQ ID NO: 1587429 - RNA, 15 nt, Human adenovirus F
ggccaugcgccgagc

SEQ ID NO: 1587430 - RNA, 14 nt, Human adenovirus F
gagccgccaggugg

SEQ ID NO: 1587431 - RNA, 17 nt, Human adenovirus F
auccucagugucuugcc

SEQ ID NO: 1587432 - RNA, 16 nt, Human adenovirus F
guguaccgcaacgacc

SEQ ID NO: 1587433 - RNA, 23 nt, Human adenovirus F
gguggauaccgcugcagcugcug

SEQ ID NO: 1587434 - RNA, 21 nt, Human adenovirus F
cuggaagauguccuuaaggag

SEQ ID NO: 1587435 - RNA, 20 nt, Human adenovirus F
cucuagcggcgacggacugc

SEQ ID NO: 1587436 - RNA, 14 nt, Human adenovirus F
ggagcagcgggaag

SEQ ID NO: 1587437 - RNA, 20 nt, Human adenovirus F
uaauggagcuauuacuuuag

SEQ ID NO: 1587438 - RNA, 15 nt, Human adenovirus F
agugcuggccgggca

SEQ ID NO: 1587439 - RNA, 17 nt, Human adenovirus F
acgugugugugagggca

SEQ ID NO: 1587440 - RNA, 14 nt, Human adenovirus F
gaacaauaaaauau

SEQ ID NO: 1587441 - RNA, 17 nt, Human adenovirus F
gaagaggguacuagcag

SEQ ID NO: 1587442 - RNA, 15 nt, Human adenovirus F
cgaacuuucucucuu

SEQ ID NO: 1587443 - RNA, 14 nt, Human adenovirus F
uaacuuuugccaca

SEQ ID NO: 1587444 - RNA, 14 nt, Human adenovirus F
gccuucaggcagca

SEQ ID NO: 1587445 - RNA, 13 nt, Human adenovirus F
ccuacucuuacaa

SEQ ID NO: 1587446 - RNA, 13 nt, Human adenovirus F
aaguuauacagug

SEQ ID NO: 1587447 - RNA, 16 nt, Human adenovirus F
augguggcaaggagag

SEQ ID NO: 1587448 - RNA, 12 nt, Human adenovirus F
uuuaaacuuuuu

SEQ ID NO: 1587449 - RNA, 19 nt, Human adenovirus F
cacgguauagccggugcac

SEQ ID NO: 1587450 - RNA, 14 nt, Human adenovirus F
aaaacuugcaagga

SEQ ID NO: 1587451 - RNA, 22 nt, Human adenovirus F
cgucaacuccucuugcaggagc

SEQ ID NO: 1587452 - RNA, 15 nt, Human adenovirus F
gacagcaaggaaaga

SEQ ID NO: 1587453 - RNA, 17 nt, Human adenovirus F
ccggcuucggugacaaa

SEQ ID NO: 1587454 - RNA, 20 nt, Human adenovirus F
gaggcagcuucucgaggcca

SEQ ID NO: 1587455 - RNA, 13 nt, Human adenovirus F
agauuugacgaaa

SEQ ID NO: 1587456 - RNA, 17 nt, Human adenovirus F
cuuccucccccgagaga

SEQ ID NO: 1587457 - RNA, 18 nt, Human adenovirus F
acuccuuuggacaagcuc

SEQ ID NO: 1587458 - RNA, 22 nt, Human adenovirus F
uagcccuguacuugccugacuc

SEQ ID NO: 1587459 - RNA, 20 nt, Human adenovirus F
aauauuuauacacucccuuu

SEQ ID NO: 1587460 - RNA, 11 nt, Human adenovirus F
gagcuggccug

SEQ ID NO: 1587461 - RNA, 22 nt, Human adenovirus F
caguguauccccgaaacaaaac

SEQ ID NO: 1587462 - RNA, 19 nt, Human adenovirus F
cuuuugcaccagggcggcg

SEQ ID NO: 1587463 - RNA, 17 nt, Human adenovirus F
cgcuaucaggaagcagc

SEQ ID NO: 1587464 - RNA, 22 nt, Human adenovirus F
gccagacuacuuuuuccaaacu

SEQ ID NO: 1587465 - RNA, 13 nt, Human adenovirus F
aguccacaaaaac

SEQ ID NO: 1587466 - RNA, 17 nt, Human adenovirus F
agauuuuggacuguaca

SEQ ID NO: 1587467 - RNA, 18 nt, Human adenovirus F
aacagcauugugggucug

SEQ ID NO: 1587468 - RNA, 16 nt, Human adenovirus F
aaaaugccaggcagca

SEQ ID NO: 1587469 - RNA, 19 nt, Human adenovirus F
ugucuucccgccuugcuga

SEQ ID NO: 1587470 - RNA, 20 nt, Human adenovirus F
gucgcuggcuuuuggaccug

SEQ ID NO: 1587471 - RNA, 18 nt, Human adenovirus F
cgcgugcuuagacccggc

SEQ ID NO: 1587472 - RNA, 17 nt, Human adenovirus F
uaagcagcuugaagaac

SEQ ID NO: 1587473 - RNA, 24 nt, Human adenovirus F
gccagccaaugggcuccagcgagc

SEQ ID NO: 1587474 - RNA, 15 nt, Human adenovirus F
gcaccugcacgcucu

SEQ ID NO: 1587475 - RNA, 17 nt, Human adenovirus F
acuaucccgccccugcc

SEQ ID NO: 1587476 - RNA, 13 nt, Human adenovirus F
ccaacuauuuggg

SEQ ID NO: 1587477 - RNA, 15 nt, Human adenovirus F
cgagaucggcaccag

SEQ ID NO: 1587478 - RNA, 13 nt, Human adenovirus F
cagaauguaacuc

SEQ ID NO: 1587479 - RNA, 16 nt, Human adenovirus F
ccggaucuggaggaaa

SEQ ID NO: 1587480 - RNA, 14 nt, Human adenovirus F
caaauaauuuuccg

SEQ ID NO: 1587481 - RNA, 22 nt, Human adenovirus F
cagcgcgcuucgccuccuggug

SEQ ID NO: 1587482 - RNA, 19 nt, Human adenovirus F
cgggaagagaggcagcccc

SEQ ID NO: 1587483 - RNA, 17 nt, Human adenovirus F
gccuuguaugggcagca

SEQ ID NO: 1587484 - RNA, 17 nt, Human adenovirus F
ggaguuggaggagaugg

SEQ ID NO: 1587485 - RNA, 20 nt, Human adenovirus F
aaagcagugggacgaggagg

SEQ ID NO: 1587486 - RNA, 13 nt, Human adenovirus F
gagcuaaggagga

SEQ ID NO: 1587487 - RNA, 19 nt, Human adenovirus F
acgugagagaggcgguggc

SEQ ID NO: 1587488 - RNA, 14 nt, Human adenovirus F
caaacauagcaaaa

SEQ ID NO: 1587489 - RNA, 14 nt, Human adenovirus F
caggucaaaugcuc

SEQ ID NO: 1587490 - RNA, 19 nt, Human adenovirus F
guagccgaugcccaacgcu

SEQ ID NO: 1587491 - RNA, 14 nt, Human adenovirus F
cgacaccacccggg

SEQ ID NO: 1587492 - RNA, 15 nt, Human adenovirus F
agcugguaagcagcc

SEQ ID NO: 1587493 - RNA, 20 nt, Human adenovirus F
ugccaccgcaaaaaaaucaa

SEQ ID NO: 1587494 - RNA, 20 nt, Human adenovirus F
uagggcguagaguuugggag

SEQ ID NO: 1587495 - RNA, 15 nt, Human adenovirus F
agccgugaagccaaa

SEQ ID NO: 1587496 - RNA, 16 nt, Human adenovirus F
cgacgcuuggcaccgc

SEQ ID NO: 1587497 - RNA, 18 nt, Human adenovirus F
augguaaaaaugccaggc

SEQ ID NO: 1587498 - RNA, 16 nt, Human adenovirus F
uccuaacgccacuuuu

SEQ ID NO: 1587499 - RNA, 18 nt, Human adenovirus F
gccaggguucucuucagg

SEQ ID NO: 1587500 - RNA, 18 nt, Human adenovirus F
cucacccgcagcugcuug

SEQ ID NO: 1587501 - RNA, 19 nt, Human adenovirus F
gggucuauuuggaccccca

SEQ ID NO: 1587502 - RNA, 23 nt, Human adenovirus F
ccaucaugagucuguuugguggg

SEQ ID NO: 1587503 - RNA, 16 nt, Human adenovirus F
ggugcaguggcgggga

SEQ ID NO: 1587504 - RNA, 12 nt, Human adenovirus F
cgauuuuguccc

SEQ ID NO: 1587505 - RNA, 18 nt, Human adenovirus F
ccgccguuucucgcccca

SEQ ID NO: 1587506 - RNA, 17 nt, Human adenovirus F
cccacuguuucuccucc

SEQ ID NO: 1587507 - RNA, 14 nt, Human adenovirus F
ugcagcgguaucug

SEQ ID NO: 1587508 - RNA, 20 nt, Human adenovirus F
aggagcagauggagagcugg

SEQ ID NO: 1587509 - RNA, 17 nt, Human adenovirus F
aagccucucgcucugca

SEQ ID NO: 1587510 - RNA, 14 nt, Human adenovirus F
gauuuggaagauga

SEQ ID NO: 1587511 - RNA, 19 nt, Human adenovirus F
agaaguggaggaaaaacua

SEQ ID NO: 1587512 - RNA, 22 nt, Human adenovirus F
ugggaaggggccagcaagcugc

SEQ ID NO: 1587513 - RNA, 16 nt, Human adenovirus F
cgugcgcacccuggug

SEQ ID NO: 1587514 - RNA, 16 nt, Human adenovirus F
aucuugguccagguuu

SEQ ID NO: 1587515 - RNA, 18 nt, Human adenovirus F
ccaaagguacacaccaaa

SEQ ID NO: 1587516 - RNA, 14 nt, Human adenovirus F
aaauuaauugcacu

SEQ ID NO: 1587517 - RNA, 15 nt, Human adenovirus F
acagcuccucagccc

SEQ ID NO: 1587518 - RNA, 23 nt, Human adenovirus F
ucagaaaccccaccguggcuccc

SEQ ID NO: 1587519 - RNA, 16 nt, Human adenovirus F
ggaccacuggagggcg

SEQ ID NO: 1587520 - RNA, 21 nt, Human adenovirus F
cuuccaagcgguccauugccu

SEQ ID NO: 1587521 - RNA, 12 nt, Human adenovirus F
ucugacaaacac

SEQ ID NO: 1587522 - RNA, 15 nt, Human adenovirus F
gcagcgggcaggagc

SEQ ID NO: 1587523 - RNA, 14 nt, Human adenovirus F
cuggcuggcccugg

SEQ ID NO: 1587524 - RNA, 15 nt, Human adenovirus F
caucugcggccucag

SEQ ID NO: 1587525 - RNA, 16 nt, Human adenovirus F
gacccauuuccaagca

SEQ ID NO: 1587526 - RNA, 13 nt, Human adenovirus F
ccccuaccagccg

SEQ ID NO: 1587527 - RNA, 23 nt, Human adenovirus F
cggcucuggacaugacggcacgu

SEQ ID NO: 1587528 - RNA, 16 nt, Human adenovirus F
guggaggguuaauaag

SEQ ID NO: 1587529 - RNA, 19 nt, Human adenovirus F
aguccuggccaacugccac

SEQ ID NO: 1587530 - RNA, 14 nt, Human adenovirus F
acuaaugcacagcc

SEQ ID NO: 1587531 - RNA, 21 nt, Human adenovirus F
cgaaaaaggaggucaagccaa

SEQ ID NO: 1587532 - RNA, 17 nt, Human adenovirus F
ccugcaauggcagccca

SEQ ID NO: 1587533 - RNA, 14 nt, Human adenovirus F
cuaaagggaacugc

SEQ ID NO: 1587534 - RNA, 16 nt, Human adenovirus F
ucuauggcccugccgc

SEQ ID NO: 1587535 - RNA, 11 nt, Human adenovirus F
aagggcaaagg

SEQ ID NO: 1587536 - RNA, 13 nt, Human adenovirus F
caauagcagcacc

SEQ ID NO: 1587537 - RNA, 22 nt, Human adenovirus F
auuucuuguaaacuggcgccau

SEQ ID NO: 1587538 - RNA, 22 nt, Human adenovirus F
acacaaacauagcaaaagcauu

SEQ ID NO: 1587539 - RNA, 13 nt, Human adenovirus F
cgccuccuggugg

SEQ ID NO: 1587540 - RNA, 14 nt, Human adenovirus F
accgccaaaaaagc

SEQ ID NO: 1587541 - RNA, 19 nt, Human adenovirus F
agcugcuaaccugugcaga

SEQ ID NO: 1587542 - RNA, 17 nt, Human adenovirus F
cucuuaccuacacuuuu

SEQ ID NO: 1587543 - RNA, 19 nt, Human adenovirus F
uaaggacgguggcaugagg

SEQ ID NO: 1587544 - RNA, 18 nt, Human adenovirus F
cgaagccuucaggcagca

SEQ ID NO: 1587545 - RNA, 13 nt, Human adenovirus F
gccuccugguggc

SEQ ID NO: 1587546 - RNA, 21 nt, Human adenovirus F
ggauuugccgcagccaguggg

SEQ ID NO: 1587547 - RNA, 16 nt, Human adenovirus F
acuuggaagggaaggc

SEQ ID NO: 1587548 - RNA, 23 nt, Human adenovirus F
gaauuuguuauacaaguauacau

SEQ ID NO: 1587549 - RNA, 20 nt, Human adenovirus F
cgcugcgcuucgugcccguc

SEQ ID NO: 1587550 - RNA, 22 nt, Human adenovirus F
ugcuacacaacaaaucaucucu

SEQ ID NO: 1587551 - RNA, 17 nt, Human adenovirus F
caugcccgagccggaga

SEQ ID NO: 1587552 - RNA, 12 nt, Human adenovirus F
cuacauaacuga

SEQ ID NO: 1587553 - RNA, 12 nt, Human adenovirus F
gggcggaccugc

SEQ ID NO: 1587554 - RNA, 17 nt, Human adenovirus F
uggcccaccacucugau

SEQ ID NO: 1587555 - RNA, 16 nt, Human adenovirus F
cacggguucucgccuc

SEQ ID NO: 1587556 - RNA, 20 nt, Human adenovirus F
caccagccgcaccgcggcgu

SEQ ID NO: 1587557 - RNA, 17 nt, Human adenovirus F
caggagacggguaaggg

SEQ ID NO: 1587558 - RNA, 18 nt, Human adenovirus F
agaugcguccgacggcgc

SEQ ID NO: 1587559 - RNA, 14 nt, Human adenovirus F
acacucccuuugcc

SEQ ID NO: 1587560 - RNA, 19 nt, Human adenovirus F
ggaggcgauuugggaggga

SEQ ID NO: 1587561 - RNA, 20 nt, Human adenovirus F
aaacuccuuuggacaagcuc

SEQ ID NO: 1587562 - RNA, 14 nt, Human adenovirus F
acggcgugcuggaa

SEQ ID NO: 1587563 - RNA, 16 nt, Human adenovirus F
cucugcagcagcgccc

SEQ ID NO: 1587564 - RNA, 21 nt, Human adenovirus F
auuacuccagucgcaugaauu

SEQ ID NO: 1587565 - RNA, 18 nt, Human adenovirus F
agucuguuuggugggcug

SEQ ID NO: 1587566 - RNA, 20 nt, Human adenovirus F
ucaagggauugacgcagcaa

SEQ ID NO: 1587567 - RNA, 12 nt, Human adenovirus F
ugcucugcaaaa

SEQ ID NO: 1587568 - RNA, 18 nt, Human adenovirus F
ugugcaauguucaguucu

SEQ ID NO: 1587569 - RNA, 15 nt, Human adenovirus F
caccacguaaaaggu

SEQ ID NO: 1587570 - RNA, 15 nt, Human adenovirus F
cggagccggcggugg

SEQ ID NO: 1587571 - RNA, 18 nt, Human adenovirus F
ccagaguaacuuuugcca

SEQ ID NO: 1587572 - RNA, 20 nt, Human adenovirus F
caggccaaccuagaccgacu

SEQ ID NO: 1587573 - RNA, 16 nt, Human adenovirus F
caggagcccgaagaga

SEQ ID NO: 1587574 - RNA, 21 nt, Human adenovirus F
ucaggugaugcuacacaacaa

SEQ ID NO: 1587575 - RNA, 14 nt, Human adenovirus F
uccuggcgagccca

SEQ ID NO: 1587576 - RNA, 16 nt, Human adenovirus F
aaagagcguguuccca

SEQ ID NO: 1587577 - RNA, 17 nt, Human adenovirus F
uuaucccaugaccaaac

SEQ ID NO: 1587578 - RNA, 14 nt, Human adenovirus F
uggcucagccccgc

SEQ ID NO: 1587579 - RNA, 16 nt, Human adenovirus F
gcaccuacuuugacau

SEQ ID NO: 1587580 - RNA, 17 nt, Human adenovirus F
gacaagguggcggccau

SEQ ID NO: 1587581 - RNA, 20 nt, Human adenovirus F
gcagccugagcugccagagg

SEQ ID NO: 1587582 - RNA, 19 nt, Human adenovirus F
gcaaagggggggcauuaau

SEQ ID NO: 1587583 - RNA, 23 nt, Human adenovirus F
agauggaaaacgagggggaggac

SEQ ID NO: 1587584 - RNA, 13 nt, Human adenovirus F
gcugacagcuggg

SEQ ID NO: 1587585 - RNA, 11 nt, Human adenovirus F
gccucccuuug

SEQ ID NO: 1587586 - RNA, 12 nt, Human adenovirus F
ccucgcuccggc

SEQ ID NO: 1587587 - RNA, 14 nt, Human adenovirus F
caagcuucucagcu

SEQ ID NO: 1587588 - RNA, 13 nt, Human adenovirus F
cuguggagaaccu

SEQ ID NO: 1587589 - RNA, 15 nt, Human adenovirus F
ucuugagcaggccgc

SEQ ID NO: 1587590 - RNA, 24 nt, Human adenovirus F
cgggaagcaaccgcacaugccagc

SEQ ID NO: 1587591 - RNA, 18 nt, Human adenovirus F
ggagcucgucguggcaug

SEQ ID NO: 1587592 - RNA, 16 nt, Human adenovirus F
gcgggcucugauaaug

SEQ ID NO: 1587593 - RNA, 11 nt, Human adenovirus F
cugaagaggaa

SEQ ID NO: 1587594 - RNA, 21 nt, Human adenovirus F
ucgggcccgucgucaggccgc

SEQ ID NO: 1587595 - RNA, 20 nt, Human adenovirus F
cggcauuaacggcguggugg

SEQ ID NO: 1587596 - RNA, 17 nt, Human adenovirus F
cuaucuagauaauaacu

SEQ ID NO: 1587597 - RNA, 13 nt, Human adenovirus F
caaggccuggaac

SEQ ID NO: 1587598 - RNA, 14 nt, Human adenovirus F
uaacagcuccucag

SEQ ID NO: 1587599 - RNA, 17 nt, Human adenovirus F
gugcauuggcacaggaa

SEQ ID NO: 1587600 - RNA, 11 nt, Human adenovirus F
gccagugcagg

SEQ ID NO: 1587601 - RNA, 17 nt, Human adenovirus F
uuacgcggggcaggagc

SEQ ID NO: 1587602 - RNA, 20 nt, Human adenovirus F
uagaguaaaaaaaagggaag

SEQ ID NO: 1587603 - RNA, 16 nt, Human adenovirus F
gucuccagaccccaug

SEQ ID NO: 1587604 - RNA, 16 nt, Human adenovirus F
ggcauguacggcggcg

SEQ ID NO: 1587605 - RNA, 18 nt, Human adenovirus F
uggcaucucgauccaaca

SEQ ID NO: 1587606 - RNA, 12 nt, Human adenovirus F
ugauuuggaaga

SEQ ID NO: 1587607 - RNA, 17 nt, Human adenovirus F
cgguuuggauccagugc

SEQ ID NO: 1587608 - RNA, 15 nt, Human adenovirus F
ucugaucucuuacau

SEQ ID NO: 1587609 - RNA, 19 nt, Human adenovirus F
acguucgucguuuccccaa

SEQ ID NO: 1587610 - RNA, 14 nt, Human adenovirus F
ggcccugccgcgga

SEQ ID NO: 1587611 - RNA, 12 nt, Human adenovirus F
ucauccgccucc

SEQ ID NO: 1587612 - RNA, 14 nt, Human adenovirus F
gcagugggacgagg

SEQ ID NO: 1587613 - RNA, 17 nt, Human adenovirus F
ggcucagccccgccggg

SEQ ID NO: 1587614 - RNA, 21 nt, Human adenovirus F
acuguuaauauacguaaaugu

SEQ ID NO: 1587615 - RNA, 19 nt, Human adenovirus F
caccaggucguaaugagga

SEQ ID NO: 1587616 - RNA, 21 nt, Human adenovirus F
ccggugcuauuaaaauggaac

SEQ ID NO: 1587617 - RNA, 16 nt, Human adenovirus F
gugccguucgcagaaa

SEQ ID NO: 1587618 - RNA, 22 nt, Human adenovirus F
cagucggugggcguccagugga

SEQ ID NO: 1587619 - RNA, 15 nt, Human adenovirus F
gcgccucaauuuuua

SEQ ID NO: 1587620 - RNA, 20 nt, Human adenovirus F
ugaugaagcgugguaaaagg

SEQ ID NO: 1587621 - RNA, 15 nt, Human adenovirus F
uaggaccacuggagg

SEQ ID NO: 1587622 - RNA, 12 nt, Human adenovirus F
agcaaacagugc

SEQ ID NO: 1587623 - RNA, 19 nt, Human adenovirus F
gccuugcaaaaccaaauca

SEQ ID NO: 1587624 - RNA, 23 nt, Human adenovirus F
gggcguagaguuugggagccagg

SEQ ID NO: 1587625 - RNA, 13 nt, Human adenovirus F
gugccucuguccu

SEQ ID NO: 1587626 - RNA, 21 nt, Human adenovirus F
accugcacgcucuugcugugg

SEQ ID NO: 1587627 - RNA, 21 nt, Human adenovirus F
gcugucucaccuacuaccacu

SEQ ID NO: 1587628 - RNA, 14 nt, Human adenovirus F
uuaaccuuaaaauu

SEQ ID NO: 1587629 - RNA, 15 nt, Human adenovirus F
gccggcgggaagagg

SEQ ID NO: 1587630 - RNA, 19 nt, Human adenovirus F
gauaacgguuguuuuccac

SEQ ID NO: 1587631 - RNA, 13 nt, Human adenovirus F
ccugaaauacacu

SEQ ID NO: 1587632 - RNA, 23 nt, Human adenovirus F
ccaaacggcguucuagccaacac

SEQ ID NO: 1587633 - RNA, 22 nt, Human adenovirus F
ugguccugacuauuuuaugcag

SEQ ID NO: 1587634 - RNA, 19 nt, Human adenovirus F
cagcuacaagauuccacca

SEQ ID NO: 1587635 - RNA, 15 nt, Human adenovirus F
accccgacagaggcc

SEQ ID NO: 1587636 - RNA, 14 nt, Human adenovirus F
cgcacgcuggagga

SEQ ID NO: 1587637 - RNA, 17 nt, Human adenovirus F
caaaguccuggccaacu

SEQ ID NO: 1587638 - RNA, 12 nt, Human adenovirus F
gugucugccaga

SEQ ID NO: 1587639 - RNA, 16 nt, Human adenovirus F
gugcagauggaaacug

SEQ ID NO: 1587640 - RNA, 12 nt, Human adenovirus F
cugacuuccugg

SEQ ID NO: 1587641 - RNA, 19 nt, Human adenovirus F
gggcccugaccgaccuggg

SEQ ID NO: 1587642 - RNA, 16 nt, Human adenovirus F
aggcucuucuuccucg

SEQ ID NO: 1587643 - RNA, 17 nt, Human adenovirus F
caggaagcagcucaggu

SEQ ID NO: 1587644 - RNA, 13 nt, Human adenovirus F
cgugaccgagcag

SEQ ID NO: 1587645 - RNA, 23 nt, Human adenovirus F
ggcagcccagcgcccgggcccug

SEQ ID NO: 1587646 - RNA, 23 nt, Human adenovirus F
cgggcccgucgucaggccgcccg

SEQ ID NO: 1587647 - RNA, 22 nt, Human adenovirus F
gaugcaugcgaggggaaaucag

SEQ ID NO: 1587648 - RNA, 21 nt, Human adenovirus F
ucagagcucuucaucccagcc

SEQ ID NO: 1587649 - RNA, 19 nt, Human adenovirus F
accguaccugcuaccucuu

SEQ ID NO: 1587650 - RNA, 19 nt, Human adenovirus F
agcucaacgcaguggugga

SEQ ID NO: 1587651 - RNA, 13 nt, Human adenovirus F
cugccaguugggg

SEQ ID NO: 1587652 - RNA, 17 nt, Human adenovirus F
auaaaggggaccagcug

SEQ ID NO: 1587653 - RNA, 16 nt, Human adenovirus F
gcucgcgcacagcuuc

SEQ ID NO: 1587654 - RNA, 16 nt, Human adenovirus F
caugccuuucucccag

SEQ ID NO: 1587655 - RNA, 16 nt, Human adenovirus F
ccauuuggucuaucuc

SEQ ID NO: 1587656 - RNA, 17 nt, Human adenovirus F
acgcccaugcagccaug

SEQ ID NO: 1587657 - RNA, 23 nt, Human adenovirus F
agcugucuuaccaguuaaugcuu

SEQ ID NO: 1587658 - RNA, 23 nt, Human adenovirus F
gauuugccggcaacgcugcaggc

SEQ ID NO: 1587659 - RNA, 11 nt, Human adenovirus F
cuuucuuacac

SEQ ID NO: 1587660 - RNA, 19 nt, Human adenovirus F
cagaggccgguacccagac

SEQ ID NO: 1587661 - RNA, 21 nt, Human adenovirus F
cuagugaaacaugaggaggaa

SEQ ID NO: 1587662 - RNA, 16 nt, Human adenovirus F
cgggucgcagcaggug

SEQ ID NO: 1587663 - RNA, 18 nt, Human adenovirus F
ccaugcgccgagcggcug

SEQ ID NO: 1587664 - RNA, 13 nt, Human adenovirus F
acucuugcuggac

SEQ ID NO: 1587665 - RNA, 19 nt, Human adenovirus F
ugccacccaagggaaacaa

SEQ ID NO: 1587666 - RNA, 16 nt, Human adenovirus F
ccaccacgggaguugc

SEQ ID NO: 1587667 - RNA, 13 nt, Human adenovirus F
gcucgcuggcuag

SEQ ID NO: 1587668 - RNA, 16 nt, Human adenovirus F
cagcaggccgcuccca

SEQ ID NO: 1587669 - RNA, 19 nt, Human adenovirus F
acccagguuuaauacagug

SEQ ID NO: 1587670 - RNA, 14 nt, Human adenovirus F
cuacgcccaggagc

SEQ ID NO: 1587671 - RNA, 23 nt, Human adenovirus F
uaagcgggggaaauuuaaaccug

SEQ ID NO: 1587672 - RNA, 20 nt, Human adenovirus F
gugcggcuuuucgcagagac

SEQ ID NO: 1587673 - RNA, 16 nt, Human adenovirus F
guggccaacgccaggc

SEQ ID NO: 1587674 - RNA, 17 nt, Human adenovirus F
gcaugcccgagccggag

SEQ ID NO: 1587675 - RNA, 14 nt, Human adenovirus F
ccuccaccaccuuc

SEQ ID NO: 1587676 - RNA, 19 nt, Human adenovirus F
gcagguaggaccacuggag

SEQ ID NO: 1587677 - RNA, 11 nt, Human adenovirus F
gauggcagcag

SEQ ID NO: 1587678 - RNA, 17 nt, Human adenovirus F
gccagcauggcucagcc

SEQ ID NO: 1587679 - RNA, 15 nt, Human adenovirus F
uucucaccuggcaaa

SEQ ID NO: 1587680 - RNA, 20 nt, Human adenovirus F
acgagaucggcaccagccag

SEQ ID NO: 1587681 - RNA, 14 nt, Human adenovirus F
aggguuucggcagc

SEQ ID NO: 1587682 - RNA, 22 nt, Human adenovirus F
aaucagaugcauuuuggccuga

SEQ ID NO: 1587683 - RNA, 18 nt, Human adenovirus F
gugcgcgaacugggcugc

SEQ ID NO: 1587684 - RNA, 20 nt, Human adenovirus F
ccacaaaugucuuguggcug

SEQ ID NO: 1587685 - RNA, 16 nt, Human adenovirus F
aguuuuaauggaaacu

SEQ ID NO: 1587686 - RNA, 16 nt, Human adenovirus F
ccggagccggcggugg

SEQ ID NO: 1587687 - RNA, 16 nt, Human adenovirus F
ccuguucuaaaaccaa

SEQ ID NO: 1587688 - RNA, 13 nt, Human adenovirus F
cgccuccaccacc

SEQ ID NO: 1587689 - RNA, 19 nt, Human adenovirus F
caccaauaugcccaacauc

SEQ ID NO: 1587690 - RNA, 15 nt, Human adenovirus F
uaacucucccuuucc

SEQ ID NO: 1587691 - RNA, 17 nt, Human adenovirus F
ggcgccggcgggaagag

SEQ ID NO: 1587692 - RNA, 15 nt, Human adenovirus F
acacuuuuuugcaag

SEQ ID NO: 1587693 - RNA, 17 nt, Human adenovirus F
cgguggucuccagaccc

SEQ ID NO: 1587694 - RNA, 21 nt, Human adenovirus F
aguugcaagauaugucugcca

SEQ ID NO: 1587695 - RNA, 12 nt, Human adenovirus F
accucugcgcug

SEQ ID NO: 1587696 - RNA, 20 nt, Human adenovirus F
augcgucgggcgugcgggug

SEQ ID NO: 1587697 - RNA, 11 nt, Human adenovirus F
ugaccuguggg

SEQ ID NO: 1587698 - RNA, 22 nt, Human adenovirus F
uagaaaacgaaaacuuaacccu

SEQ ID NO: 1587699 - RNA, 13 nt, Human adenovirus F
aagcugccccguc

SEQ ID NO: 1587700 - RNA, 18 nt, Human adenovirus F
cucaaacacugcgcaaag

SEQ ID NO: 1587701 - RNA, 23 nt, Human adenovirus F
gugcggauuugggaacuguccag

SEQ ID NO: 1587702 - RNA, 16 nt, Human adenovirus F
aacgcccgcuagcucu

SEQ ID NO: 1587703 - RNA, 16 nt, Human adenovirus F
cugauaauguguguuu

SEQ ID NO: 1587704 - RNA, 18 nt, Human adenovirus F
ccggagaggggaggaagu

SEQ ID NO: 1587705 - RNA, 18 nt, Human adenovirus F
ggcggcccugcaaagcca

SEQ ID NO: 1587706 - RNA, 22 nt, Human adenovirus F
aacacggagcugucuuaccagu

SEQ ID NO: 1587707 - RNA, 11 nt, Human adenovirus F
aacacaggcgu

SEQ ID NO: 1587708 - RNA, 16 nt, Human adenovirus F
uuacauuguucgcugc

SEQ ID NO: 1587709 - RNA, 23 nt, Human adenovirus F
acgacuucaaccccgucuacccc

SEQ ID NO: 1587710 - RNA, 21 nt, Human adenovirus F
cagguguacuggucccuuccc

SEQ ID NO: 1587711 - RNA, 18 nt, Human adenovirus F
gcugaugcauuuguggga

SEQ ID NO: 1587712 - RNA, 21 nt, Human adenovirus F
gcagcguguccuuuggcgcga

SEQ ID NO: 1587713 - RNA, 21 nt, Human adenovirus F
cuagggugugaaggcaaaggu

SEQ ID NO: 1587714 - RNA, 20 nt, Human adenovirus F
gcaugccuccagcacugccg

SEQ ID NO: 1587715 - RNA, 16 nt, Human adenovirus F
auccagcaacucugaa

SEQ ID NO: 1587716 - RNA, 22 nt, Human adenovirus F
cagcucgcaaacaauaaaagaa

SEQ ID NO: 1587717 - RNA, 14 nt, Human adenovirus F
cuuaccagagccau

SEQ ID NO: 1587718 - RNA, 17 nt, Human adenovirus F
aaaggcgaaaagcggcc

SEQ ID NO: 1587719 - RNA, 14 nt, Human adenovirus F
gaucagccaggugg

SEQ ID NO: 1587720 - RNA, 12 nt, Human adenovirus F
ucuucuccuggc

SEQ ID NO: 1587721 - RNA, 19 nt, Human adenovirus F
aaguguuuauuuauuucuu

SEQ ID NO: 1587722 - RNA, 15 nt, Human adenovirus F
ccgccccugccaccg

SEQ ID NO: 1587723 - RNA, 18 nt, Human adenovirus F
agcccagcgcccgggccc

SEQ ID NO: 1587724 - RNA, 16 nt, Human adenovirus F
ccaguccgggccagac

SEQ ID NO: 1587725 - RNA, 22 nt, Human adenovirus F
ucuuaacucugaagaugucuga

SEQ ID NO: 1587726 - RNA, 22 nt, Human adenovirus F
ccagcgcccgggcccuggaggc

SEQ ID NO: 1587727 - RNA, 16 nt, Human adenovirus F
cucaugagcugggaga

SEQ ID NO: 1587728 - RNA, 23 nt, Human adenovirus F
gggcauuaaugggcaaaggggga

SEQ ID NO: 1587729 - RNA, 16 nt, Human adenovirus F
gggcaggaggacuaug

SEQ ID NO: 1587730 - RNA, 23 nt, Human adenovirus F
auccuucagagcauugugguaca

SEQ ID NO: 1587731 - RNA, 23 nt, Human adenovirus F
cgcugccguuuuuucagauggcu

SEQ ID NO: 1587732 - RNA, 15 nt, Human adenovirus F
ccuacggcaagcgcg

SEQ ID NO: 1587733 - RNA, 17 nt, Human adenovirus F
ggcgguacuaaggcggg

SEQ ID NO: 1587734 - RNA, 16 nt, Human adenovirus F
cuauguuaggcuuuau

SEQ ID NO: 1587735 - RNA, 16 nt, Human adenovirus F
guccgacggcgccucc

SEQ ID NO: 1587736 - RNA, 23 nt, Human adenovirus F
gaucgccaacagccccagcuggu

SEQ ID NO: 1587737 - RNA, 15 nt, Human adenovirus F
acugcggacuaccua

SEQ ID NO: 1587738 - RNA, 21 nt, Human adenovirus F
agauuuuucuucuccuggccg

SEQ ID NO: 1587739 - RNA, 18 nt, Human adenovirus F
ccagcugguaagcagccu

SEQ ID NO: 1587740 - RNA, 20 nt, Human adenovirus F
caauauaaugacaaugucca

SEQ ID NO: 1587741 - RNA, 16 nt, Human adenovirus F
aagaugcgauuuucca

SEQ ID NO: 1587742 - RNA, 23 nt, Human adenovirus F
gugucaauagcauacagaagacc

SEQ ID NO: 1587743 - RNA, 21 nt, Human adenovirus F
ggucagcaagacaccaguagc

SEQ ID NO: 1587744 - RNA, 14 nt, Human adenovirus F
ggaauggagcugug

SEQ ID NO: 1587745 - RNA, 18 nt, Human adenovirus F
ccaacagccccagcuggu

SEQ ID NO: 1587746 - RNA, 22 nt, Human adenovirus F
gcgcacggcccccaucucugug

SEQ ID NO: 1587747 - RNA, 22 nt, Human adenovirus F
gggaugcagguaggaccacugg

SEQ ID NO: 1587748 - RNA, 19 nt, Human adenovirus F
aaaaguccacaaaaacucc

SEQ ID NO: 1587749 - RNA, 16 nt, Human adenovirus F
agcggccgcgaccgga

SEQ ID NO: 1587750 - RNA, 16 nt, Human adenovirus F
aggauccauagagggc

SEQ ID NO: 1587751 - RNA, 22 nt, Human adenovirus F
acgcgauccggcacuugaacau

SEQ ID NO: 1587752 - RNA, 21 nt, Human adenovirus F
gcaacaucggcaccccucucc

SEQ ID NO: 1587753 - RNA, 17 nt, Human adenovirus F
uaggcuuuaacaacaca

SEQ ID NO: 1587754 - RNA, 20 nt, Human adenovirus F
cuggauacuggcaagagcca

SEQ ID NO: 1587755 - RNA, 20 nt, Human adenovirus F
auagcaccaacgugcaggcc

SEQ ID NO: 1587756 - RNA, 14 nt, Human adenovirus F
ucccaacacuuuca

SEQ ID NO: 1587757 - RNA, 16 nt, Human adenovirus F
guuaucacccaaagcc

SEQ ID NO: 1587758 - RNA, 22 nt, Human adenovirus F
ugaagccauucuucucuucggc

SEQ ID NO: 1587759 - RNA, 23 nt, Human adenovirus F
ucagacggccguaccaagccuga

SEQ ID NO: 1587760 - RNA, 15 nt, Human adenovirus F
gcgaaauugggcugc

SEQ ID NO: 1587761 - RNA, 16 nt, Human adenovirus F
auggaaacgcagccug

SEQ ID NO: 1587762 - RNA, 12 nt, Human adenovirus F
agccgccagccu

SEQ ID NO: 1587763 - RNA, 15 nt, Human adenovirus F
gcacacgcacuucaa

SEQ ID NO: 1587764 - RNA, 12 nt, Human adenovirus F
cgcggggcagga

SEQ ID NO: 1587765 - RNA, 15 nt, Human adenovirus F
cggaccuuuuacugu

SEQ ID NO: 1587766 - RNA, 18 nt, Human adenovirus F
gcgagcccccguggggga

SEQ ID NO: 1587767 - RNA, 23 nt, Human adenovirus F
ccucggcuacaguuucgcgcacc

SEQ ID NO: 1587768 - RNA, 16 nt, Human adenovirus F
uugcggugccugaagc

SEQ ID NO: 1587769 - RNA, 18 nt, Human adenovirus F
uccucugacgggggaggc

SEQ ID NO: 1587770 - RNA, 20 nt, Human adenovirus F
aguggaacuuccggaaggau

SEQ ID NO: 1587771 - RNA, 16 nt, Human adenovirus F
gcaaacaauaaaagaa

SEQ ID NO: 1587772 - RNA, 23 nt, Human adenovirus F
ucggguugccguccccagcgccc

SEQ ID NO: 1587773 - RNA, 19 nt, Human adenovirus F
ugccgcaauggucuuacau

SEQ ID NO: 1587774 - RNA, 19 nt, Human adenovirus F
ggcagcagugcuuggaaga

SEQ ID NO: 1587775 - RNA, 21 nt, Human adenovirus F
uguucaaggaaacaacagccu

SEQ ID NO: 1587776 - RNA, 21 nt, Human adenovirus F
guccuggccaacugccaccuc

SEQ ID NO: 1587777 - RNA, 20 nt, Human adenovirus F
ggcagcagugcuuggaagag

SEQ ID NO: 1587778 - RNA, 14 nt, Human adenovirus F
acgcggggcaggag

SEQ ID NO: 1587779 - RNA, 14 nt, Human adenovirus F
gcucugccugcgga

SEQ ID NO: 1587780 - RNA, 15 nt, Human adenovirus F
cugcgguggaggcca

SEQ ID NO: 1587781 - RNA, 15 nt, Human adenovirus F
gcuucgccuccuggu

SEQ ID NO: 1587782 - RNA, 14 nt, Human adenovirus F
aaaggggugguggg

SEQ ID NO: 1587783 - RNA, 18 nt, Human adenovirus F
uuccaccaacugcucuuu

SEQ ID NO: 1587784 - RNA, 20 nt, Human adenovirus F
cuuuugccacacuaaaguuu

SEQ ID NO: 1587785 - RNA, 17 nt, Human adenovirus F
cccaggaucccucagag

SEQ ID NO: 1587786 - RNA, 21 nt, Human adenovirus F
acgggcggcaaaugcucugca

SEQ ID NO: 1587787 - RNA, 15 nt, Human adenovirus F
gcgucgcuggcuccg

SEQ ID NO: 1587788 - RNA, 12 nt, Human adenovirus F
cuaucugcaaaa

SEQ ID NO: 1587789 - RNA, 15 nt, Human adenovirus F
uccacuuacaaccaa

SEQ ID NO: 1587790 - RNA, 14 nt, Human adenovirus F
agcauaauaacucu

SEQ ID NO: 1587791 - RNA, 14 nt, Human adenovirus F
caugcuuagccucg

SEQ ID NO: 1587792 - RNA, 15 nt, Human adenovirus F
agcaggccgcccaac

SEQ ID NO: 1587793 - RNA, 14 nt, Human adenovirus F
guaagugcagaggc

SEQ ID NO: 1587794 - RNA, 14 nt, Human adenovirus F
ugcccgccagcugg

SEQ ID NO: 1587795 - RNA, 10 nt, Human adenovirus F
acagcuggga

SEQ ID NO: 1587796 - RNA, 20 nt, Human adenovirus F
ggaccuuacuuucugggcac

SEQ ID NO: 1587797 - RNA, 20 nt, Human adenovirus F
auuuaauggcacaguguuug

SEQ ID NO: 1587798 - RNA, 16 nt, Human adenovirus F
guaggaccacuggagg

SEQ ID NO: 1587799 - RNA, 12 nt, Human adenovirus F
agccaaccuccg

SEQ ID NO: 1587800 - RNA, 18 nt, Human adenovirus F
aguggaguucagcgcgug

SEQ ID NO: 1587801 - RNA, 14 nt, Human adenovirus F
augcagacaagaca

SEQ ID NO: 1587802 - RNA, 18 nt, Human adenovirus F
guucaaaaccucuuacaa

SEQ ID NO: 1587803 - RNA, 18 nt, Human adenovirus F
cagccugagcugccagag

SEQ ID NO: 1587804 - RNA, 21 nt, Human adenovirus F
auuucuuugucuaacuaaaaa

SEQ ID NO: 1587805 - RNA, 23 nt, Human adenovirus F
ucgugcccguggaaaaagacagc

SEQ ID NO: 1587806 - RNA, 13 nt, Human adenovirus F
cuguacugugcau

SEQ ID NO: 1587807 - RNA, 12 nt, Human adenovirus F
uacacuaagccu

SEQ ID NO: 1587808 - RNA, 18 nt, Human adenovirus F
aacacugccuaccgcagc

SEQ ID NO: 1587809 - RNA, 14 nt, Human adenovirus F
gcuaauuuuucacc

SEQ ID NO: 1587810 - RNA, 19 nt, Human adenovirus F
gaugcugcugaugaggaaa

SEQ ID NO: 1587811 - RNA, 13 nt, Human adenovirus F
uggccauuuucca

SEQ ID NO: 1587812 - RNA, 16 nt, Human adenovirus F
cgccaacuccgcccac

SEQ ID NO: 1587813 - RNA, 13 nt, Human adenovirus F
ggcuaauggccag

SEQ ID NO: 1587814 - RNA, 17 nt, Human adenovirus F
aaggcccauaccaaaga

SEQ ID NO: 1587815 - RNA, 16 nt, Human adenovirus F
cagcccagcgcccggg

SEQ ID NO: 1587816 - RNA, 13 nt, Human adenovirus F
cgcagcgggcagg

SEQ ID NO: 1587817 - RNA, 19 nt, Human adenovirus F
ccucguuguuuuccucuga

SEQ ID NO: 1587818 - RNA, 13 nt, Human adenovirus F
gacgugcgguggg

SEQ ID NO: 1587819 - RNA, 11 nt, Human adenovirus F
ccauggagcua

SEQ ID NO: 1587820 - RNA, 18 nt, Human adenovirus F
cugucauacgcaggcaca

SEQ ID NO: 1587821 - RNA, 15 nt, Human adenovirus F
uccaagugccccaga

SEQ ID NO: 1587822 - RNA, 14 nt, Human adenovirus F
cagcgggcaggagc

SEQ ID NO: 1587823 - RNA, 22 nt, Human adenovirus F
aaaaucacuguuuuuaacuauu

SEQ ID NO: 1587824 - RNA, 15 nt, Human adenovirus F
uucaaagaagagcug

SEQ ID NO: 1587825 - RNA, 15 nt, Human adenovirus F
auguggaaccaggca

SEQ ID NO: 1587826 - RNA, 19 nt, Human adenovirus F
cagcaguccgucagcuugu

SEQ ID NO: 1587827 - RNA, 20 nt, Human adenovirus F
gaugcgccucaugagcuggg

SEQ ID NO: 1587828 - RNA, 13 nt, Human adenovirus F
caccagccagcuc

SEQ ID NO: 1587829 - RNA, 22 nt, Human adenovirus F
cuggccuuuugaacgaccugca

SEQ ID NO: 1587830 - RNA, 12 nt, Human adenovirus F
agccuuuaacug

SEQ ID NO: 1587831 - RNA, 24 nt, Human adenovirus F
ucgcacuccacuaaccaggcgagc

SEQ ID NO: 1587832 - RNA, 23 nt, Human adenovirus F
gagcgguccgucacgcgggccuu

SEQ ID NO: 1587833 - RNA, 13 nt, Human adenovirus F
ccuagguccgacc

SEQ ID NO: 1587834 - RNA, 15 nt, Human adenovirus F
ugccgagcuuuuacu

SEQ ID NO: 1587835 - RNA, 16 nt, Human adenovirus F
ccaguagcuuggaagc

SEQ ID NO: 1587836 - RNA, 16 nt, Human adenovirus F
gugaguuuugagggug

SEQ ID NO: 1587837 - RNA, 14 nt, Human adenovirus F
caggcuacugggga

SEQ ID NO: 1587838 - RNA, 14 nt, Human adenovirus F
cggaaccugaaaga

SEQ ID NO: 1587839 - RNA, 17 nt, Human adenovirus F
gaggccgucuaccugcg

SEQ ID NO: 1587840 - RNA, 14 nt, Human adenovirus F
acaauaagcagcuu

SEQ ID NO: 1587841 - RNA, 12 nt, Human adenovirus F
agucgaggaggu

SEQ ID NO: 1587842 - RNA, 18 nt, Human adenovirus F
guucgucaggccugcaag

SEQ ID NO: 1587843 - RNA, 14 nt, Human adenovirus F
cguuuaaaaacuug

SEQ ID NO: 1587844 - RNA, 20 nt, Human adenovirus F
uguggggcgugcgagccccc

SEQ ID NO: 1587845 - RNA, 16 nt, Human adenovirus F
ccaagugccccagaaa

SEQ ID NO: 1587846 - RNA, 16 nt, Human adenovirus F
ucguagggauugagug

SEQ ID NO: 1587847 - RNA, 23 nt, Human adenovirus F
uuuaccaccccagcacuuggauu

SEQ ID NO: 1587848 - RNA, 12 nt, Human adenovirus F
cauuaaaaacuu

SEQ ID NO: 1587849 - RNA, 22 nt, Human adenovirus F
cucacagaucacggaacccugc

SEQ ID NO: 1587850 - RNA, 17 nt, Human adenovirus F
ugcuauugaaaauaacu

SEQ ID NO: 1587851 - RNA, 20 nt, Human adenovirus F
caaagcacacagaacaaaac

SEQ ID NO: 1587852 - RNA, 13 nt, Human adenovirus F
aacguucaaacag

SEQ ID NO: 1587853 - RNA, 18 nt, Human adenovirus F
cuggcguuaccaggaaac

SEQ ID NO: 1587854 - RNA, 22 nt, Human adenovirus F
cagcgggaagagaggcagcccc

SEQ ID NO: 1587855 - RNA, 20 nt, Human adenovirus F
cccgcuauguuggcggcccu

SEQ ID NO: 1587856 - RNA, 14 nt, Human adenovirus F
cggcgccggacggg

SEQ ID NO: 1587857 - RNA, 12 nt, Human adenovirus F
gugcaggucggg

SEQ ID NO: 1587858 - RNA, 13 nt, Human adenovirus F
cacugacaguaag

SEQ ID NO: 1587859 - RNA, 16 nt, Human adenovirus F
guggaaagcaaguuuc

SEQ ID NO: 1587860 - RNA, 22 nt, Human adenovirus F
ccgagcggcugcuucugccagu

SEQ ID NO: 1587861 - RNA, 18 nt, Human adenovirus F
cgacugggcggcggccau

SEQ ID NO: 1587862 - RNA, 12 nt, Human adenovirus F
agacgaggaggc

SEQ ID NO: 1587863 - RNA, 23 nt, Human adenovirus F
ccgcaaaugggccuggcagcugg

SEQ ID NO: 1587864 - RNA, 23 nt, Human adenovirus F
ugacuuuaccccgacagaggccg

SEQ ID NO: 1587865 - RNA, 18 nt, Human adenovirus F
ggacagcuaugacccaga

SEQ ID NO: 1587866 - RNA, 23 nt, Human adenovirus F
guggaguuuuacuagacuaaaaa

SEQ ID NO: 1587867 - RNA, 14 nt, Human adenovirus F
uaugggcagcaucc

SEQ ID NO: 1587868 - RNA, 15 nt, Human adenovirus F
ugaguuagcucugaa

SEQ ID NO: 1587869 - RNA, 22 nt, Human adenovirus F
uaaacuccucuuccuccacagc

SEQ ID NO: 1587870 - RNA, 22 nt, Human adenovirus F
ugaacguacucuuuugccacgc

SEQ ID NO: 1587871 - RNA, 21 nt, Human adenovirus F
accgguuuuguaccaccuugg

SEQ ID NO: 1587872 - RNA, 15 nt, Human adenovirus F
ggagccggcgguggc

SEQ ID NO: 1587873 - RNA, 14 nt, Human adenovirus F
aacucucuuacauu

SEQ ID NO: 1587874 - RNA, 14 nt, Human adenovirus F
aacuuucuuacacu

SEQ ID NO: 1587875 - RNA, 13 nt, Human adenovirus F
aaaaaaagaauua

SEQ ID NO: 1587876 - RNA, 13 nt, Human adenovirus F
cucauuuuucccg

SEQ ID NO: 1587877 - RNA, 13 nt, Human adenovirus F
aauaaagcuuacc

SEQ ID NO: 1587878 - RNA, 15 nt, Human adenovirus F
gaccccguuugcccg

SEQ ID NO: 1587879 - RNA, 19 nt, Human adenovirus F
cuggaacaguaacacaggu

SEQ ID NO: 1587880 - RNA, 20 nt, Human adenovirus F
gagcagcgggaagagaggca

SEQ ID NO: 1587881 - RNA, 16 nt, Human adenovirus F
cguucgacggcggugg

SEQ ID NO: 1587882 - RNA, 19 nt, Human adenovirus F
gcccgcuugggggcgccau

SEQ ID NO: 1587883 - RNA, 22 nt, Human adenovirus F
agggauucuaagggaggcagca

SEQ ID NO: 1587884 - RNA, 17 nt, Human adenovirus F
gaagguugacuugcagg

SEQ ID NO: 1587885 - RNA, 19 nt, Human adenovirus F
acaaagucauccaaaucau

SEQ ID NO: 1587886 - RNA, 21 nt, Human adenovirus F
ccuugcuacggaggaagaggg

SEQ ID NO: 1587887 - RNA, 14 nt, Human adenovirus F
agcagcagcagcgg

SEQ ID NO: 1587888 - RNA, 17 nt, Human adenovirus F
cgcugccuuugcaauau

SEQ ID NO: 1587889 - RNA, 14 nt, Human adenovirus F
gggucuauuuggac

SEQ ID NO: 1587890 - RNA, 18 nt, Human adenovirus F
cgccuuaguugguaccaa

SEQ ID NO: 1587891 - RNA, 20 nt, Human adenovirus F
augcaacuuggaagggaagg

SEQ ID NO: 1587892 - RNA, 21 nt, Human adenovirus F
cauuaggccgucccugggaug

SEQ ID NO: 1587893 - RNA, 22 nt, Human adenovirus F
acaacguggcucaauguaacau

SEQ ID NO: 1587894 - RNA, 24 nt, Human adenovirus F
cggcguaguugcguagacgcugga

SEQ ID NO: 1587895 - RNA, 14 nt, Human adenovirus F
gcccgggcccugga

SEQ ID NO: 1587896 - RNA, 18 nt, Human adenovirus F
cgaggggcuggcccgcuu

SEQ ID NO: 1587897 - RNA, 23 nt, Human adenovirus F
caccuucagugucgucuacaacg

SEQ ID NO: 1587898 - RNA, 18 nt, Human adenovirus F
ccgaccauuaccaccguc

SEQ ID NO: 1587899 - RNA, 17 nt, Human adenovirus F
cucccugaacuaccaga

SEQ ID NO: 1587900 - RNA, 21 nt, Human adenovirus F
cagcaguuuugguuacagugg

SEQ ID NO: 1587901 - RNA, 20 nt, Human adenovirus F
aaaaaccgccacaugaacac

SEQ ID NO: 1587902 - RNA, 13 nt, Human adenovirus F
uccaguggagcaa

SEQ ID NO: 1587903 - RNA, 14 nt, Human adenovirus F
agaugcccuguccg

SEQ ID NO: 1587904 - RNA, 22 nt, Human adenovirus F
ugcgcagcaguaucaguggagu

SEQ ID NO: 1587905 - RNA, 15 nt, Human adenovirus F
cuuuaugacuauggu

SEQ ID NO: 1587906 - RNA, 17 nt, Human adenovirus F
caacggcaaucccagca

SEQ ID NO: 1587907 - RNA, 19 nt, Human adenovirus F
agacgacugggcggcggcc

SEQ ID NO: 1587908 - RNA, 21 nt, Human adenovirus F
uaacggugaagcuucccaaca

SEQ ID NO: 1587909 - RNA, 22 nt, Human adenovirus F
gagcaaacggugaacgaggagc

SEQ ID NO: 1587910 - RNA, 22 nt, Human adenovirus F
cgccggcauguacggcggcgcc

SEQ ID NO: 1587911 - RNA, 21 nt, Human adenovirus F
ggaauguggggcgugcgagcc

SEQ ID NO: 1587912 - RNA, 18 nt, Human adenovirus F
uuccagcagcaccaccug

SEQ ID NO: 1587913 - RNA, 19 nt, Human adenovirus F
uacuggcaagagccaccuu

SEQ ID NO: 1587914 - RNA, 16 nt, Human adenovirus F
ugaaauuaauugcacu

SEQ ID NO: 1587915 - RNA, 22 nt, Human adenovirus F
caaguauacauuugaacagcug

SEQ ID NO: 1587916 - RNA, 19 nt, Human adenovirus F
guacggaccaccagaugau

SEQ ID NO: 1587917 - RNA, 13 nt, Human adenovirus F
ggcggcccugcaa

SEQ ID NO: 1587918 - RNA, 17 nt, Human adenovirus F
gaucccgacucacugga

SEQ ID NO: 1587919 - RNA, 13 nt, Human adenovirus F
gccaccuccaccg

SEQ ID NO: 1587920 - RNA, 16 nt, Human adenovirus F
gggauucuaagggagg

SEQ ID NO: 1587921 - RNA, 20 nt, Human adenovirus F
cugggacagccuagacgagg

SEQ ID NO: 1587922 - RNA, 14 nt, Human adenovirus F
caagcuaaaugcca

SEQ ID NO: 1587923 - RNA, 22 nt, Human adenovirus F
ccugcggauuaagaaccacuga

SEQ ID NO: 1587924 - RNA, 19 nt, Human adenovirus F
auguaaaguucuaaaaagc

SEQ ID NO: 1587925 - RNA, 21 nt, Human adenovirus F
gcuaaaucuuccucccaaagu

SEQ ID NO: 1587926 - RNA, 23 nt, Human adenovirus F
ccccggcggcgggugcaguggcg

SEQ ID NO: 1587927 - RNA, 18 nt, Human adenovirus F
agccuuuguuccuuccga

SEQ ID NO: 1587928 - RNA, 12 nt, Human adenovirus F
gagagccgagug

SEQ ID NO: 1587929 - RNA, 14 nt, Human adenovirus F
agccccaggccaac

SEQ ID NO: 1587930 - RNA, 14 nt, Human adenovirus F
cuuaaaggagcacu

SEQ ID NO: 1587931 - RNA, 17 nt, Human adenovirus F
agcauuaaccuguaugc

SEQ ID NO: 1587932 - RNA, 22 nt, Human adenovirus F
gccguugcucucuccggagccg

SEQ ID NO: 1587933 - RNA, 23 nt, Human adenovirus F
caugagucuguuuggugggcuga

SEQ ID NO: 1587934 - RNA, 17 nt, Human adenovirus F
ggucguccugucgcccc

SEQ ID NO: 1587935 - RNA, 20 nt, Human adenovirus F
cccccguuugcuuccuccaa

SEQ ID NO: 1587936 - RNA, 16 nt, Human adenovirus F
cacgcugacccuuccc

SEQ ID NO: 1587937 - RNA, 16 nt, Human adenovirus F
gcauccaccagccgca

SEQ ID NO: 1587938 - RNA, 13 nt, Human adenovirus F
ggguuuaccuggu

SEQ ID NO: 1587939 - RNA, 13 nt, Human adenovirus F
cucaacugugccu

SEQ ID NO: 1587940 - RNA, 23 nt, Human adenovirus F
acgguugcccgccagcuggcaaa

SEQ ID NO: 1587941 - RNA, 16 nt, Human adenovirus F
cccguaaaaaggaggg

SEQ ID NO: 1587942 - RNA, 16 nt, Human adenovirus F
accguuaaucucccuc

SEQ ID NO: 1587943 - RNA, 18 nt, Human adenovirus F
ggaguaccugagcccggg

SEQ ID NO: 1587944 - RNA, 16 nt, Human adenovirus F
cgguggcaacccugag

SEQ ID NO: 1587945 - RNA, 13 nt, Human adenovirus F
caagaaacacaaa

SEQ ID NO: 1587946 - RNA, 21 nt, Human adenovirus F
ucaacgcggggcaccuucagc

SEQ ID NO: 1587947 - RNA, 21 nt, Human adenovirus F
cggaaguuaaagugcgcccca

SEQ ID NO: 1587948 - RNA, 19 nt, Human adenovirus F
augugucuccgcugggaga

SEQ ID NO: 1587949 - RNA, 15 nt, Human adenovirus F
cgccaguccaccgcg

SEQ ID NO: 1587950 - RNA, 22 nt, Human adenovirus F
caacagggacacgagcugucau

SEQ ID NO: 1587951 - RNA, 22 nt, Human adenovirus F
gugcuggggaauggagcugugg

SEQ ID NO: 1587952 - RNA, 13 nt, Human adenovirus F
cccacuuaaugcu

SEQ ID NO: 1587953 - RNA, 14 nt, Human adenovirus F
aaucuucaaacauu

SEQ ID NO: 1587954 - RNA, 23 nt, Human adenovirus F
ccgacagaggccgguacccagac

SEQ ID NO: 1587955 - RNA, 15 nt, Human adenovirus F
ccaccguggcuccca

SEQ ID NO: 1587956 - RNA, 20 nt, Human adenovirus F
ugggcauaacuucagcacuu

SEQ ID NO: 1587957 - RNA, 19 nt, Human adenovirus F
auccucaagacuuggaaau

SEQ ID NO: 1587958 - RNA, 12 nt, Human adenovirus F
gcccgggcacau

SEQ ID NO: 1587959 - RNA, 16 nt, Human adenovirus F
uggaugcauccuccca

SEQ ID NO: 1587960 - RNA, 13 nt, Human adenovirus F
agaccaacaaacg

SEQ ID NO: 1587961 - RNA, 13 nt, Human adenovirus F
agccaaccaggcc

SEQ ID NO: 1587962 - RNA, 20 nt, Human adenovirus F
cuguauuuugcuacauaacu

SEQ ID NO: 1587963 - RNA, 22 nt, Human adenovirus F
cuauuucuuugucuaacuaaaa

SEQ ID NO: 1587964 - RNA, 13 nt, Human adenovirus F
uucgcccggacac

SEQ ID NO: 1587965 - RNA, 19 nt, Human adenovirus F
gcagaggaggugaugcugc

SEQ ID NO: 1587966 - RNA, 17 nt, Human adenovirus F
ugcuacggaggaagagg

SEQ ID NO: 1587967 - RNA, 21 nt, Human adenovirus F
cguagaguuugggagccagga

SEQ ID NO: 1587968 - RNA, 15 nt, Human adenovirus F
gaaugcccuuucaaa

SEQ ID NO: 1587969 - RNA, 19 nt, Human adenovirus F
agcgcagucuaagccuggc

SEQ ID NO: 1587970 - RNA, 20 nt, Human adenovirus F
guggauaccgcugcagcugc

SEQ ID NO: 1587971 - RNA, 22 nt, Human adenovirus F
uaagaccguuuucguuccacac

SEQ ID NO: 1587972 - RNA, 16 nt, Human adenovirus F
ggguauuugauuuaac

SEQ ID NO: 1587973 - RNA, 17 nt, Human adenovirus F
cuggggaauggagcugu

SEQ ID NO: 1587974 - RNA, 15 nt, Human adenovirus F
gaugcugcugaugag

SEQ ID NO: 1587975 - RNA, 20 nt, Human adenovirus F
gccaacuccaaccaagaaau

SEQ ID NO: 1587976 - RNA, 20 nt, Human adenovirus F
ccauccaucacgccaacgcc

SEQ ID NO: 1587977 - RNA, 17 nt, Human adenovirus F
gaaaccuuaaccacccc

SEQ ID NO: 1587978 - RNA, 20 nt, Human adenovirus F
ccucgagugcguaagaccuc

SEQ ID NO: 1587979 - RNA, 20 nt, Human adenovirus F
gaccacgucgccaacagugu

SEQ ID NO: 1587980 - RNA, 13 nt, Human adenovirus F
gguuccaccaagc

SEQ ID NO: 1587981 - RNA, 21 nt, Human adenovirus F
uaagcgucggcgccacacugu

SEQ ID NO: 1587982 - RNA, 15 nt, Human adenovirus F
auuucaccuacucug

SEQ ID NO: 1587983 - RNA, 19 nt, Human adenovirus F
ugaucuuauggaagacucu

SEQ ID NO: 1587984 - RNA, 14 nt, Human adenovirus F
gugucaguuuccac

SEQ ID NO: 1587985 - RNA, 15 nt, Human adenovirus F
ccaugccggcuccga

SEQ ID NO: 1587986 - RNA, 15 nt, Human adenovirus F
cugucuagccgcacg

SEQ ID NO: 1587987 - RNA, 20 nt, Human adenovirus F
agcccauucugccaguuggg

SEQ ID NO: 1587988 - RNA, 16 nt, Human adenovirus F
aggacucacgccaggc

SEQ ID NO: 1587989 - RNA, 16 nt, Human adenovirus F
cgaucgcuccaggugg

SEQ ID NO: 1587990 - RNA, 13 nt, Human adenovirus F
uccauaacuaaaa

SEQ ID NO: 1587991 - RNA, 15 nt, Human adenovirus F
cugaagacacauugg

SEQ ID NO: 1587992 - RNA, 16 nt, Human adenovirus F
gcaccgcgcggcggcc

SEQ ID NO: 1587993 - RNA, 20 nt, Human adenovirus F
augcagccauguuauggguc

SEQ ID NO: 1587994 - RNA, 19 nt, Human adenovirus F
ccgagcuucuuagcgaaac

SEQ ID NO: 1587995 - RNA, 13 nt, Human adenovirus F
cuguuacuauuaa

SEQ ID NO: 1587996 - RNA, 21 nt, Human adenovirus F
cuaaccguuaaucucccuccc

SEQ ID NO: 1587997 - RNA, 22 nt, Human adenovirus F
cucggguagcgguuggugcugc

SEQ ID NO: 1587998 - RNA, 22 nt, Human adenovirus F
cgcggaagaagaugaggaggac

SEQ ID NO: 1587999 - RNA, 14 nt, Human adenovirus F
aggcgagcucaggg

SEQ ID NO: 1588000 - RNA, 21 nt, Human adenovirus F
caauuuugcaaacuauucugg

SEQ ID NO: 1588001 - RNA, 21 nt, Human adenovirus F
cugggguucauguugugcaga

SEQ ID NO: 1588002 - RNA, 15 nt, Human adenovirus F
ccuccagcacugccg

SEQ ID NO: 1588003 - RNA, 18 nt, Human adenovirus F
uacaaaugcucagucacu

SEQ ID NO: 1588004 - RNA, 16 nt, Human adenovirus F
augccuuacuggagcg

SEQ ID NO: 1588005 - RNA, 22 nt, Human adenovirus F
acagccuguuacuauuaaugca

SEQ ID NO: 1588006 - RNA, 15 nt, Human adenovirus F
caaaaugugcagcaa

SEQ ID NO: 1588007 - RNA, 17 nt, Human adenovirus F
agggcucugccugcgga

SEQ ID NO: 1588008 - RNA, 13 nt, Human adenovirus F
cgccuccaacaca

SEQ ID NO: 1588009 - RNA, 21 nt, Human adenovirus F
ggccaacugccaccuccaccg

SEQ ID NO: 1588010 - RNA, 15 nt, Human adenovirus F
ggggcggaccugcaa

SEQ ID NO: 1588011 - RNA, 15 nt, Human adenovirus F
cuuuuugggaggaag

SEQ ID NO: 1588012 - RNA, 15 nt, Human adenovirus F
aguuuuaagguauau

SEQ ID NO: 1588013 - RNA, 16 nt, Human adenovirus F
accccaccguggcucc

SEQ ID NO: 1588014 - RNA, 12 nt, Human adenovirus F
guaugggcagca

SEQ ID NO: 1588015 - RNA, 18 nt, Human adenovirus F
aagcuggguggaaagcaa

SEQ ID NO: 1588016 - RNA, 20 nt, Human adenovirus F
gucgggccaugcgccgagcg

SEQ ID NO: 1588017 - RNA, 15 nt, Human adenovirus F
ggauguacuccuuuu

SEQ ID NO: 1588018 - RNA, 22 nt, Human adenovirus F
aaccggcggcguacacuggcug

SEQ ID NO: 1588019 - RNA, 13 nt, Human adenovirus F
agccgccagccuc

SEQ ID NO: 1588020 - RNA, 17 nt, Human adenovirus F
gccaucgacguucucuc

SEQ ID NO: 1588021 - RNA, 22 nt, Human adenovirus F
cagcaccgcacagaaagcucau

SEQ ID NO: 1588022 - RNA, 16 nt, Human adenovirus F
aggcgcaaucccaggc

SEQ ID NO: 1588023 - RNA, 18 nt, Human adenovirus F
ccugggaugcagguagga

SEQ ID NO: 1588024 - RNA, 12 nt, Human adenovirus F
acgcuguuccaa

SEQ ID NO: 1588025 - RNA, 23 nt, Human adenovirus F
cacaaaguccuggccaacugcca

SEQ ID NO: 1588026 - RNA, 15 nt, Human adenovirus F
gcuaacuuguggaga

SEQ ID NO: 1588027 - RNA, 19 nt, Human adenovirus F
caucugcagcauugccacu

SEQ ID NO: 1588028 - RNA, 21 nt, Human adenovirus F
cacccggguuuaccuggugga

SEQ ID NO: 1588029 - RNA, 15 nt, Human adenovirus F
gcuacacaacaaauc

SEQ ID NO: 1588030 - RNA, 15 nt, Human adenovirus F
accaaauucugcuag

SEQ ID NO: 1588031 - RNA, 22 nt, Human adenovirus F
aggacgccucggaguaccugag

SEQ ID NO: 1588032 - RNA, 18 nt, Human adenovirus F
caacucauggugccaaag

SEQ ID NO: 1588033 - RNA, 19 nt, Human adenovirus F
ccuucacuccucgccaggc

SEQ ID NO: 1588034 - RNA, 14 nt, Human adenovirus F
ucacccaaagccaa

SEQ ID NO: 1588035 - RNA, 21 nt, Human adenovirus F
ugucgucgacgacggcgccgg

SEQ ID NO: 1588036 - RNA, 17 nt, Human adenovirus F
accuggggccuacggaa

SEQ ID NO: 1588037 - RNA, 20 nt, Human adenovirus F
cagccugagcugccagaggc

SEQ ID NO: 1588038 - RNA, 18 nt, Human adenovirus F
ggcgaggggcuggcccgc

SEQ ID NO: 1588039 - RNA, 17 nt, Human adenovirus F
caccccuagucccuccu

SEQ ID NO: 1588040 - RNA, 13 nt, Human adenovirus F
cgcaacacaucca

SEQ ID NO: 1588041 - RNA, 21 nt, Human adenovirus F
cccaccgaguuccugcgcugc

SEQ ID NO: 1588042 - RNA, 13 nt, Human adenovirus F
aaaauaacucacu

SEQ ID NO: 1588043 - RNA, 23 nt, Human adenovirus F
aguggagggauuuaauggcacag

SEQ ID NO: 1588044 - RNA, 15 nt, Human adenovirus F
gcuuccggcauuaac

SEQ ID NO: 1588045 - RNA, 22 nt, Human adenovirus F
ggaccccauggaugagcccaca

SEQ ID NO: 1588046 - RNA, 20 nt, Human adenovirus F
cauuuaugcccaacaguaca

SEQ ID NO: 1588047 - RNA, 18 nt, Human adenovirus F
cggggcuaacuggcagag

SEQ ID NO: 1588048 - RNA, 17 nt, Human adenovirus F
caccgcgcccguccucc

SEQ ID NO: 1588049 - RNA, 14 nt, Human adenovirus F
aggcggaaaccaag

SEQ ID NO: 1588050 - RNA, 14 nt, Human adenovirus F
cgccagcuggcaaa

SEQ ID NO: 1588051 - RNA, 22 nt, Human adenovirus F
ugacgaacuuacuagucuuagc

SEQ ID NO: 1588052 - RNA, 20 nt, Human adenovirus F
ccaaauuacgucauugacau

SEQ ID NO: 1588053 - RNA, 19 nt, Human adenovirus F
ccgcagacgaacacaauau

SEQ ID NO: 1588054 - RNA, 15 nt, Human adenovirus F
aacagcuccucagcc

SEQ ID NO: 1588055 - RNA, 23 nt, Human adenovirus F
caccccucuccgugcaaaacaau

SEQ ID NO: 1588056 - RNA, 14 nt, Human adenovirus F
acuucuuaauaaag

SEQ ID NO: 1588057 - RNA, 17 nt, Human adenovirus F
aaacuucccuuugacaa

SEQ ID NO: 1588058 - RNA, 17 nt, Human adenovirus F
cacggaacccugccgcu

SEQ ID NO: 1588059 - RNA, 18 nt, Human adenovirus F
cuacgccuccaccaccuu

SEQ ID NO: 1588060 - RNA, 16 nt, Human adenovirus F
aucgacguucucuccc

SEQ ID NO: 1588061 - RNA, 20 nt, Human adenovirus F
uugcgcaggcgaauaaaagg

SEQ ID NO: 1588062 - RNA, 22 nt, Human adenovirus F
caaaaugugcagcaaaaacucc

SEQ ID NO: 1588063 - RNA, 22 nt, Human adenovirus F
gugcuuauuaagcgagcagagc

SEQ ID NO: 1588064 - RNA, 13 nt, Human adenovirus F
cuaccgcagcugg

SEQ ID NO: 1588065 - RNA, 20 nt, Human adenovirus F
augagcuuacuuuaaaacuu

SEQ ID NO: 1588066 - RNA, 18 nt, Human adenovirus F
cuucaccuuaucccauga

SEQ ID NO: 1588067 - RNA, 20 nt, Human adenovirus F
aggcagcuucucgaggccaa

SEQ ID NO: 1588068 - RNA, 15 nt, Human adenovirus F
ggcgcacggccccca

SEQ ID NO: 1588069 - RNA, 17 nt, Human adenovirus F
uacuauuaaugcaaaca

SEQ ID NO: 1588070 - RNA, 18 nt, Human adenovirus F
gaaucuuacuuugacaug

SEQ ID NO: 1588071 - RNA, 14 nt, Human adenovirus F
cugcccuuccuccc

SEQ ID NO: 1588072 - RNA, 21 nt, Human adenovirus F
aagaugacuucaaccccgucu

SEQ ID NO: 1588073 - RNA, 23 nt, Human adenovirus F
ggcaauguugccaccgagaucac

SEQ ID NO: 1588074 - RNA, 17 nt, Human adenovirus F
gcggugauauuaagaug

SEQ ID NO: 1588075 - RNA, 16 nt, Human adenovirus F
gaggguacuagcagug

SEQ ID NO: 1588076 - RNA, 14 nt, Human adenovirus F
caguuaccaaggcg

SEQ ID NO: 1588077 - RNA, 22 nt, Human adenovirus F
cagggcgugcaagugggcucag

SEQ ID NO: 1588078 - RNA, 16 nt, Human adenovirus F
ccaaaauggcucugcu

SEQ ID NO: 1588079 - RNA, 15 nt, Human adenovirus F
ugggauuacaaauuu

SEQ ID NO: 1588080 - RNA, 17 nt, Human adenovirus F
guggaaagccugguaga

SEQ ID NO: 1588081 - RNA, 13 nt, Human adenovirus F
ucacuuccgccgc

SEQ ID NO: 1588082 - RNA, 21 nt, Human adenovirus F
caaagugcugucuagccgcac

SEQ ID NO: 1588083 - RNA, 15 nt, Human adenovirus F
acccuaguuguggaa

SEQ ID NO: 1588084 - RNA, 16 nt, Human adenovirus F
uugaagaacugggagu

SEQ ID NO: 1588085 - RNA, 13 nt, Human adenovirus F
cugacaauggaac

SEQ ID NO: 1588086 - RNA, 16 nt, Human adenovirus F
acaccggugggcuugu

SEQ ID NO: 1588087 - RNA, 16 nt, Human adenovirus F
cuucuauugcacuuaa

SEQ ID NO: 1588088 - RNA, 14 nt, Human adenovirus F
acugcuaccuccuc

SEQ ID NO: 1588089 - RNA, 13 nt, Human adenovirus F
cuggcuggcccug

SEQ ID NO: 1588090 - RNA, 22 nt, Human adenovirus F
ccuuuaauuaaaguuauucuga

SEQ ID NO: 1588091 - RNA, 13 nt, Human adenovirus F
caaagaagagcug

SEQ ID NO: 1588092 - RNA, 19 nt, Human adenovirus F
gcccggacuuggcgugcag

SEQ ID NO: 1588093 - RNA, 13 nt, Human adenovirus F
cgauacugcaaac

SEQ ID NO: 1588094 - RNA, 17 nt, Human adenovirus F
gcuaaggacgguggcau

SEQ ID NO: 1588095 - RNA, 21 nt, Human adenovirus F
gaagccacgcugaacuuuuug

SEQ ID NO: 1588096 - RNA, 11 nt, Human adenovirus F
agacaauccua

SEQ ID NO: 1588097 - RNA, 12 nt, Human adenovirus F
cacuccugcagu

SEQ ID NO: 1588098 - RNA, 13 nt, Human adenovirus F
caguggccgcacu

SEQ ID NO: 1588099 - RNA, 22 nt, Human adenovirus F
caggagcgcagucuaagccugg

SEQ ID NO: 1588100 - RNA, 22 nt, Human adenovirus F
ggauaaacugagcguaggauuc

SEQ ID NO: 1588101 - RNA, 21 nt, Human adenovirus F
auaggcauuaggccgucccug

SEQ ID NO: 1588102 - RNA, 22 nt, Human adenovirus F
ugggggcccugaccgaccuggg

SEQ ID NO: 1588103 - RNA, 22 nt, Human adenovirus F
cguagguuuaaauuacacuaag

SEQ ID NO: 1588104 - RNA, 18 nt, Human adenovirus F
ccacgauguaaccacaga

SEQ ID NO: 1588105 - RNA, 18 nt, Human adenovirus F
cccagcgcccgggcccug

SEQ ID NO: 1588106 - RNA, 20 nt, Human adenovirus F
gcugagugacgaucuggggg

SEQ ID NO: 1588107 - RNA, 12 nt, Human adenovirus F
gcugcagccaga

SEQ ID NO: 1588108 - RNA, 16 nt, Human adenovirus F
accaaaggugguucug

SEQ ID NO: 1588109 - RNA, 14 nt, Human adenovirus F
ugggacagccuaga

SEQ ID NO: 1588110 - RNA, 22 nt, Human adenovirus F
caaccccacgccaagccugaag

SEQ ID NO: 1588111 - RNA, 17 nt, Human adenovirus F
uuggagcagccugugga

SEQ ID NO: 1588112 - RNA, 16 nt, Human adenovirus F
ccauggaaacgcagcc

SEQ ID NO: 1588113 - RNA, 17 nt, Human adenovirus F
agcgcugccuuugcaau

SEQ ID NO: 1588114 - RNA, 20 nt, Human adenovirus F
uccuggccaacugccaccuc

SEQ ID NO: 1588115 - RNA, 15 nt, Human adenovirus F
gcaaacaauaaaaga

SEQ ID NO: 1588116 - RNA, 15 nt, Human adenovirus F
gcagacgaacacaau

SEQ ID NO: 1588117 - RNA, 19 nt, Human adenovirus F
aagccacaauaagcagcuu

SEQ ID NO: 1588118 - RNA, 15 nt, Human adenovirus F
guccugucgccccug

SEQ ID NO: 1588119 - RNA, 14 nt, Human adenovirus F
gacgcuggaagagg

SEQ ID NO: 1588120 - RNA, 22 nt, Human adenovirus F
cgcuuucaguuggagcagccug

SEQ ID NO: 1588121 - RNA, 21 nt, Human adenovirus F
gccucuguuguagucugccaa

SEQ ID NO: 1588122 - RNA, 14 nt, Human adenovirus F
aaccuauugguucc

SEQ ID NO: 1588123 - RNA, 18 nt, Human adenovirus F
acaaagucauccaaauca

SEQ ID NO: 1588124 - RNA, 15 nt, Human adenovirus F
accaccgcaaacaac

SEQ ID NO: 1588125 - RNA, 21 nt, Human adenovirus F
acauuguguccugcaacaaaa

SEQ ID NO: 1588126 - RNA, 22 nt, Human adenovirus F
accccacgccaagccugaagcc

SEQ ID NO: 1588127 - RNA, 14 nt, Human adenovirus F
agaccuuccaggaa

SEQ ID NO: 1588128 - RNA, 16 nt, Human adenovirus F
cgccgaggcacuguuc

SEQ ID NO: 1588129 - RNA, 14 nt, Human adenovirus F
gaggaggaggccau

SEQ ID NO: 1588130 - RNA, 24 nt, Human adenovirus F
acguaccagaaagcuacaaggaca

SEQ ID NO: 1588131 - RNA, 13 nt, Human adenovirus F
cugcgggaggaau

SEQ ID NO: 1588132 - RNA, 23 nt, Human adenovirus F
uaacacugcgauuagaaaacggg

SEQ ID NO: 1588133 - RNA, 23 nt, Human adenovirus F
ugacuucaaccccgucuacccuu

SEQ ID NO: 1588134 - RNA, 15 nt, Human adenovirus F
cuuaugcgcuguacu

SEQ ID NO: 1588135 - RNA, 17 nt, Human adenovirus F
agcccggguccaggcua

SEQ ID NO: 1588136 - RNA, 15 nt, Human adenovirus F
cgcuaucaggaagca

SEQ ID NO: 1588137 - RNA, 14 nt, Human adenovirus F
gacguuaaccuagg

SEQ ID NO: 1588138 - RNA, 14 nt, Human adenovirus F
cugguggacaacaa

SEQ ID NO: 1588139 - RNA, 23 nt, Human adenovirus F
caacccugaggaggaggccaucc

SEQ ID NO: 1588140 - RNA, 16 nt, Human adenovirus F
gaugucauaaacguaa

SEQ ID NO: 1588141 - RNA, 12 nt, Human adenovirus F
gaagcaaucaac

SEQ ID NO: 1588142 - RNA, 22 nt, Human adenovirus F
ccggcggcguacacuggcuggc

SEQ ID NO: 1588143 - RNA, 21 nt, Human adenovirus F
acguugcauuauggccauggu

SEQ ID NO: 1588144 - RNA, 16 nt, Human adenovirus F
cuuucaucuuaacucu

SEQ ID NO: 1588145 - RNA, 15 nt, Human adenovirus F
gcucagccccgccgg

SEQ ID NO: 1588146 - RNA, 17 nt, Human adenovirus F
gcaacgcugcaggcgcu

SEQ ID NO: 1588147 - RNA, 12 nt, Human adenovirus F
cauuauugcacu

SEQ ID NO: 1588148 - RNA, 21 nt, Human adenovirus F
cuugcuuuuucacgacggggu

SEQ ID NO: 1588149 - RNA, 22 nt, Human adenovirus F
aagcucgucauaggccauuuug

SEQ ID NO: 1588150 - RNA, 18 nt, Human adenovirus F
gcaguccacuuaacagcu

SEQ ID NO: 1588151 - RNA, 17 nt, Human adenovirus F
ccaaaacuuucaacaaa

SEQ ID NO: 1588152 - RNA, 23 nt, Human adenovirus F
caaguuucgggcgcgggugaugg

SEQ ID NO: 1588153 - RNA, 11 nt, Human adenovirus F
auuuucugcca

SEQ ID NO: 1588154 - RNA, 15 nt, Human adenovirus F
cagccggaggagugg

SEQ ID NO: 1588155 - RNA, 11 nt, Human adenovirus F
acaagggcuuc

SEQ ID NO: 1588156 - RNA, 13 nt, Human adenovirus F
caaccaggccuug

SEQ ID NO: 1588157 - RNA, 23 nt, Human adenovirus F
gcaggccagucggcaggcuuccu

SEQ ID NO: 1588158 - RNA, 22 nt, Human adenovirus F
gacuuuaccccgacagaggccg

SEQ ID NO: 1588159 - RNA, 14 nt, Human adenovirus F
uuagcucugaacac

SEQ ID NO: 1588160 - RNA, 20 nt, Human adenovirus F
gcuacuuaucacaucuuuuu

SEQ ID NO: 1588161 - RNA, 16 nt, Human adenovirus F
cgccgccccuggccug

SEQ ID NO: 1588162 - RNA, 22 nt, Human adenovirus F
acgaucgcuccagguggggcgg

SEQ ID NO: 1588163 - RNA, 15 nt, Human adenovirus F
guggucacucucagc

SEQ ID NO: 1588164 - RNA, 17 nt, Human adenovirus F
aguugagcgugguggca

SEQ ID NO: 1588165 - RNA, 19 nt, Human adenovirus F
gggcaagcuucucagcuca

SEQ ID NO: 1588166 - RNA, 17 nt, Human adenovirus F
ccucccuuugcccccca

SEQ ID NO: 1588167 - RNA, 14 nt, Human adenovirus F
agguggaccccaug

SEQ ID NO: 1588168 - RNA, 11 nt, Human adenovirus F
gccccuggccu

SEQ ID NO: 1588169 - RNA, 19 nt, Human adenovirus F
accccuaugacaccuccuc

SEQ ID NO: 1588170 - RNA, 20 nt, Human adenovirus F
aggagcugucucagcaguug

SEQ ID NO: 1588171 - RNA, 23 nt, Human adenovirus F
gcuaauacuucuuaauaaagaca

SEQ ID NO: 1588172 - RNA, 21 nt, Human adenovirus F
cuauuacagguauaaagguug

SEQ ID NO: 1588173 - RNA, 18 nt, Human adenovirus F
ucagcgcgugaccaucac

SEQ ID NO: 1588174 - RNA, 21 nt, Human adenovirus F
cgcgcuucgccuccugguggc

SEQ ID NO: 1588175 - RNA, 16 nt, Human adenovirus F
cuuucaguuggagcag

SEQ ID NO: 1588176 - RNA, 17 nt, Human adenovirus F
ucgcaaacaauaaaaga

SEQ ID NO: 1588177 - RNA, 17 nt, Human adenovirus F
gcaguucauuuaaaaga

SEQ ID NO: 1588178 - RNA, 16 nt, Human adenovirus F
gcugacagcugggaca

SEQ ID NO: 1588179 - RNA, 12 nt, Human adenovirus F
cggcgcagcaga

SEQ ID NO: 1588180 - RNA, 21 nt, Human adenovirus F
uguacuacaauuccacuggca

SEQ ID NO: 1588181 - RNA, 18 nt, Human adenovirus F
gcaaccauguucacugaa

SEQ ID NO: 1588182 - RNA, 20 nt, Human adenovirus F
gacauuguuuugcuaccugg

SEQ ID NO: 1588183 - RNA, 19 nt, Human adenovirus F
gcuuuccgcgaggccaugc

SEQ ID NO: 1588184 - RNA, 13 nt, Human adenovirus F
cgccauaggcgca

SEQ ID NO: 1588185 - RNA, 21 nt, Human adenovirus F
gcgcgaacagagugggggcaa

SEQ ID NO: 1588186 - RNA, 16 nt, Human adenovirus F
cgcuaugugcagcagu

SEQ ID NO: 1588187 - RNA, 14 nt, Human adenovirus F
ccaccguggcuccc

SEQ ID NO: 1588188 - RNA, 22 nt, Human adenovirus F
auuuaaaguggugagguaugau

SEQ ID NO: 1588189 - RNA, 16 nt, Human adenovirus F
gcaccgcgcccguccu

SEQ ID NO: 1588190 - RNA, 22 nt, Human adenovirus F
caaucagggcgugcaagugggc

SEQ ID NO: 1588191 - RNA, 12 nt, Human adenovirus F
uacgagcaggcu

SEQ ID NO: 1588192 - RNA, 20 nt, Human adenovirus F
aagagcaaaaccuccaggag

SEQ ID NO: 1588193 - RNA, 20 nt, Human adenovirus F
auaacggacgcauuaccauu

SEQ ID NO: 1588194 - RNA, 22 nt, Human adenovirus F
cuguaagcgggggaaauuuaaa

SEQ ID NO: 1588195 - RNA, 23 nt, Human adenovirus F
ggaggcuauuggccagacgcagg

SEQ ID NO: 1588196 - RNA, 23 nt, Human adenovirus F
gccgucguacaaguugcaaagcu

SEQ ID NO: 1588197 - RNA, 21 nt, Human adenovirus F
gccagaaaaaacccuuaacaa

SEQ ID NO: 1588198 - RNA, 15 nt, Human adenovirus F
ucccagucugccauc

SEQ ID NO: 1588199 - RNA, 23 nt, Human adenovirus F
ggcuccgacgcuuggcaccgccg

SEQ ID NO: 1588200 - RNA, 13 nt, Human adenovirus F
gagcagauggaga

SEQ ID NO: 1588201 - RNA, 22 nt, Human adenovirus F
ugguuuuuuucgcggucggcac

SEQ ID NO: 1588202 - RNA, 16 nt, Human adenovirus F
gcagcaguaucagugg

SEQ ID NO: 1588203 - RNA, 13 nt, Human adenovirus F
aaacgcugugagu

SEQ ID NO: 1588204 - RNA, 15 nt, Human adenovirus F
aagauuuuugaaggu

SEQ ID NO: 1588205 - RNA, 22 nt, Human adenovirus F
ccguggagccgacuucaagccc

SEQ ID NO: 1588206 - RNA, 23 nt, Human adenovirus F
ugccccccggcggcgggugcagu

SEQ ID NO: 1588207 - RNA, 22 nt, Human adenovirus F
aacagggacacgagcugucaua

SEQ ID NO: 1588208 - RNA, 14 nt, Human adenovirus F
cgcgacagagcacc

SEQ ID NO: 1588209 - RNA, 16 nt, Human adenovirus F
uccagggaguccagga

SEQ ID NO: 1588210 - RNA, 23 nt, Human adenovirus F
cugaaugugucuccgcugggaga

SEQ ID NO: 1588211 - RNA, 15 nt, Human adenovirus F
gcaaggaaccagugg

SEQ ID NO: 1588212 - RNA, 17 nt, Human adenovirus F
ucaagcccgacauuaag

SEQ ID NO: 1588213 - RNA, 17 nt, Human adenovirus F
gaguuggcuucugccag

SEQ ID NO: 1588214 - RNA, 12 nt, Human adenovirus F
ccuccaauuuga

SEQ ID NO: 1588215 - RNA, 23 nt, Human adenovirus F
ccgccuagguccgaccgcugggg

SEQ ID NO: 1588216 - RNA, 17 nt, Human adenovirus F
agugccgccggugaugg

SEQ ID NO: 1588217 - RNA, 15 nt, Human adenovirus F
uagcucuuccaagcu

SEQ ID NO: 1588218 - RNA, 14 nt, Human adenovirus F
cauuggcuggaggc

SEQ ID NO: 1588219 - RNA, 19 nt, Human adenovirus F
accugagggccggccugga

SEQ ID NO: 1588220 - RNA, 18 nt, Human adenovirus F
uguacucaaauguagccc

SEQ ID NO: 1588221 - RNA, 10 nt, Human adenovirus F
gcaaaugcuc

SEQ ID NO: 1588222 - RNA, 21 nt, Human adenovirus F
gcgcagcaguaucaguggagu

SEQ ID NO: 1588223 - RNA, 19 nt, Human adenovirus F
gccaggcguacuuaacgcu

SEQ ID NO: 1588224 - RNA, 12 nt, Human adenovirus F
ugcuaaacauga

SEQ ID NO: 1588225 - RNA, 13 nt, Human adenovirus F
ugacgugccugag

SEQ ID NO: 1588226 - RNA, 20 nt, Human adenovirus F
uuuaauggcacaguguuugc

SEQ ID NO: 1588227 - RNA, 15 nt, Human adenovirus F
cgccgccccuggccu

SEQ ID NO: 1588228 - RNA, 16 nt, Human adenovirus F
cuccaggguaagcucg

SEQ ID NO: 1588229 - RNA, 17 nt, Human adenovirus F
gugaguugguagcagug

SEQ ID NO: 1588230 - RNA, 22 nt, Human adenovirus F
cauuugguaacaaggccuggaa

SEQ ID NO: 1588231 - RNA, 23 nt, Human adenovirus F
gcagccuguggaguggcauuaaa

SEQ ID NO: 1588232 - RNA, 14 nt, Human adenovirus F
aacggaaacaaaaa

SEQ ID NO: 1588233 - RNA, 17 nt, Human adenovirus F
gucccuggaguuugggg

SEQ ID NO: 1588234 - RNA, 18 nt, Human adenovirus F
agguccgaccgcuggggu

SEQ ID NO: 1588235 - RNA, 23 nt, Human adenovirus F
acuccuuggguuuagccacaucc

SEQ ID NO: 1588236 - RNA, 16 nt, Human adenovirus F
cugcuaaccugugcag

SEQ ID NO: 1588237 - RNA, 17 nt, Human adenovirus F
uaccagaaagcuacaag

SEQ ID NO: 1588238 - RNA, 21 nt, Human adenovirus F
aaaacguaccaaccggagccu

SEQ ID NO: 1588239 - RNA, 16 nt, Human adenovirus F
acuucaccaaugccau

SEQ ID NO: 1588240 - RNA, 16 nt, Human adenovirus F
ggcaccagccagcuca

SEQ ID NO: 1588241 - RNA, 13 nt, Human adenovirus F
uggcacagcucac

SEQ ID NO: 1588242 - RNA, 24 nt, Human adenovirus F
ggauccagugcaggaagaggagga

SEQ ID NO: 1588243 - RNA, 18 nt, Human adenovirus F
ggacucgucuccugcaag

SEQ ID NO: 1588244 - RNA, 21 nt, Human adenovirus F
guguuucacguaguaucucau

SEQ ID NO: 1588245 - RNA, 11 nt, Human adenovirus F
cuucagccugg

SEQ ID NO: 1588246 - RNA, 23 nt, Human adenovirus F
cuugccaggguucucuucaggcu

SEQ ID NO: 1588247 - RNA, 20 nt, Human adenovirus F
uucaacggaauuguaacuga

SEQ ID NO: 1588248 - RNA, 14 nt, Human adenovirus F
ucggcaccagccag

SEQ ID NO: 1588249 - RNA, 18 nt, Human adenovirus F
guuccucauacaaaugcu

SEQ ID NO: 1588250 - RNA, 15 nt, Human adenovirus F
acguacucuuuugcc

SEQ ID NO: 1588251 - RNA, 22 nt, Human adenovirus F
aacuccaaccaagaaauacaaa

SEQ ID NO: 1588252 - RNA, 15 nt, Human adenovirus F
gauccauagagggcg

SEQ ID NO: 1588253 - RNA, 16 nt, Human adenovirus F
auuguaaacgcucugg

SEQ ID NO: 1588254 - RNA, 18 nt, Human adenovirus F
ccuuuaaccaccaccgca

SEQ ID NO: 1588255 - RNA, 16 nt, Human adenovirus F
cuggggaauggagcug

SEQ ID NO: 1588256 - RNA, 18 nt, Human adenovirus F
cgaugaugccgcaauggu

SEQ ID NO: 1588257 - RNA, 16 nt, Human adenovirus F
uuaaguuauacaguga

SEQ ID NO: 1588258 - RNA, 22 nt, Human adenovirus F
uccagugcaggaagaggaggag

SEQ ID NO: 1588259 - RNA, 13 nt, Human adenovirus F
cccauacccgcca

SEQ ID NO: 1588260 - RNA, 18 nt, Human adenovirus F
gaagacauucuugagcag

SEQ ID NO: 1588261 - RNA, 21 nt, Human adenovirus F
uuggcuggaggcuugggagga

SEQ ID NO: 1588262 - RNA, 20 nt, Human adenovirus F
aauaauuuuccgcuugccac

SEQ ID NO: 1588263 - RNA, 18 nt, Human adenovirus F
cagcugcuaaccugugca

SEQ ID NO: 1588264 - RNA, 15 nt, Human adenovirus F
guggcggaggugccc

SEQ ID NO: 1588265 - RNA, 21 nt, Human adenovirus F
cgccauugccacccgccagga

SEQ ID NO: 1588266 - RNA, 19 nt, Human adenovirus F
ucauggcguggaagacgag

SEQ ID NO: 1588267 - RNA, 23 nt, Human adenovirus F
ugggcauaguugcucccaaagug

SEQ ID NO: 1588268 - RNA, 18 nt, Human adenovirus F
ucucgccguaggagaggc

SEQ ID NO: 1588269 - RNA, 21 nt, Human adenovirus F
ccagcgucagguuugacagca

SEQ ID NO: 1588270 - RNA, 13 nt, Human adenovirus F
agguuaaagccaa

SEQ ID NO: 1588271 - RNA, 22 nt, Human adenovirus F
gguccauacuugugcauuggca

SEQ ID NO: 1588272 - RNA, 22 nt, Human adenovirus F
cugggauuugccgcagccagug

SEQ ID NO: 1588273 - RNA, 16 nt, Human adenovirus F
cuccugcaguccacuu

SEQ ID NO: 1588274 - RNA, 14 nt, Human adenovirus F
gacuaaacacccgc

SEQ ID NO: 1588275 - RNA, 14 nt, Human adenovirus F
ccuuaaggaggagg

SEQ ID NO: 1588276 - RNA, 16 nt, Human adenovirus F
ccugcacgcucuugcu

SEQ ID NO: 1588277 - RNA, 19 nt, Human adenovirus F
cucgcuggcuagguaccca

SEQ ID NO: 1588278 - RNA, 15 nt, Human adenovirus F
ucgacuccucuguga

SEQ ID NO: 1588279 - RNA, 16 nt, Human adenovirus F
aaccccacgccaagcc

SEQ ID NO: 1588280 - RNA, 22 nt, Human adenovirus F
uagccaacuauuuggcccacca

SEQ ID NO: 1588281 - RNA, 15 nt, Human adenovirus F
uuaaaaacuugcaag

SEQ ID NO: 1588282 - RNA, 19 nt, Human adenovirus F
ccgagccaccaucuccagc

SEQ ID NO: 1588283 - RNA, 14 nt, Human adenovirus F
uccgcccgcuccga

SEQ ID NO: 1588284 - RNA, 16 nt, Human adenovirus F
gacuaugucagcuuua

SEQ ID NO: 1588285 - RNA, 17 nt, Human adenovirus F
aaacuggaagauguccu

SEQ ID NO: 1588286 - RNA, 14 nt, Human adenovirus F
ugggcguccagugg

SEQ ID NO: 1588287 - RNA, 13 nt, Human adenovirus F
caggcacaccuuc

SEQ ID NO: 1588288 - RNA, 19 nt, Human adenovirus F
uucccgugucaccugcagu

SEQ ID NO: 1588289 - RNA, 16 nt, Human adenovirus F
uuuaugcccaacagua

SEQ ID NO: 1588290 - RNA, 16 nt, Human adenovirus F
caggauucgcccgcca

SEQ ID NO: 1588291 - RNA, 18 nt, Human adenovirus F
cuggggaauggagcugug

SEQ ID NO: 1588292 - RNA, 23 nt, Human adenovirus F
gcgucagguuugacagcauuaac

SEQ ID NO: 1588293 - RNA, 16 nt, Human adenovirus F
ucggcacgcuccuugg

SEQ ID NO: 1588294 - RNA, 21 nt, Human adenovirus F
aaacgagccagauuugaagau

SEQ ID NO: 1588295 - RNA, 19 nt, Human adenovirus F
ggaaauuuacucaacugug

SEQ ID NO: 1588296 - RNA, 22 nt, Human adenovirus F
uuugaacagcugaagacacauu

SEQ ID NO: 1588297 - RNA, 22 nt, Human adenovirus F
acgucccuccccguuaccuggg

SEQ ID NO: 1588298 - RNA, 20 nt, Human adenovirus F
aacaugcuguacgccaacuc

SEQ ID NO: 1588299 - RNA, 21 nt, Human adenovirus F
cugggcuggaugcauccuccc

SEQ ID NO: 1588300 - RNA, 21 nt, Human adenovirus F
cuguggacgacagccagcugu

SEQ ID NO: 1588301 - RNA, 15 nt, Human adenovirus F
gagcccgggccuggu

SEQ ID NO: 1588302 - RNA, 17 nt, Human adenovirus F
ccggguuuaccuggugg

SEQ ID NO: 1588303 - RNA, 22 nt, Human adenovirus F
ucaaaaguguuuauuuauuucu

SEQ ID NO: 1588304 - RNA, 13 nt, Human adenovirus F
ggacgacagccag

SEQ ID NO: 1588305 - RNA, 21 nt, Human adenovirus F
agagcauugugguacaggagc

SEQ ID NO: 1588306 - RNA, 22 nt, Human adenovirus F
cugggguagggugucugccaga

SEQ ID NO: 1588307 - RNA, 18 nt, Human adenovirus F
guaugguaacuccucuuc

SEQ ID NO: 1588308 - RNA, 12 nt, Human adenovirus F
ggccaaccuaga

SEQ ID NO: 1588309 - RNA, 20 nt, Human adenovirus F
ggggcccugaccgaccuggg

SEQ ID NO: 1588310 - RNA, 17 nt, Human adenovirus F
cuccuaacgccacuuuu

SEQ ID NO: 1588311 - RNA, 19 nt, Human adenovirus F
uccgcagacgaacacaaua

SEQ ID NO: 1588312 - RNA, 11 nt, Human adenovirus F
gggcaaaacau

SEQ ID NO: 1588313 - RNA, 17 nt, Human adenovirus F
agggcaacguucagcca

SEQ ID NO: 1588314 - RNA, 14 nt, Human adenovirus F
gccaccgcaaccau

SEQ ID NO: 1588315 - RNA, 17 nt, Human adenovirus F
accuuacaccaccccua

SEQ ID NO: 1588316 - RNA, 18 nt, Human adenovirus F
ccagccggaggagugggc

SEQ ID NO: 1588317 - RNA, 14 nt, Human adenovirus F
cccugugagugugg

SEQ ID NO: 1588318 - RNA, 17 nt, Human adenovirus F
agaggaggugaugcugc

SEQ ID NO: 1588319 - RNA, 18 nt, Human adenovirus F
ugccauacgggagggaca

SEQ ID NO: 1588320 - RNA, 17 nt, Human adenovirus F
agccacaauaagcagcu

SEQ ID NO: 1588321 - RNA, 11 nt, Human adenovirus F
aaaccaaauca

SEQ ID NO: 1588322 - RNA, 19 nt, Human adenovirus F
gaacccaacuauuugggag

SEQ ID NO: 1588323 - RNA, 15 nt, Human adenovirus F
gccccccaauccaaa

SEQ ID NO: 1588324 - RNA, 17 nt, Human adenovirus F
aggucguaaugaggaca

SEQ ID NO: 1588325 - RNA, 17 nt, Human adenovirus F
ucgcgaaauugggcugc

SEQ ID NO: 1588326 - RNA, 16 nt, Human adenovirus F
aaauagccgccagccu

SEQ ID NO: 1588327 - RNA, 21 nt, Human adenovirus F
gcucugguagaaagcaaagcc

SEQ ID NO: 1588328 - RNA, 23 nt, Human adenovirus F
cgaggcuuuccgcgaggccaugc

SEQ ID NO: 1588329 - RNA, 15 nt, Human adenovirus F
uuuuuaugaaucacu

SEQ ID NO: 1588330 - RNA, 23 nt, Human adenovirus F
gcuguacugugcauuugggagcu

SEQ ID NO: 1588331 - RNA, 17 nt, Human adenovirus F
ccugugcagcgcgcucc

SEQ ID NO: 1588332 - RNA, 22 nt, Human adenovirus F
cgaggacggcaaggaaccagug

SEQ ID NO: 1588333 - RNA, 20 nt, Human adenovirus F
cccagaccaucaauuuugac

SEQ ID NO: 1588334 - RNA, 22 nt, Human adenovirus F
cccuuggaaauuugcugacagc

SEQ ID NO: 1588335 - RNA, 17 nt, Human adenovirus F
acauguuugucuuuaaa

SEQ ID NO: 1588336 - RNA, 14 nt, Human adenovirus F
acaggugggcuugg

SEQ ID NO: 1588337 - RNA, 16 nt, Human adenovirus F
accacuaccacccucc

SEQ ID NO: 1588338 - RNA, 12 nt, Human adenovirus F
aggccgcuccca

SEQ ID NO: 1588339 - RNA, 18 nt, Human adenovirus F
agggcaaaaugggcuugc

SEQ ID NO: 1588340 - RNA, 19 nt, Human adenovirus F
agggcggaacagcauacgu

SEQ ID NO: 1588341 - RNA, 13 nt, Human adenovirus F
guaggcaaucucc

SEQ ID NO: 1588342 - RNA, 20 nt, Human adenovirus F
guagagacugccaagccuca

SEQ ID NO: 1588343 - RNA, 20 nt, Human adenovirus F
guauuaacacuggcagaggc

SEQ ID NO: 1588344 - RNA, 21 nt, Human adenovirus F
gacaugggggcggaccugcaa

SEQ ID NO: 1588345 - RNA, 12 nt, Human adenovirus F
cuggaaccacuu

SEQ ID NO: 1588346 - RNA, 18 nt, Human adenovirus F
gccauucuuaacccgcac

SEQ ID NO: 1588347 - RNA, 16 nt, Human adenovirus F
gcccacugaccggcac

SEQ ID NO: 1588348 - RNA, 16 nt, Human adenovirus F
uacauuggccaccgcc

SEQ ID NO: 1588349 - RNA, 17 nt, Human adenovirus F
uaggugacaaagaggcg

SEQ ID NO: 1588350 - RNA, 15 nt, Human adenovirus F
ucucgccccaccgcc

SEQ ID NO: 1588351 - RNA, 19 nt, Human adenovirus F
ucucggccgguaacgccac

SEQ ID NO: 1588352 - RNA, 16 nt, Human adenovirus F
ucucgguaacgaccuc

SEQ ID NO: 1588353 - RNA, 18 nt, Human adenovirus F
ugaggcagcgacagggcg

SEQ ID NO: 1588354 - RNA, 19 nt, Human adenovirus F
ugcggugccugaagcacug

SEQ ID NO: 1588355 - RNA, 22 nt, Human adenovirus F
uggggguucgccuggagaggcg

SEQ ID NO: 1588356 - RNA, 18 nt, Human adenovirus F
uggguaagugcagaggcg

SEQ ID NO: 1588357 - RNA, 20 nt, Human adenovirus F
uggguguauaaaagggggcg

SEQ ID NO: 1588358 - RNA, 14 nt, Human adenovirus F
uccgccuccacccu

SEQ ID NO: 1588359 - RNA, 16 nt, Human adenovirus F
ucgccaguccaccgcg

SEQ ID NO: 1588360 - RNA, 12 nt, Human adenovirus F
ucggcacgcucc

SEQ ID NO: 1588361 - RNA, 19 nt, Human adenovirus F
gucaggccugcaagaucuc

SEQ ID NO: 1588362 - RNA, 20 nt, Human adenovirus F
gcucuaacgggcaccggcac

SEQ ID NO: 1588363 - RNA, 17 nt, Human adenovirus F
gcgucgcuggcuccgcg

SEQ ID NO: 1588364 - RNA, 20 nt, Human adenovirus F
gcgugcccaucauacagcag

SEQ ID NO: 1588365 - RNA, 17 nt, Human adenovirus F
gcguccgcccgcuccga

SEQ ID NO: 1588366 - RNA, 18 nt, Human adenovirus F
uggaccuggaagagggcg

SEQ ID NO: 1588367 - RNA, 17 nt, Human adenovirus F
ugacgugccugagggcg

SEQ ID NO: 1588368 - RNA, 16 nt, Human adenovirus F
ugacgguaaaggggcg

SEQ ID NO: 1588369 - RNA, 17 nt, Human adenovirus F
ugaggauuuggagggcg

SEQ ID NO: 1588370 - RNA, 20 nt, Human adenovirus F
ugaaccggaaaaccaacgcu

SEQ ID NO: 1588371 - RNA, 22 nt, Human adenovirus F
ucagcuugagagcaagagugcg

SEQ ID NO: 1588372 - RNA, 18 nt, Human adenovirus F
ucacucuccgccgccgcu

SEQ ID NO: 1588373 - RNA, 18 nt, Human adenovirus F
ucacuuugccagagggca

SEQ ID NO: 1588374 - RNA, 21 nt, Human adenovirus F
uauugcuuuauugccaccgca

SEQ ID NO: 1588375 - RNA, 16 nt, Human adenovirus F
ucaaacaaccagcgcu

SEQ ID NO: 1588376 - RNA, 20 nt, Human adenovirus F
ucacaccucuccccaccgcu

SEQ ID NO: 1588377 - RNA, 16 nt, Human adenovirus F
ucacccacccaccgcu

SEQ ID NO: 1588378 - RNA, 18 nt, Human adenovirus F
ucaccuuacaccaccccu

SEQ ID NO: 1588379 - RNA, 14 nt, Human adenovirus F
uaaccaccaccgca

SEQ ID NO: 1588380 - RNA, 16 nt, Human adenovirus F
uaaccacuaccacccu

SEQ ID NO: 1588381 - RNA, 16 nt, Human adenovirus F
uacagcccccaccgcc

SEQ ID NO: 1588382 - RNA, 23 nt, Human adenovirus F
gcagguaggaccacuggagggcg

SEQ ID NO: 1588383 - RNA, 13 nt, Human adenovirus F
accugcacgcucu

SEQ ID NO: 1588384 - RNA, 18 nt, Human adenovirus F
accugcaguucauuuaaa

SEQ ID NO: 1588385 - RNA, 19 nt, Human adenovirus F
accucugacaaacacgcuc

SEQ ID NO: 1588386 - RNA, 15 nt, Human adenovirus F
accccgucacucucc

SEQ ID NO: 1588387 - RNA, 14 nt, Human adenovirus F
acaaaauaaugacu

SEQ ID NO: 1588388 - RNA, 19 nt, Human adenovirus F
accugucgcggucguuuaa

SEQ ID NO: 1588389 - RNA, 21 nt, Human adenovirus F
auguccccauaaacguucaaa

SEQ ID NO: 1588390 - RNA, 20 nt, Human adenovirus F
ccaagucaaaaaagaugcga

SEQ ID NO: 1588391 - RNA, 16 nt, Human adenovirus F
aacgaaaaaggagguc

SEQ ID NO: 1588392 - RNA, 23 nt, Human adenovirus F
aacccaugagccgccagguggua

SEQ ID NO: 1588393 - RNA, 22 nt, Human adenovirus F
aacuaccgccuuuggagguggc

SEQ ID NO: 1588394 - RNA, 15 nt, Human adenovirus F
cagucaagcucucca

SEQ ID NO: 1588395 - RNA, 20 nt, Human adenovirus F
aucgccgggcaggacgccuc

SEQ ID NO: 1588396 - RNA, 21 nt, Human adenovirus F
aguccaaagcagagcucugca

SEQ ID NO: 1588397 - RNA, 19 nt, Human adenovirus F
agccuccgguggcucugca

SEQ ID NO: 1588398 - RNA, 16 nt, Human adenovirus F
agccucucgcucugca

SEQ ID NO: 1588399 - RNA, 15 nt, Human adenovirus F
agccugaaacgccgc

SEQ ID NO: 1588400 - RNA, 18 nt, Human adenovirus F
agcgagcaggaguugguc

SEQ ID NO: 1588401 - RNA, 20 nt, Human adenovirus F
gcccucuucugcaccugcac

SEQ ID NO: 1588402 - RNA, 15 nt, Human adenovirus F
ggacuuugcuccgcc

SEQ ID NO: 1588403 - RNA, 14 nt, Human adenovirus F
gucgcagaaucucc

SEQ ID NO: 1588404 - RNA, 20 nt, Human adenovirus F
gcagcgacagggcgcuaacu

SEQ ID NO: 1588405 - RNA, 17 nt, Human adenovirus F
cugccaccgcaaccaug

SEQ ID NO: 1588406 - RNA, 18 nt, Human adenovirus F
cugccguugcaaccucug

SEQ ID NO: 1588407 - RNA, 20 nt, Human adenovirus F
cugcggauuaagaaccacug

SEQ ID NO: 1588408 - RNA, 19 nt, Human adenovirus F
cuuccuccaacggcuugca

SEQ ID NO: 1588409 - RNA, 15 nt, Human adenovirus F
cuucgcccugaaagu

SEQ ID NO: 1588410 - RNA, 23 nt, Human adenovirus F
cuucggcaggaaagccacgcucg

SEQ ID NO: 1588411 - RNA, 18 nt, Human adenovirus F
ucccccuguaccaccgca

SEQ ID NO: 1588412 - RNA, 22 nt, Human adenovirus F
ucccaacgcgcguuaccacccu

SEQ ID NO: 1588413 - RNA, 13 nt, Human adenovirus F
uccauagagggcg

SEQ ID NO: 1588414 - RNA, 20 nt, Human adenovirus F
uccaugccuuucucccaggc

SEQ ID NO: 1588415 - RNA, 19 nt, Human adenovirus F
ucccgccccugccaccgca

SEQ ID NO: 1588416 - RNA, 20 nt, Human adenovirus F
ucccugcacuaugccuuccg

SEQ ID NO: 1588417 - RNA, 18 nt, Human adenovirus F
uccgaccauuaccaccgu

SEQ ID NO: 1588418 - RNA, 14 nt, Human adenovirus F
acucuuacaccucc

SEQ ID NO: 1588419 - RNA, 16 nt, Human adenovirus F
caccccuagucccucc

SEQ ID NO: 1588420 - RNA, 14 nt, Human adenovirus F
caccaaaggugguu

SEQ ID NO: 1588421 - RNA, 21 nt, Human adenovirus F
acucgcagcguugcacgcucu

SEQ ID NO: 1588422 - RNA, 14 nt, Human adenovirus F
cgcgcccguccucc

SEQ ID NO: 1588423 - RNA, 18 nt, Human adenovirus F
uccacccgugcccaccgu

SEQ ID NO: 1588424 - RNA, 20 nt, Human adenovirus F
uccaagacccgguacaggug

SEQ ID NO: 1588425 - RNA, 14 nt, Human adenovirus F
ccuaugacaccucc

SEQ ID NO: 1588426 - RNA, 20 nt, Human adenovirus F
cagccuccgguggcucugca

SEQ ID NO: 1588427 - RNA, 21 nt, Human adenovirus F
caccgccgcaccacugacagu

SEQ ID NO: 1588428 - RNA, 22 nt, Human adenovirus F
agaaaccccaccguggcuccca

SEQ ID NO: 1588429 - RNA, 19 nt, Human adenovirus F
acguggucauugggcuugu

SEQ ID NO: 1588430 - RNA, 19 nt, Human adenovirus F
cacccuauggaccaccgcg

SEQ ID NO: 1588431 - RNA, 21 nt, Human adenovirus F
acgccaagccugaagcccgca

SEQ ID NO: 1588432 - RNA, 19 nt, Human adenovirus F
caggcgcuccacgucccuc

SEQ ID NO: 1588433 - RNA, 18 nt, Human adenovirus F
caagcccauucugccagu

SEQ ID NO: 1588434 - RNA, 19 nt, Human
ccaauucgaacuuuuucca

SEQ ID NO: 1588435 - RNA, 23 nt, Human
caguuguucaauaauaaauauuu

SEQ ID NO: 1588436 - RNA, 11 nt, Human
cauacauauuu

SEQ ID NO: 1588437 - RNA, 21 nt, Human
auugauaaguucauacauugu

SEQ ID NO: 1588438 - RNA, 19 nt, Human
auugauaaguucauacauu

SEQ ID NO: 1588439 - RNA, 18 nt, Human
auugauaaguucauacau

SEQ ID NO: 1588440 - RNA, 17 nt, Human
auugauaaguucauaca

SEQ ID NO: 1588441 - RNA, 16 nt, Human
auugauaaguucauac

SEQ ID NO: 1588442 - RNA, 15 nt, Human
auugauaaguucaua

SEQ ID NO: 1588443 - RNA, 12 nt, Human
auugauaaguuc

SEQ ID NO: 1588444 - RNA, 20 nt, Human
caacuauuuuuccaaaauaa

SEQ ID NO: 1588445 - RNA, 15 nt, Human
caacuauuuuuccaa

SEQ ID NO: 1588446 - RNA, 22 nt, Human
gcuuccuucugugaaaguacau

SEQ ID NO: 1588447 - RNA, 21 nt, Human
gccacuguuuugaaucucaua

SEQ ID NO: 1588448 - RNA, 19 nt, Human
aaaagccugcaauuucaua

SEQ ID NO: 1588449 - RNA, 15 nt, Human
aaaauauauuuaaug

SEQ ID NO: 1588450 - RNA, 14 nt, Human
aaaauauauuuaau

SEQ ID NO: 1588451 - RNA, 21 nt, Human
aaagauuuucagaaaauauua

SEQ ID NO: 1588452 - RNA, 13 nt, Human
ggugaaaauuauu

SEQ ID NO: 1588453 - RNA, 21 nt, Human
ggucauauuaauauauuucca

SEQ ID NO: 1588454 - RNA, 15 nt, Human
aaagauuuucagaaa

SEQ ID NO: 1588455 - RNA, 15 nt, Human
aaaauauuauguguu

SEQ ID NO: 1588456 - RNA, 14 nt, Human
aaaauauuaugugu

SEQ ID NO: 1588457 - RNA, 21 nt, Human
aaaauauuauguguuuccaua

SEQ ID NO: 1588458 - RNA, 19 nt, Human
aaacaacuucaauauccaa

SEQ ID NO: 1588459 - RNA, 20 nt, Human
gaauauguuucaaacuuugg

SEQ ID NO: 1588460 - RNA, 15 nt, Human
gaauauguuucaaac

SEQ ID NO: 1588461 - RNA, 14 nt, Human
gaauauguuucaaa

SEQ ID NO: 1588462 - RNA, 14 nt, Human
gaugguucuagcau

SEQ ID NO: 1588463 - RNA, 12 nt, Human
cuucaucugacu

SEQ ID NO: 1588464 - RNA, 18 nt, Human
cuucaucugacuaugaca

SEQ ID NO: 1588465 - RNA, 13 nt, Human
auguuaagcagau

SEQ ID NO: 1588466 - RNA, 12 nt, Human
auguuaagcaga

SEQ ID NO: 1588467 - RNA, 12 nt, Human
auguguuuccau

SEQ ID NO: 1588468 - RNA, 13 nt, Human
uuugagaguucua

SEQ ID NO: 1588469 - RNA, 14 nt, Human
uuugagaguucuaa

SEQ ID NO: 1588470 - RNA, 21 nt, Human
uuugacagaauauguuucaaa

SEQ ID NO: 1588471 - RNA, 20 nt, Human
uuugacagaauauguuucaa

SEQ ID NO: 1588472 - RNA, 19 nt, Human
uuugacagaauauguuuca

SEQ ID NO: 1588473 - RNA, 18 nt, Human
uuugacagaauauguuuc

SEQ ID NO: 1588474 - RNA, 22 nt, Human
auucaggagaguagaacagaua

SEQ ID NO: 1588475 - RNA, 21 nt, Human
auucaggagaguagaacagau

SEQ ID NO: 1588476 - RNA, 13 nt, Human
uuuuugacagaau

SEQ ID NO: 1588477 - RNA, 12 nt, Human
uuuuugacagaa

SEQ ID NO: 1588478 - RNA, 19 nt, Human
uuuuuguagcacugacaga

SEQ ID NO: 1588479 - RNA, 21 nt, Human
uuuuuguagcacugacagauu

SEQ ID NO: 1588480 - RNA, 20 nt, Human
uuuuuguagcacugacagau

SEQ ID NO: 1588481 - RNA, 19 nt, Human
auugauguguuuauuuaua

SEQ ID NO: 1588482 - RNA, 12 nt, Human
auugauguguuu

SEQ ID NO: 1588483 - RNA, 18 nt, Human
auuugaauguuaagcaga

SEQ ID NO: 1588484 - RNA, 13 nt, Human
auuugaauguuaa

SEQ ID NO: 1588485 - RNA, 19 nt, Human
auuugaauguuaagcagau

SEQ ID NO: 1588486 - RNA, 21 nt, Human
auggaaugcuguguuaaauaa

SEQ ID NO: 1588487 - RNA, 22 nt, Human
uuucacauaucuaguaugaaau

SEQ ID NO: 1588488 - RNA, 18 nt, Human
uuguucauacauauuuuu

SEQ ID NO: 1588489 - RNA, 16 nt, Human
uuguucauacauauuu

SEQ ID NO: 1588490 - RNA, 22 nt, Human
uuguucaauaauaaauauuuuu

SEQ ID NO: 1588491 - RNA, 13 nt, Human
uuguucauacaua

SEQ ID NO: 1588492 - RNA, 20 nt, Human
uuguucaauaauaaauauuu

SEQ ID NO: 1588493 - RNA, 17 nt, Human
uuguagcuuuaucaaag

SEQ ID NO: 1588494 - RNA, 16 nt, Human
uuguagcuuuaucaaa

SEQ ID NO: 1588495 - RNA, 14 nt, Human
aucugacuaugaca

SEQ ID NO: 1588496 - RNA, 17 nt, Human
aucugacuaugacauaa

SEQ ID NO: 1588497 - RNA, 18 nt, Human
uuggagacacaacuauuu

SEQ ID NO: 1588498 - RNA, 21 nt, Human
uucagaaaauauuauguguuu

SEQ ID NO: 1588499 - RNA, 20 nt, Human
uucagaaaauauuauguguu

SEQ ID NO: 1588500 - RNA, 14 nt, Human
uucagaaaauauua

SEQ ID NO: 1588501 - RNA, 13 nt, Human
uucagaaaauauu

SEQ ID NO: 1588502 - RNA, 19 nt, Human
auauaaguauucuaaauuu

SEQ ID NO: 1588503 - RNA, 17 nt, Human
auauaaguauucuaaau

SEQ ID NO: 1588504 - RNA, 21 nt, Human
uucacauaucuaguaugaaau

SEQ ID NO: 1588505 - RNA, 20 nt, Human
uucacauaucuaguaugaaa

SEQ ID NO: 1588506 - RNA, 22 nt, Human
uucaagaaaacaacuucaauau

SEQ ID NO: 1588507 - RNA, 16 nt, Human
uucaaacuuuggaaca

SEQ ID NO: 1588508 - RNA, 19 nt, Human
aucagugugucuaaauuug

SEQ ID NO: 1588509 - RNA, 20 nt, Human
aucagugugucuaaauuuga

SEQ ID NO: 1588510 - RNA, 18 nt, Human
auauuguguugugaaugu

SEQ ID NO: 1588511 - RNA, 17 nt, Human
auauuguguugugaaug

SEQ ID NO: 1588512 - RNA, 14 nt, Human
ugugauguauucua

SEQ ID NO: 1588513 - RNA, 16 nt, Human
ugugauguauucuagc

SEQ ID NO: 1588514 - RNA, 18 nt, Human
agucacuaccuucaugca

SEQ ID NO: 1588515 - RNA, 17 nt, Human
aguguacuuaacuauuc

SEQ ID NO: 1588516 - RNA, 14 nt, Human
agugugucuaaauu

SEQ ID NO: 1588517 - RNA, 16 nt, Human
uguuaaguauguguaa

SEQ ID NO: 1588518 - RNA, 15 nt, Human
uguuaaguaugugua

SEQ ID NO: 1588519 - RNA, 19 nt, Human
uguguuaaguauguguaaa

SEQ ID NO: 1588520 - RNA, 22 nt, Human
uguguuaaguauguguaaaaug

SEQ ID NO: 1588521 - RNA, 19 nt, Human
uguuuugaaucucauaauu

SEQ ID NO: 1588522 - RNA, 24 nt, Human
uguuuauuuauagaguguacuuaa

SEQ ID NO: 1588523 - RNA, 14 nt, Human
uguuuauuuauaga

SEQ ID NO: 1588524 - RNA, 17 nt, Human
uuaauuccaauuauaug

SEQ ID NO: 1588525 - RNA, 16 nt, Human
aguacauuuggagaca

SEQ ID NO: 1588526 - RNA, 15 nt, Human
aguaauucaagaaaa

SEQ ID NO: 1588527 - RNA, 14 nt, Human
aguaauagagcaaa

SEQ ID NO: 1588528 - RNA, 16 nt, Human
aguaguaauagagcaa

SEQ ID NO: 1588529 - RNA, 22 nt, Human
uguauucuagcuaauguaauaa

SEQ ID NO: 1588530 - RNA, 20 nt, Human
uguauucuagcuaauguaau

SEQ ID NO: 1588531 - RNA, 16 nt, Human
uguaaauaguauuuga

SEQ ID NO: 1588532 - RNA, 17 nt, Human
aggagaguagaacagau

SEQ ID NO: 1588533 - RNA, 21 nt, Human
uggaacaagaugguucuagca

SEQ ID NO: 1588534 - RNA, 19 nt, Human
ugauaaguucauacauugu

SEQ ID NO: 1588535 - RNA, 17 nt, Human
ugauaaguucauacauu

SEQ ID NO: 1588536 - RNA, 15 nt, Human
ugauaaguucauaca

SEQ ID NO: 1588537 - RNA, 13 nt, Human
ugauaaguucaua

SEQ ID NO: 1588538 - RNA, 16 nt, Human
ugauaaguaaaugcua

SEQ ID NO: 1588539 - RNA, 22 nt, Human
ugaguucuacauaaguaauuca

SEQ ID NO: 1588540 - RNA, 20 nt, Human
ugaguucuacauaaguaauu

SEQ ID NO: 1588541 - RNA, 15 nt, Human
ugaguucuacauaag

SEQ ID NO: 1588542 - RNA, 17 nt, Human
ugacauaaaaacaacuu

SEQ ID NO: 1588543 - RNA, 20 nt, Human
ugacauaaaaacaacuuuau

SEQ ID NO: 1588544 - RNA, 18 nt, Human
ugacauaaaaacaacuuu

SEQ ID NO: 1588545 - RNA, 20 nt, Human
agagcaaaauugauguguuu

SEQ ID NO: 1588546 - RNA, 14 nt, Human
agagcaaaauugau

SEQ ID NO: 1588547 - RNA, 20 nt, Human
agacacaacuauuuuuccaa

SEQ ID NO: 1588548 - RNA, 19 nt, Human
agacacaacuauuuuucca

SEQ ID NO: 1588549 - RNA, 17 nt, Human
agaaaucaaagagagaa

SEQ ID NO: 1588550 - RNA, 16 nt, Human
ucugacuaugacauaa

SEQ ID NO: 1588551 - RNA, 14 nt, Human
ucugacuaugacau

SEQ ID NO: 1588552 - RNA, 22 nt, Human
ucuacauaaguaauucaagaaa

SEQ ID NO: 1588553 - RNA, 20 nt, Human
ucuacauaaguaauucaaga

SEQ ID NO: 1588554 - RNA, 17 nt, Human
ucuacauaaguaauuca

SEQ ID NO: 1588555 - RNA, 19 nt, Human
ucccuuucugcuuguguua

SEQ ID NO: 1588556 - RNA, 19 nt, Human
accucaaaaugucuaagau

SEQ ID NO: 1588557 - RNA, 21 nt, Human
uauuuccauuaaaaaaucagu

SEQ ID NO: 1588558 - RNA, 21 nt, Human
acauaaaaacaacuuuauacc

SEQ ID NO: 1588559 - RNA, 19 nt, Human
acauaaaaacaacuuuaua

SEQ ID NO: 1588560 - RNA, 16 nt, Human
acauaaaaacaacuuu

SEQ ID NO: 1588561 - RNA, 17 nt, Human
acauaucuaguaugaaa

SEQ ID NO: 1588562 - RNA, 22 nt, Human
acauaucuaguaugaaauuaua

SEQ ID NO: 1588563 - RNA, 20 nt, Human
acauaucuaguaugaaauua

SEQ ID NO: 1588564 - RNA, 23 nt, Human
acauaucuaguaugaaauuauau

SEQ ID NO: 1588565 - RNA, 17 nt, Human
ucaaagggugaaaauua

SEQ ID NO: 1588566 - RNA, 23 nt, Human
uauuuuugacagaauauguuuca

SEQ ID NO: 1588567 - RNA, 19 nt, Human
uauuuuugacagaauaugu

SEQ ID NO: 1588568 - RNA, 15 nt, Human
uauuuuugacagaau

SEQ ID NO: 1588569 - RNA, 14 nt, Human
uauuuuugacagaa

SEQ ID NO: 1588570 - RNA, 13 nt, Human
uauuuuugacaga

SEQ ID NO: 1588571 - RNA, 14 nt, Human
ucaaaaugucuaag

SEQ ID NO: 1588572 - RNA, 17 nt, Human
ucacuaccuucaugcau

SEQ ID NO: 1588573 - RNA, 22 nt, Human
ucacauaucuaguaugaaauua

SEQ ID NO: 1588574 - RNA, 21 nt, Human
ucacauaucuaguaugaaauu

SEQ ID NO: 1588575 - RNA, 17 nt, Human
ucacauaucuaguauga

SEQ ID NO: 1588576 - RNA, 18 nt, Human
acacaacuauuuuuccaa

SEQ ID NO: 1588577 - RNA, 20 nt, Human
uaguaauagagcaaaauuga

SEQ ID NO: 1588578 - RNA, 14 nt, Human
uaguaauagagcaa

SEQ ID NO: 1588579 - RNA, 14 nt, Human
acagauaaucagug

SEQ ID NO: 1588580 - RNA, 16 nt, Human
uaucuuguagcuuuau

SEQ ID NO: 1588581 - RNA, 15 nt, Human
uauauuuaaugauaa

SEQ ID NO: 1588582 - RNA, 16 nt, Human
uauaaguauucuaaau

SEQ ID NO: 1588583 - RNA, 17 nt, Human
acaagaugguucuagca

SEQ ID NO: 1588584 - RNA, 18 nt, Human
acaaugaagauaaaaaga

SEQ ID NO: 1588585 - RNA, 17 nt, Human
aauuuauacaggucaua

SEQ ID NO: 1588586 - RNA, 16 nt, Human
aauuuauacaggucau

SEQ ID NO: 1588587 - RNA, 13 nt, Human
aauaacugugaag

SEQ ID NO: 1588588 - RNA, 17 nt, Human
uaaauuuugaguucuac

SEQ ID NO: 1588589 - RNA, 16 nt, Human
aauaacugugaaguuu

SEQ ID NO: 1588590 - RNA, 14 nt, Human
aauaacugugaagu

SEQ ID NO: 1588591 - RNA, 20 nt, Human
aauaacugugaaguuuacau

SEQ ID NO: 1588592 - RNA, 21 nt, Human
aauaauuuuaagaaaucaaag

SEQ ID NO: 1588593 - RNA, 20 nt, Human
aauauugcuuuggucauaug

SEQ ID NO: 1588594 - RNA, 15 nt, Human
aauaguauuugagag

SEQ ID NO: 1588595 - RNA, 20 nt, Human
uaaauuuugucuuuaacuca

SEQ ID NO: 1588596 - RNA, 19 nt, Human
uaaauuuugaguucuacau

SEQ ID NO: 1588597 - RNA, 18 nt, Human
uaaauuuugaguucuaca

SEQ ID NO: 1588598 - RNA, 12 nt, Human
uaaguucauaca

SEQ ID NO: 1588599 - RNA, 14 nt, Human
uaaguucauacauu

SEQ ID NO: 1588600 - RNA, 13 nt, Human
uaaguucauacau

SEQ ID NO: 1588601 - RNA, 20 nt, Human
uaaguauguguaaaauguga

SEQ ID NO: 1588602 - RNA, 14 nt, Human
uaaugguguuuuaa

SEQ ID NO: 1588603 - RNA, 18 nt, Human
uacauauuuuuguagcac

SEQ ID NO: 1588604 - RNA, 17 nt, Human
uacauauuuuuguagca

SEQ ID NO: 1588605 - RNA, 17 nt, Human
uaauuuauacaggucau

SEQ ID NO: 1588606 - RNA, 13 nt, Human
uaauucaagaaaa

SEQ ID NO: 1588607 - RNA, 12 nt, Human
aaugcuguguua

SEQ ID NO: 1588608 - RNA, 18 nt, Human
guguuuccauauuuuaua

SEQ ID NO: 1588609 - RNA, 19 nt, Human
guucuagcauggcauauuu

SEQ ID NO: 1588610 - RNA, 18 nt, Human
guucuagcauggcauauu

SEQ ID NO: 1588611 - RNA, 14 nt, Human
guuaaguaugugua

SEQ ID NO: 1588612 - RNA, 23 nt, Human
guucauacauauuuuuguagcac

SEQ ID NO: 1588613 - RNA, 14 nt, Human
guucauacauauuu

SEQ ID NO: 1588614 - RNA, 13 nt, Human
guucauacauauu

SEQ ID NO: 1588615 - RNA, 10 nt, Human
guucauacau

SEQ ID NO: 1588616 - RNA, 9 nt, Human
guucauaca

SEQ ID NO: 1588617 - RNA, 14 nt, Human
guucauacauugua

SEQ ID NO: 1588618 - RNA, 11 nt, Human
guucauacauu

SEQ ID NO: 1588619 - RNA, 18 nt, Human
aacaaugaagauaaaaag

SEQ ID NO: 1588620 - RNA, 14 nt, Human
aacaaugaagauaa

SEQ ID NO: 1588621 - RNA, 17 nt, Human
aaccucaaaaugucuaa

SEQ ID NO: 1588622 - RNA, 20 nt, Human
guauuuuugacagaauaugu

SEQ ID NO: 1588623 - RNA, 18 nt, Human
aaauuauauaaguauucu

SEQ ID NO: 1588624 - RNA, 16 nt, Human
aaauuauauaaguauu

SEQ ID NO: 1588625 - RNA, 19 nt, Human
aaauuauuuuguucauaca

SEQ ID NO: 1588626 - RNA, 17 nt, Human
aaauuauuuuguucaua

SEQ ID NO: 1588627 - RNA, 22 nt, Human
aaauuauauaaguauucuaaau

SEQ ID NO: 1588628 - RNA, 21 nt, Human
aaauuauuuuguucauacaua

SEQ ID NO: 1588629 - RNA, 20 nt, Human
aaauuauuuuguucauacau

SEQ ID NO: 1588630 - RNA, 22 nt, Human
aaauuauuuuguucauacauau

SEQ ID NO: 1588631 - RNA, 18 nt, Human
aaagccugcaauuucaua

SEQ ID NO: 1588632 - RNA, 13 nt, Human
aaagccugcaauu

SEQ ID NO: 1588633 - RNA, 23 nt, Human
aaaucucaaauuuggauugcuaa

SEQ ID NO: 1588634 - RNA, 19 nt, Human
aagaguauuuuugacagaa

SEQ ID NO: 1588635 - RNA, 16 nt, Human
aagaguaguaauagag

SEQ ID NO: 1588636 - RNA, 14 nt, Human
aagagagaaaauaa

SEQ ID NO: 1588637 - RNA, 16 nt, Human
aaucucauaauuuaua

SEQ ID NO: 1588638 - RNA, 21 nt, Human
acauaaguaauucaagaaaac

SEQ ID NO: 1588639 - RNA, 18 nt, Human
aauuucauaugcuguaua

SEQ ID NO: 1588640 - RNA, 16 nt, Human
aauuucauaugcugua

SEQ ID NO: 1588641 - RNA, 17 nt, Human
aauuauauaaguauucu

SEQ ID NO: 1588642 - RNA, 16 nt, Human
aauuauauaaguauuc

SEQ ID NO: 1588643 - RNA, 15 nt, Human
aauuauauaaguauu

SEQ ID NO: 1588644 - RNA, 16 nt, Human
acugacagauuuccau

SEQ ID NO: 1588645 - RNA, 23 nt, Human
agcaaaauugauguguuuauuua

SEQ ID NO: 1588646 - RNA, 19 nt, Human
agcaaaauugauguguuua

SEQ ID NO: 1588647 - RNA, 13 nt, Human
agcaaaauugaug

SEQ ID NO: 1588648 - RNA, 19 nt, Human
agaacagauaaucagugug

SEQ ID NO: 1588649 - RNA, 17 nt, Human
auaaguaauucaagaaa

SEQ ID NO: 1588650 - RNA, 15 nt, Human
auaaguaaaugcuag

SEQ ID NO: 1588651 - RNA, 20 nt, Human
aguuguucaauaauaaauau

SEQ ID NO: 1588652 - RNA, 23 nt, Human
auaaaaauauuguguugugaaug

SEQ ID NO: 1588653 - RNA, 14 nt, Human
auaaaaacaacuuu

SEQ ID NO: 1588654 - RNA, 20 nt, Human
auaaaaagacauucuuccaa

SEQ ID NO: 1588655 - RNA, 13 nt, Human
agugaaugaaaca

SEQ ID NO: 1588656 - RNA, 17 nt, Human
augcauagguuuagcag

SEQ ID NO: 1588657 - RNA, 20 nt, Human
aucaaagggugaaaauuauu

SEQ ID NO: 1588658 - RNA, 18 nt, Human
aucaaagagagaaaauaa

SEQ ID NO: 1588659 - RNA, 23 nt, Human
uuuggaacaagaugguucuagca

SEQ ID NO: 1588660 - RNA, 13 nt, Human
uuuguucauacau

SEQ ID NO: 1588661 - RNA, 16 nt, Human
uuuguucauacauauu

SEQ ID NO: 1588662 - RNA, 13 nt, Human
uuuucacauaucu

SEQ ID NO: 1588663 - RNA, 16 nt, Human
uuuucacauaucuagu

SEQ ID NO: 1588664 - RNA, 15 nt, Human
uuuucagaaaauauu

SEQ ID NO: 1588665 - RNA, 16 nt, Human
uuuucagaaaauauua

SEQ ID NO: 1588666 - RNA, 22 nt, Human
uuuucagaaaauauuauguguu

SEQ ID NO: 1588667 - RNA, 14 nt, Human
uuuccaaaauaauu

SEQ ID NO: 1588668 - RNA, 15 nt, Human
uuuacauuguaaaua

SEQ ID NO: 1588669 - RNA, 20 nt, Human
uuuacauuguaaauaguauu

SEQ ID NO: 1588670 - RNA, 13 nt, Human
uuuacauuguaaa

SEQ ID NO: 1588671 - RNA, 20 nt, Human
uuccuucugugaaaguacau

SEQ ID NO: 1588672 - RNA, 17 nt, Human
uuccuucugugaaagua

SEQ ID NO: 1588673 - RNA, 17 nt, Human
uucaucugacuaugaca

SEQ ID NO: 1588674 - RNA, 20 nt, Human
uucaucugacuaugacauaa

SEQ ID NO: 1588675 - RNA, 21 nt, Human
uuccauccuagucacuaccuu

SEQ ID NO: 1588676 - RNA, 15 nt, Human
uugaaucucauaauu

SEQ ID NO: 1588677 - RNA, 21 nt, Human
uugaaucucauaauuuauaca

SEQ ID NO: 1588678 - RNA, 20 nt, Human
ugugaaguuuacauuguaaa

SEQ ID NO: 1588679 - RNA, 16 nt, Human
uguagcacugacagau

SEQ ID NO: 1588680 - RNA, 22 nt, Human
uguagcacugacagauuuccau

SEQ ID NO: 1588681 - RNA, 17 nt, Human
uguagcacugacagauu

SEQ ID NO: 1588682 - RNA, 12 nt, Human
uguuuuaaaaaa

SEQ ID NO: 1588683 - RNA, 15 nt, Human
uggagcaaagcugau

SEQ ID NO: 1588684 - RNA, 16 nt, Human
ugcuagguuaauucca

SEQ ID NO: 1588685 - RNA, 23 nt, Human
ugcuagguuaauuccaauuauau

SEQ ID NO: 1588686 - RNA, 20 nt, Human
uccuucugugaaaguacauu

SEQ ID NO: 1588687 - RNA, 17 nt, Human
ucuaguaugaaauuaua

SEQ ID NO: 1588688 - RNA, 15 nt, Human
ucuaguaugaaauua

SEQ ID NO: 1588689 - RNA, 21 nt, Human
ucucaaauuuggauugcuaau

SEQ ID NO: 1588690 - RNA, 23 nt, Human
ucuaaauuuuauaucuuguagcu

SEQ ID NO: 1588691 - RNA, 18 nt, Human
ucuaaauuuuauaucuug

SEQ ID NO: 1588692 - RNA, 23 nt, Human
ucuaaauuugaauguuaagcaga

SEQ ID NO: 1588693 - RNA, 22 nt, Human
ucuaaauuugaauguuaagcag

SEQ ID NO: 1588694 - RNA, 19 nt, Human
ucuaacaaaaaaauauauu

SEQ ID NO: 1588695 - RNA, 17 nt, Human
ucuaaauuugaauguua

SEQ ID NO: 1588696 - RNA, 13 nt, Human
ucuaaauuugaau

SEQ ID NO: 1588697 - RNA, 19 nt, Human
uauuugagaguucuaaauu

SEQ ID NO: 1588698 - RNA, 18 nt, Human
uauuugagaguucuaaau

SEQ ID NO: 1588699 - RNA, 16 nt, Human
uauuugagaguucuaa

SEQ ID NO: 1588700 - RNA, 15 nt, Human
uauuugagaguucua

SEQ ID NO: 1588701 - RNA, 20 nt, Human
ucagaaaauauuauguguuu

SEQ ID NO: 1588702 - RNA, 19 nt, Human
ucagaaaauauuauguguu

SEQ ID NO: 1588703 - RNA, 17 nt, Human
ucagaaaauauuaugug

SEQ ID NO: 1588704 - RNA, 16 nt, Human
ucauacauuguacgaa

SEQ ID NO: 1588705 - RNA, 15 nt, Human
ucauacauuguacga

SEQ ID NO: 1588706 - RNA, 13 nt, Human
ucauacauuguac

SEQ ID NO: 1588707 - RNA, 15 nt, Human
ucauaauuuauacag

SEQ ID NO: 1588708 - RNA, 13 nt, Human
ucaguuguacagu

SEQ ID NO: 1588709 - RNA, 13 nt, Human
guuuagcaguaua

SEQ ID NO: 1588710 - RNA, 22 nt, Human
uaaauaaaccucaaaaugucua

SEQ ID NO: 1588711 - RNA, 19 nt, Human
uaagaaaucaaagagagaa

SEQ ID NO: 1588712 - RNA, 13 nt, Human
uaacugugaaguu

SEQ ID NO: 1588713 - RNA, 19 nt, Human
uaaugauaaguaaaugcua

SEQ ID NO: 1588714 - RNA, 14 nt, Human
uaauauauuuccau

SEQ ID NO: 1588715 - RNA, 15 nt, Human
uaauaacugugaagu

SEQ ID NO: 1588716 - RNA, 13 nt, Human
uaauuuuaagaaa

SEQ ID NO: 1588717 - RNA, 23 nt, Human
uaauuaaauuuugaguucuacau

SEQ ID NO: 1588718 - RNA, 15 nt, Human
uacauaaguaauuca

SEQ ID NO: 1588719 - RNA, 23 nt, Human
uacauuuggagacacaacuauuu

SEQ ID NO: 1588720 - RNA, 17 nt, Human
uagaacagauaaucagu

SEQ ID NO: 1588721 - RNA, 23 nt, Human
uacgaagaguauuuuugacagaa

SEQ ID NO: 1588722 - RNA, 22 nt, Human
uacgaagaguauuuuugacaga

SEQ ID NO: 1588723 - RNA, 20 nt, Human
uacgaagaguauuuuugaca

SEQ ID NO: 1588724 - RNA, 21 nt, Human
uauaauucagaaggaucuuca

SEQ ID NO: 1588725 - RNA, 16 nt, Human
uauacccagaaaguua

SEQ ID NO: 1588726 - RNA, 18 nt, Human
gcagauggaaugcugugu

SEQ ID NO: 1588727 - RNA, 22 nt, Human
gcagauggaaugcuguguuaaa

SEQ ID NO: 1588728 - RNA, 11 nt, Human
gaguucuacau

SEQ ID NO: 1588729 - RNA, 17 nt, Human
gacauaaaaacaacuuu

SEQ ID NO: 1588730 - RNA, 15 nt, Human
cuuaugauugcagau

SEQ ID NO: 1588731 - RNA, 11 nt, Human
cuuaacuauuc

SEQ ID NO: 1588732 - RNA, 18 nt, Human
cuguuuugaaucucauaa

SEQ ID NO: 1588733 - RNA, 15 nt, Human
cucauaauuuauaca

SEQ ID NO: 1588734 - RNA, 13 nt, Human
cucauaauuuaua

SEQ ID NO: 1588735 - RNA, 22 nt, Human
cucauaauuuauacaggucaua

SEQ ID NO: 1588736 - RNA, 20 nt, Human
cugcaauuucauaugcugua

SEQ ID NO: 1588737 - RNA, 18 nt, Human
cugcaauuucauaugcug

SEQ ID NO: 1588738 - RNA, 20 nt, Human
ccagugaauucuugaaggaa

SEQ ID NO: 1588739 - RNA, 16 nt, Human
ccagugaauucuugaa

SEQ ID NO: 1588740 - RNA, 16 nt, Human
ccaaaggcucucuccu

SEQ ID NO: 1588741 - RNA, 19 nt, Human
acauaauuaaauuuugagu

SEQ ID NO: 1588742 - RNA, 15 nt, Human
acauaaguaauucaa

SEQ ID NO: 1588743 - RNA, 20 nt, Human
acauaaguaauucaagaaaa

SEQ ID NO: 1588744 - RNA, 21 nt, Human
aagacauucuuccaaaaagau

SEQ ID NO: 1588745 - RNA, 13 nt, Human
aagauuuucagaa

SEQ ID NO: 1588746 - RNA, 20 nt, Human
aauaaaccucaaaaugucua

SEQ ID NO: 1588747 - RNA, 14 nt, Human
aauaauaaauauuu

SEQ ID NO: 1588748 - RNA, 17 nt, Human
aauaaaccucaaaaugu

SEQ ID NO: 1588749 - RNA, 20 nt, Human
aaaugcuagguuaauuccaa

SEQ ID NO: 1588750 - RNA, 21 nt, Human
aaauugauguguuuauuuaua

SEQ ID NO: 1588751 - RNA, 14 nt, Human
aaauugauguguuu

SEQ ID NO: 1588752 - RNA, 18 nt, Human
aaaauuauuuuguucaua

SEQ ID NO: 1588753 - RNA, 16 nt, Human
aaaauuauuuuguuca

SEQ ID NO: 1588754 - RNA, 20 nt, Human
aaaauuauuuuguucauaca

SEQ ID NO: 1588755 - RNA, 21 nt, Human
aaaauuauuuuguucauacau

SEQ ID NO: 1588756 - RNA, 22 nt, Human
aaaccucaaaaugucuaagaua

SEQ ID NO: 1588757 - RNA, 17 nt, Human
aaaccucaaaaugucua

SEQ ID NO: 1588758 - RNA, 20 nt, Human
aaauaaaaauauuguguugu

SEQ ID NO: 1588759 - RNA, 19 nt, Human
aaauaaaccucaaaauguc

SEQ ID NO: 1588760 - RNA, 23 nt, Human
agcuaauguaauaacugugaagu

SEQ ID NO: 1588761 - RNA, 21 nt, Human
agcaaagcugaugacaacuuc

SEQ ID NO: 1588762 - RNA, 23 nt, Human
agcaaagcugaugacaacuuccc

SEQ ID NO: 1588763 - RNA, 14 nt, Human
agaugguucuagca

SEQ ID NO: 1588764 - RNA, 22 nt, Human
aguaaaugcuagguuaauucca

SEQ ID NO: 1588765 - RNA, 11 nt, Human
aguaaaugcua

SEQ ID NO: 1588766 - RNA, 23 nt, Human
aguaaaugcuagguuaauuccaa

SEQ ID NO: 1588767 - RNA, 19 nt, Human
aguaacaaugaagauaaaa

SEQ ID NO: 1588768 - RNA, 17 nt, Human
aguauuuuugacagaau

SEQ ID NO: 1588769 - RNA, 16 nt, Human
aguauuuuugacagaa

SEQ ID NO: 1588770 - RNA, 18 nt, Human
aguauuuuugacagaaua

SEQ ID NO: 1588771 - RNA, 13 nt, Human
aguauuuuugaca

SEQ ID NO: 1588772 - RNA, 20 nt, Human
agugaauucuugaaggaaaa

SEQ ID NO: 1588773 - RNA, 20 nt, Human
auaaaaagccugcaauuuca

SEQ ID NO: 1588774 - RNA, 22 nt, Human
auaaaaagccugcaauuucaua

SEQ ID NO: 1588775 - RNA, 17 nt, Human
auacccagaaaguuauu

SEQ ID NO: 1588776 - RNA, 17 nt, Human
auauuauguguuuccau

SEQ ID NO: 1588777 - RNA, 14 nt, Human
aucuaguaugaaau

SEQ ID NO: 1588778 - RNA, 18 nt, Human
aucuaguaugaaauuaua

SEQ ID NO: 1588779 - RNA, 17 nt, Human
aucuaguaugaaauuau

SEQ ID NO: 1588780 - RNA, 16 nt, Human
aucuaguaugaaauua

SEQ ID NO: 1588781 - RNA, 15 nt, Human
aucuaguaugaaauu

SEQ ID NO: 1588782 - RNA, 19 nt, Human
aucuaguaugaaauuauau

SEQ ID NO: 1588783 - RNA, 15 nt, Human
auguguaaaauguga

SEQ ID NO: 1588784 - RNA, 22 nt, Human
cuacauaaguaauucaagaaaa

SEQ ID NO: 1588785 - RNA, 23 nt, Human
cuacauaaguaauucaagaaaac

SEQ ID NO: 1588786 - RNA, 22 nt, Human
ccaauuauaugagacguuuuug

SEQ ID NO: 1588787 - RNA, 19 nt, Human
ccaaaaagauuuucagaaa

SEQ ID NO: 1588788 - RNA, 11 nt, Human
cacugacagau

SEQ ID NO: 1588789 - RNA, 14 nt, Human
auuguaaauaguau

SEQ ID NO: 1588790 - RNA, 22 nt, Human
auugauaaguucauacauugua

SEQ ID NO: 1588791 - RNA, 18 nt, Human
auucuugaaggaaaauga

SEQ ID NO: 1588792 - RNA, 15 nt, Human
auucuugaaggaaaa

SEQ ID NO: 1588793 - RNA, 22 nt, Human
ggaucuucaucugacuaugaca

SEQ ID NO: 1588794 - RNA, 17 nt, Human
ggcauauuuuucacaua

SEQ ID NO: 1588795 - RNA, 15 nt, Human
ggcauauuuuucaca

SEQ ID NO: 1588796 - RNA, 19 nt, Human
aaaaauauauuuaaugaua

SEQ ID NO: 1588797 - RNA, 15 nt, Human
aaaaauauauuuaau

SEQ ID NO: 1588798 - RNA, 13 nt, Human
aaaaauauauuua

SEQ ID NO: 1588799 - RNA, 12 nt, Human
aaaaugugaagu

SEQ ID NO: 1588800 - RNA, 13 nt, Human
aaagauuuucaga

SEQ ID NO: 1588801 - RNA, 14 nt, Human
aaagauuuucagaa

SEQ ID NO: 1588802 - RNA, 23 nt, Human
aaaguuauugauaaguucauaca

SEQ ID NO: 1588803 - RNA, 22 nt, Human
guaaaaugugaagugaaugaaa

SEQ ID NO: 1588804 - RNA, 20 nt, Human
guaaaaugugaagugaauga

SEQ ID NO: 1588805 - RNA, 19 nt, Human
guaaaaugugaagugaaug

SEQ ID NO: 1588806 - RNA, 12 nt, Human
guaaaaugugaa

SEQ ID NO: 1588807 - RNA, 17 nt, Human
guaacaaugaagauaaa

SEQ ID NO: 1588808 - RNA, 12 nt, Human
gcacugacagau

SEQ ID NO: 1588809 - RNA, 17 nt, Human
gcacugacagauuucca

SEQ ID NO: 1588810 - RNA, 16 nt, Human
gacagaauauguuuca

SEQ ID NO: 1588811 - RNA, 13 nt, Human
gacuaugacauaa

SEQ ID NO: 1588812 - RNA, 22 nt, Human
gagacguuuuuggaagaguagu

SEQ ID NO: 1588813 - RNA, 18 nt, Human
cugugaaguuuacauugu

SEQ ID NO: 1588814 - RNA, 20 nt, Human
cuucaugcauagguuuagca

SEQ ID NO: 1588815 - RNA, 21 nt, Human
cuucaucugacuaugacauaa

SEQ ID NO: 1588816 - RNA, 19 nt, Human
cuucaucugacuaugacau

SEQ ID NO: 1588817 - RNA, 20 nt, Human
uugauguguuuauuuauaga

SEQ ID NO: 1588818 - RNA, 11 nt, Human
uugauguguuu

SEQ ID NO: 1588819 - RNA, 17 nt, Human
aucucauaauuuauaca

SEQ ID NO: 1588820 - RNA, 18 nt, Human
aucucauaauuuauacag

SEQ ID NO: 1588821 - RNA, 17 nt, Human
auggaaugcuguguuaa

SEQ ID NO: 1588822 - RNA, 16 nt, Human
auggaaugcuguguua

SEQ ID NO: 1588823 - RNA, 20 nt, Human
uuguguuaaguauguguaaa

SEQ ID NO: 1588824 - RNA, 20 nt, Human
uucuaacaaaaaaauauauu

SEQ ID NO: 1588825 - RNA, 20 nt, Human
auccuagucacuaccuucau

SEQ ID NO: 1588826 - RNA, 17 nt, Human
uuauuuuguucauacau

SEQ ID NO: 1588827 - RNA, 21 nt, Human
uuauuuuguucauacauauuu

SEQ ID NO: 1588828 - RNA, 13 nt, Human
auagucuuucagu

SEQ ID NO: 1588829 - RNA, 15 nt, Human
auauauuuaaugaua

SEQ ID NO: 1588830 - RNA, 13 nt, Human
auauauuuaauga

SEQ ID NO: 1588831 - RNA, 19 nt, Human
uucauacauuguacgaaga

SEQ ID NO: 1588832 - RNA, 13 nt, Human
uucauacauugua

SEQ ID NO: 1588833 - RNA, 23 nt, Human
uucauacauauuuuuguagcacu

SEQ ID NO: 1588834 - RNA, 12 nt, Human
uucauacauauu

SEQ ID NO: 1588835 - RNA, 13 nt, Human
auaucuuguagcu

SEQ ID NO: 1588836 - RNA, 17 nt, Human
auaucuaguaugaaauu

SEQ ID NO: 1588837 - RNA, 15 nt, Human
auaucuaguaugaaa

SEQ ID NO: 1588838 - RNA, 14 nt, Human
auaucuaguaugaa

SEQ ID NO: 1588839 - RNA, 21 nt, Human
auuuggagacacaacuauuuu

SEQ ID NO: 1588840 - RNA, 20 nt, Human
auuuggagacacaacuauuu

SEQ ID NO: 1588841 - RNA, 21 nt, Human
auugcuaaucaccaaaggcuc

SEQ ID NO: 1588842 - RNA, 15 nt, Human
auuaauauauuucca

SEQ ID NO: 1588843 - RNA, 20 nt, Human
auuaaaaaaucaguuguaca

SEQ ID NO: 1588844 - RNA, 15 nt, Human
auguugugauguauu

SEQ ID NO: 1588845 - RNA, 11 nt, Human
uuuuaagaaau

SEQ ID NO: 1588846 - RNA, 19 nt, Human
uuuguagcacugacagauu

SEQ ID NO: 1588847 - RNA, 17 nt, Human
uuuguagcacugacaga

SEQ ID NO: 1588848 - RNA, 13 nt, Human
auaacugugaagu

SEQ ID NO: 1588849 - RNA, 18 nt, Human
auaaauauuuuugccaua

SEQ ID NO: 1588850 - RNA, 14 nt, Human
uuaaguauguguaa

SEQ ID NO: 1588851 - RNA, 13 nt, Human
aguuuacauugua

SEQ ID NO: 1588852 - RNA, 15 nt, Human
aguucuacauaagua

SEQ ID NO: 1588853 - RNA, 20 nt, Human
uguugugauguauucuagcu

SEQ ID NO: 1588854 - RNA, 14 nt, Human
uguugugauguauu

SEQ ID NO: 1588855 - RNA, 13 nt, Human
uguugugaauguu

SEQ ID NO: 1588856 - RNA, 12 nt, Human
uguugugaaugu

SEQ ID NO: 1588857 - RNA, 13 nt, Human
uguguugugaaug

SEQ ID NO: 1588858 - RNA, 16 nt, Human
aguauuugagaguucu

SEQ ID NO: 1588859 - RNA, 14 nt, Human
aguauguguaaaau

SEQ ID NO: 1588860 - RNA, 19 nt, Human
aguagaacagauaaucagu

SEQ ID NO: 1588861 - RNA, 13 nt, Human
aguagaacagaua

SEQ ID NO: 1588862 - RNA, 19 nt, Human
aggucauauuaauauauuu

SEQ ID NO: 1588863 - RNA, 18 nt, Human
aggucauauuaauauauu

SEQ ID NO: 1588864 - RNA, 17 nt, Human
uggcauauuuuucacau

SEQ ID NO: 1588865 - RNA, 16 nt, Human
uggcauauuuuucaca

SEQ ID NO: 1588866 - RNA, 23 nt, Human
agcuuuaucaaagggugaaaauu

SEQ ID NO: 1588867 - RNA, 12 nt, Human
ugauaaguaaau

SEQ ID NO: 1588868 - RNA, 19 nt, Human
ugauacgcaacauaauuaa

SEQ ID NO: 1588869 - RNA, 22 nt, Human
agcauggcauauuuuucacaua

SEQ ID NO: 1588870 - RNA, 21 nt, Human
agcauggcauauuuuucacau

SEQ ID NO: 1588871 - RNA, 19 nt, Human
agcauggcauauuuuucac

SEQ ID NO: 1588872 - RNA, 18 nt, Human
agcauggcauauuuuuca

SEQ ID NO: 1588873 - RNA, 15 nt, Human
agauggaaugcugug

SEQ ID NO: 1588874 - RNA, 13 nt, Human
agauggaaugcug

SEQ ID NO: 1588875 - RNA, 18 nt, Human
agauggaaugcuguguua

SEQ ID NO: 1588876 - RNA, 20 nt, Human
agaguauuuuugacagaaua

SEQ ID NO: 1588877 - RNA, 18 nt, Human
agaguauuuuugacagaa

SEQ ID NO: 1588878 - RNA, 17 nt, Human
agaguauuuuugacaga

SEQ ID NO: 1588879 - RNA, 23 nt, Human
ugaaaguacauuuggagacacaa

SEQ ID NO: 1588880 - RNA, 14 nt, Human
ugaaaguacauuug

SEQ ID NO: 1588881 - RNA, 15 nt, Human
agaguauuuuugaca

SEQ ID NO: 1588882 - RNA, 14 nt, Human
agaguauuuuugac

SEQ ID NO: 1588883 - RNA, 22 nt, Human
ugaaaaagaccuuuggagcaaa

SEQ ID NO: 1588884 - RNA, 14 nt, Human
agagagaaaauaaa

SEQ ID NO: 1588885 - RNA, 19 nt, Human
agacauucuuccaaaaaga

SEQ ID NO: 1588886 - RNA, 15 nt, Human
ucuuuaacucauaaa

SEQ ID NO: 1588887 - RNA, 16 nt, Human
agaaggaucuucaucu

SEQ ID NO: 1588888 - RNA, 15 nt, Human
acuuuggaacaagau

SEQ ID NO: 1588889 - RNA, 21 nt, Human
ucuaagauaguaacaaugaag

SEQ ID NO: 1588890 - RNA, 22 nt, Human
acuucccuuucugcuuguguua

SEQ ID NO: 1588891 - RNA, 17 nt, Human
acuucccagugaauucu

SEQ ID NO: 1588892 - RNA, 18 nt, Human
ucuagcauggcauauuuu

SEQ ID NO: 1588893 - RNA, 17 nt, Human
ucuagcauggcauauuu

SEQ ID NO: 1588894 - RNA, 18 nt, Human
accaaauaaaaauauugu

SEQ ID NO: 1588895 - RNA, 16 nt, Human
accaaauaaaaauauu

SEQ ID NO: 1588896 - RNA, 21 nt, Human
acauuguaaauaguauuugag

SEQ ID NO: 1588897 - RNA, 19 nt, Human
acauuguaaauaguauuug

SEQ ID NO: 1588898 - RNA, 17 nt, Human
acauuguaaauaguauu

SEQ ID NO: 1588899 - RNA, 19 nt, Human
acauuguacgaagaguauu

SEQ ID NO: 1588900 - RNA, 19 nt, Human
uauuuuuguagcacugaca

SEQ ID NO: 1588901 - RNA, 15 nt, Human
uauuuuuguagcacu

SEQ ID NO: 1588902 - RNA, 13 nt, Human
uauuuuuguagca

SEQ ID NO: 1588903 - RNA, 13 nt, Human
uauuuuucacaua

SEQ ID NO: 1588904 - RNA, 12 nt, Human
uauuuuucacau

SEQ ID NO: 1588905 - RNA, 16 nt, Human
uauuuuguucauacau

SEQ ID NO: 1588906 - RNA, 15 nt, Human
uauuuuguucauaca

SEQ ID NO: 1588907 - RNA, 17 nt, Human
uauguguaaaaugugaa

SEQ ID NO: 1588908 - RNA, 14 nt, Human
uauguguaaaaugu

SEQ ID NO: 1588909 - RNA, 14 nt, Human
acucagaauauugc

SEQ ID NO: 1588910 - RNA, 13 nt, Human
acugaaacuuccc

SEQ ID NO: 1588911 - RNA, 20 nt, Human
acgaagaguauuuuugacag

SEQ ID NO: 1588912 - RNA, 22 nt, Human
acgaagaguauuuuugacagaa

SEQ ID NO: 1588913 - RNA, 19 nt, Human
uccaaaaagauuuucagaa

SEQ ID NO: 1588914 - RNA, 20 nt, Human
uccaaaaagauuuucagaaa

SEQ ID NO: 1588915 - RNA, 17 nt, Human
aauuccaauuauaugag

SEQ ID NO: 1588916 - RNA, 16 nt, Human
aauuuggauugcuaau

SEQ ID NO: 1588917 - RNA, 19 nt, Human
uagcacugacagauuucca

SEQ ID NO: 1588918 - RNA, 14 nt, Human
uagcacugacagau

SEQ ID NO: 1588919 - RNA, 18 nt, Human
uaggcaaccuuuauuuuu

SEQ ID NO: 1588920 - RNA, 21 nt, Human
uauacaggucauauuaauaua

SEQ ID NO: 1588921 - RNA, 16 nt, Human
uauacaggucauauua

SEQ ID NO: 1588922 - RNA, 15 nt, Human
uauacaggucauauu

SEQ ID NO: 1588923 - RNA, 16 nt, Human
acacucaguuguucaa

SEQ ID NO: 1588924 - RNA, 20 nt, Human
uauauccuuucuaacaaaaa

SEQ ID NO: 1588925 - RNA, 19 nt, Human
uaucaaagggugaaaauua

SEQ ID NO: 1588926 - RNA, 18 nt, Human
uaucaaagggugaaaauu

SEQ ID NO: 1588927 - RNA, 22 nt, Human
uaucaaagggugaaaauuauuu

SEQ ID NO: 1588928 - RNA, 21 nt, Human
aauucagaaggaucuucaucu

SEQ ID NO: 1588929 - RNA, 20 nt, Human
aauucaagaaaacaacuuca

SEQ ID NO: 1588930 - RNA, 12 nt, Human
aauucaagaaaa

SEQ ID NO: 1588931 - RNA, 20 nt, Human
aaugacucagaauauugcuu

SEQ ID NO: 1588932 - RNA, 16 nt, Human
uaauuuauacagguca

SEQ ID NO: 1588933 - RNA, 14 nt, Human
aaucagugugucua

SEQ ID NO: 1588934 - RNA, 16 nt, Human
uaaguaauucaagaaa

SEQ ID NO: 1588935 - RNA, 22 nt, Human
aaucagugugucuaaauuugaa

SEQ ID NO: 1588936 - RNA, 18 nt, Human
aaucagugugucuaaauu

SEQ ID NO: 1588937 - RNA, 17 nt, Human
aaucagugugucuaaau

SEQ ID NO: 1588938 - RNA, 17 nt, Human
uaacaaugaagauaaaa

SEQ ID NO: 1588939 - RNA, 22 nt, Human
aauagagcaaaauugauguguu

SEQ ID NO: 1588940 - RNA, 20 nt, Human
aauagagcaaaauugaugug

SEQ ID NO: 1588941 - RNA, 14 nt, Human
aauauauuuaauga

SEQ ID NO: 1588942 - RNA, 22 nt, Human
aagccugcaauuucauaugcug

SEQ ID NO: 1588943 - RNA, 17 nt, Human
aagccugcaauuucaua

SEQ ID NO: 1588944 - RNA, 18 nt, Human
guuauugauaaguucaua

SEQ ID NO: 1588945 - RNA, 21 nt, Human
aagaccuuuggagcaaagcug

SEQ ID NO: 1588946 - RNA, 23 nt, Human
aagaccuugcuuaugauugcaga

SEQ ID NO: 1588947 - RNA, 12 nt, Human
guuucaaacuuu

SEQ ID NO: 1588948 - RNA, 16 nt, Human
aagggugaaaauuauu

SEQ ID NO: 1588949 - RNA, 15 nt, Human
aagggugaaaauuau

SEQ ID NO: 1588950 - RNA, 15 nt, Human
guauuuuugacagaa

SEQ ID NO: 1588951 - RNA, 12 nt, Human
guauuuuugaca

SEQ ID NO: 1588952 - RNA, 16 nt, Human
guauuuuugacagaau

SEQ ID NO: 1588953 - RNA, 13 nt, Human
aacagauaaucag

SEQ ID NO: 1588954 - RNA, 19 nt, Human
aacaagaugguucuagcau

SEQ ID NO: 1588955 - RNA, 18 nt, Human
aacuucccagugaauucu

SEQ ID NO: 1588956 - RNA, 19 nt, Human
caauaauaaauauuuuugc

SEQ ID NO: 1588957 - RNA, 22 nt, Human
caaaauaauuuuaagaaaucaa

SEQ ID NO: 1588958 - RNA, 18 nt, Human
caaaauaauuuuaagaaa

SEQ ID NO: 1588959 - RNA, 18 nt, Human
caaauaaaaauauugugu

SEQ ID NO: 1588960 - RNA, 16 nt, Human
caaauaaaaauauugu

SEQ ID NO: 1588961 - RNA, 19 nt, Human
caaagagagaaaauaaaga

SEQ ID NO: 1588962 - RNA, 16 nt, Human
caaagagagaaaauaa

SEQ ID NO: 1588963 - RNA, 13 nt, Human
uuacauuguaaau

SEQ ID NO: 1588964 - RNA, 12 nt, Human
uuacauuguaaa

SEQ ID NO: 1588965 - RNA, 16 nt, Human
uuaaugauaaguaaau

SEQ ID NO: 1588966 - RNA, 17 nt, Human
uuaaugauaaguaaaug

SEQ ID NO: 1588967 - RNA, 19 nt, Human
uguuuccauauuuuauagg

SEQ ID NO: 1588968 - RNA, 23 nt, Human
uguucauacauauuuuuguagca

SEQ ID NO: 1588969 - RNA, 14 nt, Human
uguucauacauauu

SEQ ID NO: 1588970 - RNA, 12 nt, Human
uguucauacaua

SEQ ID NO: 1588971 - RNA, 21 nt, Human
ugugaauguugugauguauuc

SEQ ID NO: 1588972 - RNA, 14 nt, Human
ugugaaguuuacau

SEQ ID NO: 1588973 - RNA, 18 nt, Human
ugugaagugaaugaaaca

SEQ ID NO: 1588974 - RNA, 14 nt, Human
uguacgaagaguau

SEQ ID NO: 1588975 - RNA, 22 nt, Human
uguacgaagaguauuuuugaca

SEQ ID NO: 1588976 - RNA, 16 nt, Human
uggaaugcuguguuaa

SEQ ID NO: 1588977 - RNA, 22 nt, Human
ucucauaauuuauacaggucau

SEQ ID NO: 1588978 - RNA, 16 nt, Human
ucucauaauuuauaca

SEQ ID NO: 1588979 - RNA, 19 nt, Human
ucagugugucuaaauuuga

SEQ ID NO: 1588980 - RNA, 22 nt, Human
ucaggagaguagaacagauaau

SEQ ID NO: 1588981 - RNA, 23 nt, Human
ucucauaauuuauacaggucaua

SEQ ID NO: 1588982 - RNA, 19 nt, Human
ugaaaauuauuuuguucau

SEQ ID NO: 1588983 - RNA, 23 nt, Human
ugaaaauuauuuuguucauacau

SEQ ID NO: 1588984 - RNA, 22 nt, Human
ugaaaauuauuuuguucauaca

SEQ ID NO: 1588985 - RNA, 23 nt, Human
ugaaacacucaguuguucaauaa

SEQ ID NO: 1588986 - RNA, 18 nt, Human
ucuuguagcuuuaucaaa

SEQ ID NO: 1588987 - RNA, 19 nt, Human
ucuugaaggaaaaugauac

SEQ ID NO: 1588988 - RNA, 23 nt, Human
ugacagaauauguuucaaacuuu

SEQ ID NO: 1588989 - RNA, 22 nt, Human
ugacagaauauguuucaaacuu

SEQ ID NO: 1588990 - RNA, 21 nt, Human
ugacagaauauguuucaaacu

SEQ ID NO: 1588991 - RNA, 22 nt, Human
ugacaacuucccagugaauucu

SEQ ID NO: 1588992 - RNA, 20 nt, Human
ugaaguuuacauuguaaaua

SEQ ID NO: 1588993 - RNA, 16 nt, Human
ugaaguuuacauugua

SEQ ID NO: 1588994 - RNA, 14 nt, Human
ugaaguuuacauug

SEQ ID NO: 1588995 - RNA, 20 nt, Human
ugaaucucauaauuuauaca

SEQ ID NO: 1588996 - RNA, 13 nt, Human
ugaaucucauaau

SEQ ID NO: 1588997 - RNA, 15 nt, Human
ugaaggaaaaugaua

SEQ ID NO: 1588998 - RNA, 13 nt, Human
uacuuaacuauuc

SEQ ID NO: 1588999 - RNA, 14 nt, Human
uacccagaaaguua

SEQ ID NO: 1589000 - RNA, 18 nt, Human
uagcauggcauauuuuuc

SEQ ID NO: 1589001 - RNA, 17 nt, Human
uagcauggcauauuuuu

SEQ ID NO: 1589002 - RNA, 15 nt, Human
uagcauggcauauuu

SEQ ID NO: 1589003 - RNA, 21 nt, Human
uagcauggcauauuuuucaca

SEQ ID NO: 1589004 - RNA, 22 nt, Human
uagguuaauuccaauuauauga

SEQ ID NO: 1589005 - RNA, 18 nt, Human
uauauaaguauucuaaau

SEQ ID NO: 1589006 - RNA, 14 nt, Human
uauaucuuguagcu

SEQ ID NO: 1589007 - RNA, 21 nt, Human
uaauaacugugaaguuuacau

SEQ ID NO: 1589008 - RNA, 19 nt, Human
uaauaaauauuuuugccau

SEQ ID NO: 1589009 - RNA, 18 nt, Human
uaacugugaaguuuacau

SEQ ID NO: 1589010 - RNA, 17 nt, Human
uaacugugaaguuuaca

SEQ ID NO: 1589011 - RNA, 14 nt, Human
uaaauuugaauguu

SEQ ID NO: 1589012 - RNA, 22 nt, Human
uaaauuugaauguuaagcagau

SEQ ID NO: 1589013 - RNA, 19 nt, Human
uaaaaagccugcaauuuca

SEQ ID NO: 1589014 - RNA, 21 nt, Human
uaaaaagacauucuuccaaaa

SEQ ID NO: 1589015 - RNA, 19 nt, Human
uaaaaacaacuuuauaccc

SEQ ID NO: 1589016 - RNA, 18 nt, Human
uaaaaacaacuuuauacc

SEQ ID NO: 1589017 - RNA, 13 nt, Human
uaaaaacaacuuu

SEQ ID NO: 1589018 - RNA, 14 nt, Human
guugugaauguugu

SEQ ID NO: 1589019 - RNA, 18 nt, Human
guucaauaauaaauauuu

SEQ ID NO: 1589020 - RNA, 15 nt, Human
guguacuuaacuauu

SEQ ID NO: 1589021 - RNA, 18 nt, Human
gugaauucuugaaggaaa

SEQ ID NO: 1589022 - RNA, 22 nt, Human
gugaauucuugaaggaaaauga

SEQ ID NO: 1589023 - RNA, 13 nt, Human
gucuaaauuugaa

SEQ ID NO: 1589024 - RNA, 21 nt, Human
gucuaagauaguaacaaugaa

SEQ ID NO: 1589025 - RNA, 23 nt, Human
gucuaagauaguaacaaugaaga

SEQ ID NO: 1589026 - RNA, 23 nt, Human
guaugaaauuauauaaguauucu

SEQ ID NO: 1589027 - RNA, 13 nt, Human
guaugaaauuaua

SEQ ID NO: 1589028 - RNA, 15 nt, Human
guagcacugacagau

SEQ ID NO: 1589029 - RNA, 14 nt, Human
guagcacugacaga

SEQ ID NO: 1589030 - RNA, 20 nt, Human
uuugaaucucauaauuuaua

SEQ ID NO: 1589031 - RNA, 19 nt, Human
uuugaaucucauaauuuau

SEQ ID NO: 1589032 - RNA, 16 nt, Human
uuugaaucucauaauu

SEQ ID NO: 1589033 - RNA, 22 nt, Human
uuugaaucucauaauuuauaca

SEQ ID NO: 1589034 - RNA, 21 nt, Human
uuugaaucucauaauuuauac

SEQ ID NO: 1589035 - RNA, 11 nt, Human
uuuugacagaa

SEQ ID NO: 1589036 - RNA, 20 nt, Human
uuuugaaucucauaauuuau

SEQ ID NO: 1589037 - RNA, 18 nt, Human
uuuuguagcacugacaga

SEQ ID NO: 1589038 - RNA, 19 nt, Human
uuuuguagcacugacagau

SEQ ID NO: 1589039 - RNA, 15 nt, Human
gccugcaauuucaua

SEQ ID NO: 1589040 - RNA, 14 nt, Human
gauagucuuucagu

SEQ ID NO: 1589041 - RNA, 15 nt, Human
gauaguaacaaugaa

SEQ ID NO: 1589042 - RNA, 22 nt, Human
gauagucuuucaguuaaggaga

SEQ ID NO: 1589043 - RNA, 16 nt, Human
gauaaguucauacauu

SEQ ID NO: 1589044 - RNA, 14 nt, Human
gauaaguucauaca

SEQ ID NO: 1589045 - RNA, 12 nt, Human
gauaaguucaua

SEQ ID NO: 1589046 - RNA, 17 nt, Human
gaugacaacuucccagu

SEQ ID NO: 1589047 - RNA, 19 nt, Human
gcauauuuuucacauaucu

SEQ ID NO: 1589048 - RNA, 16 nt, Human
gcauauuuuucacaua

SEQ ID NO: 1589049 - RNA, 15 nt, Human
gcauauuuuucacau

SEQ ID NO: 1589050 - RNA, 14 nt, Human
gcauauuuuucaca

SEQ ID NO: 1589051 - RNA, 20 nt, Human
gcauauuuuucacauaucua

SEQ ID NO: 1589052 - RNA, 23 nt, Human
gaaauuauauaaguauucuaaau

SEQ ID NO: 1589053 - RNA, 17 nt, Human
gaaauuauauaaguauu

SEQ ID NO: 1589054 - RNA, 18 nt, Human
gaacagauaaucagugug

SEQ ID NO: 1589055 - RNA, 23 nt, Human
gaaaguuauugauaaguucauac

SEQ ID NO: 1589056 - RNA, 20 nt, Human
gaagaguauuuuugacagaa

SEQ ID NO: 1589057 - RNA, 16 nt, Human
cuuuggaacaagaugg

SEQ ID NO: 1589058 - RNA, 15 nt, Human
cugacagauuuccau

SEQ ID NO: 1589059 - RNA, 11 nt, Human
cugacagauuu

SEQ ID NO: 1589060 - RNA, 15 nt, Human
cugacuaugacauaa

SEQ ID NO: 1589061 - RNA, 21 nt, Human
cucuccugauagucuuucagu

SEQ ID NO: 1589062 - RNA, 23 nt, Human
cuaaauuugaauguuaagcagau

SEQ ID NO: 1589063 - RNA, 21 nt, Human
cuaugacauaaaaacaacuuu

SEQ ID NO: 1589064 - RNA, 18 nt, Human
cuaugacauaaaaacaac

SEQ ID NO: 1589065 - RNA, 16 nt, Human
cuaguaugaaauuaua

SEQ ID NO: 1589066 - RNA, 19 nt, Human
cuaauguaauaacugugaa

SEQ ID NO: 1589067 - RNA, 14 nt, Human
cagugugucuaaau

SEQ ID NO: 1589068 - RNA, 23 nt, Human
cagugugucuaaauuugaauguu

SEQ ID NO: 1589069 - RNA, 15 nt, Human
cauaaaaacaacuuu

SEQ ID NO: 1589070 - RNA, 23 nt, Human
cauaaaaacaacuuuauacccag

SEQ ID NO: 1589071 - RNA, 21 nt, Human
cauaaaaacaacuuuauaccc

SEQ ID NO: 1589072 - RNA, 20 nt, Human
cauaaaaacaacuuuauacc

SEQ ID NO: 1589073 - RNA, 17 nt, Human
cauaaaaacaacuuuau

SEQ ID NO: 1589074 - RNA, 23 nt, Human
cauaaaaagccugcaauuucaua

SEQ ID NO: 1589075 - RNA, 22 nt, Human
cauaaguaauucaagaaaacaa

SEQ ID NO: 1589076 - RNA, 18 nt, Human
cauaaguaauucaagaaa

SEQ ID NO: 1589077 - RNA, 17 nt, Human
cauaaguaauucaagaa

SEQ ID NO: 1589078 - RNA, 16 nt, Human
cauaaguaauucaaga

SEQ ID NO: 1589079 - RNA, 19 nt, Human
cauacauauuuuuguagca

SEQ ID NO: 1589080 - RNA, 12 nt, Human
cauacauauuuu

SEQ ID NO: 1589081 - RNA, 15 nt, Human
cauacauuguacgaa

SEQ ID NO: 1589082 - RNA, 18 nt, Human
cauauuuuucacauaucu

SEQ ID NO: 1589083 - RNA, 21 nt, Human
cauauuuuucacauaucuagu

SEQ ID NO: 1589084 - RNA, 14 nt, Human
cauauuuuucacau

SEQ ID NO: 1589085 - RNA, 13 nt, Human
cugaaacuucccu

SEQ ID NO: 1589086 - RNA, 23 nt, Human
cgccacuguuuugaaucucauaa

SEQ ID NO: 1589087 - RNA, 23 nt, Human
cauaugcuguauauccuuucuaa

SEQ ID NO: 1589088 - RNA, 19 nt, Human
cauauuaauauauuuccau

SEQ ID NO: 1589089 - RNA, 15 nt, Human
cauauuaauauauuu

SEQ ID NO: 1589090 - RNA, 14 nt, Human
cauauuaauauauu

SEQ ID NO: 1589091 - RNA, 12 nt, Human
cagaauauguuu

SEQ ID NO: 1589092 - RNA, 17 nt, Human
cagaauauguuucaaac

SEQ ID NO: 1589093 - RNA, 15 nt, Human
cagaauauguuucaa

SEQ ID NO: 1589094 - RNA, 14 nt, Human
cagaauauguuuca

SEQ ID NO: 1589095 - RNA, 13 nt, Human
cagaauauguuuc

SEQ ID NO: 1589096 - RNA, 20 nt, Human
cagaauauguuucaaacuuu

SEQ ID NO: 1589097 - RNA, 18 nt, Human
cagaauauguuucaaacu

SEQ ID NO: 1589098 - RNA, 13 nt, Human
cagaauauugcuu

SEQ ID NO: 1589099 - RNA, 18 nt, Human
caaaaaaauauauuuaau

SEQ ID NO: 1589100 - RNA, 22 nt, Human
auuuaaugauaaguaaaugcua

SEQ ID NO: 1589101 - RNA, 19 nt, Human
auuuauacaggucauauua

SEQ ID NO: 1589102 - RNA, 22 nt, Human
auucaagaaaacaacuucaaua

SEQ ID NO: 1589103 - RNA, 18 nt, Human
auuaaauuuugaguucua

SEQ ID NO: 1589104 - RNA, 20 nt, Human
auuaaauuuugaguucuaca

SEQ ID NO: 1589105 - RNA, 19 nt, Human
gaaaucaaagagagaaaau

SEQ ID NO: 1589106 - RNA, 16 nt, Human
gaacaagaugguucua

SEQ ID NO: 1589107 - RNA, 23 nt, Human
cugugaaguuuacauuguaaaua

SEQ ID NO: 1589108 - RNA, 22 nt, Human
gaauauugcuuuggucauauga

SEQ ID NO: 1589109 - RNA, 17 nt, Human
gcaaaauugauguguuu

SEQ ID NO: 1589110 - RNA, 23 nt, Human
ggaucuucaucugacuaugacau

SEQ ID NO: 1589111 - RNA, 23 nt, Human
aaaaagauuuucagaaaauauua

SEQ ID NO: 1589112 - RNA, 20 nt, Human
aaaaagccugcaauuucaua

SEQ ID NO: 1589113 - RNA, 20 nt, Human
gguucuagcauggcauauuu

SEQ ID NO: 1589114 - RNA, 17 nt, Human
gguguuuuaaaaaaucu

SEQ ID NO: 1589115 - RNA, 15 nt, Human
guaauagagcaaaau

SEQ ID NO: 1589116 - RNA, 19 nt, Human
guaauagagcaaaauugau

SEQ ID NO: 1589117 - RNA, 20 nt, Human
aaauauuguguugugaaugu

SEQ ID NO: 1589118 - RNA, 15 nt, Human
aaauauauuuaauga

SEQ ID NO: 1589119 - RNA, 14 nt, Human
aaauauauuuaaug

SEQ ID NO: 1589120 - RNA, 21 nt, Human
aaacuucccuuucugcuugug

SEQ ID NO: 1589121 - RNA, 18 nt, Human
ggucauauuaauauauuu

SEQ ID NO: 1589122 - RNA, 16 nt, Human
aaaauauauuuaauga

SEQ ID NO: 1589123 - RNA, 17 nt, Human
uuuuguucauacauauu

SEQ ID NO: 1589124 - RNA, 14 nt, Human
uuuuguucauacau

SEQ ID NO: 1589125 - RNA, 14 nt, Human
uuuugaguucuaca

SEQ ID NO: 1589126 - RNA, 17 nt, Human
auuauauaaguauucua

SEQ ID NO: 1589127 - RNA, 14 nt, Human
auuauauaaguauu

SEQ ID NO: 1589128 - RNA, 20 nt, Human
auuauauaaguauucuaaau

SEQ ID NO: 1589129 - RNA, 17 nt, Human
uuuuuguagcacugaca

SEQ ID NO: 1589130 - RNA, 15 nt, Human
uuuuccaaaauaauu

SEQ ID NO: 1589131 - RNA, 14 nt, Human
auucuaaauuuuau

SEQ ID NO: 1589132 - RNA, 17 nt, Human
auuuucagaaaauauua

SEQ ID NO: 1589133 - RNA, 14 nt, Human
auuuucagaaaaua

SEQ ID NO: 1589134 - RNA, 19 nt, Human
augacauaaaaacaacuuu

SEQ ID NO: 1589135 - RNA, 19 nt, Human
augcuguauauccuuucua

SEQ ID NO: 1589136 - RNA, 22 nt, Human
uuucagaaaauauuauguguuu

SEQ ID NO: 1589137 - RNA, 15 nt, Human
uuucauaugcuguau

SEQ ID NO: 1589138 - RNA, 16 nt, Human
auauauuuaaugauaa

SEQ ID NO: 1589139 - RNA, 13 nt, Human
uucauaugcugua

SEQ ID NO: 1589140 - RNA, 21 nt, Human
auaugagcuuccuucugugaa

SEQ ID NO: 1589141 - RNA, 22 nt, Human
auaugagcuuccuucugugaaa

SEQ ID NO: 1589142 - RNA, 23 nt, Human
auauuuuuguagcacugacagau

SEQ ID NO: 1589143 - RNA, 16 nt, Human
auauuuuuguagcacu

SEQ ID NO: 1589144 - RNA, 15 nt, Human
auauuuuuguagcac

SEQ ID NO: 1589145 - RNA, 18 nt, Human
auauuuuucacauaucua

SEQ ID NO: 1589146 - RNA, 17 nt, Human
uucccagugaauucuug

SEQ ID NO: 1589147 - RNA, 17 nt, Human
auauguuucaaacuuug

SEQ ID NO: 1589148 - RNA, 16 nt, Human
auauguuucaaacuuu

SEQ ID NO: 1589149 - RNA, 14 nt, Human
auauguuucaaacu

SEQ ID NO: 1589150 - RNA, 13 nt, Human
auauguuucaaac

SEQ ID NO: 1589151 - RNA, 23 nt, Human
auauuuaaugauaaguaaaugcu

SEQ ID NO: 1589152 - RNA, 13 nt, Human
auauuuaaugaua

SEQ ID NO: 1589153 - RNA, 12 nt, Human
auauuuaaugau

SEQ ID NO: 1589154 - RNA, 14 nt, Human
uugagaguucuaaa

SEQ ID NO: 1589155 - RNA, 16 nt, Human
uugauaaguucauaca

SEQ ID NO: 1589156 - RNA, 17 nt, Human
uugauaaguucauacau

SEQ ID NO: 1589157 - RNA, 17 nt, Human
uugaaggaaaaugauac

SEQ ID NO: 1589158 - RNA, 23 nt, Human
aucagugugucuaaauuugaaug

SEQ ID NO: 1589159 - RNA, 15 nt, Human
aguucuaaauuuugu

SEQ ID NO: 1589160 - RNA, 22 nt, Human
aguuauugauaaguucauacau

SEQ ID NO: 1589161 - RNA, 21 nt, Human
aguuauugauaaguucauaca

SEQ ID NO: 1589162 - RNA, 19 nt, Human
aguuauugauaaguucaua

SEQ ID NO: 1589163 - RNA, 17 nt, Human
aguuauugauaaguuca

SEQ ID NO: 1589164 - RNA, 23 nt, Human
aguuauugauaaguucauacauu

SEQ ID NO: 1589165 - RNA, 22 nt, Human
auacauuguacgaagaguauuu

SEQ ID NO: 1589166 - RNA, 21 nt, Human
auacauuguacgaagaguauu

SEQ ID NO: 1589167 - RNA, 14 nt, Human
auacauuguacgaa

SEQ ID NO: 1589168 - RNA, 19 nt, Human
auacauauuuuuguagcac

SEQ ID NO: 1589169 - RNA, 21 nt, Human
auacaggucauauuaauauau

SEQ ID NO: 1589170 - RNA, 15 nt, Human
auacaggucauauua

SEQ ID NO: 1589171 - RNA, 22 nt, Human
uuaucaaagggugaaaauuauu

SEQ ID NO: 1589172 - RNA, 21 nt, Human
auaauuuuaagaaaucaaaga

SEQ ID NO: 1589173 - RNA, 15 nt, Human
auaauuuuaagaaau

SEQ ID NO: 1589174 - RNA, 16 nt, Human
uuauauaaguauucua

SEQ ID NO: 1589175 - RNA, 14 nt, Human
uuauauaaguauuc

SEQ ID NO: 1589176 - RNA, 13 nt, Human
uuauauaaguauu

SEQ ID NO: 1589177 - RNA, 19 nt, Human
uuauacccagaaaguuauu

SEQ ID NO: 1589178 - RNA, 18 nt, Human
uuauacccagaaaguuau

SEQ ID NO: 1589179 - RNA, 23 nt, Human
uuauacccagaaaguuauugaua

SEQ ID NO: 1589180 - RNA, 23 nt, Human
uuauagaguguacuuaacuauuc

SEQ ID NO: 1589181 - RNA, 16 nt, Human
auaaaccucaaaaugu

SEQ ID NO: 1589182 - RNA, 12 nt, Human
auaacugugaag

SEQ ID NO: 1589183 - RNA, 20 nt, Human
auaaucagugugucuaaauu

SEQ ID NO: 1589184 - RNA, 15 nt, Human
auaaguucauacauu

SEQ ID NO: 1589185 - RNA, 14 nt, Human
auaaguucauacau

SEQ ID NO: 1589186 - RNA, 13 nt, Human
auaaguucauaca

SEQ ID NO: 1589187 - RNA, 11 nt, Human
auaaguucaua

SEQ ID NO: 1589188 - RNA, 21 nt, Human
auaaguucauacauuguacga

SEQ ID NO: 1589189 - RNA, 15 nt, Human
agggugaaaauuauu

SEQ ID NO: 1589190 - RNA, 16 nt, Human
aggucauauuaauaua

SEQ ID NO: 1589191 - RNA, 15 nt, Human
uguacuuaacuauuc

SEQ ID NO: 1589192 - RNA, 18 nt, Human
ugucuaaauuugaauguu

SEQ ID NO: 1589193 - RNA, 15 nt, Human
ugucuaagauaguaa

SEQ ID NO: 1589194 - RNA, 14 nt, Human
ugucuaagauagua

SEQ ID NO: 1589195 - RNA, 14 nt, Human
ugacuaugacauaa

SEQ ID NO: 1589196 - RNA, 23 nt, Human
acuuaacuauucaggagaguaga

SEQ ID NO: 1589197 - RNA, 14 nt, Human
acuucccuuucugc

SEQ ID NO: 1589198 - RNA, 23 nt, Human
ucuagcauggcauauuuuucaca

SEQ ID NO: 1589199 - RNA, 22 nt, Human
ucuagcauggcauauuuuucac

SEQ ID NO: 1589200 - RNA, 21 nt, Human
ucuagcauggcauauuuuuca

SEQ ID NO: 1589201 - RNA, 16 nt, Human
ucugugaaaguacauu

SEQ ID NO: 1589202 - RNA, 14 nt, Human
ucugcuuguguuaa

SEQ ID NO: 1589203 - RNA, 21 nt, Human
agaauauguuucaaacuuugg

SEQ ID NO: 1589204 - RNA, 19 nt, Human
agaauauguuucaaacuuu

SEQ ID NO: 1589205 - RNA, 18 nt, Human
agaauauguuucaaacuu

SEQ ID NO: 1589206 - RNA, 17 nt, Human
agaauauguuucaaacu

SEQ ID NO: 1589207 - RNA, 13 nt, Human
agaauauguuuca

SEQ ID NO: 1589208 - RNA, 18 nt, Human
accuuuggagcaaagcug

SEQ ID NO: 1589209 - RNA, 22 nt, Human
ucauaaaaagccugcaauuuca

SEQ ID NO: 1589210 - RNA, 16 nt, Human
accucaaaaugucuaa

SEQ ID NO: 1589211 - RNA, 14 nt, Human
accccugcuucuga

SEQ ID NO: 1589212 - RNA, 17 nt, Human
ucaagaaaacaacuuca

SEQ ID NO: 1589213 - RNA, 18 nt, Human
ucaauauccaaaccaaau

SEQ ID NO: 1589214 - RNA, 19 nt, Human
acauucuuccaaaaagauu

SEQ ID NO: 1589215 - RNA, 14 nt, Human
ucacauaucuagua

SEQ ID NO: 1589216 - RNA, 22 nt, Human
uaagcagauggaaugcuguguu

SEQ ID NO: 1589217 - RNA, 18 nt, Human
aauauuguguugugaaug

SEQ ID NO: 1589218 - RNA, 17 nt, Human
aauauuguguugugaau

SEQ ID NO: 1589219 - RNA, 23 nt, Human
aauaguauuugagaguucuaaau

SEQ ID NO: 1589220 - RNA, 22 nt, Human
aauaguauuugagaguucuaaa

SEQ ID NO: 1589221 - RNA, 20 nt, Human
aauaguauuugagaguucua

SEQ ID NO: 1589222 - RNA, 16 nt, Human
uaaguauucuaaauuu

SEQ ID NO: 1589223 - RNA, 13 nt, Human
uaaguaaaugcua

SEQ ID NO: 1589224 - RNA, 21 nt, Human
uaauagagcaaaauugaugug

SEQ ID NO: 1589225 - RNA, 12 nt, Human
uaauagagcaaa

SEQ ID NO: 1589226 - RNA, 19 nt, Human
aaugaaacacucaguuguu

SEQ ID NO: 1589227 - RNA, 20 nt, Human
aauuauuuuguucauacaua

SEQ ID NO: 1589228 - RNA, 19 nt, Human
aauuauuuuguucauacau

SEQ ID NO: 1589229 - RNA, 18 nt, Human
aauuauuuuguucauaca

SEQ ID NO: 1589230 - RNA, 16 nt, Human
aauuauuuuguucaua

SEQ ID NO: 1589231 - RNA, 22 nt, Human
aauuauuuuguucauacauauu

SEQ ID NO: 1589232 - RNA, 21 nt, Human
aauuauuuuguucauacauau

SEQ ID NO: 1589233 - RNA, 15 nt, Human
aauucagaaggaucu

SEQ ID NO: 1589234 - RNA, 19 nt, Human
uacauuguacgaagaguau

SEQ ID NO: 1589235 - RNA, 14 nt, Human
aauugauguguuua

SEQ ID NO: 1589236 - RNA, 13 nt, Human
aauugauguguuu

SEQ ID NO: 1589237 - RNA, 13 nt, Human
aaugcuguguuaa

SEQ ID NO: 1589238 - RNA, 13 nt, Human
aauguuaagcaga

SEQ ID NO: 1589239 - RNA, 17 nt, Human
uacauuguaaauaguau

SEQ ID NO: 1589240 - RNA, 23 nt, Human
uacaggucauauuaauauauuuc

SEQ ID NO: 1589241 - RNA, 19 nt, Human
uauccaaaccaaauaaaaa

SEQ ID NO: 1589242 - RNA, 20 nt, Human
acagauuuccauccuaguca

SEQ ID NO: 1589243 - RNA, 19 nt, Human
uaugaaauuauauaaguau

SEQ ID NO: 1589244 - RNA, 19 nt, Human
uagcuaauguaauaacugu

SEQ ID NO: 1589245 - RNA, 12 nt, Human
uagcuaauguaa

SEQ ID NO: 1589246 - RNA, 22 nt, Human
uagcauggcauauuuuucacau

SEQ ID NO: 1589247 - RNA, 21 nt, Human
uagagcaaaauugauguguuu

SEQ ID NO: 1589248 - RNA, 14 nt, Human
uagagcaaaauuga

SEQ ID NO: 1589249 - RNA, 22 nt, Human
uagagcaaaauugauguguuua

SEQ ID NO: 1589250 - RNA, 14 nt, Human
aagaaaacaacuuc

SEQ ID NO: 1589251 - RNA, 19 nt, Human
aacugugaaguuuacauug

SEQ ID NO: 1589252 - RNA, 17 nt, Human
aacugugaaguuuacau

SEQ ID NO: 1589253 - RNA, 14 nt, Human
gugaaguuuacauu

SEQ ID NO: 1589254 - RNA, 23 nt, Human
aacuauucaggagaguagaacag

SEQ ID NO: 1589255 - RNA, 19 nt, Human
guauucuagcuaauguaau

SEQ ID NO: 1589256 - RNA, 24 nt, Human
guauucuaaauuuuauaucuugua

SEQ ID NO: 1589257 - RNA, 21 nt, Human
guauucuaaauuuuauaucuu

SEQ ID NO: 1589258 - RNA, 22 nt, Human
uaaaaauauuguguugugaaug

SEQ ID NO: 1589259 - RNA, 21 nt, Human
uaaaaauauuguguugugaau

SEQ ID NO: 1589260 - RNA, 22 nt, Human
uaaaaagccugcaauuucauau

SEQ ID NO: 1589261 - RNA, 14 nt, Human
uaaaaauauugugu

SEQ ID NO: 1589262 - RNA, 11 nt, Human
uaaaaugugaa

SEQ ID NO: 1589263 - RNA, 13 nt, Human
uaaaaugugaagu

SEQ ID NO: 1589264 - RNA, 12 nt, Human
aaggaaaaugau

SEQ ID NO: 1589265 - RNA, 19 nt, Human
aaguauguguaaaauguga

SEQ ID NO: 1589266 - RNA, 22 nt, Human
guucuagcauggcauauuuuuc

SEQ ID NO: 1589267 - RNA, 19 nt, Human
guuaauuccaauuauauga

SEQ ID NO: 1589268 - RNA, 22 nt, Human
guuauugauaaguucauacauu

SEQ ID NO: 1589269 - RNA, 21 nt, Human
guuauugauaaguucauacau

SEQ ID NO: 1589270 - RNA, 15 nt, Human
guguaaaaugugaag

SEQ ID NO: 1589271 - RNA, 12 nt, Human
aaaaacaacuuu

SEQ ID NO: 1589272 - RNA, 12 nt, Human
aaaacaacuuua

SEQ ID NO: 1589273 - RNA, 19 nt, Human
agcuuccuucugugaaagu

SEQ ID NO: 1589274 - RNA, 22 nt, Human
agguuaauuccaauuauaugag

SEQ ID NO: 1589275 - RNA, 15 nt, Human
agguuaauuccaauu

SEQ ID NO: 1589276 - RNA, 14 nt, Human
agacacaacuauuu

SEQ ID NO: 1589277 - RNA, 13 nt, Human
auccuuucuaaca

SEQ ID NO: 1589278 - RNA, 14 nt, Human
augacucagaauau

SEQ ID NO: 1589279 - RNA, 20 nt, Human
augaaacacucaguuguuca

SEQ ID NO: 1589280 - RNA, 17 nt, Human
auguaauaacugugaag

SEQ ID NO: 1589281 - RNA, 22 nt, Human
auauaaguauucuaaauuuuau

SEQ ID NO: 1589282 - RNA, 16 nt, Human
auauccuuucuaacaa

SEQ ID NO: 1589283 - RNA, 15 nt, Human
auauccuuucuaaca

SEQ ID NO: 1589284 - RNA, 19 nt, Human
acaggucauauuaauauau

SEQ ID NO: 1589285 - RNA, 21 nt, Human
acagaauauguuucaaacuuu

SEQ ID NO: 1589286 - RNA, 19 nt, Human
acagaauauguuucaaacu

SEQ ID NO: 1589287 - RNA, 17 nt, Human
acagaauauguuucaaa

SEQ ID NO: 1589288 - RNA, 16 nt, Human
acagaauauguuucaa

SEQ ID NO: 1589289 - RNA, 20 nt, Human
aauuuugaguucuacauaag

SEQ ID NO: 1589290 - RNA, 15 nt, Human
aauuuuauaucuugu

SEQ ID NO: 1589291 - RNA, 16 nt, Human
acaacuauuuuuccaa

SEQ ID NO: 1589292 - RNA, 18 nt, Human
acaacuucccagugaauu

SEQ ID NO: 1589293 - RNA, 17 nt, Human
acaacuucaauauccaa

SEQ ID NO: 1589294 - RNA, 14 nt, Human
acaacuuuauaccc

SEQ ID NO: 1589295 - RNA, 13 nt, Human
acaacuuuauacc

SEQ ID NO: 1589296 - RNA, 19 nt, Human
acuuuauacccagaaaguu

SEQ ID NO: 1589297 - RNA, 23 nt, Human
agaaaauauuauguguuuccaua

SEQ ID NO: 1589298 - RNA, 12 nt, Human
acuguuuugaau

SEQ ID NO: 1589299 - RNA, 21 nt, Human
acucauaaaaagccugcaauu

SEQ ID NO: 1589300 - RNA, 16 nt, Human
aacuuuggaacaagau

SEQ ID NO: 1589301 - RNA, 14 nt, Human
aaauaguauuugag

SEQ ID NO: 1589302 - RNA, 18 nt, Human
aaguauguguaaaaugug

SEQ ID NO: 1589303 - RNA, 14 nt, Human
aauauuauguguuu

SEQ ID NO: 1589304 - RNA, 18 nt, Human
aaucucauaauuuauaca

SEQ ID NO: 1589305 - RNA, 21 nt, Human
aaugauaaguaaaugcuaggu

SEQ ID NO: 1589306 - RNA, 18 nt, Human
aaugauaaguaaaugcua

SEQ ID NO: 1589307 - RNA, 22 nt, Human
aauuaaauuuugaguucuacau

SEQ ID NO: 1589308 - RNA, 14 nt, Human
aauuaaauuuugag

SEQ ID NO: 1589309 - RNA, 16 nt, Human
caaaauugauguguuu

SEQ ID NO: 1589310 - RNA, 15 nt, Human
caaaauugauguguu

SEQ ID NO: 1589311 - RNA, 22 nt, Human
caaaauugauguguuuauuuau

SEQ ID NO: 1589312 - RNA, 19 nt, Human
caaagcugaugacaacuuc

SEQ ID NO: 1589313 - RNA, 15 nt, Human
caagaaaacaacuuc

SEQ ID NO: 1589314 - RNA, 18 nt, Human
caagaaaacaacuucaau

SEQ ID NO: 1589315 - RNA, 15 nt, Human
uuauaucuuguagcu

SEQ ID NO: 1589316 - RNA, 22 nt, Human
uuauaucuuguagcuuuaucaa

SEQ ID NO: 1589317 - RNA, 22 nt, Human
uuauacaggucauauuaauaua

SEQ ID NO: 1589318 - RNA, 14 nt, Human
uuauacaggucaua

SEQ ID NO: 1589319 - RNA, 21 nt, Human
uuccaaaaagauuuucagaaa

SEQ ID NO: 1589320 - RNA, 16 nt, Human
uuauuuuguucauaca

SEQ ID NO: 1589321 - RNA, 14 nt, Human
uuauuuuguucaua

SEQ ID NO: 1589322 - RNA, 16 nt, Human
uucaauaauaaauauu

SEQ ID NO: 1589323 - RNA, 18 nt, Human
uucugcuuguguuaagua

SEQ ID NO: 1589324 - RNA, 17 nt, Human
uucuuccaaaaagauuu

SEQ ID NO: 1589325 - RNA, 22 nt, Human
uucuacauaaguaauucaagaa

SEQ ID NO: 1589326 - RNA, 17 nt, Human
uuguaaauaguauuuga

SEQ ID NO: 1589327 - RNA, 23 nt, Human
uuguacgaagaguauuuuugaca

SEQ ID NO: 1589328 - RNA, 21 nt, Human
uuguacgaagaguauuuuuga

SEQ ID NO: 1589329 - RNA, 13 nt, Human
uuguguugugaau

SEQ ID NO: 1589330 - RNA, 22 nt, Human
uuuugacagaauauguuucaaa

SEQ ID NO: 1589331 - RNA, 23 nt, Human
uuuugacagaauauguuucaaac

SEQ ID NO: 1589332 - RNA, 12 nt, Human
uuugaguucuac

SEQ ID NO: 1589333 - RNA, 23 nt, Human
uuuucagaaaauauuauguguuu

SEQ ID NO: 1589334 - RNA, 20 nt, Human
ugcaauuucauaugcuguau

SEQ ID NO: 1589335 - RNA, 14 nt, Human
ugcaauuucauaug

SEQ ID NO: 1589336 - RNA, 21 nt, Human
ugauguauucuagcuaaugua

SEQ ID NO: 1589337 - RNA, 20 nt, Human
ugauguauucuagcuaaugu

SEQ ID NO: 1589338 - RNA, 14 nt, Human
ugauguauucuagc

SEQ ID NO: 1589339 - RNA, 13 nt, Human
ugauguauucuag

SEQ ID NO: 1589340 - RNA, 17 nt, Human
uggagacacaacuauuu

SEQ ID NO: 1589341 - RNA, 15 nt, Human
ugcuuguguuaagua

SEQ ID NO: 1589342 - RNA, 12 nt, Human
ugcuuguguuaa

SEQ ID NO: 1589343 - RNA, 15 nt, Human
uguagcuuuaucaaa

SEQ ID NO: 1589344 - RNA, 14 nt, Human
uguagcuuuaucaa

SEQ ID NO: 1589345 - RNA, 20 nt, Human
uguaaaaugugaagugaaug

SEQ ID NO: 1589346 - RNA, 22 nt, Human
uguaauaacugugaaguuuaca

SEQ ID NO: 1589347 - RNA, 14 nt, Human
uguaauaacuguga

SEQ ID NO: 1589348 - RNA, 19 nt, Human
ucuucaucugacuaugaca

SEQ ID NO: 1589349 - RNA, 14 nt, Human
uauucuaaauuuua

SEQ ID NO: 1589350 - RNA, 19 nt, Human
uauucuagcuaauguaaua

SEQ ID NO: 1589351 - RNA, 19 nt, Human
uauucuaaauuuuauaucu

SEQ ID NO: 1589352 - RNA, 15 nt, Human
uauucuaaauuuuau

SEQ ID NO: 1589353 - RNA, 20 nt, Human
uauucuaaauuuuauaucuu

SEQ ID NO: 1589354 - RNA, 12 nt, Human
uauuaauauauu

SEQ ID NO: 1589355 - RNA, 16 nt, Human
uauguuucaaacuuug

SEQ ID NO: 1589356 - RNA, 15 nt, Human
uauguuucaaacuuu

SEQ ID NO: 1589357 - RNA, 13 nt, Human
uauguuucaaacu

SEQ ID NO: 1589358 - RNA, 15 nt, Human
uccaaaauaauuuua

SEQ ID NO: 1589359 - RNA, 19 nt, Human
uccaaaauaauuuuaagaa

SEQ ID NO: 1589360 - RNA, 18 nt, Human
ucaucugacuaugacaua

SEQ ID NO: 1589361 - RNA, 17 nt, Human
ucaucugacuaugacau

SEQ ID NO: 1589362 - RNA, 12 nt, Human
gcuuguguuaag

SEQ ID NO: 1589363 - RNA, 18 nt, Human
gcuguguuaaauaaaccu

SEQ ID NO: 1589364 - RNA, 17 nt, Human
gaguauuuuugacagaa

SEQ ID NO: 1589365 - RNA, 16 nt, Human
gaguauuuuugacaga

SEQ ID NO: 1589366 - RNA, 14 nt, Human
gaguauuuuugaca

SEQ ID NO: 1589367 - RNA, 18 nt, Human
gaguauuuuugacagaau

SEQ ID NO: 1589368 - RNA, 21 nt, Human
gauaaucagugugucuaaauu

SEQ ID NO: 1589369 - RNA, 16 nt, Human
gaucuucaucugacua

SEQ ID NO: 1589370 - RNA, 23 nt, Human
gaucuucaucugacuaugacaua

SEQ ID NO: 1589371 - RNA, 13 nt, Human
gagcaaagcugau

SEQ ID NO: 1589372 - RNA, 18 nt, Human
gaaucucauaauuuauac

SEQ ID NO: 1589373 - RNA, 17 nt, Human
gaaguuuacauuguaaa

SEQ ID NO: 1589374 - RNA, 16 nt, Human
gaaguuuacauuguaa

SEQ ID NO: 1589375 - RNA, 14 nt, Human
gaaggaaaaugaua

SEQ ID NO: 1589376 - RNA, 17 nt, Human
gaaaauauuauguguuu

SEQ ID NO: 1589377 - RNA, 19 nt, Human
cuuguguuaaguaugugua

SEQ ID NO: 1589378 - RNA, 18 nt, Human
cugugaaaguacauuugg

SEQ ID NO: 1589379 - RNA, 15 nt, Human
ccuucugugaaagua

SEQ ID NO: 1589380 - RNA, 21 nt, Human
cgaagaguauuuuugacagaa

SEQ ID NO: 1589381 - RNA, 23 nt, Human
cgaagaguauuuuugacagaaua

SEQ ID NO: 1589382 - RNA, 19 nt, Human
ccugcaauuucauaugcug

SEQ ID NO: 1589383 - RNA, 19 nt, Human
cauuguacgaagaguauuu

SEQ ID NO: 1589384 - RNA, 20 nt, Human
cauuguacgaagaguauuuu

SEQ ID NO: 1589385 - RNA, 13 nt, Human
cauggcauauuuu

SEQ ID NO: 1589386 - RNA, 19 nt, Human
cauggcauauuuuucacau

SEQ ID NO: 1589387 - RNA, 15 nt, Human
cauggcauauuuuuc

SEQ ID NO: 1589388 - RNA, 23 nt, Human
cauggcauauuuuucacauaucu

SEQ ID NO: 1589389 - RNA, 21 nt, Human
cauuaaaaaaucaguuguaca

SEQ ID NO: 1589390 - RNA, 18 nt, Human
cauaucuaguaugaaauu

SEQ ID NO: 1589391 - RNA, 17 nt, Human
cauaucuaguaugaaau

SEQ ID NO: 1589392 - RNA, 15 nt, Human
cauaucuaguaugaa

SEQ ID NO: 1589393 - RNA, 21 nt, Human
cauaucuaguaugaaauuaua

SEQ ID NO: 1589394 - RNA, 17 nt, Human
caucugacuaugacaua

SEQ ID NO: 1589395 - RNA, 12 nt, Human
caggagaguaga

SEQ ID NO: 1589396 - RNA, 12 nt, Human
cagugaauucuu

SEQ ID NO: 1589397 - RNA, 21 nt, Human
caggucauauuaauauauuuc

SEQ ID NO: 1589398 - RNA, 20 nt, Human
caggucauauuaauauauuu

SEQ ID NO: 1589399 - RNA, 21 nt, Human
cagauggaaugcuguguuaaa

SEQ ID NO: 1589400 - RNA, 19 nt, Human
cagauggaaugcuguguua

SEQ ID NO: 1589401 - RNA, 17 nt, Human
cagauggaaugcugugu

SEQ ID NO: 1589402 - RNA, 16 nt, Human
cagauggaaugcugug

SEQ ID NO: 1589403 - RNA, 17 nt, Human
cagaaggaucuucaucu

SEQ ID NO: 1589404 - RNA, 19 nt, Human
cagaaaauauuauguguuu

SEQ ID NO: 1589405 - RNA, 14 nt, Human
cagauaaucagugu

SEQ ID NO: 1589406 - RNA, 22 nt, Human
cacugacagauuuccauccuag

SEQ ID NO: 1589407 - RNA, 17 nt, Human
cacugacagauuuccau

SEQ ID NO: 1589408 - RNA, 13 nt, Human
cacugacagauuu

SEQ ID NO: 1589409 - RNA, 11 nt, Human
aguucauacau

SEQ ID NO: 1589410 - RNA, 10 nt, Human
aguucauaca

SEQ ID NO: 1589411 - RNA, 15 nt, Human
aguucauacauugua

SEQ ID NO: 1589412 - RNA, 16 nt, Human
aguaugaaauuauaua

SEQ ID NO: 1589413 - RNA, 14 nt, Human
aguaugaaauuaua

SEQ ID NO: 1589414 - RNA, 14 nt, Human
auaaaaauauugug

SEQ ID NO: 1589415 - RNA, 22 nt, Human
auaaaaauauuguguugugaau

SEQ ID NO: 1589416 - RNA, 20 nt, Human
auaauuaaauuuugaguucu

SEQ ID NO: 1589417 - RNA, 13 nt, Human
auauuauguguuu

SEQ ID NO: 1589418 - RNA, 21 nt, Human
auaguauuugagaguucuaaa

SEQ ID NO: 1589419 - RNA, 20 nt, Human
auaguauuugagaguucuaa

SEQ ID NO: 1589420 - RNA, 23 nt, Human
auaguauuugagaguucuaaauu

SEQ ID NO: 1589421 - RNA, 21 nt, Human
augcauagguuuagcaguaua

SEQ ID NO: 1589422 - RNA, 13 nt, Human
auguuucaaacuu

SEQ ID NO: 1589423 - RNA, 12 nt, Human
auguuucaaacu

SEQ ID NO: 1589424 - RNA, 17 nt, Human
auguuucaaacuuugga

SEQ ID NO: 1589425 - RNA, 14 nt, Human
auguuucaaacuuu

SEQ ID NO: 1589426 - RNA, 19 nt, Human
auguauucuagcuaaugua

SEQ ID NO: 1589427 - RNA, 20 nt, Human
auguauucuagcuaauguaa

SEQ ID NO: 1589428 - RNA, 18 nt, Human
agcacugacagauuucca

SEQ ID NO: 1589429 - RNA, 14 nt, Human
agcacugacagauu

SEQ ID NO: 1589430 - RNA, 13 nt, Human
agcacugacagau

SEQ ID NO: 1589431 - RNA, 15 nt, Human
aaucaccaaaggcuc

SEQ ID NO: 1589432 - RNA, 17 nt, Human
aauauguuucaaacuuu

SEQ ID NO: 1589433 - RNA, 16 nt, Human
aauauguuucaaacuu

SEQ ID NO: 1589434 - RNA, 15 nt, Human
aauauguuucaaacu

SEQ ID NO: 1589435 - RNA, 13 nt, Human
aauauguuucaaa

SEQ ID NO: 1589436 - RNA, 19 nt, Human
aaugcuagguuaauuccaa

SEQ ID NO: 1589437 - RNA, 18 nt, Human
aaugcuagguuaauucca

SEQ ID NO: 1589438 - RNA, 21 nt, Human
aaugcuagguuaauuccaauu

SEQ ID NO: 1589439 - RNA, 20 nt, Human
aagcagauggaaugcugugu

SEQ ID NO: 1589440 - RNA, 19 nt, Human
aagcagauggaaugcugug

SEQ ID NO: 1589441 - RNA, 17 nt, Human
aagcagauggaaugcug

SEQ ID NO: 1589442 - RNA, 23 nt, Human
aacuuuauacccagaaaguuauu

SEQ ID NO: 1589443 - RNA, 22 nt, Human
aacuuuauacccagaaaguuau

SEQ ID NO: 1589444 - RNA, 21 nt, Human
aaaauugauguguuuauuuau

SEQ ID NO: 1589445 - RNA, 14 nt, Human
aaaauugauguguu

SEQ ID NO: 1589446 - RNA, 12 nt, Human
aaaauugaugug

SEQ ID NO: 1589447 - RNA, 24 nt, Human
aaacacucaguuguucaauaauaa

SEQ ID NO: 1589448 - RNA, 17 nt, Human
aaaaucaguuguacagu

SEQ ID NO: 1589449 - RNA, 11 nt, Human
agaaaguuauu

SEQ ID NO: 1589450 - RNA, 23 nt, Human
agaaaguuauugauaaguucaua

SEQ ID NO: 1589451 - RNA, 22 nt, Human
acuuuauacccagaaaguuauu

SEQ ID NO: 1589452 - RNA, 20 nt, Human
acuuuauacccagaaaguua

SEQ ID NO: 1589453 - RNA, 22 nt, Human
acugugaaguuuacauuguaaa

SEQ ID NO: 1589454 - RNA, 22 nt, Human
acuauucaggagaguagaacag

SEQ ID NO: 1589455 - RNA, 12 nt, Human
cucagaauauug

SEQ ID NO: 1589456 - RNA, 16 nt, Human
cagaaaguuauugaua

SEQ ID NO: 1589457 - RNA, 11 nt, Human
cagaaaguuau

SEQ ID NO: 1589458 - RNA, 22 nt, Human
cacuguuuugaaucucauaauu

SEQ ID NO: 1589459 - RNA, 15 nt, Human
caaaccaaauaaaaa

SEQ ID NO: 1589460 - RNA, 14 nt, Human
caaaccaaauaaaa

SEQ ID NO: 1589461 - RNA, 12 nt, Human
auuuuauaucuu

SEQ ID NO: 1589462 - RNA, 16 nt, Human
auuuuauaucuuguag

SEQ ID NO: 1589463 - RNA, 14 nt, Human
auuuuauaucuugu

SEQ ID NO: 1589464 - RNA, 18 nt, Human
caaagggugaaaauuauu

SEQ ID NO: 1589465 - RNA, 16 nt, Human
caagaugguucuagca

SEQ ID NO: 1589466 - RNA, 13 nt, Human
caagaugguucua

SEQ ID NO: 1589467 - RNA, 16 nt, Human
auuucauaugcuguau

SEQ ID NO: 1589468 - RNA, 17 nt, Human
auuguguugugaauguu

SEQ ID NO: 1589469 - RNA, 14 nt, Human
auuguguugugaau

SEQ ID NO: 1589470 - RNA, 20 nt, Human
cauaauuuauacaggucaua

SEQ ID NO: 1589471 - RNA, 13 nt, Human
cauaauuuauaca

SEQ ID NO: 1589472 - RNA, 19 nt, Human
cauuguaaauaguauuuga

SEQ ID NO: 1589473 - RNA, 21 nt, Human
cauuuggagacacaacuauuu

SEQ ID NO: 1589474 - RNA, 21 nt, Human
aaaagauuuucagaaaauauu

SEQ ID NO: 1589475 - RNA, 14 nt, Human
aaauauuauguguu

SEQ ID NO: 1589476 - RNA, 15 nt, Human
aaauauuauguguuu

SEQ ID NO: 1589477 - RNA, 15 nt, Human
guacauuuggagaca

SEQ ID NO: 1589478 - RNA, 14 nt, Human
guacuuaacuauuc

SEQ ID NO: 1589479 - RNA, 20 nt, Human
aaaguuauugauaaguucau

SEQ ID NO: 1589480 - RNA, 14 nt, Human
aaauaaaaauauug

SEQ ID NO: 1589481 - RNA, 22 nt, Human
guaauaacugugaaguuuacau

SEQ ID NO: 1589482 - RNA, 16 nt, Human
guaauaacugugaagu

SEQ ID NO: 1589483 - RNA, 15 nt, Human
guaauaacugugaag

SEQ ID NO: 1589484 - RNA, 22 nt, Human
aaagaccuuuggagcaaagcug

SEQ ID NO: 1589485 - RNA, 17 nt, Human
aaagggugaaaauuauu

SEQ ID NO: 1589486 - RNA, 22 nt, Human
ggugaaaauuauuuuguucaua

SEQ ID NO: 1589487 - RNA, 14 nt, Human
ggugaaaauuauuu

SEQ ID NO: 1589488 - RNA, 18 nt, Human
gcauggcauauuuuucac

SEQ ID NO: 1589489 - RNA, 22 nt, Human
gaaaauuauuuuguucauacau

SEQ ID NO: 1589490 - RNA, 21 nt, Human
gaaaauuauuuuguucauaca

SEQ ID NO: 1589491 - RNA, 20 nt, Human
gaaaauuauuuuguucauac

SEQ ID NO: 1589492 - RNA, 23 nt, Human
gaaaauuauuuuguucauacaua

SEQ ID NO: 1589493 - RNA, 16 nt, Human
auuguacgaagaguau

SEQ ID NO: 1589494 - RNA, 17 nt, Human
auuguacgaagaguauu

SEQ ID NO: 1589495 - RNA, 14 nt, Human
auugcuuuggucau

SEQ ID NO: 1589496 - RNA, 18 nt, Human
auugcuuuggucauauga

SEQ ID NO: 1589497 - RNA, 18 nt, Human
auuuuguucauacauauu

SEQ ID NO: 1589498 - RNA, 16 nt, Human
auuuuguucauacaua

SEQ ID NO: 1589499 - RNA, 15 nt, Human
auuuuguucauacau

SEQ ID NO: 1589500 - RNA, 14 nt, Human
auuuuguucauaca

SEQ ID NO: 1589501 - RNA, 12 nt, Human
auuuuguucaua

SEQ ID NO: 1589502 - RNA, 21 nt, Human
auuuuucacauaucuaguaug

SEQ ID NO: 1589503 - RNA, 18 nt, Human
auuuuucacauaucuagu

SEQ ID NO: 1589504 - RNA, 15 nt, Human
auuuuucacauaucu

SEQ ID NO: 1589505 - RNA, 15 nt, Human
auuuuuccaaaauaa

SEQ ID NO: 1589506 - RNA, 15 nt, Human
auuuuugacagaaua

SEQ ID NO: 1589507 - RNA, 14 nt, Human
auuuuugacagaau

SEQ ID NO: 1589508 - RNA, 13 nt, Human
auuuuugacagaa

SEQ ID NO: 1589509 - RNA, 12 nt, Human
auuuuugacaga

SEQ ID NO: 1589510 - RNA, 22 nt, Human
auuuuugacagaauauguuuca

SEQ ID NO: 1589511 - RNA, 20 nt, Human
auuuuuguagcacugacaga

SEQ ID NO: 1589512 - RNA, 21 nt, Human
auuuuuguagcacugacagau

SEQ ID NO: 1589513 - RNA, 18 nt, Human
auucuagcuaauguaaua

SEQ ID NO: 1589514 - RNA, 15 nt, Human
auucuagcuaaugua

SEQ ID NO: 1589515 - RNA, 16 nt, Human
auuauuuuguucauac

SEQ ID NO: 1589516 - RNA, 15 nt, Human
auuauuuuguucaua

SEQ ID NO: 1589517 - RNA, 21 nt, Human
auuauuuuguucauacauauu

SEQ ID NO: 1589518 - RNA, 19 nt, Human
auuauuuuguucauacaua

SEQ ID NO: 1589519 - RNA, 18 nt, Human
auuauuuuguucauacau

SEQ ID NO: 1589520 - RNA, 17 nt, Human
auuauuuuguucauaca

SEQ ID NO: 1589521 - RNA, 24 nt, Human
auucagaaggaucuucaucugacu

SEQ ID NO: 1589522 - RNA, 18 nt, Human
auucagaaggaucuucau

SEQ ID NO: 1589523 - RNA, 22 nt, Human
uuugacagaauauguuucaaac

SEQ ID NO: 1589524 - RNA, 17 nt, Human
augauaaguaaaugcua

SEQ ID NO: 1589525 - RNA, 23 nt, Human
auggcauauuuuucacauaucua

SEQ ID NO: 1589526 - RNA, 22 nt, Human
auggcauauuuuucacauaucu

SEQ ID NO: 1589527 - RNA, 21 nt, Human
auggcauauuuuucacauauc

SEQ ID NO: 1589528 - RNA, 20 nt, Human
auggcauauuuuucacauau

SEQ ID NO: 1589529 - RNA, 18 nt, Human
auggcauauuuuucacau

SEQ ID NO: 1589530 - RNA, 14 nt, Human
uuucaaacuuugga

SEQ ID NO: 1589531 - RNA, 18 nt, Human
augcuagguuaauuccaa

SEQ ID NO: 1589532 - RNA, 21 nt, Human
uuuaucaaagggugaaaauua

SEQ ID NO: 1589533 - RNA, 17 nt, Human
auauuuuucacauaucu

SEQ ID NO: 1589534 - RNA, 15 nt, Human
auauuuuucacauau

SEQ ID NO: 1589535 - RNA, 14 nt, Human
auauuuuucacaua

SEQ ID NO: 1589536 - RNA, 13 nt, Human
auauuuuucacau

SEQ ID NO: 1589537 - RNA, 12 nt, Human
auauuuuucaca

SEQ ID NO: 1589538 - RNA, 19 nt, Human
uucuaacaaaaaaauauau

SEQ ID NO: 1589539 - RNA, 14 nt, Human
uucuaaauuuuaua

SEQ ID NO: 1589540 - RNA, 21 nt, Human
uucuagcauggcauauuuuuc

SEQ ID NO: 1589541 - RNA, 20 nt, Human
uucuagcauggcauauuuuu

SEQ ID NO: 1589542 - RNA, 18 nt, Human
uucuagcauggcauauuu

SEQ ID NO: 1589543 - RNA, 15 nt, Human
uucuagcauggcaua

SEQ ID NO: 1589544 - RNA, 14 nt, Human
uucuagcauggcau

SEQ ID NO: 1589545 - RNA, 22 nt, Human
uucuagcauggcauauuuuuca

SEQ ID NO: 1589546 - RNA, 17 nt, Human
uucuagcuaauguaaua

SEQ ID NO: 1589547 - RNA, 17 nt, Human
uugacagaauauguuuc

SEQ ID NO: 1589548 - RNA, 20 nt, Human
uugacagaauauguuucaaa

SEQ ID NO: 1589549 - RNA, 20 nt, Human
uuggagacacaacuauuuuu

SEQ ID NO: 1589550 - RNA, 21 nt, Human
augaaauuauauaaguauucu

SEQ ID NO: 1589551 - RNA, 19 nt, Human
augaaauuauauaaguauu

SEQ ID NO: 1589552 - RNA, 20 nt, Human
aucuuguagcuuuaucaaag

SEQ ID NO: 1589553 - RNA, 19 nt, Human
aucuuguagcuuuaucaaa

SEQ ID NO: 1589554 - RNA, 18 nt, Human
aucuuguagcuuuaucaa

SEQ ID NO: 1589555 - RNA, 17 nt, Human
auaauucagaaggaucu

SEQ ID NO: 1589556 - RNA, 21 nt, Human
auaauuuauacaggucauauu

SEQ ID NO: 1589557 - RNA, 19 nt, Human
auaauuuauacaggucaua

SEQ ID NO: 1589558 - RNA, 14 nt, Human
auaauuuuaagaaa

SEQ ID NO: 1589559 - RNA, 17 nt, Human
aguuuacauuguaaaua

SEQ ID NO: 1589560 - RNA, 15 nt, Human
aguuuacauuguaaa

SEQ ID NO: 1589561 - RNA, 20 nt, Human
uuaaauuuugaguucuacau

SEQ ID NO: 1589562 - RNA, 15 nt, Human
uuaaauuuugaguuc

SEQ ID NO: 1589563 - RNA, 23 nt, Human
auacgcaacauaauuaaauuuug

SEQ ID NO: 1589564 - RNA, 22 nt, Human
auagagcaaaauugauguguuu

SEQ ID NO: 1589565 - RNA, 21 nt, Human
auagagcaaaauugauguguu

SEQ ID NO: 1589566 - RNA, 17 nt, Human
auagagcaaaauugaug

SEQ ID NO: 1589567 - RNA, 15 nt, Human
auagagcaaaauuga

SEQ ID NO: 1589568 - RNA, 21 nt, Human
auagaguguacuuaacuauuc

SEQ ID NO: 1589569 - RNA, 19 nt, Human
auagaguguacuuaacuau

SEQ ID NO: 1589570 - RNA, 14 nt, Human
auagaguguacuua

SEQ ID NO: 1589571 - RNA, 22 nt, Human
ugugucuaaauuugaauguuaa

SEQ ID NO: 1589572 - RNA, 19 nt, Human
ugugucuaaauuugaaugu

SEQ ID NO: 1589573 - RNA, 14 nt, Human
uguguaaaauguga

SEQ ID NO: 1589574 - RNA, 23 nt, Human
uguuaagcagauggaaugcugug

SEQ ID NO: 1589575 - RNA, 19 nt, Human
aguacauuuggagacacaa

SEQ ID NO: 1589576 - RNA, 19 nt, Human
aguaauucaagaaaacaac

SEQ ID NO: 1589577 - RNA, 13 nt, Human
aguaauagagcaa

SEQ ID NO: 1589578 - RNA, 18 nt, Human
uguauauccuuucuaaca

SEQ ID NO: 1589579 - RNA, 21 nt, Human
agccugcaauuucauaugcug

SEQ ID NO: 1589580 - RNA, 19 nt, Human
agccugcaauuucauaugc

SEQ ID NO: 1589581 - RNA, 19 nt, Human
agauaaucagugugucuaa

SEQ ID NO: 1589582 - RNA, 12 nt, Human
agauuuucagaa

SEQ ID NO: 1589583 - RNA, 17 nt, Human
agauuuucagaaaauau

SEQ ID NO: 1589584 - RNA, 21 nt, Human
agcagauggaaugcuguguua

SEQ ID NO: 1589585 - RNA, 19 nt, Human
ucauauuaauauauuucca

SEQ ID NO: 1589586 - RNA, 22 nt, Human
uccuuucuaacaaaaaaauaua

SEQ ID NO: 1589587 - RNA, 15 nt, Human
ucccagugaauucuu

SEQ ID NO: 1589588 - RNA, 22 nt, Human
acuaugacauaaaaacaacuuu

SEQ ID NO: 1589589 - RNA, 21 nt, Human
uaugagcuuccuucugugaaa

SEQ ID NO: 1589590 - RNA, 18 nt, Human
uaugagcuuccuucugug

SEQ ID NO: 1589591 - RNA, 17 nt, Human
uaucuaguaugaaauua

SEQ ID NO: 1589592 - RNA, 16 nt, Human
uaucuaguaugaaauu

SEQ ID NO: 1589593 - RNA, 14 nt, Human
uaucuaguaugaaa

SEQ ID NO: 1589594 - RNA, 17 nt, Human
uauauccuuucuaacaa

SEQ ID NO: 1589595 - RNA, 16 nt, Human
uauauccuuucuaaca

SEQ ID NO: 1589596 - RNA, 19 nt, Human
uauuuaaugauaaguaaau

SEQ ID NO: 1589597 - RNA, 16 nt, Human
uauucaggagaguaga

SEQ ID NO: 1589598 - RNA, 21 nt, Human
aauucuugaaggaaaaugaua

SEQ ID NO: 1589599 - RNA, 16 nt, Human
aauucuugaaggaaaa

SEQ ID NO: 1589600 - RNA, 15 nt, Human
aauucuugaaggaaa

SEQ ID NO: 1589601 - RNA, 20 nt, Human
acaaaaaaauauauuuaaug

SEQ ID NO: 1589602 - RNA, 17 nt, Human
acaaaaaaauauauuua

SEQ ID NO: 1589603 - RNA, 13 nt, Human
acaaaaaaauaua

SEQ ID NO: 1589604 - RNA, 18 nt, Human
uaaucagugugucuaaau

SEQ ID NO: 1589605 - RNA, 17 nt, Human
uaaucagugugucuaaa

SEQ ID NO: 1589606 - RNA, 23 nt, Human
uaaucagugugucuaaauuugaa

SEQ ID NO: 1589607 - RNA, 17 nt, Human
uaauguaauaacuguga

SEQ ID NO: 1589608 - RNA, 18 nt, Human
uaauguaauaacugugaa

SEQ ID NO: 1589609 - RNA, 19 nt, Human
uacauaaguaauucaagaa

SEQ ID NO: 1589610 - RNA, 17 nt, Human
uacauaaguaauucaag

SEQ ID NO: 1589611 - RNA, 16 nt, Human
uacauaaguaauucaa

SEQ ID NO: 1589612 - RNA, 22 nt, Human
uacauuguacgaagaguauuuu

SEQ ID NO: 1589613 - RNA, 20 nt, Human
uacauuguacgaagaguauu

SEQ ID NO: 1589614 - RNA, 23 nt, Human
uacauuguacgaagaguauuuuu

SEQ ID NO: 1589615 - RNA, 14 nt, Human
aaggaucuucaucu

SEQ ID NO: 1589616 - RNA, 14 nt, Human
aaggaaaaugauac

SEQ ID NO: 1589617 - RNA, 13 nt, Human
guguuuauuuaua

SEQ ID NO: 1589618 - RNA, 13 nt, Human
aaguauucuaaau

SEQ ID NO: 1589619 - RNA, 15 nt, Human
aaguauucuaaauuu

SEQ ID NO: 1589620 - RNA, 12 nt, Human
aaguaaaugcua

SEQ ID NO: 1589621 - RNA, 20 nt, Human
aaguuauugauaaguucaua

SEQ ID NO: 1589622 - RNA, 19 nt, Human
aaguuauugauaaguucau

SEQ ID NO: 1589623 - RNA, 19 nt, Human
aaguuuacauuguaaauag

SEQ ID NO: 1589624 - RNA, 18 nt, Human
aaguuuacauuguaaaua

SEQ ID NO: 1589625 - RNA, 13 nt, Human
aaguucauacauu

SEQ ID NO: 1589626 - RNA, 12 nt, Human
aaguucauacau

SEQ ID NO: 1589627 - RNA, 15 nt, Human
aaguucauacauugu

SEQ ID NO: 1589628 - RNA, 23 nt, Human
aaguuauugauaaguucauacau

SEQ ID NO: 1589629 - RNA, 22 nt, Human
aaguuauugauaaguucauaca

SEQ ID NO: 1589630 - RNA, 19 nt, Human
uaaaccucaaaaugucuaa

SEQ ID NO: 1589631 - RNA, 18 nt, Human
uaaaccucaaaaugucua

SEQ ID NO: 1589632 - RNA, 23 nt, Human
uaacaaaaaaauauauuuaauga

SEQ ID NO: 1589633 - RNA, 20 nt, Human
uaacaaaaaaauauauuuaa

SEQ ID NO: 1589634 - RNA, 16 nt, Human
uaaauuuugaguucua

SEQ ID NO: 1589635 - RNA, 14 nt, Human
uaaauuuuauaucu

SEQ ID NO: 1589636 - RNA, 18 nt, Human
uaaauaguauuugagagu

SEQ ID NO: 1589637 - RNA, 22 nt, Human
aauaaaaauauuguguugugaa

SEQ ID NO: 1589638 - RNA, 12 nt, Human
aacauaauuaaa

SEQ ID NO: 1589639 - RNA, 16 nt, Human
gugaagugaaugaaac

SEQ ID NO: 1589640 - RNA, 15 nt, Human
caaauaaaaauauug

SEQ ID NO: 1589641 - RNA, 23 nt, Human
caaaaaaauauauuuaaugauaa

SEQ ID NO: 1589642 - RNA, 12 nt, Human
caacuuuauacc

SEQ ID NO: 1589643 - RNA, 19 nt, Human
cacaacuauuuuuccaaaa

SEQ ID NO: 1589644 - RNA, 14 nt, Human
cacaacuauuuuuc

SEQ ID NO: 1589645 - RNA, 23 nt, Human
cacauaucuaguaugaaauuaua

SEQ ID NO: 1589646 - RNA, 17 nt, Human
uugaauguuaagcagau

SEQ ID NO: 1589647 - RNA, 14 nt, Human
uugaauguuaagca

SEQ ID NO: 1589648 - RNA, 19 nt, Human
uuguacgaagaguauuuuu

SEQ ID NO: 1589649 - RNA, 16 nt, Human
uuguacgaagaguauu

SEQ ID NO: 1589650 - RNA, 18 nt, Human
uuguagcacugacagauu

SEQ ID NO: 1589651 - RNA, 17 nt, Human
uuguagcacugacagau

SEQ ID NO: 1589652 - RNA, 16 nt, Human
uuguagcacugacaga

SEQ ID NO: 1589653 - RNA, 14 nt, Human
uuguagcacugaca

SEQ ID NO: 1589654 - RNA, 22 nt, Human
uuguagcacugacagauuucca

SEQ ID NO: 1589655 - RNA, 19 nt, Human
uuguucaauaauaaauauu

SEQ ID NO: 1589656 - RNA, 15 nt, Human
uuuauacaggucaua

SEQ ID NO: 1589657 - RNA, 21 nt, Human
uuucuaacaaaaaaauauauu

SEQ ID NO: 1589658 - RNA, 21 nt, Human
uuucacauaucuaguaugaaa

SEQ ID NO: 1589659 - RNA, 15 nt, Human
uuucacauaucuagu

SEQ ID NO: 1589660 - RNA, 13 nt, Human
uuugaguucuaca

SEQ ID NO: 1589661 - RNA, 16 nt, Human
uuugagaguucuaaau

SEQ ID NO: 1589662 - RNA, 20 nt, Human
uuauugauaaguucauacau

SEQ ID NO: 1589663 - RNA, 19 nt, Human
uuauugauaaguucauaca

SEQ ID NO: 1589664 - RNA, 15 nt, Human
uuauugauaaguuca

SEQ ID NO: 1589665 - RNA, 12 nt, Human
uuccaaaauaau

SEQ ID NO: 1589666 - RNA, 19 nt, Human
uucaugcauagguuuagca

SEQ ID NO: 1589667 - RNA, 21 nt, Human
uuccaaaauaauuuuaagaaa

SEQ ID NO: 1589668 - RNA, 13 nt, Human
uuccaaaauaauu

SEQ ID NO: 1589669 - RNA, 21 nt, Human
uuaaugauaaguaaaugcuag

SEQ ID NO: 1589670 - RNA, 14 nt, Human
uuaauauauuucca

SEQ ID NO: 1589671 - RNA, 13 nt, Human
uuaauauauuucc

SEQ ID NO: 1589672 - RNA, 21 nt, Human
uuaagcagauggaaugcugug

SEQ ID NO: 1589673 - RNA, 16 nt, Human
ugcauagguuuagcag

SEQ ID NO: 1589674 - RNA, 18 nt, Human
ugcuguguuaaauaaacc

SEQ ID NO: 1589675 - RNA, 11 nt, Human
ugcuguguuaa

SEQ ID NO: 1589676 - RNA, 18 nt, Human
ugauguguuuauuuauag

SEQ ID NO: 1589677 - RNA, 14 nt, Human
ugauguguuuauuu

SEQ ID NO: 1589678 - RNA, 23 nt, Human
ugagacguuuuuggaagaguagu

SEQ ID NO: 1589679 - RNA, 16 nt, Human
ugacagaauauguuuc

SEQ ID NO: 1589680 - RNA, 18 nt, Human
ugacagaauauguuucaa

SEQ ID NO: 1589681 - RNA, 16 nt, Human
uccaaaccaaauaaaa

SEQ ID NO: 1589682 - RNA, 22 nt, Human
uccaaaaagauuuucagaaaau

SEQ ID NO: 1589683 - RNA, 12 nt, Human
uauuauguguuu

SEQ ID NO: 1589684 - RNA, 14 nt, Human
uauuguguugugaa

SEQ ID NO: 1589685 - RNA, 23 nt, Human
uauugauaaguucauacauugua

SEQ ID NO: 1589686 - RNA, 16 nt, Human
uauugauaaguucaua

SEQ ID NO: 1589687 - RNA, 14 nt, Human
uauugauaaguuca

SEQ ID NO: 1589688 - RNA, 15 nt, Human
ucaaagagagaaaau

SEQ ID NO: 1589689 - RNA, 20 nt, Human
ucaaagagagaaaauaaaga

SEQ ID NO: 1589690 - RNA, 13 nt, Human
uaguaugaaauua

SEQ ID NO: 1589691 - RNA, 23 nt, Human
uaguaugaaauuauauaaguauu

SEQ ID NO: 1589692 - RNA, 15 nt, Human
uaguaugaaauuaua

SEQ ID NO: 1589693 - RNA, 17 nt, Human
uauccuuucuaacaaaa

SEQ ID NO: 1589694 - RNA, 22 nt, Human
uaugacauaaaaacaacuuuau

SEQ ID NO: 1589695 - RNA, 19 nt, Human
uaugacauaaaaacaacuu

SEQ ID NO: 1589696 - RNA, 23 nt, Human
uaugacauaaaaacaacuuuaua

SEQ ID NO: 1589697 - RNA, 15 nt, Human
gugaaaauuauuuug

SEQ ID NO: 1589698 - RNA, 12 nt, Human
gugaaaauuauu

SEQ ID NO: 1589699 - RNA, 17 nt, Human
gugaaaguacauuugga

SEQ ID NO: 1589700 - RNA, 21 nt, Human
guauuugagaguucuaaauuu

SEQ ID NO: 1589701 - RNA, 19 nt, Human
guauuugagaguucuaaau

SEQ ID NO: 1589702 - RNA, 17 nt, Human
guaaauaguauuugaga

SEQ ID NO: 1589703 - RNA, 16 nt, Human
guaaauaguauuugag

SEQ ID NO: 1589704 - RNA, 15 nt, Human
guaaauaguauuuga

SEQ ID NO: 1589705 - RNA, 14 nt, Human
guaauucaagaaaa

SEQ ID NO: 1589706 - RNA, 13 nt, Human
guaauucaagaaa

SEQ ID NO: 1589707 - RNA, 15 nt, Human
guacgaagaguauuu

SEQ ID NO: 1589708 - RNA, 14 nt, Human
gcuuuaucaaaggg

SEQ ID NO: 1589709 - RNA, 14 nt, Human
ggaaugcuguguua

SEQ ID NO: 1589710 - RNA, 18 nt, Human
gaguguacuuaacuauuc

SEQ ID NO: 1589711 - RNA, 14 nt, Human
gcaauuucauaugc

SEQ ID NO: 1589712 - RNA, 21 nt, Human
gcaaagcugaugacaacuucc

SEQ ID NO: 1589713 - RNA, 13 nt, Human
gacacaacuauuu

SEQ ID NO: 1589714 - RNA, 14 nt, Human
gaaugcuguguuaa

SEQ ID NO: 1589715 - RNA, 13 nt, Human
gaaugcuguguua

SEQ ID NO: 1589716 - RNA, 19 nt, Human
gaaucucauaauuuauaca

SEQ ID NO: 1589717 - RNA, 14 nt, Human
gaauguuaagcaga

SEQ ID NO: 1589718 - RNA, 15 nt, Human
gaauguuaagcagau

SEQ ID NO: 1589719 - RNA, 23 nt, Human
gaauucuugaaggaaaaugauac

SEQ ID NO: 1589720 - RNA, 18 nt, Human
gaauucuugaaggaaaau

SEQ ID NO: 1589721 - RNA, 15 nt, Human
gagaguagaacagau

SEQ ID NO: 1589722 - RNA, 14 nt, Human
cuucugugaaagua

SEQ ID NO: 1589723 - RNA, 13 nt, Human
cuucccuuucugc

SEQ ID NO: 1589724 - RNA, 16 nt, Human
cuuucugcuuguguua

SEQ ID NO: 1589725 - RNA, 22 nt, Human
cuuuaucaaagggugaaaauua

SEQ ID NO: 1589726 - RNA, 21 nt, Human
cuuuaucaaagggugaaaauu

SEQ ID NO: 1589727 - RNA, 20 nt, Human
gaaaaugauacgcaacauaa

SEQ ID NO: 1589728 - RNA, 21 nt, Human
gaaaauauuauguguuuccau

SEQ ID NO: 1589729 - RNA, 21 nt, Human
cucauaaaaagccugcaauuu

SEQ ID NO: 1589730 - RNA, 12 nt, Human
cucaaauuugga

SEQ ID NO: 1589731 - RNA, 21 nt, Human
cuauucaggagaguagaacag

SEQ ID NO: 1589732 - RNA, 22 nt, Human
cuagcuaauguaauaacuguga

SEQ ID NO: 1589733 - RNA, 13 nt, Human
cuaaauuuuauau

SEQ ID NO: 1589734 - RNA, 16 nt, Human
cuaaauuuuauaucuu

SEQ ID NO: 1589735 - RNA, 15 nt, Human
cuaaauuuuauaucu

SEQ ID NO: 1589736 - RNA, 20 nt, Human
cuaaauuuuauaucuuguag

SEQ ID NO: 1589737 - RNA, 16 nt, Human
cuaagauaguaacaau

SEQ ID NO: 1589738 - RNA, 23 nt, Human
ccagugaauucuugaaggaaaau

SEQ ID NO: 1589739 - RNA, 21 nt, Human
cuggaugccaccucugcaggg

SEQ ID NO: 1589740 - RNA, 19 nt, Human
cuguuauaaucuuucacag

SEQ ID NO: 1589741 - RNA, 13 nt, Human
cuguuauaaucuu

SEQ ID NO: 1589742 - RNA, 12 nt, Human
cuguucacagcc

SEQ ID NO: 1589743 - RNA, 23 nt, Human
gaaaauuauuuuguucauacaua

SEQ ID NO: 1589744 - RNA, 20 nt, Human
gaaaauuauuuuguucauac

SEQ ID NO: 1589745 - RNA, 21 nt, Human
gaaaauuauuuuguucauaca

SEQ ID NO: 1589746 - RNA, 22 nt, Human
gaaaauuauuuuguucauacau

SEQ ID NO: 1589747 - RNA, 17 nt, Human
gaaaagacuccaaagaa

SEQ ID NO: 1589748 - RNA, 16 nt, Human
gaaaagacuccaaaga

SEQ ID NO: 1589749 - RNA, 18 nt, Human
gaaaagacuccaaagaaa

SEQ ID NO: 1589750 - RNA, 14 nt, Human
gaaaagacuccaaa

SEQ ID NO: 1589751 - RNA, 21 nt, Human
gaaaacuuuaugcuaagugaa

SEQ ID NO: 1589752 - RNA, 17 nt, Human
gaaaugaaagcagggac

SEQ ID NO: 1589753 - RNA, 18 nt, Human
gaaagaaaaucaggcugg

SEQ ID NO: 1589754 - RNA, 19 nt, Human
gaacccgggaggcagaggu

SEQ ID NO: 1589755 - RNA, 17 nt, Human
gaacccgggaggcagag

SEQ ID NO: 1589756 - RNA, 13 nt, Human
gaacugaaaucau

SEQ ID NO: 1589757 - RNA, 17 nt, Human
gaacccaaguccaagca

SEQ ID NO: 1589758 - RNA, 16 nt, Human
gaacccaaguccaagc

SEQ ID NO: 1589759 - RNA, 16 nt, Human
cuuggucugugagaug

SEQ ID NO: 1589760 - RNA, 19 nt, Human
cuuggucugugagaugcua

SEQ ID NO: 1589761 - RNA, 21 nt, Human
cuucuaaguaaaaccacagca

SEQ ID NO: 1589762 - RNA, 17 nt, Human
cuucuaaguaaaaccac

SEQ ID NO: 1589763 - RNA, 13 nt, Human
cuucuaaguaaaa

SEQ ID NO: 1589764 - RNA, 13 nt, Human
cuucucacauuua

SEQ ID NO: 1589765 - RNA, 20 nt, Human
cuucucacauuuauauuuuu

SEQ ID NO: 1589766 - RNA, 18 nt, Human
gcauggcauauuuuucac

SEQ ID NO: 1589767 - RNA, 16 nt, Human
gcauuguaaaugugcu

SEQ ID NO: 1589768 - RNA, 15 nt, Human
gcagcuuauucacaa

SEQ ID NO: 1589769 - RNA, 17 nt, Human
gauguagaggagaaacu

SEQ ID NO: 1589770 - RNA, 16 nt, Human
gcaauaaaauggguuu

SEQ ID NO: 1589771 - RNA, 18 nt, Human
gcaauagucaaauugugu

SEQ ID NO: 1589772 - RNA, 17 nt, Human
gagcuguucacagccag

SEQ ID NO: 1589773 - RNA, 15 nt, Human
gagcgacagugagac

SEQ ID NO: 1589774 - RNA, 20 nt, Human
gacaguauggcagcuuuccu

SEQ ID NO: 1589775 - RNA, 14 nt, Human
gacagaaagcagaa

SEQ ID NO: 1589776 - RNA, 20 nt, Human
gacagaaagcagaacaguga

SEQ ID NO: 1589777 - RNA, 21 nt, Human
gacagcccuucuuuccacaga

SEQ ID NO: 1589778 - RNA, 16 nt, Human
gacuauucaaacaguc

SEQ ID NO: 1589779 - RNA, 15 nt, Human
gacuauucaaacagu

SEQ ID NO: 1589780 - RNA, 22 nt, Human
gacuauucaaacagucucagga

SEQ ID NO: 1589781 - RNA, 14 nt, Human
ggugaaaauuauuu

SEQ ID NO: 1589782 - RNA, 22 nt, Human
ggugaaaauuauuuuguucaua

SEQ ID NO: 1589783 - RNA, 13 nt, Human
ggugaaaauuauu

SEQ ID NO: 1589784 - RNA, 17 nt, Human
aaagggugaaaauuauu

SEQ ID NO: 1589785 - RNA, 14 nt, Human
aaagguacuucaaa

SEQ ID NO: 1589786 - RNA, 20 nt, Human
aaagggauggcaagaugugg

SEQ ID NO: 1589787 - RNA, 21 nt, Human
aaagcacugacuucuaaguaa

SEQ ID NO: 1589788 - RNA, 17 nt, Human
aaagcacugacuucuaa

SEQ ID NO: 1589789 - RNA, 22 nt, Human
aaagaccuuuggagcaaagcug

SEQ ID NO: 1589790 - RNA, 19 nt, Human
aaagacuauucaaacaguc

SEQ ID NO: 1589791 - RNA, 18 nt, Human
aaagacuauucaaacagu

SEQ ID NO: 1589792 - RNA, 21 nt, Human
aaagacuccaaagaaauguaa

SEQ ID NO: 1589793 - RNA, 15 nt, Human
aaagacuccaaagaa

SEQ ID NO: 1589794 - RNA, 21 nt, Human
aaagacuauucaaacagucuc

SEQ ID NO: 1589795 - RNA, 13 nt, Human
aaagacagugaaa

SEQ ID NO: 1589796 - RNA, 23 nt, Human
aaacuucagcgguuuauauaagc

SEQ ID NO: 1589797 - RNA, 15 nt, Human
aaagaggcagcuuga

SEQ ID NO: 1589798 - RNA, 15 nt, Human
aaagaggaaugaagu

SEQ ID NO: 1589799 - RNA, 15 nt, Human
aaacagucucaggaa

SEQ ID NO: 1589800 - RNA, 14 nt, Human
aaacaguagugaua

SEQ ID NO: 1589801 - RNA, 20 nt, Human
aaacagucucaggaaaucaa

SEQ ID NO: 1589802 - RNA, 19 nt, Human
ggggaauugaggacacuga

SEQ ID NO: 1589803 - RNA, 14 nt, Human
aaacacagcaaggg

SEQ ID NO: 1589804 - RNA, 12 nt, Human
aaacacagcaag

SEQ ID NO: 1589805 - RNA, 11 nt, Human
aaacacagcaa

SEQ ID NO: 1589806 - RNA, 15 nt, Human
aaacucguuaauuug

SEQ ID NO: 1589807 - RNA, 12 nt, Human
aaaccacagcag

SEQ ID NO: 1589808 - RNA, 15 nt, Human
aaaccacagcaguug

SEQ ID NO: 1589809 - RNA, 15 nt, Human
guaauaacugugaag

SEQ ID NO: 1589810 - RNA, 16 nt, Human
guaauaacugugaagu

SEQ ID NO: 1589811 - RNA, 22 nt, Human
guaauaacugugaaguuuacau

SEQ ID NO: 1589812 - RNA, 20 nt, Human
guaauaggcguaacuaauuu

SEQ ID NO: 1589813 - RNA, 21 nt, Human
aaauaauuuuuauauuugaaa

SEQ ID NO: 1589814 - RNA, 23 nt, Human
guacacugccuucucaacuccaa

SEQ ID NO: 1589815 - RNA, 15 nt, Human
aaauacacacucaaa

SEQ ID NO: 1589816 - RNA, 23 nt, Human
aaauaauuuuuauauuugaaaua

SEQ ID NO: 1589817 - RNA, 22 nt, Human
aaauaauuuuuauauuugaaau

SEQ ID NO: 1589818 - RNA, 19 nt, Human
aaauacacacucaaaucaa

SEQ ID NO: 1589819 - RNA, 14 nt, Human
aaauaaaaauauug

SEQ ID NO: 1589820 - RNA, 20 nt, Human
aaaguuauugauaaguucau

SEQ ID NO: 1589821 - RNA, 23 nt, Human
aaaguucugcagauaaacaguag

SEQ ID NO: 1589822 - RNA, 20 nt, Human
aaagguauuuuaaucaccaa

SEQ ID NO: 1589823 - RNA, 18 nt, Human
aaaguauguuagugcaaa

SEQ ID NO: 1589824 - RNA, 14 nt, Human
guacuuaacuauuc

SEQ ID NO: 1589825 - RNA, 15 nt, Human
guacuucaugcuguc

SEQ ID NO: 1589826 - RNA, 22 nt, Human
guacuucaaauccuugaagauu

SEQ ID NO: 1589827 - RNA, 21 nt, Human
guacuucaaauccuugaagau

SEQ ID NO: 1589828 - RNA, 15 nt, Human
guacauuuggagaca

SEQ ID NO: 1589829 - RNA, 18 nt, Human
aaauccauacauuugugu

SEQ ID NO: 1589830 - RNA, 15 nt, Human
aaauccauacauuug

SEQ ID NO: 1589831 - RNA, 15 nt, Human
aaauauuauguguuu

SEQ ID NO: 1589832 - RNA, 14 nt, Human
aaauauuauguguu

SEQ ID NO: 1589833 - RNA, 17 nt, Human
aaauauuauguuaaaac

SEQ ID NO: 1589834 - RNA, 12 nt, Human
aaaucauuucug

SEQ ID NO: 1589835 - RNA, 23 nt, Human
aaaucauuucugcaucagcugcu

SEQ ID NO: 1589836 - RNA, 22 nt, Human
aaaucauuucugcaucagcugc

SEQ ID NO: 1589837 - RNA, 21 nt, Human
aaaucauuucugcaucagcug

SEQ ID NO: 1589838 - RNA, 19 nt, Human
aaaucauuucugcaucagc

SEQ ID NO: 1589839 - RNA, 21 nt, Human
aaaagauuuucagaaaauauu

SEQ ID NO: 1589840 - RNA, 15 nt, Human
aaaacuucagacaua

SEQ ID NO: 1589841 - RNA, 17 nt, Human
aaaaaugguuuaaaugg

SEQ ID NO: 1589842 - RNA, 19 nt, Human
gggacauuugcucauggaa

SEQ ID NO: 1589843 - RNA, 14 nt, Human
aaaaauaacaauga

SEQ ID NO: 1589844 - RNA, 20 nt, Human
gggaacccaaguccaagcau

SEQ ID NO: 1589845 - RNA, 22 nt, Human
gggacagucaccucauggaauu

SEQ ID NO: 1589846 - RNA, 21 nt, Human
gggacagucaccucauggaau

SEQ ID NO: 1589847 - RNA, 20 nt, Human
gggacagucaccucauggaa

SEQ ID NO: 1589848 - RNA, 14 nt, Human
ggcuccacuugguc

SEQ ID NO: 1589849 - RNA, 16 nt, Human
ggccuccauccugagg

SEQ ID NO: 1589850 - RNA, 15 nt, Human
ggccuccauccugag

SEQ ID NO: 1589851 - RNA, 14 nt, Human
ggccuccauccuga

SEQ ID NO: 1589852 - RNA, 21 nt, Human
ggcacaguuuucugagaaaga

SEQ ID NO: 1589853 - RNA, 18 nt, Human
gcuagaacucccuuucaa

SEQ ID NO: 1589854 - RNA, 16 nt, Human
gcuagaacucccuuuc

SEQ ID NO: 1589855 - RNA, 15 nt, Human
gcuagaacucccuuu

SEQ ID NO: 1589856 - RNA, 14 nt, Human
gcuagaacucccuu

SEQ ID NO: 1589857 - RNA, 13 nt, Human
gcuagaacucccu

SEQ ID NO: 1589858 - RNA, 12 nt, Human
gcuagaacuccc

SEQ ID NO: 1589859 - RNA, 15 nt, Human
gcuccacuuggucug

SEQ ID NO: 1589860 - RNA, 21 nt, Human
gcuccccucggagaagagcug

SEQ ID NO: 1589861 - RNA, 19 nt, Human
gcuccacuuggucugugag

SEQ ID NO: 1589862 - RNA, 18 nt, Human
gcuccacuuggucuguga

SEQ ID NO: 1589863 - RNA, 20 nt, Human
gccuucggccuccauccuga

SEQ ID NO: 1589864 - RNA, 23 nt, Human
gccuucggccuccauccugaggc

SEQ ID NO: 1589865 - RNA, 21 nt, Human
gccuucggccuccauccugag

SEQ ID NO: 1589866 - RNA, 12 nt, Human
gccuccauccug

SEQ ID NO: 1589867 - RNA, 15 nt, Human
gccucuuagaugcag

SEQ ID NO: 1589868 - RNA, 22 nt, Human
ggacucauuuuaaaaaauggaa

SEQ ID NO: 1589869 - RNA, 13 nt, Human
ggagaaacuggaa

SEQ ID NO: 1589870 - RNA, 21 nt, Human
cauuuggagacacaacuauuu

SEQ ID NO: 1589871 - RNA, 19 nt, Human
cauuguaaauaguauuuga

SEQ ID NO: 1589872 - RNA, 18 nt, Human
ccacagaagcuccaggua

SEQ ID NO: 1589873 - RNA, 18 nt, Human
ccaccagucugacuguuu

SEQ ID NO: 1589874 - RNA, 16 nt, Human
ccacagaagcuccagg

SEQ ID NO: 1589875 - RNA, 13 nt, Human
cauaauuuauaca

SEQ ID NO: 1589876 - RNA, 20 nt, Human
cauaauuuauacaggucaua

SEQ ID NO: 1589877 - RNA, 13 nt, Human
cauuaucucaaaa

SEQ ID NO: 1589878 - RNA, 12 nt, Human
cauuaucucaaa

SEQ ID NO: 1589879 - RNA, 15 nt, Human
cagucaccucaugga

SEQ ID NO: 1589880 - RNA, 15 nt, Human
cagucucaggaaauc

SEQ ID NO: 1589881 - RNA, 18 nt, Human
cagggaggacgcucucug

SEQ ID NO: 1589882 - RNA, 17 nt, Human
cagggaggacgcucucu

SEQ ID NO: 1589883 - RNA, 19 nt, Human
cagggaggacgcucucugg

SEQ ID NO: 1589884 - RNA, 17 nt, Human
cagagcugcccucuccu

SEQ ID NO: 1589885 - RNA, 13 nt, Human
cagagcugcccuc

SEQ ID NO: 1589886 - RNA, 15 nt, Human
cagagcugcccucuc

SEQ ID NO: 1589887 - RNA, 21 nt, Human
cagcaguugaaaagacuccaa

SEQ ID NO: 1589888 - RNA, 20 nt, Human
cagcaguugaaaagacucca

SEQ ID NO: 1589889 - RNA, 17 nt, Human
cagcaguugaaaagacu

SEQ ID NO: 1589890 - RNA, 22 nt, Human
cagcaguugaaaagacuccaaa

SEQ ID NO: 1589891 - RNA, 22 nt, Human
cagccagcaguucagagcugcc

SEQ ID NO: 1589892 - RNA, 15 nt, Human
cagccagcaguucag

SEQ ID NO: 1589893 - RNA, 21 nt, Human
cagccagcaguucagagcugc

SEQ ID NO: 1589894 - RNA, 14 nt, Human
cagccagcaguuca

SEQ ID NO: 1589895 - RNA, 22 nt, Human
cagcacagccucuuagaugcag

SEQ ID NO: 1589896 - RNA, 22 nt, Human
cagccugagcgacagugagacu

SEQ ID NO: 1589897 - RNA, 19 nt, Human
cagccugagcgacagugag

SEQ ID NO: 1589898 - RNA, 18 nt, Human
cagccugagcgacaguga

SEQ ID NO: 1589899 - RNA, 20 nt, Human
cagcccuucuuuccacagaa

SEQ ID NO: 1589900 - RNA, 19 nt, Human
cagcccuucuuuccacaga

SEQ ID NO: 1589901 - RNA, 15 nt, Human
cagcccuucuuucca

SEQ ID NO: 1589902 - RNA, 23 nt, Human
caggaaaucaaauaugcaaagca

SEQ ID NO: 1589903 - RNA, 20 nt, Human
cagcuccccucggagaagag

SEQ ID NO: 1589904 - RNA, 18 nt, Human
cagcuccccucggagaag

SEQ ID NO: 1589905 - RNA, 17 nt, Human
cagcuccccucggagaa

SEQ ID NO: 1589906 - RNA, 16 nt, Human
cagcuccccucggaga

SEQ ID NO: 1589907 - RNA, 23 nt, Human
cagcugccuccccuccucugcuu

SEQ ID NO: 1589908 - RNA, 24 nt, Human
cagcugccuccccuccucugcuug

SEQ ID NO: 1589909 - RNA, 21 nt, Human
cagcugccuccccuccucugc

SEQ ID NO: 1589910 - RNA, 22 nt, Human
cagcugccuccccuccucugcu

SEQ ID NO: 1589911 - RNA, 14 nt, Human
auuguguugugaau

SEQ ID NO: 1589912 - RNA, 17 nt, Human
auuguguugugaauguu

SEQ ID NO: 1589913 - RNA, 15 nt, Human
auuguuuaaaaucau

SEQ ID NO: 1589914 - RNA, 16 nt, Human
auuucauaugcuguau

SEQ ID NO: 1589915 - RNA, 14 nt, Human
auuucuaugaaaua

SEQ ID NO: 1589916 - RNA, 20 nt, Human
auuucauaccuaucaucuua

SEQ ID NO: 1589917 - RNA, 16 nt, Human
auuuaauaaaugugcc

SEQ ID NO: 1589918 - RNA, 22 nt, Human
auuaugaauuacauuuguauaa

SEQ ID NO: 1589919 - RNA, 20 nt, Human
auuaugaauuacauuuguau

SEQ ID NO: 1589920 - RNA, 19 nt, Human
auuaugaauuacauuugua

SEQ ID NO: 1589921 - RNA, 13 nt, Human
caagaugguucua

SEQ ID NO: 1589922 - RNA, 16 nt, Human
caagaugguucuagca

SEQ ID NO: 1589923 - RNA, 19 nt, Human
caagacccaaaaggcagaa

SEQ ID NO: 1589924 - RNA, 18 nt, Human
caaagggugaaaauuauu

SEQ ID NO: 1589925 - RNA, 21 nt, Human
caaaucuuaacuugaaggagu

SEQ ID NO: 1589926 - RNA, 14 nt, Human
auuuuauaucuugu

SEQ ID NO: 1589927 - RNA, 16 nt, Human
auuuuauaucuuguag

SEQ ID NO: 1589928 - RNA, 12 nt, Human
auuuuauaucuu

SEQ ID NO: 1589929 - RNA, 21 nt, Human
auuuuauaucaauuuaaaaaa

SEQ ID NO: 1589930 - RNA, 14 nt, Human
caaaccaaauaaaa

SEQ ID NO: 1589931 - RNA, 15 nt, Human
caaaccaaauaaaaa

SEQ ID NO: 1589932 - RNA, 17 nt, Human
caaacagucucaggaaa

SEQ ID NO: 1589933 - RNA, 16 nt, Human
caaacagucucaggaa

SEQ ID NO: 1589934 - RNA, 17 nt, Human
caaacauauauaacaau

SEQ ID NO: 1589935 - RNA, 21 nt, Human
caaaaggauaaugaauacuuu

SEQ ID NO: 1589936 - RNA, 16 nt, Human
auuuuuauauuugaaa

SEQ ID NO: 1589937 - RNA, 15 nt, Human
auuuuuauauuugaa

SEQ ID NO: 1589938 - RNA, 22 nt, Human
cacuguuuugaaucucauaauu

SEQ ID NO: 1589939 - RNA, 15 nt, Human
cacuuaaaaaugguu

SEQ ID NO: 1589940 - RNA, 17 nt, Human
cacuuguguuuugcaag

SEQ ID NO: 1589941 - RNA, 11 nt, Human
cagaaaguuau

SEQ ID NO: 1589942 - RNA, 16 nt, Human
cagaaaguuauugaua

SEQ ID NO: 1589943 - RNA, 18 nt, Human
cagaacagugauuaccag

SEQ ID NO: 1589944 - RNA, 17 nt, Human
cagaacagugauuacca

SEQ ID NO: 1589945 - RNA, 12 nt, Human
cagaacagugau

SEQ ID NO: 1589946 - RNA, 11 nt, Human
cagaacaguga

SEQ ID NO: 1589947 - RNA, 12 nt, Human
cacuccagccug

SEQ ID NO: 1589948 - RNA, 13 nt, Human
cacuccagccuga

SEQ ID NO: 1589949 - RNA, 23 nt, Human
cacuccagccugagcgacaguga

SEQ ID NO: 1589950 - RNA, 23 nt, Human
caauaaaauccauacauuugugu

SEQ ID NO: 1589951 - RNA, 20 nt, Human
caauaaaauccauacauuug

SEQ ID NO: 1589952 - RNA, 15 nt, Human
caauaaaauggguuu

SEQ ID NO: 1589953 - RNA, 12 nt, Human
cucagaauauug

SEQ ID NO: 1589954 - RNA, 23 nt, Human
cucagaaaacaaggaugaauuaa

SEQ ID NO: 1589955 - RNA, 19 nt, Human
cucagaaaacaaggaugaa

SEQ ID NO: 1589956 - RNA, 23 nt, Human
cuaugucauuugcuggagcucug

SEQ ID NO: 1589957 - RNA, 13 nt, Human
cucaaaacugcac

SEQ ID NO: 1589958 - RNA, 17 nt, Human
cucaaaacugcacuguc

SEQ ID NO: 1589959 - RNA, 14 nt, Human
cuaacuggacuggu

SEQ ID NO: 1589960 - RNA, 24 nt, Human
cggagaagagcuguucacagccag

SEQ ID NO: 1589961 - RNA, 23 nt, Human
cggagaagagcuguucacagcca

SEQ ID NO: 1589962 - RNA, 15 nt, Human
cgguuuauauaagcu

SEQ ID NO: 1589963 - RNA, 17 nt, Human
cugaaagaggaaugaag

SEQ ID NO: 1589964 - RNA, 13 nt, Human
cugaaagaggaau

SEQ ID NO: 1589965 - RNA, 17 nt, Human
cucucuggccuucggcc

SEQ ID NO: 1589966 - RNA, 22 nt, Human
cucucuggccuucggccuccau

SEQ ID NO: 1589967 - RNA, 19 nt, Human
cucucuggccuucggccuc

SEQ ID NO: 1589968 - RNA, 19 nt, Human
cuccccaugauguuuagaa

SEQ ID NO: 1589969 - RNA, 17 nt, Human
ccugucucuacuaaaaa

SEQ ID NO: 1589970 - RNA, 16 nt, Human
ccucccuucucuucac

SEQ ID NO: 1589971 - RNA, 14 nt, Human
ccucggagaagagc

SEQ ID NO: 1589972 - RNA, 12 nt, Human
ccucggagaaga

SEQ ID NO: 1589973 - RNA, 13 nt, Human
ccccugcacucca

SEQ ID NO: 1589974 - RNA, 13 nt, Human
cccuccucugcuu

SEQ ID NO: 1589975 - RNA, 22 nt, Human
cccuccucugcuugccaucccu

SEQ ID NO: 1589976 - RNA, 14 nt, Human
ccaucccucccucc

SEQ ID NO: 1589977 - RNA, 15 nt, Human
ccaucccucccucca

SEQ ID NO: 1589978 - RNA, 13 nt, Human
ccaucccucccuc

SEQ ID NO: 1589979 - RNA, 13 nt, Human
cccaacuccagaa

SEQ ID NO: 1589980 - RNA, 16 nt, Human
gugaagugaaugaaac

SEQ ID NO: 1589981 - RNA, 23 nt, Human
aacuaucucauuuccaagcaagu

SEQ ID NO: 1589982 - RNA, 20 nt, Human
aacuaucucauuuccaagca

SEQ ID NO: 1589983 - RNA, 13 nt, Human
aacuauauuguuu

SEQ ID NO: 1589984 - RNA, 20 nt, Human
aacugaaaucauacuucuua

SEQ ID NO: 1589985 - RNA, 12 nt, Human
aacauaauuaaa

SEQ ID NO: 1589986 - RNA, 16 nt, Human
aacauauauaacaaug

SEQ ID NO: 1589987 - RNA, 19 nt, Human
aacagauuauuaccuuaca

SEQ ID NO: 1589988 - RNA, 16 nt, Human
aacagauaaauaguuu

SEQ ID NO: 1589989 - RNA, 17 nt, Human
aacagucucaggaaauc

SEQ ID NO: 1589990 - RNA, 19 nt, Human
aacagucucaggaaaucaa

SEQ ID NO: 1589991 - RNA, 23 nt, Human
gucucaguccaugaagauguaga

SEQ ID NO: 1589992 - RNA, 16 nt, Human
aagcaaguauuagaau

SEQ ID NO: 1589993 - RNA, 19 nt, Human
aagcaaaauuuuuucucua

SEQ ID NO: 1589994 - RNA, 22 nt, Human
aagauguagaggagaaacugga

SEQ ID NO: 1589995 - RNA, 14 nt, Human
aagacuauucaaac

SEQ ID NO: 1589996 - RNA, 17 nt, Human
aagacuccaaagaaaug

SEQ ID NO: 1589997 - RNA, 16 nt, Human
aagacuccaaagaaau

SEQ ID NO: 1589998 - RNA, 14 nt, Human
aagacuccaaagaa

SEQ ID NO: 1589999 - RNA, 19 nt, Human
aagagcuguucacagccag

SEQ ID NO: 1590000 - RNA, 18 nt, Human
aagagcuguucacagcca

SEQ ID NO: 1590001 - RNA, 13 nt, Human
aagaaaauaucac

SEQ ID NO: 1590002 - RNA, 13 nt, Human
aagaauauuuuaa

SEQ ID NO: 1590003 - RNA, 13 nt, Human
aagacccaaaagg

SEQ ID NO: 1590004 - RNA, 22 nt, Human
aauaaaaauauuguguugugaa

SEQ ID NO: 1590005 - RNA, 12 nt, Human
aauaaaaauaau

SEQ ID NO: 1590006 - RNA, 22 nt, Human
aauaaaauccauacauuugugu

SEQ ID NO: 1590007 - RNA, 21 nt, Human
aauaaaugugccuucauuuuu

SEQ ID NO: 1590008 - RNA, 12 nt, Human
aauaaaugugcc

SEQ ID NO: 1590009 - RNA, 15 nt, Human
aauaacaauaaaaga

SEQ ID NO: 1590010 - RNA, 18 nt, Human
uaaauaguauuugagagu

SEQ ID NO: 1590011 - RNA, 14 nt, Human
aauacacacucaaa

SEQ ID NO: 1590012 - RNA, 14 nt, Human
uaaauuuuauaucu

SEQ ID NO: 1590013 - RNA, 16 nt, Human
uaaauuuugaguucua

SEQ ID NO: 1590014 - RNA, 20 nt, Human
uaacaaaaaaauauauuuaa

SEQ ID NO: 1590015 - RNA, 23 nt, Human
uaacaaaaaaauauauuuaauga

SEQ ID NO: 1590016 - RNA, 17 nt, Human
uaacaaugcuguauuuu

SEQ ID NO: 1590017 - RNA, 15 nt, Human
uaacaaugcuguauu

SEQ ID NO: 1590018 - RNA, 17 nt, Human
uaaaugauuucauucaa

SEQ ID NO: 1590019 - RNA, 18 nt, Human
uaaaccucaaaaugucua

SEQ ID NO: 1590020 - RNA, 19 nt, Human
uaaaccucaaaaugucuaa

SEQ ID NO: 1590021 - RNA, 22 nt, Human
aaguuauugauaaguucauaca

SEQ ID NO: 1590022 - RNA, 23 nt, Human
aaguuauugauaaguucauacau

SEQ ID NO: 1590023 - RNA, 15 nt, Human
aaguucauacauugu

SEQ ID NO: 1590024 - RNA, 12 nt, Human
aaguucauacau

SEQ ID NO: 1590025 - RNA, 13 nt, Human
aaguucauacauu

SEQ ID NO: 1590026 - RNA, 18 nt, Human
aaguuuacauuguaaaua

SEQ ID NO: 1590027 - RNA, 19 nt, Human
aaguuuacauuguaaauag

SEQ ID NO: 1590028 - RNA, 17 nt, Human
aaguucugcagauaaac

SEQ ID NO: 1590029 - RNA, 19 nt, Human
aaguuauugauaaguucau

SEQ ID NO: 1590030 - RNA, 20 nt, Human
aaguuauugauaaguucaua

SEQ ID NO: 1590031 - RNA, 12 nt, Human
aaguaaaugcua

SEQ ID NO: 1590032 - RNA, 18 nt, Human
aaguaaaaccacagcagu

SEQ ID NO: 1590033 - RNA, 17 nt, Human
aaguaaaaccacagcag

SEQ ID NO: 1590034 - RNA, 21 nt, Human
aagggugaugggaaagcauug

SEQ ID NO: 1590035 - RNA, 16 nt, Human
aaguaaaaccacagca

SEQ ID NO: 1590036 - RNA, 15 nt, Human
aaguaaaaccacagc

SEQ ID NO: 1590037 - RNA, 14 nt, Human
aaguaaaaccacag

SEQ ID NO: 1590038 - RNA, 22 nt, Human
guuuuauaauuuugugaagcaa

SEQ ID NO: 1590039 - RNA, 15 nt, Human
guuuuauaauuuugu

SEQ ID NO: 1590040 - RNA, 15 nt, Human
aaguauucuaaauuu

SEQ ID NO: 1590041 - RNA, 13 nt, Human
aaguauucuaaau

SEQ ID NO: 1590042 - RNA, 23 nt, Human
aaguauguuagugcaaauuguca

SEQ ID NO: 1590043 - RNA, 22 nt, Human
guuuucugagaaagacuauuca

SEQ ID NO: 1590044 - RNA, 17 nt, Human
guuuucugagaaagacu

SEQ ID NO: 1590045 - RNA, 16 nt, Human
guuuucugagaaagac

SEQ ID NO: 1590046 - RNA, 23 nt, Human
guuuuuuuuuaaaaaagaaacau

SEQ ID NO: 1590047 - RNA, 22 nt, Human
aagucuuauauauuguagauaa

SEQ ID NO: 1590048 - RNA, 13 nt, Human
guguuuauuuaua

SEQ ID NO: 1590049 - RNA, 16 nt, Human
aaggaaaaaauaacaa

SEQ ID NO: 1590050 - RNA, 19 nt, Human
aaggaaaaaauaacaauga

SEQ ID NO: 1590051 - RNA, 13 nt, Human
guugacaugggac

SEQ ID NO: 1590052 - RNA, 14 nt, Human
aaggaaaaugauac

SEQ ID NO: 1590053 - RNA, 12 nt, Human
aaggaaaaugau

SEQ ID NO: 1590054 - RNA, 14 nt, Human
aaggaucuucaucu

SEQ ID NO: 1590055 - RNA, 13 nt, Human
aaggauaaugaau

SEQ ID NO: 1590056 - RNA, 23 nt, Human
uacauuguacgaagaguauuuuu

SEQ ID NO: 1590057 - RNA, 20 nt, Human
uacauuguacgaagaguauu

SEQ ID NO: 1590058 - RNA, 22 nt, Human
uacauuguacgaagaguauuuu

SEQ ID NO: 1590059 - RNA, 18 nt, Human
aauguugacaugggacau

SEQ ID NO: 1590060 - RNA, 16 nt, Human
uaccaugccauuuaaa

SEQ ID NO: 1590061 - RNA, 16 nt, Human
uacauaaguaauucaa

SEQ ID NO: 1590062 - RNA, 17 nt, Human
uacauaaguaauucaag

SEQ ID NO: 1590063 - RNA, 19 nt, Human
uacauaaguaauucaagaa

SEQ ID NO: 1590064 - RNA, 16 nt, Human
aaugguuuaaaugguc

SEQ ID NO: 1590065 - RNA, 18 nt, Human
uaauguaauaacugugaa

SEQ ID NO: 1590066 - RNA, 17 nt, Human
uaauguaauaacuguga

SEQ ID NO: 1590067 - RNA, 15 nt, Human
aaugaaugaaugaau

SEQ ID NO: 1590068 - RNA, 13 nt, Human
uaaucuuucacag

SEQ ID NO: 1590069 - RNA, 17 nt, Human
uaaucagugugucuaaa

SEQ ID NO: 1590070 - RNA, 18 nt, Human
uaaucagugugucuaaau

SEQ ID NO: 1590071 - RNA, 19 nt, Human
uaacaaugcuguauuuuaa

SEQ ID NO: 1590072 - RNA, 18 nt, Human
uacaaaaacacagcaagg

SEQ ID NO: 1590073 - RNA, 17 nt, Human
uacaaaaacacagcaag

SEQ ID NO: 1590074 - RNA, 13 nt, Human
acaaaaaaauaua

SEQ ID NO: 1590075 - RNA, 17 nt, Human
acaaaaaaauauauuua

SEQ ID NO: 1590076 - RNA, 20 nt, Human
acaaaaaaauauauuuaaug

SEQ ID NO: 1590077 - RNA, 19 nt, Human
aauuuuuucucuaggaaau

SEQ ID NO: 1590078 - RNA, 19 nt, Human
aauuuuuauauuugaaaua

SEQ ID NO: 1590079 - RNA, 15 nt, Human
uagaacucccuuuca

SEQ ID NO: 1590080 - RNA, 16 nt, Human
uacuucaugcugucua

SEQ ID NO: 1590081 - RNA, 21 nt, Human
uacuucaaauccuugaagauu

SEQ ID NO: 1590082 - RNA, 19 nt, Human
uagaggagaaacuggaacu

SEQ ID NO: 1590083 - RNA, 16 nt, Human
uagaugcaguucugaa

SEQ ID NO: 1590084 - RNA, 19 nt, Human
uagaugcaguucugaagaa

SEQ ID NO: 1590085 - RNA, 17 nt, Human
uagaugcaguucugaag

SEQ ID NO: 1590086 - RNA, 21 nt, Human
uagcaugucgucaaagcugaa

SEQ ID NO: 1590087 - RNA, 18 nt, Human
acaagcacuaaacaaaga

SEQ ID NO: 1590088 - RNA, 15 nt, Human
aauucuugaaggaaa

SEQ ID NO: 1590089 - RNA, 16 nt, Human
aauucuugaaggaaaa

SEQ ID NO: 1590090 - RNA, 21 nt, Human
aauucuugaaggaaaaugaua

SEQ ID NO: 1590091 - RNA, 21 nt, Human
aauucuugccaaauauaaaua

SEQ ID NO: 1590092 - RNA, 19 nt, Human
aauugacccacaagaaaug

SEQ ID NO: 1590093 - RNA, 16 nt, Human
aauugacccacaagaa

SEQ ID NO: 1590094 - RNA, 21 nt, Human
aauugacccacaagaaaugaa

SEQ ID NO: 1590095 - RNA, 20 nt, Human
aauuucucccagucauuuaa

SEQ ID NO: 1590096 - RNA, 19 nt, Human
uacuucaaauccuugaaga

SEQ ID NO: 1590097 - RNA, 14 nt, Human
uacuucaaauccuu

SEQ ID NO: 1590098 - RNA, 13 nt, Human
uacuguaagaaaa

SEQ ID NO: 1590099 - RNA, 23 nt, Human
aauugugugaaagguacuucaaa

SEQ ID NO: 1590100 - RNA, 16 nt, Human
uauucaggagaguaga

SEQ ID NO: 1590101 - RNA, 23 nt, Human
uauucauagcagcuuauucacaa

SEQ ID NO: 1590102 - RNA, 16 nt, Human
uauuaaaacucauuuu

SEQ ID NO: 1590103 - RNA, 12 nt, Human
uauuaaaacuca

SEQ ID NO: 1590104 - RNA, 21 nt, Human
uauguuuucaggcuagaugua

SEQ ID NO: 1590105 - RNA, 21 nt, Human
acaguauggcagcuuuccuca

SEQ ID NO: 1590106 - RNA, 16 nt, Human
acagucucaggaaauc

SEQ ID NO: 1590107 - RNA, 15 nt, Human
acagucucaggaaau

SEQ ID NO: 1590108 - RNA, 14 nt, Human
acagucucaggaaa

SEQ ID NO: 1590109 - RNA, 13 nt, Human
acagucucaggaa

SEQ ID NO: 1590110 - RNA, 17 nt, Human
acagucucaggaaauca

SEQ ID NO: 1590111 - RNA, 20 nt, Human
acagugaaagaaaauaacaa

SEQ ID NO: 1590112 - RNA, 18 nt, Human
acagugagacucugucuc

SEQ ID NO: 1590113 - RNA, 14 nt, Human
acagugagacucug

SEQ ID NO: 1590114 - RNA, 21 nt, Human
acaguuaccucugccucagaa

SEQ ID NO: 1590115 - RNA, 19 nt, Human
uauuuaaugauaaguaaau

SEQ ID NO: 1590116 - RNA, 18 nt, Human
uauuuauuuuaauaaugu

SEQ ID NO: 1590117 - RNA, 16 nt, Human
uauuuauuuuaauaau

SEQ ID NO: 1590118 - RNA, 14 nt, Human
uauuuauuuuaaua

SEQ ID NO: 1590119 - RNA, 17 nt, Human
uauugucuagugaaacu

SEQ ID NO: 1590120 - RNA, 23 nt, Human
acaguucggugagcuacaaaugc

SEQ ID NO: 1590121 - RNA, 19 nt, Human
acaguucggugagcuacaa

SEQ ID NO: 1590122 - RNA, 22 nt, Human
acaguucggugagcuacaaaug

SEQ ID NO: 1590123 - RNA, 16 nt, Human
uauauccuuucuaaca

SEQ ID NO: 1590124 - RNA, 17 nt, Human
uauauccuuucuaacaa

SEQ ID NO: 1590125 - RNA, 19 nt, Human
uauaggaauugacccacaa

SEQ ID NO: 1590126 - RNA, 14 nt, Human
uauaggaauugacc

SEQ ID NO: 1590127 - RNA, 13 nt, Human
uauaggaauugac

SEQ ID NO: 1590128 - RNA, 21 nt, Human
uauaggugcuacaaaaacaca

SEQ ID NO: 1590129 - RNA, 23 nt, Human
uauaggugcuacaaaaacacagc

SEQ ID NO: 1590130 - RNA, 19 nt, Human
uauaauuuugugaagcaaa

SEQ ID NO: 1590131 - RNA, 14 nt, Human
uauaauuuugugaa

SEQ ID NO: 1590132 - RNA, 23 nt, Human
uauaaaauaauuuuuauauuuga

SEQ ID NO: 1590133 - RNA, 22 nt, Human
acacaucagcuugcccuguuaa

SEQ ID NO: 1590134 - RNA, 22 nt, Human
uauaaaauaauuuuuauauuug

SEQ ID NO: 1590135 - RNA, 21 nt, Human
uauaaaauaauuuuuauauuu

SEQ ID NO: 1590136 - RNA, 22 nt, Human
uagugagcagucaggaaagaga

SEQ ID NO: 1590137 - RNA, 16 nt, Human
uaguuuuauaugcuuc

SEQ ID NO: 1590138 - RNA, 14 nt, Human
uaucuaguaugaaa

SEQ ID NO: 1590139 - RNA, 16 nt, Human
uaucuaguaugaaauu

SEQ ID NO: 1590140 - RNA, 17 nt, Human
uaucuaguaugaaauua

SEQ ID NO: 1590141 - RNA, 15 nt, Human
uauauuuacaaaugg

SEQ ID NO: 1590142 - RNA, 14 nt, Human
uauauuuacaaaug

SEQ ID NO: 1590143 - RNA, 18 nt, Human
uaugagcuuccuucugug

SEQ ID NO: 1590144 - RNA, 21 nt, Human
uaugagcuuccuucugugaaa

SEQ ID NO: 1590145 - RNA, 16 nt, Human
uauggcuauaggugcu

SEQ ID NO: 1590146 - RNA, 17 nt, Human
uauggcuauaggugcua

SEQ ID NO: 1590147 - RNA, 22 nt, Human
acuaugacauaaaaacaacuuu

SEQ ID NO: 1590148 - RNA, 14 nt, Human
uccccuccucugcu

SEQ ID NO: 1590149 - RNA, 12 nt, Human
uccccuccucug

SEQ ID NO: 1590150 - RNA, 15 nt, Human
ucccagugaauucuu

SEQ ID NO: 1590151 - RNA, 13 nt, Human
acuaaaaauacaa

SEQ ID NO: 1590152 - RNA, 20 nt, Human
acucauuuuaaaaaauggaa

SEQ ID NO: 1590153 - RNA, 19 nt, Human
acuccagugagacagcucu

SEQ ID NO: 1590154 - RNA, 22 nt, Human
uccuuucuaacaaaaaaauaua

SEQ ID NO: 1590155 - RNA, 22 nt, Human
acugccuucucaacuccaaacu

SEQ ID NO: 1590156 - RNA, 22 nt, Human
acuggcacaguuuucugagaaa

SEQ ID NO: 1590157 - RNA, 13 nt, Human
uccuucagccuga

SEQ ID NO: 1590158 - RNA, 22 nt, Human
acugaggggaggggagcauggg

SEQ ID NO: 1590159 - RNA, 17 nt, Human
acugaggggaggggagc

SEQ ID NO: 1590160 - RNA, 15 nt, Human
uccugggcagcugcc

SEQ ID NO: 1590161 - RNA, 16 nt, Human
uccugggcagcugccu

SEQ ID NO: 1590162 - RNA, 17 nt, Human
uccugggcagcugccuc

SEQ ID NO: 1590163 - RNA, 18 nt, Human
uccugggcagcugccucc

SEQ ID NO: 1590164 - RNA, 19 nt, Human
uccugggcagcugccuccc

SEQ ID NO: 1590165 - RNA, 22 nt, Human
uccugggcagcugccuccccuc

SEQ ID NO: 1590166 - RNA, 23 nt, Human
uccugggcagcugccuccccucc

SEQ ID NO: 1590167 - RNA, 19 nt, Human
ucauauuaauauauuucca

SEQ ID NO: 1590168 - RNA, 22 nt, Human
ucaugaauuaguuuuauaugcu

SEQ ID NO: 1590169 - RNA, 21 nt, Human
uccaacuaucucauuuccaag

SEQ ID NO: 1590170 - RNA, 20 nt, Human
uccagccugagcgacaguga

SEQ ID NO: 1590171 - RNA, 21 nt, Human
uccagccugagcgacagugag

SEQ ID NO: 1590172 - RNA, 12 nt, Human
uauuucauuucu

SEQ ID NO: 1590173 - RNA, 13 nt, Human
uauuucauuucuu

SEQ ID NO: 1590174 - RNA, 11 nt, Human
accacagcagu

SEQ ID NO: 1590175 - RNA, 19 nt, Human
accacugcagaagacagua

SEQ ID NO: 1590176 - RNA, 14 nt, Human
accacugcagaaga

SEQ ID NO: 1590177 - RNA, 23 nt, Human
accacuuguguuuugcaagccag

SEQ ID NO: 1590178 - RNA, 19 nt, Human
accacuuguguuuugcaag

SEQ ID NO: 1590179 - RNA, 15 nt, Human
acccaaaaggcagaa

SEQ ID NO: 1590180 - RNA, 13 nt, Human
acccaaaaggcag

SEQ ID NO: 1590181 - RNA, 18 nt, Human
acccaaaaggcagaagca

SEQ ID NO: 1590182 - RNA, 21 nt, Human
acccaaauguucaucaaugaa

SEQ ID NO: 1590183 - RNA, 21 nt, Human
agcagauggaaugcuguguua

SEQ ID NO: 1590184 - RNA, 22 nt, Human
ugagguacugagagugaacaaa

SEQ ID NO: 1590185 - RNA, 17 nt, Human
ugagguacugagaguga

SEQ ID NO: 1590186 - RNA, 15 nt, Human
ugaggacacugauau

SEQ ID NO: 1590187 - RNA, 13 nt, Human
ugagcuacaaaug

SEQ ID NO: 1590188 - RNA, 14 nt, Human
ugagcuacaaaugc

SEQ ID NO: 1590189 - RNA, 16 nt, Human
ugagcuacaaaugcau

SEQ ID NO: 1590190 - RNA, 20 nt, Human
ugagcgacagugagacucug

SEQ ID NO: 1590191 - RNA, 16 nt, Human
ugagcgacagugagac

SEQ ID NO: 1590192 - RNA, 14 nt, Human
ugagcgacagugag

SEQ ID NO: 1590193 - RNA, 13 nt, Human
ugagcgacaguga

SEQ ID NO: 1590194 - RNA, 14 nt, Human
agcagaacagugau

SEQ ID NO: 1590195 - RNA, 14 nt, Human
agcaacgcaggccc

SEQ ID NO: 1590196 - RNA, 16 nt, Human
agcaccaaucaugaau

SEQ ID NO: 1590197 - RNA, 22 nt, Human
agcacagccucuuagaugcagu

SEQ ID NO: 1590198 - RNA, 17 nt, Human
agauuuucagaaaauau

SEQ ID NO: 1590199 - RNA, 14 nt, Human
agauuuuccugaaa

SEQ ID NO: 1590200 - RNA, 12 nt, Human
agauuuucagaa

SEQ ID NO: 1590201 - RNA, 21 nt, Human
agauugugccccugcacucca

SEQ ID NO: 1590202 - RNA, 16 nt, Human
agauugugccccugca

SEQ ID NO: 1590203 - RNA, 16 nt, Human
agauuuaccacuugug

SEQ ID NO: 1590204 - RNA, 15 nt, Human
ugacuguuuccauca

SEQ ID NO: 1590205 - RNA, 23 nt, Human
agaugcuagaacucccuuucaac

SEQ ID NO: 1590206 - RNA, 19 nt, Human
agauaaucagugugucuaa

SEQ ID NO: 1590207 - RNA, 22 nt, Human
agagugaacaaauuuacagaga

SEQ ID NO: 1590208 - RNA, 20 nt, Human
ugaagaagcaccaaucauga

SEQ ID NO: 1590209 - RNA, 14 nt, Human
ugaagaagauggua

SEQ ID NO: 1590210 - RNA, 22 nt, Human
ugaagaagcaccaaucaugaau

SEQ ID NO: 1590211 - RNA, 18 nt, Human
ugaagauguagaggagaa

SEQ ID NO: 1590212 - RNA, 18 nt, Human
ucuguuuuauaauuuugu

SEQ ID NO: 1590213 - RNA, 20 nt, Human
ucuguuuuauaauuuuguga

SEQ ID NO: 1590214 - RNA, 21 nt, Human
ucuuaauuaaaagaauauuuu

SEQ ID NO: 1590215 - RNA, 18 nt, Human
ucuuaauuaaaagaauau

SEQ ID NO: 1590216 - RNA, 22 nt, Human
ucuuagaugcaguucugaagaa

SEQ ID NO: 1590217 - RNA, 15 nt, Human
agacuggcacaguuu

SEQ ID NO: 1590218 - RNA, 14 nt, Human
agacuggcacaguu

SEQ ID NO: 1590219 - RNA, 18 nt, Human
agacuggcacaguuuucu

SEQ ID NO: 1590220 - RNA, 15 nt, Human
agagaaugagagaca

SEQ ID NO: 1590221 - RNA, 17 nt, Human
agagacacacugaagaa

SEQ ID NO: 1590222 - RNA, 20 nt, Human
agagacacacugaagaagca

SEQ ID NO: 1590223 - RNA, 18 nt, Human
agagacacacugaagaag

SEQ ID NO: 1590224 - RNA, 21 nt, Human
ucuuuaaagggauggcaagau

SEQ ID NO: 1590225 - RNA, 17 nt, Human
ucuuuaaaauacacacu

SEQ ID NO: 1590226 - RNA, 14 nt, Human
agacuccaaagaaa

SEQ ID NO: 1590227 - RNA, 13 nt, Human
agacuccaaagaa

SEQ ID NO: 1590228 - RNA, 12 nt, Human
agacuccaaaga

SEQ ID NO: 1590229 - RNA, 20 nt, Human
agacuauucaaacagucuca

SEQ ID NO: 1590230 - RNA, 18 nt, Human
agacuauucaaacagucu

SEQ ID NO: 1590231 - RNA, 21 nt, Human
agacuauucaaacagucucag

SEQ ID NO: 1590232 - RNA, 19 nt, Human
agacuccaaagaaauguaa

SEQ ID NO: 1590233 - RNA, 16 nt, Human
agacuccaaagaaaug

SEQ ID NO: 1590234 - RNA, 23 nt, Human
agacuauucaaacagucucagga

SEQ ID NO: 1590235 - RNA, 22 nt, Human
agacuccaaagaaauguaaggg

SEQ ID NO: 1590236 - RNA, 17 nt, Human
ucucuggccuucggccu

SEQ ID NO: 1590237 - RNA, 16 nt, Human
ucucuggccuucggcc

SEQ ID NO: 1590238 - RNA, 13 nt, Human
ucucuucuuuaaa

SEQ ID NO: 1590239 - RNA, 12 nt, Human
ucucuucuuuaa

SEQ ID NO: 1590240 - RNA, 19 nt, Human
agaaaacaaggaugaauua

SEQ ID NO: 1590241 - RNA, 15 nt, Human
agaaacuggaacucu

SEQ ID NO: 1590242 - RNA, 13 nt, Human
agaaacuggaacu

SEQ ID NO: 1590243 - RNA, 15 nt, Human
ucucccagucauuua

SEQ ID NO: 1590244 - RNA, 15 nt, Human
agaacucccuuucaa

SEQ ID NO: 1590245 - RNA, 14 nt, Human
agaacucccuuuca

SEQ ID NO: 1590246 - RNA, 15 nt, Human
ucugcagauaaacag

SEQ ID NO: 1590247 - RNA, 23 nt, Human
agaaagacuauucaaacagucuc

SEQ ID NO: 1590248 - RNA, 20 nt, Human
agaaagacuauucaaacagu

SEQ ID NO: 1590249 - RNA, 19 nt, Human
agaaagacuauucaaacag

SEQ ID NO: 1590250 - RNA, 20 nt, Human
ucugagaaagacuauucaaa

SEQ ID NO: 1590251 - RNA, 19 nt, Human
ucugagaaagacuauucaa

SEQ ID NO: 1590252 - RNA, 15 nt, Human
ucugagaaagacuau

SEQ ID NO: 1590253 - RNA, 14 nt, Human
ucugagaaagacua

SEQ ID NO: 1590254 - RNA, 21 nt, Human
ucugacuguuuccaucaaggg

SEQ ID NO: 1590255 - RNA, 22 nt, Human
ucugagaaagacuauucaaaca

SEQ ID NO: 1590256 - RNA, 21 nt, Human
ucugagaaagacuauucaaac

SEQ ID NO: 1590257 - RNA, 23 nt, Human
ucugagaaagacuauucaaacag

SEQ ID NO: 1590258 - RNA, 11 nt, Human
ucugcuugcca

SEQ ID NO: 1590259 - RNA, 21 nt, Human
agaagaacugaaaucauacuu

SEQ ID NO: 1590260 - RNA, 12 nt, Human
ucugcuugccau

SEQ ID NO: 1590261 - RNA, 14 nt, Human
ucugcuugccaucc

SEQ ID NO: 1590262 - RNA, 14 nt, Human
agaagcuccaggua

SEQ ID NO: 1590263 - RNA, 19 nt, Human
agccugcaauuucauaugc

SEQ ID NO: 1590264 - RNA, 21 nt, Human
agccugcaauuucauaugcug

SEQ ID NO: 1590265 - RNA, 13 nt, Human
ugcauacucauua

SEQ ID NO: 1590266 - RNA, 19 nt, Human
ugcagugagccgagauugu

SEQ ID NO: 1590267 - RNA, 14 nt, Human
ugcagugagccgag

SEQ ID NO: 1590268 - RNA, 18 nt, Human
agccugagcgacagugag

SEQ ID NO: 1590269 - RNA, 19 nt, Human
agccugagcgacagugaga

SEQ ID NO: 1590270 - RNA, 19 nt, Human
agcccuucuuuccacagaa

SEQ ID NO: 1590271 - RNA, 18 nt, Human
agcccuucuuuccacaga

SEQ ID NO: 1590272 - RNA, 19 nt, Human
agcuauggugucauaggcu

SEQ ID NO: 1590273 - RNA, 13 nt, Human
agcuggaaaagua

SEQ ID NO: 1590274 - RNA, 18 nt, Human
agcugccuccccuccucu

SEQ ID NO: 1590275 - RNA, 19 nt, Human
agcugccuccccuccucug

SEQ ID NO: 1590276 - RNA, 20 nt, Human
agcugccuccccuccucugc

SEQ ID NO: 1590277 - RNA, 23 nt, Human
agcugccuccccuccucugcuug

SEQ ID NO: 1590278 - RNA, 21 nt, Human
agcugccuccccuccucugcu

SEQ ID NO: 1590279 - RNA, 22 nt, Human
agcugccuccccuccucugcuu

SEQ ID NO: 1590280 - RNA, 14 nt, Human
ugcuaguaauugga

SEQ ID NO: 1590281 - RNA, 16 nt, Human
ugcuaguaauuggaaa

SEQ ID NO: 1590282 - RNA, 19 nt, Human
aggaaagagaacuuccaga

SEQ ID NO: 1590283 - RNA, 13 nt, Human
aggaaagagaacu

SEQ ID NO: 1590284 - RNA, 20 nt, Human
agcuuauuaaaacucauuuu

SEQ ID NO: 1590285 - RNA, 15 nt, Human
agcuuauuaaaacuc

SEQ ID NO: 1590286 - RNA, 21 nt, Human
agcuuauugucuagugaaacu

SEQ ID NO: 1590287 - RNA, 23 nt, Human
aggaauugacccacaagaaauga

SEQ ID NO: 1590288 - RNA, 19 nt, Human
aggaauugacccacaagaa

SEQ ID NO: 1590289 - RNA, 19 nt, Human
aggaaaucaaauaugcaaa

SEQ ID NO: 1590290 - RNA, 18 nt, Human
aggaaauauuuauuuuaa

SEQ ID NO: 1590291 - RNA, 14 nt, Human
aggaaauauuuauu

SEQ ID NO: 1590292 - RNA, 23 nt, Human
agggacuucugucuucacaacag

SEQ ID NO: 1590293 - RNA, 13 nt, Human
agggaaauuucag

SEQ ID NO: 1590294 - RNA, 14 nt, Human
agggagagaagaua

SEQ ID NO: 1590295 - RNA, 13 nt, Human
agggagagaagau

SEQ ID NO: 1590296 - RNA, 19 nt, Human
ugggaggcugagaugggag

SEQ ID NO: 1590297 - RNA, 22 nt, Human
agggcuguuauaaucuuucaca

SEQ ID NO: 1590298 - RNA, 23 nt, Human
agggaaacugccagcaacgcagg

SEQ ID NO: 1590299 - RNA, 21 nt, Human
agggaaacugccagcaacgca

SEQ ID NO: 1590300 - RNA, 19 nt, Human
agggaaacugccagcaacg

SEQ ID NO: 1590301 - RNA, 16 nt, Human
agggaaacugccagca

SEQ ID NO: 1590302 - RNA, 15 nt, Human
agggaaacugccagc

SEQ ID NO: 1590303 - RNA, 14 nt, Human
agggaaacugccag

SEQ ID NO: 1590304 - RNA, 20 nt, Human
ugggaacccaaguccaagca

SEQ ID NO: 1590305 - RNA, 19 nt, Human
uggcuauaggugcuacaaa

SEQ ID NO: 1590306 - RNA, 15 nt, Human
uggcuauaggugcua

SEQ ID NO: 1590307 - RNA, 18 nt, Human
uggcuaagcaaaauguga

SEQ ID NO: 1590308 - RNA, 23 nt, Human
uggcuauaggugcuacaaaaaca

SEQ ID NO: 1590309 - RNA, 18 nt, Human
ugggaaagcauuguaaau

SEQ ID NO: 1590310 - RNA, 17 nt, Human
ugggaaagcauuguaaa

SEQ ID NO: 1590311 - RNA, 21 nt, Human
ugggaaagcauuguaaaugug

SEQ ID NO: 1590312 - RNA, 16 nt, Human
ugggaaagcauuguaa

SEQ ID NO: 1590313 - RNA, 14 nt, Human
ugggaaagcauugu

SEQ ID NO: 1590314 - RNA, 18 nt, Human
ugggaaacaaaaggauaa

SEQ ID NO: 1590315 - RNA, 22 nt, Human
aggcuccacuuggucugugaga

SEQ ID NO: 1590316 - RNA, 21 nt, Human
aggcuccacuuggucugugag

SEQ ID NO: 1590317 - RNA, 17 nt, Human
aggcuccacuuggucug

SEQ ID NO: 1590318 - RNA, 11 nt, Human
aggcuccacuu

SEQ ID NO: 1590319 - RNA, 20 nt, Human
aggcagcucuaaaugucaau

SEQ ID NO: 1590320 - RNA, 16 nt, Human
uggagaagaacugaaa

SEQ ID NO: 1590321 - RNA, 18 nt, Human
uguauauccuuucuaaca

SEQ ID NO: 1590322 - RNA, 19 nt, Human
uguaguguuggagaagaac

SEQ ID NO: 1590323 - RNA, 18 nt, Human
uguaguguuggagaagaa

SEQ ID NO: 1590324 - RNA, 17 nt, Human
uguaguguuggagaaga

SEQ ID NO: 1590325 - RNA, 13 nt, Human
aguaauagagcaa

SEQ ID NO: 1590326 - RNA, 20 nt, Human
aguaaaaccacagcaguuga

SEQ ID NO: 1590327 - RNA, 19 nt, Human
aguaaaaccacagcaguug

SEQ ID NO: 1590328 - RNA, 17 nt, Human
aguaaaaccacagcagu

SEQ ID NO: 1590329 - RNA, 16 nt, Human
aguaaaaccacagcag

SEQ ID NO: 1590330 - RNA, 19 nt, Human
aguaauucaagaaaacaac

SEQ ID NO: 1590331 - RNA, 13 nt, Human
aguaauuggaaag

SEQ ID NO: 1590332 - RNA, 12 nt, Human
aguaauuggaaa

SEQ ID NO: 1590333 - RNA, 13 nt, Human
aguaaugauaacu

SEQ ID NO: 1590334 - RNA, 19 nt, Human
aguacauuuggagacacaa

SEQ ID NO: 1590335 - RNA, 19 nt, Human
uguaagggaaacugccagc

SEQ ID NO: 1590336 - RNA, 18 nt, Human
uguaagggaaacugccag

SEQ ID NO: 1590337 - RNA, 13 nt, Human
uguaagggaaacu

SEQ ID NO: 1590338 - RNA, 16 nt, Human
aggugcuacaaaaaca

SEQ ID NO: 1590339 - RNA, 16 nt, Human
agucucaggaaaucaa

SEQ ID NO: 1590340 - RNA, 13 nt, Human
agucucaggaaau

SEQ ID NO: 1590341 - RNA, 15 nt, Human
agucaggaaagagaa

SEQ ID NO: 1590342 - RNA, 14 nt, Human
agucaggaaagaga

SEQ ID NO: 1590343 - RNA, 23 nt, Human
uguuaagcagauggaaugcugug

SEQ ID NO: 1590344 - RNA, 22 nt, Human
uguguuaaguauguguaaaaug

SEQ ID NO: 1590345 - RNA, 14 nt, Human
uguguaaaauguga

SEQ ID NO: 1590346 - RNA, 20 nt, Human
uguggucacaggaaguagag

SEQ ID NO: 1590347 - RNA, 19 nt, Human
ugugucuaaauuugaaugu

SEQ ID NO: 1590348 - RNA, 22 nt, Human
ugugucuaaauuugaauguuaa

SEQ ID NO: 1590349 - RNA, 22 nt, Human
uguugcccacagcuguaugauu

SEQ ID NO: 1590350 - RNA, 15 nt, Human
uguucuaagaaguga

SEQ ID NO: 1590351 - RNA, 23 nt, Human
agugaacaaauuuacagagacag

SEQ ID NO: 1590352 - RNA, 22 nt, Human
agugaacaaauuuacagagaca

SEQ ID NO: 1590353 - RNA, 16 nt, Human
agucuuucacauuuaa

SEQ ID NO: 1590354 - RNA, 21 nt, Human
agugaacaaauuuacagagac

SEQ ID NO: 1590355 - RNA, 18 nt, Human
agucuuucacauuuaaau

SEQ ID NO: 1590356 - RNA, 14 nt, Human
agugcaaauuguca

SEQ ID NO: 1590357 - RNA, 14 nt, Human
auagaguguacuua

SEQ ID NO: 1590358 - RNA, 19 nt, Human
auagaguguacuuaacuau

SEQ ID NO: 1590359 - RNA, 21 nt, Human
auagaguguacuuaacuauuc

SEQ ID NO: 1590360 - RNA, 18 nt, Human
auagauaggucagugcaa

SEQ ID NO: 1590361 - RNA, 15 nt, Human
auagagcaaaauuga

SEQ ID NO: 1590362 - RNA, 17 nt, Human
auagagcaaaauugaug

SEQ ID NO: 1590363 - RNA, 21 nt, Human
auagagcaaaauugauguguu

SEQ ID NO: 1590364 - RNA, 22 nt, Human
auagagcaaaauugauguguuu

SEQ ID NO: 1590365 - RNA, 17 nt, Human
auagaauuaacacauga

SEQ ID NO: 1590366 - RNA, 13 nt, Human
auagaaguaaaaa

SEQ ID NO: 1590367 - RNA, 15 nt, Human
uuauuauauuuacaa

SEQ ID NO: 1590368 - RNA, 19 nt, Human
uuauguuaaaacugggaca

SEQ ID NO: 1590369 - RNA, 14 nt, Human
uuauuauauuuaca

SEQ ID NO: 1590370 - RNA, 16 nt, Human
auacucauuaggaugg

SEQ ID NO: 1590371 - RNA, 23 nt, Human
auacgcaacauaauuaaauuuug

SEQ ID NO: 1590372 - RNA, 17 nt, Human
auacuauggaauuucuc

SEQ ID NO: 1590373 - RNA, 19 nt, Human
uuauauuugaaauauugac

SEQ ID NO: 1590374 - RNA, 21 nt, Human
uuaugaauuacauuuguauaa

SEQ ID NO: 1590375 - RNA, 17 nt, Human
uuaugaauuacauuugu

SEQ ID NO: 1590376 - RNA, 16 nt, Human
uuaugaauuacauuug

SEQ ID NO: 1590377 - RNA, 14 nt, Human
uuaugaauuacauu

SEQ ID NO: 1590378 - RNA, 22 nt, Human
uuaugauuaaguaaugauaacu

SEQ ID NO: 1590379 - RNA, 19 nt, Human
uuaugauuaaguaaugaua

SEQ ID NO: 1590380 - RNA, 15 nt, Human
uuaaauuuugaguuc

SEQ ID NO: 1590381 - RNA, 20 nt, Human
uuaaauuuugaguucuacau

SEQ ID NO: 1590382 - RNA, 15 nt, Human
aguuuacauuguaaa

SEQ ID NO: 1590383 - RNA, 17 nt, Human
aguuuacauuguaaaua

SEQ ID NO: 1590384 - RNA, 17 nt, Human
aguuuaaauuguaauag

SEQ ID NO: 1590385 - RNA, 20 nt, Human
aguuuaaauuguaauaggcg

SEQ ID NO: 1590386 - RNA, 15 nt, Human
aguuuagcuggaaaa

SEQ ID NO: 1590387 - RNA, 16 nt, Human
aguuuagcuggaaaag

SEQ ID NO: 1590388 - RNA, 22 nt, Human
uuaaaaucauuucugcaucagc

SEQ ID NO: 1590389 - RNA, 20 nt, Human
uuaaaaaugguuuaaauggu

SEQ ID NO: 1590390 - RNA, 16 nt, Human
uuaaaaaauggaacau

SEQ ID NO: 1590391 - RNA, 16 nt, Human
aguuuuauaugcuucu

SEQ ID NO: 1590392 - RNA, 14 nt, Human
auaauuuuaagaaa

SEQ ID NO: 1590393 - RNA, 19 nt, Human
auaauuuauacaggucaua

SEQ ID NO: 1590394 - RNA, 21 nt, Human
auaauuuauacaggucauauu

SEQ ID NO: 1590395 - RNA, 17 nt, Human
auaauucagaaggaucu

SEQ ID NO: 1590396 - RNA, 14 nt, Human
auaaucuuucacag

SEQ ID NO: 1590397 - RNA, 14 nt, Human
auaagccagacauc

SEQ ID NO: 1590398 - RNA, 15 nt, Human
uuagggagagaagau

SEQ ID NO: 1590399 - RNA, 16 nt, Human
uuaggguuaugauuaa

SEQ ID NO: 1590400 - RNA, 14 nt, Human
uuaggguuaugauu

SEQ ID NO: 1590401 - RNA, 18 nt, Human
aucuuguagcuuuaucaa

SEQ ID NO: 1590402 - RNA, 14 nt, Human
aucuuauaauuuaa

SEQ ID NO: 1590403 - RNA, 19 nt, Human
aucuuguagcuuuaucaaa

SEQ ID NO: 1590404 - RNA, 20 nt, Human
aucuuguagcuuuaucaaag

SEQ ID NO: 1590405 - RNA, 19 nt, Human
augaaauuauauaaguauu

SEQ ID NO: 1590406 - RNA, 21 nt, Human
augaaauuauauaaguauucu

SEQ ID NO: 1590407 - RNA, 18 nt, Human
augaacuuguaaaggaau

SEQ ID NO: 1590408 - RNA, 17 nt, Human
augaauuacauuuguau

SEQ ID NO: 1590409 - RNA, 16 nt, Human
augaauuacauuugua

SEQ ID NO: 1590410 - RNA, 23 nt, Human
augaauggcuaagcaaaauguga

SEQ ID NO: 1590411 - RNA, 15 nt, Human
augaauuacauuugu

SEQ ID NO: 1590412 - RNA, 20 nt, Human
uuggagacacaacuauuuuu

SEQ ID NO: 1590413 - RNA, 20 nt, Human
uugacagaauauguuucaaa

SEQ ID NO: 1590414 - RNA, 19 nt, Human
aucuacacuccagugagac

SEQ ID NO: 1590415 - RNA, 18 nt, Human
aucuacacuccagugaga

SEQ ID NO: 1590416 - RNA, 17 nt, Human
uugacagaauauguuuc

SEQ ID NO: 1590417 - RNA, 17 nt, Human
uugaagggaaauuucag

SEQ ID NO: 1590418 - RNA, 13 nt, Human
uugcaucaauuuu

SEQ ID NO: 1590419 - RNA, 14 nt, Human
aucucauuuccaag

SEQ ID NO: 1590420 - RNA, 17 nt, Human
uucuagcuaauguaaua

SEQ ID NO: 1590421 - RNA, 22 nt, Human
uucuagcauggcauauuuuuca

SEQ ID NO: 1590422 - RNA, 14 nt, Human
uucuagcauggcau

SEQ ID NO: 1590423 - RNA, 15 nt, Human
uucuagcauggcaua

SEQ ID NO: 1590424 - RNA, 18 nt, Human
uucuagcauggcauauuu

SEQ ID NO: 1590425 - RNA, 20 nt, Human
uucuagcauggcauauuuuu

SEQ ID NO: 1590426 - RNA, 21 nt, Human
uucuagcauggcauauuuuuc

SEQ ID NO: 1590427 - RNA, 14 nt, Human
uucuaaauuuuaua

SEQ ID NO: 1590428 - RNA, 19 nt, Human
uucuaacaaaaaaauauau

SEQ ID NO: 1590429 - RNA, 23 nt, Human
uucuaagaagugaaaaucuacac

SEQ ID NO: 1590430 - RNA, 16 nt, Human
uucuaaguaaaaccac

SEQ ID NO: 1590431 - RNA, 17 nt, Human
uucuaaguaaaaccaca

SEQ ID NO: 1590432 - RNA, 15 nt, Human
uucuaaguaaaacca

SEQ ID NO: 1590433 - RNA, 14 nt, Human
uucggccuccaucc

SEQ ID NO: 1590434 - RNA, 15 nt, Human
uucggccuccauccu

SEQ ID NO: 1590435 - RNA, 22 nt, Human
aucacuugucaauaaaauccau

SEQ ID NO: 1590436 - RNA, 17 nt, Human
aucaggguuaguauugu

SEQ ID NO: 1590437 - RNA, 12 nt, Human
auauuuuucaca

SEQ ID NO: 1590438 - RNA, 13 nt, Human
auauuuuucacau

SEQ ID NO: 1590439 - RNA, 14 nt, Human
auauuuuucacaua

SEQ ID NO: 1590440 - RNA, 15 nt, Human
auauuuuucacauau

SEQ ID NO: 1590441 - RNA, 17 nt, Human
auauuuuucacauaucu

SEQ ID NO: 1590442 - RNA, 18 nt, Human
auauuuuuuguuaaauga

SEQ ID NO: 1590443 - RNA, 20 nt, Human
auauuuuuuguuaaaugauu

SEQ ID NO: 1590444 - RNA, 14 nt, Human
aucaacagauaaau

SEQ ID NO: 1590445 - RNA, 19 nt, Human
uuccguagguuauuuucag

SEQ ID NO: 1590446 - RNA, 19 nt, Human
uugaacccgggaggcagag

SEQ ID NO: 1590447 - RNA, 17 nt, Human
uugaaauuguauuacaa

SEQ ID NO: 1590448 - RNA, 12 nt, Human
uucucuaggaaa

SEQ ID NO: 1590449 - RNA, 21 nt, Human
uuuaucaaagggugaaaauua

SEQ ID NO: 1590450 - RNA, 13 nt, Human
augcuaagugaaa

SEQ ID NO: 1590451 - RNA, 18 nt, Human
augcuagguuaauuccaa

SEQ ID NO: 1590452 - RNA, 22 nt, Human
augcuagaacucccuuucaaca

SEQ ID NO: 1590453 - RNA, 21 nt, Human
augcuagaacucccuuucaac

SEQ ID NO: 1590454 - RNA, 20 nt, Human
augcuagaacucccuuucaa

SEQ ID NO: 1590455 - RNA, 17 nt, Human
uuucaaacauauauaac

SEQ ID NO: 1590456 - RNA, 16 nt, Human
uuucaaacauauauaa

SEQ ID NO: 1590457 - RNA, 14 nt, Human
uuucaaacuuugga

SEQ ID NO: 1590458 - RNA, 18 nt, Human
auggcauauuuuucacau

SEQ ID NO: 1590459 - RNA, 20 nt, Human
auggcauauuuuucacauau

SEQ ID NO: 1590460 - RNA, 21 nt, Human
auggcauauuuuucacauauc

SEQ ID NO: 1590461 - RNA, 22 nt, Human
auggcauauuuuucacauaucu

SEQ ID NO: 1590462 - RNA, 23 nt, Human
auggcauauuuuucacauaucua

SEQ ID NO: 1590463 - RNA, 16 nt, Human
auggcacuaguauuuc

SEQ ID NO: 1590464 - RNA, 14 nt, Human
auggcacuaguauu

SEQ ID NO: 1590465 - RNA, 19 nt, Human
auggcuaagcaaaauguga

SEQ ID NO: 1590466 - RNA, 17 nt, Human
augauaaguaaaugcua

SEQ ID NO: 1590467 - RNA, 15 nt, Human
augauaacuggaaac

SEQ ID NO: 1590468 - RNA, 18 nt, Human
augauuaaguaaugauaa

SEQ ID NO: 1590469 - RNA, 14 nt, Human
augauuaaguaaug

SEQ ID NO: 1590470 - RNA, 21 nt, Human
augccauuuaaagcuuauuaa

SEQ ID NO: 1590471 - RNA, 17 nt, Human
augccauuuaaagcuua

SEQ ID NO: 1590472 - RNA, 13 nt, Human
augcaguucugaa

SEQ ID NO: 1590473 - RNA, 18 nt, Human
uuuaaauauaugcuaagu

SEQ ID NO: 1590474 - RNA, 22 nt, Human
uuugacagaauauguuucaaac

SEQ ID NO: 1590475 - RNA, 13 nt, Human
auguagaggagaa

SEQ ID NO: 1590476 - RNA, 12 nt, Human
auguagaggaga

SEQ ID NO: 1590477 - RNA, 19 nt, Human
auguagaggagaaacugga

SEQ ID NO: 1590478 - RNA, 17 nt, Human
auguagaggagaaacug

SEQ ID NO: 1590479 - RNA, 16 nt, Human
auguacuucaugcugu

SEQ ID NO: 1590480 - RNA, 14 nt, Human
uuugcaagccagau

SEQ ID NO: 1590481 - RNA, 17 nt, Human
uuugugaagcaaaauuu

SEQ ID NO: 1590482 - RNA, 21 nt, Human
uuuguaguguuggagaagaac

SEQ ID NO: 1590483 - RNA, 19 nt, Human
uuuguaguguuggagaaga

SEQ ID NO: 1590484 - RNA, 17 nt, Human
auguccacugguucuuc

SEQ ID NO: 1590485 - RNA, 21 nt, Human
augguucccuugaugaagaag

SEQ ID NO: 1590486 - RNA, 18 nt, Human
uuucucccagucauuuaa

SEQ ID NO: 1590487 - RNA, 17 nt, Human
uuucucccagucauuua

SEQ ID NO: 1590488 - RNA, 18 nt, Human
auucagaaggaucuucau

SEQ ID NO: 1590489 - RNA, 24 nt, Human
auucagaaggaucuucaucugacu

SEQ ID NO: 1590490 - RNA, 17 nt, Human
auuauuuuguucauaca

SEQ ID NO: 1590491 - RNA, 18 nt, Human
auuauuuuguucauacau

SEQ ID NO: 1590492 - RNA, 19 nt, Human
auuauuuuguucauacaua

SEQ ID NO: 1590493 - RNA, 21 nt, Human
auuauuuuguucauacauauu

SEQ ID NO: 1590494 - RNA, 18 nt, Human
auucaaacagucucagga

SEQ ID NO: 1590495 - RNA, 20 nt, Human
auucaaacagucucaggaaa

SEQ ID NO: 1590496 - RNA, 19 nt, Human
auucaaacagucucaggaa

SEQ ID NO: 1590497 - RNA, 15 nt, Human
auuauuuuguucaua

SEQ ID NO: 1590498 - RNA, 16 nt, Human
auuauuuuguucauac

SEQ ID NO: 1590499 - RNA, 21 nt, Human
auuauguuaaaacugggacag

SEQ ID NO: 1590500 - RNA, 18 nt, Human
auuauauuuauuacugua

SEQ ID NO: 1590501 - RNA, 15 nt, Human
auuauauuuauuacu

SEQ ID NO: 1590502 - RNA, 15 nt, Human
auuauauuuacaaau

SEQ ID NO: 1590503 - RNA, 15 nt, Human
auucuagcuaaugua

SEQ ID NO: 1590504 - RNA, 18 nt, Human
auucuagcuaauguaaua

SEQ ID NO: 1590505 - RNA, 19 nt, Human
auugacacuuaaaaauggu

SEQ ID NO: 1590506 - RNA, 17 nt, Human
auugacacuuaaaaaug

SEQ ID NO: 1590507 - RNA, 15 nt, Human
auugacacuuaaaaa

SEQ ID NO: 1590508 - RNA, 21 nt, Human
auuuuuguagcacugacagau

SEQ ID NO: 1590509 - RNA, 20 nt, Human
auuuuuguagcacugacaga

SEQ ID NO: 1590510 - RNA, 22 nt, Human
auuuuugugauuuugugauuga

SEQ ID NO: 1590511 - RNA, 21 nt, Human
auuuuuguuuucauuaucuca

SEQ ID NO: 1590512 - RNA, 18 nt, Human
auuuuuuguuaaaugauu

SEQ ID NO: 1590513 - RNA, 23 nt, Human
auuuuuucucuaggaaauauuua

SEQ ID NO: 1590514 - RNA, 20 nt, Human
auuuuuucucuaggaaauau

SEQ ID NO: 1590515 - RNA, 22 nt, Human
auuuuugacagaauauguuuca

SEQ ID NO: 1590516 - RNA, 12 nt, Human
auuuuugacaga

SEQ ID NO: 1590517 - RNA, 13 nt, Human
auuuuugacagaa

SEQ ID NO: 1590518 - RNA, 14 nt, Human
auuuuugacagaau

SEQ ID NO: 1590519 - RNA, 15 nt, Human
auuuuugacagaaua

SEQ ID NO: 1590520 - RNA, 20 nt, Human
auuuuucuuauuucauuucu

SEQ ID NO: 1590521 - RNA, 19 nt, Human
auuuuucuuauuucauuuc

SEQ ID NO: 1590522 - RNA, 15 nt, Human
auuuuucuuauuuca

SEQ ID NO: 1590523 - RNA, 15 nt, Human
auuuuuccaaaauaa

SEQ ID NO: 1590524 - RNA, 15 nt, Human
auuuuucacauaucu

SEQ ID NO: 1590525 - RNA, 18 nt, Human
auuuuucacauaucuagu

SEQ ID NO: 1590526 - RNA, 21 nt, Human
auuuuucacauaucuaguaug

SEQ ID NO: 1590527 - RNA, 12 nt, Human
auuuuguucaua

SEQ ID NO: 1590528 - RNA, 14 nt, Human
auuuuguucauaca

SEQ ID NO: 1590529 - RNA, 15 nt, Human
auuuuguucauacau

SEQ ID NO: 1590530 - RNA, 16 nt, Human
auuuuguucauacaua

SEQ ID NO: 1590531 - RNA, 18 nt, Human
auuuuguucauacauauu

SEQ ID NO: 1590532 - RNA, 14 nt, Human
auuuuccugaaaac

SEQ ID NO: 1590533 - RNA, 14 nt, Human
auuuucuauaauuu

SEQ ID NO: 1590534 - RNA, 15 nt, Human
auuuucuauaauuua

SEQ ID NO: 1590535 - RNA, 12 nt, Human
auuuuaauaaug

SEQ ID NO: 1590536 - RNA, 18 nt, Human
auugcuuuggucauauga

SEQ ID NO: 1590537 - RNA, 14 nt, Human
auugcuuuggucau

SEQ ID NO: 1590538 - RNA, 18 nt, Human
auugacuuuuuauggcac

SEQ ID NO: 1590539 - RNA, 13 nt, Human
auugacuuuuuau

SEQ ID NO: 1590540 - RNA, 19 nt, Human
auuggagcucgugggacag

SEQ ID NO: 1590541 - RNA, 19 nt, Human
auuggacaguaaaauccac

SEQ ID NO: 1590542 - RNA, 17 nt, Human
auuguacgaagaguauu

SEQ ID NO: 1590543 - RNA, 16 nt, Human
auuguacgaagaguau

SEQ ID NO: 1590544 - RNA, 13 nt, Human
auugucuagugaa

SEQ ID NO: 1590545 - RNA, 14 nt, Human
auuuauuuuaauaa

SEQ ID NO: 1590546 - RNA, 20 nt, Human
auuucuugagguaaaagcau

SEQ ID NO: 1590547 - RNA, 16 nt, Human
auuuuaaaagaaugau

SEQ ID NO: 1590548 - RNA, 23 nt, Human
auuuuaaaagaaugauuaugaau

SEQ ID NO: 1590549 - RNA, 15 nt, Human
auuuguauaaaauaa

SEQ ID NO: 1590550 - RNA, 14 nt, Human
auuuguauaaaaua

SEQ ID NO: 1590551 - RNA, 22 nt, Human
auuuguaguguuggagaagaac

SEQ ID NO: 1590552 - RNA, 22 nt, Human
acuauucaggagaguagaacag

SEQ ID NO: 1590553 - RNA, 21 nt, Human
acuauucaaacagucucagga

SEQ ID NO: 1590554 - RNA, 20 nt, Human
acuaguauuucuaugaaaua

SEQ ID NO: 1590555 - RNA, 17 nt, Human
acucuauguucuaagaa

SEQ ID NO: 1590556 - RNA, 15 nt, Human
acuaagagagaauga

SEQ ID NO: 1590557 - RNA, 13 nt, Human
acuaagagagaau

SEQ ID NO: 1590558 - RNA, 22 nt, Human
acgcaggcccccaggugccagu

SEQ ID NO: 1590559 - RNA, 22 nt, Human
acugugaaguuuacauuguaaa

SEQ ID NO: 1590560 - RNA, 22 nt, Human
acuguaagaaaauaucacuugu

SEQ ID NO: 1590561 - RNA, 13 nt, Human
acuguaagaaaau

SEQ ID NO: 1590562 - RNA, 19 nt, Human
acuguaagaaaauaucacu

SEQ ID NO: 1590563 - RNA, 18 nt, Human
acucugucucaguccaug

SEQ ID NO: 1590564 - RNA, 20 nt, Human
acucugucucaguccaugaa

SEQ ID NO: 1590565 - RNA, 13 nt, Human
acugccagcaacg

SEQ ID NO: 1590566 - RNA, 21 nt, Human
acuucugucuucacaacagau

SEQ ID NO: 1590567 - RNA, 12 nt, Human
acuucagacaua

SEQ ID NO: 1590568 - RNA, 22 nt, Human
acuucugucuucacaacagauu

SEQ ID NO: 1590569 - RNA, 18 nt, Human
acuuguaaaggaauuuaa

SEQ ID NO: 1590570 - RNA, 20 nt, Human
acuuuauacccagaaaguua

SEQ ID NO: 1590571 - RNA, 22 nt, Human
acuuuauacccagaaaguuauu

SEQ ID NO: 1590572 - RNA, 22 nt, Human
acuuuauuuucuauaauuuaaa

SEQ ID NO: 1590573 - RNA, 16 nt, Human
agaaaaucaggcuggc

SEQ ID NO: 1590574 - RNA, 23 nt, Human
agaaaguuauugauaaguucaua

SEQ ID NO: 1590575 - RNA, 11 nt, Human
agaaaguuauu

SEQ ID NO: 1590576 - RNA, 21 nt, Human
acacgagcaggcuacugucag

SEQ ID NO: 1590577 - RNA, 19 nt, Human
acacgagcaggcuacuguc

SEQ ID NO: 1590578 - RNA, 14 nt, Human
acacgagcaggcua

SEQ ID NO: 1590579 - RNA, 13 nt, Human
acaagaaaugaaa

SEQ ID NO: 1590580 - RNA, 13 nt, Human
aauuuugugaagc

SEQ ID NO: 1590581 - RNA, 23 nt, Human
acagcaguugaaaagacuccaaa

SEQ ID NO: 1590582 - RNA, 22 nt, Human
acagcaguugaaaagacuccaa

SEQ ID NO: 1590583 - RNA, 21 nt, Human
acagcaguugaaaagacucca

SEQ ID NO: 1590584 - RNA, 17 nt, Human
acccacaagaaaugaaa

SEQ ID NO: 1590585 - RNA, 21 nt, Human
acccacaagaaaugaaagcag

SEQ ID NO: 1590586 - RNA, 17 nt, Human
aaaaucaguuguacagu

SEQ ID NO: 1590587 - RNA, 21 nt, Human
aaaaucuacacuccagugaga

SEQ ID NO: 1590588 - RNA, 18 nt, Human
aaaaguucugcagauaaa

SEQ ID NO: 1590589 - RNA, 16 nt, Human
aaaaagaaacauuugg

SEQ ID NO: 1590590 - RNA, 24 nt, Human
aaacacucaguuguucaauaauaa

SEQ ID NO: 1590591 - RNA, 12 nt, Human
aaaauugaugug

SEQ ID NO: 1590592 - RNA, 14 nt, Human
aaaauugauguguu

SEQ ID NO: 1590593 - RNA, 21 nt, Human
aaaauugauguguuuauuuau

SEQ ID NO: 1590594 - RNA, 17 nt, Human
aaaaucucaauauuuca

SEQ ID NO: 1590595 - RNA, 16 nt, Human
aaaaucucaauauuuc

SEQ ID NO: 1590596 - RNA, 15 nt, Human
aaagaaauguaaggg

SEQ ID NO: 1590597 - RNA, 23 nt, Human
aaacugagaugugaacacaucag

SEQ ID NO: 1590598 - RNA, 21 nt, Human
aaacugagaugugaacacauc

SEQ ID NO: 1590599 - RNA, 19 nt, Human
aaaggcagaagcaacccaa

SEQ ID NO: 1590600 - RNA, 14 nt, Human
aaaggcagaagcaa

SEQ ID NO: 1590601 - RNA, 16 nt, Human
aaaucaaauaugcaaa

SEQ ID NO: 1590602 - RNA, 15 nt, Human
aaaucaaauaugcaa

SEQ ID NO: 1590603 - RNA, 14 nt, Human
aaaucaaauaugca

SEQ ID NO: 1590604 - RNA, 12 nt, Human
aaaucaaauaug

SEQ ID NO: 1590605 - RNA, 20 nt, Human
aaauauuuauuuuaauaaug

SEQ ID NO: 1590606 - RNA, 13 nt, Human
aaauauuuauuuu

SEQ ID NO: 1590607 - RNA, 15 nt, Human
aaauauuuauuuuaa

SEQ ID NO: 1590608 - RNA, 22 nt, Human
aacuuuauacccagaaaguuau

SEQ ID NO: 1590609 - RNA, 23 nt, Human
aacuuuauacccagaaaguuauu

SEQ ID NO: 1590610 - RNA, 20 nt, Human
aacuuuaugcuaagugaaau

SEQ ID NO: 1590611 - RNA, 21 nt, Human
aacuuuaugcuaagugaaaua

SEQ ID NO: 1590612 - RNA, 23 nt, Human
aacugagaugugaacacaucagc

SEQ ID NO: 1590613 - RNA, 20 nt, Human
aacugagaugugaacacauc

SEQ ID NO: 1590614 - RNA, 20 nt, Human
aacugacucuuaagaagacu

SEQ ID NO: 1590615 - RNA, 19 nt, Human
aacugacucuuaagaagac

SEQ ID NO: 1590616 - RNA, 18 nt, Human
aacugacucuuaagaaga

SEQ ID NO: 1590617 - RNA, 15 nt, Human
aacugacucuuaaga

SEQ ID NO: 1590618 - RNA, 19 nt, Human
aaauugacacuuaaaaaug

SEQ ID NO: 1590619 - RNA, 22 nt, Human
aaauugacacuuaaaaaugguu

SEQ ID NO: 1590620 - RNA, 22 nt, Human
aaauguuguucucuucuuuaaa

SEQ ID NO: 1590621 - RNA, 17 nt, Human
aaaucuuauaauuuaaa

SEQ ID NO: 1590622 - RNA, 18 nt, Human
aacaaauuuacagagaca

SEQ ID NO: 1590623 - RNA, 16 nt, Human
aacacaucagcuugcc

SEQ ID NO: 1590624 - RNA, 17 nt, Human
aaccuagggugauauua

SEQ ID NO: 1590625 - RNA, 17 nt, Human
aagcagauggaaugcug

SEQ ID NO: 1590626 - RNA, 19 nt, Human
aagcagauggaaugcugug

SEQ ID NO: 1590627 - RNA, 20 nt, Human
aagcagauggaaugcugugu

SEQ ID NO: 1590628 - RNA, 20 nt, Human
aaggcagcucuaaaugucaa

SEQ ID NO: 1590629 - RNA, 17 nt, Human
aagggaaacugccagca

SEQ ID NO: 1590630 - RNA, 16 nt, Human
aagggaaacugccagc

SEQ ID NO: 1590631 - RNA, 23 nt, Human
aagggaaacugccagcaacgcag

SEQ ID NO: 1590632 - RNA, 17 nt, Human
aaguccaagcauaccaa

SEQ ID NO: 1590633 - RNA, 18 nt, Human
aaguccaagcauuuagau

SEQ ID NO: 1590634 - RNA, 21 nt, Human
aaguagggacuucugucuuca

SEQ ID NO: 1590635 - RNA, 21 nt, Human
aaugcuagguuaauuccaauu

SEQ ID NO: 1590636 - RNA, 23 nt, Human
aauguuucaaacauauauaacaa

SEQ ID NO: 1590637 - RNA, 18 nt, Human
aaugcuagguuaauucca

SEQ ID NO: 1590638 - RNA, 19 nt, Human
aaugcuagguuaauuccaa

SEQ ID NO: 1590639 - RNA, 13 nt, Human
aauauguuucaaa

SEQ ID NO: 1590640 - RNA, 15 nt, Human
aauauguuucaaacu

SEQ ID NO: 1590641 - RNA, 16 nt, Human
aauauguuucaaacuu

SEQ ID NO: 1590642 - RNA, 17 nt, Human
aauauguuucaaacuuu

SEQ ID NO: 1590643 - RNA, 15 nt, Human
aaucaccaaaggcuc

SEQ ID NO: 1590644 - RNA, 15 nt, Human
aauccaaugaaauga

SEQ ID NO: 1590645 - RNA, 15 nt, Human
aaugauuaugaauua

SEQ ID NO: 1590646 - RNA, 23 nt, Human
aaugauuaugaauuacauuugua

SEQ ID NO: 1590647 - RNA, 21 nt, Human
aaugauuaugaauuacauuug

SEQ ID NO: 1590648 - RNA, 13 nt, Human
agcacugacagau

SEQ ID NO: 1590649 - RNA, 14 nt, Human
agcacugacagauu

SEQ ID NO: 1590650 - RNA, 18 nt, Human
agcacugacagauuucca

SEQ ID NO: 1590651 - RNA, 16 nt, Human
agcacugacuucuaag

SEQ ID NO: 1590652 - RNA, 21 nt, Human
agcaguugaaaagacuccaaa

SEQ ID NO: 1590653 - RNA, 13 nt, Human
agcaguugaaaag

SEQ ID NO: 1590654 - RNA, 15 nt, Human
agcaguucagagcug

SEQ ID NO: 1590655 - RNA, 23 nt, Human
agcaguucagagcugcccucucc

SEQ ID NO: 1590656 - RNA, 16 nt, Human
agcaguugaaaagacu

SEQ ID NO: 1590657 - RNA, 21 nt, Human
agccgggcgugguggugagug

SEQ ID NO: 1590658 - RNA, 21 nt, Human
agacugcauuauauuuauuac

SEQ ID NO: 1590659 - RNA, 17 nt, Human
agagaacuuccagaucc

SEQ ID NO: 1590660 - RNA, 17 nt, Human
aggcuagauguauguac

SEQ ID NO: 1590661 - RNA, 16 nt, Human
aggcuagauguaugua

SEQ ID NO: 1590662 - RNA, 15 nt, Human
aggcuagauguaugu

SEQ ID NO: 1590663 - RNA, 21 nt, Human
aggcuagaaccaccugccuau

SEQ ID NO: 1590664 - RNA, 17 nt, Human
aggcuacugucagcucc

SEQ ID NO: 1590665 - RNA, 24 nt, Human
aggugcuacaaaaacacagcaagg

SEQ ID NO: 1590666 - RNA, 23 nt, Human
aggugcuacaaaaacacagcaag

SEQ ID NO: 1590667 - RNA, 22 nt, Human
aggugcuacaaaaacacagcaa

SEQ ID NO: 1590668 - RNA, 21 nt, Human
aggugcuacaaaaacacagca

SEQ ID NO: 1590669 - RNA, 20 nt, Human
aggugcuacaaaaacacagc

SEQ ID NO: 1590670 - RNA, 19 nt, Human
aggugcuacaaaaacacag

SEQ ID NO: 1590671 - RNA, 18 nt, Human
aggugcuacaaaaacaca

SEQ ID NO: 1590672 - RNA, 20 nt, Human
agguaaaagcaucacaugaa

SEQ ID NO: 1590673 - RNA, 22 nt, Human
agcuccccucggagaagagcug

SEQ ID NO: 1590674 - RNA, 23 nt, Human
aggaugguucccuugaugaagaa

SEQ ID NO: 1590675 - RNA, 20 nt, Human
auguauucuagcuaauguaa

SEQ ID NO: 1590676 - RNA, 19 nt, Human
auguauucuagcuaaugua

SEQ ID NO: 1590677 - RNA, 19 nt, Human
auguaagggaaacugccag

SEQ ID NO: 1590678 - RNA, 20 nt, Human
auguaagggaaacugccagc

SEQ ID NO: 1590679 - RNA, 16 nt, Human
auguaagggaaacugc

SEQ ID NO: 1590680 - RNA, 14 nt, Human
auguaagggaaacu

SEQ ID NO: 1590681 - RNA, 14 nt, Human
auguuucaaacuuu

SEQ ID NO: 1590682 - RNA, 17 nt, Human
auguuucaaacuuugga

SEQ ID NO: 1590683 - RNA, 12 nt, Human
auguuucaaacu

SEQ ID NO: 1590684 - RNA, 13 nt, Human
auguuucaaacuu

SEQ ID NO: 1590685 - RNA, 17 nt, Human
auguucuaagaagugaa

SEQ ID NO: 1590686 - RNA, 18 nt, Human
augugggcagugauguca

SEQ ID NO: 1590687 - RNA, 21 nt, Human
augcauagguuuagcaguaua

SEQ ID NO: 1590688 - RNA, 17 nt, Human
augcauagguuuagcag

SEQ ID NO: 1590689 - RNA, 23 nt, Human
aucagcugcugaaacaacaaaua

SEQ ID NO: 1590690 - RNA, 22 nt, Human
aucagcugcugaaacaacaaau

SEQ ID NO: 1590691 - RNA, 21 nt, Human
aucagcugcugaaacaacaaa

SEQ ID NO: 1590692 - RNA, 15 nt, Human
auauuuauuuuaaua

SEQ ID NO: 1590693 - RNA, 14 nt, Human
auauuuauuuuaau

SEQ ID NO: 1590694 - RNA, 17 nt, Human
auauuuauuuuaauaau

SEQ ID NO: 1590695 - RNA, 23 nt, Human
auaguauuugagaguucuaaauu

SEQ ID NO: 1590696 - RNA, 14 nt, Human
auagucaaauugug

SEQ ID NO: 1590697 - RNA, 20 nt, Human
auaguauuugagaguucuaa

SEQ ID NO: 1590698 - RNA, 21 nt, Human
auaguauuugagaguucuaaa

SEQ ID NO: 1590699 - RNA, 15 nt, Human
auagguuuaauaauu

SEQ ID NO: 1590700 - RNA, 21 nt, Human
auaggugcuacaaaaacacag

SEQ ID NO: 1590701 - RNA, 15 nt, Human
auaggugcuacaaaa

SEQ ID NO: 1590702 - RNA, 23 nt, Human
auaggugcuacaaaaacacagca

SEQ ID NO: 1590703 - RNA, 14 nt, Human
auaggugcuacaaa

SEQ ID NO: 1590704 - RNA, 13 nt, Human
auauuauguguuu

SEQ ID NO: 1590705 - RNA, 13 nt, Human
auauuuauuuuaa

SEQ ID NO: 1590706 - RNA, 22 nt, Human
auaugcuucuguuuuauaauuu

SEQ ID NO: 1590707 - RNA, 20 nt, Human
auaugcuucuguuuuauaau

SEQ ID NO: 1590708 - RNA, 23 nt, Human
auaugcuucuguuuuauaauuuu

SEQ ID NO: 1590709 - RNA, 15 nt, Human
auaucaauuuaaaaa

SEQ ID NO: 1590710 - RNA, 20 nt, Human
auaauuaaauuuugaguucu

SEQ ID NO: 1590711 - RNA, 23 nt, Human
auaauguuucaaacauauauaac

SEQ ID NO: 1590712 - RNA, 20 nt, Human
auacacacucaaaucaagaa

SEQ ID NO: 1590713 - RNA, 18 nt, Human
auacacacucaaaucaag

SEQ ID NO: 1590714 - RNA, 17 nt, Human
auacacacucaaaucaa

SEQ ID NO: 1590715 - RNA, 22 nt, Human
auaaaaauauuguguugugaau

SEQ ID NO: 1590716 - RNA, 14 nt, Human
auaaaaauauugug

SEQ ID NO: 1590717 - RNA, 18 nt, Human
auaaaggauuaaugucaa

SEQ ID NO: 1590718 - RNA, 14 nt, Human
aguaugaaauuaua

SEQ ID NO: 1590719 - RNA, 16 nt, Human
aguaugaaauuauaua

SEQ ID NO: 1590720 - RNA, 19 nt, Human
agucaaauugugugaaagg

SEQ ID NO: 1590721 - RNA, 23 nt, Human
agucaaauugugugaaagguacu

SEQ ID NO: 1590722 - RNA, 12 nt, Human
aguccuguaaug

SEQ ID NO: 1590723 - RNA, 15 nt, Human
aguucauacauugua

SEQ ID NO: 1590724 - RNA, 22 nt, Human
aguugaaaaucuuauaauuuaa

SEQ ID NO: 1590725 - RNA, 10 nt, Human
aguucauaca

SEQ ID NO: 1590726 - RNA, 11 nt, Human
aguucauacau

SEQ ID NO: 1590727 - RNA, 22 nt, Human
aguugaaaagacuccaaagaaa

SEQ ID NO: 1590728 - RNA, 23 nt, Human
aguugaaaaucuuauaauuuaaa

SEQ ID NO: 1590729 - RNA, 15 nt, Human
agugucuuaauuaaa

SEQ ID NO: 1590730 - RNA, 18 nt, Human
agugucuuaauuaaaaga

SEQ ID NO: 1590731 - RNA, 17 nt, Human
agugucuuaauuaaaag

SEQ ID NO: 1590732 - RNA, 21 nt, Human
agugucuuaauuaaaagaaua

SEQ ID NO: 1590733 - RNA, 18 nt, Human
aaaaacacagcaagggug

SEQ ID NO: 1590734 - RNA, 13 nt, Human
aaaaacacagcaa

SEQ ID NO: 1590735 - RNA, 23 nt, Human
cacauaucuaguaugaaauuaua

SEQ ID NO: 1590736 - RNA, 14 nt, Human
cacaguuuucugag

SEQ ID NO: 1590737 - RNA, 15 nt, Human
cacaguuuucugaga

SEQ ID NO: 1590738 - RNA, 15 nt, Human
cacaggaaguagagg

SEQ ID NO: 1590739 - RNA, 20 nt, Human
cacaggaaccacaagacugc

SEQ ID NO: 1590740 - RNA, 19 nt, Human
cacaggaaccacaagacug

SEQ ID NO: 1590741 - RNA, 14 nt, Human
cacaacuauuuuuc

SEQ ID NO: 1590742 - RNA, 19 nt, Human
cacaacuauuuuuccaaaa

SEQ ID NO: 1590743 - RNA, 13 nt, Human
cacaacuauauug

SEQ ID NO: 1590744 - RNA, 19 nt, Human
cacacucaaaucaagaaac

SEQ ID NO: 1590745 - RNA, 11 nt, Human
cacaacagauu

SEQ ID NO: 1590746 - RNA, 22 nt, Human
caaugaaugaaugaauggcuaa

SEQ ID NO: 1590747 - RNA, 12 nt, Human
caacuuuauacc

SEQ ID NO: 1590748 - RNA, 15 nt, Human
caaauuuacagagac

SEQ ID NO: 1590749 - RNA, 16 nt, Human
caaauuuacagagaca

SEQ ID NO: 1590750 - RNA, 14 nt, Human
caaauuuacagaga

SEQ ID NO: 1590751 - RNA, 17 nt, Human
caagcacuaaacaaaga

SEQ ID NO: 1590752 - RNA, 23 nt, Human
caaaaaaauauauuuaaugauaa

SEQ ID NO: 1590753 - RNA, 15 nt, Human
caaauaaaaauauug

SEQ ID NO: 1590754 - RNA, 21 nt, Human
caaauguucaucaaugaauga

SEQ ID NO: 1590755 - RNA, 17 nt, Human
caaauaugcaaagcacu

SEQ ID NO: 1590756 - RNA, 16 nt, Human
caaauaugcaaagcac

SEQ ID NO: 1590757 - RNA, 18 nt, Human
caaauaugcaaagcacug

SEQ ID NO: 1590758 - RNA, 19 nt, Human
caaauaugcaaagcacuga

SEQ ID NO: 1590759 - RNA, 23 nt, Human
ccagugaauucuugaaggaaaau

SEQ ID NO: 1590760 - RNA, 13 nt, Human
ccaggugccaguu

SEQ ID NO: 1590761 - RNA, 12 nt, Human
ccaggugccagu

SEQ ID NO: 1590762 - RNA, 18 nt, Human
ccauccugaggcuccacu

SEQ ID NO: 1590763 - RNA, 20 nt, Human
ccauccugaggcuccacuug

SEQ ID NO: 1590764 - RNA, 20 nt, Human
ccagguagaggguguguaag

SEQ ID NO: 1590765 - RNA, 15 nt, Human
ccaccucccugcaau

SEQ ID NO: 1590766 - RNA, 19 nt, Human
ccaccucccugcaauaaaa

SEQ ID NO: 1590767 - RNA, 21 nt, Human
ccaccucccugcaauaaaaug

SEQ ID NO: 1590768 - RNA, 15 nt, Human
ccacugguucuucuu

SEQ ID NO: 1590769 - RNA, 14 nt, Human
ccagacaucaacag

SEQ ID NO: 1590770 - RNA, 15 nt, Human
ccuaacgaaguaucc

SEQ ID NO: 1590771 - RNA, 23 nt, Human
cccucuccugggcagcugccucc

SEQ ID NO: 1590772 - RNA, 20 nt, Human
cccucuccugggcagcugcc

SEQ ID NO: 1590773 - RNA, 21 nt, Human
cccucuccugggcagcugccu

SEQ ID NO: 1590774 - RNA, 22 nt, Human
cccucuccugggcagcugccuc

SEQ ID NO: 1590775 - RNA, 12 nt, Human
cccucccuccac

SEQ ID NO: 1590776 - RNA, 15 nt, Human
cccuugaugaagaag

SEQ ID NO: 1590777 - RNA, 15 nt, Human
ccccucggagaagag

SEQ ID NO: 1590778 - RNA, 13 nt, Human
ccccuccucugcu

SEQ ID NO: 1590779 - RNA, 14 nt, Human
ccccuccucugcuu

SEQ ID NO: 1590780 - RNA, 17 nt, Human
ccccuccucugcuugcc

SEQ ID NO: 1590781 - RNA, 16 nt, Human
cuaagauaguaacaau

SEQ ID NO: 1590782 - RNA, 15 nt, Human
cuaagagagaaugag

SEQ ID NO: 1590783 - RNA, 14 nt, Human
cuaagagagaauga

SEQ ID NO: 1590784 - RNA, 20 nt, Human
cuaaauuuuauaucuuguag

SEQ ID NO: 1590785 - RNA, 15 nt, Human
cuaaauuuuauaucu

SEQ ID NO: 1590786 - RNA, 16 nt, Human
cuaaauuuuauaucuu

SEQ ID NO: 1590787 - RNA, 13 nt, Human
cuaaauuuuauau

SEQ ID NO: 1590788 - RNA, 19 nt, Human
cuaaauugacacuuaaaaa

SEQ ID NO: 1590789 - RNA, 20 nt, Human
cgggaggcagagguugcagu

SEQ ID NO: 1590790 - RNA, 14 nt, Human
cuacacuaagagag

SEQ ID NO: 1590791 - RNA, 23 nt, Human
cuacacgagauacagaauuuuau

SEQ ID NO: 1590792 - RNA, 21 nt, Human
cuaagcuucacuguaaaauaa

SEQ ID NO: 1590793 - RNA, 18 nt, Human
cuaaguaaaaccacagca

SEQ ID NO: 1590794 - RNA, 14 nt, Human
cuaaguaaaaccac

SEQ ID NO: 1590795 - RNA, 19 nt, Human
cuaaguaaaaccacagcag

SEQ ID NO: 1590796 - RNA, 20 nt, Human
cuaaguaaaaccacagcagu

SEQ ID NO: 1590797 - RNA, 22 nt, Human
cuaggaaauauuuauuuuaaua

SEQ ID NO: 1590798 - RNA, 22 nt, Human
cuagcuaauguaauaacuguga

SEQ ID NO: 1590799 - RNA, 20 nt, Human
cuaggaaauauuuauuuuaa

SEQ ID NO: 1590800 - RNA, 19 nt, Human
cuaggaaauauuuauuuua

SEQ ID NO: 1590801 - RNA, 15 nt, Human
cuaggaaauauuuau

SEQ ID NO: 1590802 - RNA, 14 nt, Human
cuaggaaauauuua

SEQ ID NO: 1590803 - RNA, 15 nt, Human
cuauaggugcuacaa

SEQ ID NO: 1590804 - RNA, 19 nt, Human
cuagaguuuagcuggaaaa

SEQ ID NO: 1590805 - RNA, 18 nt, Human
cuagaguuuagcuggaaa

SEQ ID NO: 1590806 - RNA, 21 nt, Human
cuauucaggagaguagaacag

SEQ ID NO: 1590807 - RNA, 16 nt, Human
cuauucaaacagucuc

SEQ ID NO: 1590808 - RNA, 12 nt, Human
cuauaauuuaaa

SEQ ID NO: 1590809 - RNA, 13 nt, Human
cuauaauuuaaau

SEQ ID NO: 1590810 - RNA, 19 nt, Human
cuaugaaauauuauguuaa

SEQ ID NO: 1590811 - RNA, 12 nt, Human
cucaaauuugga

SEQ ID NO: 1590812 - RNA, 21 nt, Human
cucauaaaaagccugcaauuu

SEQ ID NO: 1590813 - RNA, 21 nt, Human
cucauuuccaagcaaguauua

SEQ ID NO: 1590814 - RNA, 17 nt, Human
cucauuuccaagcaagu

SEQ ID NO: 1590815 - RNA, 14 nt, Human
cucauuuccaagca

SEQ ID NO: 1590816 - RNA, 13 nt, Human
cucauuuccaagc

SEQ ID NO: 1590817 - RNA, 12 nt, Human
cucauuuccaag

SEQ ID NO: 1590818 - RNA, 14 nt, Human
cuccccucggagaa

SEQ ID NO: 1590819 - RNA, 22 nt, Human
cucaggaaaucaaauaugcaaa

SEQ ID NO: 1590820 - RNA, 15 nt, Human
ccuuggacucauuuu

SEQ ID NO: 1590821 - RNA, 18 nt, Human
ccuucggccuccauccug

SEQ ID NO: 1590822 - RNA, 19 nt, Human
ccuucggccuccauccuga

SEQ ID NO: 1590823 - RNA, 17 nt, Human
ccuucggccuccauccu

SEQ ID NO: 1590824 - RNA, 13 nt, Human
ccugggcagcugc

SEQ ID NO: 1590825 - RNA, 14 nt, Human
ccugggcagcugcc

SEQ ID NO: 1590826 - RNA, 14 nt, Human
ccugaggcuccacu

SEQ ID NO: 1590827 - RNA, 13 nt, Human
ccugaggcuccac

SEQ ID NO: 1590828 - RNA, 17 nt, Human
ccugaggcuccacuugg

SEQ ID NO: 1590829 - RNA, 13 nt, Human
ccugaaagaggaa

SEQ ID NO: 1590830 - RNA, 17 nt, Human
ccugccccugagcccau

SEQ ID NO: 1590831 - RNA, 21 nt, Human
gaaaauauuauguguuuccau

SEQ ID NO: 1590832 - RNA, 18 nt, Human
gaaaauauuuguaucaca

SEQ ID NO: 1590833 - RNA, 22 nt, Human
gaaaaucuacacuccagugaga

SEQ ID NO: 1590834 - RNA, 18 nt, Human
gaaaaucuuauaauuuaa

SEQ ID NO: 1590835 - RNA, 20 nt, Human
gaaaaugauacgcaacauaa

SEQ ID NO: 1590836 - RNA, 16 nt, Human
gaaacacaacuauauu

SEQ ID NO: 1590837 - RNA, 14 nt, Human
gaaacccugucucu

SEQ ID NO: 1590838 - RNA, 23 nt, Human
gaaacucguuaauuuguaguguu

SEQ ID NO: 1590839 - RNA, 17 nt, Human
gaaagagaacuuccaga

SEQ ID NO: 1590840 - RNA, 21 nt, Human
gaaagaggaaugaaguacuca

SEQ ID NO: 1590841 - RNA, 20 nt, Human
gaaagaggcagcuugaaacu

SEQ ID NO: 1590842 - RNA, 17 nt, Human
gaaagcagaacagugau

SEQ ID NO: 1590843 - RNA, 22 nt, Human
gaaagcagaacagugauuacca

SEQ ID NO: 1590844 - RNA, 14 nt, Human
gaaagcagggacuu

SEQ ID NO: 1590845 - RNA, 21 nt, Human
gaaagcuugcccuggugccuc

SEQ ID NO: 1590846 - RNA, 21 nt, Human
cuuuaucaaagggugaaaauu

SEQ ID NO: 1590847 - RNA, 22 nt, Human
cuuuaucaaagggugaaaauua

SEQ ID NO: 1590848 - RNA, 19 nt, Human
cuugaguuuaaauuguaau

SEQ ID NO: 1590849 - RNA, 23 nt, Human
cuugucaauaaaauccauacauu

SEQ ID NO: 1590850 - RNA, 17 nt, Human
cuuguacuuuauuuucu

SEQ ID NO: 1590851 - RNA, 16 nt, Human
cuuucugcuuguguua

SEQ ID NO: 1590852 - RNA, 13 nt, Human
cuucccuuucugc

SEQ ID NO: 1590853 - RNA, 15 nt, Human
cuuauuucauuucuu

SEQ ID NO: 1590854 - RNA, 14 nt, Human
cuuauuucauuucu

SEQ ID NO: 1590855 - RNA, 22 nt, Human
cuuagaugcaguucugaagaag

SEQ ID NO: 1590856 - RNA, 19 nt, Human
cuuauaggaauugacccac

SEQ ID NO: 1590857 - RNA, 14 nt, Human
cuucugugaaagua

SEQ ID NO: 1590858 - RNA, 14 nt, Human
cuugaacccgggag

SEQ ID NO: 1590859 - RNA, 22 nt, Human
cuucugucuucacaacagauua

SEQ ID NO: 1590860 - RNA, 21 nt, Human
cuucugucuucacaacagauu

SEQ ID NO: 1590861 - RNA, 18 nt, Human
cuucugucuucacaacag

SEQ ID NO: 1590862 - RNA, 23 nt, Human
cuguuaaaagaugaaaauauuug

SEQ ID NO: 1590863 - RNA, 21 nt, Human
cuguuaaaagaugaaaauauu

SEQ ID NO: 1590864 - RNA, 20 nt, Human
cuguauuuuaaaagaaugau

SEQ ID NO: 1590865 - RNA, 22 nt, Human
cuguauuuuaaaagaaugauua

SEQ ID NO: 1590866 - RNA, 23 nt, Human
cuguaaucacagcuacuugggag

SEQ ID NO: 1590867 - RNA, 22 nt, Human
cugggggggauuguaaaauggu

SEQ ID NO: 1590868 - RNA, 14 nt, Human
cugccuccccuccu

SEQ ID NO: 1590869 - RNA, 13 nt, Human
cugccuccccucc

SEQ ID NO: 1590870 - RNA, 16 nt, Human
cugcccucuccugggc

SEQ ID NO: 1590871 - RNA, 18 nt, Human
cugcccucuccugggcag

SEQ ID NO: 1590872 - RNA, 19 nt, Human
cugcccucuccugggcagc

SEQ ID NO: 1590873 - RNA, 20 nt, Human
cugcccucuccugggcagcu

SEQ ID NO: 1590874 - RNA, 21 nt, Human
cugcccucuccugggcagcug

SEQ ID NO: 1590875 - RNA, 13 nt, Human
cuggagcucugcc

SEQ ID NO: 1590876 - RNA, 16 nt, Human
cuggagcucugcccau

SEQ ID NO: 1590877 - RNA, 23 nt, Human
cuggccuucggccuccauccuga

SEQ ID NO: 1590878 - RNA, 22 nt, Human
cuggccuucggccuccauccug

SEQ ID NO: 1590879 - RNA, 22 nt, Human
cuggcacaguuuucugagaaag

SEQ ID NO: 1590880 - RNA, 21 nt, Human
cuggcacaguuuucugagaaa

SEQ ID NO: 1590881 - RNA, 15 nt, Human
gagaguagaacagau

SEQ ID NO: 1590882 - RNA, 20 nt, Human
gagacagcucugcauacuca

SEQ ID NO: 1590883 - RNA, 21 nt, Human
gagaaugagagacacacugaa

SEQ ID NO: 1590884 - RNA, 20 nt, Human
gagaaugagagacacacuga

SEQ ID NO: 1590885 - RNA, 15 nt, Human
gacuccaaagaaaug

SEQ ID NO: 1590886 - RNA, 12 nt, Human
gacuccaaagaa

SEQ ID NO: 1590887 - RNA, 11 nt, Human
gacuccaaaga

SEQ ID NO: 1590888 - RNA, 21 nt, Human
gacucauuuuaaaaaauggaa

SEQ ID NO: 1590889 - RNA, 18 nt, Human
gacuccaaagaaauguaa

SEQ ID NO: 1590890 - RNA, 16 nt, Human
gacuccaaagaaaugu

SEQ ID NO: 1590891 - RNA, 16 nt, Human
gacugcauuauauuua

SEQ ID NO: 1590892 - RNA, 14 nt, Human
gacugcauuauauu

SEQ ID NO: 1590893 - RNA, 24 nt, Human
gacugcauuauauuuauuacugua

SEQ ID NO: 1590894 - RNA, 23 nt, Human
gacuucugucuucacaacagauu

SEQ ID NO: 1590895 - RNA, 20 nt, Human
gacuucugucuucacaacag

SEQ ID NO: 1590896 - RNA, 23 nt, Human
gacuucuaaguaaaaccacagca

SEQ ID NO: 1590897 - RNA, 19 nt, Human
gacuucuaaguaaaaccac

SEQ ID NO: 1590898 - RNA, 24 nt, Human
gacuucuaaguaaaaccacagcag

SEQ ID NO: 1590899 - RNA, 18 nt, Human
gacuucuaaguaaaacca

SEQ ID NO: 1590900 - RNA, 17 nt, Human
gacuucuaaguaaaacc

SEQ ID NO: 1590901 - RNA, 16 nt, Human
gacuucuaaguaaaac

SEQ ID NO: 1590902 - RNA, 22 nt, Human
gagaaccuagggugauauuaac

SEQ ID NO: 1590903 - RNA, 21 nt, Human
gagaaccuagggugauauuaa

SEQ ID NO: 1590904 - RNA, 23 nt, Human
gagaacuuccagauccuggaaau

SEQ ID NO: 1590905 - RNA, 22 nt, Human
gagaacuuccagauccuggaaa

SEQ ID NO: 1590906 - RNA, 13 nt, Human
gagaagagcuguu

SEQ ID NO: 1590907 - RNA, 17 nt, Human
gagaaugagagacacac

SEQ ID NO: 1590908 - RNA, 18 nt, Human
gaauucuugaaggaaaau

SEQ ID NO: 1590909 - RNA, 21 nt, Human
gaauugacccacaagaaauga

SEQ ID NO: 1590910 - RNA, 16 nt, Human
gaauugacccacaaga

SEQ ID NO: 1590911 - RNA, 16 nt, Human
gaauuggagcucgugg

SEQ ID NO: 1590912 - RNA, 15 nt, Human
gaauguuaagcagau

SEQ ID NO: 1590913 - RNA, 14 nt, Human
gaauguuaagcaga

SEQ ID NO: 1590914 - RNA, 19 nt, Human
gaaucucauaauuuauaca

SEQ ID NO: 1590915 - RNA, 13 nt, Human
gaaugcuguguua

SEQ ID NO: 1590916 - RNA, 14 nt, Human
gaaugcuguguuaa

SEQ ID NO: 1590917 - RNA, 18 nt, Human
gaaucucauaauuuauac

SEQ ID NO: 1590918 - RNA, 13 nt, Human
gacacaacuauuu

SEQ ID NO: 1590919 - RNA, 16 nt, Human
gacaaggaaaaaauaa

SEQ ID NO: 1590920 - RNA, 17 nt, Human
gacagggaggacgcucu

SEQ ID NO: 1590921 - RNA, 18 nt, Human
gacagggaggacgcucuc

SEQ ID NO: 1590922 - RNA, 20 nt, Human
gacauagaauuaacacauga

SEQ ID NO: 1590923 - RNA, 22 nt, Human
gacccacaagaaaugaaagcag

SEQ ID NO: 1590924 - RNA, 15 nt, Human
gacccacaagaaaug

SEQ ID NO: 1590925 - RNA, 16 nt, Human
gacccaaaaggcagaa

SEQ ID NO: 1590926 - RNA, 21 nt, Human
gaccacugcagaagacaguau

SEQ ID NO: 1590927 - RNA, 16 nt, Human
gacaugggacauuugc

SEQ ID NO: 1590928 - RNA, 17 nt, Human
gacaugggacauuugcu

SEQ ID NO: 1590929 - RNA, 21 nt, Human
gcaaagcugaugacaacuucc

SEQ ID NO: 1590930 - RNA, 23 nt, Human
gcaaagcacugacuucuaaguaa

SEQ ID NO: 1590931 - RNA, 16 nt, Human
gcaaauugucacagga

SEQ ID NO: 1590932 - RNA, 22 nt, Human
gaugguucccuugaugaagaag

SEQ ID NO: 1590933 - RNA, 22 nt, Human
gaugcuagaacucccuuucaac

SEQ ID NO: 1590934 - RNA, 20 nt, Human
gaugcuagaacucccuuuca

SEQ ID NO: 1590935 - RNA, 18 nt, Human
gaugcuagaacucccuuu

SEQ ID NO: 1590936 - RNA, 14 nt, Human
gcaauuucauaugc

SEQ ID NO: 1590937 - RNA, 18 nt, Human
gcacugacuucuaaguaa

SEQ ID NO: 1590938 - RNA, 15 nt, Human
gcacugacuucuaag

SEQ ID NO: 1590939 - RNA, 19 nt, Human
gcacuguggguagacacac

SEQ ID NO: 1590940 - RNA, 18 nt, Human
gaguguacuuaacuauuc

SEQ ID NO: 1590941 - RNA, 19 nt, Human
gagugucuuaauuaaaaga

SEQ ID NO: 1590942 - RNA, 22 nt, Human
gauaaauggcuuccuggcaaua

SEQ ID NO: 1590943 - RNA, 19 nt, Human
gaggcagagguugcaguga

SEQ ID NO: 1590944 - RNA, 14 nt, Human
ggaaugcuguguua

SEQ ID NO: 1590945 - RNA, 23 nt, Human
ggaauuucucccagucauuuaau

SEQ ID NO: 1590946 - RNA, 22 nt, Human
ggaauuggagcucgugggacag

SEQ ID NO: 1590947 - RNA, 16 nt, Human
ggaauuggagcucgug

SEQ ID NO: 1590948 - RNA, 20 nt, Human
ggaagugacgguuuaauggg

SEQ ID NO: 1590949 - RNA, 16 nt, Human
ggacauuugcucaugg

SEQ ID NO: 1590950 - RNA, 14 nt, Human
ggacgcucucuggc

SEQ ID NO: 1590951 - RNA, 13 nt, Human
ggacgcucucugg

SEQ ID NO: 1590952 - RNA, 15 nt, Human
ggacgcucucuggcc

SEQ ID NO: 1590953 - RNA, 19 nt, Human
ggagaaucacuugaacccg

SEQ ID NO: 1590954 - RNA, 15 nt, Human
ggagaaucacuugaa

SEQ ID NO: 1590955 - RNA, 14 nt, Human
gcuuuaucaaaggg

SEQ ID NO: 1590956 - RNA, 17 nt, Human
ggaaaucaaauaugcaa

SEQ ID NO: 1590957 - RNA, 20 nt, Human
gcugucuacacuaagagaga

SEQ ID NO: 1590958 - RNA, 14 nt, Human
ggcauggcugggaa

SEQ ID NO: 1590959 - RNA, 15 nt, Human
ggauuguaaaauggu

SEQ ID NO: 1590960 - RNA, 17 nt, Human
ggauuagggagagaaga

SEQ ID NO: 1590961 - RNA, 20 nt, Human
gcucucuggccuucggccuc

SEQ ID NO: 1590962 - RNA, 19 nt, Human
gcucucuggccuucggccu

SEQ ID NO: 1590963 - RNA, 15 nt, Human
gcucucuggccuucg

SEQ ID NO: 1590964 - RNA, 14 nt, Human
gcucucuggccuuc

SEQ ID NO: 1590965 - RNA, 13 nt, Human
gcucucuggccuu

SEQ ID NO: 1590966 - RNA, 12 nt, Human
gcucucuggccu

SEQ ID NO: 1590967 - RNA, 11 nt, Human
gcucucuggcc

SEQ ID NO: 1590968 - RNA, 17 nt, Human
gcuaagcaaaaugugau

SEQ ID NO: 1590969 - RNA, 14 nt, Human
gcuaagcauuccaa

SEQ ID NO: 1590970 - RNA, 20 nt, Human
gcuccauuuuuagugaaaua

SEQ ID NO: 1590971 - RNA, 12 nt, Human
gcccucuccugg

SEQ ID NO: 1590972 - RNA, 13 nt, Human
gcccucuccuggg

SEQ ID NO: 1590973 - RNA, 14 nt, Human
gcccucuccugggc

SEQ ID NO: 1590974 - RNA, 22 nt, Human
gcccucuccugggcagcugccu

SEQ ID NO: 1590975 - RNA, 23 nt, Human
gcccucuccugggcagcugccuc

SEQ ID NO: 1590976 - RNA, 17 nt, Human
gccuaagugcagccccg

SEQ ID NO: 1590977 - RNA, 22 nt, Human
gccuauauuuuuuguuaaauga

SEQ ID NO: 1590978 - RNA, 15 nt, Human
guacgaagaguauuu

SEQ ID NO: 1590979 - RNA, 15 nt, Human
guaccgcaaugugac

SEQ ID NO: 1590980 - RNA, 15 nt, Human
guagaggagaaacug

SEQ ID NO: 1590981 - RNA, 23 nt, Human
guacuuuauuuucuauaauuuaa

SEQ ID NO: 1590982 - RNA, 13 nt, Human
guaauucaagaaa

SEQ ID NO: 1590983 - RNA, 14 nt, Human
guaauucaagaaaa

SEQ ID NO: 1590984 - RNA, 15 nt, Human
guaauuggaaaggca

SEQ ID NO: 1590985 - RNA, 19 nt, Human
guaaugauaacuggaaacu

SEQ ID NO: 1590986 - RNA, 15 nt, Human
guaaauaguauuuga

SEQ ID NO: 1590987 - RNA, 16 nt, Human
guaaauaguauuugag

SEQ ID NO: 1590988 - RNA, 17 nt, Human
guaaauaguauuugaga

SEQ ID NO: 1590989 - RNA, 18 nt, Human
guaagggaaacugccagc

SEQ ID NO: 1590990 - RNA, 17 nt, Human
guaagggaaacugccag

SEQ ID NO: 1590991 - RNA, 23 nt, Human
guaaaaccacagcaguugaaaag

SEQ ID NO: 1590992 - RNA, 18 nt, Human
guaaaaccacagcaguug

SEQ ID NO: 1590993 - RNA, 16 nt, Human
guaaaaccacagcagu

SEQ ID NO: 1590994 - RNA, 15 nt, Human
guaaaaccacagcag

SEQ ID NO: 1590995 - RNA, 14 nt, Human
guaaaaccacagca

SEQ ID NO: 1590996 - RNA, 22 nt, Human
gguagacacacaugaaguccaa

SEQ ID NO: 1590997 - RNA, 15 nt, Human
gguagacacacauga

SEQ ID NO: 1590998 - RNA, 22 nt, Human
gguacuucaaauccuugaagau

SEQ ID NO: 1590999 - RNA, 19 nt, Human
ggugcuacaaaaacacagc

SEQ ID NO: 1591000 - RNA, 21 nt, Human
ggugcuacaaaaacacagcaa

SEQ ID NO: 1591001 - RNA, 19 nt, Human
guauuugagaguucuaaau

SEQ ID NO: 1591002 - RNA, 21 nt, Human
guauuugagaguucuaaauuu

SEQ ID NO: 1591003 - RNA, 22 nt, Human
guauuucuaugaaauauuaugu

SEQ ID NO: 1591004 - RNA, 17 nt, Human
guauuucuaugaaauau

SEQ ID NO: 1591005 - RNA, 18 nt, Human
guauuuuaaaagaaugau

SEQ ID NO: 1591006 - RNA, 17 nt, Human
guauuuuaaaagaauga

SEQ ID NO: 1591007 - RNA, 16 nt, Human
guauuuuaaaagaaug

SEQ ID NO: 1591008 - RNA, 21 nt, Human
gucaauaaaauccauacauuu

SEQ ID NO: 1591009 - RNA, 15 nt, Human
gucaauaaaauccau

SEQ ID NO: 1591010 - RNA, 14 nt, Human
gucaccucauggaa

SEQ ID NO: 1591011 - RNA, 20 nt, Human
gucccagccagcaguucaga

SEQ ID NO: 1591012 - RNA, 13 nt, Human
gucugacuguuuc

SEQ ID NO: 1591013 - RNA, 23 nt, Human
gucuacacuaagagagaaugaga

SEQ ID NO: 1591014 - RNA, 17 nt, Human
gucuacacuaagagaga

SEQ ID NO: 1591015 - RNA, 17 nt, Human
gugaaaguacauuugga

SEQ ID NO: 1591016 - RNA, 12 nt, Human
gugaaaauuauu

SEQ ID NO: 1591017 - RNA, 15 nt, Human
gugaaaauuauuuug

SEQ ID NO: 1591018 - RNA, 20 nt, Human
gugaaacucguuaauuugua

SEQ ID NO: 1591019 - RNA, 19 nt, Human
gugaaagaaaauaacaaua

SEQ ID NO: 1591020 - RNA, 16 nt, Human
gugagcagucaggaaa

SEQ ID NO: 1591021 - RNA, 16 nt, Human
gugacaagcucacaga

SEQ ID NO: 1591022 - RNA, 18 nt, Human
gugcaaauugucacagga

SEQ ID NO: 1591023 - RNA, 23 nt, Human
uaugacauaaaaacaacuuuaua

SEQ ID NO: 1591024 - RNA, 19 nt, Human
uaugacauaaaaacaacuu

SEQ ID NO: 1591025 - RNA, 22 nt, Human
uaugacauaaaaacaacuuuau

SEQ ID NO: 1591026 - RNA, 23 nt, Human
uaugaauuacauuuguauaaaau

SEQ ID NO: 1591027 - RNA, 17 nt, Human
uaugaauuacauuugua

SEQ ID NO: 1591028 - RNA, 17 nt, Human
uauccuuucuaacaaaa

SEQ ID NO: 1591029 - RNA, 15 nt, Human
uauccuucagccuga

SEQ ID NO: 1591030 - RNA, 16 nt, Human
uaugcuucuguuuuau

SEQ ID NO: 1591031 - RNA, 15 nt, Human
uaugcuucuguuuua

SEQ ID NO: 1591032 - RNA, 14 nt, Human
uaugcaaagcacug

SEQ ID NO: 1591033 - RNA, 13 nt, Human
uaugcaaagcacu

SEQ ID NO: 1591034 - RNA, 12 nt, Human
uaugcaaagcac

SEQ ID NO: 1591035 - RNA, 15 nt, Human
uaugcaaagcacuga

SEQ ID NO: 1591036 - RNA, 16 nt, Human
uaugauucccagccag

SEQ ID NO: 1591037 - RNA, 15 nt, Human
uaguaugaaauuaua

SEQ ID NO: 1591038 - RNA, 23 nt, Human
uaguaugaaauuauauaaguauu

SEQ ID NO: 1591039 - RNA, 16 nt, Human
uaguauuucuaugaaa

SEQ ID NO: 1591040 - RNA, 13 nt, Human
uaguaugaaauua

SEQ ID NO: 1591041 - RNA, 19 nt, Human
uaguauuucuaugaaauau

SEQ ID NO: 1591042 - RNA, 18 nt, Human
uaguauuucuaugaaaua

SEQ ID NO: 1591043 - RNA, 18 nt, Human
uaggugcuacaaaaacac

SEQ ID NO: 1591044 - RNA, 13 nt, Human
uaguaucaaaaga

SEQ ID NO: 1591045 - RNA, 15 nt, Human
uagugcaaauuguca

SEQ ID NO: 1591046 - RNA, 14 nt, Human
uagugcaaauuguc

SEQ ID NO: 1591047 - RNA, 14 nt, Human
uagucaaauugugu

SEQ ID NO: 1591048 - RNA, 13 nt, Human
uagucaaauugug

SEQ ID NO: 1591049 - RNA, 18 nt, Human
uaggccaugggacaggga

SEQ ID NO: 1591050 - RNA, 12 nt, Human
uaggaauugacc

SEQ ID NO: 1591051 - RNA, 20 nt, Human
uaggaauugacccacaagaa

SEQ ID NO: 1591052 - RNA, 16 nt, Human
uaggucagugcaaaua

SEQ ID NO: 1591053 - RNA, 13 nt, Human
uauaugcuucugu

SEQ ID NO: 1591054 - RNA, 13 nt, Human
uauauaacaaugc

SEQ ID NO: 1591055 - RNA, 20 nt, Human
ucaaagagagaaaauaaaga

SEQ ID NO: 1591056 - RNA, 15 nt, Human
ucaaagagagaaaau

SEQ ID NO: 1591057 - RNA, 17 nt, Human
ucaaauaugcaaagcac

SEQ ID NO: 1591058 - RNA, 19 nt, Human
ucaaauaugcaaagcacug

SEQ ID NO: 1591059 - RNA, 18 nt, Human
ucaaauaugcaaagcacu

SEQ ID NO: 1591060 - RNA, 16 nt, Human
ucaaauccuugaagau

SEQ ID NO: 1591061 - RNA, 17 nt, Human
ucaaacauauauaacaa

SEQ ID NO: 1591062 - RNA, 22 nt, Human
ucaaacagucucaggaaaucaa

SEQ ID NO: 1591063 - RNA, 22 nt, Human
ucaacuccaaacugacucuuaa

SEQ ID NO: 1591064 - RNA, 12 nt, Human
ucacauuuaaau

SEQ ID NO: 1591065 - RNA, 22 nt, Human
ucacaagacccaaaaggcagaa

SEQ ID NO: 1591066 - RNA, 14 nt, Human
ucaauaaaauccau

SEQ ID NO: 1591067 - RNA, 14 nt, Human
uauugauaaguuca

SEQ ID NO: 1591068 - RNA, 16 nt, Human
uauugauaaguucaua

SEQ ID NO: 1591069 - RNA, 23 nt, Human
uauugauaaguucauacauugua

SEQ ID NO: 1591070 - RNA, 14 nt, Human
uauuguguugugaa

SEQ ID NO: 1591071 - RNA, 17 nt, Human
uauuguuuaaaaucauu

SEQ ID NO: 1591072 - RNA, 16 nt, Human
uauuguuuaaaaucau

SEQ ID NO: 1591073 - RNA, 15 nt, Human
uauuguuuaaaauca

SEQ ID NO: 1591074 - RNA, 20 nt, Human
uauuguuuaaaaucauuucu

SEQ ID NO: 1591075 - RNA, 14 nt, Human
uauuuauuacugua

SEQ ID NO: 1591076 - RNA, 13 nt, Human
uauuucuaugaaa

SEQ ID NO: 1591077 - RNA, 15 nt, Human
uauuucuaugaaaua

SEQ ID NO: 1591078 - RNA, 14 nt, Human
uauuucuaugaaau

SEQ ID NO: 1591079 - RNA, 12 nt, Human
uauuauguguuu

SEQ ID NO: 1591080 - RNA, 16 nt, Human
uauuauguuaaaacug

SEQ ID NO: 1591081 - RNA, 17 nt, Human
uauuauauuuacaaaug

SEQ ID NO: 1591082 - RNA, 17 nt, Human
uauguucuaagaaguga

SEQ ID NO: 1591083 - RNA, 19 nt, Human
uauguuagugcaaauuguc

SEQ ID NO: 1591084 - RNA, 12 nt, Human
uauguuaaaacu

SEQ ID NO: 1591085 - RNA, 19 nt, Human
uauggaggcuuugcauaga

SEQ ID NO: 1591086 - RNA, 22 nt, Human
uccaaaaagauuuucagaaaau

SEQ ID NO: 1591087 - RNA, 16 nt, Human
uccaaaccaaauaaaa

SEQ ID NO: 1591088 - RNA, 17 nt, Human
uccaaagaaauguaagg

SEQ ID NO: 1591089 - RNA, 14 nt, Human
uccaaagaaaugua

SEQ ID NO: 1591090 - RNA, 16 nt, Human
ucauuaggauggcuag

SEQ ID NO: 1591091 - RNA, 11 nt, Human
ucauagcagcu

SEQ ID NO: 1591092 - RNA, 12 nt, Human
ucauagcagcuu

SEQ ID NO: 1591093 - RNA, 17 nt, Human
ucaucaaugaaugaaug

SEQ ID NO: 1591094 - RNA, 19 nt, Human
uccagguagagggugugua

SEQ ID NO: 1591095 - RNA, 15 nt, Human
uccauacauuugugu

SEQ ID NO: 1591096 - RNA, 20 nt, Human
uccaugggccauaugaaaag

SEQ ID NO: 1591097 - RNA, 23 nt, Human
uccacuuggucugugagaugcua

SEQ ID NO: 1591098 - RNA, 21 nt, Human
uccacuuggucugugagaugc

SEQ ID NO: 1591099 - RNA, 17 nt, Human
ucuacacuaagagagaa

SEQ ID NO: 1591100 - RNA, 16 nt, Human
ucggagaagagcuguu

SEQ ID NO: 1591101 - RNA, 14 nt, Human
ucggagaagagcug

SEQ ID NO: 1591102 - RNA, 12 nt, Human
ucggagaagagc

SEQ ID NO: 1591103 - RNA, 23 nt, Human
ucucaguccaugaagauguagag

SEQ ID NO: 1591104 - RNA, 23 nt, Human
uccuagugaaagaggcagcuuga

SEQ ID NO: 1591105 - RNA, 14 nt, Human
uccuagugaaagag

SEQ ID NO: 1591106 - RNA, 18 nt, Human
uccugccccugagcccau

SEQ ID NO: 1591107 - RNA, 17 nt, Human
uccugccccugagccca

SEQ ID NO: 1591108 - RNA, 20 nt, Human
uccugaggcuccacuugguc

SEQ ID NO: 1591109 - RNA, 19 nt, Human
uccugaggcuccacuuggu

SEQ ID NO: 1591110 - RNA, 21 nt, Human
uccugaggcuccacuuggucu

SEQ ID NO: 1591111 - RNA, 17 nt, Human
uccuggcaauagucaaa

SEQ ID NO: 1591112 - RNA, 16 nt, Human
ugacagaauauguuuc

SEQ ID NO: 1591113 - RNA, 20 nt, Human
ugacaagcucacagaccuuu

SEQ ID NO: 1591114 - RNA, 15 nt, Human
ugacaagcucacaga

SEQ ID NO: 1591115 - RNA, 12 nt, Human
ugacaagcucac

SEQ ID NO: 1591116 - RNA, 20 nt, Human
ugaccacugcagaagacagu

SEQ ID NO: 1591117 - RNA, 18 nt, Human
ugacaugggacauuugcu

SEQ ID NO: 1591118 - RNA, 17 nt, Human
ugacaugggacauuugc

SEQ ID NO: 1591119 - RNA, 16 nt, Human
ugacaugggacauuug

SEQ ID NO: 1591120 - RNA, 18 nt, Human
ugaauuacauuuguauaa

SEQ ID NO: 1591121 - RNA, 16 nt, Human
ugaauuacauuuguau

SEQ ID NO: 1591122 - RNA, 15 nt, Human
ugaauuacauuugua

SEQ ID NO: 1591123 - RNA, 11 nt, Human
ugaaguccaag

SEQ ID NO: 1591124 - RNA, 13 nt, Human
ugaaguccaagca

SEQ ID NO: 1591125 - RNA, 18 nt, Human
ugaaagaggcagcuugaa

SEQ ID NO: 1591126 - RNA, 18 nt, Human
ugaaacccugucucuacu

SEQ ID NO: 1591127 - RNA, 15 nt, Human
ugaaagguacuucaa

SEQ ID NO: 1591128 - RNA, 16 nt, Human
ugaaagguacuucaaa

SEQ ID NO: 1591129 - RNA, 22 nt, Human
ugaaacaacaaauaggaauugu

SEQ ID NO: 1591130 - RNA, 20 nt, Human
ugaaaagcuccauuuuuagu

SEQ ID NO: 1591131 - RNA, 16 nt, Human
ugaaauauugacuuuu

SEQ ID NO: 1591132 - RNA, 12 nt, Human
ucuuugccaagu

SEQ ID NO: 1591133 - RNA, 19 nt, Human
ucuuuccacagaagcucca

SEQ ID NO: 1591134 - RNA, 23 nt, Human
ugagacguuuuuggaagaguagu

SEQ ID NO: 1591135 - RNA, 16 nt, Human
ugagagugaacaaauu

SEQ ID NO: 1591136 - RNA, 16 nt, Human
ugauaacuggaaacuu

SEQ ID NO: 1591137 - RNA, 20 nt, Human
ugaggcuccacuuggucugu

SEQ ID NO: 1591138 - RNA, 18 nt, Human
ugaggcuccacuuggucu

SEQ ID NO: 1591139 - RNA, 14 nt, Human
ugauguguuuauuu

SEQ ID NO: 1591140 - RNA, 18 nt, Human
ugauguguuuauuuauag

SEQ ID NO: 1591141 - RNA, 17 nt, Human
ugaucuuuaaaauacac

SEQ ID NO: 1591142 - RNA, 23 nt, Human
ugaugcuacaggauuugaaauug

SEQ ID NO: 1591143 - RNA, 20 nt, Human
ugaugcuacaggauuugaaa

SEQ ID NO: 1591144 - RNA, 14 nt, Human
ugaucuuuaaaaua

SEQ ID NO: 1591145 - RNA, 24 nt, Human
ugaucagcuuauugucuagugaaa

SEQ ID NO: 1591146 - RNA, 17 nt, Human
ugaucagcuuauugucu

SEQ ID NO: 1591147 - RNA, 22 nt, Human
ugauuaugaauuacauuuguau

SEQ ID NO: 1591148 - RNA, 21 nt, Human
ugauuaugaauuacauuugua

SEQ ID NO: 1591149 - RNA, 22 nt, Human
ugauguuuagaaacacaacuau

SEQ ID NO: 1591150 - RNA, 19 nt, Human
ugauuaugaauuacauuug

SEQ ID NO: 1591151 - RNA, 17 nt, Human
ugauuaugaauuacauu

SEQ ID NO: 1591152 - RNA, 13 nt, Human
ugauuauauguca

SEQ ID NO: 1591153 - RNA, 11 nt, Human
ugcuguguuaa

SEQ ID NO: 1591154 - RNA, 18 nt, Human
ugcuguguuaaauaaacc

SEQ ID NO: 1591155 - RNA, 20 nt, Human
ugcugggggggauuguaaaa

SEQ ID NO: 1591156 - RNA, 17 nt, Human
ugcuagaacucccuuuc

SEQ ID NO: 1591157 - RNA, 15 nt, Human
ugcuagaacucccuu

SEQ ID NO: 1591158 - RNA, 14 nt, Human
ugcuagaacucccu

SEQ ID NO: 1591159 - RNA, 13 nt, Human
ugcuagaacuccc

SEQ ID NO: 1591160 - RNA, 18 nt, Human
ugcuagaacucccuuuca

SEQ ID NO: 1591161 - RNA, 16 nt, Human
ugcauagguuuagcag

SEQ ID NO: 1591162 - RNA, 14 nt, Human
ugcaguucugaaga

SEQ ID NO: 1591163 - RNA, 12 nt, Human
ugcaguucugaa

SEQ ID NO: 1591164 - RNA, 22 nt, Human
ugcaucaauuuuucuuauuuca

SEQ ID NO: 1591165 - RNA, 19 nt, Human
ugcaucagcugcugaaaca

SEQ ID NO: 1591166 - RNA, 13 nt, Human
ugcaucagcugcu

SEQ ID NO: 1591167 - RNA, 17 nt, Human
ugcaugguuuagaaagc

SEQ ID NO: 1591168 - RNA, 16 nt, Human
ugccacuaaauugaca

SEQ ID NO: 1591169 - RNA, 21 nt, Human
ugguauguuuucaggcuagau

SEQ ID NO: 1591170 - RNA, 13 nt, Human
ugguauguuuuca

SEQ ID NO: 1591171 - RNA, 22 nt, Human
uggucacaggaaguagaggagg

SEQ ID NO: 1591172 - RNA, 16 nt, Human
uggucccagccagcag

SEQ ID NO: 1591173 - RNA, 13 nt, Human
ugggcagcugccu

SEQ ID NO: 1591174 - RNA, 14 nt, Human
ugggcagcugccuc

SEQ ID NO: 1591175 - RNA, 15 nt, Human
ugggcagcugccucc

SEQ ID NO: 1591176 - RNA, 17 nt, Human
ugggcagcugccucccc

SEQ ID NO: 1591177 - RNA, 19 nt, Human
ugggcagcugccuccccuc

SEQ ID NO: 1591178 - RNA, 15 nt, Human
uggcacuaguauuuc

SEQ ID NO: 1591179 - RNA, 20 nt, Human
uggcaauagucaaauugugu

SEQ ID NO: 1591180 - RNA, 21 nt, Human
uuaagcagauggaaugcugug

SEQ ID NO: 1591181 - RNA, 13 nt, Human
uuaauauauuucc

SEQ ID NO: 1591182 - RNA, 14 nt, Human
uuaauauauuucca

SEQ ID NO: 1591183 - RNA, 21 nt, Human
uuaaugauaaguaaaugcuag

SEQ ID NO: 1591184 - RNA, 22 nt, Human
uuaaugucaauucuugccaaau

SEQ ID NO: 1591185 - RNA, 22 nt, Human
uuaaaagaauauuuuaacuucc

SEQ ID NO: 1591186 - RNA, 21 nt, Human
uuaaaagaauauuuuaacuuc

SEQ ID NO: 1591187 - RNA, 18 nt, Human
uuaaaagaugaaaauauu

SEQ ID NO: 1591188 - RNA, 15 nt, Human
uuaaaagaugaaaau

SEQ ID NO: 1591189 - RNA, 13 nt, Human
uuaaaagaaugau

SEQ ID NO: 1591190 - RNA, 19 nt, Human
uguuucaaacauauauaac

SEQ ID NO: 1591191 - RNA, 22 nt, Human
uguuucaaacauauauaacaau

SEQ ID NO: 1591192 - RNA, 21 nt, Human
uguuucaaacauauauaacaa

SEQ ID NO: 1591193 - RNA, 21 nt, Human
uuagaugcaguucugaagaag

SEQ ID NO: 1591194 - RNA, 20 nt, Human
uuagaugcaguucugaagaa

SEQ ID NO: 1591195 - RNA, 13 nt, Human
uuagcuggaaaag

SEQ ID NO: 1591196 - RNA, 12 nt, Human
uuagcuggaaaa

SEQ ID NO: 1591197 - RNA, 18 nt, Human
uuaggauguugaaaaagu

SEQ ID NO: 1591198 - RNA, 19 nt, Human
uuagaaacacaacuauauu

SEQ ID NO: 1591199 - RNA, 17 nt, Human
uuacuaguuucccuugc

SEQ ID NO: 1591200 - RNA, 13 nt, Human
uuccaaaauaauu

SEQ ID NO: 1591201 - RNA, 21 nt, Human
uuccaaaauaauuuuaagaaa

SEQ ID NO: 1591202 - RNA, 19 nt, Human
uucaugcauagguuuagca

SEQ ID NO: 1591203 - RNA, 12 nt, Human
uuccaaaauaau

SEQ ID NO: 1591204 - RNA, 20 nt, Human
uuccuuggacucauuuuaaa

SEQ ID NO: 1591205 - RNA, 18 nt, Human
uucccuugaugaagaagu

SEQ ID NO: 1591206 - RNA, 17 nt, Human
uucccuugaugaagaag

SEQ ID NO: 1591207 - RNA, 15 nt, Human
uuauugauaaguuca

SEQ ID NO: 1591208 - RNA, 19 nt, Human
uuauugauaaguucauaca

SEQ ID NO: 1591209 - RNA, 20 nt, Human
uuauugauaaguucauacau

SEQ ID NO: 1591210 - RNA, 17 nt, Human
uuauggcuauaggugcu

SEQ ID NO: 1591211 - RNA, 18 nt, Human
uuauuacuguaagaaaau

SEQ ID NO: 1591212 - RNA, 17 nt, Human
uuauuacuguaagaaaa

SEQ ID NO: 1591213 - RNA, 16 nt, Human
uuauuacuguaagaaa

SEQ ID NO: 1591214 - RNA, 21 nt, Human
uuauggcacuaguauuucuau

SEQ ID NO: 1591215 - RNA, 15 nt, Human
uuauugucuagugaa

SEQ ID NO: 1591216 - RNA, 16 nt, Human
uuauuuuaauaauguu

SEQ ID NO: 1591217 - RNA, 15 nt, Human
uuauuuuaauaaugu

SEQ ID NO: 1591218 - RNA, 17 nt, Human
uuauuuuaauaauguuu

SEQ ID NO: 1591219 - RNA, 17 nt, Human
uucaaauccuugaagau

SEQ ID NO: 1591220 - RNA, 20 nt, Human
uucagacauagaauuaacac

SEQ ID NO: 1591221 - RNA, 16 nt, Human
uucagacauagaauua

SEQ ID NO: 1591222 - RNA, 20 nt, Human
uucagauaaucacaauacau

SEQ ID NO: 1591223 - RNA, 13 nt, Human
uucagagcugccc

SEQ ID NO: 1591224 - RNA, 14 nt, Human
uucagagcugcccu

SEQ ID NO: 1591225 - RNA, 16 nt, Human
uuugagaguucuaaau

SEQ ID NO: 1591226 - RNA, 13 nt, Human
uuugaguucuaca

SEQ ID NO: 1591227 - RNA, 21 nt, Human
uuugaaauuguauuacaaauc

SEQ ID NO: 1591228 - RNA, 18 nt, Human
uuugguaaggggaauuga

SEQ ID NO: 1591229 - RNA, 15 nt, Human
uuucacauaucuagu

SEQ ID NO: 1591230 - RNA, 21 nt, Human
uuucacauaucuaguaugaaa

SEQ ID NO: 1591231 - RNA, 17 nt, Human
uuuauggcacuaguauu

SEQ ID NO: 1591232 - RNA, 21 nt, Human
uuucuaacaaaaaaauauauu

SEQ ID NO: 1591233 - RNA, 12 nt, Human
uuucucuaggaa

SEQ ID NO: 1591234 - RNA, 15 nt, Human
uuuauacaggucaua

SEQ ID NO: 1591235 - RNA, 13 nt, Human
uuuacagagacag

SEQ ID NO: 1591236 - RNA, 19 nt, Human
uuuaauaauguuucaaaca

SEQ ID NO: 1591237 - RNA, 15 nt, Human
uuuaauaauguuuca

SEQ ID NO: 1591238 - RNA, 13 nt, Human
uuuaauaaaccau

SEQ ID NO: 1591239 - RNA, 19 nt, Human
uuguucaauaauaaauauu

SEQ ID NO: 1591240 - RNA, 18 nt, Human
uuguuuaaaaucauuucu

SEQ ID NO: 1591241 - RNA, 17 nt, Human
uuuaaaagaaugauuau

SEQ ID NO: 1591242 - RNA, 14 nt, Human
uuuaaaagaaugau

SEQ ID NO: 1591243 - RNA, 16 nt, Human
uuuaaaaucauuucug

SEQ ID NO: 1591244 - RNA, 19 nt, Human
uuuaaaauacacacucaaa

SEQ ID NO: 1591245 - RNA, 12 nt, Human
uuuaaaaugucu

SEQ ID NO: 1591246 - RNA, 22 nt, Human
uuguagcacugacagauuucca

SEQ ID NO: 1591247 - RNA, 14 nt, Human
uuguagcacugaca

SEQ ID NO: 1591248 - RNA, 16 nt, Human
uuguagcacugacaga

SEQ ID NO: 1591249 - RNA, 17 nt, Human
uuguagcacugacagau

SEQ ID NO: 1591250 - RNA, 18 nt, Human
uuguagcacugacagauu

SEQ ID NO: 1591251 - RNA, 16 nt, Human
uuguacgaagaguauu

SEQ ID NO: 1591252 - RNA, 19 nt, Human
uuguacgaagaguauuuuu

SEQ ID NO: 1591253 - RNA, 16 nt, Human
uuguaccgcaauguga

SEQ ID NO: 1591254 - RNA, 20 nt, Human
uuguaaaauggugugaccac

SEQ ID NO: 1591255 - RNA, 13 nt, Human
uuguaaaauggug

SEQ ID NO: 1591256 - RNA, 12 nt, Human
uuguaaaauggu

SEQ ID NO: 1591257 - RNA, 15 nt, Human
uuggucugugagaug

SEQ ID NO: 1591258 - RNA, 20 nt, Human
uugguaaggggaauugagga

SEQ ID NO: 1591259 - RNA, 18 nt, Human
uugcuaagcauuccaacu

SEQ ID NO: 1591260 - RNA, 16 nt, Human
uugcuaagcauuccaa

SEQ ID NO: 1591261 - RNA, 14 nt, Human
uugaauguuaagca

SEQ ID NO: 1591262 - RNA, 17 nt, Human
uugaauguuaagcagau

SEQ ID NO: 1591263 - RNA, 21 nt, Human
uugaaaaucuuauaauuuaaa

SEQ ID NO: 1591264 - RNA, 18 nt, Human
uucuuuccacagaagcuc

SEQ ID NO: 1591265 - RNA, 24 nt, Human
uucuaaguaaaaccacagcaguug

SEQ ID NO: 1591266 - RNA, 19 nt, Human
uucuuaggguuaugauuaa

SEQ ID NO: 1591267 - RNA, 22 nt, Human
uugccaucccucccuccaccuc

SEQ ID NO: 1591268 - RNA, 23 nt, Human
uugccaucccucccuccaccucc

SEQ ID NO: 1591269 - RNA, 14 nt, Human
uugccaucccuccc

SEQ ID NO: 1591270 - RNA, 16 nt, Human
uugccaucccucccuc

SEQ ID NO: 1591271 - RNA, 17 nt, Human
uugccaucccucccucc

SEQ ID NO: 1591272 - RNA, 18 nt, Human
uugccaucccucccucca

SEQ ID NO: 1591273 - RNA, 13 nt, Human
uugccaucccucc

SEQ ID NO: 1591274 - RNA, 20 nt, Human
uugauaugccuuuucccaac

SEQ ID NO: 1591275 - RNA, 18 nt, Human
caagaaaacaacuucaau

SEQ ID NO: 1591276 - RNA, 15 nt, Human
caagaaaacaacuuc

SEQ ID NO: 1591277 - RNA, 19 nt, Human
caagacugcacaucaaaau

SEQ ID NO: 1591278 - RNA, 17 nt, Human
caaggcugauuaaacca

SEQ ID NO: 1591279 - RNA, 21 nt, Human
caagccagauuuuccugaaaa

SEQ ID NO: 1591280 - RNA, 23 nt, Human
caauacaucccuuaccugggaaa

SEQ ID NO: 1591281 - RNA, 19 nt, Human
caaagcugaugacaacuuc

SEQ ID NO: 1591282 - RNA, 22 nt, Human
caaaauugauguguuuauuuau

SEQ ID NO: 1591283 - RNA, 15 nt, Human
caaaauugauguguu

SEQ ID NO: 1591284 - RNA, 16 nt, Human
caaaauugauguguuu

SEQ ID NO: 1591285 - RNA, 22 nt, Human
caaaauuuuuucucuaggaaau

SEQ ID NO: 1591286 - RNA, 21 nt, Human
caaaauuuuuucucuaggaaa

SEQ ID NO: 1591287 - RNA, 16 nt, Human
caaaauuuuuucucua

SEQ ID NO: 1591288 - RNA, 15 nt, Human
caaauugugugaaag

SEQ ID NO: 1591289 - RNA, 21 nt, Human
caaauaugcaaagcacugacu

SEQ ID NO: 1591290 - RNA, 13 nt, Human
auuuuccugaaaa

SEQ ID NO: 1591291 - RNA, 14 nt, Human
caaaaacacagcaa

SEQ ID NO: 1591292 - RNA, 13 nt, Human
caaaaacacagca

SEQ ID NO: 1591293 - RNA, 17 nt, Human
caaaaacacagcaaggg

SEQ ID NO: 1591294 - RNA, 15 nt, Human
caaaaacacagcaag

SEQ ID NO: 1591295 - RNA, 23 nt, Human
caaaacuucagacauagaauuaa

SEQ ID NO: 1591296 - RNA, 19 nt, Human
caaaaaucucaauauuuca

SEQ ID NO: 1591297 - RNA, 20 nt, Human
cacaguuuucugagaaagac

SEQ ID NO: 1591298 - RNA, 19 nt, Human
cacaguuuucugagaaaga

SEQ ID NO: 1591299 - RNA, 17 nt, Human
cacaguuuucugagaaa

SEQ ID NO: 1591300 - RNA, 16 nt, Human
cacaguuuucugagaa

SEQ ID NO: 1591301 - RNA, 14 nt, Human
aauuaaauuuugag

SEQ ID NO: 1591302 - RNA, 22 nt, Human
aauuaaauuuugaguucuacau

SEQ ID NO: 1591303 - RNA, 20 nt, Human
aauuaguuuuauaugcuucu

SEQ ID NO: 1591304 - RNA, 17 nt, Human
aauuaguuuuauaugcu

SEQ ID NO: 1591305 - RNA, 14 nt, Human
aauuaguuuuauau

SEQ ID NO: 1591306 - RNA, 18 nt, Human
aaugauaaguaaaugcua

SEQ ID NO: 1591307 - RNA, 20 nt, Human
aaugauaacuggaaacuuca

SEQ ID NO: 1591308 - RNA, 21 nt, Human
aaugauaaguaaaugcuaggu

SEQ ID NO: 1591309 - RNA, 17 nt, Human
aaugauaacuggaaacu

SEQ ID NO: 1591310 - RNA, 18 nt, Human
aaucucauaauuuauaca

SEQ ID NO: 1591311 - RNA, 14 nt, Human
aauccauacauuug

SEQ ID NO: 1591312 - RNA, 13 nt, Human
aauccauacauuu

SEQ ID NO: 1591313 - RNA, 14 nt, Human
aauauuauguguuu

SEQ ID NO: 1591314 - RNA, 16 nt, Human
aauauuauguuaaaac

SEQ ID NO: 1591315 - RNA, 15 nt, Human
aaucaagaaacuuaa

SEQ ID NO: 1591316 - RNA, 13 nt, Human
aaucacaauacau

SEQ ID NO: 1591317 - RNA, 18 nt, Human
aaguauguguaaaaugug

SEQ ID NO: 1591318 - RNA, 21 nt, Human
aauaauccuaaacauaugaau

SEQ ID NO: 1591319 - RNA, 19 nt, Human
aauaaaauggguuuuacug

SEQ ID NO: 1591320 - RNA, 14 nt, Human
aauaaaauggguuu

SEQ ID NO: 1591321 - RNA, 13 nt, Human
aagccagauuuuc

SEQ ID NO: 1591322 - RNA, 16 nt, Human
aagauuuaccacuugu

SEQ ID NO: 1591323 - RNA, 14 nt, Human
aaauaguauuugag

SEQ ID NO: 1591324 - RNA, 19 nt, Human
aaaucaaauaugcaaagca

SEQ ID NO: 1591325 - RNA, 18 nt, Human
aaaucaaauaugcaaagc

SEQ ID NO: 1591326 - RNA, 18 nt, Human
aaauggcuuccuggcaau

SEQ ID NO: 1591327 - RNA, 12 nt, Human
aaauaacaauga

SEQ ID NO: 1591328 - RNA, 16 nt, Human
aaagaugaaaauauuu

SEQ ID NO: 1591329 - RNA, 13 nt, Human
aaagaugaaaaua

SEQ ID NO: 1591330 - RNA, 17 nt, Human
aaagaugaaaauauuug

SEQ ID NO: 1591331 - RNA, 15 nt, Human
aaacugccagcaacg

SEQ ID NO: 1591332 - RNA, 14 nt, Human
aaacugccagcaac

SEQ ID NO: 1591333 - RNA, 17 nt, Human
aaacugacucuuaagaa

SEQ ID NO: 1591334 - RNA, 16 nt, Human
aaacugacucuuaaga

SEQ ID NO: 1591335 - RNA, 19 nt, Human
aaacugccagcaacgcagg

SEQ ID NO: 1591336 - RNA, 16 nt, Human
aacuuuggaacaagau

SEQ ID NO: 1591337 - RNA, 14 nt, Human
aagaaauguaaggg

SEQ ID NO: 1591338 - RNA, 13 nt, Human
aagaaauguaagg

SEQ ID NO: 1591339 - RNA, 15 nt, Human
aacacgagcaggcua

SEQ ID NO: 1591340 - RNA, 22 nt, Human
aaccacuggaaaguuuaugguu

SEQ ID NO: 1591341 - RNA, 21 nt, Human
acucauaaaaagccugcaauu

SEQ ID NO: 1591342 - RNA, 14 nt, Human
acucaaaucaagaa

SEQ ID NO: 1591343 - RNA, 14 nt, Human
acuagcuauggugu

SEQ ID NO: 1591344 - RNA, 13 nt, Human
acucccuuucaac

SEQ ID NO: 1591345 - RNA, 12 nt, Human
acucccuuucaa

SEQ ID NO: 1591346 - RNA, 16 nt, Human
acuaagagagaaugag

SEQ ID NO: 1591347 - RNA, 12 nt, Human
acuguuuugaau

SEQ ID NO: 1591348 - RNA, 21 nt, Human
acuuggucugugagaugcuag

SEQ ID NO: 1591349 - RNA, 15 nt, Human
acuuggucugugaga

SEQ ID NO: 1591350 - RNA, 14 nt, Human
acuuggucugugag

SEQ ID NO: 1591351 - RNA, 19 nt, Human
acuuguaaaggaauuuaaa

SEQ ID NO: 1591352 - RNA, 20 nt, Human
acuuguaaaggaauuuaaaa

SEQ ID NO: 1591353 - RNA, 23 nt, Human
agaaaauauuauguguuuccaua

SEQ ID NO: 1591354 - RNA, 14 nt, Human
agaaaauaacaaua

SEQ ID NO: 1591355 - RNA, 19 nt, Human
acuuuauacccagaaaguu

SEQ ID NO: 1591356 - RNA, 13 nt, Human
acaacuuuauacc

SEQ ID NO: 1591357 - RNA, 14 nt, Human
acaacuuuauaccc

SEQ ID NO: 1591358 - RNA, 17 nt, Human
acaacuucaauauccaa

SEQ ID NO: 1591359 - RNA, 18 nt, Human
acaacuucccagugaauu

SEQ ID NO: 1591360 - RNA, 16 nt, Human
acaacuauuuuuccaa

SEQ ID NO: 1591361 - RNA, 15 nt, Human
aauuuuauaucuugu

SEQ ID NO: 1591362 - RNA, 20 nt, Human
aauuuugaguucuacauaag

SEQ ID NO: 1591363 - RNA, 13 nt, Human
acaacuauauugu

SEQ ID NO: 1591364 - RNA, 16 nt, Human
acagaauauguuucaa

SEQ ID NO: 1591365 - RNA, 17 nt, Human
acagaauauguuucaaa

SEQ ID NO: 1591366 - RNA, 19 nt, Human
acagaauauguuucaaacu

SEQ ID NO: 1591367 - RNA, 21 nt, Human
acagaauauguuucaaacuuu

SEQ ID NO: 1591368 - RNA, 18 nt, Human
acagcaguugaaaagacu

SEQ ID NO: 1591369 - RNA, 15 nt, Human
acagcaguugaaaag

SEQ ID NO: 1591370 - RNA, 15 nt, Human
acagccagacuggca

SEQ ID NO: 1591371 - RNA, 13 nt, Human
acagccagacugg

SEQ ID NO: 1591372 - RNA, 16 nt, Human
acagccagacuggcac

SEQ ID NO: 1591373 - RNA, 19 nt, Human
acaggucauauuaauauau

SEQ ID NO: 1591374 - RNA, 20 nt, Human
acagcucugcauacucauua

SEQ ID NO: 1591375 - RNA, 15 nt, Human
acccacaagaaauga

SEQ ID NO: 1591376 - RNA, 16 nt, Human
acccaaguccaagcau

SEQ ID NO: 1591377 - RNA, 14 nt, Human
acauuuguauaaaa

SEQ ID NO: 1591378 - RNA, 18 nt, Human
acauuugcucauggaauu

SEQ ID NO: 1591379 - RNA, 13 nt, Human
acauguuacaaca

SEQ ID NO: 1591380 - RNA, 15 nt, Human
auauccuuucuaaca

SEQ ID NO: 1591381 - RNA, 16 nt, Human
auauccuuucuaacaa

SEQ ID NO: 1591382 - RNA, 18 nt, Human
auaucacuugucaauaaa

SEQ ID NO: 1591383 - RNA, 22 nt, Human
auauuuauuacuguaagaaaau

SEQ ID NO: 1591384 - RNA, 18 nt, Human
auauuuauuuuaauaaug

SEQ ID NO: 1591385 - RNA, 19 nt, Human
auauuuauuacuguaagaa

SEQ ID NO: 1591386 - RNA, 14 nt, Human
auauuuauuacugu

SEQ ID NO: 1591387 - RNA, 23 nt, Human
auauuucagauaaucacaauaca

SEQ ID NO: 1591388 - RNA, 22 nt, Human
auauaaguauucuaaauuuuau

SEQ ID NO: 1591389 - RNA, 14 nt, Human
auaauuacuauguc

SEQ ID NO: 1591390 - RNA, 13 nt, Human
agucaaauugugu

SEQ ID NO: 1591391 - RNA, 17 nt, Human
agucaaauugugugaaa

SEQ ID NO: 1591392 - RNA, 15 nt, Human
agucaaauuguguga

SEQ ID NO: 1591393 - RNA, 21 nt, Human
aguccaagcauuuagauguau

SEQ ID NO: 1591394 - RNA, 16 nt, Human
aguccaagcauuuaga

SEQ ID NO: 1591395 - RNA, 18 nt, Human
agugauuaccagggacug

SEQ ID NO: 1591396 - RNA, 19 nt, Human
aguuguaccgcaaugugac

SEQ ID NO: 1591397 - RNA, 17 nt, Human
auguaauaacugugaag

SEQ ID NO: 1591398 - RNA, 22 nt, Human
auguaagggaaacugccagcaa

SEQ ID NO: 1591399 - RNA, 21 nt, Human
auguaagggaaacugccagca

SEQ ID NO: 1591400 - RNA, 16 nt, Human
augucaaucagccuag

SEQ ID NO: 1591401 - RNA, 14 nt, Human
augccuuuucccaa

SEQ ID NO: 1591402 - RNA, 20 nt, Human
augaaacacucaguuguuca

SEQ ID NO: 1591403 - RNA, 14 nt, Human
augacucagaauau

SEQ ID NO: 1591404 - RNA, 22 nt, Human
aucuuauaauuuaaaauaugcu

SEQ ID NO: 1591405 - RNA, 13 nt, Human
auccuuucuaaca

SEQ ID NO: 1591406 - RNA, 17 nt, Human
aucagcugcugaaacaa

SEQ ID NO: 1591407 - RNA, 14 nt, Human
agacacaacuauuu

SEQ ID NO: 1591408 - RNA, 17 nt, Human
agacugcauuauauuua

SEQ ID NO: 1591409 - RNA, 21 nt, Human
agauaggucagugcaaauacu

SEQ ID NO: 1591410 - RNA, 19 nt, Human
agccagauuuuccugaaaa

SEQ ID NO: 1591411 - RNA, 15 nt, Human
agccagauuuuccug

SEQ ID NO: 1591412 - RNA, 20 nt, Human
agcaguucagagcugcccuc

SEQ ID NO: 1591413 - RNA, 19 nt, Human
agcaguucagagcugcccu

SEQ ID NO: 1591414 - RNA, 16 nt, Human
agauguagaggagaaa

SEQ ID NO: 1591415 - RNA, 21 nt, Human
agaugggagaaucacuugaac

SEQ ID NO: 1591416 - RNA, 14 nt, Human
agauguagaggaga

SEQ ID NO: 1591417 - RNA, 23 nt, Human
agcaguugaaaagacuccaaaga

SEQ ID NO: 1591418 - RNA, 16 nt, Human
agcaguucagagcugc

SEQ ID NO: 1591419 - RNA, 17 nt, Human
agcaguucagagcugcc

SEQ ID NO: 1591420 - RNA, 18 nt, Human
agcaguucagagcugccc

SEQ ID NO: 1591421 - RNA, 15 nt, Human
agguuaauuccaauu

SEQ ID NO: 1591422 - RNA, 22 nt, Human
agguuaauuccaauuauaugag

SEQ ID NO: 1591423 - RNA, 19 nt, Human
agcuuccuucugugaaagu

SEQ ID NO: 1591424 - RNA, 14 nt, Human
agcuguaugauucc

SEQ ID NO: 1591425 - RNA, 14 nt, Human
aggauguugaaaaa

SEQ ID NO: 1591426 - RNA, 17 nt, Human
aggauguugaaaaaguu

SEQ ID NO: 1591427 - RNA, 12 nt, Human
aaaacaacuuua

SEQ ID NO: 1591428 - RNA, 14 nt, Human
aaaacaaggaugaa

SEQ ID NO: 1591429 - RNA, 13 nt, Human
aaaacacagcaag

SEQ ID NO: 1591430 - RNA, 12 nt, Human
aaaacacagcaa

SEQ ID NO: 1591431 - RNA, 18 nt, Human
aaaacacagcaaggguga

SEQ ID NO: 1591432 - RNA, 17 nt, Human
aaaacaaggaugaauua

SEQ ID NO: 1591433 - RNA, 12 nt, Human
aaaaacaacuuu

SEQ ID NO: 1591434 - RNA, 12 nt, Human
aaaaacacagca

SEQ ID NO: 1591435 - RNA, 15 nt, Human
guguaaaaugugaag

SEQ ID NO: 1591436 - RNA, 15 nt, Human
aagauagcagggcau

SEQ ID NO: 1591437 - RNA, 22 nt, Human
gugucuuaauuaaaagaauauu

SEQ ID NO: 1591438 - RNA, 17 nt, Human
aagcaacccaaauguuc

SEQ ID NO: 1591439 - RNA, 13 nt, Human
aagcaaaauguga

SEQ ID NO: 1591440 - RNA, 19 nt, Human
aagcauuguaaaugugcuu

SEQ ID NO: 1591441 - RNA, 20 nt, Human
aagcacugacuucuaaguaa

SEQ ID NO: 1591442 - RNA, 19 nt, Human
aagcacugacuucuaagua

SEQ ID NO: 1591443 - RNA, 17 nt, Human
aagcacugacuucuaag

SEQ ID NO: 1591444 - RNA, 16 nt, Human
aagcacugacuucuaa

SEQ ID NO: 1591445 - RNA, 16 nt, Human
aagcacuaaacaaaga

SEQ ID NO: 1591446 - RNA, 21 nt, Human
guuauugauaaguucauacau

SEQ ID NO: 1591447 - RNA, 22 nt, Human
guuauugauaaguucauacauu

SEQ ID NO: 1591448 - RNA, 20 nt, Human
guuauuauauuuacaaaugg

SEQ ID NO: 1591449 - RNA, 19 nt, Human
guuauuauauuuacaaaug

SEQ ID NO: 1591450 - RNA, 19 nt, Human
guuaauuccaauuauauga

SEQ ID NO: 1591451 - RNA, 21 nt, Human
aagccuuggggcugaugcagu

SEQ ID NO: 1591452 - RNA, 22 nt, Human
guucuagcauggcauauuuuuc

SEQ ID NO: 1591453 - RNA, 18 nt, Human
guucccuugaugaagaag

SEQ ID NO: 1591454 - RNA, 18 nt, Human
aagcuuauuaaaacucau

SEQ ID NO: 1591455 - RNA, 23 nt, Human
aagcuuguauuccuuuuucucuc

SEQ ID NO: 1591456 - RNA, 19 nt, Human
aaguauguguaaaauguga

SEQ ID NO: 1591457 - RNA, 21 nt, Human
aaguauguuagugcaaauugu

SEQ ID NO: 1591458 - RNA, 19 nt, Human
aaguauguuagugcaaauu

SEQ ID NO: 1591459 - RNA, 18 nt, Human
aaguauguuagugcaaau

SEQ ID NO: 1591460 - RNA, 14 nt, Human
guuuaugauuccac

SEQ ID NO: 1591461 - RNA, 17 nt, Human
aagggcuguuauaaucu

SEQ ID NO: 1591462 - RNA, 15 nt, Human
aagggcuguuauaau

SEQ ID NO: 1591463 - RNA, 13 nt, Human
uaaaaugugaagu

SEQ ID NO: 1591464 - RNA, 11 nt, Human
uaaaaugugaa

SEQ ID NO: 1591465 - RNA, 9 nt, Human
uaaaauggu

SEQ ID NO: 1591466 - RNA, 14 nt, Human
uaaaaauauugugu

SEQ ID NO: 1591467 - RNA, 22 nt, Human
uaaaaagccugcaauuucauau

SEQ ID NO: 1591468 - RNA, 21 nt, Human
uaaaaaaaaaccugagcccca

SEQ ID NO: 1591469 - RNA, 21 nt, Human
uaaaaauauuguguugugaau

SEQ ID NO: 1591470 - RNA, 22 nt, Human
uaaaaauauuguguugugaaug

SEQ ID NO: 1591471 - RNA, 14 nt, Human
uaaaaccacagcag

SEQ ID NO: 1591472 - RNA, 15 nt, Human
uaaaaccacagcagu

SEQ ID NO: 1591473 - RNA, 16 nt, Human
uaaaagaauauuuuaa

SEQ ID NO: 1591474 - RNA, 13 nt, Human
uaaaagaauauuu

SEQ ID NO: 1591475 - RNA, 21 nt, Human
uaaaauacacacucaaaucaa

SEQ ID NO: 1591476 - RNA, 22 nt, Human
uaaaauaauuuuuauauuugaa

SEQ ID NO: 1591477 - RNA, 21 nt, Human
guauucuaaauuuuauaucuu

SEQ ID NO: 1591478 - RNA, 24 nt, Human
guauucuaaauuuuauaucuugua

SEQ ID NO: 1591479 - RNA, 19 nt, Human
guauucuagcuaauguaau

SEQ ID NO: 1591480 - RNA, 11 nt, Human
aaaucauuucu

SEQ ID NO: 1591481 - RNA, 17 nt, Human
aaauuccaagugauuga

SEQ ID NO: 1591482 - RNA, 17 nt, Human
aaauuguauuacaaauc

SEQ ID NO: 1591483 - RNA, 15 nt, Human
aaaugugcuuuuaaa

SEQ ID NO: 1591484 - RNA, 18 nt, Human
aaaugugccuucauuuuu

SEQ ID NO: 1591485 - RNA, 14 nt, Human
gucaggaaagagaa

SEQ ID NO: 1591486 - RNA, 15 nt, Human
gucacaggaaguaga

SEQ ID NO: 1591487 - RNA, 13 nt, Human
gucacaggaagua

SEQ ID NO: 1591488 - RNA, 21 nt, Human
gucaauuuuguuauguauauu

SEQ ID NO: 1591489 - RNA, 20 nt, Human
gucacaggaaguagaggagg

SEQ ID NO: 1591490 - RNA, 23 nt, Human
guccaugaagauguagaggagaa

SEQ ID NO: 1591491 - RNA, 22 nt, Human
guccaugaagauguagaggaga

SEQ ID NO: 1591492 - RNA, 20 nt, Human
aacacagcaagggugauggg

SEQ ID NO: 1591493 - RNA, 13 nt, Human
aacagucucagga

SEQ ID NO: 1591494 - RNA, 12 nt, Human
aacauauauaac

SEQ ID NO: 1591495 - RNA, 14 nt, Human
aacagucucaggaa

SEQ ID NO: 1591496 - RNA, 14 nt, Human
aacauaaaauacaa

SEQ ID NO: 1591497 - RNA, 23 nt, Human
aacuauucaggagaguagaacag

SEQ ID NO: 1591498 - RNA, 24 nt, Human
aacucauuuuuguuuucauuaucu

SEQ ID NO: 1591499 - RNA, 21 nt, Human
aacucauuuuuguuuucauua

SEQ ID NO: 1591500 - RNA, 14 nt, Human
gucuuaauuaaaag

SEQ ID NO: 1591501 - RNA, 13 nt, Human
gucuucacaacag

SEQ ID NO: 1591502 - RNA, 14 nt, Human
gugaaguuuacauu

SEQ ID NO: 1591503 - RNA, 17 nt, Human
aacugugaaguuuacau

SEQ ID NO: 1591504 - RNA, 19 nt, Human
aacugugaaguuuacauug

SEQ ID NO: 1591505 - RNA, 23 nt, Human
aacuuccuuggacucauuuuaaa

SEQ ID NO: 1591506 - RNA, 21 nt, Human
aacuucagcgguuuauauaag

SEQ ID NO: 1591507 - RNA, 13 nt, Human
aacuucagacaua

SEQ ID NO: 1591508 - RNA, 18 nt, Human
aacuucagcgguuuauau

SEQ ID NO: 1591509 - RNA, 22 nt, Human
aacuuccuuggacucauuuuaa

SEQ ID NO: 1591510 - RNA, 17 nt, Human
gugauuaccagggacug

SEQ ID NO: 1591511 - RNA, 16 nt, Human
gugauuaccagggacu

SEQ ID NO: 1591512 - RNA, 11 nt, Human
gugauuaccag

SEQ ID NO: 1591513 - RNA, 14 nt, Human
aagaaaacaacuuc

SEQ ID NO: 1591514 - RNA, 11 nt, Human
aagaaacauuu

SEQ ID NO: 1591515 - RNA, 16 nt, Human
aagaaagaaaaucagg

SEQ ID NO: 1591516 - RNA, 14 nt, Human
aagaaagaaaauca

SEQ ID NO: 1591517 - RNA, 22 nt, Human
gugcuacaaaaacacagcaagg

SEQ ID NO: 1591518 - RNA, 22 nt, Human
aagaagcaccaaucaugaauua

SEQ ID NO: 1591519 - RNA, 22 nt, Human
uagagcaaaauugauguguuua

SEQ ID NO: 1591520 - RNA, 14 nt, Human
uagagcaaaauuga

SEQ ID NO: 1591521 - RNA, 21 nt, Human
uagagcaaaauugauguguuu

SEQ ID NO: 1591522 - RNA, 22 nt, Human
uagaggagaaacuggaacucuc

SEQ ID NO: 1591523 - RNA, 18 nt, Human
acaaaaggauaaugaaua

SEQ ID NO: 1591524 - RNA, 22 nt, Human
uagcauggcauauuuuucacau

SEQ ID NO: 1591525 - RNA, 21 nt, Human
uagcauggcauauuuuucaca

SEQ ID NO: 1591526 - RNA, 15 nt, Human
uagaugcaguucuga

SEQ ID NO: 1591527 - RNA, 18 nt, Human
uagcaugucgucaaagcu

SEQ ID NO: 1591528 - RNA, 20 nt, Human
acaagacccaaaaggcagaa

SEQ ID NO: 1591529 - RNA, 18 nt, Human
acaaauuuacagagacag

SEQ ID NO: 1591530 - RNA, 19 nt, Human
acaaauuuacagagacaga

SEQ ID NO: 1591531 - RNA, 12 nt, Human
uagcuaauguaa

SEQ ID NO: 1591532 - RNA, 19 nt, Human
uagcuaauguaauaacugu

SEQ ID NO: 1591533 - RNA, 23 nt, Human
acaauacaucccuuaccugggaa

SEQ ID NO: 1591534 - RNA, 14 nt, Human
acaagacugcacau

SEQ ID NO: 1591535 - RNA, 13 nt, Human
acaagacugcaca

SEQ ID NO: 1591536 - RNA, 15 nt, Human
uagggagagaagaua

SEQ ID NO: 1591537 - RNA, 14 nt, Human
uagggagagaagau

SEQ ID NO: 1591538 - RNA, 18 nt, Human
uaggcaaccuuuauuuuu

SEQ ID NO: 1591539 - RNA, 18 nt, Human
uaggaaauauuuauuuua

SEQ ID NO: 1591540 - RNA, 19 nt, Human
uaggaaauauuuauuuuaa

SEQ ID NO: 1591541 - RNA, 18 nt, Human
acacaugauccugcaauu

SEQ ID NO: 1591542 - RNA, 15 nt, Human
acacaucagcuugcc

SEQ ID NO: 1591543 - RNA, 15 nt, Human
acacaugaaguccaa

SEQ ID NO: 1591544 - RNA, 19 nt, Human
acacucaaaucaagaaacu

SEQ ID NO: 1591545 - RNA, 14 nt, Human
acacuaagagagaa

SEQ ID NO: 1591546 - RNA, 13 nt, Human
acacuaagagaga

SEQ ID NO: 1591547 - RNA, 23 nt, Human
uaguguuggagaagaacugaaau

SEQ ID NO: 1591548 - RNA, 22 nt, Human
uagugaaacucguuaauuugua

SEQ ID NO: 1591549 - RNA, 22 nt, Human
acaaugcuguauuuuaaaagaa

SEQ ID NO: 1591550 - RNA, 15 nt, Human
acacacucaaaucaa

SEQ ID NO: 1591551 - RNA, 20 nt, Human
acacacucaaaucaagaaac

SEQ ID NO: 1591552 - RNA, 19 nt, Human
uaugaaauuauauaaguau

SEQ ID NO: 1591553 - RNA, 18 nt, Human
acagcaagggugauggga

SEQ ID NO: 1591554 - RNA, 20 nt, Human
acagauuuccauccuaguca

SEQ ID NO: 1591555 - RNA, 21 nt, Human
uaugauuaaguaaugauaacu

SEQ ID NO: 1591556 - RNA, 20 nt, Human
uaugauuaaguaaugauaac

SEQ ID NO: 1591557 - RNA, 16 nt, Human
uaugauuaaguaauga

SEQ ID NO: 1591558 - RNA, 19 nt, Human
uaugccccauucaacaucu

SEQ ID NO: 1591559 - RNA, 16 nt, Human
acagccucuuagaugc

SEQ ID NO: 1591560 - RNA, 19 nt, Human
uauccaaaccaaauaaaaa

SEQ ID NO: 1591561 - RNA, 17 nt, Human
uaucucaaaacugcacu

SEQ ID NO: 1591562 - RNA, 15 nt, Human
uauauuguuugcuaa

SEQ ID NO: 1591563 - RNA, 17 nt, Human
acaggaaguagaggagg

SEQ ID NO: 1591564 - RNA, 21 nt, Human
acagggaggacgcucucuggc

SEQ ID NO: 1591565 - RNA, 20 nt, Human
acagggaggacgcucucugg

SEQ ID NO: 1591566 - RNA, 18 nt, Human
acagucaccucauggaau

SEQ ID NO: 1591567 - RNA, 17 nt, Human
acagucaccucauggaa

SEQ ID NO: 1591568 - RNA, 16 nt, Human
acagucaccucaugga

SEQ ID NO: 1591569 - RNA, 14 nt, Human
uauuacuguaagaa

SEQ ID NO: 1591570 - RNA, 15 nt, Human
uauuagaauaccaca

SEQ ID NO: 1591571 - RNA, 15 nt, Human
uauucaaacagucuc

SEQ ID NO: 1591572 - RNA, 23 nt, Human
uauucaaacagucucaggaaauc

SEQ ID NO: 1591573 - RNA, 23 nt, Human
uacaggucauauuaauauauuuc

SEQ ID NO: 1591574 - RNA, 20 nt, Human
uacaucccuuaccugggaaa

SEQ ID NO: 1591575 - RNA, 17 nt, Human
uacauuguaaauaguau

SEQ ID NO: 1591576 - RNA, 13 nt, Human
aauguuaagcaga

SEQ ID NO: 1591577 - RNA, 13 nt, Human
aaugcuguguuaa

SEQ ID NO: 1591578 - RNA, 16 nt, Human
aaugcuguauuuuaaa

SEQ ID NO: 1591579 - RNA, 18 nt, Human
uacacuaagagagaauga

SEQ ID NO: 1591580 - RNA, 14 nt, Human
uacacuaagagaga

SEQ ID NO: 1591581 - RNA, 13 nt, Human
aauugauguguuu

SEQ ID NO: 1591582 - RNA, 14 nt, Human
aauugauguguuua

SEQ ID NO: 1591583 - RNA, 22 nt, Human
aauugacccacaagaaaugaaa

SEQ ID NO: 1591584 - RNA, 14 nt, Human
uacuguaagaaaau

SEQ ID NO: 1591585 - RNA, 19 nt, Human
uacauuguacgaagaguau

SEQ ID NO: 1591586 - RNA, 15 nt, Human
aauucagaaggaucu

SEQ ID NO: 1591587 - RNA, 18 nt, Human
aauuccaagugauugaaa

SEQ ID NO: 1591588 - RNA, 22 nt, Human
aauuccacuuauaggaauugac

SEQ ID NO: 1591589 - RNA, 21 nt, Human
aauuauuuuguucauacauau

SEQ ID NO: 1591590 - RNA, 22 nt, Human
aauuauuuuguucauacauauu

SEQ ID NO: 1591591 - RNA, 16 nt, Human
aauuauuuuguucaua

SEQ ID NO: 1591592 - RNA, 18 nt, Human
aauuauuuuguucauaca

SEQ ID NO: 1591593 - RNA, 19 nt, Human
aauuauuuuguucauacau

SEQ ID NO: 1591594 - RNA, 20 nt, Human
aauuauuuuguucauacaua

SEQ ID NO: 1591595 - RNA, 19 nt, Human
aaugaaacacucaguuguu

SEQ ID NO: 1591596 - RNA, 22 nt, Human
aaugaauggcuaagcaaaaugu

SEQ ID NO: 1591597 - RNA, 12 nt, Human
uaauagagcaaa

SEQ ID NO: 1591598 - RNA, 21 nt, Human
uaauagagcaaaauugaugug

SEQ ID NO: 1591599 - RNA, 13 nt, Human
uaaguaaaugcua

SEQ ID NO: 1591600 - RNA, 19 nt, Human
uaaguaaugauaacuggaa

SEQ ID NO: 1591601 - RNA, 16 nt, Human
uaagcuuguauuccuu

SEQ ID NO: 1591602 - RNA, 16 nt, Human
uaaguauucuaaauuu

SEQ ID NO: 1591603 - RNA, 15 nt, Human
aaucaugaauuaguu

SEQ ID NO: 1591604 - RNA, 12 nt, Human
aaucaugaauua

SEQ ID NO: 1591605 - RNA, 19 nt, Human
aaucuacacuccagugaga

SEQ ID NO: 1591606 - RNA, 19 nt, Human
aaucuuauaauuuaaaaua

SEQ ID NO: 1591607 - RNA, 20 nt, Human
aauaguauuugagaguucua

SEQ ID NO: 1591608 - RNA, 22 nt, Human
aauaguauuugagaguucuaaa

SEQ ID NO: 1591609 - RNA, 16 nt, Human
aauagucaaauugugu

SEQ ID NO: 1591610 - RNA, 23 nt, Human
aauaguauuugagaguucuaaau

SEQ ID NO: 1591611 - RNA, 19 nt, Human
aauagucaaauugugugaa

SEQ ID NO: 1591612 - RNA, 22 nt, Human
aauaucacuugucaauaaaauc

SEQ ID NO: 1591613 - RNA, 20 nt, Human
uaacgauaaaagacagugaa

SEQ ID NO: 1591614 - RNA, 17 nt, Human
aauauuguguugugaau

SEQ ID NO: 1591615 - RNA, 14 nt, Human
aauauuucagauaa

SEQ ID NO: 1591616 - RNA, 19 nt, Human
aauauuuauuuuaauaaug

SEQ ID NO: 1591617 - RNA, 18 nt, Human
aauauuuauuuuaauaau

SEQ ID NO: 1591618 - RNA, 24 nt, Human
aauaugccccauucaacaucuagu

SEQ ID NO: 1591619 - RNA, 21 nt, Human
aauaugccccauucaacaucu

SEQ ID NO: 1591620 - RNA, 22 nt, Human
uaagcagauggaaugcuguguu

SEQ ID NO: 1591621 - RNA, 21 nt, Human
aaucaggguuaguauugucca

SEQ ID NO: 1591622 - RNA, 16 nt, Human
aaucaggguuaguauu

SEQ ID NO: 1591623 - RNA, 22 nt, Human
aaucaggguuaguauuguccag

SEQ ID NO: 1591624 - RNA, 14 nt, Human
ucacauaucuagua

SEQ ID NO: 1591625 - RNA, 16 nt, Human
ucaauucuugccaaau

SEQ ID NO: 1591626 - RNA, 23 nt, Human
ucacuugaacccgggaggcagag

SEQ ID NO: 1591627 - RNA, 14 nt, Human
accagucugacugu

SEQ ID NO: 1591628 - RNA, 14 nt, Human
ucaccucauggaau

SEQ ID NO: 1591629 - RNA, 13 nt, Human
ucaccucauggaa

SEQ ID NO: 1591630 - RNA, 12 nt, Human
ucaccucaugga

SEQ ID NO: 1591631 - RNA, 19 nt, Human
acauucuuccaaaaagauu

SEQ ID NO: 1591632 - RNA, 23 nt, Human
ucaaugaaugaaugaauggcuaa

SEQ ID NO: 1591633 - RNA, 19 nt, Human
ucaauauuucagauaauca

SEQ ID NO: 1591634 - RNA, 15 nt, Human
ucaauauuucagaua

SEQ ID NO: 1591635 - RNA, 18 nt, Human
ucaauauccaaaccaaau

SEQ ID NO: 1591636 - RNA, 22 nt, Human
ucaauaucuuuuuuuuaauaaa

SEQ ID NO: 1591637 - RNA, 17 nt, Human
ucaagaaaacaacuuca

SEQ ID NO: 1591638 - RNA, 20 nt, Human
acaugagguacugagaguga

SEQ ID NO: 1591639 - RNA, 23 nt, Human
acaugagguacugagagugaaca

SEQ ID NO: 1591640 - RNA, 14 nt, Human
acaugggacauuug

SEQ ID NO: 1591641 - RNA, 11 nt, Human
acaugggacau

SEQ ID NO: 1591642 - RNA, 21 nt, Human
acaugggacauuugcucaugg

SEQ ID NO: 1591643 - RNA, 20 nt, Human
acaugggacauuugcucaug

SEQ ID NO: 1591644 - RNA, 15 nt, Human
acaugggacauuugc

SEQ ID NO: 1591645 - RNA, 18 nt, Human
ucaaauugugugaaaggu

SEQ ID NO: 1591646 - RNA, 14 nt, Human
accccugcuucuga

SEQ ID NO: 1591647 - RNA, 17 nt, Human
acccgggaggcagaggu

SEQ ID NO: 1591648 - RNA, 16 nt, Human
accucaaaaugucuaa

SEQ ID NO: 1591649 - RNA, 16 nt, Human
accuagggugauauua

SEQ ID NO: 1591650 - RNA, 22 nt, Human
ucauaaaaagccugcaauuuca

SEQ ID NO: 1591651 - RNA, 17 nt, Human
ucaguuuuugugaaaag

SEQ ID NO: 1591652 - RNA, 15 nt, Human
ucaguuuuugugaaa

SEQ ID NO: 1591653 - RNA, 18 nt, Human
accuuuggagcaaagcug

SEQ ID NO: 1591654 - RNA, 19 nt, Human
accuugaaaacuuuaugcu

SEQ ID NO: 1591655 - RNA, 22 nt, Human
uccacugguucuucuuggucuc

SEQ ID NO: 1591656 - RNA, 20 nt, Human
accuuuuggucuggagggaa

SEQ ID NO: 1591657 - RNA, 14 nt, Human
acgcucucuggccu

SEQ ID NO: 1591658 - RNA, 11 nt, Human
acgcucucugg

SEQ ID NO: 1591659 - RNA, 18 nt, Human
uccagugagacagcucug

SEQ ID NO: 1591660 - RNA, 15 nt, Human
acuaauuuuaaaaug

SEQ ID NO: 1591661 - RNA, 15 nt, Human
uccauccugaggcuc

SEQ ID NO: 1591662 - RNA, 12 nt, Human
uccauccugagg

SEQ ID NO: 1591663 - RNA, 19 nt, Human
uccauccugaggcuccacu

SEQ ID NO: 1591664 - RNA, 22 nt, Human
acuauauuguuugcuaagcauu

SEQ ID NO: 1591665 - RNA, 17 nt, Human
acuauauuguuugcuaa

SEQ ID NO: 1591666 - RNA, 15 nt, Human
acuaucucauuucca

SEQ ID NO: 1591667 - RNA, 17 nt, Human
acuaucucauuuccaag

SEQ ID NO: 1591668 - RNA, 16 nt, Human
acuaucucauuuccaa

SEQ ID NO: 1591669 - RNA, 16 nt, Human
uccuggaaaucagggu

SEQ ID NO: 1591670 - RNA, 17 nt, Human
acugagaugugaacaca

SEQ ID NO: 1591671 - RNA, 22 nt, Human
acugagaugugaacacaucagc

SEQ ID NO: 1591672 - RNA, 18 nt, Human
acugagagugaacaaauu

SEQ ID NO: 1591673 - RNA, 22 nt, Human
acugacuucuaaguaaaaccac

SEQ ID NO: 1591674 - RNA, 16 nt, Human
acugacuucuaaguaa

SEQ ID NO: 1591675 - RNA, 15 nt, Human
acugacuucuaagua

SEQ ID NO: 1591676 - RNA, 13 nt, Human
acugacuucuaag

SEQ ID NO: 1591677 - RNA, 20 nt, Human
acugacucuuaagaagacug

SEQ ID NO: 1591678 - RNA, 18 nt, Human
acugacucuuaagaagac

SEQ ID NO: 1591679 - RNA, 17 nt, Human
acugacucuuaagaaga

SEQ ID NO: 1591680 - RNA, 16 nt, Human
acugacucuuaagaag

SEQ ID NO: 1591681 - RNA, 15 nt, Human
acugacucuuaagaa

SEQ ID NO: 1591682 - RNA, 14 nt, Human
acugacucuuaaga

SEQ ID NO: 1591683 - RNA, 13 nt, Human
acugacucuuaag

SEQ ID NO: 1591684 - RNA, 12 nt, Human
acugaagaagca

SEQ ID NO: 1591685 - RNA, 21 nt, Human
acucuuaagaagacugcauua

SEQ ID NO: 1591686 - RNA, 13 nt, Human
agaauauguuuca

SEQ ID NO: 1591687 - RNA, 17 nt, Human
agaauauguuucaaacu

SEQ ID NO: 1591688 - RNA, 18 nt, Human
agaauauguuucaaacuu

SEQ ID NO: 1591689 - RNA, 19 nt, Human
agaauauguuucaaacuuu

SEQ ID NO: 1591690 - RNA, 21 nt, Human
agaauauguuucaaacuuugg

SEQ ID NO: 1591691 - RNA, 14 nt, Human
ucugcuuguguuaa

SEQ ID NO: 1591692 - RNA, 15 nt, Human
agaauuaacacauga

SEQ ID NO: 1591693 - RNA, 23 nt, Human
agaauuaacacaugauccugcaa

SEQ ID NO: 1591694 - RNA, 16 nt, Human
ucugugaaaguacauu

SEQ ID NO: 1591695 - RNA, 14 nt, Human
ucugugagaugcua

SEQ ID NO: 1591696 - RNA, 22 nt, Human
ucugugagaugcuagaacuccc

SEQ ID NO: 1591697 - RNA, 17 nt, Human
ucugugagaugcuagaa

SEQ ID NO: 1591698 - RNA, 23 nt, Human
ucugugagaugcuagaacucccu

SEQ ID NO: 1591699 - RNA, 15 nt, Human
agacacacaugaagu

SEQ ID NO: 1591700 - RNA, 12 nt, Human
agacacacauga

SEQ ID NO: 1591701 - RNA, 16 nt, Human
ucugcuugccaucccu

SEQ ID NO: 1591702 - RNA, 17 nt, Human
ucugcuugccaucccuc

SEQ ID NO: 1591703 - RNA, 20 nt, Human
ucugcuugccaucccucccu

SEQ ID NO: 1591704 - RNA, 23 nt, Human
ucugcuugccaucccucccucca

SEQ ID NO: 1591705 - RNA, 19 nt, Human
agaagcaacccaaauguuc

SEQ ID NO: 1591706 - RNA, 14 nt, Human
agaagaacugaaau

SEQ ID NO: 1591707 - RNA, 13 nt, Human
agaagaacugaaa

SEQ ID NO: 1591708 - RNA, 18 nt, Human
agaagaugguaccaccag

SEQ ID NO: 1591709 - RNA, 18 nt, Human
ucugcagauaaacaguag

SEQ ID NO: 1591710 - RNA, 21 nt, Human
ucuagcauggcauauuuuuca

SEQ ID NO: 1591711 - RNA, 22 nt, Human
ucuagcauggcauauuuuucac

SEQ ID NO: 1591712 - RNA, 23 nt, Human
ucuagcauggcauauuuuucaca

SEQ ID NO: 1591713 - RNA, 14 nt, Human
acuucccuuucugc

SEQ ID NO: 1591714 - RNA, 16 nt, Human
ucuaggaaauauuuau

SEQ ID NO: 1591715 - RNA, 17 nt, Human
ucuaggaaauauuuauu

SEQ ID NO: 1591716 - RNA, 23 nt, Human
acuuaacuauucaggagaguaga

SEQ ID NO: 1591717 - RNA, 15 nt, Human
ucuaaguaaaaccac

SEQ ID NO: 1591718 - RNA, 14 nt, Human
ucuaaguaaaacca

SEQ ID NO: 1591719 - RNA, 19 nt, Human
ucuaaguaaaaccacagca

SEQ ID NO: 1591720 - RNA, 20 nt, Human
ucuaaguaaaaccacagcag

SEQ ID NO: 1591721 - RNA, 12 nt, Human
uccugggcagcu

SEQ ID NO: 1591722 - RNA, 13 nt, Human
uccugggcagcug

SEQ ID NO: 1591723 - RNA, 14 nt, Human
uccugggcagcugc

SEQ ID NO: 1591724 - RNA, 15 nt, Human
acuugucaauaaaau

SEQ ID NO: 1591725 - RNA, 21 nt, Human
ucucaggaaaucaaauaugca

SEQ ID NO: 1591726 - RNA, 14 nt, Human
ucucaggaaaucaa

SEQ ID NO: 1591727 - RNA, 23 nt, Human
ucucaggaaaucaaauaugcaaa

SEQ ID NO: 1591728 - RNA, 15 nt, Human
ucucauuuccaagca

SEQ ID NO: 1591729 - RNA, 22 nt, Human
acuuuuuauggcacuaguauuu

SEQ ID NO: 1591730 - RNA, 14 nt, Human
ugacuaugacauaa

SEQ ID NO: 1591731 - RNA, 17 nt, Human
agaugugaacacaucag

SEQ ID NO: 1591732 - RNA, 22 nt, Human
agauguauguacuucaugcugu

SEQ ID NO: 1591733 - RNA, 22 nt, Human
agaugugaacacaucagcuugc

SEQ ID NO: 1591734 - RNA, 16 nt, Human
ugacacuuaaaaaugg

SEQ ID NO: 1591735 - RNA, 15 nt, Human
ugacacuuaaaaaug

SEQ ID NO: 1591736 - RNA, 14 nt, Human
agauccuggaaauc

SEQ ID NO: 1591737 - RNA, 13 nt, Human
agauccuggaaau

SEQ ID NO: 1591738 - RNA, 22 nt, Human
agaugcuagaacucccuuucaa

SEQ ID NO: 1591739 - RNA, 21 nt, Human
agaugcuagaacucccuuuca

SEQ ID NO: 1591740 - RNA, 19 nt, Human
agaugcuagaacucccuuu

SEQ ID NO: 1591741 - RNA, 21 nt, Human
agaugcaguucugaagaagau

SEQ ID NO: 1591742 - RNA, 16 nt, Human
agcaagggugauggga

SEQ ID NO: 1591743 - RNA, 22 nt, Human
agcaagggugaugggaaagcau

SEQ ID NO: 1591744 - RNA, 20 nt, Human
agcaagggugaugggaaagc

SEQ ID NO: 1591745 - RNA, 16 nt, Human
agauuuuccugaaaac

SEQ ID NO: 1591746 - RNA, 15 nt, Human
agauuuuccugaaaa

SEQ ID NO: 1591747 - RNA, 12 nt, Human
ugagacagcucu

SEQ ID NO: 1591748 - RNA, 20 nt, Human
ugagacucugucucagucca

SEQ ID NO: 1591749 - RNA, 20 nt, Human
ugagagacacacugaagaag

SEQ ID NO: 1591750 - RNA, 19 nt, Human
ugagagacacacugaagaa

SEQ ID NO: 1591751 - RNA, 17 nt, Human
ugagagacacacugaag

SEQ ID NO: 1591752 - RNA, 16 nt, Human
ugagagacacacugaa

SEQ ID NO: 1591753 - RNA, 13 nt, Human
ugagaugugaaca

SEQ ID NO: 1591754 - RNA, 19 nt, Human
ugagaugugaacacaucag

SEQ ID NO: 1591755 - RNA, 18 nt, Human
ugagaugugaacacauca

SEQ ID NO: 1591756 - RNA, 24 nt, Human
ugagaugugaacacaucagcuugc

SEQ ID NO: 1591757 - RNA, 22 nt, Human
ugagagacacacugaagaagca

SEQ ID NO: 1591758 - RNA, 21 nt, Human
ugagagacacacugaagaagc

SEQ ID NO: 1591759 - RNA, 22 nt, Human
agagcugcccucuccugggcag

SEQ ID NO: 1591760 - RNA, 19 nt, Human
agagcugcccucuccuggg

SEQ ID NO: 1591761 - RNA, 20 nt, Human
agagcugcccucuccugggc

SEQ ID NO: 1591762 - RNA, 16 nt, Human
agagcugcccucuccu

SEQ ID NO: 1591763 - RNA, 17 nt, Human
agagcugcccucuccug

SEQ ID NO: 1591764 - RNA, 18 nt, Human
agagcugcccucuccugg

SEQ ID NO: 1591765 - RNA, 14 nt, Human
ugaaauaagccaga

SEQ ID NO: 1591766 - RNA, 13 nt, Human
ugaacaaauuuac

SEQ ID NO: 1591767 - RNA, 18 nt, Human
ugaacaaauuuacagaga

SEQ ID NO: 1591768 - RNA, 18 nt, Human
ugaacccgggaggcagag

SEQ ID NO: 1591769 - RNA, 22 nt, Human
ugaacccauauuuguacaccaa

SEQ ID NO: 1591770 - RNA, 23 nt, Human
ugaacuagaguuuagcuggaaaa

SEQ ID NO: 1591771 - RNA, 20 nt, Human
ugaagauuuaccacuugugu

SEQ ID NO: 1591772 - RNA, 17 nt, Human
ugaagauuuaccacuug

SEQ ID NO: 1591773 - RNA, 17 nt, Human
ugaaguacucauacaug

SEQ ID NO: 1591774 - RNA, 19 nt, Human
agagcuguucacagccaga

SEQ ID NO: 1591775 - RNA, 18 nt, Human
agagcuguucacagccag

SEQ ID NO: 1591776 - RNA, 17 nt, Human
ugaaagaggaaugaagu

SEQ ID NO: 1591777 - RNA, 18 nt, Human
ugaaagaggaaugaagua

SEQ ID NO: 1591778 - RNA, 17 nt, Human
ugaaaauauuuguauca

SEQ ID NO: 1591779 - RNA, 22 nt, Human
ugaaaauauuuguaucacaaau

SEQ ID NO: 1591780 - RNA, 21 nt, Human
ugaaaauauuuguaucacaaa

SEQ ID NO: 1591781 - RNA, 13 nt, Human
ugaaagaaaauaa

SEQ ID NO: 1591782 - RNA, 21 nt, Human
agacuggcacaguuuucugag

SEQ ID NO: 1591783 - RNA, 20 nt, Human
agacuggcacaguuuucuga

SEQ ID NO: 1591784 - RNA, 23 nt, Human
agacuggcacaguuuucugagaa

SEQ ID NO: 1591785 - RNA, 15 nt, Human
agagacagaaagcag

SEQ ID NO: 1591786 - RNA, 14 nt, Human
agagacagaaagca

SEQ ID NO: 1591787 - RNA, 16 nt, Human
agagacacacugaaga

SEQ ID NO: 1591788 - RNA, 14 nt, Human
ugucuaagauagua

SEQ ID NO: 1591789 - RNA, 15 nt, Human
ugucuaagauaguaa

SEQ ID NO: 1591790 - RNA, 18 nt, Human
ugucuaaauuugaauguu

SEQ ID NO: 1591791 - RNA, 21 nt, Human
ugucagcuccccucggagaag

SEQ ID NO: 1591792 - RNA, 20 nt, Human
ugucagcuccccucggagaa

SEQ ID NO: 1591793 - RNA, 23 nt, Human
ugucagcuccccucggagaagag

SEQ ID NO: 1591794 - RNA, 21 nt, Human
aguauguuagugcaaauuguc

SEQ ID NO: 1591795 - RNA, 18 nt, Human
aguauguuagugcaaauu

SEQ ID NO: 1591796 - RNA, 20 nt, Human
agucacauuccaagccucau

SEQ ID NO: 1591797 - RNA, 16 nt, Human
aguauuguccaggucu

SEQ ID NO: 1591798 - RNA, 15 nt, Human
aguauuguccagguc

SEQ ID NO: 1591799 - RNA, 14 nt, Human
ugugaagcaaaauu

SEQ ID NO: 1591800 - RNA, 16 nt, Human
agugaaagaggcagcu

SEQ ID NO: 1591801 - RNA, 22 nt, Human
agugaaagaggcagcuugaaac

SEQ ID NO: 1591802 - RNA, 14 nt, Human
agugagacagcucu

SEQ ID NO: 1591803 - RNA, 20 nt, Human
agugaaacucguuaauuugu

SEQ ID NO: 1591804 - RNA, 16 nt, Human
agugagccgagauugu

SEQ ID NO: 1591805 - RNA, 21 nt, Human
agugagcagucaggaaagaga

SEQ ID NO: 1591806 - RNA, 14 nt, Human
ugucuucacaacag

SEQ ID NO: 1591807 - RNA, 14 nt, Human
ugucuuaauuaaaa

SEQ ID NO: 1591808 - RNA, 17 nt, Human
ugucucuacuaaaaaua

SEQ ID NO: 1591809 - RNA, 15 nt, Human
uguacuuaacuauuc

SEQ ID NO: 1591810 - RNA, 18 nt, Human
uguaagaaaauaucacuu

SEQ ID NO: 1591811 - RNA, 16 nt, Human
uguaaaggaauuuaaa

SEQ ID NO: 1591812 - RNA, 16 nt, Human
aggucauauuaauaua

SEQ ID NO: 1591813 - RNA, 15 nt, Human
aggucagugcaaaua

SEQ ID NO: 1591814 - RNA, 20 nt, Human
aggguuuauguuuaggaugu

SEQ ID NO: 1591815 - RNA, 22 nt, Human
uggucugugagaugcuagaacu

SEQ ID NO: 1591816 - RNA, 22 nt, Human
ugguccaugggccauaugaaaa

SEQ ID NO: 1591817 - RNA, 15 nt, Human
agggugaaaauuauu

SEQ ID NO: 1591818 - RNA, 22 nt, Human
agggugaugggaaagcauugua

SEQ ID NO: 1591819 - RNA, 21 nt, Human
agggugaugggaaagcauugu

SEQ ID NO: 1591820 - RNA, 21 nt, Human
auaaguucauacauuguacga

SEQ ID NO: 1591821 - RNA, 11 nt, Human
auaaguucaua

SEQ ID NO: 1591822 - RNA, 13 nt, Human
auaaguucauaca

SEQ ID NO: 1591823 - RNA, 14 nt, Human
auaaguucauacau

SEQ ID NO: 1591824 - RNA, 15 nt, Human
auaaguucauacauu

SEQ ID NO: 1591825 - RNA, 12 nt, Human
uuaccugggaaa

SEQ ID NO: 1591826 - RNA, 20 nt, Human
auaaucagugugucuaaauu

SEQ ID NO: 1591827 - RNA, 21 nt, Human
auaaucuuucacaggggacag

SEQ ID NO: 1591828 - RNA, 14 nt, Human
auaaugaauacuuu

SEQ ID NO: 1591829 - RNA, 22 nt, Human
uuagaugcaguucugaagaaga

SEQ ID NO: 1591830 - RNA, 23 nt, Human
uuagaugcaguucugaagaagau

SEQ ID NO: 1591831 - RNA, 12 nt, Human
auaacugugaag

SEQ ID NO: 1591832 - RNA, 12 nt, Human
auaacuggaaac

SEQ ID NO: 1591833 - RNA, 19 nt, Human
auaaaugugccuucauuuu

SEQ ID NO: 1591834 - RNA, 16 nt, Human
auaaaccucaaaaugu

SEQ ID NO: 1591835 - RNA, 13 nt, Human
aguuuucugagaa

SEQ ID NO: 1591836 - RNA, 12 nt, Human
aguuuucugaga

SEQ ID NO: 1591837 - RNA, 17 nt, Human
aguuuucugagaaagac

SEQ ID NO: 1591838 - RNA, 14 nt, Human
aguuuucugagaaa

SEQ ID NO: 1591839 - RNA, 18 nt, Human
aguuuucugagaaagacu

SEQ ID NO: 1591840 - RNA, 23 nt, Human
uuauagaguguacuuaacuauuc

SEQ ID NO: 1591841 - RNA, 23 nt, Human
uuauacccagaaaguuauugaua

SEQ ID NO: 1591842 - RNA, 18 nt, Human
uuauacccagaaaguuau

SEQ ID NO: 1591843 - RNA, 19 nt, Human
uuauacccagaaaguuauu

SEQ ID NO: 1591844 - RNA, 13 nt, Human
uuauauaaguauu

SEQ ID NO: 1591845 - RNA, 14 nt, Human
uuauauaaguauuc

SEQ ID NO: 1591846 - RNA, 16 nt, Human
uuauauaaguauucua

SEQ ID NO: 1591847 - RNA, 18 nt, Human
uuauauaagcuuguauuc

SEQ ID NO: 1591848 - RNA, 15 nt, Human
auaauuuuaagaaau

SEQ ID NO: 1591849 - RNA, 21 nt, Human
auaauuuuaagaaaucaaaga

SEQ ID NO: 1591850 - RNA, 22 nt, Human
auacaaaaaaaaaaaaaaauua

SEQ ID NO: 1591851 - RNA, 22 nt, Human
auaauuuuuauauuugaaauau

SEQ ID NO: 1591852 - RNA, 21 nt, Human
auaauuuuuauauuugaaaua

SEQ ID NO: 1591853 - RNA, 19 nt, Human
auaauuuuuauauuugaaa

SEQ ID NO: 1591854 - RNA, 16 nt, Human
auaauuuuuauauuug

SEQ ID NO: 1591855 - RNA, 14 nt, Human
auaauuuuuauauu

SEQ ID NO: 1591856 - RNA, 20 nt, Human
auaauuuugugaagcaaaau

SEQ ID NO: 1591857 - RNA, 15 nt, Human
auaauuuugugaagc

SEQ ID NO: 1591858 - RNA, 14 nt, Human
auaauuuugugaag

SEQ ID NO: 1591859 - RNA, 13 nt, Human
auaauuuugugaa

SEQ ID NO: 1591860 - RNA, 22 nt, Human
uuaucaaagggugaaaauuauu

SEQ ID NO: 1591861 - RNA, 22 nt, Human
auaccacaggaaccacaagacu

SEQ ID NO: 1591862 - RNA, 15 nt, Human
auacaggucauauua

SEQ ID NO: 1591863 - RNA, 21 nt, Human
auacaggucauauuaauauau

SEQ ID NO: 1591864 - RNA, 21 nt, Human
auacaguucggugagcuacaa

SEQ ID NO: 1591865 - RNA, 19 nt, Human
auacauauuuuuguagcac

SEQ ID NO: 1591866 - RNA, 20 nt, Human
auacaucccuuaccugggaa

SEQ ID NO: 1591867 - RNA, 14 nt, Human
auacauuguacgaa

SEQ ID NO: 1591868 - RNA, 21 nt, Human
auacauuguacgaagaguauu

SEQ ID NO: 1591869 - RNA, 22 nt, Human
auacauuguacgaagaguauuu

SEQ ID NO: 1591870 - RNA, 23 nt, Human
aguuauugauaaguucauacauu

SEQ ID NO: 1591871 - RNA, 17 nt, Human
aguuauugauaaguuca

SEQ ID NO: 1591872 - RNA, 19 nt, Human
aguuauugauaaguucaua

SEQ ID NO: 1591873 - RNA, 21 nt, Human
aguuauugauaaguucauaca

SEQ ID NO: 1591874 - RNA, 22 nt, Human
aguuauugauaaguucauacau

SEQ ID NO: 1591875 - RNA, 19 nt, Human
aguuauggcuauaggugcu

SEQ ID NO: 1591876 - RNA, 20 nt, Human
aguuauuauauuuacaaaug

SEQ ID NO: 1591877 - RNA, 15 nt, Human
aguucuaaauuuugu

SEQ ID NO: 1591878 - RNA, 15 nt, Human
aguucagagcugccc

SEQ ID NO: 1591879 - RNA, 16 nt, Human
aguucagagcugcccu

SEQ ID NO: 1591880 - RNA, 17 nt, Human
aguucagagcugcccuc

SEQ ID NO: 1591881 - RNA, 18 nt, Human
aguucagagcugcccucu

SEQ ID NO: 1591882 - RNA, 19 nt, Human
aguucagagcugcccucuc

SEQ ID NO: 1591883 - RNA, 14 nt, Human
uuaaaaucauuucu

SEQ ID NO: 1591884 - RNA, 18 nt, Human
uuaaaaaagaaacauuug

SEQ ID NO: 1591885 - RNA, 15 nt, Human
uuaaaaaagaaacau

SEQ ID NO: 1591886 - RNA, 19 nt, Human
uuaaaaaagaaacauuugg

SEQ ID NO: 1591887 - RNA, 16 nt, Human
aguucugaagaagaug

SEQ ID NO: 1591888 - RNA, 15 nt, Human
aguucugaagaagau

SEQ ID NO: 1591889 - RNA, 14 nt, Human
aguucugaagaaga

SEQ ID NO: 1591890 - RNA, 13 nt, Human
aguucugaagaag

SEQ ID NO: 1591891 - RNA, 21 nt, Human
aguugauaugccuuuucccaa

SEQ ID NO: 1591892 - RNA, 15 nt, Human
uguuugcuaagcauu

SEQ ID NO: 1591893 - RNA, 19 nt, Human
uguuugcuaagcauuccaa

SEQ ID NO: 1591894 - RNA, 20 nt, Human
uguuuuauaauuuugugaag

SEQ ID NO: 1591895 - RNA, 13 nt, Human
uguuuuauaauuu

SEQ ID NO: 1591896 - RNA, 15 nt, Human
ugcagaagacaguau

SEQ ID NO: 1591897 - RNA, 14 nt, Human
ugcagaagacagua

SEQ ID NO: 1591898 - RNA, 17 nt, Human
agccagcaguucagagc

SEQ ID NO: 1591899 - RNA, 19 nt, Human
agccagcaguucagagcug

SEQ ID NO: 1591900 - RNA, 22 nt, Human
agccagcaguucagagcugccc

SEQ ID NO: 1591901 - RNA, 20 nt, Human
agccagcaguucagagcugc

SEQ ID NO: 1591902 - RNA, 21 nt, Human
agccagcaguucagagcugcc

SEQ ID NO: 1591903 - RNA, 18 nt, Human
ugauuaaguaaugauaac

SEQ ID NO: 1591904 - RNA, 23 nt, Human
ugauuaaguaaugauaacuggaa

SEQ ID NO: 1591905 - RNA, 12 nt, Human
ugaugaagaagu

SEQ ID NO: 1591906 - RNA, 11 nt, Human
ugaugaagaag

SEQ ID NO: 1591907 - RNA, 19 nt, Human
ugaugggaaagcauuguaa

SEQ ID NO: 1591908 - RNA, 16 nt, Human
ugccccauucaacauc

SEQ ID NO: 1591909 - RNA, 22 nt, Human
ugccauuuaaagcuuauuaaaa

SEQ ID NO: 1591910 - RNA, 23 nt, Human
agcucugcccauccugccccuga

SEQ ID NO: 1591911 - RNA, 12 nt, Human
ugcccucuccug

SEQ ID NO: 1591912 - RNA, 13 nt, Human
ugcccucuccugg

SEQ ID NO: 1591913 - RNA, 14 nt, Human
ugcccucuccuggg

SEQ ID NO: 1591914 - RNA, 15 nt, Human
ugcccucuccugggc

SEQ ID NO: 1591915 - RNA, 22 nt, Human
ugcccucuccugggcagcugcc

SEQ ID NO: 1591916 - RNA, 23 nt, Human
ugcccucuccugggcagcugccu

SEQ ID NO: 1591917 - RNA, 16 nt, Human
ugcccucuccugggca

SEQ ID NO: 1591918 - RNA, 17 nt, Human
ugcccucuccugggcag

SEQ ID NO: 1591919 - RNA, 18 nt, Human
ugcccucuccugggcagc

SEQ ID NO: 1591920 - RNA, 20 nt, Human
ugcccucuccugggcagcug

SEQ ID NO: 1591921 - RNA, 19 nt, Human
ugcccuguuaaaagaugaa

SEQ ID NO: 1591922 - RNA, 15 nt, Human
ugccucaccccuugc

SEQ ID NO: 1591923 - RNA, 18 nt, Human
ugccucagaaaacaagga

SEQ ID NO: 1591924 - RNA, 16 nt, Human
ugccuccccuccucug

SEQ ID NO: 1591925 - RNA, 11 nt, Human
ugccuccccuc

SEQ ID NO: 1591926 - RNA, 12 nt, Human
ugccuccccucc

SEQ ID NO: 1591927 - RNA, 13 nt, Human
ugccuccccuccu

SEQ ID NO: 1591928 - RNA, 14 nt, Human
ugccuccccuccuc

SEQ ID NO: 1591929 - RNA, 15 nt, Human
ugccuccccuccucu

SEQ ID NO: 1591930 - RNA, 17 nt, Human
agcugcccucuccuggg

SEQ ID NO: 1591931 - RNA, 18 nt, Human
agcugcccucuccugggc

SEQ ID NO: 1591932 - RNA, 19 nt, Human
agcugcccucuccugggca

SEQ ID NO: 1591933 - RNA, 20 nt, Human
agcugcccucuccugggcag

SEQ ID NO: 1591934 - RNA, 21 nt, Human
agcugcccucuccugggcagc

SEQ ID NO: 1591935 - RNA, 22 nt, Human
uggcacaguuuucugagaaaga

SEQ ID NO: 1591936 - RNA, 18 nt, Human
uggacgagaaaacaauaa

SEQ ID NO: 1591937 - RNA, 22 nt, Human
uggaauuucucccagucauuua

SEQ ID NO: 1591938 - RNA, 18 nt, Human
uggaauuggagcucgugg

SEQ ID NO: 1591939 - RNA, 13 nt, Human
uggaaaggcagcu

SEQ ID NO: 1591940 - RNA, 15 nt, Human
ugcuugccaucccuc

SEQ ID NO: 1591941 - RNA, 16 nt, Human
ugcuugccaucccucc

SEQ ID NO: 1591942 - RNA, 17 nt, Human
aggagaaacuggaacuc

SEQ ID NO: 1591943 - RNA, 11 nt, Human
aggagaaacug

SEQ ID NO: 1591944 - RNA, 11 nt, Human
aggaauuuaaa

SEQ ID NO: 1591945 - RNA, 17 nt, Human
aggacacugauaugggu

SEQ ID NO: 1591946 - RNA, 14 nt, Human
aggacacugauaug

SEQ ID NO: 1591947 - RNA, 14 nt, Human
ugcuggagcucugc

SEQ ID NO: 1591948 - RNA, 13 nt, Human
ugcuggagcucug

SEQ ID NO: 1591949 - RNA, 23 nt, Human
aucagugugucuaaauuugaaug

SEQ ID NO: 1591950 - RNA, 23 nt, Human
aucacuugaacccgggaggcaga

SEQ ID NO: 1591951 - RNA, 16 nt, Human
uucugcaucagcugcu

SEQ ID NO: 1591952 - RNA, 17 nt, Human
uucuguuuuauaauuuu

SEQ ID NO: 1591953 - RNA, 16 nt, Human
uucuguuuuauaauuu

SEQ ID NO: 1591954 - RNA, 16 nt, Human
aucccucccuccaccu

SEQ ID NO: 1591955 - RNA, 17 nt, Human
aucccucccuccaccuc

SEQ ID NO: 1591956 - RNA, 18 nt, Human
aucccucccuccaccucc

SEQ ID NO: 1591957 - RNA, 20 nt, Human
aucccucccuccaccucccu

SEQ ID NO: 1591958 - RNA, 21 nt, Human
aucccucccuccaccucccug

SEQ ID NO: 1591959 - RNA, 17 nt, Human
uugaaggaaaaugauac

SEQ ID NO: 1591960 - RNA, 17 nt, Human
uugacacuuaaaaaugg

SEQ ID NO: 1591961 - RNA, 17 nt, Human
uugauaaguucauacau

SEQ ID NO: 1591962 - RNA, 16 nt, Human
uugauaaguucauaca

SEQ ID NO: 1591963 - RNA, 14 nt, Human
uugagaguucuaaa

SEQ ID NO: 1591964 - RNA, 14 nt, Human
uugacccacaagaa

SEQ ID NO: 1591965 - RNA, 19 nt, Human
uugacacuuaaaaaugguu

SEQ ID NO: 1591966 - RNA, 18 nt, Human
auccugaggcuccacuug

SEQ ID NO: 1591967 - RNA, 16 nt, Human
auccugaggcuccacu

SEQ ID NO: 1591968 - RNA, 13 nt, Human
auccugaggcucc

SEQ ID NO: 1591969 - RNA, 11 nt, Human
auccugaggcu

SEQ ID NO: 1591970 - RNA, 13 nt, Human
auccugccccuga

SEQ ID NO: 1591971 - RNA, 22 nt, Human
auccugaggcuccacuuggucu

SEQ ID NO: 1591972 - RNA, 16 nt, Human
auccugcaauuccacu

SEQ ID NO: 1591973 - RNA, 12 nt, Human
auauuuaaugau

SEQ ID NO: 1591974 - RNA, 13 nt, Human
auauuuaaugaua

SEQ ID NO: 1591975 - RNA, 23 nt, Human
auauuuaaugauaaguaaaugcu

SEQ ID NO: 1591976 - RNA, 13 nt, Human
auauuuacaaaug

SEQ ID NO: 1591977 - RNA, 14 nt, Human
auauuguuugcuaa

SEQ ID NO: 1591978 - RNA, 13 nt, Human
auauguuucaaac

SEQ ID NO: 1591979 - RNA, 14 nt, Human
auauguuucaaacu

SEQ ID NO: 1591980 - RNA, 16 nt, Human
auauguuucaaacuuu

SEQ ID NO: 1591981 - RNA, 17 nt, Human
auauguuucaaacuuug

SEQ ID NO: 1591982 - RNA, 17 nt, Human
uucccagugaauucuug

SEQ ID NO: 1591983 - RNA, 18 nt, Human
auauuuuucacauaucua

SEQ ID NO: 1591984 - RNA, 15 nt, Human
auauuuuuguagcac

SEQ ID NO: 1591985 - RNA, 16 nt, Human
auauuuuuguagcacu

SEQ ID NO: 1591986 - RNA, 23 nt, Human
auauuuuuguagcacugacagau

SEQ ID NO: 1591987 - RNA, 18 nt, Human
aucaaauaugcaaagcac

SEQ ID NO: 1591988 - RNA, 17 nt, Human
aucaaauaugcaaagca

SEQ ID NO: 1591989 - RNA, 16 nt, Human
aucaaauaugcaaagc

SEQ ID NO: 1591990 - RNA, 16 nt, Human
aucaaggguacacugc

SEQ ID NO: 1591991 - RNA, 13 nt, Human
aucaauuuaaaaa

SEQ ID NO: 1591992 - RNA, 21 nt, Human
aucaaggguacacugccuucu

SEQ ID NO: 1591993 - RNA, 19 nt, Human
aucaauuuuucuuauuuca

SEQ ID NO: 1591994 - RNA, 14 nt, Human
aucaauuuuucuua

SEQ ID NO: 1591995 - RNA, 22 nt, Human
auaugagcuuccuucugugaaa

SEQ ID NO: 1591996 - RNA, 21 nt, Human
auaugagcuuccuucugugaa

SEQ ID NO: 1591997 - RNA, 14 nt, Human
auaugcaaagcacu

SEQ ID NO: 1591998 - RNA, 13 nt, Human
auaugcaaagcac

SEQ ID NO: 1591999 - RNA, 15 nt, Human
auaugcaaagcacug

SEQ ID NO: 1592000 - RNA, 23 nt, Human
auauguaccuaacgaaguauccu

SEQ ID NO: 1592001 - RNA, 14 nt, Human
uucauuaucucaaa

SEQ ID NO: 1592002 - RNA, 13 nt, Human
uucauaugcugua

SEQ ID NO: 1592003 - RNA, 16 nt, Human
auauauuuaaugauaa

SEQ ID NO: 1592004 - RNA, 15 nt, Human
uucaucaaugaauga

SEQ ID NO: 1592005 - RNA, 13 nt, Human
auauaugcuaagu

SEQ ID NO: 1592006 - RNA, 17 nt, Human
uucagcgguuuauauaa

SEQ ID NO: 1592007 - RNA, 15 nt, Human
uuucauaugcuguau

SEQ ID NO: 1592008 - RNA, 23 nt, Human
auggaauuggagcucgugggaca

SEQ ID NO: 1592009 - RNA, 22 nt, Human
uuucagaaaauauuauguguuu

SEQ ID NO: 1592010 - RNA, 19 nt, Human
augcuguauauccuuucua

SEQ ID NO: 1592011 - RNA, 19 nt, Human
uuuauuacuguaagaaaau

SEQ ID NO: 1592012 - RNA, 19 nt, Human
augcuguauuuuaaaagaa

SEQ ID NO: 1592013 - RNA, 14 nt, Human
augcuguauuuuaa

SEQ ID NO: 1592014 - RNA, 16 nt, Human
auggaacauaaaauac

SEQ ID NO: 1592015 - RNA, 16 nt, Human
uuuauuuuaauaaugu

SEQ ID NO: 1592016 - RNA, 20 nt, Human
uuuagcuggaaaaguauguu

SEQ ID NO: 1592017 - RNA, 19 nt, Human
uuuauaugcuucuguuuua

SEQ ID NO: 1592018 - RNA, 17 nt, Human
uuuauaugcuucuguuu

SEQ ID NO: 1592019 - RNA, 24 nt, Human
uuuaaagcuuauuaaaacucauuu

SEQ ID NO: 1592020 - RNA, 15 nt, Human
uuugaaauauugacu

SEQ ID NO: 1592021 - RNA, 14 nt, Human
uuugaaauauugac

SEQ ID NO: 1592022 - RNA, 14 nt, Human
uuucugcaucagcu

SEQ ID NO: 1592023 - RNA, 20 nt, Human
uuucuaugaaauauuauguu

SEQ ID NO: 1592024 - RNA, 14 nt, Human
uuucuaugaaauau

SEQ ID NO: 1592025 - RNA, 13 nt, Human
uuucuaugaaaua

SEQ ID NO: 1592026 - RNA, 17 nt, Human
auggaauuucucccagu

SEQ ID NO: 1592027 - RNA, 19 nt, Human
auggcuauaggugcuacaa

SEQ ID NO: 1592028 - RNA, 16 nt, Human
auggcuauaggugcua

SEQ ID NO: 1592029 - RNA, 23 nt, Human
auggcuauaggugcuacaaaaac

SEQ ID NO: 1592030 - RNA, 21 nt, Human
auggcuauaggugcuacaaaa

SEQ ID NO: 1592031 - RNA, 21 nt, Human
augggacauuugcucauggaa

SEQ ID NO: 1592032 - RNA, 22 nt, Human
augggacauuugcucauggaau

SEQ ID NO: 1592033 - RNA, 19 nt, Human
augacauaaaaacaacuuu

SEQ ID NO: 1592034 - RNA, 14 nt, Human
augauaacuggaaa

SEQ ID NO: 1592035 - RNA, 18 nt, Human
uugugaagcaaaauuuuu

SEQ ID NO: 1592036 - RNA, 22 nt, Human
augaauuacauuuguauaaaau

SEQ ID NO: 1592037 - RNA, 19 nt, Human
augaauuacauuuguauaa

SEQ ID NO: 1592038 - RNA, 18 nt, Human
augaauuacauuuguaua

SEQ ID NO: 1592039 - RNA, 23 nt, Human
augaauuaguuuuauaugcuucu

SEQ ID NO: 1592040 - RNA, 21 nt, Human
augaauuaguuuuauaugcuu

SEQ ID NO: 1592041 - RNA, 15 nt, Human
uuguauaaaauaauu

SEQ ID NO: 1592042 - RNA, 13 nt, Human
uuguauaaaauaa

SEQ ID NO: 1592043 - RNA, 21 nt, Human
augaaauauuauguuaaaacu

SEQ ID NO: 1592044 - RNA, 12 nt, Human
uugcucauggaa

SEQ ID NO: 1592045 - RNA, 11 nt, Human
uugcucaugga

SEQ ID NO: 1592046 - RNA, 14 nt, Human
auuuucagaaaaua

SEQ ID NO: 1592047 - RNA, 17 nt, Human
auuuucagaaaauauua

SEQ ID NO: 1592048 - RNA, 22 nt, Human
auuuucaguuauuauauuuaca

SEQ ID NO: 1592049 - RNA, 17 nt, Human
auuuuaaaagaaugauu

SEQ ID NO: 1592050 - RNA, 21 nt, Human
auuuguauaaaauaauuuuua

SEQ ID NO: 1592051 - RNA, 19 nt, Human
auuuguauaaaauaauuuu

SEQ ID NO: 1592052 - RNA, 18 nt, Human
auuuguauaaaauaauuu

SEQ ID NO: 1592053 - RNA, 22 nt, Human
auuuuaaaagaaugauuaugaa

SEQ ID NO: 1592054 - RNA, 18 nt, Human
auuuuaaaagaaugauua

SEQ ID NO: 1592055 - RNA, 13 nt, Human
auuuagauguaua

SEQ ID NO: 1592056 - RNA, 17 nt, Human
auuuauuuuaauaaugu

SEQ ID NO: 1592057 - RNA, 12 nt, Human
auuucauuucuu

SEQ ID NO: 1592058 - RNA, 20 nt, Human
auuuauuuuaauaauguuuc

SEQ ID NO: 1592059 - RNA, 19 nt, Human
auuuauuuuaauaauguuu

SEQ ID NO: 1592060 - RNA, 14 nt, Human
auuugaaauauuga

SEQ ID NO: 1592061 - RNA, 21 nt, Human
auugacccacaagaaaugaaa

SEQ ID NO: 1592062 - RNA, 18 nt, Human
auugacccacaagaaaug

SEQ ID NO: 1592063 - RNA, 14 nt, Human
auucuaaauuuuau

SEQ ID NO: 1592064 - RNA, 15 nt, Human
uuuuccaaaauaauu

SEQ ID NO: 1592065 - RNA, 18 nt, Human
uuuucugagaaagacuau

SEQ ID NO: 1592066 - RNA, 15 nt, Human
uuuucugagaaagac

SEQ ID NO: 1592067 - RNA, 16 nt, Human
uuuucucuaggaaaua

SEQ ID NO: 1592068 - RNA, 14 nt, Human
uuuucucuaggaaa

SEQ ID NO: 1592069 - RNA, 15 nt, Human
auuaaaagaauauuu

SEQ ID NO: 1592070 - RNA, 21 nt, Human
auguuuucaggcuagauguau

SEQ ID NO: 1592071 - RNA, 17 nt, Human
auguuuucaggcuagau

SEQ ID NO: 1592072 - RNA, 15 nt, Human
auguuuucaggcuag

SEQ ID NO: 1592073 - RNA, 18 nt, Human
auguucaucaaugaauga

SEQ ID NO: 1592074 - RNA, 14 nt, Human
uuuuaauaauguuu

SEQ ID NO: 1592075 - RNA, 13 nt, Human
uuuuaauaauguu

SEQ ID NO: 1592076 - RNA, 12 nt, Human
uuuuaauaaugu

SEQ ID NO: 1592077 - RNA, 16 nt, Human
uuuuaauaauguuuca

SEQ ID NO: 1592078 - RNA, 19 nt, Human
augugcuaguaauuggaaa

SEQ ID NO: 1592079 - RNA, 20 nt, Human
augugcuaguaauuggaaag

SEQ ID NO: 1592080 - RNA, 17 nt, Human
uuuuuguagcacugaca

SEQ ID NO: 1592081 - RNA, 23 nt, Human
auuaaguaaugauaacuggaaac

SEQ ID NO: 1592082 - RNA, 19 nt, Human
uuuuugugaaaagcuccau

SEQ ID NO: 1592083 - RNA, 20 nt, Human
auuacauuuguauaaaauaa

SEQ ID NO: 1592084 - RNA, 18 nt, Human
auuacauuuguauaaaau

SEQ ID NO: 1592085 - RNA, 17 nt, Human
auuacauuuguauaaaa

SEQ ID NO: 1592086 - RNA, 20 nt, Human
auuauauaaguauucuaaau

SEQ ID NO: 1592087 - RNA, 14 nt, Human
auuauauaaguauu

SEQ ID NO: 1592088 - RNA, 17 nt, Human
auuauauaaguauucua

SEQ ID NO: 1592089 - RNA, 14 nt, Human
uuuugaguucuaca

SEQ ID NO: 1592090 - RNA, 14 nt, Human
uuuuguucauacau

SEQ ID NO: 1592091 - RNA, 17 nt, Human
uuuuguucauacauauu

SEQ ID NO: 1592092 - RNA, 19 nt, Human
uuuuuauauuugaaauauu

SEQ ID NO: 1592093 - RNA, 16 nt, Human
aaaauauauuuaauga

SEQ ID NO: 1592094 - RNA, 15 nt, Human
aaaauauauuuaaug

SEQ ID NO: 1592095 - RNA, 14 nt, Human
aaaauacacacuca

SEQ ID NO: 1592096 - RNA, 20 nt, Human
aaaauaauuuuuauauuuga

SEQ ID NO: 1592097 - RNA, 17 nt, Human
aaaauaauuuuuauauu

SEQ ID NO: 1592098 - RNA, 16 nt, Human
aaaauaauuuuuauau

SEQ ID NO: 1592099 - RNA, 11 nt, Human
aaaauaauuuu

SEQ ID NO: 1592100 - RNA, 15 nt, Human
gggcgugguggugag

SEQ ID NO: 1592101 - RNA, 16 nt, Human
aaaauggguuuuacug

SEQ ID NO: 1592102 - RNA, 18 nt, Human
aaaaugguuuaaaugguc

SEQ ID NO: 1592103 - RNA, 16 nt, Human
aaaaugguuuaaaugg

SEQ ID NO: 1592104 - RNA, 18 nt, Human
ggucauauuaauauauuu

SEQ ID NO: 1592105 - RNA, 14 nt, Human
ggucagugcaaaua

SEQ ID NO: 1592106 - RNA, 21 nt, Human
aaacuucccuuucugcuugug

SEQ ID NO: 1592107 - RNA, 19 nt, Human
aaacuucagacauagaauu

SEQ ID NO: 1592108 - RNA, 14 nt, Human
aaauauauuuaaug

SEQ ID NO: 1592109 - RNA, 18 nt, Human
aaauauaugcuaagucuu

SEQ ID NO: 1592110 - RNA, 15 nt, Human
aaauauauuuaauga

SEQ ID NO: 1592111 - RNA, 22 nt, Human
aaauaucacuugucaauaaaau

SEQ ID NO: 1592112 - RNA, 21 nt, Human
aaauaccaugccauuuaaagc

SEQ ID NO: 1592113 - RNA, 20 nt, Human
aaauauuguguugugaaugu

SEQ ID NO: 1592114 - RNA, 17 nt, Human
aaauaugcaaagcacug

SEQ ID NO: 1592115 - RNA, 16 nt, Human
aaauaugcaaagcacu

SEQ ID NO: 1592116 - RNA, 15 nt, Human
aaauaugcaaagcac

SEQ ID NO: 1592117 - RNA, 13 nt, Human
aaauaugcaaagc

SEQ ID NO: 1592118 - RNA, 19 nt, Human
guaauagagcaaaauugau

SEQ ID NO: 1592119 - RNA, 15 nt, Human
guaauagagcaaaau

SEQ ID NO: 1592120 - RNA, 17 nt, Human
gguguuuuaaaaaaucu

SEQ ID NO: 1592121 - RNA, 20 nt, Human
gguucuagcauggcauauuu

SEQ ID NO: 1592122 - RNA, 17 nt, Human
aaaguauguuagugcaa

SEQ ID NO: 1592123 - RNA, 19 nt, Human
gguuuuauuguuuaaaauc

SEQ ID NO: 1592124 - RNA, 19 nt, Human
aaacuuuaugcuaagugaa

SEQ ID NO: 1592125 - RNA, 12 nt, Human
aaacuuuaugcu

SEQ ID NO: 1592126 - RNA, 16 nt, Human
aaagcagaacagugau

SEQ ID NO: 1592127 - RNA, 13 nt, Human
aaagcuuauuaaa

SEQ ID NO: 1592128 - RNA, 22 nt, Human
aaagggcuguuauaaucuuuca

SEQ ID NO: 1592129 - RNA, 20 nt, Human
aaagggcuguuauaaucuuu

SEQ ID NO: 1592130 - RNA, 20 nt, Human
aaaaagccugcaauuucaua

SEQ ID NO: 1592131 - RNA, 13 nt, Human
aaaaauacaaaaa

SEQ ID NO: 1592132 - RNA, 23 nt, Human
aaaaagauuuucagaaaauauua

SEQ ID NO: 1592133 - RNA, 16 nt, Human
ggccuucggccuccau

SEQ ID NO: 1592134 - RNA, 22 nt, Human
ggccuucggccuccauccugag

SEQ ID NO: 1592135 - RNA, 18 nt, Human
ggccuucggccuccaucc

SEQ ID NO: 1592136 - RNA, 20 nt, Human
ggcuaagcuucacuguaaaa

SEQ ID NO: 1592137 - RNA, 23 nt, Human
ggaucuucaucugacuaugacau

SEQ ID NO: 1592138 - RNA, 14 nt, Human
gcugccuccccucc

SEQ ID NO: 1592139 - RNA, 21 nt, Human
gcuguauuuuaaaagaaugau

SEQ ID NO: 1592140 - RNA, 18 nt, Human
gcuguauuuuaaaagaau

SEQ ID NO: 1592141 - RNA, 20 nt, Human
gcuguauuuuaaaagaauga

SEQ ID NO: 1592142 - RNA, 13 nt, Human
gcugcugaaacaa

SEQ ID NO: 1592143 - RNA, 21 nt, Human
ggacagucaccucauggaauu

SEQ ID NO: 1592144 - RNA, 18 nt, Human
ggacagucaccucaugga

SEQ ID NO: 1592145 - RNA, 17 nt, Human
ggacagucaccucaugg

SEQ ID NO: 1592146 - RNA, 19 nt, Human
ggaaaucaggguuaguauu

SEQ ID NO: 1592147 - RNA, 13 nt, Human
ggaaacugccagc

SEQ ID NO: 1592148 - RNA, 16 nt, Human
ggaaaaaauaacaaug

SEQ ID NO: 1592149 - RNA, 12 nt, Human
gcauuuagaugu

SEQ ID NO: 1592150 - RNA, 19 nt, Human
gcauuuaggccaugggaca

SEQ ID NO: 1592151 - RNA, 13 nt, Human
gcauuuagaugua

SEQ ID NO: 1592152 - RNA, 11 nt, Human
gccccaaaagg

SEQ ID NO: 1592153 - RNA, 22 nt, Human
gccucauguccacugguucuuc

SEQ ID NO: 1592154 - RNA, 15 nt, Human
gccuccauccugagg

SEQ ID NO: 1592155 - RNA, 14 nt, Human
gccuccauccugag

SEQ ID NO: 1592156 - RNA, 13 nt, Human
gccuccauccuga

SEQ ID NO: 1592157 - RNA, 17 nt, Human
gcaaaauugauguguuu

SEQ ID NO: 1592158 - RNA, 20 nt, Human
gcaucuagcaugucgucaaa

SEQ ID NO: 1592159 - RNA, 13 nt, Human
gcagugaugucac

SEQ ID NO: 1592160 - RNA, 22 nt, Human
gcaguuguugcccacagcugua

SEQ ID NO: 1592161 - RNA, 11 nt, Human
gcagcugccuc

SEQ ID NO: 1592162 - RNA, 13 nt, Human
gcagaacagugau

SEQ ID NO: 1592163 - RNA, 12 nt, Human
gcagaacaguga

SEQ ID NO: 1592164 - RNA, 22 nt, Human
gcagaacagugauuaccaggga

SEQ ID NO: 1592165 - RNA, 18 nt, Human
gcagaacagugauuacca

SEQ ID NO: 1592166 - RNA, 22 nt, Human
gaauauugcuuuggucauauga

SEQ ID NO: 1592167 - RNA, 14 nt, Human
gaaugaauggcuaa

SEQ ID NO: 1592168 - RNA, 20 nt, Human
gaaugaauggcuaagcaaaa

SEQ ID NO: 1592169 - RNA, 15 nt, Human
gaaugaauggcuaag

SEQ ID NO: 1592170 - RNA, 14 nt, Human
gaaugauuaugaau

SEQ ID NO: 1592171 - RNA, 22 nt, Human
gaaugauuaugaauuacauuug

SEQ ID NO: 1592172 - RNA, 15 nt, Human
gaauuaacacaugau

SEQ ID NO: 1592173 - RNA, 14 nt, Human
gaauuaacacauga

SEQ ID NO: 1592174 - RNA, 20 nt, Human
gaauuacauuuguauaaaau

SEQ ID NO: 1592175 - RNA, 18 nt, Human
gaauuacauuuguauaaa

SEQ ID NO: 1592176 - RNA, 15 nt, Human
gaauuacauuuguau

SEQ ID NO: 1592177 - RNA, 13 nt, Human
gaauuacauuugu

SEQ ID NO: 1592178 - RNA, 12 nt, Human
gacagcucugca

SEQ ID NO: 1592179 - RNA, 18 nt, Human
gacagucaccucauggaa

SEQ ID NO: 1592180 - RNA, 14 nt, Human
gacgcucucuggcc

SEQ ID NO: 1592181 - RNA, 22 nt, Human
gacuuuuuauggcacuaguauu

SEQ ID NO: 1592182 - RNA, 21 nt, Human
gagauugugccccugcacucc

SEQ ID NO: 1592183 - RNA, 16 nt, Human
gagaugcuagaacucc

SEQ ID NO: 1592184 - RNA, 20 nt, Human
gagaugcuagaacucccuuu

SEQ ID NO: 1592185 - RNA, 22 nt, Human
gagcuguucacagccagacugg

SEQ ID NO: 1592186 - RNA, 20 nt, Human
gagcuguucacagccagacu

SEQ ID NO: 1592187 - RNA, 14 nt, Human
gagcagucaggaaa

SEQ ID NO: 1592188 - RNA, 15 nt, Human
gaggcuccacuuggu

SEQ ID NO: 1592189 - RNA, 18 nt, Human
gaggcuccacuuggucug

SEQ ID NO: 1592190 - RNA, 17 nt, Human
gaggcuccacuuggucu

SEQ ID NO: 1592191 - RNA, 18 nt, Human
gaggcugagaugggagaa

SEQ ID NO: 1592192 - RNA, 21 nt, Human
gaggacgcucucuggccuucg

SEQ ID NO: 1592193 - RNA, 14 nt, Human
gaggagaaacugga

SEQ ID NO: 1592194 - RNA, 12 nt, Human
gaggagaaacug

SEQ ID NO: 1592195 - RNA, 23 nt, Human
cugugaaguuuacauuguaaaua

SEQ ID NO: 1592196 - RNA, 23 nt, Human
cugugagaugcuagaacucccuu

SEQ ID NO: 1592197 - RNA, 22 nt, Human
cuguucacagccagacuggcac

SEQ ID NO: 1592198 - RNA, 19 nt, Human
cuguucacagccagacugg

SEQ ID NO: 1592199 - RNA, 20 nt, Human
cuuaaaaaugguuuaaaugg

SEQ ID NO: 1592200 - RNA, 13 nt, Human
cuuaaaaaugguu

SEQ ID NO: 1592201 - RNA, 21 nt, Human
cuuaaaaaugguuuaaauggu

SEQ ID NO: 1592202 - RNA, 20 nt, Human
cugucuacacuaagagagaa

SEQ ID NO: 1592203 - RNA, 20 nt, Human
cuguaagaaaauaucacuug

SEQ ID NO: 1592204 - RNA, 12 nt, Human
cuggugccucac

SEQ ID NO: 1592205 - RNA, 17 nt, Human
cugccuccccuccucug

SEQ ID NO: 1592206 - RNA, 18 nt, Human
cugccuccccuccucugc

SEQ ID NO: 1592207 - RNA, 21 nt, Human
cugccuccccuccucugcuug

SEQ ID NO: 1592208 - RNA, 19 nt, Human
cugccuccccuccucugcu

SEQ ID NO: 1592209 - RNA, 20 nt, Human
cugccuccccuccucugcuu

SEQ ID NO: 1592210 - RNA, 23 nt, Human
cuggaaaaguauguuagugcaaa

SEQ ID NO: 1592211 - RNA, 16 nt, Human
gaacaagaugguucua

SEQ ID NO: 1592212 - RNA, 23 nt, Human
gaacaaauuuacagagacagaaa

SEQ ID NO: 1592213 - RNA, 18 nt, Human
gaacaaauuuacagagac

SEQ ID NO: 1592214 - RNA, 17 nt, Human
gaacaaauuuacagaga

SEQ ID NO: 1592215 - RNA, 18 nt, Human
gaaaugaaagcagggacu

SEQ ID NO: 1592216 - RNA, 23 nt, Human
gaaaucaaauaugcaaagcacug

SEQ ID NO: 1592217 - RNA, 19 nt, Human
gaaaucaaagagagaaaau

SEQ ID NO: 1592218 - RNA, 16 nt, Human
gaaaucaaauaugcaa

SEQ ID NO: 1592219 - RNA, 17 nt, Human
gaaaucaaauaugcaaa

SEQ ID NO: 1592220 - RNA, 23 nt, Human
gaaacuucagcgguuuauauaag

SEQ ID NO: 1592221 - RNA, 21 nt, Human
gaaaagacuccaaagaaaugu

SEQ ID NO: 1592222 - RNA, 20 nt, Human
gaaaagacuccaaagaaaug

SEQ ID NO: 1592223 - RNA, 23 nt, Human
cuuggucucagugucaaugcagc

SEQ ID NO: 1592224 - RNA, 20 nt, Human
auuaaauuuugaguucuaca

SEQ ID NO: 1592225 - RNA, 18 nt, Human
auuaaauuuugaguucua

SEQ ID NO: 1592226 - RNA, 22 nt, Human
auucaagaaaacaacuucaaua

SEQ ID NO: 1592227 - RNA, 18 nt, Human
auucacaagacccaaaag

SEQ ID NO: 1592228 - RNA, 17 nt, Human
auucuugccaaauauaa

SEQ ID NO: 1592229 - RNA, 19 nt, Human
auuuauacaggucauauua

SEQ ID NO: 1592230 - RNA, 16 nt, Human
auuucagcagcugcag

SEQ ID NO: 1592231 - RNA, 22 nt, Human
auuuaaugauaaguaaaugcua

SEQ ID NO: 1592232 - RNA, 20 nt, Human
auuucuaugaaauauuaugu

SEQ ID NO: 1592233 - RNA, 18 nt, Human
auuucuaugaaauauuau

SEQ ID NO: 1592234 - RNA, 15 nt, Human
auuucuaugaaauau

SEQ ID NO: 1592235 - RNA, 19 nt, Human
auuguuuaaaaucauuucu

SEQ ID NO: 1592236 - RNA, 17 nt, Human
auuguaaaugugcuuuu

SEQ ID NO: 1592237 - RNA, 15 nt, Human
auuguaaaugugcuu

SEQ ID NO: 1592238 - RNA, 14 nt, Human
auuguaaaugugcu

SEQ ID NO: 1592239 - RNA, 23 nt, Human
auuguaauaggcguaacuaauuu

SEQ ID NO: 1592240 - RNA, 13 nt, Human
auuguaaaauggu

SEQ ID NO: 1592241 - RNA, 18 nt, Human
caaaaaaauauauuuaau

SEQ ID NO: 1592242 - RNA, 17 nt, Human
auuuuauagcuacuaau

SEQ ID NO: 1592243 - RNA, 19 nt, Human
caacccaaauguucaucaa

SEQ ID NO: 1592244 - RNA, 21 nt, Human
caacuaucucauuuccaagca

SEQ ID NO: 1592245 - RNA, 15 nt, Human
caacacgagcaggcu

SEQ ID NO: 1592246 - RNA, 13 nt, Human
cagaauauugcuu

SEQ ID NO: 1592247 - RNA, 18 nt, Human
cagaauauguuucaaacu

SEQ ID NO: 1592248 - RNA, 20 nt, Human
cagaauauguuucaaacuuu

SEQ ID NO: 1592249 - RNA, 13 nt, Human
cagaauauguuuc

SEQ ID NO: 1592250 - RNA, 14 nt, Human
cagaauauguuuca

SEQ ID NO: 1592251 - RNA, 15 nt, Human
cagaauauguuucaa

SEQ ID NO: 1592252 - RNA, 17 nt, Human
cagaauauguuucaaac

SEQ ID NO: 1592253 - RNA, 12 nt, Human
cagaauauguuu

SEQ ID NO: 1592254 - RNA, 20 nt, Human
cacuuggucugugagaugcu

SEQ ID NO: 1592255 - RNA, 23 nt, Human
caccucaaaauaccaugccauuu

SEQ ID NO: 1592256 - RNA, 21 nt, Human
caccuacaugagguacugaga

SEQ ID NO: 1592257 - RNA, 11 nt, Human
cacugaagaag

SEQ ID NO: 1592258 - RNA, 23 nt, Human
caaugcuguauuuuaaaagaaug

SEQ ID NO: 1592259 - RNA, 14 nt, Human
caaugcuguauuuu

SEQ ID NO: 1592260 - RNA, 21 nt, Human
caauauuucagauaaucacaa

SEQ ID NO: 1592261 - RNA, 20 nt, Human
caauauuucagauaaucaca

SEQ ID NO: 1592262 - RNA, 12 nt, Human
caauauuucaga

SEQ ID NO: 1592263 - RNA, 12 nt, Human
caauuuaaaaaa

SEQ ID NO: 1592264 - RNA, 16 nt, Human
cacaagacugcacauc

SEQ ID NO: 1592265 - RNA, 20 nt, Human
caaguauuagaauaccacag

SEQ ID NO: 1592266 - RNA, 14 nt, Human
caaguauuagaaua

SEQ ID NO: 1592267 - RNA, 13 nt, Human
cacaucagcuugc

SEQ ID NO: 1592268 - RNA, 14 nt, Human
cauauuaauauauu

SEQ ID NO: 1592269 - RNA, 15 nt, Human
cauauuaauauauuu

SEQ ID NO: 1592270 - RNA, 19 nt, Human
cauauuaauauauuuccau

SEQ ID NO: 1592271 - RNA, 23 nt, Human
cauaugcuguauauccuuucuaa

SEQ ID NO: 1592272 - RNA, 19 nt, Human
cauuauauuuauuacugua

SEQ ID NO: 1592273 - RNA, 14 nt, Human
caugauguuuagaa

SEQ ID NO: 1592274 - RNA, 17 nt, Human
ccaaauguucaucaaug

SEQ ID NO: 1592275 - RNA, 18 nt, Human
ccaaauguucaucaauga

SEQ ID NO: 1592276 - RNA, 20 nt, Human
cauuuguauaaaauaauuuu

SEQ ID NO: 1592277 - RNA, 19 nt, Human
cauuuguauaaaauaauuu

SEQ ID NO: 1592278 - RNA, 12 nt, Human
ccacagcaguug

SEQ ID NO: 1592279 - RNA, 18 nt, Human
ccacagcaguugaaaaga

SEQ ID NO: 1592280 - RNA, 17 nt, Human
ccacagcaguugaaaag

SEQ ID NO: 1592281 - RNA, 23 nt, Human
ccacagcaguugaaaagacucca

SEQ ID NO: 1592282 - RNA, 20 nt, Human
cagucugacuguuuccauca

SEQ ID NO: 1592283 - RNA, 19 nt, Human
caggugccaguuauggcua

SEQ ID NO: 1592284 - RNA, 19 nt, Human
cagucaccucauggaauug

SEQ ID NO: 1592285 - RNA, 15 nt, Human
cagucacauuccaag

SEQ ID NO: 1592286 - RNA, 16 nt, Human
cagucaccucauggaa

SEQ ID NO: 1592287 - RNA, 22 nt, Human
cagcuccccucggagaagagcu

SEQ ID NO: 1592288 - RNA, 21 nt, Human
cagcuccccucggagaagagc

SEQ ID NO: 1592289 - RNA, 13 nt, Human
cagcaguucagag

SEQ ID NO: 1592290 - RNA, 18 nt, Human
cagcaguucagagcugcc

SEQ ID NO: 1592291 - RNA, 17 nt, Human
cagagguugcagugagc

SEQ ID NO: 1592292 - RNA, 12 nt, Human
cagauccuggaa

SEQ ID NO: 1592293 - RNA, 13 nt, Human
cagauccuggaaa

SEQ ID NO: 1592294 - RNA, 23 nt, Human
cgccacuguuuugaaucucauaa

SEQ ID NO: 1592295 - RNA, 18 nt, Human
cgcaggcccccaggugcc

SEQ ID NO: 1592296 - RNA, 17 nt, Human
cuacaaaaacacagcaa

SEQ ID NO: 1592297 - RNA, 16 nt, Human
cuacaaaaacacagca

SEQ ID NO: 1592298 - RNA, 18 nt, Human
cuacaaaaacacagcaag

SEQ ID NO: 1592299 - RNA, 18 nt, Human
cuacauacuauggaauuu

SEQ ID NO: 1592300 - RNA, 20 nt, Human
cuacaugagguacugagagu

SEQ ID NO: 1592301 - RNA, 23 nt, Human
cuaaguaaaaccacagcaguuga

SEQ ID NO: 1592302 - RNA, 22 nt, Human
cuaaguaaaaccacagcaguug

SEQ ID NO: 1592303 - RNA, 13 nt, Human
cuagaacucccuu

SEQ ID NO: 1592304 - RNA, 12 nt, Human
cuagaacucccu

SEQ ID NO: 1592305 - RNA, 23 nt, Human
cucaaaauaccaugccauuuaaa

SEQ ID NO: 1592306 - RNA, 13 nt, Human
cugaaacuucccu

SEQ ID NO: 1592307 - RNA, 15 nt, Human
cugaaacaacaaaua

SEQ ID NO: 1592308 - RNA, 22 nt, Human
cucuuagaugcaguucugaaga

SEQ ID NO: 1592309 - RNA, 16 nt, Human
cugagaugugaacaca

SEQ ID NO: 1592310 - RNA, 12 nt, Human
cuccucugcuug

SEQ ID NO: 1592311 - RNA, 14 nt, Human
cuccucugcuugcc

SEQ ID NO: 1592312 - RNA, 12 nt, Human
cuccugggcagc

SEQ ID NO: 1592313 - RNA, 14 nt, Human
cuccugggcagcug

SEQ ID NO: 1592314 - RNA, 15 nt, Human
cuccugggcagcugc

SEQ ID NO: 1592315 - RNA, 16 nt, Human
cuccugggcagcugcc

SEQ ID NO: 1592316 - RNA, 17 nt, Human
cuccugggcagcugccu

SEQ ID NO: 1592317 - RNA, 18 nt, Human
cuccugggcagcugccuc

SEQ ID NO: 1592318 - RNA, 19 nt, Human
cuccugggcagcugccucc

SEQ ID NO: 1592319 - RNA, 22 nt, Human
cuccugggcagcugccuccccu

SEQ ID NO: 1592320 - RNA, 21 nt, Human
cuccucugcuugccaucccuc

SEQ ID NO: 1592321 - RNA, 22 nt, Human
cuccucugcuugccaucccucc

SEQ ID NO: 1592322 - RNA, 15 nt, Human
cuccucugcuugcca

SEQ ID NO: 1592323 - RNA, 16 nt, Human
cuccucugcuugccau

SEQ ID NO: 1592324 - RNA, 17 nt, Human
cuccucugcuugccauc

SEQ ID NO: 1592325 - RNA, 20 nt, Human
cuccucugcuugccaucccu

SEQ ID NO: 1592326 - RNA, 14 nt, Human
cucguuaauuugua

SEQ ID NO: 1592327 - RNA, 23 nt, Human
cuccacuuggucugugagaugcu

SEQ ID NO: 1592328 - RNA, 22 nt, Human
cuccacuuggucugugagaugc

SEQ ID NO: 1592329 - RNA, 21 nt, Human
cuccacuuggucugugagaug

SEQ ID NO: 1592330 - RNA, 17 nt, Human
cuccacuuggucuguga

SEQ ID NO: 1592331 - RNA, 16 nt, Human
cuccacuuggucugug

SEQ ID NO: 1592332 - RNA, 15 nt, Human
cuccacuuggucugu

SEQ ID NO: 1592333 - RNA, 13 nt, Human
cuccacuuggucu

SEQ ID NO: 1592334 - RNA, 22 nt, Human
ccauuuaaagcuuauuaaaacu

SEQ ID NO: 1592335 - RNA, 14 nt, Human
ccauacauuugugu

SEQ ID NO: 1592336 - RNA, 13 nt, Human
ccauacauuugug

SEQ ID NO: 1592337 - RNA, 18 nt, Human
ccccugcacuccagccug

SEQ ID NO: 1592338 - RNA, 23 nt, Human
ccucauggaauuggagcucgugg

SEQ ID NO: 1592339 - RNA, 15 nt, Human
ccuguaaucacagcu

SEQ ID NO: 1592340 - RNA, 13 nt, Human
cacugacagauuu

SEQ ID NO: 1592341 - RNA, 17 nt, Human
cacugacagauuuccau

SEQ ID NO: 1592342 - RNA, 22 nt, Human
cacugacagauuuccauccuag

SEQ ID NO: 1592343 - RNA, 20 nt, Human
cacugacuucuaaguaaaac

SEQ ID NO: 1592344 - RNA, 16 nt, Human
cacugacuucuaagua

SEQ ID NO: 1592345 - RNA, 15 nt, Human
cacugacuucuaagu

SEQ ID NO: 1592346 - RNA, 14 nt, Human
cacugacuucuaag

SEQ ID NO: 1592347 - RNA, 21 nt, Human
cacugacuucuaaguaaaacc

SEQ ID NO: 1592348 - RNA, 20 nt, Human
cacugccuucucaacuccaa

SEQ ID NO: 1592349 - RNA, 23 nt, Human
cacuugaacccgggaggcagagg

SEQ ID NO: 1592350 - RNA, 21 nt, Human
cacuugaacccgggaggcaga

SEQ ID NO: 1592351 - RNA, 20 nt, Human
cacuugaacccgggaggcag

SEQ ID NO: 1592352 - RNA, 17 nt, Human
cacuuggucugugagau

SEQ ID NO: 1592353 - RNA, 15 nt, Human
cacuuggucugugag

SEQ ID NO: 1592354 - RNA, 19 nt, Human
cacuguggguagacacaca

SEQ ID NO: 1592355 - RNA, 24 nt, Human
cacuguggguagacacacaugaag

SEQ ID NO: 1592356 - RNA, 22 nt, Human
cacuguggguagacacacauga

SEQ ID NO: 1592357 - RNA, 14 nt, Human
cacugucaagauga

SEQ ID NO: 1592358 - RNA, 22 nt, Human
cacgagcaggcuacugucagcu

SEQ ID NO: 1592359 - RNA, 20 nt, Human
cacgagcaggcuacugucag

SEQ ID NO: 1592360 - RNA, 19 nt, Human
cacgagcaggcuacuguca

SEQ ID NO: 1592361 - RNA, 17 nt, Human
cacgagcaggcuacugu

SEQ ID NO: 1592362 - RNA, 22 nt, Human
cacguucuuacuaguuucccuu

SEQ ID NO: 1592363 - RNA, 13 nt, Human
cacuaaacaaaga

SEQ ID NO: 1592364 - RNA, 16 nt, Human
cacucaaaucaagaaa

SEQ ID NO: 1592365 - RNA, 19 nt, Human
cacuaguauuucuaugaaa

SEQ ID NO: 1592366 - RNA, 14 nt, Human
cacuaguauuucua

SEQ ID NO: 1592367 - RNA, 21 nt, Human
cacuaaauugacacuuaaaaa

SEQ ID NO: 1592368 - RNA, 17 nt, Human
cacuaagagagaaugag

SEQ ID NO: 1592369 - RNA, 13 nt, Human
caccucccugcaa

SEQ ID NO: 1592370 - RNA, 14 nt, Human
caccucccugcaau

SEQ ID NO: 1592371 - RNA, 14 nt, Human
caccucauggaauu

SEQ ID NO: 1592372 - RNA, 12 nt, Human
caccucauggaa

SEQ ID NO: 1592373 - RNA, 11 nt, Human
caccucaugga

SEQ ID NO: 1592374 - RNA, 10 nt, Human
caccucccug

SEQ ID NO: 1592375 - RNA, 14 nt, Human
cagauaaucagugu

SEQ ID NO: 1592376 - RNA, 14 nt, Human
cagauaaucacaau

SEQ ID NO: 1592377 - RNA, 14 nt, Human
cagauaaacaguag

SEQ ID NO: 1592378 - RNA, 23 nt, Human
cagauaaauaguuuaugauucca

SEQ ID NO: 1592379 - RNA, 14 nt, Human
cagauccuggaaau

SEQ ID NO: 1592380 - RNA, 19 nt, Human
cagaaaauauuauguguuu

SEQ ID NO: 1592381 - RNA, 23 nt, Human
cagaacagugauuaccagggacu

SEQ ID NO: 1592382 - RNA, 19 nt, Human
cagaaagcagaacagugau

SEQ ID NO: 1592383 - RNA, 18 nt, Human
cagaaagcagaacaguga

SEQ ID NO: 1592384 - RNA, 17 nt, Human
cagaaggaucuucaucu

SEQ ID NO: 1592385 - RNA, 20 nt, Human
cagaagcaacccaaauguuc

SEQ ID NO: 1592386 - RNA, 19 nt, Human
cagaagcaacccaaauguu

SEQ ID NO: 1592387 - RNA, 19 nt, Human
cagacauagaauuaacaca

SEQ ID NO: 1592388 - RNA, 17 nt, Human
cagacauagaauuaaca

SEQ ID NO: 1592389 - RNA, 16 nt, Human
cagauggaaugcugug

SEQ ID NO: 1592390 - RNA, 17 nt, Human
cagauggaaugcugugu

SEQ ID NO: 1592391 - RNA, 19 nt, Human
cagauggaaugcuguguua

SEQ ID NO: 1592392 - RNA, 21 nt, Human
cagauggaaugcuguguuaaa

SEQ ID NO: 1592393 - RNA, 15 nt, Human
cagauuuuccugaaa

SEQ ID NO: 1592394 - RNA, 14 nt, Human
cagauuuuccugaa

SEQ ID NO: 1592395 - RNA, 23 nt, Human
cagcaacgcaggcccccaggugc

SEQ ID NO: 1592396 - RNA, 19 nt, Human
cagcaagggugaugggaaa

SEQ ID NO: 1592397 - RNA, 23 nt, Human
cagcaagggugaugggaaagcau

SEQ ID NO: 1592398 - RNA, 22 nt, Human
cagcaagggugaugggaaagca

SEQ ID NO: 1592399 - RNA, 15 nt, Human
caggaaguagaggag

SEQ ID NO: 1592400 - RNA, 16 nt, Human
caggaaguagaggagg

SEQ ID NO: 1592401 - RNA, 23 nt, Human
cagcuuuccucaaaacuucagac

SEQ ID NO: 1592402 - RNA, 18 nt, Human
caggaaccacaagacugc

SEQ ID NO: 1592403 - RNA, 18 nt, Human
cagcuugaaacugagaug

SEQ ID NO: 1592404 - RNA, 19 nt, Human
cagcuguaugauucccagc

SEQ ID NO: 1592405 - RNA, 21 nt, Human
cagcugcugaaacaacaaaua

SEQ ID NO: 1592406 - RNA, 20 nt, Human
cagcugcugaaacaacaaau

SEQ ID NO: 1592407 - RNA, 18 nt, Human
cagcuguaugauucccag

SEQ ID NO: 1592408 - RNA, 20 nt, Human
cagcucugcauacucauuag

SEQ ID NO: 1592409 - RNA, 16 nt, Human
cagccuaguugaucag

SEQ ID NO: 1592410 - RNA, 19 nt, Human
cagcuacuugggaggcuga

SEQ ID NO: 1592411 - RNA, 20 nt, Human
caggucauauuaauauauuu

SEQ ID NO: 1592412 - RNA, 21 nt, Human
caggucauauuaauauauuuc

SEQ ID NO: 1592413 - RNA, 12 nt, Human
cagugaauucuu

SEQ ID NO: 1592414 - RNA, 15 nt, Human
cagugagacagcucu

SEQ ID NO: 1592415 - RNA, 16 nt, Human
cagugaaagaaaauaa

SEQ ID NO: 1592416 - RNA, 20 nt, Human
cagugaaagaaaauaacaau

SEQ ID NO: 1592417 - RNA, 18 nt, Human
cagugauuaccagggacu

SEQ ID NO: 1592418 - RNA, 17 nt, Human
cagugauuaccagggac

SEQ ID NO: 1592419 - RNA, 12 nt, Human
caguauggcagc

SEQ ID NO: 1592420 - RNA, 12 nt, Human
caguagugauag

SEQ ID NO: 1592421 - RNA, 13 nt, Human
caguccaugaaga

SEQ ID NO: 1592422 - RNA, 22 nt, Human
cagucaggaaagagaacuucca

SEQ ID NO: 1592423 - RNA, 18 nt, Human
cagucaggaaagagaacu

SEQ ID NO: 1592424 - RNA, 15 nt, Human
cagucaggaaagaga

SEQ ID NO: 1592425 - RNA, 12 nt, Human
caggagaguaga

SEQ ID NO: 1592426 - RNA, 20 nt, Human
caggcccccaggugccaguu

SEQ ID NO: 1592427 - RNA, 19 nt, Human
caggcccccaggugccagu

SEQ ID NO: 1592428 - RNA, 14 nt, Human
caggcccccaggug

SEQ ID NO: 1592429 - RNA, 23 nt, Human
caggaugguucccuugaugaaga

SEQ ID NO: 1592430 - RNA, 21 nt, Human
caggaugguucccuugaugaa

SEQ ID NO: 1592431 - RNA, 16 nt, Human
caggauuuuaaucuuu

SEQ ID NO: 1592432 - RNA, 16 nt, Human
caggggacaggauggu

SEQ ID NO: 1592433 - RNA, 11 nt, Human
caggggacagg

SEQ ID NO: 1592434 - RNA, 17 nt, Human
cagggcauggcugggaa

SEQ ID NO: 1592435 - RNA, 18 nt, Human
cagggacaggauaagagg

SEQ ID NO: 1592436 - RNA, 14 nt, Human
caggcuacugucag

SEQ ID NO: 1592437 - RNA, 19 nt, Human
caggcuagauguauguacu

SEQ ID NO: 1592438 - RNA, 13 nt, Human
caggcuagaugua

SEQ ID NO: 1592439 - RNA, 17 nt, Human
caucugacuaugacaua

SEQ ID NO: 1592440 - RNA, 19 nt, Human
caugaagauguagaggaga

SEQ ID NO: 1592441 - RNA, 18 nt, Human
caugaagauguagaggag

SEQ ID NO: 1592442 - RNA, 16 nt, Human
caugagguacugagag

SEQ ID NO: 1592443 - RNA, 19 nt, Human
caugagguacugagaguga

SEQ ID NO: 1592444 - RNA, 21 nt, Human
cauaucuaguaugaaauuaua

SEQ ID NO: 1592445 - RNA, 15 nt, Human
cauaucuaguaugaa

SEQ ID NO: 1592446 - RNA, 17 nt, Human
cauaucuaguaugaaau

SEQ ID NO: 1592447 - RNA, 18 nt, Human
cauaucuaguaugaaauu

SEQ ID NO: 1592448 - RNA, 20 nt, Human
cauauauaacaaugcuguau

SEQ ID NO: 1592449 - RNA, 15 nt, Human
cauauauaacaaugc

SEQ ID NO: 1592450 - RNA, 13 nt, Human
cauauauaacaau

SEQ ID NO: 1592451 - RNA, 22 nt, Human
caucccucccuccaccucccug

SEQ ID NO: 1592452 - RNA, 23 nt, Human
caucccucccuccaccucccugc

SEQ ID NO: 1592453 - RNA, 18 nt, Human
caucccuuaccugggaaa

SEQ ID NO: 1592454 - RNA, 21 nt, Human
cauuaaaaaaucaguuguaca

SEQ ID NO: 1592455 - RNA, 20 nt, Human
caugugcuaguaauuggaaa

SEQ ID NO: 1592456 - RNA, 23 nt, Human
cauggcauauuuuucacauaucu

SEQ ID NO: 1592457 - RNA, 15 nt, Human
cauggcauauuuuuc

SEQ ID NO: 1592458 - RNA, 19 nt, Human
cauggcauauuuuucacau

SEQ ID NO: 1592459 - RNA, 13 nt, Human
cauggcauauuuu

SEQ ID NO: 1592460 - RNA, 20 nt, Human
cauggaauuggagcucgugg

SEQ ID NO: 1592461 - RNA, 20 nt, Human
cauuguacgaagaguauuuu

SEQ ID NO: 1592462 - RNA, 19 nt, Human
cauuguacgaagaguauuu

SEQ ID NO: 1592463 - RNA, 21 nt, Human
cauuguaaaugugcuuuuaaa

SEQ ID NO: 1592464 - RNA, 22 nt, Human
cauuccaacuaucucauuucca

SEQ ID NO: 1592465 - RNA, 13 nt, Human
cauucuggaauaa

SEQ ID NO: 1592466 - RNA, 19 nt, Human
ccaugggacagggaggacg

SEQ ID NO: 1592467 - RNA, 16 nt, Human
ccaugggacagggagg

SEQ ID NO: 1592468 - RNA, 14 nt, Human
ccaguuauggcuau

SEQ ID NO: 1592469 - RNA, 21 nt, Human
ccaguuauggcuauaggugcu

SEQ ID NO: 1592470 - RNA, 23 nt, Human
ccagcaguucagagcugcccucu

SEQ ID NO: 1592471 - RNA, 13 nt, Human
ccagcaguucaga

SEQ ID NO: 1592472 - RNA, 18 nt, Human
ccagcaguucagagcugc

SEQ ID NO: 1592473 - RNA, 19 nt, Human
ccagcaguucagagcugcc

SEQ ID NO: 1592474 - RNA, 20 nt, Human
ccagcaguucagagcugccc

SEQ ID NO: 1592475 - RNA, 21 nt, Human
ccagcaguucagagcugcccu

SEQ ID NO: 1592476 - RNA, 22 nt, Human
ccagcaguucagagcugcccuc

SEQ ID NO: 1592477 - RNA, 22 nt, Human
ccagccagcaguucagagcugc

SEQ ID NO: 1592478 - RNA, 14 nt, Human
ccaccucccugcaa

SEQ ID NO: 1592479 - RNA, 19 nt, Human
ccugcaauuucauaugcug

SEQ ID NO: 1592480 - RNA, 16 nt, Human
ccugcaauaaaauggg

SEQ ID NO: 1592481 - RNA, 11 nt, Human
ccugagcccca

SEQ ID NO: 1592482 - RNA, 23 nt, Human
ccuggaaaucaggguuaguauug

SEQ ID NO: 1592483 - RNA, 23 nt, Human
cgaagaguauuuuugacagaaua

SEQ ID NO: 1592484 - RNA, 21 nt, Human
cgaagaguauuuuugacagaa

SEQ ID NO: 1592485 - RNA, 18 nt, Human
cgagcaggcuacugucag

SEQ ID NO: 1592486 - RNA, 15 nt, Human
ccuucugugaaagua

SEQ ID NO: 1592487 - RNA, 16 nt, Human
ccuucggccuccaucc

SEQ ID NO: 1592488 - RNA, 19 nt, Human
ccuuggggcugaugcaguu

SEQ ID NO: 1592489 - RNA, 20 nt, Human
ccuucggccuccauccugag

SEQ ID NO: 1592490 - RNA, 14 nt, Human
ccuucggccuccau

SEQ ID NO: 1592491 - RNA, 12 nt, Human
ccuucagccuga

SEQ ID NO: 1592492 - RNA, 21 nt, Human
ccuguuaaaagaugaaaauau

SEQ ID NO: 1592493 - RNA, 20 nt, Human
ccuguuaaaagaugaaaaua

SEQ ID NO: 1592494 - RNA, 16 nt, Human
ccgggcguggugguga

SEQ ID NO: 1592495 - RNA, 13 nt, Human
ccuccaccucccu

SEQ ID NO: 1592496 - RNA, 14 nt, Human
ccuccaccucccug

SEQ ID NO: 1592497 - RNA, 15 nt, Human
ccuccaccucccugc

SEQ ID NO: 1592498 - RNA, 17 nt, Human
ccuccaccucccugcaa

SEQ ID NO: 1592499 - RNA, 22 nt, Human
ccuccaccucccugcaauaaaa

SEQ ID NO: 1592500 - RNA, 17 nt, Human
ccucccuccaccucccu

SEQ ID NO: 1592501 - RNA, 20 nt, Human
ccucccuccaccucccugca

SEQ ID NO: 1592502 - RNA, 16 nt, Human
ccuccucugcuugcca

SEQ ID NO: 1592503 - RNA, 18 nt, Human
ccuccucugcuugccauc

SEQ ID NO: 1592504 - RNA, 15 nt, Human
cccgugggguuccuc

SEQ ID NO: 1592505 - RNA, 14 nt, Human
cccucuccugggca

SEQ ID NO: 1592506 - RNA, 15 nt, Human
cccucuccugggcag

SEQ ID NO: 1592507 - RNA, 11 nt, Human
cccucuccugg

SEQ ID NO: 1592508 - RNA, 12 nt, Human
cccucuccuggg

SEQ ID NO: 1592509 - RNA, 13 nt, Human
cccucuccugggc

SEQ ID NO: 1592510 - RNA, 14 nt, Human
cccuccaccucccu

SEQ ID NO: 1592511 - RNA, 12 nt, Human
cccuccaccucc

SEQ ID NO: 1592512 - RNA, 19 nt, Human
cccuccaccucccugcaau

SEQ ID NO: 1592513 - RNA, 15 nt, Human
cccuccaccucccug

SEQ ID NO: 1592514 - RNA, 17 nt, Human
cccuccaccucccugca

SEQ ID NO: 1592515 - RNA, 13 nt, Human
cccacaagaaaug

SEQ ID NO: 1592516 - RNA, 20 nt, Human
cccacaagaaaugaaagcag

SEQ ID NO: 1592517 - RNA, 18 nt, Human
cugugaaaguacauuugg

SEQ ID NO: 1592518 - RNA, 18 nt, Human
cugucuucacaacagauu

SEQ ID NO: 1592519 - RNA, 16 nt, Human
cuguuaaaagaugaaa

SEQ ID NO: 1592520 - RNA, 15 nt, Human
cuguuaaaagaugaa

SEQ ID NO: 1592521 - RNA, 19 nt, Human
cuguuaaaagaugaaaaua

SEQ ID NO: 1592522 - RNA, 20 nt, Human
cuguuaaaagaugaaaauau

SEQ ID NO: 1592523 - RNA, 15 nt, Human
cuguuuuauaauuuu

SEQ ID NO: 1592524 - RNA, 14 nt, Human
cuguuuuauaauuu

SEQ ID NO: 1592525 - RNA, 17 nt, Human
cuuaauuaaaagaauau

SEQ ID NO: 1592526 - RNA, 16 nt, Human
cuuaauuaaaagaaua

SEQ ID NO: 1592527 - RNA, 20 nt, Human
cuuaauuaaaagaauauuuu

SEQ ID NO: 1592528 - RNA, 19 nt, Human
cuuaauuaaaagaauauuu

SEQ ID NO: 1592529 - RNA, 12 nt, Human
cuuaaaaauggu

SEQ ID NO: 1592530 - RNA, 23 nt, Human
cuuaagaagacugcauuauauuu

SEQ ID NO: 1592531 - RNA, 20 nt, Human
cuucggccuccauccugagg

SEQ ID NO: 1592532 - RNA, 19 nt, Human
cuuccagauccuggaaauc

SEQ ID NO: 1592533 - RNA, 14 nt, Human
cuucacaacagauu

SEQ ID NO: 1592534 - RNA, 12 nt, Human
cuucacaacaga

SEQ ID NO: 1592535 - RNA, 17 nt, Human
cuucaaauccuugaaga

SEQ ID NO: 1592536 - RNA, 15 nt, Human
cuucagccugaaaga

SEQ ID NO: 1592537 - RNA, 16 nt, Human
cuucagcgguuuauau

SEQ ID NO: 1592538 - RNA, 19 nt, Human
cuuguguuaaguaugugua

SEQ ID NO: 1592539 - RNA, 18 nt, Human
cuuuaaagggauggcaag

SEQ ID NO: 1592540 - RNA, 20 nt, Human
cuuuaaagggauggcaagau

SEQ ID NO: 1592541 - RNA, 21 nt, Human
cuuuauuuucuauaauuuaaa

SEQ ID NO: 1592542 - RNA, 13 nt, Human
cuuuccacagaag

SEQ ID NO: 1592543 - RNA, 21 nt, Human
cuugccaucccucccuccacc

SEQ ID NO: 1592544 - RNA, 18 nt, Human
cuugcccuggugccucac

SEQ ID NO: 1592545 - RNA, 22 nt, Human
cuugccaucccucccuccaccu

SEQ ID NO: 1592546 - RNA, 19 nt, Human
cuuguaaaggaauuuaaaa

SEQ ID NO: 1592547 - RNA, 17 nt, Human
gaaaauauuauguguuu

SEQ ID NO: 1592548 - RNA, 12 nt, Human
gaaaauaucacu

SEQ ID NO: 1592549 - RNA, 19 nt, Human
gaaaaucuuauaauuuaaa

SEQ ID NO: 1592550 - RNA, 19 nt, Human
gaaaauaacgauaaaagac

SEQ ID NO: 1592551 - RNA, 20 nt, Human
gaaaaucuuauaauuuaaaa

SEQ ID NO: 1592552 - RNA, 22 nt, Human
gaaaacaauaacgauaaaagac

SEQ ID NO: 1592553 - RNA, 14 nt, Human
gaaggaaaaugaua

SEQ ID NO: 1592554 - RNA, 21 nt, Human
gaagccuuggggcugaugcag

SEQ ID NO: 1592555 - RNA, 17 nt, Human
gaagacugcauuauauu

SEQ ID NO: 1592556 - RNA, 16 nt, Human
gaaguuuacauuguaa

SEQ ID NO: 1592557 - RNA, 17 nt, Human
gaaguuuacauuguaaa

SEQ ID NO: 1592558 - RNA, 14 nt, Human
gaauacuuuauaaa

SEQ ID NO: 1592559 - RNA, 22 nt, Human
gaacuagaguuuagcuggaaaa

SEQ ID NO: 1592560 - RNA, 22 nt, Human
gaacuuccagauccuggaaauc

SEQ ID NO: 1592561 - RNA, 14 nt, Human
gaacucccuuucaa

SEQ ID NO: 1592562 - RNA, 15 nt, Human
gaacucccuuucaac

SEQ ID NO: 1592563 - RNA, 21 nt, Human
gaacuuguaaaggaauuuaaa

SEQ ID NO: 1592564 - RNA, 21 nt, Human
gaagaagcaccaaucaugaau

SEQ ID NO: 1592565 - RNA, 11 nt, Human
gaaacauuugg

SEQ ID NO: 1592566 - RNA, 22 nt, Human
gaaauguaagggaaacugccag

SEQ ID NO: 1592567 - RNA, 16 nt, Human
gaaauauuauguuaaa

SEQ ID NO: 1592568 - RNA, 13 nt, Human
gaaauauuauguu

SEQ ID NO: 1592569 - RNA, 22 nt, Human
cugcaauaaaauggguuuuacu

SEQ ID NO: 1592570 - RNA, 15 nt, Human
cugcaauaaaauggg

SEQ ID NO: 1592571 - RNA, 21 nt, Human
cugaggcuccacuuggucugu

SEQ ID NO: 1592572 - RNA, 15 nt, Human
cugaggcuccacuug

SEQ ID NO: 1592573 - RNA, 14 nt, Human
cugaagaagauggu

SEQ ID NO: 1592574 - RNA, 20 nt, Human
cugagaugugaacacaucag

SEQ ID NO: 1592575 - RNA, 20 nt, Human
cugagaaagacuauucaaac

SEQ ID NO: 1592576 - RNA, 19 nt, Human
cugagaaagacuauucaaa

SEQ ID NO: 1592577 - RNA, 22 nt, Human
cugagaaagacuauucaaacag

SEQ ID NO: 1592578 - RNA, 21 nt, Human
cugagaugugaacacaucagc

SEQ ID NO: 1592579 - RNA, 16 nt, Human
cugagcaggauuuuaa

SEQ ID NO: 1592580 - RNA, 18 nt, Human
cugagaaagacuauucaa

SEQ ID NO: 1592581 - RNA, 15 nt, Human
cugagaaagacuauu

SEQ ID NO: 1592582 - RNA, 13 nt, Human
cugagaaagacua

SEQ ID NO: 1592583 - RNA, 12 nt, Human
cugagaaagacu

SEQ ID NO: 1592584 - RNA, 22 nt, Human
cucuggccuucggccuccaucc

SEQ ID NO: 1592585 - RNA, 21 nt, Human
cucuggccuucggccuccauc

SEQ ID NO: 1592586 - RNA, 19 nt, Human
cucuuaagaagacugcauu

SEQ ID NO: 1592587 - RNA, 12 nt, Human
cucccuuucaac

SEQ ID NO: 1592588 - RNA, 20 nt, Human
cuccccuccucugcuugcca

SEQ ID NO: 1592589 - RNA, 13 nt, Human
cuccauccugagg

SEQ ID NO: 1592590 - RNA, 14 nt, Human
cuccauccugaggc

SEQ ID NO: 1592591 - RNA, 11 nt, Human
cuccccuccuc

SEQ ID NO: 1592592 - RNA, 13 nt, Human
cuccccuccucug

SEQ ID NO: 1592593 - RNA, 12 nt, Human
cuccauccugag

SEQ ID NO: 1592594 - RNA, 13 nt, Human
cuccaaagaaaug

SEQ ID NO: 1592595 - RNA, 12 nt, Human
cuccaaagaaau

SEQ ID NO: 1592596 - RNA, 21 nt, Human
cuccaaacugacucuuaagaa

SEQ ID NO: 1592597 - RNA, 21 nt, Human
cuagugagcagucaggaaaga

SEQ ID NO: 1592598 - RNA, 19 nt, Human
cuagugaaagaggcagcuu

SEQ ID NO: 1592599 - RNA, 18 nt, Human
cuagugaaagaggcagcu

SEQ ID NO: 1592600 - RNA, 20 nt, Human
cuagugaaacucguuaauuu

SEQ ID NO: 1592601 - RNA, 16 nt, Human
cuaguaauuggaaagg

SEQ ID NO: 1592602 - RNA, 22 nt, Human
cuauaggugcuacaaaaacaca

SEQ ID NO: 1592603 - RNA, 21 nt, Human
cuauaggugcuacaaaaacac

SEQ ID NO: 1592604 - RNA, 20 nt, Human
cuauaggugcuacaaaaaca

SEQ ID NO: 1592605 - RNA, 18 nt, Human
cuauauuguuugcuaagc

SEQ ID NO: 1592606 - RNA, 18 nt, Human
cuauucaaacagucucag

SEQ ID NO: 1592607 - RNA, 23 nt, Human
cuauucaaacagucucaggaaau

SEQ ID NO: 1592608 - RNA, 13 nt, Human
gagcaaagcugau

SEQ ID NO: 1592609 - RNA, 21 nt, Human
gagcaggcuacugucagcucc

SEQ ID NO: 1592610 - RNA, 12 nt, Human
gagcuacaaaug

SEQ ID NO: 1592611 - RNA, 13 nt, Human
gagcuacaaaugc

SEQ ID NO: 1592612 - RNA, 14 nt, Human
gagcugcccucucc

SEQ ID NO: 1592613 - RNA, 15 nt, Human
gagcugcccucuccu

SEQ ID NO: 1592614 - RNA, 16 nt, Human
gagcugcccucuccug

SEQ ID NO: 1592615 - RNA, 17 nt, Human
gagcugcccucuccugg

SEQ ID NO: 1592616 - RNA, 14 nt, Human
gagcuacaaaugca

SEQ ID NO: 1592617 - RNA, 23 nt, Human
gaucuucaucugacuaugacaua

SEQ ID NO: 1592618 - RNA, 14 nt, Human
gaucuuuaaaauac

SEQ ID NO: 1592619 - RNA, 16 nt, Human
gaucuucaucugacua

SEQ ID NO: 1592620 - RNA, 16 nt, Human
gaugggaaagcauugu

SEQ ID NO: 1592621 - RNA, 18 nt, Human
gaugcaguucugaagaag

SEQ ID NO: 1592622 - RNA, 13 nt, Human
gauugugccccug

SEQ ID NO: 1592623 - RNA, 19 nt, Human
gauguugaaaaaguucugc

SEQ ID NO: 1592624 - RNA, 21 nt, Human
gauaaucagugugucuaaauu

SEQ ID NO: 1592625 - RNA, 19 nt, Human
gagugaacaaauuuacaga

SEQ ID NO: 1592626 - RNA, 23 nt, Human
gagugaacaaauuuacagagaca

SEQ ID NO: 1592627 - RNA, 22 nt, Human
gagugaacaaauuuacagagac

SEQ ID NO: 1592628 - RNA, 21 nt, Human
gaguugaaaaucuuauaauuu

SEQ ID NO: 1592629 - RNA, 18 nt, Human
gaguauuuuugacagaau

SEQ ID NO: 1592630 - RNA, 14 nt, Human
gaguauuuuugaca

SEQ ID NO: 1592631 - RNA, 16 nt, Human
gaguauuuuugacaga

SEQ ID NO: 1592632 - RNA, 17 nt, Human
gaguauuuuugacagaa

SEQ ID NO: 1592633 - RNA, 22 nt, Human
gcaguugaaaagacuccaaaga

SEQ ID NO: 1592634 - RNA, 21 nt, Human
gcaguugaaaagacuccaaag

SEQ ID NO: 1592635 - RNA, 19 nt, Human
gcaguugaaaagacuccaa

SEQ ID NO: 1592636 - RNA, 16 nt, Human
gcaguugaaaagacuc

SEQ ID NO: 1592637 - RNA, 20 nt, Human
gcaguucagagcugcccucu

SEQ ID NO: 1592638 - RNA, 22 nt, Human
gcaguucagagcugcccucucc

SEQ ID NO: 1592639 - RNA, 23 nt, Human
gcaguucagagcugcccucuccu

SEQ ID NO: 1592640 - RNA, 22 nt, Human
gcaucagcugcugaaacaacaa

SEQ ID NO: 1592641 - RNA, 23 nt, Human
gcaucagcugcugaaacaacaaa

SEQ ID NO: 1592642 - RNA, 18 nt, Human
gcacagccucuuagaugc

SEQ ID NO: 1592643 - RNA, 15 nt, Human
gcacagccucuuaga

SEQ ID NO: 1592644 - RNA, 18 nt, Human
gcagagguugcagugagc

SEQ ID NO: 1592645 - RNA, 23 nt, Human
gcagagguugcagugagccgaga

SEQ ID NO: 1592646 - RNA, 19 nt, Human
gccagauuuuccugaaaac

SEQ ID NO: 1592647 - RNA, 23 nt, Human
gccaugggacagggaggacgcuc

SEQ ID NO: 1592648 - RNA, 19 nt, Human
gccaugggcacugugggua

SEQ ID NO: 1592649 - RNA, 18 nt, Human
gccagacuggcacaguuu

SEQ ID NO: 1592650 - RNA, 15 nt, Human
gccagacuggcacag

SEQ ID NO: 1592651 - RNA, 19 nt, Human
gccagacuggcacaguuuu

SEQ ID NO: 1592652 - RNA, 18 nt, Human
gcuguguuaaauaaaccu

SEQ ID NO: 1592653 - RNA, 23 nt, Human
gcuggucccagccagcaguucag

SEQ ID NO: 1592654 - RNA, 12 nt, Human
gcuuguguuaag

SEQ ID NO: 1592655 - RNA, 19 nt, Human
gcuucuguuuuauaauuuu

SEQ ID NO: 1592656 - RNA, 23 nt, Human
gcugcccucuccugggcagcugc

SEQ ID NO: 1592657 - RNA, 13 nt, Human
gcugcccucuccu

SEQ ID NO: 1592658 - RNA, 14 nt, Human
gcugcccucuccug

SEQ ID NO: 1592659 - RNA, 15 nt, Human
gcugcccucuccugg

SEQ ID NO: 1592660 - RNA, 16 nt, Human
gcugcccucuccuggg

SEQ ID NO: 1592661 - RNA, 17 nt, Human
gcugcccucuccugggc

SEQ ID NO: 1592662 - RNA, 18 nt, Human
gcugcccucuccugggca

SEQ ID NO: 1592663 - RNA, 20 nt, Human
gcugcccucuccugggcagc

SEQ ID NO: 1592664 - RNA, 22 nt, Human
gcugcccucuccugggcagcug

SEQ ID NO: 1592665 - RNA, 23 nt, Human
gcuggaaaaguauguuagugcaa

SEQ ID NO: 1592666 - RNA, 21 nt, Human
gcuggaaaaguauguuagugc

SEQ ID NO: 1592667 - RNA, 12 nt, Human
gcugcccucucc

SEQ ID NO: 1592668 - RNA, 21 nt, Human
gcugauuaaaccaaggcuaga

SEQ ID NO: 1592669 - RNA, 20 nt, Human
gccugagcgacagugagacu

SEQ ID NO: 1592670 - RNA, 17 nt, Human
gccugagcgacagugag

SEQ ID NO: 1592671 - RNA, 13 nt, Human
gcuagauguaugu

SEQ ID NO: 1592672 - RNA, 16 nt, Human
gcuagauguauguacu

SEQ ID NO: 1592673 - RNA, 14 nt, Human
gcuagauguaugua

SEQ ID NO: 1592674 - RNA, 21 nt, Human
gcuauaggugcuacaaaaaca

SEQ ID NO: 1592675 - RNA, 21 nt, Human
gggacugaggggaggggagca

SEQ ID NO: 1592676 - RNA, 14 nt, Human
gggaauugaggaca

SEQ ID NO: 1592677 - RNA, 11 nt, Human
gggaggcagag

SEQ ID NO: 1592678 - RNA, 20 nt, Human
gggaggacgcucucuggccu

SEQ ID NO: 1592679 - RNA, 17 nt, Human
gggaggacgcucucugg

SEQ ID NO: 1592680 - RNA, 23 nt, Human
ggcuauaggugcuacaaaaacac

SEQ ID NO: 1592681 - RNA, 20 nt, Human
ggcuaguaucaaaagaaaga

SEQ ID NO: 1592682 - RNA, 16 nt, Human
ggcuccacuuggucug

SEQ ID NO: 1592683 - RNA, 11 nt, Human
ggcagcugccu

SEQ ID NO: 1592684 - RNA, 12 nt, Human
ggcagcugccuc

SEQ ID NO: 1592685 - RNA, 13 nt, Human
ggcagcugccucc

SEQ ID NO: 1592686 - RNA, 16 nt, Human
ggcagcugccuccccu

SEQ ID NO: 1592687 - RNA, 21 nt, Human
ggcagagguugcagugagccg

SEQ ID NO: 1592688 - RNA, 20 nt, Human
ggacauuugcucauggaauu

SEQ ID NO: 1592689 - RNA, 17 nt, Human
ggacauuugcucaugga

SEQ ID NO: 1592690 - RNA, 19 nt, Human
ggacgcucucuggccuucg

SEQ ID NO: 1592691 - RNA, 16 nt, Human
ggacgcucucuggccu

SEQ ID NO: 1592692 - RNA, 23 nt, Human
ggagaagagcuguucacagccag

SEQ ID NO: 1592693 - RNA, 15 nt, Human
ggagaagagcuguuc

SEQ ID NO: 1592694 - RNA, 14 nt, Human
ggagaagaacugaa

SEQ ID NO: 1592695 - RNA, 11 nt, Human
ggagaagaacu

SEQ ID NO: 1592696 - RNA, 19 nt, Human
ggaggggagcaugggaagu

SEQ ID NO: 1592697 - RNA, 16 nt, Human
ggaggacgcucucugg

SEQ ID NO: 1592698 - RNA, 17 nt, Human
ucaucugacuaugacau

SEQ ID NO: 1592699 - RNA, 18 nt, Human
ucaucugacuaugacaua

SEQ ID NO: 1592700 - RNA, 18 nt, Human
ucauaccuaucaucuuaa

SEQ ID NO: 1592701 - RNA, 16 nt, Human
ucauuuccaagcaagu

SEQ ID NO: 1592702 - RNA, 13 nt, Human
ucauuuccaagca

SEQ ID NO: 1592703 - RNA, 13 nt, Human
ucauuaucucaaa

SEQ ID NO: 1592704 - RNA, 20 nt, Human
ucauuaucucaaaacugcac

SEQ ID NO: 1592705 - RNA, 19 nt, Human
ucauuaucucaaaacugca

SEQ ID NO: 1592706 - RNA, 19 nt, Human
uccaaaauaauuuuaagaa

SEQ ID NO: 1592707 - RNA, 15 nt, Human
uccaaaauaauuuua

SEQ ID NO: 1592708 - RNA, 15 nt, Human
uccaccucccugcaa

SEQ ID NO: 1592709 - RNA, 16 nt, Human
uccaccucccugcaau

SEQ ID NO: 1592710 - RNA, 17 nt, Human
uccaccucccugcaaua

SEQ ID NO: 1592711 - RNA, 23 nt, Human
uccaccucccugcaauaaaaugg

SEQ ID NO: 1592712 - RNA, 13 nt, Human
uccaccucccugc

SEQ ID NO: 1592713 - RNA, 14 nt, Human
uccaccucccugca

SEQ ID NO: 1592714 - RNA, 19 nt, Human
uccacagaagcuccaggua

SEQ ID NO: 1592715 - RNA, 16 nt, Human
uccacuuggucuguga

SEQ ID NO: 1592716 - RNA, 15 nt, Human
uccacuuggucugug

SEQ ID NO: 1592717 - RNA, 17 nt, Human
uccacuuggucugugag

SEQ ID NO: 1592718 - RNA, 17 nt, Human
ucaggcuagauguaugu

SEQ ID NO: 1592719 - RNA, 13 nt, Human
ucaggcuagaugu

SEQ ID NO: 1592720 - RNA, 21 nt, Human
ucagcuccccucggagaagag

SEQ ID NO: 1592721 - RNA, 18 nt, Human
ucagcuccccucggagaa

SEQ ID NO: 1592722 - RNA, 17 nt, Human
ucagcuccccucggaga

SEQ ID NO: 1592723 - RNA, 22 nt, Human
ucagagcugcccucuccugggc

SEQ ID NO: 1592724 - RNA, 23 nt, Human
ucagagcugcccucuccugggca

SEQ ID NO: 1592725 - RNA, 19 nt, Human
ucagagcugcccucuccug

SEQ ID NO: 1592726 - RNA, 20 nt, Human
ucagagcugcccucuccugg

SEQ ID NO: 1592727 - RNA, 21 nt, Human
ucagagcugcccucuccuggg

SEQ ID NO: 1592728 - RNA, 13 nt, Human
uauguuucaaacu

SEQ ID NO: 1592729 - RNA, 15 nt, Human
uauguuucaaacuuu

SEQ ID NO: 1592730 - RNA, 16 nt, Human
uauguuucaaacuuug

SEQ ID NO: 1592731 - RNA, 12 nt, Human
uauuaauauauu

SEQ ID NO: 1592732 - RNA, 17 nt, Human
uauguacuucaugcugu

SEQ ID NO: 1592733 - RNA, 13 nt, Human
uauguacuucaug

SEQ ID NO: 1592734 - RNA, 20 nt, Human
uauucuaaauuuuauaucuu

SEQ ID NO: 1592735 - RNA, 15 nt, Human
uauucuaaauuuuau

SEQ ID NO: 1592736 - RNA, 19 nt, Human
uauucuaaauuuuauaucu

SEQ ID NO: 1592737 - RNA, 19 nt, Human
uauucuagcuaauguaaua

SEQ ID NO: 1592738 - RNA, 14 nt, Human
uauucuaaauuuua

SEQ ID NO: 1592739 - RNA, 16 nt, Human
uauuauucccauucua

SEQ ID NO: 1592740 - RNA, 16 nt, Human
ucacagucacauucca

SEQ ID NO: 1592741 - RNA, 18 nt, Human
ucacaagacccaaaaggc

SEQ ID NO: 1592742 - RNA, 17 nt, Human
ucacaagacccaaaagg

SEQ ID NO: 1592743 - RNA, 13 nt, Human
ucacaagacccaa

SEQ ID NO: 1592744 - RNA, 14 nt, Human
ucaccaaggcugau

SEQ ID NO: 1592745 - RNA, 21 nt, Human
ucaauaaaauccauacauuug

SEQ ID NO: 1592746 - RNA, 15 nt, Human
ucaaauugugugaaa

SEQ ID NO: 1592747 - RNA, 14 nt, Human
ucaaauugugugaa

SEQ ID NO: 1592748 - RNA, 15 nt, Human
ucaaauccuugaaga

SEQ ID NO: 1592749 - RNA, 20 nt, Human
ucaaaucaagaaacuuaagg

SEQ ID NO: 1592750 - RNA, 14 nt, Human
ucaaauaugcaaag

SEQ ID NO: 1592751 - RNA, 16 nt, Human
ucaaauaugcaaagca

SEQ ID NO: 1592752 - RNA, 19 nt, Human
ucuucaucugacuaugaca

SEQ ID NO: 1592753 - RNA, 22 nt, Human
ucuuaggguuaugauuaaguaa

SEQ ID NO: 1592754 - RNA, 15 nt, Human
ucugucuucacaaca

SEQ ID NO: 1592755 - RNA, 18 nt, Human
ucuuaagaagacugcauu

SEQ ID NO: 1592756 - RNA, 12 nt, Human
ucuuaagaagac

SEQ ID NO: 1592757 - RNA, 23 nt, Human
ucuggccuucggccuccauccug

SEQ ID NO: 1592758 - RNA, 18 nt, Human
ucuggccuucggccucca

SEQ ID NO: 1592759 - RNA, 17 nt, Human
ucuggccuucggccucc

SEQ ID NO: 1592760 - RNA, 21 nt, Human
ucugcaucagcugcugaaaca

SEQ ID NO: 1592761 - RNA, 19 nt, Human
ucugcaucagcugcugaaa

SEQ ID NO: 1592762 - RNA, 14 nt, Human
ucugcaucagcugc

SEQ ID NO: 1592763 - RNA, 22 nt, Human
ucgugggacagucaccucaugg

SEQ ID NO: 1592764 - RNA, 21 nt, Human
ucguggaacaguuaccucugc

SEQ ID NO: 1592765 - RNA, 18 nt, Human
ucggccuccauccugagg

SEQ ID NO: 1592766 - RNA, 13 nt, Human
ucguuaauuugua

SEQ ID NO: 1592767 - RNA, 18 nt, Human
ucuaugaaauauuauguu

SEQ ID NO: 1592768 - RNA, 17 nt, Human
ucuaugaaauauuaugu

SEQ ID NO: 1592769 - RNA, 14 nt, Human
ucuaugaaauauua

SEQ ID NO: 1592770 - RNA, 13 nt, Human
ucuaugaaauauu

SEQ ID NO: 1592771 - RNA, 19 nt, Human
ucuagugagcagucaggaa

SEQ ID NO: 1592772 - RNA, 22 nt, Human
ucuagugagcagucaggaaaga

SEQ ID NO: 1592773 - RNA, 20 nt, Human
uccugccuaagugcagcccc

SEQ ID NO: 1592774 - RNA, 16 nt, Human
uccuuggacucauuuu

SEQ ID NO: 1592775 - RNA, 20 nt, Human
uccucugcuugccaucccuc

SEQ ID NO: 1592776 - RNA, 21 nt, Human
uccucugcuugccaucccucc

SEQ ID NO: 1592777 - RNA, 22 nt, Human
uccucugcuugccaucccuccc

SEQ ID NO: 1592778 - RNA, 16 nt, Human
ucccuugaugaagaag

SEQ ID NO: 1592779 - RNA, 15 nt, Human
ucccuugaugaagaa

SEQ ID NO: 1592780 - RNA, 14 nt, Human
uguaauaacuguga

SEQ ID NO: 1592781 - RNA, 22 nt, Human
uguaauaacugugaaguuuaca

SEQ ID NO: 1592782 - RNA, 20 nt, Human
uguaaaaugugaagugaaug

SEQ ID NO: 1592783 - RNA, 12 nt, Human
uguaaaauggug

SEQ ID NO: 1592784 - RNA, 11 nt, Human
uguaaaauggu

SEQ ID NO: 1592785 - RNA, 14 nt, Human
uggguagacacaca

SEQ ID NO: 1592786 - RNA, 20 nt, Human
ugguucccuugaugaagaag

SEQ ID NO: 1592787 - RNA, 17 nt, Human
ugguucccuugaugaag

SEQ ID NO: 1592788 - RNA, 16 nt, Human
ugguucccuugaugaa

SEQ ID NO: 1592789 - RNA, 14 nt, Human
uguagcuuuaucaa

SEQ ID NO: 1592790 - RNA, 15 nt, Human
uguagcuuuaucaaa

SEQ ID NO: 1592791 - RNA, 13 nt, Human
uguauaaaauaau

SEQ ID NO: 1592792 - RNA, 14 nt, Human
uguauaaaauaauu

SEQ ID NO: 1592793 - RNA, 21 nt, Human
uguaguguuggagaagaacug

SEQ ID NO: 1592794 - RNA, 20 nt, Human
uguaguguuggagaagaacu

SEQ ID NO: 1592795 - RNA, 19 nt, Human
uguauuuuaaaagaaugau

SEQ ID NO: 1592796 - RNA, 18 nt, Human
uguauuuuaaaagaauga

SEQ ID NO: 1592797 - RNA, 12 nt, Human
ugucuuaauuaa

SEQ ID NO: 1592798 - RNA, 22 nt, Human
ugucuacacuaagagagaauga

SEQ ID NO: 1592799 - RNA, 17 nt, Human
ugucuacacuaagagag

SEQ ID NO: 1592800 - RNA, 12 nt, Human
ugcuuguguuaa

SEQ ID NO: 1592801 - RNA, 22 nt, Human
ugcuucuguuuuauaauuuugu

SEQ ID NO: 1592802 - RNA, 15 nt, Human
ugcuuguguuaagua

SEQ ID NO: 1592803 - RNA, 22 nt, Human
uggaaaaguauguuagugcaaa

SEQ ID NO: 1592804 - RNA, 17 nt, Human
ugcuucuguuuuauaau

SEQ ID NO: 1592805 - RNA, 17 nt, Human
uggagacacaacuauuu

SEQ ID NO: 1592806 - RNA, 22 nt, Human
uggccuucggccuccauccuga

SEQ ID NO: 1592807 - RNA, 23 nt, Human
uggccuucggccuccauccugag

SEQ ID NO: 1592808 - RNA, 14 nt, Human
ugggacagggagga

SEQ ID NO: 1592809 - RNA, 12 nt, Human
ugggcagcugcc

SEQ ID NO: 1592810 - RNA, 20 nt, Human
ugggcagcugccuccccucc

SEQ ID NO: 1592811 - RNA, 22 nt, Human
ugggcagcugccuccccuccuc

SEQ ID NO: 1592812 - RNA, 23 nt, Human
ugggcagcugccuccccuccucu

SEQ ID NO: 1592813 - RNA, 13 nt, Human
ugauguauucuag

SEQ ID NO: 1592814 - RNA, 14 nt, Human
ugauguauucuagc

SEQ ID NO: 1592815 - RNA, 20 nt, Human
ugauguauucuagcuaaugu

SEQ ID NO: 1592816 - RNA, 21 nt, Human
ugauguauucuagcuaaugua

SEQ ID NO: 1592817 - RNA, 24 nt, Human
ugauaguuguaccgcaaugugacu

SEQ ID NO: 1592818 - RNA, 12 nt, Human
ugacucuuaaga

SEQ ID NO: 1592819 - RNA, 13 nt, Human
ugacucuuaagaa

SEQ ID NO: 1592820 - RNA, 16 nt, Human
ugagacagcucugcau

SEQ ID NO: 1592821 - RNA, 14 nt, Human
ugagacagcucugc

SEQ ID NO: 1592822 - RNA, 17 nt, Human
ugagaaagacuauucaa

SEQ ID NO: 1592823 - RNA, 16 nt, Human
ugagaaagacuauuca

SEQ ID NO: 1592824 - RNA, 18 nt, Human
ugagaaagacuauucaaa

SEQ ID NO: 1592825 - RNA, 20 nt, Human
ugagaaagacuauucaaaca

SEQ ID NO: 1592826 - RNA, 13 nt, Human
ugagccccaaaag

SEQ ID NO: 1592827 - RNA, 20 nt, Human
ugagaugcuagaacucccuu

SEQ ID NO: 1592828 - RNA, 16 nt, Human
ugagaugcuagaacuc

SEQ ID NO: 1592829 - RNA, 14 nt, Human
ugagaugcuagaac

SEQ ID NO: 1592830 - RNA, 20 nt, Human
ugagcagucaggaaagagaa

SEQ ID NO: 1592831 - RNA, 15 nt, Human
ugagcagucaggaaa

SEQ ID NO: 1592832 - RNA, 17 nt, Human
ugagcagucaggaaaga

SEQ ID NO: 1592833 - RNA, 14 nt, Human
ugcaauuucauaug

SEQ ID NO: 1592834 - RNA, 20 nt, Human
ugcaauuucauaugcuguau

SEQ ID NO: 1592835 - RNA, 14 nt, Human
ugcauuauauuuau

SEQ ID NO: 1592836 - RNA, 19 nt, Human
ugcagauaaacaguaguga

SEQ ID NO: 1592837 - RNA, 23 nt, Human
uuuucagaaaauauuauguguuu

SEQ ID NO: 1592838 - RNA, 13 nt, Human
uuuucuuauuuca

SEQ ID NO: 1592839 - RNA, 21 nt, Human
uuuuauaauuuugugaagcaa

SEQ ID NO: 1592840 - RNA, 23 nt, Human
uuuuauaauuuugugaagcaaaa

SEQ ID NO: 1592841 - RNA, 21 nt, Human
uuuuaaaguaacccuacaaaa

SEQ ID NO: 1592842 - RNA, 18 nt, Human
uuuuauauuugaaauauu

SEQ ID NO: 1592843 - RNA, 13 nt, Human
uuuuauauuugaa

SEQ ID NO: 1592844 - RNA, 12 nt, Human
uuugaguucuac

SEQ ID NO: 1592845 - RNA, 15 nt, Human
uuuccacagaagcuc

SEQ ID NO: 1592846 - RNA, 17 nt, Human
uuuguauaaaauaauuu

SEQ ID NO: 1592847 - RNA, 19 nt, Human
uuuguauaaaauaauuuuu

SEQ ID NO: 1592848 - RNA, 18 nt, Human
uuuguauaaaauaauuuu

SEQ ID NO: 1592849 - RNA, 23 nt, Human
uuuugacagaauauguuucaaac

SEQ ID NO: 1592850 - RNA, 22 nt, Human
uuuugacagaauauguuucaaa

SEQ ID NO: 1592851 - RNA, 13 nt, Human
uuguguugugaau

SEQ ID NO: 1592852 - RNA, 12 nt, Human
uugugccccugc

SEQ ID NO: 1592853 - RNA, 17 nt, Human
uuguuuaaaaucauuuc

SEQ ID NO: 1592854 - RNA, 14 nt, Human
uuguuuaaaaucau

SEQ ID NO: 1592855 - RNA, 18 nt, Human
uuguguuuugcaagccag

SEQ ID NO: 1592856 - RNA, 21 nt, Human
uuguacgaagaguauuuuuga

SEQ ID NO: 1592857 - RNA, 23 nt, Human
uuguacgaagaguauuuuugaca

SEQ ID NO: 1592858 - RNA, 14 nt, Human
uuguauuacaaauc

SEQ ID NO: 1592859 - RNA, 15 nt, Human
uugucuagugaaacu

SEQ ID NO: 1592860 - RNA, 17 nt, Human
uuguaaauaguauuuga

SEQ ID NO: 1592861 - RNA, 16 nt, Human
uuggucugugagaugc

SEQ ID NO: 1592862 - RNA, 13 nt, Human
uuuaauaauguuu

SEQ ID NO: 1592863 - RNA, 19 nt, Human
uuuaacucuauaauguguu

SEQ ID NO: 1592864 - RNA, 14 nt, Human
uuuaauaauguuuc

SEQ ID NO: 1592865 - RNA, 13 nt, Human
uuuaccacuugug

SEQ ID NO: 1592866 - RNA, 22 nt, Human
uuuauaauuuugugaagcaaaa

SEQ ID NO: 1592867 - RNA, 22 nt, Human
uucuacauaaguaauucaagaa

SEQ ID NO: 1592868 - RNA, 15 nt, Human
uucuacauacuaugg

SEQ ID NO: 1592869 - RNA, 17 nt, Human
uuccuuggacucauuuu

SEQ ID NO: 1592870 - RNA, 18 nt, Human
uucggugagcuacaaaug

SEQ ID NO: 1592871 - RNA, 21 nt, Human
uucugagaaagacuauucaaa

SEQ ID NO: 1592872 - RNA, 16 nt, Human
uucugagaaagacuau

SEQ ID NO: 1592873 - RNA, 21 nt, Human
uucuaugaaauauuauguuaa

SEQ ID NO: 1592874 - RNA, 14 nt, Human
uucuaugaaauauu

SEQ ID NO: 1592875 - RNA, 17 nt, Human
uucuuccaaaaagauuu

SEQ ID NO: 1592876 - RNA, 16 nt, Human
uugaaaagacuccaaa

SEQ ID NO: 1592877 - RNA, 18 nt, Human
uucugcuuguguuaagua

SEQ ID NO: 1592878 - RNA, 17 nt, Human
uucugucuucacaacag

SEQ ID NO: 1592879 - RNA, 23 nt, Human
uugaugaagaaguugauaugccu

SEQ ID NO: 1592880 - RNA, 14 nt, Human
uugaugaagaaguu

SEQ ID NO: 1592881 - RNA, 17 nt, Human
uugacccacaagaaaug

SEQ ID NO: 1592882 - RNA, 16 nt, Human
uucaauaauaaauauu

SEQ ID NO: 1592883 - RNA, 14 nt, Human
uuauuuuguucaua

SEQ ID NO: 1592884 - RNA, 16 nt, Human
uuauuuuguucauaca

SEQ ID NO: 1592885 - RNA, 20 nt, Human
uuauuuuaauaauguuucaa

SEQ ID NO: 1592886 - RNA, 19 nt, Human
uuauuuuaauaauguuuca

SEQ ID NO: 1592887 - RNA, 15 nt, Human
uucagagcugcccuc

SEQ ID NO: 1592888 - RNA, 17 nt, Human
uucagagcugcccucuc

SEQ ID NO: 1592889 - RNA, 18 nt, Human
uucagagcugcccucucc

SEQ ID NO: 1592890 - RNA, 19 nt, Human
uucagagcugcccucuccu

SEQ ID NO: 1592891 - RNA, 20 nt, Human
uucagagcugcccucuccug

SEQ ID NO: 1592892 - RNA, 21 nt, Human
uucagagcugcccucuccugg

SEQ ID NO: 1592893 - RNA, 22 nt, Human
uucacaagacccaaaaggcaga

SEQ ID NO: 1592894 - RNA, 21 nt, Human
uuccaaaaagauuuucagaaa

SEQ ID NO: 1592895 - RNA, 19 nt, Human
uuccagauccuggaaauca

SEQ ID NO: 1592896 - RNA, 18 nt, Human
uuccagauccuggaaauc

SEQ ID NO: 1592897 - RNA, 23 nt, Human
uucaguuauuauauuuacaaaug

SEQ ID NO: 1592898 - RNA, 14 nt, Human
uuauacaggucaua

SEQ ID NO: 1592899 - RNA, 18 nt, Human
uuauaauuuugugaagca

SEQ ID NO: 1592900 - RNA, 17 nt, Human
uuauaauuuugugaagc

SEQ ID NO: 1592901 - RNA, 16 nt, Human
uuauaauuuugugaag

SEQ ID NO: 1592902 - RNA, 22 nt, Human
uuauacaggucauauuaauaua

SEQ ID NO: 1592903 - RNA, 22 nt, Human
uuauaucuuguagcuuuaucaa

SEQ ID NO: 1592904 - RNA, 15 nt, Human
uuauaucuuguagcu

SEQ ID NO: 1592905 - RNA, 11 nt, Human
uuauaaucuuu

SEQ ID NO: 1592906 - RNA, 15 nt, Human
uuauaauuuugugaa

SEQ ID NO: 1592907 - RNA, 14 nt, Human
uuauaauuuuguga

SEQ ID NO: 1592908 - RNA, 12 nt, Human
uuauaauuuaaa

SEQ ID NO: 1592909 - RNA, 18 nt, Human
uuauggcuauaggugcua

SEQ ID NO: 1592910 - RNA, 11 nt, Human
uuaucucaaaa

SEQ ID NO: 1592911 - RNA, 15 nt, Human
uuauauuugaaauau

SEQ ID NO: 1592912 - RNA, 13 nt, Human
uuauauuugaaau

SEQ ID NO: 1592913 - RNA, 12 nt, Human
uuauauuugaaa

SEQ ID NO: 1592914 - RNA, 20 nt, Human
uuauauuuauuacuguaaga

SEQ ID NO: 1592915 - RNA, 16 nt, Human
uuauauuuacaaaugg

SEQ ID NO: 1592916 - RNA, 16 nt, Human
caaagagagaaaauaa

SEQ ID NO: 1592917 - RNA, 19 nt, Human
caaagagagaaaauaaaga

SEQ ID NO: 1592918 - RNA, 16 nt, Human
caaauaaaaauauugu

SEQ ID NO: 1592919 - RNA, 18 nt, Human
caaauaaaaauauugugu

SEQ ID NO: 1592920 - RNA, 14 nt, Human
caaauguucaucaa

SEQ ID NO: 1592921 - RNA, 18 nt, Human
caaauguucaucaaugaa

SEQ ID NO: 1592922 - RNA, 20 nt, Human
caaauguucaucaaugaaug

SEQ ID NO: 1592923 - RNA, 12 nt, Human
caaauaugcaaa

SEQ ID NO: 1592924 - RNA, 13 nt, Human
caaauaugcaaag

SEQ ID NO: 1592925 - RNA, 14 nt, Human
caaauaugcaaagc

SEQ ID NO: 1592926 - RNA, 19 nt, Human
caagaaaugaaagcaggga

SEQ ID NO: 1592927 - RNA, 17 nt, Human
caagaaaugaaagcagg

SEQ ID NO: 1592928 - RNA, 18 nt, Human
caaaauaauuuuaagaaa

SEQ ID NO: 1592929 - RNA, 22 nt, Human
caaaauaauuuuaagaaaucaa

SEQ ID NO: 1592930 - RNA, 18 nt, Human
caaaacugcacugucaag

SEQ ID NO: 1592931 - RNA, 17 nt, Human
caaaacugcacugucaa

SEQ ID NO: 1592932 - RNA, 14 nt, Human
caaaacugcacugu

SEQ ID NO: 1592933 - RNA, 16 nt, Human
caaacugacucuuaag

SEQ ID NO: 1592934 - RNA, 21 nt, Human
caaacugacucuuaagaagac

SEQ ID NO: 1592935 - RNA, 17 nt, Human
caaacugacucuuaaga

SEQ ID NO: 1592936 - RNA, 19 nt, Human
caauaauaaauauuuuugc

SEQ ID NO: 1592937 - RNA, 19 nt, Human
caauagucaaauuguguga

SEQ ID NO: 1592938 - RNA, 17 nt, Human
caauagucaaauugugu

SEQ ID NO: 1592939 - RNA, 21 nt, Human
caagggugaugggaaagcauu

SEQ ID NO: 1592940 - RNA, 23 nt, Human
caagggugaugggaaagcauugu

SEQ ID NO: 1592941 - RNA, 18 nt, Human
caaggaaaaaauaacaau

SEQ ID NO: 1592942 - RNA, 20 nt, Human
caaggaaaaaauaacaauga

SEQ ID NO: 1592943 - RNA, 14 nt, Human
cacacugaagaagc

SEQ ID NO: 1592944 - RNA, 13 nt, Human
cacacugaagaag

SEQ ID NO: 1592945 - RNA, 19 nt, Human
cacagcaguugaaaagacu

SEQ ID NO: 1592946 - RNA, 22 nt, Human
cacagcaguugaaaagacucca

SEQ ID NO: 1592947 - RNA, 21 nt, Human
cacagcaguugaaaagacucc

SEQ ID NO: 1592948 - RNA, 18 nt, Human
cacagccagacuggcaca

SEQ ID NO: 1592949 - RNA, 17 nt, Human
cacagccagacuggcac

SEQ ID NO: 1592950 - RNA, 22 nt, Human
caauuuuucuuauuucauuucu

SEQ ID NO: 1592951 - RNA, 21 nt, Human
caauaucuuuuuuuuaauaaa

SEQ ID NO: 1592952 - RNA, 22 nt, Human
caaugugacuuaaugccacuaa

SEQ ID NO: 1592953 - RNA, 18 nt, Human
cacaagaaaugaaagcag

SEQ ID NO: 1592954 - RNA, 21 nt, Human
cacaagaaaugaaagcaggga

SEQ ID NO: 1592955 - RNA, 20 nt, Human
cacaagaaaugaaagcaggg

SEQ ID NO: 1592956 - RNA, 18 nt, Human
aacuucccagugaauucu

SEQ ID NO: 1592957 - RNA, 18 nt, Human
aacuuccagauccuggaa

SEQ ID NO: 1592958 - RNA, 17 nt, Human
gugaugggaaagcauug

SEQ ID NO: 1592959 - RNA, 13 nt, Human
aacugaaaucaua

SEQ ID NO: 1592960 - RNA, 12 nt, Human
aacugaaaucau

SEQ ID NO: 1592961 - RNA, 21 nt, Human
gugagaugcuagaacucccuu

SEQ ID NO: 1592962 - RNA, 19 nt, Human
aacugcacugucaagauga

SEQ ID NO: 1592963 - RNA, 19 nt, Human
aacuggacugguucaaaug

SEQ ID NO: 1592964 - RNA, 17 nt, Human
aacugggacaggggaga

SEQ ID NO: 1592965 - RNA, 18 nt, Human
aaccugagccccaaaagg

SEQ ID NO: 1592966 - RNA, 16 nt, Human
aacccgggaggcagag

SEQ ID NO: 1592967 - RNA, 23 nt, Human
aacccaaauguucaucaaugaau

SEQ ID NO: 1592968 - RNA, 18 nt, Human
aacccaaguccaagcaua

SEQ ID NO: 1592969 - RNA, 18 nt, Human
aaccuugaaaacuuuaug

SEQ ID NO: 1592970 - RNA, 21 nt, Human
aacuagaguuuagcuggaaaa

SEQ ID NO: 1592971 - RNA, 16 nt, Human
gucuuucacauuuaaa

SEQ ID NO: 1592972 - RNA, 20 nt, Human
aaccugagccccaaaaggua

SEQ ID NO: 1592973 - RNA, 19 nt, Human
aacaagaugguucuagcau

SEQ ID NO: 1592974 - RNA, 20 nt, Human
aaauuuuuucucuaggaaau

SEQ ID NO: 1592975 - RNA, 15 nt, Human
aacaaugcuguauuu

SEQ ID NO: 1592976 - RNA, 14 nt, Human
aacaaugcuguauu

SEQ ID NO: 1592977 - RNA, 12 nt, Human
aacaauaaaaga

SEQ ID NO: 1592978 - RNA, 16 nt, Human
aacacaacuauauugu

SEQ ID NO: 1592979 - RNA, 15 nt, Human
aacacaacuauauug

SEQ ID NO: 1592980 - RNA, 22 nt, Human
aacaaugcuguauuuuaaaaga

SEQ ID NO: 1592981 - RNA, 17 nt, Human
aacaaugcuguauuuua

SEQ ID NO: 1592982 - RNA, 13 nt, Human
aacagauaaucag

SEQ ID NO: 1592983 - RNA, 22 nt, Human
aacagugauuaccagggacuga

SEQ ID NO: 1592984 - RNA, 15 nt, Human
aacagugauuaccag

SEQ ID NO: 1592985 - RNA, 18 nt, Human
aacacagcaagggugaug

SEQ ID NO: 1592986 - RNA, 15 nt, Human
aacacagcaagggug

SEQ ID NO: 1592987 - RNA, 17 nt, Human
aacacaacuauauuguu

SEQ ID NO: 1592988 - RNA, 16 nt, Human
guauuuuugacagaau

SEQ ID NO: 1592989 - RNA, 12 nt, Human
guauuuuugaca

SEQ ID NO: 1592990 - RNA, 15 nt, Human
guauuuuugacagaa

SEQ ID NO: 1592991 - RNA, 18 nt, Human
guauguacuucaugcugu

SEQ ID NO: 1592992 - RNA, 15 nt, Human
aaauggguuuuacug

SEQ ID NO: 1592993 - RNA, 14 nt, Human
aaauggguuuuacu

SEQ ID NO: 1592994 - RNA, 16 nt, Human
aaauguaagggaaacu

SEQ ID NO: 1592995 - RNA, 20 nt, Human
guaguguuggagaagaacug

SEQ ID NO: 1592996 - RNA, 16 nt, Human
guauauuuuauaucaa

SEQ ID NO: 1592997 - RNA, 21 nt, Human
guauaaaauaauuuuuauauu

SEQ ID NO: 1592998 - RNA, 15 nt, Human
guauaaaauaauuuu

SEQ ID NO: 1592999 - RNA, 15 nt, Human
aagggugaaaauuau

SEQ ID NO: 1593000 - RNA, 16 nt, Human
aagggugaaaauuauu

SEQ ID NO: 1593001 - RNA, 19 nt, Human
aagggugaugggaaagcau

SEQ ID NO: 1593002 - RNA, 14 nt, Human
aagguacuucaaau

SEQ ID NO: 1593003 - RNA, 12 nt, Human
guuucaaacuuu

SEQ ID NO: 1593004 - RNA, 16 nt, Human
aagucuuucacauuua

SEQ ID NO: 1593005 - RNA, 19 nt, Human
aaguaaugauaacuggaaa

SEQ ID NO: 1593006 - RNA, 14 nt, Human
aaguaaugauaacu

SEQ ID NO: 1593007 - RNA, 13 nt, Human
aaguauuagaaua

SEQ ID NO: 1593008 - RNA, 20 nt, Human
uaaaauaauuuuuauauuug

SEQ ID NO: 1593009 - RNA, 20 nt, Human
uaaaagacagugaaagaaaa

SEQ ID NO: 1593010 - RNA, 23 nt, Human
uaaaagaauauuuuaacuuccuu

SEQ ID NO: 1593011 - RNA, 12 nt, Human
uaaaagaaugau

SEQ ID NO: 1593012 - RNA, 23 nt, Human
aagaccuugcuuaugauugcaga

SEQ ID NO: 1593013 - RNA, 21 nt, Human
aagaccuuuggagcaaagcug

SEQ ID NO: 1593014 - RNA, 17 nt, Human
aagacugcauuauauuu

SEQ ID NO: 1593015 - RNA, 16 nt, Human
aagacugcacaucaaa

SEQ ID NO: 1593016 - RNA, 23 nt, Human
aagaggaaugaaguacucauaca

SEQ ID NO: 1593017 - RNA, 19 nt, Human
aagauguagaggagaaacu

SEQ ID NO: 1593018 - RNA, 13 nt, Human
aagauguagagga

SEQ ID NO: 1593019 - RNA, 21 nt, Human
gugugaccacugcagaagaca

SEQ ID NO: 1593020 - RNA, 14 nt, Human
aagaugaaaauauu

SEQ ID NO: 1593021 - RNA, 13 nt, Human
aagaugaaaauau

SEQ ID NO: 1593022 - RNA, 18 nt, Human
guuauugauaaguucaua

SEQ ID NO: 1593023 - RNA, 17 nt, Human
aagccugcaauuucaua

SEQ ID NO: 1593024 - RNA, 22 nt, Human
aagccugcaauuucauaugcug

SEQ ID NO: 1593025 - RNA, 20 nt, Human
aagcucacagaccuuugaac

SEQ ID NO: 1593026 - RNA, 14 nt, Human
aagcuccagguaga

SEQ ID NO: 1593027 - RNA, 13 nt, Human
aagcuccagguag

SEQ ID NO: 1593028 - RNA, 13 nt, Human
aagcauuguaaau

SEQ ID NO: 1593029 - RNA, 18 nt, Human
aagcauuguaaaugugcu

SEQ ID NO: 1593030 - RNA, 16 nt, Human
aagcauuuagauguau

SEQ ID NO: 1593031 - RNA, 14 nt, Human
aauauauuuaauga

SEQ ID NO: 1593032 - RNA, 21 nt, Human
uaacuuccuuggacucauuuu

SEQ ID NO: 1593033 - RNA, 13 nt, Human
uaagaagugaaaa

SEQ ID NO: 1593034 - RNA, 18 nt, Human
uaagaagugaaaaucuac

SEQ ID NO: 1593035 - RNA, 20 nt, Human
aauagagcaaaauugaugug

SEQ ID NO: 1593036 - RNA, 22 nt, Human
aauagagcaaaauugauguguu

SEQ ID NO: 1593037 - RNA, 23 nt, Human
aauacaucccuuaccugggaaag

SEQ ID NO: 1593038 - RNA, 18 nt, Human
aauaccaugccauuuaaa

SEQ ID NO: 1593039 - RNA, 23 nt, Human
aauaccacaggaaccacaagacu

SEQ ID NO: 1593040 - RNA, 17 nt, Human
uaacaaugaagauaaaa

SEQ ID NO: 1593041 - RNA, 13 nt, Human
uaacaaugcugua

SEQ ID NO: 1593042 - RNA, 17 nt, Human
aaucagugugucuaaau

SEQ ID NO: 1593043 - RNA, 18 nt, Human
aaucagugugucuaaauu

SEQ ID NO: 1593044 - RNA, 22 nt, Human
aaucagugugucuaaauuugaa

SEQ ID NO: 1593045 - RNA, 16 nt, Human
uaaguaauucaagaaa

SEQ ID NO: 1593046 - RNA, 20 nt, Human
uaaguaaugauaacuggaaa

SEQ ID NO: 1593047 - RNA, 19 nt, Human
uaaguaaaaccacagcagu

SEQ ID NO: 1593048 - RNA, 18 nt, Human
uaaguaaaaccacagcag

SEQ ID NO: 1593049 - RNA, 17 nt, Human
uaaguaaaaccacagca

SEQ ID NO: 1593050 - RNA, 16 nt, Human
uaaguaaaaccacagc

SEQ ID NO: 1593051 - RNA, 15 nt, Human
uaaguaaaaccacag

SEQ ID NO: 1593052 - RNA, 13 nt, Human
uaaguaaaaccac

SEQ ID NO: 1593053 - RNA, 14 nt, Human
aaucagugugucua

SEQ ID NO: 1593054 - RNA, 14 nt, Human
uaagcaaaauguga

SEQ ID NO: 1593055 - RNA, 21 nt, Human
uaagcaaaaugugauauguac

SEQ ID NO: 1593056 - RNA, 15 nt, Human
uaagcaaaaugugau

SEQ ID NO: 1593057 - RNA, 16 nt, Human
aaucagccuaguugau

SEQ ID NO: 1593058 - RNA, 15 nt, Human
aauauuuauuuuaau

SEQ ID NO: 1593059 - RNA, 16 nt, Human
uaauuuauacagguca

SEQ ID NO: 1593060 - RNA, 18 nt, Human
uaauuuuuauauuugaaa

SEQ ID NO: 1593061 - RNA, 21 nt, Human
uaauuuuuauauuugaaauau

SEQ ID NO: 1593062 - RNA, 19 nt, Human
uaauuuuuauauuugaaau

SEQ ID NO: 1593063 - RNA, 22 nt, Human
uaauuccguagguuauuuucag

SEQ ID NO: 1593064 - RNA, 16 nt, Human
aaugauuucauucaau

SEQ ID NO: 1593065 - RNA, 20 nt, Human
aaugacucagaauauugcuu

SEQ ID NO: 1593066 - RNA, 22 nt, Human
aaugagagacacacugaagaag

SEQ ID NO: 1593067 - RNA, 21 nt, Human
uacaaaaaaaaaaaaaaauua

SEQ ID NO: 1593068 - RNA, 21 nt, Human
aaugcuguauuuuaaaagaau

SEQ ID NO: 1593069 - RNA, 20 nt, Human
aaugcuguauuuuaaaagaa

SEQ ID NO: 1593070 - RNA, 22 nt, Human
aaugcuguauuuuaaaagaaug

SEQ ID NO: 1593071 - RNA, 20 nt, Human
aauguaagggaaacugccag

SEQ ID NO: 1593072 - RNA, 17 nt, Human
uacagagacagaaagca

SEQ ID NO: 1593073 - RNA, 12 nt, Human
aauucaagaaaa

SEQ ID NO: 1593074 - RNA, 20 nt, Human
aauucaagaaaacaacuuca

SEQ ID NO: 1593075 - RNA, 21 nt, Human
aauucagaaggaucuucaucu

SEQ ID NO: 1593076 - RNA, 14 nt, Human
aauuacauuuguau

SEQ ID NO: 1593077 - RNA, 13 nt, Human
aauuacauuugua

SEQ ID NO: 1593078 - RNA, 19 nt, Human
uaccagggacugaggggag

SEQ ID NO: 1593079 - RNA, 20 nt, Human
aauguucaucaaugaaugaa

SEQ ID NO: 1593080 - RNA, 16 nt, Human
aauguucaucaaugaa

SEQ ID NO: 1593081 - RNA, 13 nt, Human
aauguucaucaau

SEQ ID NO: 1593082 - RNA, 22 nt, Human
uaucaaagggugaaaauuauuu

SEQ ID NO: 1593083 - RNA, 18 nt, Human
uaucaaagggugaaaauu

SEQ ID NO: 1593084 - RNA, 19 nt, Human
uaucaaagggugaaaauua

SEQ ID NO: 1593085 - RNA, 14 nt, Human
acagaccuuugaac

SEQ ID NO: 1593086 - RNA, 20 nt, Human
uaucacaaaucuuaacuuga

SEQ ID NO: 1593087 - RNA, 16 nt, Human
uaucacaaaucuuaac

SEQ ID NO: 1593088 - RNA, 14 nt, Human
uaucacaaaucuua

SEQ ID NO: 1593089 - RNA, 20 nt, Human
uauauccuuucuaacaaaaa

SEQ ID NO: 1593090 - RNA, 16 nt, Human
acacucaguuguucaa

SEQ ID NO: 1593091 - RNA, 12 nt, Human
uauaggaauuga

SEQ ID NO: 1593092 - RNA, 20 nt, Human
uauaggugcuacaaaaacac

SEQ ID NO: 1593093 - RNA, 16 nt, Human
uauaggugcuacaaaa

SEQ ID NO: 1593094 - RNA, 15 nt, Human
uauacaggucauauu

SEQ ID NO: 1593095 - RNA, 16 nt, Human
uauacaggucauauua

SEQ ID NO: 1593096 - RNA, 21 nt, Human
uauacaggucauauuaauaua

SEQ ID NO: 1593097 - RNA, 17 nt, Human
acacucaaaucaagaaa

SEQ ID NO: 1593098 - RNA, 18 nt, Human
acacucaaaucaagaaac

SEQ ID NO: 1593099 - RNA, 13 nt, Human
acacucaaaucaa

SEQ ID NO: 1593100 - RNA, 22 nt, Human
acaggaaccacaagacugcaca

SEQ ID NO: 1593101 - RNA, 23 nt, Human
acagcuguaugauucccagccag

SEQ ID NO: 1593102 - RNA, 20 nt, Human
acagcuguaugauucccagc

SEQ ID NO: 1593103 - RNA, 19 nt, Human
acagcuguaugauucccag

SEQ ID NO: 1593104 - RNA, 14 nt, Human
acagcuguaugauu

SEQ ID NO: 1593105 - RNA, 19 nt, Human
acagcccuucuuuccacag

SEQ ID NO: 1593106 - RNA, 15 nt, Human
uaugccccauucaac

SEQ ID NO: 1593107 - RNA, 13 nt, Human
uaggauguugaaa

SEQ ID NO: 1593108 - RNA, 13 nt, Human
acacaacuauauu

SEQ ID NO: 1593109 - RNA, 14 nt, Human
uagcacugacagau

SEQ ID NO: 1593110 - RNA, 19 nt, Human
uagcacugacagauuucca

SEQ ID NO: 1593111 - RNA, 14 nt, Human
uagaggguguguaa

SEQ ID NO: 1593112 - RNA, 15 nt, Human
acaaaaacacagcaa

SEQ ID NO: 1593113 - RNA, 14 nt, Human
acaaaaacacagca

SEQ ID NO: 1593114 - RNA, 16 nt, Human
acaaaaacacagcaag

SEQ ID NO: 1593115 - RNA, 13 nt, Human
acaaaaacacagc

SEQ ID NO: 1593116 - RNA, 16 nt, Human
aauuuggauugcuaau

SEQ ID NO: 1593117 - RNA, 13 nt, Human
uagacacacauga

SEQ ID NO: 1593118 - RNA, 17 nt, Human
aauuccaauuauaugag

SEQ ID NO: 1593119 - RNA, 16 nt, Human
uagaacucccuuucaa

SEQ ID NO: 1593120 - RNA, 18 nt, Human
uagaacucccuuucaaca

SEQ ID NO: 1593121 - RNA, 17 nt, Human
uagaacucccuuucaac

SEQ ID NO: 1593122 - RNA, 15 nt, Human
uagaaacacaacuau

SEQ ID NO: 1593123 - RNA, 20 nt, Human
uccaaaaagauuuucagaaa

SEQ ID NO: 1593124 - RNA, 19 nt, Human
uccaaaaagauuuucagaa

SEQ ID NO: 1593125 - RNA, 17 nt, Human
accugagccccaaaagg

SEQ ID NO: 1593126 - RNA, 12 nt, Human
accugagcccca

SEQ ID NO: 1593127 - RNA, 16 nt, Human
ucauaauaaguugcau

SEQ ID NO: 1593128 - RNA, 22 nt, Human
acgaagaguauuuuugacagaa

SEQ ID NO: 1593129 - RNA, 20 nt, Human
acgaagaguauuuuugacag

SEQ ID NO: 1593130 - RNA, 16 nt, Human
acgcucucuggccuuc

SEQ ID NO: 1593131 - RNA, 15 nt, Human
acgcucucuggccuu

SEQ ID NO: 1593132 - RNA, 17 nt, Human
acgcucucuggccuucg

SEQ ID NO: 1593133 - RNA, 22 nt, Human
uccaugaagauguagaggagaa

SEQ ID NO: 1593134 - RNA, 11 nt, Human
uccauccugag

SEQ ID NO: 1593135 - RNA, 14 nt, Human
uccagugagacagc

SEQ ID NO: 1593136 - RNA, 13 nt, Human
acugaaacuuccc

SEQ ID NO: 1593137 - RNA, 22 nt, Human
uccugaaaacccuugccaugug

SEQ ID NO: 1593138 - RNA, 21 nt, Human
uccugaaaacccuugccaugu

SEQ ID NO: 1593139 - RNA, 17 nt, Human
uccucuccccaugaugu

SEQ ID NO: 1593140 - RNA, 18 nt, Human
acuccagaaagugacaag

SEQ ID NO: 1593141 - RNA, 14 nt, Human
acuccagaaaguga

SEQ ID NO: 1593142 - RNA, 14 nt, Human
acucagaauauugc

SEQ ID NO: 1593143 - RNA, 21 nt, Human
acuccaaacugacucuuaaga

SEQ ID NO: 1593144 - RNA, 14 nt, Human
ucccuccaccuccc

SEQ ID NO: 1593145 - RNA, 15 nt, Human
ucccuccaccucccu

SEQ ID NO: 1593146 - RNA, 17 nt, Human
ucccuccaccucccugc

SEQ ID NO: 1593147 - RNA, 19 nt, Human
ucccuccaccucccugcaa

SEQ ID NO: 1593148 - RNA, 15 nt, Human
uccccuccucugcuu

SEQ ID NO: 1593149 - RNA, 18 nt, Human
uccccuccucugcuugcc

SEQ ID NO: 1593150 - RNA, 24 nt, Human
uccccuccucugcuugccaucccu

SEQ ID NO: 1593151 - RNA, 18 nt, Human
acuauucaaacagucuca

SEQ ID NO: 1593152 - RNA, 16 nt, Human
acuauucaaacagucu

SEQ ID NO: 1593153 - RNA, 14 nt, Human
acuauucaaacagu

SEQ ID NO: 1593154 - RNA, 13 nt, Human
acuauucaaacag

SEQ ID NO: 1593155 - RNA, 20 nt, Human
acuagaguuuagcuggaaaa

SEQ ID NO: 1593156 - RNA, 14 nt, Human
uauguguaaaaugu

SEQ ID NO: 1593157 - RNA, 17 nt, Human
uauguguaaaaugugaa

SEQ ID NO: 1593158 - RNA, 18 nt, Human
uauuuuaaaagaaugauu

SEQ ID NO: 1593159 - RNA, 14 nt, Human
uauuuuaaaagaau

SEQ ID NO: 1593160 - RNA, 15 nt, Human
uauuuuguucauaca

SEQ ID NO: 1593161 - RNA, 16 nt, Human
uauuuuguucauacau

SEQ ID NO: 1593162 - RNA, 12 nt, Human
uauuuuucacau

SEQ ID NO: 1593163 - RNA, 13 nt, Human
uauuuuucacaua

SEQ ID NO: 1593164 - RNA, 13 nt, Human
uauuuuuguagca

SEQ ID NO: 1593165 - RNA, 22 nt, Human
uauuuuaauaauguuucaaaca

SEQ ID NO: 1593166 - RNA, 19 nt, Human
uauuuuaauaauguuucaa

SEQ ID NO: 1593167 - RNA, 15 nt, Human
uauuuuuguagcacu

SEQ ID NO: 1593168 - RNA, 19 nt, Human
uauuuuuguagcacugaca

SEQ ID NO: 1593169 - RNA, 21 nt, Human
ucaaacagucucaggaaauca

SEQ ID NO: 1593170 - RNA, 20 nt, Human
ucaaacagucucaggaaauc

SEQ ID NO: 1593171 - RNA, 13 nt, Human
ucaaacagucuca

SEQ ID NO: 1593172 - RNA, 16 nt, Human
acaugagguacugaga

SEQ ID NO: 1593173 - RNA, 19 nt, Human
acauuguacgaagaguauu

SEQ ID NO: 1593174 - RNA, 17 nt, Human
acauuguaaauaguauu

SEQ ID NO: 1593175 - RNA, 19 nt, Human
acauuguaaauaguauuug

SEQ ID NO: 1593176 - RNA, 21 nt, Human
acauuguaaauaguauuugag

SEQ ID NO: 1593177 - RNA, 23 nt, Human
ucaauauuucagauaaucacaau

SEQ ID NO: 1593178 - RNA, 16 nt, Human
accaaauaaaaauauu

SEQ ID NO: 1593179 - RNA, 18 nt, Human
accaaauaaaaauauugu

SEQ ID NO: 1593180 - RNA, 23 nt, Human
accaaaaaucucaauauuucaga

SEQ ID NO: 1593181 - RNA, 19 nt, Human
accaacacgagcaggcuac

SEQ ID NO: 1593182 - RNA, 14 nt, Human
accaacacgagcag

SEQ ID NO: 1593183 - RNA, 16 nt, Human
accacaagacugcaca

SEQ ID NO: 1593184 - RNA, 14 nt, Human
ucacaggaaguaga

SEQ ID NO: 1593185 - RNA, 23 nt, Human
ucacagccagacuggcacaguuu

SEQ ID NO: 1593186 - RNA, 17 nt, Human
ucacagccagacuggca

SEQ ID NO: 1593187 - RNA, 13 nt, Human
ucaauuuaaaaaa

SEQ ID NO: 1593188 - RNA, 12 nt, Human
ucaauuuaaaaa

SEQ ID NO: 1593189 - RNA, 16 nt, Human
ucacagaccuuugaac

SEQ ID NO: 1593190 - RNA, 18 nt, Human
ucagagcugcccucuccu

SEQ ID NO: 1593191 - RNA, 17 nt, Human
ucagagcugcccucucc

SEQ ID NO: 1593192 - RNA, 15 nt, Human
ucagagcugcccucu

SEQ ID NO: 1593193 - RNA, 16 nt, Human
ucagagcugcccucuc

SEQ ID NO: 1593194 - RNA, 14 nt, Human
ucagagcugcccuc

SEQ ID NO: 1593195 - RNA, 20 nt, Human
acccaaauguucaucaauga

SEQ ID NO: 1593196 - RNA, 16 nt, Human
acccaaauguucauca

SEQ ID NO: 1593197 - RNA, 15 nt, Human
acccgggaggcagag

SEQ ID NO: 1593198 - RNA, 17 nt, Human
ucuagcauggcauauuu

SEQ ID NO: 1593199 - RNA, 18 nt, Human
ucuagcauggcauauuuu

SEQ ID NO: 1593200 - RNA, 17 nt, Human
acuucccagugaauucu

SEQ ID NO: 1593201 - RNA, 13 nt, Human
ucuauaauuuaaa

SEQ ID NO: 1593202 - RNA, 20 nt, Human
acuuccagauccuggaaauc

SEQ ID NO: 1593203 - RNA, 22 nt, Human
acuucccuuucugcuuguguua

SEQ ID NO: 1593204 - RNA, 21 nt, Human
acuucuaaguaaaaccacagc

SEQ ID NO: 1593205 - RNA, 19 nt, Human
acuucuaaguaaaaccaca

SEQ ID NO: 1593206 - RNA, 18 nt, Human
acuucuaaguaaaaccac

SEQ ID NO: 1593207 - RNA, 13 nt, Human
acuucuaaguaaa

SEQ ID NO: 1593208 - RNA, 17 nt, Human
ucucaaaacugcacugu

SEQ ID NO: 1593209 - RNA, 23 nt, Human
acuugaacccgggaggcagaggu

SEQ ID NO: 1593210 - RNA, 21 nt, Human
ucuaagauaguaacaaugaag

SEQ ID NO: 1593211 - RNA, 17 nt, Human
ucuaccaaaaaucucaa

SEQ ID NO: 1593212 - RNA, 13 nt, Human
acuguggguagac

SEQ ID NO: 1593213 - RNA, 22 nt, Human
acugaagaagcaccaaucauga

SEQ ID NO: 1593214 - RNA, 23 nt, Human
acugucagcuccccucggagaag

SEQ ID NO: 1593215 - RNA, 15 nt, Human
acuuuggaacaagau

SEQ ID NO: 1593216 - RNA, 15 nt, Human
agaaacauuugguaa

SEQ ID NO: 1593217 - RNA, 23 nt, Human
agaaacuuaagguuaccuuuguu

SEQ ID NO: 1593218 - RNA, 16 nt, Human
agaaacacaacuauau

SEQ ID NO: 1593219 - RNA, 16 nt, Human
agaaaacaaggaugaa

SEQ ID NO: 1593220 - RNA, 16 nt, Human
agaaagacuauucaaa

SEQ ID NO: 1593221 - RNA, 18 nt, Human
agaaagacuauucaaaca

SEQ ID NO: 1593222 - RNA, 18 nt, Human
agaaagcagaacagugau

SEQ ID NO: 1593223 - RNA, 17 nt, Human
agaaagcagaacaguga

SEQ ID NO: 1593224 - RNA, 20 nt, Human
agaaagcagaacagugauua

SEQ ID NO: 1593225 - RNA, 16 nt, Human
agaaggaucuucaucu

SEQ ID NO: 1593226 - RNA, 13 nt, Human
agaaguugauaug

SEQ ID NO: 1593227 - RNA, 10 nt, Human
ucuggccuuc

SEQ ID NO: 1593228 - RNA, 16 nt, Human
agaacucccuuucaac

SEQ ID NO: 1593229 - RNA, 17 nt, Human
agaacucccuuucaaca

SEQ ID NO: 1593230 - RNA, 20 nt, Human
ucugcccauccugccccuga

SEQ ID NO: 1593231 - RNA, 19 nt, Human
agaagcaccaaucaugaau

SEQ ID NO: 1593232 - RNA, 15 nt, Human
ucuuuaacucauaaa

SEQ ID NO: 1593233 - RNA, 14 nt, Human
agacuauucaaaca

SEQ ID NO: 1593234 - RNA, 12 nt, Human
agacuauucaaa

SEQ ID NO: 1593235 - RNA, 15 nt, Human
agacuauucaaacag

SEQ ID NO: 1593236 - RNA, 16 nt, Human
agacuauucaaacagu

SEQ ID NO: 1593237 - RNA, 19 nt, Human
agacauucuuccaaaaaga

SEQ ID NO: 1593238 - RNA, 18 nt, Human
agacaucaacagauaaau

SEQ ID NO: 1593239 - RNA, 17 nt, Human
agacaucaacagauaaa

SEQ ID NO: 1593240 - RNA, 21 nt, Human
agacauagaauuaacacauga

SEQ ID NO: 1593241 - RNA, 15 nt, Human
ucuucacaacagauu

SEQ ID NO: 1593242 - RNA, 14 nt, Human
agaaucacuugaac

SEQ ID NO: 1593243 - RNA, 14 nt, Human
agagagaaaauaaa

SEQ ID NO: 1593244 - RNA, 22 nt, Human
ugaaaaagaccuuuggagcaaa

SEQ ID NO: 1593245 - RNA, 22 nt, Human
ugaaaaaguucugcagauaaac

SEQ ID NO: 1593246 - RNA, 20 nt, Human
ugaaaaucuuauaauuuaaa

SEQ ID NO: 1593247 - RNA, 22 nt, Human
ugaaacugagaugugaacacau

SEQ ID NO: 1593248 - RNA, 19 nt, Human
ugaaacucguuaauuugua

SEQ ID NO: 1593249 - RNA, 14 nt, Human
agaguauuuuugac

SEQ ID NO: 1593250 - RNA, 15 nt, Human
agaguauuuuugaca

SEQ ID NO: 1593251 - RNA, 14 nt, Human
ugaaaguacauuug

SEQ ID NO: 1593252 - RNA, 23 nt, Human
ugaaaguacauuuggagacacaa

SEQ ID NO: 1593253 - RNA, 17 nt, Human
agaguauuuuugacaga

SEQ ID NO: 1593254 - RNA, 18 nt, Human
agaguauuuuugacagaa

SEQ ID NO: 1593255 - RNA, 15 nt, Human
ugaauacuuuauaaa

SEQ ID NO: 1593256 - RNA, 20 nt, Human
agaguauuuuugacagaaua

SEQ ID NO: 1593257 - RNA, 18 nt, Human
agauggaaugcuguguua

SEQ ID NO: 1593258 - RNA, 13 nt, Human
agauggaaugcug

SEQ ID NO: 1593259 - RNA, 15 nt, Human
agauggaaugcugug

SEQ ID NO: 1593260 - RNA, 17 nt, Human
ugacacuuaaaaauggu

SEQ ID NO: 1593261 - RNA, 17 nt, Human
agaugcaguucugaaga

SEQ ID NO: 1593262 - RNA, 16 nt, Human
agaugcaguucugaag

SEQ ID NO: 1593263 - RNA, 24 nt, Human
ugacuucuaaguaaaaccacagca

SEQ ID NO: 1593264 - RNA, 23 nt, Human
ugacuucuaaguaaaaccacagc

SEQ ID NO: 1593265 - RNA, 22 nt, Human
ugacuucuaaguaaaaccacag

SEQ ID NO: 1593266 - RNA, 15 nt, Human
ugacuucuaaguaaa

SEQ ID NO: 1593267 - RNA, 15 nt, Human
agauucccugagcag

SEQ ID NO: 1593268 - RNA, 23 nt, Human
agcaacgcaggcccccaggugcc

SEQ ID NO: 1593269 - RNA, 18 nt, Human
agcauggcauauuuuuca

SEQ ID NO: 1593270 - RNA, 19 nt, Human
agcauggcauauuuuucac

SEQ ID NO: 1593271 - RNA, 21 nt, Human
agcauggcauauuuuucacau

SEQ ID NO: 1593272 - RNA, 22 nt, Human
agcauggcauauuuuucacaua

SEQ ID NO: 1593273 - RNA, 17 nt, Human
agcaugucgucaaagcu

SEQ ID NO: 1593274 - RNA, 20 nt, Human
agcaugucgucaaagcugaa

SEQ ID NO: 1593275 - RNA, 18 nt, Human
agcauuguaaaugugcuu

SEQ ID NO: 1593276 - RNA, 17 nt, Human
agcauuguaaaugugcu

SEQ ID NO: 1593277 - RNA, 20 nt, Human
agcaucacaugaacuuguaa

SEQ ID NO: 1593278 - RNA, 12 nt, Human
ugauaugggucu

SEQ ID NO: 1593279 - RNA, 19 nt, Human
ugauacgcaacauaauuaa

SEQ ID NO: 1593280 - RNA, 12 nt, Human
ugauaaguaaau

SEQ ID NO: 1593281 - RNA, 18 nt, Human
ugagugucuuaauuaaaa

SEQ ID NO: 1593282 - RNA, 22 nt, Human
ugaguaacugauuuguaacaag

SEQ ID NO: 1593283 - RNA, 23 nt, Human
agcauaaauguugacaugggaca

SEQ ID NO: 1593284 - RNA, 17 nt, Human
ugaugaagaaguugaua

SEQ ID NO: 1593285 - RNA, 14 nt, Human
ugauuaccagggac

SEQ ID NO: 1593286 - RNA, 16 nt, Human
ugauuaccagggacug

SEQ ID NO: 1593287 - RNA, 12 nt, Human
ugauuaaaccaa

SEQ ID NO: 1593288 - RNA, 17 nt, Human
ugaugaucuuuaaaaua

SEQ ID NO: 1593289 - RNA, 14 nt, Human
ugaugaucuuuaaa

SEQ ID NO: 1593290 - RNA, 15 nt, Human
ugauggugguauguu

SEQ ID NO: 1593291 - RNA, 14 nt, Human
agccagacuggcac

SEQ ID NO: 1593292 - RNA, 19 nt, Human
agccagacuggcacaguuu

SEQ ID NO: 1593293 - RNA, 20 nt, Human
agccuuggggcugaugcagu

SEQ ID NO: 1593294 - RNA, 18 nt, Human
agcuacuugggaggcuga

SEQ ID NO: 1593295 - RNA, 17 nt, Human
agcuacuugggaggcug

SEQ ID NO: 1593296 - RNA, 19 nt, Human
agcuacuaauuuuaaaaug

SEQ ID NO: 1593297 - RNA, 22 nt, Human
agccugaaagaggaaugaagua

SEQ ID NO: 1593298 - RNA, 15 nt, Human
agccucauguccacu

SEQ ID NO: 1593299 - RNA, 20 nt, Human
agccucauguccacugguuc

SEQ ID NO: 1593300 - RNA, 17 nt, Human
agcccuucuuuccacag

SEQ ID NO: 1593301 - RNA, 18 nt, Human
agcccauggcacucuaug

SEQ ID NO: 1593302 - RNA, 23 nt, Human
agcuuuaucaaagggugaaaauu

SEQ ID NO: 1593303 - RNA, 14 nt, Human
ugcucauggaauug

SEQ ID NO: 1593304 - RNA, 12 nt, Human
aggaaauauuua

SEQ ID NO: 1593305 - RNA, 13 nt, Human
aggaaauauuuau

SEQ ID NO: 1593306 - RNA, 23 nt, Human
ugcuguauuuuaaaagaaugauu

SEQ ID NO: 1593307 - RNA, 13 nt, Human
ugcuguauuuuaa

SEQ ID NO: 1593308 - RNA, 22 nt, Human
ugcuguauuuuaaaagaaugau

SEQ ID NO: 1593309 - RNA, 21 nt, Human
ugcuguauuuuaaaagaauga

SEQ ID NO: 1593310 - RNA, 17 nt, Human
agcuugaaacugagaug

SEQ ID NO: 1593311 - RNA, 19 nt, Human
ugcuacaaaaacacagcaa

SEQ ID NO: 1593312 - RNA, 18 nt, Human
ugcuacaaaaacacagca

SEQ ID NO: 1593313 - RNA, 17 nt, Human
ugcuacaaaaacacagc

SEQ ID NO: 1593314 - RNA, 16 nt, Human
ugcuacaaaaacacag

SEQ ID NO: 1593315 - RNA, 20 nt, Human
ugcuacaaaaacacagcaag

SEQ ID NO: 1593316 - RNA, 16 nt, Human
agcugccuccccuccu

SEQ ID NO: 1593317 - RNA, 17 nt, Human
agcugccuccccuccuc

SEQ ID NO: 1593318 - RNA, 15 nt, Human
agcugccuccccucc

SEQ ID NO: 1593319 - RNA, 22 nt, Human
agcugcccucuccugggcagcu

SEQ ID NO: 1593320 - RNA, 19 nt, Human
agcuguucacagccagacu

SEQ ID NO: 1593321 - RNA, 16 nt, Human
agcuguucacagccag

SEQ ID NO: 1593322 - RNA, 16 nt, Human
uggcauauuuuucaca

SEQ ID NO: 1593323 - RNA, 17 nt, Human
uggcauauuuuucacau

SEQ ID NO: 1593324 - RNA, 14 nt, Human
uggccuucggccuc

SEQ ID NO: 1593325 - RNA, 20 nt, Human
uggcacaguuuucugagaaa

SEQ ID NO: 1593326 - RNA, 19 nt, Human
uggcacaguuuucugagaa

SEQ ID NO: 1593327 - RNA, 18 nt, Human
uggcacaguuuucugaga

SEQ ID NO: 1593328 - RNA, 13 nt, Human
uggagaagaacug

SEQ ID NO: 1593329 - RNA, 14 nt, Human
uggagaagaacuga

SEQ ID NO: 1593330 - RNA, 14 nt, Human
uggagcucguggaa

SEQ ID NO: 1593331 - RNA, 23 nt, Human
aggacagcccuucuuuccacaga

SEQ ID NO: 1593332 - RNA, 18 nt, Human
aggucauauuaauauauu

SEQ ID NO: 1593333 - RNA, 19 nt, Human
aggucauauuaauauauuu

SEQ ID NO: 1593334 - RNA, 23 nt, Human
agguacuucaaauccuugaagau

SEQ ID NO: 1593335 - RNA, 17 nt, Human
aggguuaugauuaagua

SEQ ID NO: 1593336 - RNA, 20 nt, Human
ugguaaggggaauugaggac

SEQ ID NO: 1593337 - RNA, 17 nt, Human
agggcagggacaggaua

SEQ ID NO: 1593338 - RNA, 14 nt, Human
ugggaguacaaaag

SEQ ID NO: 1593339 - RNA, 13 nt, Human
aguagaacagaua

SEQ ID NO: 1593340 - RNA, 19 nt, Human
aguagaacagauaaucagu

SEQ ID NO: 1593341 - RNA, 19 nt, Human
aguagauaggccaugggca

SEQ ID NO: 1593342 - RNA, 18 nt, Human
uguagaggagaaacugga

SEQ ID NO: 1593343 - RNA, 15 nt, Human
aguaaaaccacagca

SEQ ID NO: 1593344 - RNA, 14 nt, Human
agguugcagugagc

SEQ ID NO: 1593345 - RNA, 17 nt, Human
uguaagaaaauaucacu

SEQ ID NO: 1593346 - RNA, 14 nt, Human
aguauguguaaaau

SEQ ID NO: 1593347 - RNA, 15 nt, Human
aguauuucuaugaaa

SEQ ID NO: 1593348 - RNA, 13 nt, Human
aguauuucuauga

SEQ ID NO: 1593349 - RNA, 16 nt, Human
aguauuugagaguucu

SEQ ID NO: 1593350 - RNA, 22 nt, Human
aguauuucuaugaaauauuaug

SEQ ID NO: 1593351 - RNA, 23 nt, Human
ugucauuugcuggagcucugccc

SEQ ID NO: 1593352 - RNA, 21 nt, Human
ugucaauaaaauccauacauu

SEQ ID NO: 1593353 - RNA, 20 nt, Human
ugucaaucagccuaguugau

SEQ ID NO: 1593354 - RNA, 16 nt, Human
agucaggaaagagaac

SEQ ID NO: 1593355 - RNA, 13 nt, Human
uguguugugaaug

SEQ ID NO: 1593356 - RNA, 21 nt, Human
agugccuguaaucacagcuac

SEQ ID NO: 1593357 - RNA, 21 nt, Human
agugcaaauugucacaggaca

SEQ ID NO: 1593358 - RNA, 18 nt, Human
agugcaaauugucacagg

SEQ ID NO: 1593359 - RNA, 22 nt, Human
agugcaaauugucacaggacag

SEQ ID NO: 1593360 - RNA, 12 nt, Human
uguugugaaugu

SEQ ID NO: 1593361 - RNA, 13 nt, Human
uguugugaauguu

SEQ ID NO: 1593362 - RNA, 14 nt, Human
uguugugauguauu

SEQ ID NO: 1593363 - RNA, 20 nt, Human
uguugugauguauucuagcu

SEQ ID NO: 1593364 - RNA, 15 nt, Human
aguucuacauaagua

SEQ ID NO: 1593365 - RNA, 20 nt, Human
aguucggugagcuacaaaug

SEQ ID NO: 1593366 - RNA, 19 nt, Human
aguucggugagcuacaaau

SEQ ID NO: 1593367 - RNA, 14 nt, Human
aguucagagcugcc

SEQ ID NO: 1593368 - RNA, 16 nt, Human
aguguuggagaagaac

SEQ ID NO: 1593369 - RNA, 14 nt, Human
aguguuggagaaga

SEQ ID NO: 1593370 - RNA, 18 nt, Human
aguguuggagaagaacug

SEQ ID NO: 1593371 - RNA, 17 nt, Human
aguguuggagaagaacu

SEQ ID NO: 1593372 - RNA, 23 nt, Human
aguguuggagaagaacugaaauc

SEQ ID NO: 1593373 - RNA, 13 nt, Human
aguuuacauugua

SEQ ID NO: 1593374 - RNA, 14 nt, Human
aguuuaaauuguaa

SEQ ID NO: 1593375 - RNA, 13 nt, Human
uguuucaaacaua

SEQ ID NO: 1593376 - RNA, 14 nt, Human
uuaaguauguguaa

SEQ ID NO: 1593377 - RNA, 20 nt, Human
uuaagaagacugcauuauau

SEQ ID NO: 1593378 - RNA, 23 nt, Human
aguuuucugagaaagacuauuca

SEQ ID NO: 1593379 - RNA, 19 nt, Human
aguuuucugagaaagacua

SEQ ID NO: 1593380 - RNA, 15 nt, Human
auaaaauaauuuuua

SEQ ID NO: 1593381 - RNA, 12 nt, Human
auaaaauaauuu

SEQ ID NO: 1593382 - RNA, 18 nt, Human
auaaauauuuuugccaua

SEQ ID NO: 1593383 - RNA, 15 nt, Human
auaaauaguuuauga

SEQ ID NO: 1593384 - RNA, 14 nt, Human
auaaauaaaaauaa

SEQ ID NO: 1593385 - RNA, 13 nt, Human
auaaauaaaaaua

SEQ ID NO: 1593386 - RNA, 13 nt, Human
auaacugugaagu

SEQ ID NO: 1593387 - RNA, 22 nt, Human
auaacgauaaaagacagugaaa

SEQ ID NO: 1593388 - RNA, 14 nt, Human
uuagggagagaaga

SEQ ID NO: 1593389 - RNA, 18 nt, Human
auaauccuaaacauauga

SEQ ID NO: 1593390 - RNA, 17 nt, Human
uuuguagcacugacaga

SEQ ID NO: 1593391 - RNA, 19 nt, Human
uuuguagcacugacagauu

SEQ ID NO: 1593392 - RNA, 11 nt, Human
uuuuaagaaau

SEQ ID NO: 1593393 - RNA, 13 nt, Human
uuuuaaaaaagaa

SEQ ID NO: 1593394 - RNA, 15 nt, Human
uuuuaaaagaaugau

SEQ ID NO: 1593395 - RNA, 14 nt, Human
uuuuaaaagaauga

SEQ ID NO: 1593396 - RNA, 13 nt, Human
uuugcucauggaa

SEQ ID NO: 1593397 - RNA, 15 nt, Human
auggcuauaggugcu

SEQ ID NO: 1593398 - RNA, 12 nt, Human
uuugcucaugga

SEQ ID NO: 1593399 - RNA, 11 nt, Human
uuugcucaugg

SEQ ID NO: 1593400 - RNA, 16 nt, Human
auguccacugguucuu

SEQ ID NO: 1593401 - RNA, 15 nt, Human
auguugugauguauu

SEQ ID NO: 1593402 - RNA, 21 nt, Human
auguuucaaacauauauaaca

SEQ ID NO: 1593403 - RNA, 18 nt, Human
auguuucaaacauauaua

SEQ ID NO: 1593404 - RNA, 20 nt, Human
auuaaaaaaucaguuguaca

SEQ ID NO: 1593405 - RNA, 16 nt, Human
auuaaaagaauauuuu

SEQ ID NO: 1593406 - RNA, 19 nt, Human
auguucaucaaugaaugaa

SEQ ID NO: 1593407 - RNA, 15 nt, Human
auguugacaugggac

SEQ ID NO: 1593408 - RNA, 14 nt, Human
uuuuauaauuuugu

SEQ ID NO: 1593409 - RNA, 23 nt, Human
uuuuauggaggcuuugcauagau

SEQ ID NO: 1593410 - RNA, 19 nt, Human
uuuuauggcacuaguauuu

SEQ ID NO: 1593411 - RNA, 22 nt, Human
uuuuauggcacuaguauuucua

SEQ ID NO: 1593412 - RNA, 15 nt, Human
auuaauauauuucca

SEQ ID NO: 1593413 - RNA, 21 nt, Human
auuaaguaaugauaacuggaa

SEQ ID NO: 1593414 - RNA, 15 nt, Human
auuaaguaaugauaa

SEQ ID NO: 1593415 - RNA, 13 nt, Human
auuaaguaaugau

SEQ ID NO: 1593416 - RNA, 23 nt, Human
uuuuuuaaaaaagaaacauuugg

SEQ ID NO: 1593417 - RNA, 12 nt, Human
auuaccagggac

SEQ ID NO: 1593418 - RNA, 16 nt, Human
auuacauuuguauaaa

SEQ ID NO: 1593419 - RNA, 15 nt, Human
auuacauuuguauaa

SEQ ID NO: 1593420 - RNA, 13 nt, Human
auuacauuuguau

SEQ ID NO: 1593421 - RNA, 20 nt, Human
auuauuaccuuacagaaguu

SEQ ID NO: 1593422 - RNA, 17 nt, Human
auuauauuuacaaaugg

SEQ ID NO: 1593423 - RNA, 23 nt, Human
auuaucucaaaacugcacuguca

SEQ ID NO: 1593424 - RNA, 18 nt, Human
auuaucucaaaacugcac

SEQ ID NO: 1593425 - RNA, 16 nt, Human
auuauauuuacaaaug

SEQ ID NO: 1593426 - RNA, 16 nt, Human
auucaaacagucucag

SEQ ID NO: 1593427 - RNA, 15 nt, Human
auucaaacagucuca

SEQ ID NO: 1593428 - RNA, 14 nt, Human
auucaaacagucuc

SEQ ID NO: 1593429 - RNA, 20 nt, Human
auuccacuuauaggaauuga

SEQ ID NO: 1593430 - RNA, 21 nt, Human
auugcuaaucaccaaaggcuc

SEQ ID NO: 1593431 - RNA, 13 nt, Human
auugugccccugc

SEQ ID NO: 1593432 - RNA, 14 nt, Human
auuguauuacaaau

SEQ ID NO: 1593433 - RNA, 15 nt, Human
auuguauuacaaauc

SEQ ID NO: 1593434 - RNA, 19 nt, Human
auuuaaagcuuauuaaaac

SEQ ID NO: 1593435 - RNA, 16 nt, Human
auuuacaaaugggaaa

SEQ ID NO: 1593436 - RNA, 20 nt, Human
auugacacuuaaaaaugguu

SEQ ID NO: 1593437 - RNA, 20 nt, Human
auuuggagacacaacuauuu

SEQ ID NO: 1593438 - RNA, 21 nt, Human
auuuggagacacaacuauuuu

SEQ ID NO: 1593439 - RNA, 23 nt, Human
auuugguaaggggaauugaggac

SEQ ID NO: 1593440 - RNA, 18 nt, Human
auuuguaguguuggagaa

SEQ ID NO: 1593441 - RNA, 22 nt, Human
auuuauuacuguaagaaaauau

SEQ ID NO: 1593442 - RNA, 16 nt, Human
auuuuaauaauguuuc

SEQ ID NO: 1593443 - RNA, 15 nt, Human
auuuuaauaauguuu

SEQ ID NO: 1593444 - RNA, 14 nt, Human
auuuuaauaauguu

SEQ ID NO: 1593445 - RNA, 15 nt, Human
auuuguaucacaaau

SEQ ID NO: 1593446 - RNA, 19 nt, Human
auuuguaguguuggagaag

SEQ ID NO: 1593447 - RNA, 14 nt, Human
auaucuaguaugaa

SEQ ID NO: 1593448 - RNA, 15 nt, Human
auaucuaguaugaaa

SEQ ID NO: 1593449 - RNA, 17 nt, Human
auaucuaguaugaaauu

SEQ ID NO: 1593450 - RNA, 13 nt, Human
auaucuuguagcu

SEQ ID NO: 1593451 - RNA, 12 nt, Human
uucauacauauu

SEQ ID NO: 1593452 - RNA, 23 nt, Human
uucauacauauuuuuguagcacu

SEQ ID NO: 1593453 - RNA, 13 nt, Human
uucauacauugua

SEQ ID NO: 1593454 - RNA, 19 nt, Human
uucauacauuguacgaaga

SEQ ID NO: 1593455 - RNA, 13 nt, Human
auauauuuaauga

SEQ ID NO: 1593456 - RNA, 15 nt, Human
auauauuuaaugaua

SEQ ID NO: 1593457 - RNA, 12 nt, Human
uucccaaauuuc

SEQ ID NO: 1593458 - RNA, 18 nt, Human
uucccaacuccagaaagu

SEQ ID NO: 1593459 - RNA, 13 nt, Human
auagucuuucagu

SEQ ID NO: 1593460 - RNA, 20 nt, Human
auaguuguaccgcaauguga

SEQ ID NO: 1593461 - RNA, 14 nt, Human
auauauaacaaugc

SEQ ID NO: 1593462 - RNA, 21 nt, Human
uuauuuuguucauacauauuu

SEQ ID NO: 1593463 - RNA, 17 nt, Human
uuauuuuguucauacau

SEQ ID NO: 1593464 - RNA, 18 nt, Human
uucaaacagucucaggaa

SEQ ID NO: 1593465 - RNA, 14 nt, Human
uucaaacauauaua

SEQ ID NO: 1593466 - RNA, 23 nt, Human
uucacaagacccaaaaggcagaa

SEQ ID NO: 1593467 - RNA, 17 nt, Human
auaggcguaacuaauuu

SEQ ID NO: 1593468 - RNA, 20 nt, Human
auccuagucacuaccuucau

SEQ ID NO: 1593469 - RNA, 18 nt, Human
uugaacccgggaggcaga

SEQ ID NO: 1593470 - RNA, 19 nt, Human
uugaaauauugacuuuuua

SEQ ID NO: 1593471 - RNA, 20 nt, Human
aucauuucugcaucagcugc

SEQ ID NO: 1593472 - RNA, 14 nt, Human
auccauacauuugu

SEQ ID NO: 1593473 - RNA, 20 nt, Human
uucuaacaaaaaaauauauu

SEQ ID NO: 1593474 - RNA, 20 nt, Human
uucuaaguaaaaccacagca

SEQ ID NO: 1593475 - RNA, 19 nt, Human
uucuaaguaaaaccacagc

SEQ ID NO: 1593476 - RNA, 13 nt, Human
uucuaagaaguga

SEQ ID NO: 1593477 - RNA, 13 nt, Human
uucuauaauuuaa

SEQ ID NO: 1593478 - RNA, 14 nt, Human
uucuauaauuuaaa

SEQ ID NO: 1593479 - RNA, 21 nt, Human
uucuaaguaaaaccacagcag

SEQ ID NO: 1593480 - RNA, 20 nt, Human
aucaaauaugcaaagcacug

SEQ ID NO: 1593481 - RNA, 20 nt, Human
uuguguuaaguauguguaaa

SEQ ID NO: 1593482 - RNA, 23 nt, Human
uugugugaaagguacuucaaauc

SEQ ID NO: 1593483 - RNA, 23 nt, Human
augagagacacacugaagaagca

SEQ ID NO: 1593484 - RNA, 21 nt, Human
augagagacacacugaagaag

SEQ ID NO: 1593485 - RNA, 20 nt, Human
augagagacacacugaagaa

SEQ ID NO: 1593486 - RNA, 22 nt, Human
augauuaugaauuacauuugua

SEQ ID NO: 1593487 - RNA, 12 nt, Human
augauucccagc

SEQ ID NO: 1593488 - RNA, 14 nt, Human
uuguuuucauuauc

SEQ ID NO: 1593489 - RNA, 17 nt, Human
augcaguucugaagaag

SEQ ID NO: 1593490 - RNA, 15 nt, Human
augcaguucugaaga

SEQ ID NO: 1593491 - RNA, 17 nt, Human
augccacuaaauugaca

SEQ ID NO: 1593492 - RNA, 15 nt, Human
augccacuaaauuga

SEQ ID NO: 1593493 - RNA, 19 nt, Human
augcaguucugaagaagau

SEQ ID NO: 1593494 - RNA, 18 nt, Human
augcaguucugaagaaga

SEQ ID NO: 1593495 - RNA, 16 nt, Human
auggaaugcuguguua

SEQ ID NO: 1593496 - RNA, 20 nt, Human
auggcuaguaucaaaagaaa

SEQ ID NO: 1593497 - RNA, 15 nt, Human
augcuagaacucccu

SEQ ID NO: 1593498 - RNA, 19 nt, Human
augcuagaacucccuuuca

SEQ ID NO: 1593499 - RNA, 16 nt, Human
augcuagaacucccuu

SEQ ID NO: 1593500 - RNA, 16 nt, Human
uuuauuacuguaagaa

SEQ ID NO: 1593501 - RNA, 22 nt, Human
augcugucuacacuaagagaga

SEQ ID NO: 1593502 - RNA, 23 nt, Human
augcugucuacacuaagagagaa

SEQ ID NO: 1593503 - RNA, 13 nt, Human
uuuauauaagcuu

SEQ ID NO: 1593504 - RNA, 22 nt, Human
uuuagcuggaaaaguauguuag

SEQ ID NO: 1593505 - RNA, 18 nt, Human
aucucauaauuuauacag

SEQ ID NO: 1593506 - RNA, 21 nt, Human
aucucauuuccaagcaaguau

SEQ ID NO: 1593507 - RNA, 17 nt, Human
aucucauaauuuauaca

SEQ ID NO: 1593508 - RNA, 23 nt, Human
aucucauuuccaagcaaguauua

SEQ ID NO: 1593509 - RNA, 13 nt, Human
aucucaauauuuc

SEQ ID NO: 1593510 - RNA, 11 nt, Human
uugauguguuu

SEQ ID NO: 1593511 - RNA, 20 nt, Human
uugauguguuuauuuauaga

SEQ ID NO: 1593512 - RNA, 19 nt, Human
uugauggugguauguuuuc

SEQ ID NO: 1593513 - RNA, 18 nt, Human
uugauggugguauguuuu

SEQ ID NO: 1593514 - RNA, 13 nt, Human
uugcccuguuaaa

SEQ ID NO: 1593515 - RNA, 15 nt, Human
augaaagcagggacu

SEQ ID NO: 1593516 - RNA, 13 nt, Human
aucuuuuucuaac

SEQ ID NO: 1593517 - RNA, 15 nt, Human
augaauuaaguuuuu

SEQ ID NO: 1593518 - RNA, 20 nt, Human
augaaauauuauguuaaaac

SEQ ID NO: 1593519 - RNA, 18 nt, Human
augaaauauuauguuaaa

SEQ ID NO: 1593520 - RNA, 17 nt, Human
augaaauauuauguuaa

SEQ ID NO: 1593521 - RNA, 13 nt, Human
augaaauauuaug

SEQ ID NO: 1593522 - RNA, 13 nt, Human
augaaugaauggc

SEQ ID NO: 1593523 - RNA, 18 nt, Human
augaagauguagaggaga

SEQ ID NO: 1593524 - RNA, 19 nt, Human
augagagacacacugaaga

SEQ ID NO: 1593525 - RNA, 17 nt, Human
augagagacacacugaa

SEQ ID NO: 1593526 - RNA, 14 nt, Human
augagagacacacu

SEQ ID NO: 1593527 - RNA, 13 nt, Human
augagagacacac

SEQ ID NO: 1593528 - RNA, 16 nt, Human
uuguaucacaaaucuu

SEQ ID NO: 1593529 - RNA, 19 nt, Human
uuguauaaaauaauuuuua

SEQ ID NO: 1593530 - RNA, 23 nt, Human
uuguaguguuggagaagaacuga

SEQ ID NO: 1593531 - RNA, 17 nt, Human
uuguauaaaauaauuuu

SEQ ID NO: 1593532 - RNA, 16 nt, Human
uuguauaaaauaauuu

SEQ ID NO: 1593533 - RNA, 19 nt, Human
cuucaucugacuaugacau

SEQ ID NO: 1593534 - RNA, 21 nt, Human
cuucaucugacuaugacauaa

SEQ ID NO: 1593535 - RNA, 20 nt, Human
cuucaugcauagguuuagca

SEQ ID NO: 1593536 - RNA, 15 nt, Human
cuucacuguaaaaua

SEQ ID NO: 1593537 - RNA, 13 nt, Human
cuugaugaagaag

SEQ ID NO: 1593538 - RNA, 12 nt, Human
cuugaugaagaa

SEQ ID NO: 1593539 - RNA, 23 nt, Human
cuucuaaguaaaaccacagcagu

SEQ ID NO: 1593540 - RNA, 22 nt, Human
cuucuaaguaaaaccacagcag

SEQ ID NO: 1593541 - RNA, 17 nt, Human
gaaagacuauucaaaca

SEQ ID NO: 1593542 - RNA, 15 nt, Human
gaaagacuauucaaa

SEQ ID NO: 1593543 - RNA, 14 nt, Human
gaaagacuauucaa

SEQ ID NO: 1593544 - RNA, 17 nt, Human
gaaauauuuauuuuaau

SEQ ID NO: 1593545 - RNA, 20 nt, Human
gaaaucaaauaugcaaagca

SEQ ID NO: 1593546 - RNA, 19 nt, Human
gaaaucaaauaugcaaagc

SEQ ID NO: 1593547 - RNA, 21 nt, Human
gaaaucaaauaugcaaagcac

SEQ ID NO: 1593548 - RNA, 18 nt, Human
gaaaucaaauaugcaaag

SEQ ID NO: 1593549 - RNA, 22 nt, Human
gaaauauuuauuuuaauaaugu

SEQ ID NO: 1593550 - RNA, 18 nt, Human
gaaauauuuauuuuaaua

SEQ ID NO: 1593551 - RNA, 18 nt, Human
cugugaaguuuacauugu

SEQ ID NO: 1593552 - RNA, 21 nt, Human
cugugagaugcuagaacuccc

SEQ ID NO: 1593553 - RNA, 16 nt, Human
cugugagaugcuagaa

SEQ ID NO: 1593554 - RNA, 21 nt, Human
cugucagcuccccucggagaa

SEQ ID NO: 1593555 - RNA, 23 nt, Human
cugucagcuccccucggagaaga

SEQ ID NO: 1593556 - RNA, 22 nt, Human
cugggcagcugccuccccuccu

SEQ ID NO: 1593557 - RNA, 20 nt, Human
cugggcagcugccuccccuc

SEQ ID NO: 1593558 - RNA, 21 nt, Human
cugggcagcugccuccccucc

SEQ ID NO: 1593559 - RNA, 19 nt, Human
cugggcagcugccuccccu

SEQ ID NO: 1593560 - RNA, 10 nt, Human
cugggacagg

SEQ ID NO: 1593561 - RNA, 21 nt, Human
cuggaaaucaggguuaguauu

SEQ ID NO: 1593562 - RNA, 22 nt, Human
gagacguuuuuggaagaguagu

SEQ ID NO: 1593563 - RNA, 14 nt, Human
gagaaucacuugaa

SEQ ID NO: 1593564 - RNA, 15 nt, Human
gagaaucacuugaac

SEQ ID NO: 1593565 - RNA, 13 nt, Human
gacuaugacauaa

SEQ ID NO: 1593566 - RNA, 16 nt, Human
gacucuuaagaagacu

SEQ ID NO: 1593567 - RNA, 18 nt, Human
gacucuuaagaagacugc

SEQ ID NO: 1593568 - RNA, 17 nt, Human
gacucuuaagaagacug

SEQ ID NO: 1593569 - RNA, 13 nt, Human
gagcgacagugag

SEQ ID NO: 1593570 - RNA, 16 nt, Human
gacagaauauguuuca

SEQ ID NO: 1593571 - RNA, 16 nt, Human
gacacuuaaaaauggu

SEQ ID NO: 1593572 - RNA, 17 nt, Human
gacagucaccucaugga

SEQ ID NO: 1593573 - RNA, 14 nt, Human
gacagugaaagaaa

SEQ ID NO: 1593574 - RNA, 14 nt, Human
gacacacugaagaa

SEQ ID NO: 1593575 - RNA, 12 nt, Human
gacacacaugaa

SEQ ID NO: 1593576 - RNA, 13 nt, Human
gacacacugaaga

SEQ ID NO: 1593577 - RNA, 11 nt, Human
gaauuaguuuu

SEQ ID NO: 1593578 - RNA, 20 nt, Human
gaaugagagacacacugaag

SEQ ID NO: 1593579 - RNA, 23 nt, Human
gaaugagagacacacugaagaag

SEQ ID NO: 1593580 - RNA, 22 nt, Human
gaaugagagacacacugaagaa

SEQ ID NO: 1593581 - RNA, 17 nt, Human
gcacugacagauuucca

SEQ ID NO: 1593582 - RNA, 12 nt, Human
gcacugacagau

SEQ ID NO: 1593583 - RNA, 17 nt, Human
gcacaguuuucugagaa

SEQ ID NO: 1593584 - RNA, 14 nt, Human
gcacaguuuucuga

SEQ ID NO: 1593585 - RNA, 18 nt, Human
gcacaguuuucugagaaa

SEQ ID NO: 1593586 - RNA, 20 nt, Human
gcacaguuuucugagaaaga

SEQ ID NO: 1593587 - RNA, 12 nt, Human
gcagcugccucc

SEQ ID NO: 1593588 - RNA, 13 nt, Human
gcagcugccuccc

SEQ ID NO: 1593589 - RNA, 15 nt, Human
gcagcugccuccccu

SEQ ID NO: 1593590 - RNA, 16 nt, Human
gcagcugccuccccuc

SEQ ID NO: 1593591 - RNA, 17 nt, Human
gcagcugccuccccucc

SEQ ID NO: 1593592 - RNA, 18 nt, Human
gcagcugccuccccuccu

SEQ ID NO: 1593593 - RNA, 22 nt, Human
gcagcugccuccccuccucugc

SEQ ID NO: 1593594 - RNA, 19 nt, Human
gcagggacuugaacccaua

SEQ ID NO: 1593595 - RNA, 17 nt, Human
gauuagggagagaagau

SEQ ID NO: 1593596 - RNA, 14 nt, Human
gauuaccagggacu

SEQ ID NO: 1593597 - RNA, 16 nt, Human
gaugugaacacaucag

SEQ ID NO: 1593598 - RNA, 14 nt, Human
gaugugaacacauc

SEQ ID NO: 1593599 - RNA, 16 nt, Human
gaguuuagcuggaaaa

SEQ ID NO: 1593600 - RNA, 20 nt, Human
gauauguaccuaacgaagua

SEQ ID NO: 1593601 - RNA, 17 nt, Human
guaacaaugaagauaaa

SEQ ID NO: 1593602 - RNA, 12 nt, Human
guaaaaugugaa

SEQ ID NO: 1593603 - RNA, 19 nt, Human
guaaaaugugaagugaaug

SEQ ID NO: 1593604 - RNA, 20 nt, Human
guaaaaugugaagugaauga

SEQ ID NO: 1593605 - RNA, 22 nt, Human
guaaaaugugaagugaaugaaa

SEQ ID NO: 1593606 - RNA, 20 nt, Human
aaauaauuuuuauauuugaa

SEQ ID NO: 1593607 - RNA, 18 nt, Human
aaauaauuuuuauauuug

SEQ ID NO: 1593608 - RNA, 15 nt, Human
aaauaauuuuuauau

SEQ ID NO: 1593609 - RNA, 23 nt, Human
aaaguuauugauaaguucauaca

SEQ ID NO: 1593610 - RNA, 16 nt, Human
ggugugaccacugcag

SEQ ID NO: 1593611 - RNA, 16 nt, Human
gguuuagaaagcuugc

SEQ ID NO: 1593612 - RNA, 14 nt, Human
aaagauuuucagaa

SEQ ID NO: 1593613 - RNA, 13 nt, Human
aaagauuuucaga

SEQ ID NO: 1593614 - RNA, 15 nt, Human
aaagacuauucaaac

SEQ ID NO: 1593615 - RNA, 17 nt, Human
aaagacuauucaaacag

SEQ ID NO: 1593616 - RNA, 17 nt, Human
aaagcagggacuugaac

SEQ ID NO: 1593617 - RNA, 15 nt, Human
ggugccaguuauggc

SEQ ID NO: 1593618 - RNA, 20 nt, Human
ggguuuuauuguuuaaaauc

SEQ ID NO: 1593619 - RNA, 14 nt, Human
aaagacuauucaaa

SEQ ID NO: 1593620 - RNA, 12 nt, Human
aaaaugugaagu

SEQ ID NO: 1593621 - RNA, 15 nt, Human
aaaaugugauaugua

SEQ ID NO: 1593622 - RNA, 22 nt, Human
aaaauuuuuucucuaggaaaua

SEQ ID NO: 1593623 - RNA, 20 nt, Human
aaacaagcacuaaacaaaga

SEQ ID NO: 1593624 - RNA, 19 nt, Human
aaaaguauguuagugcaaa

SEQ ID NO: 1593625 - RNA, 13 nt, Human
aaaaauauauuua

SEQ ID NO: 1593626 - RNA, 15 nt, Human
aaaaauauauuuaau

SEQ ID NO: 1593627 - RNA, 19 nt, Human
aaaaauauauuuaaugaua

SEQ ID NO: 1593628 - RNA, 21 nt, Human
gggacauuugcucauggaauu

SEQ ID NO: 1593629 - RNA, 20 nt, Human
gggacauuugcucauggaau

SEQ ID NO: 1593630 - RNA, 22 nt, Human
aaaaauggaacauaaaauacaa

SEQ ID NO: 1593631 - RNA, 12 nt, Human
aaaaccacagca

SEQ ID NO: 1593632 - RNA, 13 nt, Human
aaaacucauuuuu

SEQ ID NO: 1593633 - RNA, 13 nt, Human
aaaaccacagcag

SEQ ID NO: 1593634 - RNA, 14 nt, Human
aaaaccacagcagu

SEQ ID NO: 1593635 - RNA, 17 nt, Human
gggauuguaaaauggug

SEQ ID NO: 1593636 - RNA, 16 nt, Human
gggauuguaaaauggu

SEQ ID NO: 1593637 - RNA, 12 nt, Human
gggcagcugccu

SEQ ID NO: 1593638 - RNA, 15 nt, Human
ggcauauuuuucaca

SEQ ID NO: 1593639 - RNA, 17 nt, Human
ggcauauuuuucacaua

SEQ ID NO: 1593640 - RNA, 13 nt, Human
ggccuccauccug

SEQ ID NO: 1593641 - RNA, 23 nt, Human
ggccuucggccuccauccugagg

SEQ ID NO: 1593642 - RNA, 22 nt, Human
ggaucuucaucugacuaugaca

SEQ ID NO: 1593643 - RNA, 12 nt, Human
ggauggcaagau

SEQ ID NO: 1593644 - RNA, 22 nt, Human
ggauguugaaaaaguucugcag

SEQ ID NO: 1593645 - RNA, 15 nt, Human
gcucugcccauccug

SEQ ID NO: 1593646 - RNA, 21 nt, Human
gcucugcccauccugccccug

SEQ ID NO: 1593647 - RNA, 16 nt, Human
gcugaaacaacaaaua

SEQ ID NO: 1593648 - RNA, 20 nt, Human
gcuccacuuggucugugaga

SEQ ID NO: 1593649 - RNA, 19 nt, Human
gcuuccuggcaauagucaa

SEQ ID NO: 1593650 - RNA, 14 nt, Human
gcuggagcucugcc

SEQ ID NO: 1593651 - RNA, 13 nt, Human
gcuguauuuuaaa

SEQ ID NO: 1593652 - RNA, 12 nt, Human
gcuguauuuuaa

SEQ ID NO: 1593653 - RNA, 20 nt, Human
gccuccauccugaggcucca

SEQ ID NO: 1593654 - RNA, 16 nt, Human
gccuccauccugaggc

SEQ ID NO: 1593655 - RNA, 17 nt, Human
gcuacuugggaggcuga

SEQ ID NO: 1593656 - RNA, 15 nt, Human
gcuacugucagcucc

SEQ ID NO: 1593657 - RNA, 19 nt, Human
gcuacaaaaacacagcaag

SEQ ID NO: 1593658 - RNA, 18 nt, Human
gcuacaaaaacacagcaa

SEQ ID NO: 1593659 - RNA, 17 nt, Human
gcuacaaaaacacagca

SEQ ID NO: 1593660 - RNA, 22 nt, Human
gccaugugcuaguaauuggaaa

SEQ ID NO: 1593661 - RNA, 13 nt, Human
gccagcaguucag

SEQ ID NO: 1593662 - RNA, 14 nt, Human
gccagcaguucaga

SEQ ID NO: 1593663 - RNA, 19 nt, Human
gccagcaguucagagcugc

SEQ ID NO: 1593664 - RNA, 20 nt, Human
gccagcaguucagagcugcc

SEQ ID NO: 1593665 - RNA, 21 nt, Human
gccagcaguucagagcugccc

SEQ ID NO: 1593666 - RNA, 22 nt, Human
gccaguuauggcuauaggugcu

SEQ ID NO: 1593667 - RNA, 16 nt, Human
gccauaugaaaaggcu

SEQ ID NO: 1593668 - RNA, 15 nt, Human
auucuugaaggaaaa

SEQ ID NO: 1593669 - RNA, 18 nt, Human
auucuugaaggaaaauga

SEQ ID NO: 1593670 - RNA, 22 nt, Human
auugauaaguucauacauugua

SEQ ID NO: 1593671 - RNA, 14 nt, Human
auuguaaauaguau

SEQ ID NO: 1593672 - RNA, 14 nt, Human
auuguaaaauggug

SEQ ID NO: 1593673 - RNA, 22 nt, Human
auucauagcagcuuauucacaa

SEQ ID NO: 1593674 - RNA, 19 nt, Human
auucauagcagcuuauuca

SEQ ID NO: 1593675 - RNA, 16 nt, Human
auuagggagagaagau

SEQ ID NO: 1593676 - RNA, 17 nt, Human
auuaugaauuacauuug

SEQ ID NO: 1593677 - RNA, 14 nt, Human
auuaugaauuacau

SEQ ID NO: 1593678 - RNA, 18 nt, Human
auuaugaauuacauuugu

SEQ ID NO: 1593679 - RNA, 19 nt, Human
auucacaagacccaaaagg

SEQ ID NO: 1593680 - RNA, 22 nt, Human
caaagcacugacuucuaaguaa

SEQ ID NO: 1593681 - RNA, 20 nt, Human
caaagcacugacuucuaagu

SEQ ID NO: 1593682 - RNA, 15 nt, Human
caaauccuugaagau

SEQ ID NO: 1593683 - RNA, 23 nt, Human
caacacgagcaggcuacugucag

SEQ ID NO: 1593684 - RNA, 20 nt, Human
caaaaaaaaaaaaaaauuag

SEQ ID NO: 1593685 - RNA, 15 nt, Human
caaaaggcagaagca

SEQ ID NO: 1593686 - RNA, 15 nt, Human
caaacagucucagga

SEQ ID NO: 1593687 - RNA, 17 nt, Human
auuugcucauggaauug

SEQ ID NO: 1593688 - RNA, 14 nt, Human
auuugcucauggaa

SEQ ID NO: 1593689 - RNA, 19 nt, Human
auuuuauagcuacuaauuu

SEQ ID NO: 1593690 - RNA, 11 nt, Human
cacugacagau

SEQ ID NO: 1593691 - RNA, 21 nt, Human
cacuagggcagggacaggaua

SEQ ID NO: 1593692 - RNA, 20 nt, Human
cacuagggcagggacaggau

SEQ ID NO: 1593693 - RNA, 16 nt, Human
cacuccagugagacag

SEQ ID NO: 1593694 - RNA, 22 nt, Human
cacugguucuucuuggucucag

SEQ ID NO: 1593695 - RNA, 19 nt, Human
cacuuguguuuugcaagcc

SEQ ID NO: 1593696 - RNA, 16 nt, Human
cacuugucaauaaaau

SEQ ID NO: 1593697 - RNA, 22 nt, Human
cacuuguguuuugcaagccaga

SEQ ID NO: 1593698 - RNA, 21 nt, Human
cacugcagaagacaguauggc

SEQ ID NO: 1593699 - RNA, 14 nt, Human
caaguccaagcaua

SEQ ID NO: 1593700 - RNA, 18 nt, Human
cacaagacugcacaucaa

SEQ ID NO: 1593701 - RNA, 15 nt, Human
caauucuugccaaau

SEQ ID NO: 1593702 - RNA, 17 nt, Human
caaugcuguauuuuaaa

SEQ ID NO: 1593703 - RNA, 16 nt, Human
caaugcuguauuuuaa

SEQ ID NO: 1593704 - RNA, 15 nt, Human
caaugcuguauuuua

SEQ ID NO: 1593705 - RNA, 21 nt, Human
cacagccucuuagaugcaguu

SEQ ID NO: 1593706 - RNA, 17 nt, Human
cacagccucuuagaugc

SEQ ID NO: 1593707 - RNA, 22 nt, Human
cacacaugaaguccaagcauuu

SEQ ID NO: 1593708 - RNA, 17 nt, Human
cacacaugaaguccaag

SEQ ID NO: 1593709 - RNA, 19 nt, Human
ccaaaaagauuuucagaaa

SEQ ID NO: 1593710 - RNA, 12 nt, Human
cauuuccaagca

SEQ ID NO: 1593711 - RNA, 15 nt, Human
cauuaggauggcuag

SEQ ID NO: 1593712 - RNA, 22 nt, Human
ccaauuauaugagacguuuuug

SEQ ID NO: 1593713 - RNA, 18 nt, Human
cauagauucccugagcag

SEQ ID NO: 1593714 - RNA, 17 nt, Human
cauagauucccugagca

SEQ ID NO: 1593715 - RNA, 16 nt, Human
caugaauuaguuuuau

SEQ ID NO: 1593716 - RNA, 18 nt, Human
caucagcugcugaaacaa

SEQ ID NO: 1593717 - RNA, 17 nt, Human
caucagcugcugaaaca

SEQ ID NO: 1593718 - RNA, 15 nt, Human
caucagcugcugaaa

SEQ ID NO: 1593719 - RNA, 20 nt, Human
caucagcuugcccuguuaaa

SEQ ID NO: 1593720 - RNA, 23 nt, Human
cagccugagcgacagugagacuc

SEQ ID NO: 1593721 - RNA, 19 nt, Human
cagccccgugggguuccuc

SEQ ID NO: 1593722 - RNA, 19 nt, Human
cagcaguucagagcugccc

SEQ ID NO: 1593723 - RNA, 20 nt, Human
cagcaguucagagcugcccu

SEQ ID NO: 1593724 - RNA, 21 nt, Human
cagcaguucagagcugcccuc

SEQ ID NO: 1593725 - RNA, 22 nt, Human
cagcaguucagagcugcccucu

SEQ ID NO: 1593726 - RNA, 16 nt, Human
cagagguugcagugag

SEQ ID NO: 1593727 - RNA, 19 nt, Human
caggaaaucaaauaugcaa

SEQ ID NO: 1593728 - RNA, 21 nt, Human
caggaaaucaaauaugcaaag

SEQ ID NO: 1593729 - RNA, 22 nt, Human
caggaaaucaaauaugcaaagc

SEQ ID NO: 1593730 - RNA, 17 nt, Human
cagcuuauucacaagac

SEQ ID NO: 1593731 - RNA, 16 nt, Human
cagcuuauucacaaga

SEQ ID NO: 1593732 - RNA, 24 nt, Human
caggacagcccuucuuuccacaga

SEQ ID NO: 1593733 - RNA, 23 nt, Human
caggacagcccuucuuuccacag

SEQ ID NO: 1593734 - RNA, 22 nt, Human
cagggaggacgcucucuggccu

SEQ ID NO: 1593735 - RNA, 23 nt, Human
cuacauaaguaauucaagaaaac

SEQ ID NO: 1593736 - RNA, 22 nt, Human
cuacauaaguaauucaagaaaa

SEQ ID NO: 1593737 - RNA, 15 nt, Human
cuacaugagguacug

SEQ ID NO: 1593738 - RNA, 18 nt, Human
cuacaugagguacugaga

SEQ ID NO: 1593739 - RNA, 15 nt, Human
cuacaaaaacacagc

SEQ ID NO: 1593740 - RNA, 23 nt, Human
cuaagugaaauaagccagacauc

SEQ ID NO: 1593741 - RNA, 20 nt, Human
cuaagugaaauaagccagac

SEQ ID NO: 1593742 - RNA, 20 nt, Human
cuaacgaaguauccuucagc

SEQ ID NO: 1593743 - RNA, 19 nt, Human
cuagaacucccuuucaaca

SEQ ID NO: 1593744 - RNA, 18 nt, Human
cuagaacucccuuucaac

SEQ ID NO: 1593745 - RNA, 17 nt, Human
cuagaacucccuuucaa

SEQ ID NO: 1593746 - RNA, 16 nt, Human
cuagaacucccuuuca

SEQ ID NO: 1593747 - RNA, 23 nt, Human
cuaguugaucagcuuauugucua

SEQ ID NO: 1593748 - RNA, 16 nt, Human
cgacagugagacucug

SEQ ID NO: 1593749 - RNA, 15 nt, Human
cgacagugagacucu

SEQ ID NO: 1593750 - RNA, 21 nt, Human
cucuuagaugcaguucugaag

SEQ ID NO: 1593751 - RNA, 20 nt, Human
cucuuagaugcaguucugaa

SEQ ID NO: 1593752 - RNA, 11 nt, Human
cucucuggccu

SEQ ID NO: 1593753 - RNA, 12 nt, Human
cucucuggccuu

SEQ ID NO: 1593754 - RNA, 13 nt, Human
cucucuggccuuc

SEQ ID NO: 1593755 - RNA, 15 nt, Human
cucuccccaugaugu

SEQ ID NO: 1593756 - RNA, 15 nt, Human
cucuuagaugcaguu

SEQ ID NO: 1593757 - RNA, 21 nt, Human
cuccagugagacagcucugca

SEQ ID NO: 1593758 - RNA, 16 nt, Human
cucccugcaauaaaau

SEQ ID NO: 1593759 - RNA, 14 nt, Human
cucccugcaauaaa

SEQ ID NO: 1593760 - RNA, 15 nt, Human
ccagauccuggaaau

SEQ ID NO: 1593761 - RNA, 23 nt, Human
cccgggaggcagagguugcagug

SEQ ID NO: 1593762 - RNA, 23 nt, Human
cccauuguggucacaggaaguag

SEQ ID NO: 1593763 - RNA, 22 nt, Human
cccauuguggucacaggaagua

SEQ ID NO: 1593764 - RNA, 17 nt, Human
cccagccagcaguucag

SEQ ID NO: 1593765 - RNA, 20 nt, Human
cccagccagcaguucagagc

SEQ ID NO: 1593766 - RNA, 16 nt, Human
cccagccagcaguuca

SEQ ID NO: 1593767 - RNA, 24 nt, Human
cccagccagcaguucagagcugcc

SEQ ID NO: 1593768 - RNA, 20 nt, Human
cccauauuuguacaccaaua

SEQ ID NO: 1593769 - RNA, 17 nt, Human
ccucugcuugccauccc

SEQ ID NO: 1593770 - RNA, 13 nt, Human
ccucugcuugcca

SEQ ID NO: 1593771 - RNA, 20 nt, Human
ccucauguccacugguucuu

SEQ ID NO: 1593772 - RNA, 15 nt, Human
ccucauguccacugg

SEQ ID NO: 1593773 - RNA, 16 nt, Human
ccguagguuauuuuca

SEQ ID NO: 1593774 - RNA, 17 nt, Human
cccuucuuuccacagaa

SEQ ID NO: 1593775 - RNA, 15 nt, Human
auguguaaaauguga

SEQ ID NO: 1593776 - RNA, 16 nt, Human
auguuccuagugaaag

SEQ ID NO: 1593777 - RNA, 15 nt, Human
auguuccuagugaaa

SEQ ID NO: 1593778 - RNA, 17 nt, Human
auguuccuagugaaaga

SEQ ID NO: 1593779 - RNA, 21 nt, Human
augucaaucagccuaguugau

SEQ ID NO: 1593780 - RNA, 15 nt, Human
augugaacacaucag

SEQ ID NO: 1593781 - RNA, 16 nt, Human
augaucuuuaaaauac

SEQ ID NO: 1593782 - RNA, 21 nt, Human
augaugaucuuuaaaauacac

SEQ ID NO: 1593783 - RNA, 18 nt, Human
augaugaucuuuaaaaua

SEQ ID NO: 1593784 - RNA, 19 nt, Human
aucuaguaugaaauuauau

SEQ ID NO: 1593785 - RNA, 15 nt, Human
aucuaguaugaaauu

SEQ ID NO: 1593786 - RNA, 16 nt, Human
aucuaguaugaaauua

SEQ ID NO: 1593787 - RNA, 17 nt, Human
aucuaguaugaaauuau

SEQ ID NO: 1593788 - RNA, 18 nt, Human
aucuaguaugaaauuaua

SEQ ID NO: 1593789 - RNA, 14 nt, Human
aucuaguaugaaau

SEQ ID NO: 1593790 - RNA, 21 nt, Human
augaaguacucauacauguua

SEQ ID NO: 1593791 - RNA, 23 nt, Human
augaaguccaagcauuuagaugu

SEQ ID NO: 1593792 - RNA, 20 nt, Human
augaaguccaagcauuuaga

SEQ ID NO: 1593793 - RNA, 17 nt, Human
aucaugaauuaguuuua

SEQ ID NO: 1593794 - RNA, 22 nt, Human
aucagcuugcccuguuaaaaga

SEQ ID NO: 1593795 - RNA, 13 nt, Human
aucagcuuauugu

SEQ ID NO: 1593796 - RNA, 15 nt, Human
aucaaauaugcaaag

SEQ ID NO: 1593797 - RNA, 14 nt, Human
aucaaauaugcaaa

SEQ ID NO: 1593798 - RNA, 19 nt, Human
auccucaguuuuugugaaa

SEQ ID NO: 1593799 - RNA, 17 nt, Human
auauuauguguuuccau

SEQ ID NO: 1593800 - RNA, 13 nt, Human
auauuauguuaaa

SEQ ID NO: 1593801 - RNA, 16 nt, Human
auauuauguuaaaacu

SEQ ID NO: 1593802 - RNA, 14 nt, Human
auauuauguuaaaa

SEQ ID NO: 1593803 - RNA, 15 nt, Human
auagcagcuuauuca

SEQ ID NO: 1593804 - RNA, 18 nt, Human
auagcagcuuauucacaa

SEQ ID NO: 1593805 - RNA, 17 nt, Human
auacccagaaaguuauu

SEQ ID NO: 1593806 - RNA, 18 nt, Human
auaauguuucaaacauau

SEQ ID NO: 1593807 - RNA, 22 nt, Human
auaagccagacaucaacagaua

SEQ ID NO: 1593808 - RNA, 21 nt, Human
auaagccagacaucaacagau

SEQ ID NO: 1593809 - RNA, 13 nt, Human
auaauguuucaaa

SEQ ID NO: 1593810 - RNA, 22 nt, Human
auaaaaagccugcaauuucaua

SEQ ID NO: 1593811 - RNA, 20 nt, Human
auaaaaagccugcaauuuca

SEQ ID NO: 1593812 - RNA, 21 nt, Human
auaacaaugcuguauuuuaaa

SEQ ID NO: 1593813 - RNA, 20 nt, Human
auaacaaugcuguauuuuaa

SEQ ID NO: 1593814 - RNA, 19 nt, Human
auaacaaugcuguauuuua

SEQ ID NO: 1593815 - RNA, 17 nt, Human
auaacaaugcuguauuu

SEQ ID NO: 1593816 - RNA, 15 nt, Human
auaacaaugcuguau

SEQ ID NO: 1593817 - RNA, 14 nt, Human
auaacaaugaaagu

SEQ ID NO: 1593818 - RNA, 20 nt, Human
agugaauucuugaaggaaaa

SEQ ID NO: 1593819 - RNA, 11 nt, Human
aguccaagcau

SEQ ID NO: 1593820 - RNA, 13 nt, Human
aguauuuuugaca

SEQ ID NO: 1593821 - RNA, 18 nt, Human
aguauuuuugacagaaua

SEQ ID NO: 1593822 - RNA, 16 nt, Human
aguauuuuugacagaa

SEQ ID NO: 1593823 - RNA, 17 nt, Human
aguauuuuugacagaau

SEQ ID NO: 1593824 - RNA, 19 nt, Human
aguaacaaugaagauaaaa

SEQ ID NO: 1593825 - RNA, 23 nt, Human
aguaaaugcuagguuaauuccaa

SEQ ID NO: 1593826 - RNA, 11 nt, Human
aguaaaugcua

SEQ ID NO: 1593827 - RNA, 22 nt, Human
aguaaaugcuagguuaauucca

SEQ ID NO: 1593828 - RNA, 13 nt, Human
aguacucauacau

SEQ ID NO: 1593829 - RNA, 19 nt, Human
agugucaaugcagccccca

SEQ ID NO: 1593830 - RNA, 20 nt, Human
aguugaaaagacuccaaaga

SEQ ID NO: 1593831 - RNA, 19 nt, Human
aguugaaaagacuccaaag

SEQ ID NO: 1593832 - RNA, 18 nt, Human
aguugaaaagacuccaaa

SEQ ID NO: 1593833 - RNA, 21 nt, Human
aguugaaaagacuccaaagaa

SEQ ID NO: 1593834 - RNA, 23 nt, Human
aguucagagcugcccucuccugg

SEQ ID NO: 1593835 - RNA, 21 nt, Human
aguucagagcugcccucuccu

SEQ ID NO: 1593836 - RNA, 22 nt, Human
aguucagagcugcccucuccug

SEQ ID NO: 1593837 - RNA, 20 nt, Human
aguucagagcugcccucucc

SEQ ID NO: 1593838 - RNA, 14 nt, Human
agaugguucuagca

SEQ ID NO: 1593839 - RNA, 19 nt, Human
agaugaugaugaucuuuaa

SEQ ID NO: 1593840 - RNA, 19 nt, Human
agauguagaggagaaacug

SEQ ID NO: 1593841 - RNA, 23 nt, Human
agcaaagcugaugacaacuuccc

SEQ ID NO: 1593842 - RNA, 21 nt, Human
agcaaagcugaugacaacuuc

SEQ ID NO: 1593843 - RNA, 24 nt, Human
agcaaaauuuuuucucuaggaaau

SEQ ID NO: 1593844 - RNA, 19 nt, Human
agacccaaaaggcagaagc

SEQ ID NO: 1593845 - RNA, 17 nt, Human
agaaugauuaugaauua

SEQ ID NO: 1593846 - RNA, 22 nt, Human
agaaugagagacacacugaaga

SEQ ID NO: 1593847 - RNA, 17 nt, Human
agaaugagagacacacu

SEQ ID NO: 1593848 - RNA, 21 nt, Human
agaagugaaaaucuacacucc

SEQ ID NO: 1593849 - RNA, 22 nt, Human
agaagagcuguucacagccaga

SEQ ID NO: 1593850 - RNA, 18 nt, Human
agaagacugcauuauauu

SEQ ID NO: 1593851 - RNA, 13 nt, Human
agaagauagcagg

SEQ ID NO: 1593852 - RNA, 18 nt, Human
agacucugucucagucca

SEQ ID NO: 1593853 - RNA, 13 nt, Human
agaggaaugaagu

SEQ ID NO: 1593854 - RNA, 23 nt, Human
agcuaauguaauaacugugaagu

SEQ ID NO: 1593855 - RNA, 12 nt, Human
agcuacaaaugc

SEQ ID NO: 1593856 - RNA, 19 nt, Human
agcuccccucggagaagag

SEQ ID NO: 1593857 - RNA, 17 nt, Human
agcuccccucggagaag

SEQ ID NO: 1593858 - RNA, 20 nt, Human
agcuccccucggagaagagc

SEQ ID NO: 1593859 - RNA, 18 nt, Human
agcuucacuguaaaauaa

SEQ ID NO: 1593860 - RNA, 15 nt, Human
agggacugaggggag

SEQ ID NO: 1593861 - RNA, 23 nt, Human
aggccaugggcacuguggguaga

SEQ ID NO: 1593862 - RNA, 21 nt, Human
aggccaugggcacugugggua

SEQ ID NO: 1593863 - RNA, 15 nt, Human
agggauuagggagag

SEQ ID NO: 1593864 - RNA, 20 nt, Human
agggauuagggagagaagau

SEQ ID NO: 1593865 - RNA, 19 nt, Human
aaauaaaccucaaaauguc

SEQ ID NO: 1593866 - RNA, 20 nt, Human
aaauaaaaauauuguguugu

SEQ ID NO: 1593867 - RNA, 20 nt, Human
aaagcauuguaaaugugcuu

SEQ ID NO: 1593868 - RNA, 17 nt, Human
aaaccucaaaaugucua

SEQ ID NO: 1593869 - RNA, 22 nt, Human
aaaccucaaaaugucuaagaua

SEQ ID NO: 1593870 - RNA, 19 nt, Human
aaacccuugccaugugcua

SEQ ID NO: 1593871 - RNA, 21 nt, Human
aaacccugucucuacuaaaaa

SEQ ID NO: 1593872 - RNA, 13 nt, Human
aaagaaacauuug

SEQ ID NO: 1593873 - RNA, 21 nt, Human
aaaauuauuuuguucauacau

SEQ ID NO: 1593874 - RNA, 20 nt, Human
aaaauuauuuuguucauaca

SEQ ID NO: 1593875 - RNA, 16 nt, Human
aaaauuauuuuguuca

SEQ ID NO: 1593876 - RNA, 18 nt, Human
aaaauuauuuuguucaua

SEQ ID NO: 1593877 - RNA, 19 nt, Human
aaaauccauacauuugugu

SEQ ID NO: 1593878 - RNA, 14 nt, Human
aaauugauguguuu

SEQ ID NO: 1593879 - RNA, 21 nt, Human
aaauugauguguuuauuuaua

SEQ ID NO: 1593880 - RNA, 12 nt, Human
aacacaucagcu

SEQ ID NO: 1593881 - RNA, 20 nt, Human
aaauguucaucaaugaauga

SEQ ID NO: 1593882 - RNA, 20 nt, Human
aaaugcuagguuaauuccaa

SEQ ID NO: 1593883 - RNA, 14 nt, Human
aaaucuuaacuuga

SEQ ID NO: 1593884 - RNA, 17 nt, Human
aauaaaccucaaaaugu

SEQ ID NO: 1593885 - RNA, 10 nt, Human
aauaaaccau

SEQ ID NO: 1593886 - RNA, 14 nt, Human
aauaauaaauauuu

SEQ ID NO: 1593887 - RNA, 20 nt, Human
aauaaaccucaaaaugucua

SEQ ID NO: 1593888 - RNA, 22 nt, Human
aaguugauaugccuuuucccaa

SEQ ID NO: 1593889 - RNA, 12 nt, Human
aauaauguuuca

SEQ ID NO: 1593890 - RNA, 19 nt, Human
aauaauguuucaaacauau

SEQ ID NO: 1593891 - RNA, 14 nt, Human
aauaauguuucaaa

SEQ ID NO: 1593892 - RNA, 16 nt, Human
aaucaaauaugcaaag

SEQ ID NO: 1593893 - RNA, 15 nt, Human
aaucaaauaugcaaa

SEQ ID NO: 1593894 - RNA, 22 nt, Human
aaucaaauaugcaaagcacuga

SEQ ID NO: 1593895 - RNA, 16 nt, Human
aaugauaacuggaaac

SEQ ID NO: 1593896 - RNA, 15 nt, Human
aaugauaacuggaaa

SEQ ID NO: 1593897 - RNA, 14 nt, Human
aaugauaacuggaa

SEQ ID NO: 1593898 - RNA, 17 nt, Human
aauccauacauuugugu

SEQ ID NO: 1593899 - RNA, 16 nt, Human
aauccauacauuugug

SEQ ID NO: 1593900 - RNA, 13 nt, Human
aagauuuucagaa

SEQ ID NO: 1593901 - RNA, 15 nt, Human
aagcagggacuugaa

SEQ ID NO: 1593902 - RNA, 14 nt, Human
aagauagcagggca

SEQ ID NO: 1593903 - RNA, 21 nt, Human
aagacauucuuccaaaaagau

SEQ ID NO: 1593904 - RNA, 23 nt, Human
aagacagugaaagaaaauaacaa

SEQ ID NO: 1593905 - RNA, 15 nt, Human
aagagaacuuccaga

SEQ ID NO: 1593906 - RNA, 19 nt, Human
aagccagauuuuccugaaa

SEQ ID NO: 1593907 - RNA, 17 nt, Human
aagggauggcaagaugu

SEQ ID NO: 1593908 - RNA, 14 nt, Human
aagggauggcaaga

SEQ ID NO: 1593909 - RNA, 12 nt, Human
aaguagaggagg

SEQ ID NO: 1593910 - RNA, 20 nt, Human
acauaaguaauucaagaaaa

SEQ ID NO: 1593911 - RNA, 15 nt, Human
acauaaguaauucaa

SEQ ID NO: 1593912 - RNA, 19 nt, Human
acauaauuaaauuuugagu

SEQ ID NO: 1593913 - RNA, 21 nt, Human
acagugauuaccagggacuga

SEQ ID NO: 1593914 - RNA, 20 nt, Human
accaaggcugauuaaaccaa

SEQ ID NO: 1593915 - RNA, 19 nt, Human
accaaggcugauuaaacca

SEQ ID NO: 1593916 - RNA, 16 nt, Human
acagaagcuccaggua

SEQ ID NO: 1593917 - RNA, 18 nt, Human
aauuuugugaagcaaaau

SEQ ID NO: 1593918 - RNA, 17 nt, Human
aauuuugugaagcaaaa

SEQ ID NO: 1593919 - RNA, 16 nt, Human
acaagaaaugaaagca

SEQ ID NO: 1593920 - RNA, 15 nt, Human
acaagaaaugaaagc

SEQ ID NO: 1593921 - RNA, 22 nt, Human
acaagaaaugaaagcagggacu

SEQ ID NO: 1593922 - RNA, 21 nt, Human
acaaggaugaauuaaguuuuu

SEQ ID NO: 1593923 - RNA, 22 nt, Human
aauuucauaccuaucaucuuaa

SEQ ID NO: 1593924 - RNA, 17 nt, Human
acucugucucaguccau

SEQ ID NO: 1593925 - RNA, 15 nt, Human
acucugucucagucc

SEQ ID NO: 1593926 - RNA, 20 nt, Human
acucuuaagaagacugcauu

SEQ ID NO: 1593927 - RNA, 15 nt, Human
acucuuaagaagacu

SEQ ID NO: 1593928 - RNA, 14 nt, Human
acucuuaagaagac

SEQ ID NO: 1593929 - RNA, 22 nt, Human
acuugggaggcugagaugggag

SEQ ID NO: 1593930 - RNA, 17 nt, Human
acuuuaugcuaagugaa

SEQ ID NO: 1593931 - RNA, 12 nt, Human
acuuuaugcuaa

SEQ ID NO: 1593932 - RNA, 14 nt, Human
acuuaaaaaugguu

SEQ ID NO: 1593933 - RNA, 13 nt, Human
acuuaaaaauggu

SEQ ID NO: 1593934 - RNA, 21 nt, Human
acuuaaaaaugguuuaaaugg

SEQ ID NO: 1593935 - RNA, 19 nt, Human
acuucagcgguuuauauaa

SEQ ID NO: 1593936 - RNA, 18 nt, Human
acuucagcgguuuauaua

SEQ ID NO: 1593937 - RNA, 20 nt, Human
acuucaaauccuugaagauu

SEQ ID NO: 1593938 - RNA, 20 nt, Human
accucugccucagaaaacaa

SEQ ID NO: 1593939 - RNA, 18 nt, Human
accucugccucagaaaac

SEQ ID NO: 1593940 - RNA, 17 nt, Human
accucugccucagaaaa

SEQ ID NO: 1593941 - RNA, 19 nt, Human
acggacgaaccuugaaaac

SEQ ID NO: 1593942 - RNA, 18 nt, Human
acuaguauuucuaugaaa

SEQ ID NO: 1593943 - RNA, 19 nt, Human
acuaguauuucuaugaaau

SEQ ID NO: 1593944 - RNA, 14 nt, Human
cauauuuuucacau

SEQ ID NO: 1593945 - RNA, 21 nt, Human
cauauuuuucacauaucuagu

SEQ ID NO: 1593946 - RNA, 18 nt, Human
caucaaugaaugaaugaa

SEQ ID NO: 1593947 - RNA, 22 nt, Human
caucaagucuuucacauuuaaa

SEQ ID NO: 1593948 - RNA, 18 nt, Human
cauauuuuucacauaucu

SEQ ID NO: 1593949 - RNA, 20 nt, Human
caucccucccuccaccuccc

SEQ ID NO: 1593950 - RNA, 14 nt, Human
caucccucccucca

SEQ ID NO: 1593951 - RNA, 12 nt, Human
caucccucccuc

SEQ ID NO: 1593952 - RNA, 13 nt, Human
caucccucccucc

SEQ ID NO: 1593953 - RNA, 22 nt, Human
caucuagugagcagucaggaaa

SEQ ID NO: 1593954 - RNA, 14 nt, Human
caucuagugagcag

SEQ ID NO: 1593955 - RNA, 15 nt, Human
cauacauuguacgaa

SEQ ID NO: 1593956 - RNA, 12 nt, Human
cauacauauuuu

SEQ ID NO: 1593957 - RNA, 19 nt, Human
cauacauauuuuuguagca

SEQ ID NO: 1593958 - RNA, 17 nt, Human
cauaccaacacgagcag

SEQ ID NO: 1593959 - RNA, 11 nt, Human
cauacauauuu

SEQ ID NO: 1593960 - RNA, 16 nt, Human
cauaaguaauucaaga

SEQ ID NO: 1593961 - RNA, 17 nt, Human
cauaaguaauucaagaa

SEQ ID NO: 1593962 - RNA, 18 nt, Human
cauaaguaauucaagaaa

SEQ ID NO: 1593963 - RNA, 22 nt, Human
cauaaguaauucaagaaaacaa

SEQ ID NO: 1593964 - RNA, 23 nt, Human
cauaaaaagccugcaauuucaua

SEQ ID NO: 1593965 - RNA, 17 nt, Human
cauaaaaacaacuuuau

SEQ ID NO: 1593966 - RNA, 20 nt, Human
cauaaaaacaacuuuauacc

SEQ ID NO: 1593967 - RNA, 21 nt, Human
cauaaaaacaacuuuauaccc

SEQ ID NO: 1593968 - RNA, 23 nt, Human
cauaaaaacaacuuuauacccag

SEQ ID NO: 1593969 - RNA, 15 nt, Human
cauaaaaacaacuuu

SEQ ID NO: 1593970 - RNA, 20 nt, Human
caguuuucugagaaagacua

SEQ ID NO: 1593971 - RNA, 19 nt, Human
caguuuucugagaaagacu

SEQ ID NO: 1593972 - RNA, 15 nt, Human
caguuuucugagaaa

SEQ ID NO: 1593973 - RNA, 14 nt, Human
caguuuucugagaa

SEQ ID NO: 1593974 - RNA, 14 nt, Human
caguugaaaagacu

SEQ ID NO: 1593975 - RNA, 18 nt, Human
caguugaaaagacuccaa

SEQ ID NO: 1593976 - RNA, 22 nt, Human
caguugaaaagacuccaaagaa

SEQ ID NO: 1593977 - RNA, 21 nt, Human
caguugaaaagacuccaaaga

SEQ ID NO: 1593978 - RNA, 23 nt, Human
caguugaaaagacuccaaagaaa

SEQ ID NO: 1593979 - RNA, 23 nt, Human
cagugugucuaaauuugaauguu

SEQ ID NO: 1593980 - RNA, 14 nt, Human
cagugugucuaaau

SEQ ID NO: 1593981 - RNA, 14 nt, Human
cagugucaaugcag

SEQ ID NO: 1593982 - RNA, 22 nt, Human
caguucggugagcuacaaaugc

SEQ ID NO: 1593983 - RNA, 12 nt, Human
caguucugaaga

SEQ ID NO: 1593984 - RNA, 14 nt, Human
caguucugaagaag

SEQ ID NO: 1593985 - RNA, 13 nt, Human
caguucugaagaa

SEQ ID NO: 1593986 - RNA, 22 nt, Human
caguucugaagaagaugguacc

SEQ ID NO: 1593987 - RNA, 16 nt, Human
caguucugaagaagau

SEQ ID NO: 1593988 - RNA, 15 nt, Human
caguucugaagaaga

SEQ ID NO: 1593989 - RNA, 21 nt, Human
caguuaccucugccucagaaa

SEQ ID NO: 1593990 - RNA, 17 nt, Human
caugggacagggaggac

SEQ ID NO: 1593991 - RNA, 23 nt, Human
caugggacagggaggacgcucuc

SEQ ID NO: 1593992 - RNA, 23 nt, Human
caugcugucuacacuaagagaga

SEQ ID NO: 1593993 - RNA, 20 nt, Human
ccaauauucauagcagcuua

SEQ ID NO: 1593994 - RNA, 19 nt, Human
ccaaggcugauuaaaccaa

SEQ ID NO: 1593995 - RNA, 22 nt, Human
ccacaagaaaugaaagcaggga

SEQ ID NO: 1593996 - RNA, 16 nt, Human
ccacaagaaaugaaag

SEQ ID NO: 1593997 - RNA, 18 nt, Human
ccaaggcuagaaccaccu

SEQ ID NO: 1593998 - RNA, 14 nt, Human
ccaacacgagcagg

SEQ ID NO: 1593999 - RNA, 23 nt, Human
ccaaauuucauaccuaucaucuu

SEQ ID NO: 1594000 - RNA, 21 nt, Human
ccaacacgagcaggcuacugu

SEQ ID NO: 1594001 - RNA, 17 nt, Human
ccaaagaaauguaaggg

SEQ ID NO: 1594002 - RNA, 18 nt, Human
cauuugcucauggaauug

SEQ ID NO: 1594003 - RNA, 16 nt, Human
cauuugcucauggaau

SEQ ID NO: 1594004 - RNA, 14 nt, Human
cauuugcucaugga

SEQ ID NO: 1594005 - RNA, 15 nt, Human
cauuugcucauggaa

SEQ ID NO: 1594006 - RNA, 19 nt, Human
cauuuaaagcuuauuaaaa

SEQ ID NO: 1594007 - RNA, 23 nt, Human
cauuucugcaucagcugcugaaa

SEQ ID NO: 1594008 - RNA, 15 nt, Human
ccauccugaggcucc

SEQ ID NO: 1594009 - RNA, 16 nt, Human
ccauccugaggcucca

SEQ ID NO: 1594010 - RNA, 19 nt, Human
ccagccugagcgacaguga

SEQ ID NO: 1594011 - RNA, 23 nt, Human
ccauggcacucuauguucuaaga

SEQ ID NO: 1594012 - RNA, 14 nt, Human
ccccaggugccagu

SEQ ID NO: 1594013 - RNA, 20 nt, Human
cccucccuccaccucccugc

SEQ ID NO: 1594014 - RNA, 13 nt, Human
cccucccuccacc

SEQ ID NO: 1594015 - RNA, 14 nt, Human
cccugcaauaaaau

SEQ ID NO: 1594016 - RNA, 15 nt, Human
cccugcaauaaaaug

SEQ ID NO: 1594017 - RNA, 13 nt, Human
ccuaaacauauga

SEQ ID NO: 1594018 - RNA, 22 nt, Human
ccgggaggcagagguugcagug

SEQ ID NO: 1594019 - RNA, 12 nt, Human
ccuccccuccuc

SEQ ID NO: 1594020 - RNA, 13 nt, Human
ccuccccuccucu

SEQ ID NO: 1594021 - RNA, 14 nt, Human
ccuccccuccucug

SEQ ID NO: 1594022 - RNA, 13 nt, Human
ccuccauccugag

SEQ ID NO: 1594023 - RNA, 12 nt, Human
ccuccauccuga

SEQ ID NO: 1594024 - RNA, 14 nt, Human
ccuccauccugagg

SEQ ID NO: 1594025 - RNA, 19 nt, Human
cuaauguaauaacugugaa

SEQ ID NO: 1594026 - RNA, 17 nt, Human
cuacacuccagugagac

SEQ ID NO: 1594027 - RNA, 16 nt, Human
cuacacuccagugaga

SEQ ID NO: 1594028 - RNA, 14 nt, Human
cuaagcaaaaugug

SEQ ID NO: 1594029 - RNA, 18 nt, Human
cuaagcaaaaugugauau

SEQ ID NO: 1594030 - RNA, 15 nt, Human
cuaagcaaaauguga

SEQ ID NO: 1594031 - RNA, 19 nt, Human
cuacuugggaggcugagau

SEQ ID NO: 1594032 - RNA, 18 nt, Human
cuacuugggaggcugaga

SEQ ID NO: 1594033 - RNA, 15 nt, Human
cuacuugggaggcug

SEQ ID NO: 1594034 - RNA, 16 nt, Human
cuaguaugaaauuaua

SEQ ID NO: 1594035 - RNA, 23 nt, Human
cuaguaucaaaagaaagaaaauc

SEQ ID NO: 1594036 - RNA, 17 nt, Human
cuaguaucaaaagaaag

SEQ ID NO: 1594037 - RNA, 15 nt, Human
cuaguaucaaaagaa

SEQ ID NO: 1594038 - RNA, 20 nt, Human
cuaguauuucuaugaaauau

SEQ ID NO: 1594039 - RNA, 19 nt, Human
cuaguauuucuaugaaaua

SEQ ID NO: 1594040 - RNA, 22 nt, Human
cuaguauuucuaugaaauauua

SEQ ID NO: 1594041 - RNA, 18 nt, Human
cuaugacauaaaaacaac

SEQ ID NO: 1594042 - RNA, 18 nt, Human
cuaugaaauauuauguua

SEQ ID NO: 1594043 - RNA, 13 nt, Human
cuaugaaauauua

SEQ ID NO: 1594044 - RNA, 22 nt, Human
cuauauuuuuuguuaaaugauu

SEQ ID NO: 1594045 - RNA, 20 nt, Human
cuauauuuuuuguuaaauga

SEQ ID NO: 1594046 - RNA, 19 nt, Human
cuauauuguuugcuaagca

SEQ ID NO: 1594047 - RNA, 21 nt, Human
cuaugacauaaaaacaacuuu

SEQ ID NO: 1594048 - RNA, 17 nt, Human
cucaccccuugccauaa

SEQ ID NO: 1594049 - RNA, 13 nt, Human
cucacauuuauau

SEQ ID NO: 1594050 - RNA, 23 nt, Human
cuaaauuugaauguuaagcagau

SEQ ID NO: 1594051 - RNA, 23 nt, Human
cuaaauugacacuuaaaaauggu

SEQ ID NO: 1594052 - RNA, 22 nt, Human
cggucggguuuuauuguuuaaa

SEQ ID NO: 1594053 - RNA, 17 nt, Human
cggugagcuacaaaugc

SEQ ID NO: 1594054 - RNA, 21 nt, Human
cggguuuuauuguuuaaaauc

SEQ ID NO: 1594055 - RNA, 14 nt, Human
cggccuccauccug

SEQ ID NO: 1594056 - RNA, 12 nt, Human
cggccuccaucc

SEQ ID NO: 1594057 - RNA, 18 nt, Human
cgcucucuggccuucggc

SEQ ID NO: 1594058 - RNA, 15 nt, Human
cgcucucuggccuuc

SEQ ID NO: 1594059 - RNA, 14 nt, Human
cgcucucuggccuu

SEQ ID NO: 1594060 - RNA, 21 nt, Human
cucuccugauagucuuucagu

SEQ ID NO: 1594061 - RNA, 20 nt, Human
cucuccugggcagcugccuc

SEQ ID NO: 1594062 - RNA, 12 nt, Human
cucuccugggca

SEQ ID NO: 1594063 - RNA, 15 nt, Human
cucuccugggcagcu

SEQ ID NO: 1594064 - RNA, 16 nt, Human
cucuccugggcagcug

SEQ ID NO: 1594065 - RNA, 18 nt, Human
cucuccugggcagcugcc

SEQ ID NO: 1594066 - RNA, 19 nt, Human
cucuccugggcagcugccu

SEQ ID NO: 1594067 - RNA, 17 nt, Human
cucuaggaaauauuuau

SEQ ID NO: 1594068 - RNA, 15 nt, Human
cucuaggaaauauuu

SEQ ID NO: 1594069 - RNA, 20 nt, Human
cuccauccugaggcuccacu

SEQ ID NO: 1594070 - RNA, 18 nt, Human
cuccauccugaggcucca

SEQ ID NO: 1594071 - RNA, 16 nt, Human
cuccauccugaggcuc

SEQ ID NO: 1594072 - RNA, 11 nt, Human
cuccauccuga

SEQ ID NO: 1594073 - RNA, 15 nt, Human
cucccuccaccuccc

SEQ ID NO: 1594074 - RNA, 17 nt, Human
cucccuccaccucccug

SEQ ID NO: 1594075 - RNA, 15 nt, Human
cugacuaugacauaa

SEQ ID NO: 1594076 - RNA, 17 nt, Human
cugacucuuaagaagac

SEQ ID NO: 1594077 - RNA, 15 nt, Human
cugacuucuaaguaa

SEQ ID NO: 1594078 - RNA, 13 nt, Human
cugacuucuaagu

SEQ ID NO: 1594079 - RNA, 16 nt, Human
cugacuucuaaguaaa

SEQ ID NO: 1594080 - RNA, 23 nt, Human
cugagaaagacuauucaaacagu

SEQ ID NO: 1594081 - RNA, 11 nt, Human
cugacagauuu

SEQ ID NO: 1594082 - RNA, 15 nt, Human
cugacagauuuccau

SEQ ID NO: 1594083 - RNA, 20 nt, Human
cugagcgacagugagacucu

SEQ ID NO: 1594084 - RNA, 16 nt, Human
cugagcgacagugaga

SEQ ID NO: 1594085 - RNA, 12 nt, Human
cucugcuugcca

SEQ ID NO: 1594086 - RNA, 14 nt, Human
cucugcuugccauc

SEQ ID NO: 1594087 - RNA, 17 nt, Human
cucugcuugccaucccu

SEQ ID NO: 1594088 - RNA, 20 nt, Human
cucugcuugccaucccuccc

SEQ ID NO: 1594089 - RNA, 19 nt, Human
cucuggccuucggccucca

SEQ ID NO: 1594090 - RNA, 12 nt, Human
cucuggccuucg

SEQ ID NO: 1594091 - RNA, 23 nt, Human
cugaagaagcaccaaucaugaau

SEQ ID NO: 1594092 - RNA, 22 nt, Human
cucuucuuuaaagggauggcaa

SEQ ID NO: 1594093 - RNA, 18 nt, Human
cugucucuacuaaaaaua

SEQ ID NO: 1594094 - RNA, 19 nt, Human
cuguauuuuaaaagaauga

SEQ ID NO: 1594095 - RNA, 16 nt, Human
cuguauuuuaaaagaa

SEQ ID NO: 1594096 - RNA, 13 nt, Human
cuguauuuuaaaa

SEQ ID NO: 1594097 - RNA, 15 nt, Human
cuguaugauucccag

SEQ ID NO: 1594098 - RNA, 15 nt, Human
cuggccuucggccuc

SEQ ID NO: 1594099 - RNA, 21 nt, Human
cuggccuucggccuccauccu

SEQ ID NO: 1594100 - RNA, 18 nt, Human
cuggccuucggccuccau

SEQ ID NO: 1594101 - RNA, 17 nt, Human
cuggccuucggccucca

SEQ ID NO: 1594102 - RNA, 16 nt, Human
cuggccuucggccucc

SEQ ID NO: 1594103 - RNA, 18 nt, Human
cugcuugccaucccuccc

SEQ ID NO: 1594104 - RNA, 19 nt, Human
cugcuugccaucccucccu

SEQ ID NO: 1594105 - RNA, 20 nt, Human
cugcuugccaucccucccuc

SEQ ID NO: 1594106 - RNA, 22 nt, Human
cugcuugccaucccucccucca

SEQ ID NO: 1594107 - RNA, 16 nt, Human
cugcuugccaucccuc

SEQ ID NO: 1594108 - RNA, 15 nt, Human
cugcuugccaucccu

SEQ ID NO: 1594109 - RNA, 12 nt, Human
cugcccucuccu

SEQ ID NO: 1594110 - RNA, 13 nt, Human
cugcccucuccug

SEQ ID NO: 1594111 - RNA, 14 nt, Human
cugcccucuccugg

SEQ ID NO: 1594112 - RNA, 15 nt, Human
cugcccucuccuggg

SEQ ID NO: 1594113 - RNA, 20 nt, Human
cugcaucagcugcugaaaca

SEQ ID NO: 1594114 - RNA, 15 nt, Human
cugccagcaacgcag

SEQ ID NO: 1594115 - RNA, 12 nt, Human
cugcacugucaa

SEQ ID NO: 1594116 - RNA, 16 nt, Human
cuuuggaacaagaugg

SEQ ID NO: 1594117 - RNA, 19 nt, Human
cuuuccucaaaacuucaga

SEQ ID NO: 1594118 - RNA, 23 nt, Human
cuugcaucaauuuuucuuauuuc

SEQ ID NO: 1594119 - RNA, 21 nt, Human
cuugcaugguuuagaaagcuu

SEQ ID NO: 1594120 - RNA, 20 nt, Human
cuugaacccgggaggcagag

SEQ ID NO: 1594121 - RNA, 19 nt, Human
cuugaacccgggaggcaga

SEQ ID NO: 1594122 - RNA, 19 nt, Human
cuucuuuccacagaagcuc

SEQ ID NO: 1594123 - RNA, 13 nt, Human
cuucuuuccacag

SEQ ID NO: 1594124 - RNA, 17 nt, Human
cuugccaaauauaaaua

SEQ ID NO: 1594125 - RNA, 18 nt, Human
cuuguaaaggaauuuaaa

SEQ ID NO: 1594126 - RNA, 20 nt, Human
gaagaguauuuuugacagaa

SEQ ID NO: 1594127 - RNA, 23 nt, Human
gaagagcuguucacagccagacu

SEQ ID NO: 1594128 - RNA, 20 nt, Human
gaagagcuguucacagccag

SEQ ID NO: 1594129 - RNA, 15 nt, Human
gaagagcuguucaca

SEQ ID NO: 1594130 - RNA, 13 nt, Human
gaagagcuguuca

SEQ ID NO: 1594131 - RNA, 17 nt, Human
gaagauguagaggagaa

SEQ ID NO: 1594132 - RNA, 22 nt, Human
gaacuuguaaaggaauuuaaaa

SEQ ID NO: 1594133 - RNA, 16 nt, Human
gaacucccuuucaaca

SEQ ID NO: 1594134 - RNA, 15 nt, Human
gaaccacaagacugc

SEQ ID NO: 1594135 - RNA, 14 nt, Human
gaaccacaagacug

SEQ ID NO: 1594136 - RNA, 23 nt, Human
gaaguccaagcauuuagauguau

SEQ ID NO: 1594137 - RNA, 23 nt, Human
gaaaguuauugauaaguucauac

SEQ ID NO: 1594138 - RNA, 14 nt, Human
gaaagcagaacagu

SEQ ID NO: 1594139 - RNA, 13 nt, Human
gaaagcagaacag

SEQ ID NO: 1594140 - RNA, 23 nt, Human
gaaagacuauucaaacagucuca

SEQ ID NO: 1594141 - RNA, 22 nt, Human
gaaagacuauucaaacagucuc

SEQ ID NO: 1594142 - RNA, 19 nt, Human
gaaagacuauucaaacagu

SEQ ID NO: 1594143 - RNA, 15 nt, Human
gaaacugccagcaac

SEQ ID NO: 1594144 - RNA, 13 nt, Human
gaaacugccagca

SEQ ID NO: 1594145 - RNA, 18 nt, Human
gaacagauaaucagugug

SEQ ID NO: 1594146 - RNA, 24 nt, Human
gaacaguuaccucugccucagaaa

SEQ ID NO: 1594147 - RNA, 17 nt, Human
gaaauuauauaaguauu

SEQ ID NO: 1594148 - RNA, 23 nt, Human
gaaauuauauaaguauucuaaau

SEQ ID NO: 1594149 - RNA, 13 nt, Human
gaaauauuuauuu

SEQ ID NO: 1594150 - RNA, 16 nt, Human
gaaauauuuauuuuaa

SEQ ID NO: 1594151 - RNA, 15 nt, Human
gaaauauuuauuuua

SEQ ID NO: 1594152 - RNA, 18 nt, Human
gagcugcccucuccuggg

SEQ ID NO: 1594153 - RNA, 19 nt, Human
gagcugcccucuccugggc

SEQ ID NO: 1594154 - RNA, 21 nt, Human
gagcugcccucuccugggcag

SEQ ID NO: 1594155 - RNA, 23 nt, Human
gagcugcccucuccugggcagcu

SEQ ID NO: 1594156 - RNA, 16 nt, Human
gagcucgugggacagu

SEQ ID NO: 1594157 - RNA, 13 nt, Human
gagacagcucugc

SEQ ID NO: 1594158 - RNA, 18 nt, Human
gagacagcucugcauacu

SEQ ID NO: 1594159 - RNA, 15 nt, Human
gagacagcucugcau

SEQ ID NO: 1594160 - RNA, 15 nt, Human
gagagugaacaaauu

SEQ ID NO: 1594161 - RNA, 19 nt, Human
gagagugaacaaauuuaca

SEQ ID NO: 1594162 - RNA, 17 nt, Human
gagauacagaauuuuau

SEQ ID NO: 1594163 - RNA, 19 nt, Human
gagagacacacugaagaag

SEQ ID NO: 1594164 - RNA, 18 nt, Human
gagaaagacuauucaaac

SEQ ID NO: 1594165 - RNA, 17 nt, Human
gagaaagacuauucaaa

SEQ ID NO: 1594166 - RNA, 15 nt, Human
gagaaagacuauuca

SEQ ID NO: 1594167 - RNA, 13 nt, Human
gagaaagacuauu

SEQ ID NO: 1594168 - RNA, 18 nt, Human
gagacacacugaagaagc

SEQ ID NO: 1594169 - RNA, 22 nt, Human
gagaagagcuguucacagccag

SEQ ID NO: 1594170 - RNA, 15 nt, Human
gagaagagcuguuca

SEQ ID NO: 1594171 - RNA, 16 nt, Human
gagaagaacugaaauc

SEQ ID NO: 1594172 - RNA, 14 nt, Human
gagaagaacugaaa

SEQ ID NO: 1594173 - RNA, 13 nt, Human
gagaagaacugaa

SEQ ID NO: 1594174 - RNA, 23 nt, Human
gaccugauuucugagcauuuaau

SEQ ID NO: 1594175 - RNA, 22 nt, Human
gacaugggacauuugcucaugg

SEQ ID NO: 1594176 - RNA, 14 nt, Human
gacaucaacagaua

SEQ ID NO: 1594177 - RNA, 15 nt, Human
gacaagcucacagac

SEQ ID NO: 1594178 - RNA, 20 nt, Human
gcauauuuuucacauaucua

SEQ ID NO: 1594179 - RNA, 14 nt, Human
gcauauuuuucaca

SEQ ID NO: 1594180 - RNA, 15 nt, Human
gcauauuuuucacau

SEQ ID NO: 1594181 - RNA, 16 nt, Human
gcauauuuuucacaua

SEQ ID NO: 1594182 - RNA, 19 nt, Human
gcauauuuuucacauaucu

SEQ ID NO: 1594183 - RNA, 15 nt, Human
gcaguugaaaagacu

SEQ ID NO: 1594184 - RNA, 17 nt, Human
gcauagguuuaauaauu

SEQ ID NO: 1594185 - RNA, 16 nt, Human
gcaguucagagcugcc

SEQ ID NO: 1594186 - RNA, 15 nt, Human
gcaguucugaagaag

SEQ ID NO: 1594187 - RNA, 17 nt, Human
gcaguucagagcugccc

SEQ ID NO: 1594188 - RNA, 18 nt, Human
gcaguucagagcugcccu

SEQ ID NO: 1594189 - RNA, 17 nt, Human
gcaguucugaagaagau

SEQ ID NO: 1594190 - RNA, 19 nt, Human
gcaguucagagcugcccuc

SEQ ID NO: 1594191 - RNA, 13 nt, Human
gcauagaaguaaa

SEQ ID NO: 1594192 - RNA, 13 nt, Human
gcauuauauuuau

SEQ ID NO: 1594193 - RNA, 12 nt, Human
gcaucagcugcu

SEQ ID NO: 1594194 - RNA, 20 nt, Human
gcagccccgugggguuccuc

SEQ ID NO: 1594195 - RNA, 18 nt, Human
gcagauaaacaguaguga

SEQ ID NO: 1594196 - RNA, 17 nt, Human
gaugacaacuucccagu

SEQ ID NO: 1594197 - RNA, 21 nt, Human
gauggcuaguaucaaaagaaa

SEQ ID NO: 1594198 - RNA, 14 nt, Human
gaugaaaauauuug

SEQ ID NO: 1594199 - RNA, 13 nt, Human
gauccuggaaauc

SEQ ID NO: 1594200 - RNA, 12 nt, Human
gauaaguucaua

SEQ ID NO: 1594201 - RNA, 14 nt, Human
gauaaguucauaca

SEQ ID NO: 1594202 - RNA, 16 nt, Human
gauaaguucauacauu

SEQ ID NO: 1594203 - RNA, 22 nt, Human
gauaaauaguuuaugauuccac

SEQ ID NO: 1594204 - RNA, 13 nt, Human
gauagcagggcau

SEQ ID NO: 1594205 - RNA, 23 nt, Human
gauagauaggucagugcaaauac

SEQ ID NO: 1594206 - RNA, 22 nt, Human
gauagucuuucaguuaaggaga

SEQ ID NO: 1594207 - RNA, 15 nt, Human
gauaguaacaaugaa

SEQ ID NO: 1594208 - RNA, 14 nt, Human
gauagucuuucagu

SEQ ID NO: 1594209 - RNA, 10 nt, Human
gcaagccaga

SEQ ID NO: 1594210 - RNA, 14 nt, Human
gcaagggugauggg

SEQ ID NO: 1594211 - RNA, 15 nt, Human
gauuuuccugaaaac

SEQ ID NO: 1594212 - RNA, 15 nt, Human
gccugcaauuucaua

SEQ ID NO: 1594213 - RNA, 12 nt, Human
gcgacagugaga

SEQ ID NO: 1594214 - RNA, 22 nt, Human
gcgacagugagacucugucuca

SEQ ID NO: 1594215 - RNA, 13 nt, Human
gcuauaggugcua

SEQ ID NO: 1594216 - RNA, 19 nt, Human
gcuagaacucccuuucaac

SEQ ID NO: 1594217 - RNA, 17 nt, Human
gccuccccuccucugcu

SEQ ID NO: 1594218 - RNA, 19 nt, Human
gccuccccuccucugcuug

SEQ ID NO: 1594219 - RNA, 20 nt, Human
gccuccccuccucugcuugc

SEQ ID NO: 1594220 - RNA, 22 nt, Human
gccuccccuccucugcuugcca

SEQ ID NO: 1594221 - RNA, 23 nt, Human
gccuccccuccucugcuugccau

SEQ ID NO: 1594222 - RNA, 20 nt, Human
gccgggcgugguggugagug

SEQ ID NO: 1594223 - RNA, 18 nt, Human
gccaucccucccuccacc

SEQ ID NO: 1594224 - RNA, 23 nt, Human
gccaucccucccuccaccucccu

SEQ ID NO: 1594225 - RNA, 19 nt, Human
uuuuguagcacugacagau

SEQ ID NO: 1594226 - RNA, 18 nt, Human
uuuuguagcacugacaga

SEQ ID NO: 1594227 - RNA, 18 nt, Human
uuuuuaaaaaagaaacau

SEQ ID NO: 1594228 - RNA, 20 nt, Human
uuuugaaucucauaauuuau

SEQ ID NO: 1594229 - RNA, 11 nt, Human
uuuugacagaa

SEQ ID NO: 1594230 - RNA, 18 nt, Human
uuuuggucuggagggaag

SEQ ID NO: 1594231 - RNA, 14 nt, Human
uuuuccugaaaacc

SEQ ID NO: 1594232 - RNA, 15 nt, Human
uuuuugaagcuguau

SEQ ID NO: 1594233 - RNA, 19 nt, Human
uuuuucucuaggaaauauu

SEQ ID NO: 1594234 - RNA, 21 nt, Human
uuugaaucucauaauuuauac

SEQ ID NO: 1594235 - RNA, 22 nt, Human
uuugaaucucauaauuuauaca

SEQ ID NO: 1594236 - RNA, 16 nt, Human
uuugaaucucauaauu

SEQ ID NO: 1594237 - RNA, 19 nt, Human
uuugaaucucauaauuuau

SEQ ID NO: 1594238 - RNA, 20 nt, Human
uuugaaucucauaauuuaua

SEQ ID NO: 1594239 - RNA, 18 nt, Human
uuugaaucaucaagucuu

SEQ ID NO: 1594240 - RNA, 17 nt, Human
uuucuuauuucauuucu

SEQ ID NO: 1594241 - RNA, 13 nt, Human
uuucugagaaaga

SEQ ID NO: 1594242 - RNA, 15 nt, Human
uuucugagaaagacu

SEQ ID NO: 1594243 - RNA, 20 nt, Human
uuuuaauaauguuucaaaca

SEQ ID NO: 1594244 - RNA, 21 nt, Human
uuuuaaaagaaugauuaugaa

SEQ ID NO: 1594245 - RNA, 16 nt, Human
uuuguauaaaauaauu

SEQ ID NO: 1594246 - RNA, 14 nt, Human
uuuguauaaaauaa

SEQ ID NO: 1594247 - RNA, 13 nt, Human
uuuguauaaaaua

SEQ ID NO: 1594248 - RNA, 14 nt, Human
guagcacugacaga

SEQ ID NO: 1594249 - RNA, 15 nt, Human
guagcacugacagau

SEQ ID NO: 1594250 - RNA, 18 nt, Human
gcuauaggugcuacaaaa

SEQ ID NO: 1594251 - RNA, 19 nt, Human
gcuauaggugcuacaaaaa

SEQ ID NO: 1594252 - RNA, 17 nt, Human
guaguguuggagaagaa

SEQ ID NO: 1594253 - RNA, 15 nt, Human
guaguguuggagaag

SEQ ID NO: 1594254 - RNA, 14 nt, Human
guaguguuggagaa

SEQ ID NO: 1594255 - RNA, 13 nt, Human
guaugaaauuaua

SEQ ID NO: 1594256 - RNA, 23 nt, Human
guaugaaauuauauaaguauucu

SEQ ID NO: 1594257 - RNA, 17 nt, Human
guauguuagugcaaauu

SEQ ID NO: 1594258 - RNA, 15 nt, Human
gucaaugcagccccc

SEQ ID NO: 1594259 - RNA, 22 nt, Human
gucaauaaaauccauacauuug

SEQ ID NO: 1594260 - RNA, 23 nt, Human
gucaauaaaauccauacauuugu

SEQ ID NO: 1594261 - RNA, 13 nt, Human
guauuuuaaucac

SEQ ID NO: 1594262 - RNA, 20 nt, Human
guauuuuaaaagaaugauua

SEQ ID NO: 1594263 - RNA, 19 nt, Human
gucagcuccccucggagaa

SEQ ID NO: 1594264 - RNA, 23 nt, Human
gucagcuccccucggagaagagc

SEQ ID NO: 1594265 - RNA, 22 nt, Human
gucagcuccccucggagaagag

SEQ ID NO: 1594266 - RNA, 21 nt, Human
gucagcuccccucggagaaga

SEQ ID NO: 1594267 - RNA, 13 nt, Human
gucaggaaagaga

SEQ ID NO: 1594268 - RNA, 23 nt, Human
gucuaagauaguaacaaugaaga

SEQ ID NO: 1594269 - RNA, 21 nt, Human
gucuaagauaguaacaaugaa

SEQ ID NO: 1594270 - RNA, 13 nt, Human
gucuaaauuugaa

SEQ ID NO: 1594271 - RNA, 18 nt, Human
gucgucaaagcugaaaug

SEQ ID NO: 1594272 - RNA, 23 nt, Human
gucggguuuuauuguuuaaaauc

SEQ ID NO: 1594273 - RNA, 21 nt, Human
gucugugagaugcuagaacuc

SEQ ID NO: 1594274 - RNA, 17 nt, Human
gucugugagaugcuaga

SEQ ID NO: 1594275 - RNA, 16 nt, Human
gucugugagaugcuag

SEQ ID NO: 1594276 - RNA, 15 nt, Human
gucugugagaugcua

SEQ ID NO: 1594277 - RNA, 23 nt, Human
gucugugagaugcuagaacuccc

SEQ ID NO: 1594278 - RNA, 22 nt, Human
gucugugagaugcuagaacucc

SEQ ID NO: 1594279 - RNA, 22 nt, Human
gugaauucuugaaggaaaauga

SEQ ID NO: 1594280 - RNA, 18 nt, Human
gugaauucuugaaggaaa

SEQ ID NO: 1594281 - RNA, 13 nt, Human
gugaacacaucag

SEQ ID NO: 1594282 - RNA, 15 nt, Human
gugaacacaucagcu

SEQ ID NO: 1594283 - RNA, 21 nt, Human
gugaacaaauuuacagagaca

SEQ ID NO: 1594284 - RNA, 14 nt, Human
gugagcuacaaaug

SEQ ID NO: 1594285 - RNA, 15 nt, Human
guguacuuaacuauu

SEQ ID NO: 1594286 - RNA, 21 nt, Human
guguaaguagauaggccaugg

SEQ ID NO: 1594287 - RNA, 21 nt, Human
gugcuacaaaaacacagcaag

SEQ ID NO: 1594288 - RNA, 20 nt, Human
gugcuacaaaaacacagcaa

SEQ ID NO: 1594289 - RNA, 15 nt, Human
gugcuacaaaaacac

SEQ ID NO: 1594290 - RNA, 16 nt, Human
guuaaaagaugaaaau

SEQ ID NO: 1594291 - RNA, 14 nt, Human
guuaaaagaugaaa

SEQ ID NO: 1594292 - RNA, 20 nt, Human
guuaaaagaugaaaauauuu

SEQ ID NO: 1594293 - RNA, 18 nt, Human
guucaauaauaaauauuu

SEQ ID NO: 1594294 - RNA, 17 nt, Human
guuauuauauuuacaaa

SEQ ID NO: 1594295 - RNA, 23 nt, Human
guuaccucugccucagaaaacaa

SEQ ID NO: 1594296 - RNA, 13 nt, Human
guucagagcugcc

SEQ ID NO: 1594297 - RNA, 14 nt, Human
guucagagcugccc

SEQ ID NO: 1594298 - RNA, 23 nt, Human
guucagagcugcccucuccuggg

SEQ ID NO: 1594299 - RNA, 20 nt, Human
guucagagcugcccucuccu

SEQ ID NO: 1594300 - RNA, 22 nt, Human
guucagagcugcccucuccugg

SEQ ID NO: 1594301 - RNA, 15 nt, Human
guucagagcugcccu

SEQ ID NO: 1594302 - RNA, 16 nt, Human
guucagagcugcccuc

SEQ ID NO: 1594303 - RNA, 17 nt, Human
guucagagcugcccucu

SEQ ID NO: 1594304 - RNA, 19 nt, Human
guucagagcugcccucucc

SEQ ID NO: 1594305 - RNA, 16 nt, Human
guucaucaaugaauga

SEQ ID NO: 1594306 - RNA, 21 nt, Human
guugauggugguauguuuuca

SEQ ID NO: 1594307 - RNA, 20 nt, Human
guugauggugguauguuuuc

SEQ ID NO: 1594308 - RNA, 22 nt, Human
guugaaaagacuccaaagaaau

SEQ ID NO: 1594309 - RNA, 17 nt, Human
guugaaaagacuccaaa

SEQ ID NO: 1594310 - RNA, 23 nt, Human
guugaaaagacuccaaagaaaug

SEQ ID NO: 1594311 - RNA, 15 nt, Human
guucugaagaagaug

SEQ ID NO: 1594312 - RNA, 14 nt, Human
guucugaagaagau

SEQ ID NO: 1594313 - RNA, 13 nt, Human
guucugaagaaga

SEQ ID NO: 1594314 - RNA, 12 nt, Human
guucugaagaag

SEQ ID NO: 1594315 - RNA, 14 nt, Human
guugugaauguugu

SEQ ID NO: 1594316 - RNA, 20 nt, Human
guuuauauaagcuuguauuc

SEQ ID NO: 1594317 - RNA, 20 nt, Human
guuuaggauguugaaaaagu

SEQ ID NO: 1594318 - RNA, 21 nt, Human
guuuagcuggaaaaguauguu

SEQ ID NO: 1594319 - RNA, 20 nt, Human
guuuagcuggaaaaguaugu

SEQ ID NO: 1594320 - RNA, 13 nt, Human
uaaaaacaacuuu

SEQ ID NO: 1594321 - RNA, 18 nt, Human
uaaaaacaacuuuauacc

SEQ ID NO: 1594322 - RNA, 19 nt, Human
uaaaaacaacuuuauaccc

SEQ ID NO: 1594323 - RNA, 21 nt, Human
uaaaaagacauucuuccaaaa

SEQ ID NO: 1594324 - RNA, 19 nt, Human
uaaaaagccugcaauuuca

SEQ ID NO: 1594325 - RNA, 18 nt, Human
uaaaaaugguuuaaaugg

SEQ ID NO: 1594326 - RNA, 19 nt, Human
uaaaaaugguuuaaauggu

SEQ ID NO: 1594327 - RNA, 22 nt, Human
uaaaacaagcacuaaacaaaga

SEQ ID NO: 1594328 - RNA, 13 nt, Human
uaaaaccacagca

SEQ ID NO: 1594329 - RNA, 13 nt, Human
uaaaaucauuucu

SEQ ID NO: 1594330 - RNA, 10 nt, Human
uaaaaucauu

SEQ ID NO: 1594331 - RNA, 22 nt, Human
uaaaaucauuucugcaucagcu

SEQ ID NO: 1594332 - RNA, 18 nt, Human
uaaaaucauuucugcauc

SEQ ID NO: 1594333 - RNA, 17 nt, Human
uaaaauccauacauuug

SEQ ID NO: 1594334 - RNA, 15 nt, Human
uaaaauccauacauu

SEQ ID NO: 1594335 - RNA, 14 nt, Human
uaaaguguuugaaa

SEQ ID NO: 1594336 - RNA, 14 nt, Human
uaaaggaauuuaaa

SEQ ID NO: 1594337 - RNA, 19 nt, Human
uaaaccaaggcuagaacca

SEQ ID NO: 1594338 - RNA, 22 nt, Human
uaaauuugaauguuaagcagau

SEQ ID NO: 1594339 - RNA, 14 nt, Human
uaaauuugaauguu

SEQ ID NO: 1594340 - RNA, 23 nt, Human
uaaauugacacuuaaaaaugguu

SEQ ID NO: 1594341 - RNA, 20 nt, Human
uaaauugacacuuaaaaaug

SEQ ID NO: 1594342 - RNA, 16 nt, Human
uaaaugugcuuuuaaa

SEQ ID NO: 1594343 - RNA, 16 nt, Human
uaaaugugccuucauu

SEQ ID NO: 1594344 - RNA, 20 nt, Human
uaaauggcuuccuggcaaua

SEQ ID NO: 1594345 - RNA, 17 nt, Human
uaacugugaaguuuaca

SEQ ID NO: 1594346 - RNA, 15 nt, Human
uaacuggaaacuuca

SEQ ID NO: 1594347 - RNA, 18 nt, Human
uaacugugaaguuuacau

SEQ ID NO: 1594348 - RNA, 21 nt, Human
uaagaaaauaucacuugucaa

SEQ ID NO: 1594349 - RNA, 13 nt, Human
uaagagagaauga

SEQ ID NO: 1594350 - RNA, 23 nt, Human
uaagagagaaugagagacacacu

SEQ ID NO: 1594351 - RNA, 14 nt, Human
uaagagagaaugag

SEQ ID NO: 1594352 - RNA, 17 nt, Human
uaaccaggggccaugaa

SEQ ID NO: 1594353 - RNA, 19 nt, Human
uaauaaauauuuuugccau

SEQ ID NO: 1594354 - RNA, 21 nt, Human
uaauaacugugaaguuuacau

SEQ ID NO: 1594355 - RNA, 13 nt, Human
uaagugaaauaag

SEQ ID NO: 1594356 - RNA, 18 nt, Human
uaagguuaccuuuguucc

SEQ ID NO: 1594357 - RNA, 22 nt, Human
uaauguuucaaacauauauaac

SEQ ID NO: 1594358 - RNA, 23 nt, Human
uaaugauaacuggaaacuucagc

SEQ ID NO: 1594359 - RNA, 22 nt, Human
uaaugauaacuggaaacuucag

SEQ ID NO: 1594360 - RNA, 17 nt, Human
uaaugauaacuggaaac

SEQ ID NO: 1594361 - RNA, 14 nt, Human
uaauaauguuucaa

SEQ ID NO: 1594362 - RNA, 14 nt, Human
uauaucuuguagcu

SEQ ID NO: 1594363 - RNA, 18 nt, Human
uauauaaguauucuaaau

SEQ ID NO: 1594364 - RNA, 19 nt, Human
uauauaacaaugcuguauu

SEQ ID NO: 1594365 - RNA, 17 nt, Human
uauauaacaaugcugua

SEQ ID NO: 1594366 - RNA, 14 nt, Human
uaucaaaagaaaga

SEQ ID NO: 1594367 - RNA, 16 nt, Human
uauaugcuucuguuuu

SEQ ID NO: 1594368 - RNA, 14 nt, Human
uauaugcuucuguu

SEQ ID NO: 1594369 - RNA, 20 nt, Human
uauauuugaaauauugacuu

SEQ ID NO: 1594370 - RNA, 21 nt, Human
uauauuuuuuguuaaaugauu

SEQ ID NO: 1594371 - RNA, 22 nt, Human
uagguuaauuccaauuauauga

SEQ ID NO: 1594372 - RNA, 22 nt, Human
uaggugcuacaaaaacacagca

SEQ ID NO: 1594373 - RNA, 20 nt, Human
uaggugcuacaaaaacacag

SEQ ID NO: 1594374 - RNA, 23 nt, Human
uaggugcuacaaaaacacagcaa

SEQ ID NO: 1594375 - RNA, 17 nt, Human
uaguauuguccaggucu

SEQ ID NO: 1594376 - RNA, 15 nt, Human
uagcauggcauauuu

SEQ ID NO: 1594377 - RNA, 17 nt, Human
uagcauggcauauuuuu

SEQ ID NO: 1594378 - RNA, 18 nt, Human
uagcauggcauauuuuuc

SEQ ID NO: 1594379 - RNA, 14 nt, Human
uagauaggccaugg

SEQ ID NO: 1594380 - RNA, 18 nt, Human
uagaauuaacacaugauc

SEQ ID NO: 1594381 - RNA, 16 nt, Human
uagaauuaacacauga

SEQ ID NO: 1594382 - RNA, 15 nt, Human
uagaauuaacacaug

SEQ ID NO: 1594383 - RNA, 23 nt, Human
uagaauaccacaggaaccacaag

SEQ ID NO: 1594384 - RNA, 14 nt, Human
uacccagaaaguua

SEQ ID NO: 1594385 - RNA, 22 nt, Human
uaccaaaaaucucaauauuuca

SEQ ID NO: 1594386 - RNA, 22 nt, Human
uaccuaacgaaguauccuucag

SEQ ID NO: 1594387 - RNA, 16 nt, Human
uaccuaucaucuuaag

SEQ ID NO: 1594388 - RNA, 13 nt, Human
uacuuaacuauuc

SEQ ID NO: 1594389 - RNA, 23 nt, Human
uacugucagcuccccucggagaa

SEQ ID NO: 1594390 - RNA, 14 nt, Human
uacaggauuugaaa

SEQ ID NO: 1594391 - RNA, 23 nt, Human
uacaguucggugagcuacaaaug

SEQ ID NO: 1594392 - RNA, 17 nt, Human
uaauuuuuauauuugaa

SEQ ID NO: 1594393 - RNA, 16 nt, Human
uaauuuuuauauuuga

SEQ ID NO: 1594394 - RNA, 12 nt, Human
uaauuuuuauau

SEQ ID NO: 1594395 - RNA, 18 nt, Human
uaauuuugugaagcaaaa

SEQ ID NO: 1594396 - RNA, 16 nt, Human
uacacacucaaaucaa

SEQ ID NO: 1594397 - RNA, 17 nt, Human
uacacacucaaaucaag

SEQ ID NO: 1594398 - RNA, 15 nt, Human
ugaaggaaaaugaua

SEQ ID NO: 1594399 - RNA, 13 nt, Human
ugaaucucauaau

SEQ ID NO: 1594400 - RNA, 20 nt, Human
ugaaucucauaauuuauaca

SEQ ID NO: 1594401 - RNA, 20 nt, Human
ugaaugaauggcuaagcaaa

SEQ ID NO: 1594402 - RNA, 15 nt, Human
ugaaugaauggcuaa

SEQ ID NO: 1594403 - RNA, 14 nt, Human
ugaaguuuacauug

SEQ ID NO: 1594404 - RNA, 16 nt, Human
ugaaguuuacauugua

SEQ ID NO: 1594405 - RNA, 20 nt, Human
ugaaguuuacauuguaaaua

SEQ ID NO: 1594406 - RNA, 22 nt, Human
ugacaacuucccagugaauucu

SEQ ID NO: 1594407 - RNA, 21 nt, Human
ugacagaauauguuucaaacu

SEQ ID NO: 1594408 - RNA, 22 nt, Human
ugacagaauauguuucaaacuu

SEQ ID NO: 1594409 - RNA, 18 nt, Human
ugacagaauauguuucaa

SEQ ID NO: 1594410 - RNA, 14 nt, Human
ugaauuacauuugu

SEQ ID NO: 1594411 - RNA, 13 nt, Human
ugaauuacauuug

SEQ ID NO: 1594412 - RNA, 14 nt, Human
ugaauuaaguuuuu

SEQ ID NO: 1594413 - RNA, 23 nt, Human
ugacagaauauguuucaaacuuu

SEQ ID NO: 1594414 - RNA, 18 nt, Human
ugaccacugcagaagaca

SEQ ID NO: 1594415 - RNA, 17 nt, Human
ugaccacugcagaagac

SEQ ID NO: 1594416 - RNA, 16 nt, Human
ugaccacugcagaaga

SEQ ID NO: 1594417 - RNA, 15 nt, Human
ugagcaggauuuuaa

SEQ ID NO: 1594418 - RNA, 20 nt, Human
ugagcaggauuuuaaucuuu

SEQ ID NO: 1594419 - RNA, 15 nt, Human
ugagaaagacuauuc

SEQ ID NO: 1594420 - RNA, 16 nt, Human
ugacucuuaagaagac

SEQ ID NO: 1594421 - RNA, 15 nt, Human
ugacucuuaagaaga

SEQ ID NO: 1594422 - RNA, 14 nt, Human
ugacucuuaagaag

SEQ ID NO: 1594423 - RNA, 19 nt, Human
ucuugaaggaaaaugauac

SEQ ID NO: 1594424 - RNA, 19 nt, Human
ucuugccaaauauaaauaa

SEQ ID NO: 1594425 - RNA, 18 nt, Human
ucuuguagcuuuaucaaa

SEQ ID NO: 1594426 - RNA, 16 nt, Human
ucuucuuggucucagu

SEQ ID NO: 1594427 - RNA, 13 nt, Human
ucuuauaauuuaa

SEQ ID NO: 1594428 - RNA, 14 nt, Human
ucuuauaauuuaaa

SEQ ID NO: 1594429 - RNA, 23 nt, Human
ugaaacacucaguuguucaauaa

SEQ ID NO: 1594430 - RNA, 22 nt, Human
ugaaaauuauuuuguucauaca

SEQ ID NO: 1594431 - RNA, 23 nt, Human
ugaaaauuauuuuguucauacau

SEQ ID NO: 1594432 - RNA, 19 nt, Human
ugaaaauuauuuuguucau

SEQ ID NO: 1594433 - RNA, 17 nt, Human
ucuuuccacagaagcuc

SEQ ID NO: 1594434 - RNA, 23 nt, Human
ucucauaauuuauacaggucaua

SEQ ID NO: 1594435 - RNA, 14 nt, Human
ucugucucagucca

SEQ ID NO: 1594436 - RNA, 22 nt, Human
ucaggagaguagaacagauaau

SEQ ID NO: 1594437 - RNA, 16 nt, Human
ucagcugcugaaacaa

SEQ ID NO: 1594438 - RNA, 22 nt, Human
ucagcuccccucggagaagagc

SEQ ID NO: 1594439 - RNA, 19 nt, Human
ucagugugucuaaauuuga

SEQ ID NO: 1594440 - RNA, 18 nt, Human
ucaguccaugaagaugua

SEQ ID NO: 1594441 - RNA, 19 nt, Human
ucauggaauuggagcucgu

SEQ ID NO: 1594442 - RNA, 21 nt, Human
ucauggaauuggagcucgugg

SEQ ID NO: 1594443 - RNA, 12 nt, Human
uccauacauuug

SEQ ID NO: 1594444 - RNA, 16 nt, Human
ucucauaauuuauaca

SEQ ID NO: 1594445 - RNA, 22 nt, Human
ucucauaauuuauacaggucau

SEQ ID NO: 1594446 - RNA, 19 nt, Human
ucuacuaaaaauacaaaaa

SEQ ID NO: 1594447 - RNA, 15 nt, Human
ucuacuaaaaauaca

SEQ ID NO: 1594448 - RNA, 12 nt, Human
ucuacuaaaaau

SEQ ID NO: 1594449 - RNA, 17 nt, Human
uccuugcaucaauuuuu

SEQ ID NO: 1594450 - RNA, 17 nt, Human
ucggccuccauccugag

SEQ ID NO: 1594451 - RNA, 16 nt, Human
ucggccuccauccuga

SEQ ID NO: 1594452 - RNA, 15 nt, Human
ucggccuccauccug

SEQ ID NO: 1594453 - RNA, 20 nt, Human
uccucaaaacuucagacaua

SEQ ID NO: 1594454 - RNA, 17 nt, Human
uccugaggcuccacuug

SEQ ID NO: 1594455 - RNA, 16 nt, Human
uccugaggcuccacuu

SEQ ID NO: 1594456 - RNA, 15 nt, Human
uccugaggcuccacu

SEQ ID NO: 1594457 - RNA, 19 nt, Human
uccucugcuugccaucccu

SEQ ID NO: 1594458 - RNA, 14 nt, Human
uccucugcuugcca

SEQ ID NO: 1594459 - RNA, 15 nt, Human
uccucugcuugccau

SEQ ID NO: 1594460 - RNA, 16 nt, Human
uccucugcuugccauc

SEQ ID NO: 1594461 - RNA, 17 nt, Human
uccucugcuugccaucc

SEQ ID NO: 1594462 - RNA, 16 nt, Human
uggaaugcuguguuaa

SEQ ID NO: 1594463 - RNA, 22 nt, Human
uggaauaauccuaaacauauga

SEQ ID NO: 1594464 - RNA, 21 nt, Human
uggaacauaaaauacaauguu

SEQ ID NO: 1594465 - RNA, 20 nt, Human
uggaacauaaaauacaaugu

SEQ ID NO: 1594466 - RNA, 23 nt, Human
uggaaacuucagcgguuuauaua

SEQ ID NO: 1594467 - RNA, 11 nt, Human
uggagggaagc

SEQ ID NO: 1594468 - RNA, 21 nt, Human
uggcuugaguuuaaauuguaa

SEQ ID NO: 1594469 - RNA, 16 nt, Human
uggcuuccuggcaaua

SEQ ID NO: 1594470 - RNA, 17 nt, Human
ugccuucucaacuccaa

SEQ ID NO: 1594471 - RNA, 15 nt, Human
ugccuucucaacucc

SEQ ID NO: 1594472 - RNA, 18 nt, Human
ugccuguaaucacagcua

SEQ ID NO: 1594473 - RNA, 19 nt, Human
ugcuaagcauuccaacuau

SEQ ID NO: 1594474 - RNA, 15 nt, Human
ugcuaagcauuccaa

SEQ ID NO: 1594475 - RNA, 22 nt, Human
ugcaguucugaagaagauggua

SEQ ID NO: 1594476 - RNA, 19 nt, Human
ugcaguucugaagaagaug

SEQ ID NO: 1594477 - RNA, 18 nt, Human
ugcaguucugaagaagau

SEQ ID NO: 1594478 - RNA, 17 nt, Human
ugcaguucugaagaaga

SEQ ID NO: 1594479 - RNA, 16 nt, Human
ugcaguucugaagaag

SEQ ID NO: 1594480 - RNA, 15 nt, Human
ugcaguucugaagaa

SEQ ID NO: 1594481 - RNA, 16 nt, Human
ugcacugucaagauga

SEQ ID NO: 1594482 - RNA, 14 nt, Human
ugccaucccucccu

SEQ ID NO: 1594483 - RNA, 11 nt, Human
ugccaucccuc

SEQ ID NO: 1594484 - RNA, 12 nt, Human
ugccaucccucc

SEQ ID NO: 1594485 - RNA, 19 nt, Human
ugccaaauauaaauaaaaa

SEQ ID NO: 1594486 - RNA, 22 nt, Human
ugccaaauauaaauaaaaauaa

SEQ ID NO: 1594487 - RNA, 17 nt, Human
ugccaaauauaaauaaa

SEQ ID NO: 1594488 - RNA, 18 nt, Human
ugccaaauauaaauaaaa

SEQ ID NO: 1594489 - RNA, 20 nt, Human
ugccacuaaauugacacuua

SEQ ID NO: 1594490 - RNA, 22 nt, Human
uguacgaagaguauuuuugaca

SEQ ID NO: 1594491 - RNA, 14 nt, Human
uguacgaagaguau

SEQ ID NO: 1594492 - RNA, 22 nt, Human
uguaguguuggagaagaacuga

SEQ ID NO: 1594493 - RNA, 16 nt, Human
uguaccgcaaugugac

SEQ ID NO: 1594494 - RNA, 17 nt, Human
uggucacaggaaguaga

SEQ ID NO: 1594495 - RNA, 14 nt, Human
uguaaucacagcua

SEQ ID NO: 1594496 - RNA, 16 nt, Human
uguaugauucccagcc

SEQ ID NO: 1594497 - RNA, 15 nt, Human
uguaugauucccagc

SEQ ID NO: 1594498 - RNA, 18 nt, Human
ugugaagugaaugaaaca

SEQ ID NO: 1594499 - RNA, 21 nt, Human
ugugaauguugugauguauuc

SEQ ID NO: 1594500 - RNA, 19 nt, Human
ugugcuaguaauuggaaag

SEQ ID NO: 1594501 - RNA, 12 nt, Human
uguucauacaua

SEQ ID NO: 1594502 - RNA, 14 nt, Human
uguucauacauauu

SEQ ID NO: 1594503 - RNA, 23 nt, Human
uguucauacauauuuuuguagca

SEQ ID NO: 1594504 - RNA, 14 nt, Human
uguuagugcaaauu

SEQ ID NO: 1594505 - RNA, 21 nt, Human
uguuaaaagaugaaaauauuu

SEQ ID NO: 1594506 - RNA, 19 nt, Human
uguguuuugcaagccagau

SEQ ID NO: 1594507 - RNA, 13 nt, Human
uguguuuugcaag

SEQ ID NO: 1594508 - RNA, 22 nt, Human
ugugugaaagguacuucaaauc

SEQ ID NO: 1594509 - RNA, 21 nt, Human
ugugugaaagguacuucaaau

SEQ ID NO: 1594510 - RNA, 20 nt, Human
uguuggagaagaacugaaau

SEQ ID NO: 1594511 - RNA, 19 nt, Human
uguuggagaagaacugaaa

SEQ ID NO: 1594512 - RNA, 17 nt, Human
uguuggagaagaacuga

SEQ ID NO: 1594513 - RNA, 16 nt, Human
uguuggagaagaacug

SEQ ID NO: 1594514 - RNA, 14 nt, Human
uguuggagaagaac

SEQ ID NO: 1594515 - RNA, 18 nt, Human
uguuuaaaaucauuucug

SEQ ID NO: 1594516 - RNA, 17 nt, Human
uguuuaaaaucauuucu

SEQ ID NO: 1594517 - RNA, 20 nt, Human
uguugacaugggacauuugc

SEQ ID NO: 1594518 - RNA, 19 nt, Human
uguuuccauauuuuauagg

SEQ ID NO: 1594519 - RNA, 22 nt, Human
uuaaaaaaaaaccugagcccca

SEQ ID NO: 1594520 - RNA, 19 nt, Human
uuaaaauacacacucaaau

SEQ ID NO: 1594521 - RNA, 18 nt, Human
uuaaaauacacacucaaa

SEQ ID NO: 1594522 - RNA, 17 nt, Human
uuaaugauaaguaaaug

SEQ ID NO: 1594523 - RNA, 16 nt, Human
uuaaugauaaguaaau

SEQ ID NO: 1594524 - RNA, 12 nt, Human
uuacauuguaaa

SEQ ID NO: 1594525 - RNA, 13 nt, Human
uuacauuguaaau

SEQ ID NO: 1594526 - RNA, 20 nt, Human
uuacagagacagaaagcaga

SEQ ID NO: 1594527 - RNA, 20 nt, Human
uuacauuuguauaaaauaau

SEQ ID NO: 1594528 - RNA, 16 nt, Human
uuaauaauguuucaaa

SEQ ID NO: 1594529 - RNA, 18 nt, Human
aucaaagagagaaaauaa

SEQ ID NO: 1594530 - RNA, 20 nt, Human
aucaaagggugaaaauuauu

SEQ ID NO: 1594531 - RNA, 14 nt, Human
aucaaaagaaagaa

SEQ ID NO: 1594532 - RNA, 21 nt, Human
aucaugaauuaguuuuauaug

SEQ ID NO: 1594533 - RNA, 12 nt, Human
auccuugaagau

SEQ ID NO: 1594534 - RNA, 23 nt, Human
auggcuuccuggcaauagucaaa

SEQ ID NO: 1594535 - RNA, 20 nt, Human
augggaaagcauuguaaaug

SEQ ID NO: 1594536 - RNA, 14 nt, Human
augggaaagcauug

SEQ ID NO: 1594537 - RNA, 15 nt, Human
augggacagggagga

SEQ ID NO: 1594538 - RNA, 20 nt, Human
augggacauuugcucaugga

SEQ ID NO: 1594539 - RNA, 13 nt, Human
augaaguacucau

SEQ ID NO: 1594540 - RNA, 13 nt, Human
agugaaugaaaca

SEQ ID NO: 1594541 - RNA, 19 nt, Human
agugaugucacuagggcag

SEQ ID NO: 1594542 - RNA, 13 nt, Human
agugauuaccagg

SEQ ID NO: 1594543 - RNA, 15 nt, Human
agugauuaccaggga

SEQ ID NO: 1594544 - RNA, 13 nt, Human
agucauuuaauaa

SEQ ID NO: 1594545 - RNA, 20 nt, Human
auaaaaagacauucuuccaa

SEQ ID NO: 1594546 - RNA, 14 nt, Human
auaaaaacaacuuu

SEQ ID NO: 1594547 - RNA, 23 nt, Human
auaaaaauauuguguugugaaug

SEQ ID NO: 1594548 - RNA, 16 nt, Human
auaaaagacagugaaa

SEQ ID NO: 1594549 - RNA, 15 nt, Human
auaaaagacagugaa

SEQ ID NO: 1594550 - RNA, 20 nt, Human
aguuguucaauaauaaauau

SEQ ID NO: 1594551 - RNA, 14 nt, Human
aguugaaaagacuc

SEQ ID NO: 1594552 - RNA, 15 nt, Human
auaaguaaaugcuag

SEQ ID NO: 1594553 - RNA, 17 nt, Human
auaaguaauucaagaaa

SEQ ID NO: 1594554 - RNA, 19 nt, Human
agaacagauaaucagugug

SEQ ID NO: 1594555 - RNA, 22 nt, Human
agaacagugauuaccagggacu

SEQ ID NO: 1594556 - RNA, 13 nt, Human
agaagagcuguuc

SEQ ID NO: 1594557 - RNA, 21 nt, Human
agaagagcuguucacagccag

SEQ ID NO: 1594558 - RNA, 20 nt, Human
agaagagcuguucacagcca

SEQ ID NO: 1594559 - RNA, 21 nt, Human
agaagacugcauuauauuuau

SEQ ID NO: 1594560 - RNA, 19 nt, Human
agacaaggaaaaaauaaca

SEQ ID NO: 1594561 - RNA, 17 nt, Human
agacccaaaaggcagaa

SEQ ID NO: 1594562 - RNA, 13 nt, Human
agcaaaauugaug

SEQ ID NO: 1594563 - RNA, 19 nt, Human
agcaaaauugauguguuua

SEQ ID NO: 1594564 - RNA, 23 nt, Human
agcaaaauugauguguuuauuua

SEQ ID NO: 1594565 - RNA, 23 nt, Human
agcaaaauuuuuucucuaggaaa

SEQ ID NO: 1594566 - RNA, 20 nt, Human
agauagauaggucagugcaa

SEQ ID NO: 1594567 - RNA, 14 nt, Human
agccagcaguucag

SEQ ID NO: 1594568 - RNA, 15 nt, Human
agccagcaguucaga

SEQ ID NO: 1594569 - RNA, 17 nt, Human
agcacugacuucuaagu

SEQ ID NO: 1594570 - RNA, 19 nt, Human
agcacugacuucuaaguaa

SEQ ID NO: 1594571 - RNA, 17 nt, Human
agggacaggauaagagg

SEQ ID NO: 1594572 - RNA, 20 nt, Human
aggcagagguugcagugagc

SEQ ID NO: 1594573 - RNA, 13 nt, Human
aggaaguagagga

SEQ ID NO: 1594574 - RNA, 13 nt, Human
agcuacaaaugca

SEQ ID NO: 1594575 - RNA, 17 nt, Human
agcgacagugagacucu

SEQ ID NO: 1594576 - RNA, 15 nt, Human
agcgacagugagacu

SEQ ID NO: 1594577 - RNA, 13 nt, Human
agcgacagugaga

SEQ ID NO: 1594578 - RNA, 20 nt, Human
agcugcugaaacaacaaaua

SEQ ID NO: 1594579 - RNA, 16 nt, Human
agcugcugaaacaaca

SEQ ID NO: 1594580 - RNA, 15 nt, Human
agcugcugaaacaac

SEQ ID NO: 1594581 - RNA, 14 nt, Human
agcugcugaaacaa

SEQ ID NO: 1594582 - RNA, 18 nt, Human
aggaaaaaauaacaauga

SEQ ID NO: 1594583 - RNA, 18 nt, Human
agcuguaugauucccagc

SEQ ID NO: 1594584 - RNA, 17 nt, Human
agcuguaugauucccag

SEQ ID NO: 1594585 - RNA, 16 nt, Human
acugacagauuuccau

SEQ ID NO: 1594586 - RNA, 19 nt, Human
acugauaugggucuugaua

SEQ ID NO: 1594587 - RNA, 14 nt, Human
acucccuuucaaca

SEQ ID NO: 1594588 - RNA, 19 nt, Human
acucguuaauuuguagugu

SEQ ID NO: 1594589 - RNA, 14 nt, Human
acucguuaauuugu

SEQ ID NO: 1594590 - RNA, 12 nt, Human
acuggaacucuc

SEQ ID NO: 1594591 - RNA, 17 nt, Human
acuguaaaauaauaacu

SEQ ID NO: 1594592 - RNA, 22 nt, Human
acuuaaaaaugguuuaaauggu

SEQ ID NO: 1594593 - RNA, 19 nt, Human
acuucaaauccuugaagau

SEQ ID NO: 1594594 - RNA, 18 nt, Human
acuucaaauccuugaaga

SEQ ID NO: 1594595 - RNA, 17 nt, Human
acuucaaauccuugaag

SEQ ID NO: 1594596 - RNA, 13 nt, Human
acuuggucuguga

SEQ ID NO: 1594597 - RNA, 21 nt, Human
acuucagacauagaauuaaca

SEQ ID NO: 1594598 - RNA, 17 nt, Human
acuucagcgguuuauau

SEQ ID NO: 1594599 - RNA, 19 nt, Human
acgcaggcccccaggugcc

SEQ ID NO: 1594600 - RNA, 21 nt, Human
acccugucucuacuaaaaaua

SEQ ID NO: 1594601 - RNA, 15 nt, Human
aauuauauaaguauu

SEQ ID NO: 1594602 - RNA, 16 nt, Human
aauuauauaaguauuc

SEQ ID NO: 1594603 - RNA, 17 nt, Human
aauuauauaaguauucu

SEQ ID NO: 1594604 - RNA, 16 nt, Human
aauuucauaugcugua

SEQ ID NO: 1594605 - RNA, 18 nt, Human
aauuucauaugcuguaua

SEQ ID NO: 1594606 - RNA, 11 nt, Human
aauuguaauag

SEQ ID NO: 1594607 - RNA, 15 nt, Human
acaccaauauucaua

SEQ ID NO: 1594608 - RNA, 21 nt, Human
acauaaguaauucaagaaaac

SEQ ID NO: 1594609 - RNA, 20 nt, Human
acaucccuuaccugggaaag

SEQ ID NO: 1594610 - RNA, 21 nt, Human
acauuuguauaaaauaauuuu

SEQ ID NO: 1594611 - RNA, 19 nt, Human
acauuuguauaaaauaauu

SEQ ID NO: 1594612 - RNA, 16 nt, Human
acauuuguauaaaaua

SEQ ID NO: 1594613 - RNA, 16 nt, Human
acauuugcucauggaa

SEQ ID NO: 1594614 - RNA, 15 nt, Human
acauuugcucaugga

SEQ ID NO: 1594615 - RNA, 22 nt, Human
acaggaugguucccuugaugaa

SEQ ID NO: 1594616 - RNA, 24 nt, Human
acaggaugguucccuugaugaaga

SEQ ID NO: 1594617 - RNA, 20 nt, Human
acagugauuaccagggacug

SEQ ID NO: 1594618 - RNA, 19 nt, Human
acagugauuaccagggacu

SEQ ID NO: 1594619 - RNA, 16 nt, Human
aaucucauaauuuaua

SEQ ID NO: 1594620 - RNA, 16 nt, Human
aaucucaauauuucag

SEQ ID NO: 1594621 - RNA, 20 nt, Human
aaugaauacuuuauaaagga

SEQ ID NO: 1594622 - RNA, 14 nt, Human
aagagagaaaauaa

SEQ ID NO: 1594623 - RNA, 15 nt, Human
aagaagacugcauua

SEQ ID NO: 1594624 - RNA, 20 nt, Human
aagaagacugcauuauauuu

SEQ ID NO: 1594625 - RNA, 21 nt, Human
aagacaaggaaaaaauaacaa

SEQ ID NO: 1594626 - RNA, 15 nt, Human
aagaacugaaaucau

SEQ ID NO: 1594627 - RNA, 13 nt, Human
aagaacugaaauc

SEQ ID NO: 1594628 - RNA, 12 nt, Human
aagaacugaaau

SEQ ID NO: 1594629 - RNA, 11 nt, Human
aagaacugaaa

SEQ ID NO: 1594630 - RNA, 20 nt, Human
aacgcaggcccccaggugcc

SEQ ID NO: 1594631 - RNA, 16 nt, Human
aagaguaguaauagag

SEQ ID NO: 1594632 - RNA, 19 nt, Human
aagaguauuuuugacagaa

SEQ ID NO: 1594633 - RNA, 23 nt, Human
aaaucucaaauuuggauugcuaa

SEQ ID NO: 1594634 - RNA, 18 nt, Human
aaaucucaauauuucaga

SEQ ID NO: 1594635 - RNA, 21 nt, Human
aaauauuuauuuuaauaaugu

SEQ ID NO: 1594636 - RNA, 23 nt, Human
aaauguugacaugggacauuugc

SEQ ID NO: 1594637 - RNA, 13 nt, Human
aaauguucaucaa

SEQ ID NO: 1594638 - RNA, 17 nt, Human
aaauguucaucaaugaa

SEQ ID NO: 1594639 - RNA, 22 nt, Human
aaauguugacaugggacauuug

SEQ ID NO: 1594640 - RNA, 13 nt, Human
aaagccugcaauu

SEQ ID NO: 1594641 - RNA, 18 nt, Human
aaagccugcaauuucaua

SEQ ID NO: 1594642 - RNA, 19 nt, Human
aaagcauuguaaaugugcu

SEQ ID NO: 1594643 - RNA, 17 nt, Human
aaagcauuguaaaugug

SEQ ID NO: 1594644 - RNA, 15 nt, Human
aaagcauuguaaaug

SEQ ID NO: 1594645 - RNA, 21 nt, Human
aaaaucauuucugcaucagcu

SEQ ID NO: 1594646 - RNA, 15 nt, Human
aaacugcacugucaa

SEQ ID NO: 1594647 - RNA, 13 nt, Human
aaaagacuccaaa

SEQ ID NO: 1594648 - RNA, 11 nt, Human
aaaagaaugau

SEQ ID NO: 1594649 - RNA, 13 nt, Human
aaaagaauauuuu

SEQ ID NO: 1594650 - RNA, 20 nt, Human
aaaagacaaggaaaaaauaa

SEQ ID NO: 1594651 - RNA, 12 nt, Human
aaaagaauauuu

SEQ ID NO: 1594652 - RNA, 17 nt, Human
aaaagaaagaaaaucag

SEQ ID NO: 1594653 - RNA, 17 nt, Human
aaaagaugaaaauauuu

SEQ ID NO: 1594654 - RNA, 12 nt, Human
aaaaucauuucu

SEQ ID NO: 1594655 - RNA, 11 nt, Human
aaaaucauuuc

SEQ ID NO: 1594656 - RNA, 10 nt, Human
aaaaucauuu

SEQ ID NO: 1594657 - RNA, 22 nt, Human
aaauuauuuuguucauacauau

SEQ ID NO: 1594658 - RNA, 20 nt, Human
aaauuauuuuguucauacau

SEQ ID NO: 1594659 - RNA, 21 nt, Human
aaauuauuuuguucauacaua

SEQ ID NO: 1594660 - RNA, 22 nt, Human
aaauuauauaaguauucuaaau

SEQ ID NO: 1594661 - RNA, 17 nt, Human
aaauuauuuuguucaua

SEQ ID NO: 1594662 - RNA, 19 nt, Human
aaauuauuuuguucauaca

SEQ ID NO: 1594663 - RNA, 16 nt, Human
aaauuauauaaguauu

SEQ ID NO: 1594664 - RNA, 18 nt, Human
aaauuauauaaguauucu

SEQ ID NO: 1594665 - RNA, 20 nt, Human
guauuuuugacagaauaugu

SEQ ID NO: 1594666 - RNA, 17 nt, Human
aaauuucagcagcugca

SEQ ID NO: 1594667 - RNA, 18 nt, Human
aaauuucagcagcugcag

SEQ ID NO: 1594668 - RNA, 16 nt, Human
gucaaauugugugaaa

SEQ ID NO: 1594669 - RNA, 22 nt, Human
aaauguaagggaaacugccagc

SEQ ID NO: 1594670 - RNA, 14 nt, Human
guaugauucccagc

SEQ ID NO: 1594671 - RNA, 14 nt, Human
aaaugcauuucuaa

SEQ ID NO: 1594672 - RNA, 19 nt, Human
aaauggcuuccuggcaaua

SEQ ID NO: 1594673 - RNA, 22 nt, Human
aaaugaaagcagggacuugaac

SEQ ID NO: 1594674 - RNA, 21 nt, Human
aaaugaaagcagggacuugaa

SEQ ID NO: 1594675 - RNA, 19 nt, Human
aaaucuacacuccagugag

SEQ ID NO: 1594676 - RNA, 14 nt, Human
aaauccuugaagau

SEQ ID NO: 1594677 - RNA, 17 nt, Human
aaccucaaaaugucuaa

SEQ ID NO: 1594678 - RNA, 20 nt, Human
aaccuagggugauauuaacc

SEQ ID NO: 1594679 - RNA, 18 nt, Human
aacccaaauguucaucaa

SEQ ID NO: 1594680 - RNA, 13 nt, Human
aacccaaauguuc

SEQ ID NO: 1594681 - RNA, 20 nt, Human
aacccauauuuguacaccaa

SEQ ID NO: 1594682 - RNA, 12 nt, Human
aaccacagcagu

SEQ ID NO: 1594683 - RNA, 21 nt, Human
gucuuaauuaaaagaauauuu

SEQ ID NO: 1594684 - RNA, 19 nt, Human
gucuuaauuaaaagaauau

SEQ ID NO: 1594685 - RNA, 22 nt, Human
gucuuaauuaaaagaauauuuu

SEQ ID NO: 1594686 - RNA, 19 nt, Human
gucuuauauauuguagaua

SEQ ID NO: 1594687 - RNA, 14 nt, Human
aacucccuuucaac

SEQ ID NO: 1594688 - RNA, 13 nt, Human
aacucccuuucaa

SEQ ID NO: 1594689 - RNA, 18 nt, Human
aacucguuaauuuguagu

SEQ ID NO: 1594690 - RNA, 21 nt, Human
aacuccagaaagugacaagcu

SEQ ID NO: 1594691 - RNA, 14 nt, Human
aacuccagaaagug

SEQ ID NO: 1594692 - RNA, 14 nt, Human
aacaaugaagauaa

SEQ ID NO: 1594693 - RNA, 18 nt, Human
aacaaugaagauaaaaag

SEQ ID NO: 1594694 - RNA, 21 nt, Human
aacaagccuccuuuuaaagua

SEQ ID NO: 1594695 - RNA, 15 nt, Human
aacaaggaugaauua

SEQ ID NO: 1594696 - RNA, 24 nt, Human
guccaagcauaccaacacgagcag

SEQ ID NO: 1594697 - RNA, 21 nt, Human
guccaagcauuuagauguaua

SEQ ID NO: 1594698 - RNA, 18 nt, Human
aacauuugguaaggggaa

SEQ ID NO: 1594699 - RNA, 22 nt, Human
aacaguagugauaguuguaccg

SEQ ID NO: 1594700 - RNA, 11 nt, Human
guucauacauu

SEQ ID NO: 1594701 - RNA, 14 nt, Human
guucauacauugua

SEQ ID NO: 1594702 - RNA, 9 nt, Human
guucauaca

SEQ ID NO: 1594703 - RNA, 10 nt, Human
guucauacau

SEQ ID NO: 1594704 - RNA, 13 nt, Human
guucauacauauu

SEQ ID NO: 1594705 - RNA, 14 nt, Human
guucauacauauuu

SEQ ID NO: 1594706 - RNA, 23 nt, Human
guucauacauauuuuuguagcac

SEQ ID NO: 1594707 - RNA, 14 nt, Human
guuaaguaugugua

SEQ ID NO: 1594708 - RNA, 18 nt, Human
guucuagcauggcauauu

SEQ ID NO: 1594709 - RNA, 19 nt, Human
guucuagcauggcauauuu

SEQ ID NO: 1594710 - RNA, 18 nt, Human
guugacaugggacauuug

SEQ ID NO: 1594711 - RNA, 14 nt, Human
guugacaugggaca

SEQ ID NO: 1594712 - RNA, 18 nt, Human
guuguaccgcaaugugac

SEQ ID NO: 1594713 - RNA, 16 nt, Human
guuuaaaaucauuucu

SEQ ID NO: 1594714 - RNA, 10 nt, Human
guuuaaaauc

SEQ ID NO: 1594715 - RNA, 13 nt, Human
aagguacuucaaa

SEQ ID NO: 1594716 - RNA, 17 nt, Human
aaggggaauugaggaca

SEQ ID NO: 1594717 - RNA, 21 nt, Human
guuucaaacauauauaacaau

SEQ ID NO: 1594718 - RNA, 23 nt, Human
guuuucugagaaagacuauucaa

SEQ ID NO: 1594719 - RNA, 18 nt, Human
guguuuccauauuuuaua

SEQ ID NO: 1594720 - RNA, 13 nt, Human
aagacuauucaaa

SEQ ID NO: 1594721 - RNA, 14 nt, Human
guggguagacacac

SEQ ID NO: 1594722 - RNA, 21 nt, Human
gugggacagucaccucaugga

SEQ ID NO: 1594723 - RNA, 13 nt, Human
aagaaagaaaauc

SEQ ID NO: 1594724 - RNA, 22 nt, Human
aagaagugaaaaucuacacucc

SEQ ID NO: 1594725 - RNA, 16 nt, Human
aagaagugaaaaucua

SEQ ID NO: 1594726 - RNA, 18 nt, Human
gugcuaguaauuggaaag

SEQ ID NO: 1594727 - RNA, 18 nt, Human
aagaaugauuaugaauua

SEQ ID NO: 1594728 - RNA, 16 nt, Human
aagaaugauuaugaau

SEQ ID NO: 1594729 - RNA, 12 nt, Human
aaugcuguguua

SEQ ID NO: 1594730 - RNA, 13 nt, Human
uaauucaagaaaa

SEQ ID NO: 1594731 - RNA, 17 nt, Human
uaauuuauacaggucau

SEQ ID NO: 1594732 - RNA, 16 nt, Human
uacaaaaacacagcaa

SEQ ID NO: 1594733 - RNA, 15 nt, Human
uacaaaaacacagca

SEQ ID NO: 1594734 - RNA, 14 nt, Human
uacaaaaacacagc

SEQ ID NO: 1594735 - RNA, 13 nt, Human
uacaaaaacacag

SEQ ID NO: 1594736 - RNA, 17 nt, Human
uacauauuuuuguagca

SEQ ID NO: 1594737 - RNA, 18 nt, Human
uacauauuuuuguagcac

SEQ ID NO: 1594738 - RNA, 11 nt, Human
aaugugauaug

SEQ ID NO: 1594739 - RNA, 19 nt, Human
aauggacuuuuguacauag

SEQ ID NO: 1594740 - RNA, 14 nt, Human
uacacuccagugag

SEQ ID NO: 1594741 - RNA, 19 nt, Human
uacacuaagagagaaugag

SEQ ID NO: 1594742 - RNA, 14 nt, Human
uaaugguguuuuaa

SEQ ID NO: 1594743 - RNA, 16 nt, Human
uaaugauaacuggaaa

SEQ ID NO: 1594744 - RNA, 21 nt, Human
aaugagagacacacugaagaa

SEQ ID NO: 1594745 - RNA, 23 nt, Human
uaaucagugugucuaaauuugaa

SEQ ID NO: 1594746 - RNA, 20 nt, Human
uaaguauguguaaaauguga

SEQ ID NO: 1594747 - RNA, 13 nt, Human
uaaguucauacau

SEQ ID NO: 1594748 - RNA, 14 nt, Human
uaaguucauacauu

SEQ ID NO: 1594749 - RNA, 18 nt, Human
uaaguuuuuuuuuaaaaa

SEQ ID NO: 1594750 - RNA, 12 nt, Human
uaaguucauaca

SEQ ID NO: 1594751 - RNA, 23 nt, Human
aaucaugaauuaguuuuauaugc

SEQ ID NO: 1594752 - RNA, 17 nt, Human
aaucaugaauuaguuuu

SEQ ID NO: 1594753 - RNA, 19 nt, Human
aaucaugaauuaguuuuau

SEQ ID NO: 1594754 - RNA, 15 nt, Human
aaucaucaagucuuu

SEQ ID NO: 1594755 - RNA, 14 nt, Human
aaucuuauaauuua

SEQ ID NO: 1594756 - RNA, 16 nt, Human
aaucuuauaauuuaaa

SEQ ID NO: 1594757 - RNA, 13 nt, Human
aauccuugaagau

SEQ ID NO: 1594758 - RNA, 22 nt, Human
aaucauuucugcaucagcugcu

SEQ ID NO: 1594759 - RNA, 20 nt, Human
aauccucaguuuuugugaaa

SEQ ID NO: 1594760 - RNA, 18 nt, Human
uaaauuuugaguucuaca

SEQ ID NO: 1594761 - RNA, 19 nt, Human
uaaauuuugaguucuacau

SEQ ID NO: 1594762 - RNA, 20 nt, Human
uaaauuuugucuuuaacuca

SEQ ID NO: 1594763 - RNA, 18 nt, Human
aauaggcguaacuaauuu

SEQ ID NO: 1594764 - RNA, 15 nt, Human
aauaguauuugagag

SEQ ID NO: 1594765 - RNA, 12 nt, Human
aauaucacuugu

SEQ ID NO: 1594766 - RNA, 20 nt, Human
aauaucacuugucaauaaaa

SEQ ID NO: 1594767 - RNA, 15 nt, Human
aauaucacuugucaa

SEQ ID NO: 1594768 - RNA, 20 nt, Human
aauauugcuuuggucauaug

SEQ ID NO: 1594769 - RNA, 18 nt, Human
aauauuguguugugaaug

SEQ ID NO: 1594770 - RNA, 15 nt, Human
aauauuucagauaau

SEQ ID NO: 1594771 - RNA, 24 nt, Human
aauaugcaaagcacugacuucuaa

SEQ ID NO: 1594772 - RNA, 17 nt, Human
aauaugcaaagcacuga

SEQ ID NO: 1594773 - RNA, 15 nt, Human
aauaugcaaagcacu

SEQ ID NO: 1594774 - RNA, 19 nt, Human
aauaucuuuuuuuuaauaa

SEQ ID NO: 1594775 - RNA, 21 nt, Human
aauaauuuuaagaaaucaaag

SEQ ID NO: 1594776 - RNA, 19 nt, Human
aauaauuuuuauauuugaa

SEQ ID NO: 1594777 - RNA, 17 nt, Human
aauaauuuuuauauuug

SEQ ID NO: 1594778 - RNA, 16 nt, Human
aauaauuuuuauauuu

SEQ ID NO: 1594779 - RNA, 20 nt, Human
aauaacugugaaguuuacau

SEQ ID NO: 1594780 - RNA, 14 nt, Human
aauaacugugaagu

SEQ ID NO: 1594781 - RNA, 16 nt, Human
aauaacugugaaguuu

SEQ ID NO: 1594782 - RNA, 20 nt, Human
aauaauuuuuauauuugaaa

SEQ ID NO: 1594783 - RNA, 17 nt, Human
uaaauuuugaguucuac

SEQ ID NO: 1594784 - RNA, 15 nt, Human
uaaauguugacaugg

SEQ ID NO: 1594785 - RNA, 13 nt, Human
aauaacugugaag

SEQ ID NO: 1594786 - RNA, 15 nt, Human
aauaacgauaaaaga

SEQ ID NO: 1594787 - RNA, 21 nt, Human
aauaacaaugaaaguugauaa

SEQ ID NO: 1594788 - RNA, 16 nt, Human
aauuuauacaggucau

SEQ ID NO: 1594789 - RNA, 17 nt, Human
aauuuauacaggucaua

SEQ ID NO: 1594790 - RNA, 19 nt, Human
aauuucucccagucauuua

SEQ ID NO: 1594791 - RNA, 18 nt, Human
aauuuacagagacagaaa

SEQ ID NO: 1594792 - RNA, 17 nt, Human
aauuuacagagacagaa

SEQ ID NO: 1594793 - RNA, 15 nt, Human
aauuggagcucgugg

SEQ ID NO: 1594794 - RNA, 19 nt, Human
uacuucuuaggguuaugau

SEQ ID NO: 1594795 - RNA, 13 nt, Human
aauugacccacaa

SEQ ID NO: 1594796 - RNA, 14 nt, Human
uacuaaaaauacaa

SEQ ID NO: 1594797 - RNA, 18 nt, Human
uacuaaaaauacaaaaaa

SEQ ID NO: 1594798 - RNA, 18 nt, Human
aauugaggacacugauau

SEQ ID NO: 1594799 - RNA, 19 nt, Human
uacugagagugaacaaauu

SEQ ID NO: 1594800 - RNA, 17 nt, Human
uacugagagugaacaaa

SEQ ID NO: 1594801 - RNA, 18 nt, Human
acaaugaagauaaaaaga

SEQ ID NO: 1594802 - RNA, 16 nt, Human
uagcuacuaauuuuaa

SEQ ID NO: 1594803 - RNA, 17 nt, Human
acaagaugguucuagca

SEQ ID NO: 1594804 - RNA, 22 nt, Human
acaagcucacagaccuuugaac

SEQ ID NO: 1594805 - RNA, 17 nt, Human
acaaauuuacagagaca

SEQ ID NO: 1594806 - RNA, 20 nt, Human
uagaugcaguucugaagaag

SEQ ID NO: 1594807 - RNA, 21 nt, Human
uagaugcaguucugaagaaga

SEQ ID NO: 1594808 - RNA, 17 nt, Human
uagauaggccaugggca

SEQ ID NO: 1594809 - RNA, 22 nt, Human
uagauaggucagugcaaauacu

SEQ ID NO: 1594810 - RNA, 22 nt, Human
aauuuuuucucuaggaaauauu

SEQ ID NO: 1594811 - RNA, 21 nt, Human
aauuuuucuuauuucauuucu

SEQ ID NO: 1594812 - RNA, 16 nt, Human
uauaaguauucuaaau

SEQ ID NO: 1594813 - RNA, 14 nt, Human
acacuccagugaga

SEQ ID NO: 1594814 - RNA, 14 nt, Human
acacugaagaagca

SEQ ID NO: 1594815 - RNA, 12 nt, Human
acacugaagaag

SEQ ID NO: 1594816 - RNA, 15 nt, Human
uauauuuaaugauaa

SEQ ID NO: 1594817 - RNA, 12 nt, Human
uauauuuacaaa

SEQ ID NO: 1594818 - RNA, 19 nt, Human
acagaaagcagaacaguga

SEQ ID NO: 1594819 - RNA, 15 nt, Human
acacuuaaaaauggu

SEQ ID NO: 1594820 - RNA, 13 nt, Human
acacuuaaaaaug

SEQ ID NO: 1594821 - RNA, 16 nt, Human
uaucuuguagcuuuau

SEQ ID NO: 1594822 - RNA, 21 nt, Human
acagcccuucuuuccacagaa

SEQ ID NO: 1594823 - RNA, 20 nt, Human
acagcccuucuuuccacaga

SEQ ID NO: 1594824 - RNA, 14 nt, Human
acagauaaucagug

SEQ ID NO: 1594825 - RNA, 19 nt, Human
uauauuuauuacuguaaga

SEQ ID NO: 1594826 - RNA, 15 nt, Human
uauauuuauuacugu

SEQ ID NO: 1594827 - RNA, 14 nt, Human
uaguaauagagcaa

SEQ ID NO: 1594828 - RNA, 14 nt, Human
acacacugaagaag

SEQ ID NO: 1594829 - RNA, 20 nt, Human
uaguaauagagcaaaauuga

SEQ ID NO: 1594830 - RNA, 17 nt, Human
uaguguuggagaagaac

SEQ ID NO: 1594831 - RNA, 16 nt, Human
uaguguuggagaagaa

SEQ ID NO: 1594832 - RNA, 12 nt, Human
uaguguuggaga

SEQ ID NO: 1594833 - RNA, 18 nt, Human
acacaacuauuuuuccaa

SEQ ID NO: 1594834 - RNA, 17 nt, Human
acacaacuauauuguuu

SEQ ID NO: 1594835 - RNA, 14 nt, Human
acacaacuauauug

SEQ ID NO: 1594836 - RNA, 18 nt, Human
acaaugcuguauuuuaaa

SEQ ID NO: 1594837 - RNA, 17 nt, Human
acaaugcuguauuuuaa

SEQ ID NO: 1594838 - RNA, 14 nt, Human
acaaugcuguauuu

SEQ ID NO: 1594839 - RNA, 13 nt, Human
acacacugaagaa

SEQ ID NO: 1594840 - RNA, 17 nt, Human
acacuaagagagaauga

SEQ ID NO: 1594841 - RNA, 19 nt, Human
acacuaagagagaaugaga

SEQ ID NO: 1594842 - RNA, 18 nt, Human
acacuaagagagaaugag

SEQ ID NO: 1594843 - RNA, 17 nt, Human
ucacauaucuaguauga

SEQ ID NO: 1594844 - RNA, 21 nt, Human
ucacauaucuaguaugaaauu

SEQ ID NO: 1594845 - RNA, 22 nt, Human
ucacauaucuaguaugaaauua

SEQ ID NO: 1594846 - RNA, 21 nt, Human
ucacaacagauuauuaccuua

SEQ ID NO: 1594847 - RNA, 15 nt, Human
accaaucaugaauua

SEQ ID NO: 1594848 - RNA, 13 nt, Human
accaaucaugaau

SEQ ID NO: 1594849 - RNA, 23 nt, Human
ucaauuuuucuuauuucauuucu

SEQ ID NO: 1594850 - RNA, 20 nt, Human
ucaauuuuucuuauuucauu

SEQ ID NO: 1594851 - RNA, 15 nt, Human
ucaauucuugccaaa

SEQ ID NO: 1594852 - RNA, 17 nt, Human
ucacuaccuucaugcau

SEQ ID NO: 1594853 - RNA, 14 nt, Human
accagggacugagg

SEQ ID NO: 1594854 - RNA, 13 nt, Human
accacugcagaag

SEQ ID NO: 1594855 - RNA, 18 nt, Human
accacuuguguuuugcaa

SEQ ID NO: 1594856 - RNA, 23 nt, Human
accauuucuugagguaaaagcau

SEQ ID NO: 1594857 - RNA, 21 nt, Human
ucaggaaaucaaauaugcaaa

SEQ ID NO: 1594858 - RNA, 20 nt, Human
ucaggaaaucaaauaugcaa

SEQ ID NO: 1594859 - RNA, 19 nt, Human
ucaggaaagagaacuucca

SEQ ID NO: 1594860 - RNA, 13 nt, Human
ucaggaaagagaa

SEQ ID NO: 1594861 - RNA, 12 nt, Human
ucagagcugccc

SEQ ID NO: 1594862 - RNA, 13 nt, Human
ucagagcugcccu

SEQ ID NO: 1594863 - RNA, 14 nt, Human
ucaaaaugucuaag

SEQ ID NO: 1594864 - RNA, 21 nt, Human
ucaaaauaccaugccauuuaa

SEQ ID NO: 1594865 - RNA, 23 nt, Human
ucaaaauaccaugccauuuaaag

SEQ ID NO: 1594866 - RNA, 21 nt, Human
ucaaaauaugccccauucaac

SEQ ID NO: 1594867 - RNA, 13 nt, Human
uauuuuugacaga

SEQ ID NO: 1594868 - RNA, 14 nt, Human
uauuuuugacagaa

SEQ ID NO: 1594869 - RNA, 15 nt, Human
uauuuuugacagaau

SEQ ID NO: 1594870 - RNA, 19 nt, Human
uauuuuugacagaauaugu

SEQ ID NO: 1594871 - RNA, 23 nt, Human
uauuuuugacagaauauguuuca

SEQ ID NO: 1594872 - RNA, 18 nt, Human
ucaaaagaaagaaaauca

SEQ ID NO: 1594873 - RNA, 17 nt, Human
ucaaagggugaaaauua

SEQ ID NO: 1594874 - RNA, 14 nt, Human
ucaaagcugaaaug

SEQ ID NO: 1594875 - RNA, 19 nt, Human
acaugauccugcaauucca

SEQ ID NO: 1594876 - RNA, 16 nt, Human
acaugaaguccaagca

SEQ ID NO: 1594877 - RNA, 22 nt, Human
ucaagaugaugaugaucuuuaa

SEQ ID NO: 1594878 - RNA, 23 nt, Human
acauaucuaguaugaaauuauau

SEQ ID NO: 1594879 - RNA, 20 nt, Human
acauaucuaguaugaaauua

SEQ ID NO: 1594880 - RNA, 22 nt, Human
acauaucuaguaugaaauuaua

SEQ ID NO: 1594881 - RNA, 17 nt, Human
acauaucuaguaugaaa

SEQ ID NO: 1594882 - RNA, 18 nt, Human
acauagaauuaacacaug

SEQ ID NO: 1594883 - RNA, 14 nt, Human
acauagaauuaaca

SEQ ID NO: 1594884 - RNA, 19 nt, Human
acauauauaacaaugcugu

SEQ ID NO: 1594885 - RNA, 13 nt, Human
acaucaacagaua

SEQ ID NO: 1594886 - RNA, 16 nt, Human
acauaaaaacaacuuu

SEQ ID NO: 1594887 - RNA, 19 nt, Human
acauaaaaacaacuuuaua

SEQ ID NO: 1594888 - RNA, 21 nt, Human
acauaaaaacaacuuuauacc

SEQ ID NO: 1594889 - RNA, 21 nt, Human
acaguuuucugagaaagacua

SEQ ID NO: 1594890 - RNA, 20 nt, Human
acaguuuucugagaaagacu

SEQ ID NO: 1594891 - RNA, 19 nt, Human
acaguuuucugagaaagac

SEQ ID NO: 1594892 - RNA, 18 nt, Human
acaguuuucugagaaaga

SEQ ID NO: 1594893 - RNA, 17 nt, Human
acaguuuucugagaaag

SEQ ID NO: 1594894 - RNA, 16 nt, Human
acaguuuucugagaaa

SEQ ID NO: 1594895 - RNA, 15 nt, Human
acaguuuucugagaa

SEQ ID NO: 1594896 - RNA, 21 nt, Human
uauuuccauuaaaaaaucagu

SEQ ID NO: 1594897 - RNA, 21 nt, Human
uaugaaauauuauguuaaaac

SEQ ID NO: 1594898 - RNA, 19 nt, Human
accucaaaaugucuaagau

SEQ ID NO: 1594899 - RNA, 21 nt, Human
accuagggugauauuaaccag

SEQ ID NO: 1594900 - RNA, 23 nt, Human
ucaggaaaucaaauaugcaaagc

SEQ ID NO: 1594901 - RNA, 22 nt, Human
ucaggaaaucaaauaugcaaag

SEQ ID NO: 1594902 - RNA, 12 nt, Human
accucccugcaa

SEQ ID NO: 1594903 - RNA, 13 nt, Human
accucccugcaau

SEQ ID NO: 1594904 - RNA, 16 nt, Human
ucaugaauuaguuuua

SEQ ID NO: 1594905 - RNA, 21 nt, Human
ucaugaauuaguuuuauaugc

SEQ ID NO: 1594906 - RNA, 20 nt, Human
acgagcaggcuacugucagc

SEQ ID NO: 1594907 - RNA, 19 nt, Human
acgagcaggcuacugucag

SEQ ID NO: 1594908 - RNA, 14 nt, Human
acgagaaaacaaua

SEQ ID NO: 1594909 - RNA, 19 nt, Human
ucccuuucugcuuguguua

SEQ ID NO: 1594910 - RNA, 21 nt, Human
acuccaaagaaauguaaggga

SEQ ID NO: 1594911 - RNA, 18 nt, Human
acuccaaagaaauguaag

SEQ ID NO: 1594912 - RNA, 15 nt, Human
acuccaaagaaaugu

SEQ ID NO: 1594913 - RNA, 14 nt, Human
acuccaaagaaaug

SEQ ID NO: 1594914 - RNA, 11 nt, Human
ucccugagcag

SEQ ID NO: 1594915 - RNA, 16 nt, Human
ucccugcaauaaaaug

SEQ ID NO: 1594916 - RNA, 15 nt, Human
ucccucccuccaccu

SEQ ID NO: 1594917 - RNA, 16 nt, Human
ucccucccuccaccuc

SEQ ID NO: 1594918 - RNA, 17 nt, Human
ucccucccuccaccucc

SEQ ID NO: 1594919 - RNA, 21 nt, Human
ucccuccaccucccugcaaua

SEQ ID NO: 1594920 - RNA, 23 nt, Human
ucccuccaccucccugcaauaaa

SEQ ID NO: 1594921 - RNA, 13 nt, Human
ucccucccuccac

SEQ ID NO: 1594922 - RNA, 14 nt, Human
ucccucccuccacc

SEQ ID NO: 1594923 - RNA, 17 nt, Human
uccccucggagaagagc

SEQ ID NO: 1594924 - RNA, 16 nt, Human
uccccucggagaagag

SEQ ID NO: 1594925 - RNA, 21 nt, Human
uccauccugaggcuccacuug

SEQ ID NO: 1594926 - RNA, 20 nt, Human
uccauccugaggcuccacuu

SEQ ID NO: 1594927 - RNA, 21 nt, Human
uccaugaagauguagaggaga

SEQ ID NO: 1594928 - RNA, 13 nt, Human
uccaugaagaugu

SEQ ID NO: 1594929 - RNA, 22 nt, Human
ucccagucauuuaauaaaugug

SEQ ID NO: 1594930 - RNA, 14 nt, Human
ucccagucauuuaa

SEQ ID NO: 1594931 - RNA, 17 nt, Human
ucccagccagcaguuca

SEQ ID NO: 1594932 - RNA, 18 nt, Human
ucccagccagcaguucag

SEQ ID NO: 1594933 - RNA, 17 nt, Human
ucuacauaaguaauuca

SEQ ID NO: 1594934 - RNA, 20 nt, Human
ucuacauaaguaauucaaga

SEQ ID NO: 1594935 - RNA, 16 nt, Human
ucuacauacuauggaa

SEQ ID NO: 1594936 - RNA, 23 nt, Human
ucuaaguaaaaccacagcaguug

SEQ ID NO: 1594937 - RNA, 22 nt, Human
ucuaaguaaaaccacagcaguu

SEQ ID NO: 1594938 - RNA, 21 nt, Human
ucuaaguaaaaccacagcagu

SEQ ID NO: 1594939 - RNA, 20 nt, Human
ucuaaagccauuguaguccu

SEQ ID NO: 1594940 - RNA, 22 nt, Human
ucuacauaaguaauucaagaaa

SEQ ID NO: 1594941 - RNA, 22 nt, Human
ucggguuuuauuguuuaaaauc

SEQ ID NO: 1594942 - RNA, 22 nt, Human
acugucagcuccccucggagaa

SEQ ID NO: 1594943 - RNA, 18 nt, Human
acugggacaggggagaac

SEQ ID NO: 1594944 - RNA, 21 nt, Human
acugucagcuccccucggaga

SEQ ID NO: 1594945 - RNA, 18 nt, Human
acuguggguagacacaca

SEQ ID NO: 1594946 - RNA, 14 nt, Human
acugcauuauauuu

SEQ ID NO: 1594947 - RNA, 15 nt, Human
acugcauuauauuua

SEQ ID NO: 1594948 - RNA, 13 nt, Human
acuggcacaguuu

SEQ ID NO: 1594949 - RNA, 20 nt, Human
acuggcacaguuuucugaga

SEQ ID NO: 1594950 - RNA, 19 nt, Human
acuggcacaguuuucugag

SEQ ID NO: 1594951 - RNA, 21 nt, Human
acuggcacaguuuucugagaa

SEQ ID NO: 1594952 - RNA, 20 nt, Human
acugccuucucaacuccaaa

SEQ ID NO: 1594953 - RNA, 19 nt, Human
acugccuucucaacuccaa

SEQ ID NO: 1594954 - RNA, 13 nt, Human
acugccuucucaa

SEQ ID NO: 1594955 - RNA, 14 nt, Human
ucugacuaugacau

SEQ ID NO: 1594956 - RNA, 16 nt, Human
ucugacuaugacauaa

SEQ ID NO: 1594957 - RNA, 17 nt, Human
agaaaucaaagagagaa

SEQ ID NO: 1594958 - RNA, 14 nt, Human
agaaagaaaaucag

SEQ ID NO: 1594959 - RNA, 12 nt, Human
ucugaagaagau

SEQ ID NO: 1594960 - RNA, 14 nt, Human
agaaaugaaagcag

SEQ ID NO: 1594961 - RNA, 13 nt, Human
ucucuggccuucg

SEQ ID NO: 1594962 - RNA, 23 nt, Human
ucucuggccuucggccuccaucc

SEQ ID NO: 1594963 - RNA, 22 nt, Human
ucucuggccuucggccuccauc

SEQ ID NO: 1594964 - RNA, 21 nt, Human
ucucuggccuucggccuccau

SEQ ID NO: 1594965 - RNA, 12 nt, Human
ucucuggccuuc

SEQ ID NO: 1594966 - RNA, 21 nt, Human
acuugaacccgggaggcagag

SEQ ID NO: 1594967 - RNA, 20 nt, Human
acuugaacccgggaggcaga

SEQ ID NO: 1594968 - RNA, 19 nt, Human
acuugaacccgggaggcag

SEQ ID NO: 1594969 - RNA, 21 nt, Human
acuugaacccauauuuguaca

SEQ ID NO: 1594970 - RNA, 16 nt, Human
acuugucaauaaaauc

SEQ ID NO: 1594971 - RNA, 23 nt, Human
acuucuaaguaaaaccacagcag

SEQ ID NO: 1594972 - RNA, 16 nt, Human
acuuguguuuugcaag

SEQ ID NO: 1594973 - RNA, 12 nt, Human
ucucaggaaauc

SEQ ID NO: 1594974 - RNA, 19 nt, Human
agacacaacuauuuuucca

SEQ ID NO: 1594975 - RNA, 20 nt, Human
agacacaacuauuuuuccaa

SEQ ID NO: 1594976 - RNA, 17 nt, Human
agacacacugaagaagc

SEQ ID NO: 1594977 - RNA, 16 nt, Human
agacacacugaagaag

SEQ ID NO: 1594978 - RNA, 14 nt, Human
ucuuaauuaaaaga

SEQ ID NO: 1594979 - RNA, 23 nt, Human
ucuuagaugcaguucugaagaag

SEQ ID NO: 1594980 - RNA, 24 nt, Human
agagacagaaagcagaacagugau

SEQ ID NO: 1594981 - RNA, 15 nt, Human
ucuuauuucauuucu

SEQ ID NO: 1594982 - RNA, 16 nt, Human
ucuuauuucauuucuu

SEQ ID NO: 1594983 - RNA, 14 nt, Human
agacauagaauuaa

SEQ ID NO: 1594984 - RNA, 14 nt, Human
agagcaaaauugau

SEQ ID NO: 1594985 - RNA, 20 nt, Human
agagcaaaauugauguguuu

SEQ ID NO: 1594986 - RNA, 23 nt, Human
ugaaauaagccagacaucaacag

SEQ ID NO: 1594987 - RNA, 20 nt, Human
ugaaauaagccagacaucaa

SEQ ID NO: 1594988 - RNA, 18 nt, Human
ugaaauaagccagacauc

SEQ ID NO: 1594989 - RNA, 17 nt, Human
ugaaauaagccagacau

SEQ ID NO: 1594990 - RNA, 15 nt, Human
agagcugcccucucc

SEQ ID NO: 1594991 - RNA, 13 nt, Human
agagcugcccucu

SEQ ID NO: 1594992 - RNA, 14 nt, Human
agagcugcccucuc

SEQ ID NO: 1594993 - RNA, 18 nt, Human
ugaaauauuauguuaaaa

SEQ ID NO: 1594994 - RNA, 15 nt, Human
ugaaauuguauuaca

SEQ ID NO: 1594995 - RNA, 20 nt, Human
ugaacaaauuuacagagaca

SEQ ID NO: 1594996 - RNA, 19 nt, Human
ugaacaaauuuacagagac

SEQ ID NO: 1594997 - RNA, 21 nt, Human
agagcuguucacagccagacu

SEQ ID NO: 1594998 - RNA, 15 nt, Human
agagguugcagugag

SEQ ID NO: 1594999 - RNA, 18 nt, Human
ugacauaaaaacaacuuu

SEQ ID NO: 1595000 - RNA, 20 nt, Human
ugacauaaaaacaacuuuau

SEQ ID NO: 1595001 - RNA, 17 nt, Human
ugacauaaaaacaacuu

SEQ ID NO: 1595002 - RNA, 17 nt, Human
ugacccacaagaaauga

SEQ ID NO: 1595003 - RNA, 15 nt, Human
agaugcuagaacucc

SEQ ID NO: 1595004 - RNA, 14 nt, Human
agaugcuagaacuc

SEQ ID NO: 1595005 - RNA, 20 nt, Human
agaugcaguucugaagaaga

SEQ ID NO: 1595006 - RNA, 19 nt, Human
agaugcaguucugaagaag

SEQ ID NO: 1595007 - RNA, 18 nt, Human
agaugcaguucugaagaa

SEQ ID NO: 1595008 - RNA, 14 nt, Human
agagugaacaaauu

SEQ ID NO: 1595009 - RNA, 17 nt, Human
agaguuuagcuggaaaa

SEQ ID NO: 1595010 - RNA, 16 nt, Human
agaguuuagcuggaaa

SEQ ID NO: 1595011 - RNA, 15 nt, Human
ugaguucuacauaag

SEQ ID NO: 1595012 - RNA, 20 nt, Human
ugaguucuacauaaguaauu

SEQ ID NO: 1595013 - RNA, 22 nt, Human
ugaguucuacauaaguaauuca

SEQ ID NO: 1595014 - RNA, 16 nt, Human
ugauaaguaaaugcua

SEQ ID NO: 1595015 - RNA, 13 nt, Human
ugauaaguucaua

SEQ ID NO: 1595016 - RNA, 15 nt, Human
ugauaaguucauaca

SEQ ID NO: 1595017 - RNA, 17 nt, Human
ugauaaguucauacauu

SEQ ID NO: 1595018 - RNA, 19 nt, Human
ugauaaguucauacauugu

SEQ ID NO: 1595019 - RNA, 13 nt, Human
agcauaccaacac

SEQ ID NO: 1595020 - RNA, 22 nt, Human
agcauaccaacacgagcaggcu

SEQ ID NO: 1595021 - RNA, 19 nt, Human
agcauaccaacacgagcag

SEQ ID NO: 1595022 - RNA, 19 nt, Human
agcagucaggaaagagaac

SEQ ID NO: 1595023 - RNA, 18 nt, Human
agcagucaggaaagagaa

SEQ ID NO: 1595024 - RNA, 17 nt, Human
agcagucaggaaagaga

SEQ ID NO: 1595025 - RNA, 20 nt, Human
agcaggcuacugucagcucc

SEQ ID NO: 1595026 - RNA, 19 nt, Human
agcaggcuacugucagcuc

SEQ ID NO: 1595027 - RNA, 17 nt, Human
agcaggcuacugucagc

SEQ ID NO: 1595028 - RNA, 16 nt, Human
agcaggcuacugucag

SEQ ID NO: 1595029 - RNA, 14 nt, Human
agcaggcuacuguc

SEQ ID NO: 1595030 - RNA, 19 nt, Human
agcagggcauggcugggaa

SEQ ID NO: 1595031 - RNA, 22 nt, Human
agcauuuagauguauagguuga

SEQ ID NO: 1595032 - RNA, 14 nt, Human
ugaugggaaagcau

SEQ ID NO: 1595033 - RNA, 16 nt, Human
ugauuaaguaaugaua

SEQ ID NO: 1595034 - RNA, 15 nt, Human
ugauuaaguaaugau

SEQ ID NO: 1595035 - RNA, 22 nt, Human
ugcaaagcacugacuucuaagu

SEQ ID NO: 1595036 - RNA, 20 nt, Human
ugcaaagcacugacuucuaa

SEQ ID NO: 1595037 - RNA, 18 nt, Human
ugcaaagcacugacuucu

SEQ ID NO: 1595038 - RNA, 13 nt, Human
ugauuucauucaa

SEQ ID NO: 1595039 - RNA, 21 nt, Human
ugcaagccagauuuuccugaa

SEQ ID NO: 1595040 - RNA, 15 nt, Human
ugcaagccagauuuu

SEQ ID NO: 1595041 - RNA, 17 nt, Human
ugcaauaaaauggguuu

SEQ ID NO: 1595042 - RNA, 21 nt, Human
ugcaauaaaauggguuuuacu

SEQ ID NO: 1595043 - RNA, 18 nt, Human
agccccgugggguuccuc

SEQ ID NO: 1595044 - RNA, 15 nt, Human
ugcacuccagccuga

SEQ ID NO: 1595045 - RNA, 17 nt, Human
ugcacuccagccugagc

SEQ ID NO: 1595046 - RNA, 22 nt, Human
ugcagaagacaguauggcagcu

SEQ ID NO: 1595047 - RNA, 17 nt, Human
ugccaguuauggcuaua

SEQ ID NO: 1595048 - RNA, 13 nt, Human
ugccauaauuacu

SEQ ID NO: 1595049 - RNA, 19 nt, Human
ugcauacucauuaggaugg

SEQ ID NO: 1595050 - RNA, 20 nt, Human
ugcauagauucccugagcag

SEQ ID NO: 1595051 - RNA, 21 nt, Human
uggaacaagaugguucuagca

SEQ ID NO: 1595052 - RNA, 17 nt, Human
ugcuuuuaaaaaaaaau

SEQ ID NO: 1595053 - RNA, 17 nt, Human
aggagaguagaacagau

SEQ ID NO: 1595054 - RNA, 19 nt, Human
aggagaaacuggaacucuc

SEQ ID NO: 1595055 - RNA, 18 nt, Human
aggagaaacuggaacucu

SEQ ID NO: 1595056 - RNA, 20 nt, Human
aggacgcucucuggccuucg

SEQ ID NO: 1595057 - RNA, 19 nt, Human
aggacgcucucuggccuuc

SEQ ID NO: 1595058 - RNA, 17 nt, Human
aggacgcucucuggccu

SEQ ID NO: 1595059 - RNA, 16 nt, Human
aggacgcucucuggcc

SEQ ID NO: 1595060 - RNA, 14 nt, Human
aggacgcucucugg

SEQ ID NO: 1595061 - RNA, 13 nt, Human
aggacgcucucug

SEQ ID NO: 1595062 - RNA, 14 nt, Human
uggaguugaaaauc

SEQ ID NO: 1595063 - RNA, 15 nt, Human
aggcccccaggugcc

SEQ ID NO: 1595064 - RNA, 20 nt, Human
aggcauuuaggccaugggac

SEQ ID NO: 1595065 - RNA, 15 nt, Human
aggcagcuugaaacu

SEQ ID NO: 1595066 - RNA, 21 nt, Human
uggagcucgugggacagucac

SEQ ID NO: 1595067 - RNA, 21 nt, Human
uggagcucguggaacaguuac

SEQ ID NO: 1595068 - RNA, 17 nt, Human
uggagcucguggaacag

SEQ ID NO: 1595069 - RNA, 20 nt, Human
ugcccuguuaaaagaugaaa

SEQ ID NO: 1595070 - RNA, 13 nt, Human
agcugcccucucc

SEQ ID NO: 1595071 - RNA, 14 nt, Human
agcugcccucuccu

SEQ ID NO: 1595072 - RNA, 15 nt, Human
agcugcccucuccug

SEQ ID NO: 1595073 - RNA, 16 nt, Human
agcugcccucuccugg

SEQ ID NO: 1595074 - RNA, 14 nt, Human
agcuguucacagcc

SEQ ID NO: 1595075 - RNA, 20 nt, Human
agcuugcccuggugccucac

SEQ ID NO: 1595076 - RNA, 19 nt, Human
agcuugcccuguuaaaaga

SEQ ID NO: 1595077 - RNA, 18 nt, Human
agcuugcccuguuaaaag

SEQ ID NO: 1595078 - RNA, 16 nt, Human
agcuugcccuguuaaa

SEQ ID NO: 1595079 - RNA, 19 nt, Human
ugccuuuucccaacuccag

SEQ ID NO: 1595080 - RNA, 17 nt, Human
ugccuuuucccaacucc

SEQ ID NO: 1595081 - RNA, 15 nt, Human
ugcuacaaaaacaca

SEQ ID NO: 1595082 - RNA, 14 nt, Human
ugcuacaaaaacac

SEQ ID NO: 1595083 - RNA, 20 nt, Human
aggaaaucaaauaugcaaag

SEQ ID NO: 1595084 - RNA, 22 nt, Human
aggaaaucaaauaugcaaagca

SEQ ID NO: 1595085 - RNA, 21 nt, Human
aggaaaucaaauaugcaaagc

SEQ ID NO: 1595086 - RNA, 23 nt, Human
aggaaaucaaauaugcaaagcac

SEQ ID NO: 1595087 - RNA, 16 nt, Human
uguaaauaguauuuga

SEQ ID NO: 1595088 - RNA, 23 nt, Human
uggugugaccacugcagaagaca

SEQ ID NO: 1595089 - RNA, 20 nt, Human
uguauucuagcuaauguaau

SEQ ID NO: 1595090 - RNA, 22 nt, Human
uguauuacaaauccaaugaaau

SEQ ID NO: 1595091 - RNA, 13 nt, Human
uguauuacaaauc

SEQ ID NO: 1595092 - RNA, 22 nt, Human
uguauucuagcuaauguaauaa

SEQ ID NO: 1595093 - RNA, 18 nt, Human
uguaucacaaaucuuaac

SEQ ID NO: 1595094 - RNA, 15 nt, Human
uguaucacaaaucuu

SEQ ID NO: 1595095 - RNA, 16 nt, Human
uguaguguuggagaag

SEQ ID NO: 1595096 - RNA, 15 nt, Human
uguaguguuggagaa

SEQ ID NO: 1595097 - RNA, 14 nt, Human
uguaguguuggaga

SEQ ID NO: 1595098 - RNA, 16 nt, Human
aguaguaauagagcaa

SEQ ID NO: 1595099 - RNA, 18 nt, Human
aguauuagaauaccacag

SEQ ID NO: 1595100 - RNA, 17 nt, Human
agucaccucauggaauu

SEQ ID NO: 1595101 - RNA, 15 nt, Human
agucaccucauggaa

SEQ ID NO: 1595102 - RNA, 14 nt, Human
agucaccucaugga

SEQ ID NO: 1595103 - RNA, 21 nt, Human
aguauuagaauaccacaggaa

SEQ ID NO: 1595104 - RNA, 18 nt, Human
aguauuucuaugaaauau

SEQ ID NO: 1595105 - RNA, 16 nt, Human
aguauuucuaugaaau

SEQ ID NO: 1595106 - RNA, 17 nt, Human
aguauuucuaugaaaua

SEQ ID NO: 1595107 - RNA, 14 nt, Human
aguaauagagcaaa

SEQ ID NO: 1595108 - RNA, 17 nt, Human
aguaaugauaacuggaa

SEQ ID NO: 1595109 - RNA, 20 nt, Human
aguaaugauaacuggaaacu

SEQ ID NO: 1595110 - RNA, 18 nt, Human
aguaaugauaacuggaaa

SEQ ID NO: 1595111 - RNA, 13 nt, Human
aguaaaauccaca

SEQ ID NO: 1595112 - RNA, 16 nt, Human
uguagaggagaaacug

SEQ ID NO: 1595113 - RNA, 15 nt, Human
aguaauucaagaaaa

SEQ ID NO: 1595114 - RNA, 16 nt, Human
aguacauuuggagaca

SEQ ID NO: 1595115 - RNA, 18 nt, Human
aggggagcaugggaagug

SEQ ID NO: 1595116 - RNA, 16 nt, Human
aggggaauugaggaca

SEQ ID NO: 1595117 - RNA, 22 nt, Human
agggaggacgcucucuggccuu

SEQ ID NO: 1595118 - RNA, 21 nt, Human
agggaggacgcucucuggccu

SEQ ID NO: 1595119 - RNA, 23 nt, Human
agggaggacgcucucuggccuuc

SEQ ID NO: 1595120 - RNA, 17 nt, Human
uuaauuccaauuauaug

SEQ ID NO: 1595121 - RNA, 22 nt, Human
uuaagaagacugcauuauauuu

SEQ ID NO: 1595122 - RNA, 18 nt, Human
uuaaguaaugauaacugg

SEQ ID NO: 1595123 - RNA, 19 nt, Human
auaaaauccauacauuugu

SEQ ID NO: 1595124 - RNA, 18 nt, Human
auaaaauccauacauuug

SEQ ID NO: 1595125 - RNA, 22 nt, Human
auaaaauaauuuuuauauuuga

SEQ ID NO: 1595126 - RNA, 21 nt, Human
auaaaauaauuuuuauauuug

SEQ ID NO: 1595127 - RNA, 16 nt, Human
auaaaauaauuuuuau

SEQ ID NO: 1595128 - RNA, 14 nt, Human
uuaccuuacagaag

SEQ ID NO: 1595129 - RNA, 15 nt, Human
uuacuguaagaaaau

SEQ ID NO: 1595130 - RNA, 14 nt, Human
uguuuauuuauaga

SEQ ID NO: 1595131 - RNA, 24 nt, Human
uguuuauuuauagaguguacuuaa

SEQ ID NO: 1595132 - RNA, 19 nt, Human
uguuuugaaucucauaauu

SEQ ID NO: 1595133 - RNA, 19 nt, Human
uguuuucauuaucucaaaa

SEQ ID NO: 1595134 - RNA, 16 nt, Human
aguucugcagauaaac

SEQ ID NO: 1595135 - RNA, 21 nt, Human
aguucugcagauaaacaguag

SEQ ID NO: 1595136 - RNA, 14 nt, Human
uguuuugcaagcca

SEQ ID NO: 1595137 - RNA, 18 nt, Human
aguuguaccgcaauguga

SEQ ID NO: 1595138 - RNA, 22 nt, Human
aguugcauagguuuaauaauuu

SEQ ID NO: 1595139 - RNA, 19 nt, Human
uguguuaaguauguguaaa

SEQ ID NO: 1595140 - RNA, 15 nt, Human
uguuaaguaugugua

SEQ ID NO: 1595141 - RNA, 16 nt, Human
uguuaaguauguguaa

SEQ ID NO: 1595142 - RNA, 13 nt, Human
uguguaaguagau

SEQ ID NO: 1595143 - RNA, 20 nt, Human
ugugugaaagguacuucaaa

SEQ ID NO: 1595144 - RNA, 14 nt, Human
agugugucuaaauu

SEQ ID NO: 1595145 - RNA, 15 nt, Human
uguuauaaucuuuca

SEQ ID NO: 1595146 - RNA, 18 nt, Human
uguuccuagugaaagagg

SEQ ID NO: 1595147 - RNA, 14 nt, Human
uguuccuagugaaa

SEQ ID NO: 1595148 - RNA, 17 nt, Human
aguguacuuaacuauuc

SEQ ID NO: 1595149 - RNA, 18 nt, Human
agucacuaccuucaugca

SEQ ID NO: 1595150 - RNA, 22 nt, Human
agucucaggaaaucaaauaugc

SEQ ID NO: 1595151 - RNA, 22 nt, Human
ugugagaugcuagaacucccuu

SEQ ID NO: 1595152 - RNA, 19 nt, Human
ugugagaugcuagaacucc

SEQ ID NO: 1595153 - RNA, 15 nt, Human
ugugagaugcuagaa

SEQ ID NO: 1595154 - RNA, 16 nt, Human
ugugauguauucuagc

SEQ ID NO: 1595155 - RNA, 14 nt, Human
ugugauguauucua

SEQ ID NO: 1595156 - RNA, 20 nt, Human
agugaacaaauuuacagaga

SEQ ID NO: 1595157 - RNA, 16 nt, Human
agugaacaaauuuaca

SEQ ID NO: 1595158 - RNA, 15 nt, Human
agugaaagaaaauaa

SEQ ID NO: 1595159 - RNA, 17 nt, Human
agugaaagaaaauaaca

SEQ ID NO: 1595160 - RNA, 17 nt, Human
auauuguguugugaaug

SEQ ID NO: 1595161 - RNA, 18 nt, Human
auauuguguugugaaugu

SEQ ID NO: 1595162 - RNA, 13 nt, Human
auauuugaaauau

SEQ ID NO: 1595163 - RNA, 22 nt, Human
auauuuguaucacaaaucuuaa

SEQ ID NO: 1595164 - RNA, 12 nt, Human
auauuuuaacuu

SEQ ID NO: 1595165 - RNA, 23 nt, Human
auauuugaaauauugacuuuuua

SEQ ID NO: 1595166 - RNA, 19 nt, Human
auauuugaaauauugacuu

SEQ ID NO: 1595167 - RNA, 14 nt, Human
auauuugaaauauu

SEQ ID NO: 1595168 - RNA, 20 nt, Human
aucagugugucuaaauuuga

SEQ ID NO: 1595169 - RNA, 19 nt, Human
aucagugugucuaaauuug

SEQ ID NO: 1595170 - RNA, 18 nt, Human
uucucaacuccaaacuga

SEQ ID NO: 1595171 - RNA, 14 nt, Human
uucucaacuccaaa

SEQ ID NO: 1595172 - RNA, 14 nt, Human
aucccucccuccac

SEQ ID NO: 1595173 - RNA, 23 nt, Human
aucccucccuccaccucccugca

SEQ ID NO: 1595174 - RNA, 11 nt, Human
aucccucccuc

SEQ ID NO: 1595175 - RNA, 13 nt, Human
aucccucccucca

SEQ ID NO: 1595176 - RNA, 13 nt, Human
uucugaagaagau

SEQ ID NO: 1595177 - RNA, 12 nt, Human
uucugaagaaga

SEQ ID NO: 1595178 - RNA, 23 nt, Human
uucugcaucagcugcugaaacaa

SEQ ID NO: 1595179 - RNA, 14 nt, Human
uucugaagaagaug

SEQ ID NO: 1595180 - RNA, 16 nt, Human
uucaaacuuuggaaca

SEQ ID NO: 1595181 - RNA, 15 nt, Human
uucaaacauauauaa

SEQ ID NO: 1595182 - RNA, 22 nt, Human
uucaagaaaacaacuucaauau

SEQ ID NO: 1595183 - RNA, 20 nt, Human
uucacauaucuaguaugaaa

SEQ ID NO: 1595184 - RNA, 21 nt, Human
uucacauaucuaguaugaaau

SEQ ID NO: 1595185 - RNA, 21 nt, Human
auaggaauugacccacaagaa

SEQ ID NO: 1595186 - RNA, 22 nt, Human
auaggaauugacccacaagaaa

SEQ ID NO: 1595187 - RNA, 17 nt, Human
uuauuguuuaaaaucau

SEQ ID NO: 1595188 - RNA, 18 nt, Human
auagcuacuaauuuuaaa

SEQ ID NO: 1595189 - RNA, 14 nt, Human
auagcuacuaauuu

SEQ ID NO: 1595190 - RNA, 17 nt, Human
auagcuacuaauuuuaa

SEQ ID NO: 1595191 - RNA, 17 nt, Human
auauaaguauucuaaau

SEQ ID NO: 1595192 - RNA, 19 nt, Human
auauaagcuuguauuccuu

SEQ ID NO: 1595193 - RNA, 17 nt, Human
auauaacaaugcuguau

SEQ ID NO: 1595194 - RNA, 15 nt, Human
auauaacaaugcugu

SEQ ID NO: 1595195 - RNA, 12 nt, Human
auauaacaaugc

SEQ ID NO: 1595196 - RNA, 19 nt, Human
auauaaguauucuaaauuu

SEQ ID NO: 1595197 - RNA, 19 nt, Human
auauauaacaaugcuguau

SEQ ID NO: 1595198 - RNA, 18 nt, Human
auauauaacaaugcugua

SEQ ID NO: 1595199 - RNA, 17 nt, Human
auauauaacaaugcugu

SEQ ID NO: 1595200 - RNA, 18 nt, Human
auagucaaauugugugaa

SEQ ID NO: 1595201 - RNA, 17 nt, Human
auagucaaauuguguga

SEQ ID NO: 1595202 - RNA, 13 nt, Human
uucagaaaauauu

SEQ ID NO: 1595203 - RNA, 14 nt, Human
uucagaaaauauua

SEQ ID NO: 1595204 - RNA, 20 nt, Human
uucagaaaauauuauguguu

SEQ ID NO: 1595205 - RNA, 21 nt, Human
uucagaaaauauuauguguuu

SEQ ID NO: 1595206 - RNA, 16 nt, Human
auaugcaaagcacuga

SEQ ID NO: 1595207 - RNA, 23 nt, Human
auaugcaaagcacugacuucuaa

SEQ ID NO: 1595208 - RNA, 18 nt, Human
uuggagacacaacuauuu

SEQ ID NO: 1595209 - RNA, 15 nt, Human
uuggagaagaacuga

SEQ ID NO: 1595210 - RNA, 22 nt, Human
uuggagaagaacugaaaucaua

SEQ ID NO: 1595211 - RNA, 17 nt, Human
uuggagaagaacugaaa

SEQ ID NO: 1595212 - RNA, 15 nt, Human
aucuuuaaaauacac

SEQ ID NO: 1595213 - RNA, 12 nt, Human
aucuuuaaaaua

SEQ ID NO: 1595214 - RNA, 16 nt, Human
aucuuauaauuuaaaa

SEQ ID NO: 1595215 - RNA, 15 nt, Human
aucuuauaauuuaaa

SEQ ID NO: 1595216 - RNA, 17 nt, Human
aucugacuaugacauaa

SEQ ID NO: 1595217 - RNA, 14 nt, Human
aucugacuaugaca

SEQ ID NO: 1595218 - RNA, 22 nt, Human
uugcaagccagauuuuccugaa

SEQ ID NO: 1595219 - RNA, 20 nt, Human
aucucaaaacugcacuguca

SEQ ID NO: 1595220 - RNA, 19 nt, Human
aucucaaaacugcacuguc

SEQ ID NO: 1595221 - RNA, 15 nt, Human
aucucaaaacugcac

SEQ ID NO: 1595222 - RNA, 12 nt, Human
uugacuuuuuau

SEQ ID NO: 1595223 - RNA, 13 nt, Human
uugacaugggaca

SEQ ID NO: 1595224 - RNA, 16 nt, Human
uuguagcuuuaucaaa

SEQ ID NO: 1595225 - RNA, 17 nt, Human
uuguagcuuuaucaaag

SEQ ID NO: 1595226 - RNA, 15 nt, Human
augagguacugagag

SEQ ID NO: 1595227 - RNA, 18 nt, Human
augagguacugagaguga

SEQ ID NO: 1595228 - RNA, 17 nt, Human
augagguacugagagug

SEQ ID NO: 1595229 - RNA, 20 nt, Human
uugucaauaaaauccauaca

SEQ ID NO: 1595230 - RNA, 20 nt, Human
uuguucaauaauaaauauuu

SEQ ID NO: 1595231 - RNA, 13 nt, Human
uuguucauacaua

SEQ ID NO: 1595232 - RNA, 22 nt, Human
uuguucaauaauaaauauuuuu

SEQ ID NO: 1595233 - RNA, 16 nt, Human
uuguucauacauauuu

SEQ ID NO: 1595234 - RNA, 18 nt, Human
uuguucauacauauuuuu

SEQ ID NO: 1595235 - RNA, 13 nt, Human
augauuucauuca

SEQ ID NO: 1595236 - RNA, 15 nt, Human
augcaaagcacugac

SEQ ID NO: 1595237 - RNA, 14 nt, Human
augcaaagcacuga

SEQ ID NO: 1595238 - RNA, 13 nt, Human
augcaaagcacug

SEQ ID NO: 1595239 - RNA, 12 nt, Human
augcaaagcacu

SEQ ID NO: 1595240 - RNA, 18 nt, Human
uuuaaaaaaauuccaagu

SEQ ID NO: 1595241 - RNA, 21 nt, Human
uuuaaauauaugcuaagucuu

SEQ ID NO: 1595242 - RNA, 20 nt, Human
uuuaaaaaagaaacauuugg

SEQ ID NO: 1595243 - RNA, 22 nt, Human
uuucacauaucuaguaugaaau

SEQ ID NO: 1595244 - RNA, 19 nt, Human
uuucaaacauauauaacaa

SEQ ID NO: 1595245 - RNA, 21 nt, Human
auggaaugcuguguuaaauaa

SEQ ID NO: 1595246 - RNA, 17 nt, Human
auggaaugcuguguuaa

SEQ ID NO: 1595247 - RNA, 21 nt, Human
augcuucuguuuuauaauuuu

SEQ ID NO: 1595248 - RNA, 22 nt, Human
augcuguauuuuaaaagaauga

SEQ ID NO: 1595249 - RNA, 23 nt, Human
augcuguauuuuaaaagaaugau

SEQ ID NO: 1595250 - RNA, 21 nt, Human
uuuauaugcuucuguuuuaua

SEQ ID NO: 1595251 - RNA, 18 nt, Human
augcuacaggauuugaaa

SEQ ID NO: 1595252 - RNA, 22 nt, Human
augccuuuucccaacuccagaa

SEQ ID NO: 1595253 - RNA, 20 nt, Human
augccuuuucccaacuccag

SEQ ID NO: 1595254 - RNA, 19 nt, Human
auuugaauguuaagcagau

SEQ ID NO: 1595255 - RNA, 13 nt, Human
auuugaauguuaa

SEQ ID NO: 1595256 - RNA, 18 nt, Human
auuugaauguuaagcaga

SEQ ID NO: 1595257 - RNA, 21 nt, Human
auuuauuuuaauaauguuuca

SEQ ID NO: 1595258 - RNA, 20 nt, Human
auuuauuacuguaagaaaau

SEQ ID NO: 1595259 - RNA, 19 nt, Human
auuuauuacuguaagaaaa

SEQ ID NO: 1595260 - RNA, 17 nt, Human
auuuaaaaaaaaaccug

SEQ ID NO: 1595261 - RNA, 16 nt, Human
auuguaguccuguaau

SEQ ID NO: 1595262 - RNA, 22 nt, Human
auuuaccacuuguguuuugcaa

SEQ ID NO: 1595263 - RNA, 15 nt, Human
auuuaccacuugugu

SEQ ID NO: 1595264 - RNA, 12 nt, Human
auugauguguuu

SEQ ID NO: 1595265 - RNA, 19 nt, Human
auugauguguuuauuuaua

SEQ ID NO: 1595266 - RNA, 17 nt, Human
auuggagcucgugggac

SEQ ID NO: 1595267 - RNA, 16 nt, Human
auuggagcucguggaa

SEQ ID NO: 1595268 - RNA, 20 nt, Human
uuuuuguagcacugacagau

SEQ ID NO: 1595269 - RNA, 21 nt, Human
uuuuuguagcacugacagauu

SEQ ID NO: 1595270 - RNA, 19 nt, Human
uuuuuguagcacugacaga

SEQ ID NO: 1595271 - RNA, 12 nt, Human
uuuuugacagaa

SEQ ID NO: 1595272 - RNA, 13 nt, Human
uuuuugacagaau

SEQ ID NO: 1595273 - RNA, 17 nt, Human
uuuuuauauuugaaaua

SEQ ID NO: 1595274 - RNA, 14 nt, Human
uuuugugaagcaaa

SEQ ID NO: 1595275 - RNA, 15 nt, Human
uuuuguuuucauuau

SEQ ID NO: 1595276 - RNA, 16 nt, Human
auuacuguaagaaaau

SEQ ID NO: 1595277 - RNA, 15 nt, Human
auuacuguaagaaaa

SEQ ID NO: 1595278 - RNA, 21 nt, Human
auucaggagaguagaacagau

SEQ ID NO: 1595279 - RNA, 22 nt, Human
auucaggagaguagaacagaua

SEQ ID NO: 1595280 - RNA, 17 nt, Human
auuccaagugauugaaa

SEQ ID NO: 1595281 - RNA, 20 nt, Human
auuauauggcuugaguuuaa

SEQ ID NO: 1595282 - RNA, 22 nt, Human
auucaaacagucucaggaaauc

SEQ ID NO: 1595283 - RNA, 18 nt, Human
uuugacagaauauguuuc

SEQ ID NO: 1595284 - RNA, 19 nt, Human
uuugacagaauauguuuca

SEQ ID NO: 1595285 - RNA, 20 nt, Human
uuugacagaauauguuucaa

SEQ ID NO: 1595286 - RNA, 21 nt, Human
uuugacagaauauguuucaaa

SEQ ID NO: 1595287 - RNA, 14 nt, Human
uuugagaguucuaa

SEQ ID NO: 1595288 - RNA, 13 nt, Human
uuugagaguucua

SEQ ID NO: 1595289 - RNA, 20 nt, Human
uuugcuggagcucugcccau

SEQ ID NO: 1595290 - RNA, 19 nt, Human
uuugcuaagcauuccaacu

SEQ ID NO: 1595291 - RNA, 19 nt, Human
auguauauuuuauaucaau

SEQ ID NO: 1595292 - RNA, 23 nt, Human
augucgucaaagcugaaauggac

SEQ ID NO: 1595293 - RNA, 17 nt, Human
uuuguaguguuggagaa

SEQ ID NO: 1595294 - RNA, 12 nt, Human
auguguuuccau

SEQ ID NO: 1595295 - RNA, 21 nt, Human
augugcuaguaauuggaaagg

SEQ ID NO: 1595296 - RNA, 12 nt, Human
auguuaagcaga

SEQ ID NO: 1595297 - RNA, 13 nt, Human
auguuaagcagau

SEQ ID NO: 1595298 - RNA, 20 nt, Human
uuuucaggcuagauguaugu

SEQ ID NO: 1595299 - RNA, 16 nt, Human
uuuucuauaauuuaaa

SEQ ID NO: 1595300 - RNA, 18 nt, Human
cuucaucugacuaugaca

SEQ ID NO: 1595301 - RNA, 23 nt, Human
cuucaugcugucuacacuaagag

SEQ ID NO: 1595302 - RNA, 12 nt, Human
cuucaucugacu

SEQ ID NO: 1595303 - RNA, 11 nt, Human
cuucagacaua

SEQ ID NO: 1595304 - RNA, 21 nt, Human
cuuugagugucuuaauuaaaa

SEQ ID NO: 1595305 - RNA, 20 nt, Human
cuucuguuuuauaauuuugu

SEQ ID NO: 1595306 - RNA, 15 nt, Human
cuucuguuuuauaau

SEQ ID NO: 1595307 - RNA, 13 nt, Human
cugggcagcugcc

SEQ ID NO: 1595308 - RNA, 16 nt, Human
cugggcagcugccucc

SEQ ID NO: 1595309 - RNA, 14 nt, Human
cugggcagcugccu

SEQ ID NO: 1595310 - RNA, 15 nt, Human
cugggcagcugccuc

SEQ ID NO: 1595311 - RNA, 21 nt, Human
cuggugccucaccccuugcca

SEQ ID NO: 1595312 - RNA, 16 nt, Human
cugcacuccagccuga

SEQ ID NO: 1595313 - RNA, 20 nt, Human
cugcacuccagccugagcga

SEQ ID NO: 1595314 - RNA, 17 nt, Human
cugcacuccagccugag

SEQ ID NO: 1595315 - RNA, 14 nt, Human
gaugguucuagcau

SEQ ID NO: 1595316 - RNA, 18 nt, Human
gauguagaggagaaacug

SEQ ID NO: 1595317 - RNA, 16 nt, Human
gaugaucuuuaaaaua

SEQ ID NO: 1595318 - RNA, 15 nt, Human
gauuuaccacuugug

SEQ ID NO: 1595319 - RNA, 16 nt, Human
gauuuaccacuugugu

SEQ ID NO: 1595320 - RNA, 20 nt, Human
gcaaguauuagaauaccaca

SEQ ID NO: 1595321 - RNA, 22 nt, Human
gcaauagucaaauugugugaaa

SEQ ID NO: 1595322 - RNA, 22 nt, Human
gcacaguuuucugagaaagacu

SEQ ID NO: 1595323 - RNA, 23 nt, Human
gcacaguuuucugagaaagacua

SEQ ID NO: 1595324 - RNA, 16 nt, Human
gaguuuaaauuguaau

SEQ ID NO: 1595325 - RNA, 15 nt, Human
gaggacgcucucugg

SEQ ID NO: 1595326 - RNA, 20 nt, Human
gaggacgcucucuggccuuc

SEQ ID NO: 1595327 - RNA, 23 nt, Human
gaggcuccacuuggucugugaga

SEQ ID NO: 1595328 - RNA, 12 nt, Human
gaggcuccacuu

SEQ ID NO: 1595329 - RNA, 19 nt, Human
gaggcuccacuuggucugu

SEQ ID NO: 1595330 - RNA, 14 nt, Human
gaauauguuucaaa

SEQ ID NO: 1595331 - RNA, 15 nt, Human
gaauauguuucaaac

SEQ ID NO: 1595332 - RNA, 20 nt, Human
gaauauguuucaaacuuugg

SEQ ID NO: 1595333 - RNA, 14 nt, Human
gaagcaaaauuuuu

SEQ ID NO: 1595334 - RNA, 23 nt, Human
gaagcaacccaaauguucaucaa

SEQ ID NO: 1595335 - RNA, 14 nt, Human
gaacugaaaucaua

SEQ ID NO: 1595336 - RNA, 17 nt, Human
gacauuugcucauggaa

SEQ ID NO: 1595337 - RNA, 16 nt, Human
gacauuugcucaugga

SEQ ID NO: 1595338 - RNA, 21 nt, Human
gacagugagacucugucucag

SEQ ID NO: 1595339 - RNA, 16 nt, Human
gacacacugaagaagc

SEQ ID NO: 1595340 - RNA, 15 nt, Human
gacacacugaagaag

SEQ ID NO: 1595341 - RNA, 21 nt, Human
gacagaaagcagaacagugau

SEQ ID NO: 1595342 - RNA, 21 nt, Human
gacucuuaagaagacugcauu

SEQ ID NO: 1595343 - RNA, 15 nt, Human
gacucuuaagaagac

SEQ ID NO: 1595344 - RNA, 14 nt, Human
gacucuuaagaaga

SEQ ID NO: 1595345 - RNA, 17 nt, Human
gacgcucucuggccuuc

SEQ ID NO: 1595346 - RNA, 16 nt, Human
gacgcucucuggccuu

SEQ ID NO: 1595347 - RNA, 15 nt, Human
gacgcucucuggccu

SEQ ID NO: 1595348 - RNA, 19 nt, Human
aaacaacuucaauauccaa

SEQ ID NO: 1595349 - RNA, 17 nt, Human
aaacaaggaugaauuaa

SEQ ID NO: 1595350 - RNA, 19 nt, Human
aaaauuuuuucucuaggaa

SEQ ID NO: 1595351 - RNA, 21 nt, Human
aaaauauuauguguuuccaua

SEQ ID NO: 1595352 - RNA, 14 nt, Human
aaaauauuaugugu

SEQ ID NO: 1595353 - RNA, 15 nt, Human
aaaauauuauguguu

SEQ ID NO: 1595354 - RNA, 21 nt, Human
aaacauauauaacaaugcugu

SEQ ID NO: 1595355 - RNA, 19 nt, Human
aaacauauauaacaaugcu

SEQ ID NO: 1595356 - RNA, 16 nt, Human
aaacauauauaacaau

SEQ ID NO: 1595357 - RNA, 13 nt, Human
aaacauauauaac

SEQ ID NO: 1595358 - RNA, 14 nt, Human
aaacacaacuauau

SEQ ID NO: 1595359 - RNA, 16 nt, Human
aaaccacagcaguuga

SEQ ID NO: 1595360 - RNA, 15 nt, Human
aaagauuuucagaaa

SEQ ID NO: 1595361 - RNA, 20 nt, Human
aaagaggcagcuugaaacug

SEQ ID NO: 1595362 - RNA, 23 nt, Human
aaagacuauucaaacagucucag

SEQ ID NO: 1595363 - RNA, 13 nt, Human
aaagacuccaaag

SEQ ID NO: 1595364 - RNA, 14 nt, Human
aaagacuccaaaga

SEQ ID NO: 1595365 - RNA, 22 nt, Human
aaagacuauucaaacagucuca

SEQ ID NO: 1595366 - RNA, 18 nt, Human
aaagagaacuuccagauc

SEQ ID NO: 1595367 - RNA, 21 nt, Human
ggucauauuaauauauuucca

SEQ ID NO: 1595368 - RNA, 16 nt, Human
aaagaaugauuaugaa

SEQ ID NO: 1595369 - RNA, 21 nt, Human
aaagauuuucagaaaauauua

SEQ ID NO: 1595370 - RNA, 24 nt, Human
ggucugugagaugcuagaacuccc

SEQ ID NO: 1595371 - RNA, 14 nt, Human
ggucugugagaugc

SEQ ID NO: 1595372 - RNA, 13 nt, Human
aaaggaauuuaaa

SEQ ID NO: 1595373 - RNA, 14 nt, Human
aaaauauauuuaau

SEQ ID NO: 1595374 - RNA, 23 nt, Human
aaaauaauuuuuauauuugaaau

SEQ ID NO: 1595375 - RNA, 21 nt, Human
aaaauaauuuuuauauuugaa

SEQ ID NO: 1595376 - RNA, 20 nt, Human
gggcagcugccuccccuccu

SEQ ID NO: 1595377 - RNA, 23 nt, Human
gggcagcugccuccccuccucug

SEQ ID NO: 1595378 - RNA, 13 nt, Human
gggcagcugccuc

SEQ ID NO: 1595379 - RNA, 14 nt, Human
gggcagcugccucc

SEQ ID NO: 1595380 - RNA, 19 nt, Human
gggcagcugccuccccucc

SEQ ID NO: 1595381 - RNA, 19 nt, Human
aaaagccugcaauuucaua

SEQ ID NO: 1595382 - RNA, 21 nt, Human
aaaacuuuaugcuaagugaaa

SEQ ID NO: 1595383 - RNA, 22 nt, Human
aaaagcuccauuuuuagugaaa

SEQ ID NO: 1595384 - RNA, 20 nt, Human
gggaggcagagguugcagug

SEQ ID NO: 1595385 - RNA, 23 nt, Human
ggaugguucccuugaugaagaag

SEQ ID NO: 1595386 - RNA, 22 nt, Human
ggaugguucccuugaugaagaa

SEQ ID NO: 1595387 - RNA, 19 nt, Human
ggaggcugagaugggagaa

SEQ ID NO: 1595388 - RNA, 15 nt, Human
ggaggcugagauggg

SEQ ID NO: 1595389 - RNA, 21 nt, Human
gccacuguuuugaaucucaua

SEQ ID NO: 1595390 - RNA, 22 nt, Human
gccagcaguucagagcugcccu

SEQ ID NO: 1595391 - RNA, 23 nt, Human
gccagcaguucagagcugcccuc

SEQ ID NO: 1595392 - RNA, 22 nt, Human
gccagacaucaacagauaaaua

SEQ ID NO: 1595393 - RNA, 16 nt, Human
gcccccaggugccagu

SEQ ID NO: 1595394 - RNA, 13 nt, Human
gcccuguuaaaag

SEQ ID NO: 1595395 - RNA, 17 nt, Human
gcccuguuaaaagauga

SEQ ID NO: 1595396 - RNA, 14 nt, Human
gcccuguuaaaaga

SEQ ID NO: 1595397 - RNA, 22 nt, Human
gcuuccuucugugaaaguacau

SEQ ID NO: 1595398 - RNA, 17 nt, Human
gcuggagcucugcccau

SEQ ID NO: 1595399 - RNA, 16 nt, Human
gcugccuccccuccuc

SEQ ID NO: 1595400 - RNA, 17 nt, Human
gcugccuccccuccucu

SEQ ID NO: 1595401 - RNA, 20 nt, Human
gcugccuccccuccucugcu

SEQ ID NO: 1595402 - RNA, 21 nt, Human
gcugccuccccuccucugcuu

SEQ ID NO: 1595403 - RNA, 22 nt, Human
gcugccuccccuccucugcuug

SEQ ID NO: 1595404 - RNA, 15 nt, Human
gcuccccucggagaa

SEQ ID NO: 1595405 - RNA, 18 nt, Human
gcuccccucggagaagag

SEQ ID NO: 1595406 - RNA, 16 nt, Human
gcuaguaucaaaagaa

SEQ ID NO: 1595407 - RNA, 21 nt, Human
gcuaguaauuggaaaggcagc

SEQ ID NO: 1595408 - RNA, 15 nt, Human
caacuauuuuuccaa

SEQ ID NO: 1595409 - RNA, 12 nt, Human
caacuccagaaa

SEQ ID NO: 1595410 - RNA, 20 nt, Human
caacuauuuuuccaaaauaa

SEQ ID NO: 1595411 - RNA, 19 nt, Human
caacuaucucauuuccaag

SEQ ID NO: 1595412 - RNA, 19 nt, Human
caacuauauuguuugcuaa

SEQ ID NO: 1595413 - RNA, 14 nt, Human
caagcaaguauuag

SEQ ID NO: 1595414 - RNA, 17 nt, Human
caaucagccuaguugau

SEQ ID NO: 1595415 - RNA, 23 nt, Human
cacaucagcuugcccuguuaaaa

SEQ ID NO: 1595416 - RNA, 21 nt, Human
cacuccagugagacagcucug

SEQ ID NO: 1595417 - RNA, 23 nt, Human
cacugaagaagcaccaaucauga

SEQ ID NO: 1595418 - RNA, 12 nt, Human
auugauaaguuc

SEQ ID NO: 1595419 - RNA, 15 nt, Human
auugauaaguucaua

SEQ ID NO: 1595420 - RNA, 16 nt, Human
auugauaaguucauac

SEQ ID NO: 1595421 - RNA, 17 nt, Human
auugauaaguucauaca

SEQ ID NO: 1595422 - RNA, 18 nt, Human
auugauaaguucauacau

SEQ ID NO: 1595423 - RNA, 19 nt, Human
auugauaaguucauacauu

SEQ ID NO: 1595424 - RNA, 21 nt, Human
auugauaaguucauacauugu

SEQ ID NO: 1595425 - RNA, 17 nt, Human
auuuucuauaauuuaaa

SEQ ID NO: 1595426 - RNA, 18 nt, Human
auuuucuauaauuuaaau

SEQ ID NO: 1595427 - RNA, 19 nt, Human
auuuucuauaauuuaaaua

SEQ ID NO: 1595428 - RNA, 21 nt, Human
caaaagguauuuuaaucacca

SEQ ID NO: 1595429 - RNA, 19 nt, Human
auuuuuauauuugaaauau

SEQ ID NO: 1595430 - RNA, 22 nt, Human
auugaggacacugauauggguc

SEQ ID NO: 1595431 - RNA, 19 nt, Human
cauagcagcuuauucacaa

SEQ ID NO: 1595432 - RNA, 20 nt, Human
cauagcagcuuauucacaag

SEQ ID NO: 1595433 - RNA, 16 nt, Human
cauagguuuaauaauu

SEQ ID NO: 1595434 - RNA, 23 nt, Human
caguuguucaauaauaaauauuu

SEQ ID NO: 1595435 - RNA, 13 nt, Human
caucagcugcuga

SEQ ID NO: 1595436 - RNA, 19 nt, Human
cauccugaggcuccacuug

SEQ ID NO: 1595437 - RNA, 18 nt, Human
cauccugaggcuccacuu

SEQ ID NO: 1595438 - RNA, 22 nt, Human
cagugauuaccagggacugagg

SEQ ID NO: 1595439 - RNA, 20 nt, Human
caguuauggcuauaggugcu

SEQ ID NO: 1595440 - RNA, 19 nt, Human
caguuauggcuauaggugc

SEQ ID NO: 1595441 - RNA, 13 nt, Human
caguuauggcuau

SEQ ID NO: 1595442 - RNA, 17 nt, Human
caguuauuauauuuaca

SEQ ID NO: 1595443 - RNA, 21 nt, Human
caguuauuauauuuacaaaug

SEQ ID NO: 1595444 - RNA, 22 nt, Human
caguuauuauauuuacaaaugg

SEQ ID NO: 1595445 - RNA, 15 nt, Human
caguucagagcugcc

SEQ ID NO: 1595446 - RNA, 16 nt, Human
caguucagagcugccc

SEQ ID NO: 1595447 - RNA, 17 nt, Human
caguucagagcugcccu

SEQ ID NO: 1595448 - RNA, 23 nt, Human
caguucagagcugcccucuccug

SEQ ID NO: 1595449 - RNA, 24 nt, Human
caguucagagcugcccucuccugg

SEQ ID NO: 1595450 - RNA, 18 nt, Human
caguucagagcugcccuc

SEQ ID NO: 1595451 - RNA, 19 nt, Human
caguucagagcugcccucu

SEQ ID NO: 1595452 - RNA, 21 nt, Human
caguucagagcugcccucucc

SEQ ID NO: 1595453 - RNA, 22 nt, Human
caguucagagcugcccucuccu

SEQ ID NO: 1595454 - RNA, 19 nt, Human
ccaauucgaacuuuuucca

SEQ ID NO: 1595455 - RNA, 21 nt, Human
ccaacuccagaaagugacaag

SEQ ID NO: 1595456 - RNA, 16 nt, Human
cauuuguauaaaauaa

SEQ ID NO: 1595457 - RNA, 14 nt, Human
cauuuguauaaaau

SEQ ID NO: 1595458 - RNA, 17 nt, Human
cauuuguauaaaauaau

SEQ ID NO: 1595459 - RNA, 14 nt, Human
ccaaaaggcagaag

SEQ ID NO: 1595460 - RNA, 11 nt, Human
caggcuacugu

SEQ ID NO: 1595461 - RNA, 10 nt, Human
cagcugccuc

SEQ ID NO: 1595462 - RNA, 11 nt, Human
cagcugccucc

SEQ ID NO: 1595463 - RNA, 9 nt, Human
cagcugccu

SEQ ID NO: 1595464 - RNA, 14 nt, Human
cagcugccuccccu

SEQ ID NO: 1595465 - RNA, 15 nt, Human
cagcugccuccccuc

SEQ ID NO: 1595466 - RNA, 16 nt, Human
cagcugccuccccucc

SEQ ID NO: 1595467 - RNA, 17 nt, Human
cagcugccuccccuccu

SEQ ID NO: 1595468 - RNA, 18 nt, Human
cagcugccuccccuccuc

SEQ ID NO: 1595469 - RNA, 19 nt, Human
cagcugccuccccuccucu

SEQ ID NO: 1595470 - RNA, 20 nt, Human
cagcugccuccccuccucug

SEQ ID NO: 1595471 - RNA, 20 nt, Human
caggaaagagaacuuccaga

SEQ ID NO: 1595472 - RNA, 16 nt, Human
caggaaagagaacuuc

SEQ ID NO: 1595473 - RNA, 20 nt, Human
cagcuuauugucuagugaaa

SEQ ID NO: 1595474 - RNA, 14 nt, Human
cagcuuauugucua

SEQ ID NO: 1595475 - RNA, 20 nt, Human
cagcuguaugauucccagcc

SEQ ID NO: 1595476 - RNA, 18 nt, Human
cagacuggcacaguuuuc

SEQ ID NO: 1595477 - RNA, 17 nt, Human
cagacuggcacaguuuu

SEQ ID NO: 1595478 - RNA, 23 nt, Human
cagacuggcacaguuuucugaga

SEQ ID NO: 1595479 - RNA, 22 nt, Human
cagacuggcacaguuuucugag

SEQ ID NO: 1595480 - RNA, 23 nt, Human
cagagcugcccucuccugggcag

SEQ ID NO: 1595481 - RNA, 18 nt, Human
cagagcugcccucuccug

SEQ ID NO: 1595482 - RNA, 19 nt, Human
cagagcugcccucuccugg

SEQ ID NO: 1595483 - RNA, 20 nt, Human
cagagcugcccucuccuggg

SEQ ID NO: 1595484 - RNA, 21 nt, Human
cagagcugcccucuccugggc

SEQ ID NO: 1595485 - RNA, 18 nt, Human
cagccagacuggcacagu

SEQ ID NO: 1595486 - RNA, 15 nt, Human
cagccagacuggcac

SEQ ID NO: 1595487 - RNA, 20 nt, Human
cagccagacuggcacaguuu

SEQ ID NO: 1595488 - RNA, 23 nt, Human
cagccagcaguucagagcugccc

SEQ ID NO: 1595489 - RNA, 14 nt, Human
cagccagacuggca

SEQ ID NO: 1595490 - RNA, 16 nt, Human
cucucuggccuucggc

SEQ ID NO: 1595491 - RNA, 14 nt, Human
cucucuggccuucg

SEQ ID NO: 1595492 - RNA, 19 nt, Human
cucuauguucuaagaagug

SEQ ID NO: 1595493 - RNA, 16 nt, Human
cucuccccaugauguu

SEQ ID NO: 1595494 - RNA, 20 nt, Human
cucccuccaccucccugcaa

SEQ ID NO: 1595495 - RNA, 21 nt, Human
cucccuccaccucccugcaau

SEQ ID NO: 1595496 - RNA, 22 nt, Human
cucccuccaccucccugcaaua

SEQ ID NO: 1595497 - RNA, 19 nt, Human
cucccuccaccucccugca

SEQ ID NO: 1595498 - RNA, 18 nt, Human
cuauguucuaagaaguga

SEQ ID NO: 1595499 - RNA, 18 nt, Human
cuaucucauuuccaagca

SEQ ID NO: 1595500 - RNA, 16 nt, Human
cucaguccaugaagau

SEQ ID NO: 1595501 - RNA, 12 nt, Human
ccuuuucccaac

SEQ ID NO: 1595502 - RNA, 20 nt, Human
cuacaaaaacacagcaaggg

SEQ ID NO: 1595503 - RNA, 17 nt, Human
ccuucucuucacaguca

SEQ ID NO: 1595504 - RNA, 19 nt, Human
ccacuuggucugugagaug

SEQ ID NO: 1595505 - RNA, 17 nt, Human
ccacuuggucugugaga

SEQ ID NO: 1595506 - RNA, 16 nt, Human
ccacuuggucugugag

SEQ ID NO: 1595507 - RNA, 15 nt, Human
ccacuuggucuguga

SEQ ID NO: 1595508 - RNA, 22 nt, Human
ccacuuggucugugagaugcua

SEQ ID NO: 1595509 - RNA, 20 nt, Human
ccacuuggucugugagaugc

SEQ ID NO: 1595510 - RNA, 12 nt, Human
ccacuuggucug

SEQ ID NO: 1595511 - RNA, 15 nt, Human
ccaggggccaugaau

SEQ ID NO: 1595512 - RNA, 15 nt, Human
ccccauuguggucac

SEQ ID NO: 1595513 - RNA, 18 nt, Human
ccaugggcacugugggua

SEQ ID NO: 1595514 - RNA, 13 nt, Human
ccauuuaaagcuu

SEQ ID NO: 1595515 - RNA, 22 nt, Human
ccauuguggucacaggaaguag

SEQ ID NO: 1595516 - RNA, 21 nt, Human
ccucuccugggcagcugccuc

SEQ ID NO: 1595517 - RNA, 22 nt, Human
ccucuccugggcagcugccucc

SEQ ID NO: 1595518 - RNA, 15 nt, Human
ccucuccugggcagc

SEQ ID NO: 1595519 - RNA, 16 nt, Human
ccucuccugggcagcu

SEQ ID NO: 1595520 - RNA, 17 nt, Human
ccucuccugggcagcug

SEQ ID NO: 1595521 - RNA, 18 nt, Human
ccucuccugggcagcugc

SEQ ID NO: 1595522 - RNA, 19 nt, Human
ccucuccugggcagcugcc

SEQ ID NO: 1595523 - RNA, 20 nt, Human
ccucuccugggcagcugccu

SEQ ID NO: 1595524 - RNA, 14 nt, Human
cccugagcaggauu

SEQ ID NO: 1595525 - RNA, 13 nt, Human
cccucggagaaga

SEQ ID NO: 1595526 - RNA, 20 nt, Human
ccuaacgaaguauccuucag

SEQ ID NO: 1595527 - RNA, 22 nt, Human
cacaguuuucugagaaagacua

SEQ ID NO: 1595528 - RNA, 21 nt, Human
cacaguuuucugagaaagacu

SEQ ID NO: 1595529 - RNA, 20 nt, Human
cacaugaaguccaagcauuu

SEQ ID NO: 1595530 - RNA, 17 nt, Human
cacaugaaguccaagca

SEQ ID NO: 1595531 - RNA, 16 nt, Human
cacaugaaguccaagc

SEQ ID NO: 1595532 - RNA, 23 nt, Human
cacaagacccaaaaggcagaagc

SEQ ID NO: 1595533 - RNA, 23 nt, Human
cacaagaaaugaaagcagggacu

SEQ ID NO: 1595534 - RNA, 15 nt, Human
cacaagaaaugaaag

SEQ ID NO: 1595535 - RNA, 13 nt, Human
cacaagaaaugaa

SEQ ID NO: 1595536 - RNA, 14 nt, Human
caaagaaauguaag

SEQ ID NO: 1595537 - RNA, 19 nt, Human
auuuuaauaauguuucaaa

SEQ ID NO: 1595538 - RNA, 18 nt, Human
auuuuaauaauguuucaa

SEQ ID NO: 1595539 - RNA, 23 nt, Human
caaauuuacagagacagaaagca

SEQ ID NO: 1595540 - RNA, 17 nt, Human
caaauuuacagagacag

SEQ ID NO: 1595541 - RNA, 16 nt, Human
caagcauaccaacacg

SEQ ID NO: 1595542 - RNA, 21 nt, Human
caagcauaccaacacgagcag

SEQ ID NO: 1595543 - RNA, 19 nt, Human
caagcauuuagauguauag

SEQ ID NO: 1595544 - RNA, 16 nt, Human
caagcauuuagaugua

SEQ ID NO: 1595545 - RNA, 13 nt, Human
caagaaaugaaag

SEQ ID NO: 1595546 - RNA, 15 nt, Human
caagaaaugaaagca

SEQ ID NO: 1595547 - RNA, 16 nt, Human
ccaaaggcucucuccu

SEQ ID NO: 1595548 - RNA, 22 nt, Human
ccaaacugacucuuaagaagac

SEQ ID NO: 1595549 - RNA, 22 nt, Human
ccaagcauaccaacacgagcag

SEQ ID NO: 1595550 - RNA, 17 nt, Human
ccaagcauuuagaugua

SEQ ID NO: 1595551 - RNA, 14 nt, Human
ccaagcaaguauua

SEQ ID NO: 1595552 - RNA, 13 nt, Human
cauuugcucaugg

SEQ ID NO: 1595553 - RNA, 17 nt, Human
cauuuaggccaugggac

SEQ ID NO: 1595554 - RNA, 20 nt, Human
ccacaggaaccacaagacug

SEQ ID NO: 1595555 - RNA, 16 nt, Human
ccaauauucauagcag

SEQ ID NO: 1595556 - RNA, 18 nt, Human
ccacugcagaagacagua

SEQ ID NO: 1595557 - RNA, 13 nt, Human
ccacugcagaaga

SEQ ID NO: 1595558 - RNA, 16 nt, Human
ccagugaauucuugaa

SEQ ID NO: 1595559 - RNA, 20 nt, Human
ccagugaauucuugaaggaa

SEQ ID NO: 1595560 - RNA, 17 nt, Human
ccaggugccaguuaugg

SEQ ID NO: 1595561 - RNA, 14 nt, Human
ccaugaagauguag

SEQ ID NO: 1595562 - RNA, 16 nt, Human
ccaugauguuuagaaa

SEQ ID NO: 1595563 - RNA, 18 nt, Human
ccaucaaggguacacugc

SEQ ID NO: 1595564 - RNA, 13 nt, Human
cccaaaaggcaga

SEQ ID NO: 1595565 - RNA, 18 nt, Human
cccaaaaggcagaagcaa

SEQ ID NO: 1595566 - RNA, 13 nt, Human
cccaggugccagu

SEQ ID NO: 1595567 - RNA, 17 nt, Human
cggccuccauccugagg

SEQ ID NO: 1595568 - RNA, 16 nt, Human
cggccuccauccugag

SEQ ID NO: 1595569 - RNA, 11 nt, Human
cgcaaugugac

SEQ ID NO: 1595570 - RNA, 20 nt, Human
ccuugaaaacuuuaugcuaa

SEQ ID NO: 1595571 - RNA, 14 nt, Human
ccuugaugaagaag

SEQ ID NO: 1595572 - RNA, 20 nt, Human
ccugggcagcugccuccccu

SEQ ID NO: 1595573 - RNA, 22 nt, Human
ccugggcagcugccuccccucc

SEQ ID NO: 1595574 - RNA, 15 nt, Human
ccugggcagcugccu

SEQ ID NO: 1595575 - RNA, 16 nt, Human
ccugggcagcugccuc

SEQ ID NO: 1595576 - RNA, 17 nt, Human
ccugggcagcugccucc

SEQ ID NO: 1595577 - RNA, 18 nt, Human
ccugggcagcugccuccc

SEQ ID NO: 1595578 - RNA, 23 nt, Human
ccugaaagaggaaugaaguacuc

SEQ ID NO: 1595579 - RNA, 18 nt, Human
ccugaaagaggaaugaag

SEQ ID NO: 1595580 - RNA, 23 nt, Human
ccucuuagaugcaguucugaaga

SEQ ID NO: 1595581 - RNA, 20 nt, Human
ccugaggcuccacuuggucu

SEQ ID NO: 1595582 - RNA, 18 nt, Human
ccugaggcuccacuuggu

SEQ ID NO: 1595583 - RNA, 15 nt, Human
ccuccccuccucugc

SEQ ID NO: 1595584 - RNA, 20 nt, Human
ccucagaaaacaaggaugaa

SEQ ID NO: 1595585 - RNA, 12 nt, Human
ccucccugcaau

SEQ ID NO: 1595586 - RNA, 16 nt, Human
ccucccugcaauaaaa

SEQ ID NO: 1595587 - RNA, 17 nt, Human
ccuccccuccucugcuu

SEQ ID NO: 1595588 - RNA, 18 nt, Human
ccuccccuccucugcuug

SEQ ID NO: 1595589 - RNA, 11 nt, Human
ccuccucugcu

SEQ ID NO: 1595590 - RNA, 13 nt, Human
ccuccucugcuug

SEQ ID NO: 1595591 - RNA, 14 nt, Human
ccucuccugggcag

SEQ ID NO: 1595592 - RNA, 11 nt, Human
ccucuccuggg

SEQ ID NO: 1595593 - RNA, 12 nt, Human
ccucuccugggc

SEQ ID NO: 1595594 - RNA, 13 nt, Human
ccucuccugggca

SEQ ID NO: 1595595 - RNA, 20 nt, Human
ccucugcuugccaucccucc

SEQ ID NO: 1595596 - RNA, 21 nt, Human
ccucugcuugccaucccuccc

SEQ ID NO: 1595597 - RNA, 16 nt, Human
cccuugaugaagaagu

SEQ ID NO: 1595598 - RNA, 18 nt, Human
cugcaauuucauaugcug

SEQ ID NO: 1595599 - RNA, 20 nt, Human
cugcaauuucauaugcugua

SEQ ID NO: 1595600 - RNA, 13 nt, Human
cugcagaagacag

SEQ ID NO: 1595601 - RNA, 23 nt, Human
cugcagaagacaguauggcagcu

SEQ ID NO: 1595602 - RNA, 21 nt, Human
cugauguuccuagugaaagag

SEQ ID NO: 1595603 - RNA, 20 nt, Human
cugauguuccuagugaaaga

SEQ ID NO: 1595604 - RNA, 18 nt, Human
cugauguuccuagugaaa

SEQ ID NO: 1595605 - RNA, 13 nt, Human
cugauguuccuag

SEQ ID NO: 1595606 - RNA, 15 nt, Human
cugccuaagugcagc

SEQ ID NO: 1595607 - RNA, 21 nt, Human
cuggucccagccagcaguuca

SEQ ID NO: 1595608 - RNA, 22 nt, Human
cugggaacccaaguccaagcau

SEQ ID NO: 1595609 - RNA, 13 nt, Human
cugcugaaacaac

SEQ ID NO: 1595610 - RNA, 18 nt, Human
cugcugaaacaacaaaua

SEQ ID NO: 1595611 - RNA, 23 nt, Human
cuggaauaauccuaaacauauga

SEQ ID NO: 1595612 - RNA, 12 nt, Human
cuggagcucugc

SEQ ID NO: 1595613 - RNA, 16 nt, Human
cuggccaacgggguga

SEQ ID NO: 1595614 - RNA, 20 nt, Human
cuggcacaguuuucugagaa

SEQ ID NO: 1595615 - RNA, 19 nt, Human
cuggcacaguuuucugaga

SEQ ID NO: 1595616 - RNA, 18 nt, Human
cuggcacaguuuucugag

SEQ ID NO: 1595617 - RNA, 22 nt, Human
cucauaauuuauacaggucaua

SEQ ID NO: 1595618 - RNA, 13 nt, Human
cucauaauuuaua

SEQ ID NO: 1595619 - RNA, 15 nt, Human
cucauaauuuauaca

SEQ ID NO: 1595620 - RNA, 18 nt, Human
cucauuaggauggcuagu

SEQ ID NO: 1595621 - RNA, 17 nt, Human
cucauuaggauggcuag

SEQ ID NO: 1595622 - RNA, 17 nt, Human
cucccagucauuuaaua

SEQ ID NO: 1595623 - RNA, 21 nt, Human
cuccauccugaggcuccacuu

SEQ ID NO: 1595624 - RNA, 23 nt, Human
cuccauccugaggcuccacuugg

SEQ ID NO: 1595625 - RNA, 23 nt, Human
cuccaccucccugcaauaaaaug

SEQ ID NO: 1595626 - RNA, 14 nt, Human
cuccaccucccugc

SEQ ID NO: 1595627 - RNA, 15 nt, Human
cuccaccucccugca

SEQ ID NO: 1595628 - RNA, 16 nt, Human
cuccaccucccugcaa

SEQ ID NO: 1595629 - RNA, 17 nt, Human
cuccaccucccugcaau

SEQ ID NO: 1595630 - RNA, 16 nt, Human
cucccuucucuucaca

SEQ ID NO: 1595631 - RNA, 13 nt, Human
cucccuuucaaca

SEQ ID NO: 1595632 - RNA, 20 nt, Human
cucggagaagagcuguucac

SEQ ID NO: 1595633 - RNA, 13 nt, Human
cucggagaagagc

SEQ ID NO: 1595634 - RNA, 12 nt, Human
cucggagaagag

SEQ ID NO: 1595635 - RNA, 23 nt, Human
cucugcauacucauuaggauggc

SEQ ID NO: 1595636 - RNA, 21 nt, Human
cucuccugggcagcugccucc

SEQ ID NO: 1595637 - RNA, 13 nt, Human
cucuuaagaagac

SEQ ID NO: 1595638 - RNA, 18 nt, Human
cuguuuugaaucucauaa

SEQ ID NO: 1595639 - RNA, 19 nt, Human
cuguuuuauaauuuuguga

SEQ ID NO: 1595640 - RNA, 11 nt, Human
cuuaacuauuc

SEQ ID NO: 1595641 - RNA, 18 nt, Human
cuuaaugccacuaaauug

SEQ ID NO: 1595642 - RNA, 21 nt, Human
cuuaagaagacugcauuauau

SEQ ID NO: 1595643 - RNA, 15 nt, Human
cuuaugauugcagau

SEQ ID NO: 1595644 - RNA, 21 nt, Human
cuuaggguuaugauuaaguaa

SEQ ID NO: 1595645 - RNA, 13 nt, Human
cuuauaauuuaaa

SEQ ID NO: 1595646 - RNA, 14 nt, Human
cuuauaauuuaaaa

SEQ ID NO: 1595647 - RNA, 19 nt, Human
cuuacuaguuucccuugca

SEQ ID NO: 1595648 - RNA, 20 nt, Human
cuuagaugcaguucugaaga

SEQ ID NO: 1595649 - RNA, 19 nt, Human
cuuagaugcaguucugaag

SEQ ID NO: 1595650 - RNA, 18 nt, Human
cuucagcgguuuauauaa

SEQ ID NO: 1595651 - RNA, 17 nt, Human
cuucggccuccauccug

SEQ ID NO: 1595652 - RNA, 19 nt, Human
cuucggccuccauccugag

SEQ ID NO: 1595653 - RNA, 18 nt, Human
cuucggccuccauccuga

SEQ ID NO: 1595654 - RNA, 19 nt, Human
cuuccuuggacucauuuua

SEQ ID NO: 1595655 - RNA, 20 nt, Human
cuuccuuggacucauuuuaa

SEQ ID NO: 1595656 - RNA, 20 nt, Human
gaaaaguauguuagugcaaa

SEQ ID NO: 1595657 - RNA, 14 nt, Human
gaaaaguauguuag

SEQ ID NO: 1595658 - RNA, 19 nt, Human
gaaaauaacaauaaaagac

SEQ ID NO: 1595659 - RNA, 14 nt, Human
gaaaacaaggauga

SEQ ID NO: 1595660 - RNA, 16 nt, Human
cuuggacucauuuuaa

SEQ ID NO: 1595661 - RNA, 18 nt, Human
cuuggggcugaugcaguu

SEQ ID NO: 1595662 - RNA, 16 nt, Human
cuuggggcugaugcag

SEQ ID NO: 1595663 - RNA, 14 nt, Human
cuugcccuguuaaa

SEQ ID NO: 1595664 - RNA, 15 nt, Human
cuugccaucccuccc

SEQ ID NO: 1595665 - RNA, 16 nt, Human
cuugccaucccucccu

SEQ ID NO: 1595666 - RNA, 19 nt, Human
cuugccaucccucccucca

SEQ ID NO: 1595667 - RNA, 17 nt, Human
cuugccaucccucccuc

SEQ ID NO: 1595668 - RNA, 14 nt, Human
cuugccaucccucc

SEQ ID NO: 1595669 - RNA, 22 nt, Human
cuugcccuguuaaaagaugaaa

SEQ ID NO: 1595670 - RNA, 20 nt, Human
cuugcuugauuguauggugg

SEQ ID NO: 1595671 - RNA, 17 nt, Human
gacauaaaaacaacuuu

SEQ ID NO: 1595672 - RNA, 23 nt, Human
gacaggaugguucccuugaugaa

SEQ ID NO: 1595673 - RNA, 18 nt, Human
gaccacugcagaagacag

SEQ ID NO: 1595674 - RNA, 16 nt, Human
gaccacugcagaagac

SEQ ID NO: 1595675 - RNA, 19 nt, Human
gacccaaaaggcagaagca

SEQ ID NO: 1595676 - RNA, 18 nt, Human
gacccaaaaggcagaagc

SEQ ID NO: 1595677 - RNA, 20 nt, Human
gacccaaaaggcagaagcaa

SEQ ID NO: 1595678 - RNA, 16 nt, Human
gacugaggggagggga

SEQ ID NO: 1595679 - RNA, 22 nt, Human
gacuggcacaguuuucugagaa

SEQ ID NO: 1595680 - RNA, 18 nt, Human
gacuggcacaguuuucug

SEQ ID NO: 1595681 - RNA, 14 nt, Human
gacuggcacaguuu

SEQ ID NO: 1595682 - RNA, 18 nt, Human
gaagauguagaggagaaa

SEQ ID NO: 1595683 - RNA, 19 nt, Human
gaagacugcauuauauuua

SEQ ID NO: 1595684 - RNA, 12 nt, Human
gaagaacugaaa

SEQ ID NO: 1595685 - RNA, 21 nt, Human
gaacuagaguuuagcuggaaa

SEQ ID NO: 1595686 - RNA, 18 nt, Human
gaaauuguauuacaaauc

SEQ ID NO: 1595687 - RNA, 16 nt, Human
gaaauuguauuacaaa

SEQ ID NO: 1595688 - RNA, 20 nt, Human
gaacagugauuaccagggac

SEQ ID NO: 1595689 - RNA, 16 nt, Human
gaacagugauuaccag

SEQ ID NO: 1595690 - RNA, 15 nt, Human
gaacauaaaauacaa

SEQ ID NO: 1595691 - RNA, 20 nt, Human
gaauaauccuaaacauauga

SEQ ID NO: 1595692 - RNA, 16 nt, Human
gaauauuuuaacuucc

SEQ ID NO: 1595693 - RNA, 14 nt, Human
gaaguauccuucag

SEQ ID NO: 1595694 - RNA, 16 nt, Human
gaaguauccuucagcc

SEQ ID NO: 1595695 - RNA, 22 nt, Human
gaaguccaagcauuuagaugua

SEQ ID NO: 1595696 - RNA, 12 nt, Human
gaaguccaagca

SEQ ID NO: 1595697 - RNA, 23 nt, Human
gaauucuugaaggaaaaugauac

SEQ ID NO: 1595698 - RNA, 11 nt, Human
gaguucuacau

SEQ ID NO: 1595699 - RNA, 13 nt, Human
gauaaacaguagu

SEQ ID NO: 1595700 - RNA, 17 nt, Human
gauaggucagugcaaau

SEQ ID NO: 1595701 - RNA, 23 nt, Human
gaucagcuuauugucuagugaaa

SEQ ID NO: 1595702 - RNA, 13 nt, Human
gaucuuuaaaaua

SEQ ID NO: 1595703 - RNA, 14 nt, Human
gauccuggaaauca

SEQ ID NO: 1595704 - RNA, 16 nt, Human
gcaagaugugggcagu

SEQ ID NO: 1595705 - RNA, 12 nt, Human
gcaagauguggg

SEQ ID NO: 1595706 - RNA, 16 nt, Human
gaugcuagaacucccu

SEQ ID NO: 1595707 - RNA, 14 nt, Human
gauuaaguaaugau

SEQ ID NO: 1595708 - RNA, 22 nt, Human
gauuaaguaaugauaacuggaa

SEQ ID NO: 1595709 - RNA, 22 nt, Human
gcagauggaaugcuguguuaaa

SEQ ID NO: 1595710 - RNA, 18 nt, Human
gcagauggaaugcugugu

SEQ ID NO: 1595711 - RNA, 20 nt, Human
gcacagccucuuagaugcag

SEQ ID NO: 1595712 - RNA, 14 nt, Human
gcagaagacaguau

SEQ ID NO: 1595713 - RNA, 15 nt, Human
gcacugucaagauga

SEQ ID NO: 1595714 - RNA, 14 nt, Human
gcaguucugaagaa

SEQ ID NO: 1595715 - RNA, 13 nt, Human
gcaguucugaaga

SEQ ID NO: 1595716 - RNA, 18 nt, Human
gcauagauucccugagca

SEQ ID NO: 1595717 - RNA, 15 nt, Human
gcaggcuacugucag

SEQ ID NO: 1595718 - RNA, 19 nt, Human
gcccuucuuuccacagaag

SEQ ID NO: 1595719 - RNA, 16 nt, Human
gccuccccuccucugc

SEQ ID NO: 1595720 - RNA, 11 nt, Human
gccuccccucc

SEQ ID NO: 1595721 - RNA, 12 nt, Human
gccuccccuccu

SEQ ID NO: 1595722 - RNA, 13 nt, Human
gccuccccuccuc

SEQ ID NO: 1595723 - RNA, 14 nt, Human
gccuccccuccucu

SEQ ID NO: 1595724 - RNA, 18 nt, Human
gccuguaaucacagcuac

SEQ ID NO: 1595725 - RNA, 18 nt, Human
gccuucggccuccauccu

SEQ ID NO: 1595726 - RNA, 19 nt, Human
gccuucggccuccauccug

SEQ ID NO: 1595727 - RNA, 18 nt, Human
gccuuggggcugaugcag

SEQ ID NO: 1595728 - RNA, 22 nt, Human
gccacguucuuacuaguuuccc

SEQ ID NO: 1595729 - RNA, 11 nt, Human
gccaucccucc

SEQ ID NO: 1595730 - RNA, 13 nt, Human
gccaucccucccu

SEQ ID NO: 1595731 - RNA, 14 nt, Human
gccaucccucccuc

SEQ ID NO: 1595732 - RNA, 19 nt, Human
gccaugggacagggaggac

SEQ ID NO: 1595733 - RNA, 14 nt, Human
gccaugggacaggg

SEQ ID NO: 1595734 - RNA, 15 nt, Human
gccaucccucccucc

SEQ ID NO: 1595735 - RNA, 16 nt, Human
gccaucccucccucca

SEQ ID NO: 1595736 - RNA, 22 nt, Human
gccauuuaaagcuuauuaaaac

SEQ ID NO: 1595737 - RNA, 22 nt, Human
gccaugggacagggaggacgcu

SEQ ID NO: 1595738 - RNA, 16 nt, Human
gcccacagcuguauga

SEQ ID NO: 1595739 - RNA, 18 nt, Human
gcccucuccugggcagcu

SEQ ID NO: 1595740 - RNA, 19 nt, Human
gcccucuccugggcagcug

SEQ ID NO: 1595741 - RNA, 21 nt, Human
gcccucuccugggcagcugcc

SEQ ID NO: 1595742 - RNA, 15 nt, Human
gcccucuccugggca

SEQ ID NO: 1595743 - RNA, 16 nt, Human
gcccucuccugggcag

SEQ ID NO: 1595744 - RNA, 19 nt, Human
gccccugcacuccagccug

SEQ ID NO: 1595745 - RNA, 17 nt, Human
gccccgugggguuccuc

SEQ ID NO: 1595746 - RNA, 23 nt, Human
ggugcuacaaaaacacagcaagg

SEQ ID NO: 1595747 - RNA, 22 nt, Human
ggcuugaguuuaaauuguaaua

SEQ ID NO: 1595748 - RNA, 19 nt, Human
ggaggacgcucucuggccu

SEQ ID NO: 1595749 - RNA, 21 nt, Human
ggaggacgcucucuggccuuc

SEQ ID NO: 1595750 - RNA, 20 nt, Human
ggaggacgcucucuggccuu

SEQ ID NO: 1595751 - RNA, 18 nt, Human
ggcagcugccuccccucc

SEQ ID NO: 1595752 - RNA, 21 nt, Human
ggcagcugccuccccuccucu

SEQ ID NO: 1595753 - RNA, 22 nt, Human
ggcagcugccuccccuccucug

SEQ ID NO: 1595754 - RNA, 22 nt, Human
ggccaugggacagggaggacgc

SEQ ID NO: 1595755 - RNA, 18 nt, Human
gcuagauguauguacuuc

SEQ ID NO: 1595756 - RNA, 22 nt, Human
gcuguauuuuaaaagaaugauu

SEQ ID NO: 1595757 - RNA, 19 nt, Human
gcuugcccuggugccucac

SEQ ID NO: 1595758 - RNA, 17 nt, Human
gcuugcccuggugccuc

SEQ ID NO: 1595759 - RNA, 18 nt, Human
gcuugccaucccucccuc

SEQ ID NO: 1595760 - RNA, 21 nt, Human
gcuugccaucccucccuccac

SEQ ID NO: 1595761 - RNA, 18 nt, Human
gcuugcccuguuaaaaga

SEQ ID NO: 1595762 - RNA, 16 nt, Human
gcuugccaucccuccc

SEQ ID NO: 1595763 - RNA, 16 nt, Human
gcuguucacagccaga

SEQ ID NO: 1595764 - RNA, 15 nt, Human
gcuguucacagccag

SEQ ID NO: 1595765 - RNA, 23 nt, Human
gcuguucacagccagacuggcac

SEQ ID NO: 1595766 - RNA, 20 nt, Human
ggaaaaaauaacaaugaaag

SEQ ID NO: 1595767 - RNA, 17 nt, Human
gcuuuuaaaaaaaaaua

SEQ ID NO: 1595768 - RNA, 16 nt, Human
ggaaaucaaauaugca

SEQ ID NO: 1595769 - RNA, 18 nt, Human
ggaaauauuuauuuuaau

SEQ ID NO: 1595770 - RNA, 17 nt, Human
ggaaauauuuauuuuaa

SEQ ID NO: 1595771 - RNA, 15 nt, Human
ggaaauauuuauuuu

SEQ ID NO: 1595772 - RNA, 13 nt, Human
ggaaauauuuauu

SEQ ID NO: 1595773 - RNA, 12 nt, Human
ggaaauauuuau

SEQ ID NO: 1595774 - RNA, 16 nt, Human
uauacccagaaaguua

SEQ ID NO: 1595775 - RNA, 21 nt, Human
uauaauucagaaggaucuuca

SEQ ID NO: 1595776 - RNA, 18 nt, Human
uauaacaaugcuguauuu

SEQ ID NO: 1595777 - RNA, 15 nt, Human
uaguuuuauaugcuu

SEQ ID NO: 1595778 - RNA, 21 nt, Human
uaguuguaccgcaaugugacu

SEQ ID NO: 1595779 - RNA, 18 nt, Human
uagucaaauugugugaaa

SEQ ID NO: 1595780 - RNA, 19 nt, Human
uauauuuuuuguuaaauga

SEQ ID NO: 1595781 - RNA, 14 nt, Human
uauccuucagccug

SEQ ID NO: 1595782 - RNA, 23 nt, Human
uauauuuauuacuguaagaaaau

SEQ ID NO: 1595783 - RNA, 20 nt, Human
uauauuuauuacuguaagaa

SEQ ID NO: 1595784 - RNA, 14 nt, Human
uauauuugaaauau

SEQ ID NO: 1595785 - RNA, 13 nt, Human
uauauuugaaaua

SEQ ID NO: 1595786 - RNA, 16 nt, Human
uaggccaugggacagg

SEQ ID NO: 1595787 - RNA, 13 nt, Human
uaggccaugggac

SEQ ID NO: 1595788 - RNA, 23 nt, Human
uaggaauugacccacaagaaaug

SEQ ID NO: 1595789 - RNA, 18 nt, Human
uagaguuuagcuggaaaa

SEQ ID NO: 1595790 - RNA, 17 nt, Human
uagaguuuagcuggaaa

SEQ ID NO: 1595791 - RNA, 20 nt, Human
uagcagggcauggcugggaa

SEQ ID NO: 1595792 - RNA, 20 nt, Human
uagauguauguacuucaugc

SEQ ID NO: 1595793 - RNA, 16 nt, Human
uagauguauguacuuc

SEQ ID NO: 1595794 - RNA, 20 nt, Human
uacgaagaguauuuuugaca

SEQ ID NO: 1595795 - RNA, 22 nt, Human
uacgaagaguauuuuugacaga

SEQ ID NO: 1595796 - RNA, 23 nt, Human
uaccuuuguucccaaauuucaua

SEQ ID NO: 1595797 - RNA, 23 nt, Human
uacgaagaguauuuuugacagaa

SEQ ID NO: 1595798 - RNA, 23 nt, Human
uacugauguuccuagugaaagag

SEQ ID NO: 1595799 - RNA, 17 nt, Human
uagaacagauaaucagu

SEQ ID NO: 1595800 - RNA, 23 nt, Human
uacauuuggagacacaacuauuu

SEQ ID NO: 1595801 - RNA, 16 nt, Human
uacauuuguauaaaau

SEQ ID NO: 1595802 - RNA, 11 nt, Human
uacauuugugu

SEQ ID NO: 1595803 - RNA, 17 nt, Human
uacauuuguauaaaaua

SEQ ID NO: 1595804 - RNA, 22 nt, Human
uacaugagguacugagagugaa

SEQ ID NO: 1595805 - RNA, 21 nt, Human
uacaugagguacugagaguga

SEQ ID NO: 1595806 - RNA, 16 nt, Human
uaccaacacgagcagg

SEQ ID NO: 1595807 - RNA, 15 nt, Human
uacauaaguaauuca

SEQ ID NO: 1595808 - RNA, 18 nt, Human
uaccaccagucugacugu

SEQ ID NO: 1595809 - RNA, 23 nt, Human
uaccacaggaaccacaagacugc

SEQ ID NO: 1595810 - RNA, 13 nt, Human
uacagaauuuuau

SEQ ID NO: 1595811 - RNA, 13 nt, Human
uaauuuugugaag

SEQ ID NO: 1595812 - RNA, 23 nt, Human
uaauuaaauuuugaguucuacau

SEQ ID NO: 1595813 - RNA, 20 nt, Human
uaauuaaaagaauauuuuaa

SEQ ID NO: 1595814 - RNA, 15 nt, Human
uaauguuucaaacau

SEQ ID NO: 1595815 - RNA, 14 nt, Human
uaauguuucaaaca

SEQ ID NO: 1595816 - RNA, 13 nt, Human
uaauuuuaagaaa

SEQ ID NO: 1595817 - RNA, 23 nt, Human
uaauuuguaguguuggagaagaa

SEQ ID NO: 1595818 - RNA, 20 nt, Human
uaauuuguaguguuggagaa

SEQ ID NO: 1595819 - RNA, 22 nt, Human
uaauuggaaaggcagcucuaaa

SEQ ID NO: 1595820 - RNA, 15 nt, Human
uaauaacugugaagu

SEQ ID NO: 1595821 - RNA, 15 nt, Human
uaauaauguuucaaa

SEQ ID NO: 1595822 - RNA, 14 nt, Human
uaauauauuuccau

SEQ ID NO: 1595823 - RNA, 19 nt, Human
uaaugauaaguaaaugcua

SEQ ID NO: 1595824 - RNA, 19 nt, Human
uaaugccacuaaauugaca

SEQ ID NO: 1595825 - RNA, 13 nt, Human
uaacugugaaguu

SEQ ID NO: 1595826 - RNA, 19 nt, Human
uaagaaaucaaagagagaa

SEQ ID NO: 1595827 - RNA, 23 nt, Human
uaagagggauuagggagagaaga

SEQ ID NO: 1595828 - RNA, 21 nt, Human
uaagccagacaucaacagaua

SEQ ID NO: 1595829 - RNA, 20 nt, Human
uaagccagacaucaacagau

SEQ ID NO: 1595830 - RNA, 13 nt, Human
uaagccagacauc

SEQ ID NO: 1595831 - RNA, 20 nt, Human
uaagcauuccaacuaucuca

SEQ ID NO: 1595832 - RNA, 18 nt, Human
uaagcauuccaacuaucu

SEQ ID NO: 1595833 - RNA, 16 nt, Human
uaagcauuccaacuau

SEQ ID NO: 1595834 - RNA, 22 nt, Human
uaaauaaaccucaaaaugucua

SEQ ID NO: 1595835 - RNA, 18 nt, Human
uaaauauaugcuaagucu

SEQ ID NO: 1595836 - RNA, 17 nt, Human
uaaauaaaaauaauccu

SEQ ID NO: 1595837 - RNA, 17 nt, Human
uaaaauggguuuuacug

SEQ ID NO: 1595838 - RNA, 14 nt, Human
uaaaagaugaaaau

SEQ ID NO: 1595839 - RNA, 15 nt, Human
uaaaaaugguuuaaa

SEQ ID NO: 1595840 - RNA, 18 nt, Human
uaaaauccauacauuugu

SEQ ID NO: 1595841 - RNA, 19 nt, Human
uaaaauccauacauuugug

SEQ ID NO: 1595842 - RNA, 13 nt, Human
guuuagcaguaua

SEQ ID NO: 1595843 - RNA, 17 nt, Human
guuuagaaagcuugccc

SEQ ID NO: 1595844 - RNA, 13 nt, Human
guuuagaaagcuu

SEQ ID NO: 1595845 - RNA, 16 nt, Human
guuuucauuaucucaa

SEQ ID NO: 1595846 - RNA, 18 nt, Human
guuuucaggcuagaugua

SEQ ID NO: 1595847 - RNA, 15 nt, Human
guuuucugagaaaga

SEQ ID NO: 1595848 - RNA, 16 nt, Human
uaaaaaagaaacauuu

SEQ ID NO: 1595849 - RNA, 13 nt, Human
ucaguuguacagu

SEQ ID NO: 1595850 - RNA, 15 nt, Human
ucauaauuuauacag

SEQ ID NO: 1595851 - RNA, 13 nt, Human
ucauacauuguac

SEQ ID NO: 1595852 - RNA, 15 nt, Human
ucauacauuguacga

SEQ ID NO: 1595853 - RNA, 16 nt, Human
ucauacauuguacgaa

SEQ ID NO: 1595854 - RNA, 20 nt, Human
uccaagcauuuagauguaua

SEQ ID NO: 1595855 - RNA, 12 nt, Human
uccaccucccug

SEQ ID NO: 1595856 - RNA, 14 nt, Human
uccaccuacaugag

SEQ ID NO: 1595857 - RNA, 13 nt, Human
uccacuuggucug

SEQ ID NO: 1595858 - RNA, 12 nt, Human
uccacuuggucu

SEQ ID NO: 1595859 - RNA, 14 nt, Human
uccacuuggucugu

SEQ ID NO: 1595860 - RNA, 14 nt, Human
uccagauccuggaa

SEQ ID NO: 1595861 - RNA, 17 nt, Human
uccagauccuggaaauc

SEQ ID NO: 1595862 - RNA, 16 nt, Human
uccagauccuggaaau

SEQ ID NO: 1595863 - RNA, 23 nt, Human
uccaagcauaccaacacgagcag

SEQ ID NO: 1595864 - RNA, 17 nt, Human
uccaagcauuuagaugu

SEQ ID NO: 1595865 - RNA, 12 nt, Human
uccaaagaaaug

SEQ ID NO: 1595866 - RNA, 23 nt, Human
uccaaacugacucuuaagaagac

SEQ ID NO: 1595867 - RNA, 22 nt, Human
ucauuucugcaucagcugcuga

SEQ ID NO: 1595868 - RNA, 16 nt, Human
ucauuucugcaucagc

SEQ ID NO: 1595869 - RNA, 14 nt, Human
ucauuucuuugagu

SEQ ID NO: 1595870 - RNA, 16 nt, Human
ucccaaauuucauacc

SEQ ID NO: 1595871 - RNA, 17 nt, Human
ucagaaaauauuaugug

SEQ ID NO: 1595872 - RNA, 19 nt, Human
ucagaaaauauuauguguu

SEQ ID NO: 1595873 - RNA, 20 nt, Human
ucagaaaauauuauguguuu

SEQ ID NO: 1595874 - RNA, 17 nt, Human
ucacuugucaauaaaau
